United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 85

SEQ ID NO: 3893115 - RNA, 16 nt, Human
uuucuagacuugugcu

SEQ ID NO: 3893116 - RNA, 16 nt, Human
uuucuagauacaauaa

SEQ ID NO: 3893117 - RNA, 23 nt, Human
uuucuagauacaauaaauugcua

SEQ ID NO: 3893118 - RNA, 15 nt, Human
uuucuagccagagga

SEQ ID NO: 3893119 - RNA, 19 nt, Human
uuucuagcccgaauacaaa

SEQ ID NO: 3893120 - RNA, 21 nt, Human
uuucuagcuaauggaaaauga

SEQ ID NO: 3893121 - RNA, 20 nt, Human
uuucuagcuagaaauaugau

SEQ ID NO: 3893122 - RNA, 19 nt, Human
uuucuagcuguugagcugu

SEQ ID NO: 3893123 - RNA, 18 nt, Human
uuucuagcuuuuuaauua

SEQ ID NO: 3893124 - RNA, 16 nt, Human
uuucuaggaagaauuu

SEQ ID NO: 3893125 - RNA, 17 nt, Human
uuucuaggacugaauua

SEQ ID NO: 3893126 - RNA, 21 nt, Human
uuucuaggacugaauuaugaa

SEQ ID NO: 3893127 - RNA, 22 nt, Human
uuucuaggacugaauuaugaaa

SEQ ID NO: 3893128 - RNA, 20 nt, Human
uuucuaggccuacaugcuuu

SEQ ID NO: 3893129 - RNA, 14 nt, Human
uuucuagggaaaug

SEQ ID NO: 3893130 - RNA, 20 nt, Human
uuucuaguacacuuuuauga

SEQ ID NO: 3893131 - RNA, 20 nt, Human
uuucuaguggucuuuguaag

SEQ ID NO: 3893132 - RNA, 20 nt, Human
uuucuaguguaucaaaaugc

SEQ ID NO: 3893133 - RNA, 14 nt, Human
uuucuaguuauuua

SEQ ID NO: 3893134 - RNA, 13 nt, Human
uuucuaguugaaa

SEQ ID NO: 3893135 - RNA, 19 nt, Human
uuucuaguuugcucauacu

SEQ ID NO: 3893136 - RNA, 13 nt, Human
uuucuauacaaau

SEQ ID NO: 3893137 - RNA, 14 nt, Human
uuucuaucacauau

SEQ ID NO: 3893138 - RNA, 17 nt, Human
uuucuaucguucucucu

SEQ ID NO: 3893139 - RNA, 20 nt, Human
uuucuaucguucucucuuug

SEQ ID NO: 3893140 - RNA, 20 nt, Human
uuucuaugaaauauuauguu

SEQ ID NO: 3893141 - RNA, 21 nt, Human
uuucuaugacacaugcaaggu

SEQ ID NO: 3893142 - RNA, 13 nt, Human
uuucuauguacua

SEQ ID NO: 3893143 - RNA, 23 nt, Human
uuucuauguacuaguacugugua

SEQ ID NO: 3893144 - RNA, 14 nt, Human
uuucuauuaaaaga

SEQ ID NO: 3893145 - RNA, 18 nt, Human
uuucuauuaaaagacuca

SEQ ID NO: 3893146 - RNA, 19 nt, Human
uuucuauuaaaagacucau

SEQ ID NO: 3893147 - RNA, 22 nt, Human
uuucuauuaaauuaaauuuugu

SEQ ID NO: 3893148 - RNA, 20 nt, Human
uuucuauuauggaaaacugu

SEQ ID NO: 3893149 - RNA, 14 nt, Human
uuucuauuccuucu

SEQ ID NO: 3893150 - RNA, 16 nt, Human
uuucuauuguacagaa

SEQ ID NO: 3893151 - RNA, 13 nt, Human
uuucuauuguuac

SEQ ID NO: 3893152 - RNA, 16 nt, Human
uuucuauuucacugga

SEQ ID NO: 3893153 - RNA, 21 nt, Human
uuucuauuuucccucgcuggg

SEQ ID NO: 3893154 - RNA, 13 nt, Human
uuucuauuuuuau

SEQ ID NO: 3893155 - RNA, 13 nt, Human
uuucucaaaagca

SEQ ID NO: 3893156 - RNA, 16 nt, Human
uuucucaaaagcauuu

SEQ ID NO: 3893157 - RNA, 14 nt, Human
uuucucaaagaaau

SEQ ID NO: 3893158 - RNA, 16 nt, Human
uuucucaaagaaauuu

SEQ ID NO: 3893159 - RNA, 22 nt, Human
uuucucaaagccccauuaacug

SEQ ID NO: 3893160 - RNA, 14 nt, Human
uuucucaaaguuuu

SEQ ID NO: 3893161 - RNA, 16 nt, Human
uuucucaaaguuuuga

SEQ ID NO: 3893162 - RNA, 23 nt, Human
uuucucaccgcagucgucgcaca

SEQ ID NO: 3893163 - RNA, 20 nt, Human
uuucucagauccuuguuuca

SEQ ID NO: 3893164 - RNA, 23 nt, Human
uuucucagauccuuguuucaaac

SEQ ID NO: 3893165 - RNA, 14 nt, Human
uuucucagcuccca

SEQ ID NO: 3893166 - RNA, 20 nt, Human
uuucucauccacauacccug

SEQ ID NO: 3893167 - RNA, 22 nt, Human
uuucucauuugccaauaauaau

SEQ ID NO: 3893168 - RNA, 11 nt, Human
uuucuccagcu

SEQ ID NO: 3893169 - RNA, 12 nt, Human
uuucuccagcug

SEQ ID NO: 3893170 - RNA, 15 nt, Human
uuucuccagggucag

SEQ ID NO: 3893171 - RNA, 12 nt, Human
uuucucccagcu

SEQ ID NO: 3893172 - RNA, 23 nt, Human
uuucuccccaaugagacuugccu

SEQ ID NO: 3893173 - RNA, 12 nt, Human
uuucuccccagg

SEQ ID NO: 3893174 - RNA, 13 nt, Human
uuucucccccugg

SEQ ID NO: 3893175 - RNA, 12 nt, Human
uuucuccccgcu

SEQ ID NO: 3893176 - RNA, 16 nt, Human
uuucuccccugccccc

SEQ ID NO: 3893177 - RNA, 21 nt, Human
uuucucccucucacugucuga

SEQ ID NO: 3893178 - RNA, 14 nt, Human
uuucucccuggauu

SEQ ID NO: 3893179 - RNA, 20 nt, Human
uuucucccuggauuuuuacc

SEQ ID NO: 3893180 - RNA, 22 nt, Human
uuucucccuggauuuuuaccag

SEQ ID NO: 3893181 - RNA, 23 nt, Human
uuucucccuggauuuuuaccagu

SEQ ID NO: 3893182 - RNA, 14 nt, Human
uuucuccuccaugg

SEQ ID NO: 3893183 - RNA, 15 nt, Human
uuucuccucccagga

SEQ ID NO: 3893184 - RNA, 15 nt, Human
uuucuccucccuucc

SEQ ID NO: 3893185 - RNA, 20 nt, Human
uuucuccuuagucuucucau

SEQ ID NO: 3893186 - RNA, 18 nt, Human
uuucuccuuuaauuguaa

SEQ ID NO: 3893187 - RNA, 22 nt, Human
uuucucgcuguccuuucuagag

SEQ ID NO: 3893188 - RNA, 15 nt, Human
uuucucuaauaauaa

SEQ ID NO: 3893189 - RNA, 21 nt, Human
uuucucuaauaauaaauaguu

SEQ ID NO: 3893190 - RNA, 14 nt, Human
uuucucucaacacc

SEQ ID NO: 3893191 - RNA, 16 nt, Human
uuucucuccucacaca

SEQ ID NO: 3893192 - RNA, 16 nt, Human
uuucucuccuguccuc

SEQ ID NO: 3893193 - RNA, 19 nt, Human
uuucucucuauuucccccu

SEQ ID NO: 3893194 - RNA, 13 nt, Human
uuucucucuuccc

SEQ ID NO: 3893195 - RNA, 21 nt, Human
uuucucucuuuauacagcugu

SEQ ID NO: 3893196 - RNA, 20 nt, Human
uuucucugauuugcaaaaaa

SEQ ID NO: 3893197 - RNA, 21 nt, Human
uuucucugcagaaacuacuga

SEQ ID NO: 3893198 - RNA, 11 nt, Human
uuucucugcca

SEQ ID NO: 3893199 - RNA, 18 nt, Human
uuucucugcuucagcuug

SEQ ID NO: 3893200 - RNA, 15 nt, Human
uuucucuguacuuuu

SEQ ID NO: 3893201 - RNA, 18 nt, Human
uuucucuguguuuguucc

SEQ ID NO: 3893202 - RNA, 13 nt, Human
uuucucuuagaaa

SEQ ID NO: 3893203 - RNA, 12 nt, Human
uuucucuucaua

SEQ ID NO: 3893204 - RNA, 16 nt, Human
uuucucuucauacuuu

SEQ ID NO: 3893205 - RNA, 19 nt, Human
uuucucuucuccccuucca

SEQ ID NO: 3893206 - RNA, 17 nt, Human
uuucucuugagcuggcc

SEQ ID NO: 3893207 - RNA, 12 nt, Human
uuucucuugggc

SEQ ID NO: 3893208 - RNA, 17 nt, Human
uuucucuuuccaugaca

SEQ ID NO: 3893209 - RNA, 14 nt, Human
uuucucuuucguua

SEQ ID NO: 3893210 - RNA, 12 nt, Human
uuucucuuucuu

SEQ ID NO: 3893211 - RNA, 14 nt, Human
uuucucuuucuuua

SEQ ID NO: 3893212 - RNA, 13 nt, Human
uuucucuuugaaa

SEQ ID NO: 3893213 - RNA, 14 nt, Human
uuucucuuugaaac

SEQ ID NO: 3893214 - RNA, 22 nt, Human
uuucucuuugauuauuugcaug

SEQ ID NO: 3893215 - RNA, 15 nt, Human
uuucucuuuuuaguu

SEQ ID NO: 3893216 - RNA, 14 nt, Human
uuucugaaaagaaa

SEQ ID NO: 3893217 - RNA, 13 nt, Human
uuucugaaaauua

SEQ ID NO: 3893218 - RNA, 19 nt, Human
uuucugaaaauuaacacug

SEQ ID NO: 3893219 - RNA, 20 nt, Human
uuucugaaaauuaacacugc

SEQ ID NO: 3893220 - RNA, 18 nt, Human
uuucugaaacuaaugaaa

SEQ ID NO: 3893221 - RNA, 16 nt, Human
uuucugaacagcuggu

SEQ ID NO: 3893222 - RNA, 19 nt, Human
uuucugaacagcuggugua

SEQ ID NO: 3893223 - RNA, 15 nt, Human
uuucugaagcuuuac

SEQ ID NO: 3893224 - RNA, 18 nt, Human
uuucugaagcuuuaccag

SEQ ID NO: 3893225 - RNA, 17 nt, Human
uuucugaaggcuuugug

SEQ ID NO: 3893226 - RNA, 20 nt, Human
uuucugaccaaucacugagu

SEQ ID NO: 3893227 - RNA, 12 nt, Human
uuucugagaaaa

SEQ ID NO: 3893228 - RNA, 15 nt, Human
uuucugagaaaagaa

SEQ ID NO: 3893229 - RNA, 15 nt, Human
uuucugagaaagacu

SEQ ID NO: 3893230 - RNA, 22 nt, Human
uuucugagaaagacuauucaaa

SEQ ID NO: 3893231 - RNA, 19 nt, Human
uuucugagaagguccuuaa

SEQ ID NO: 3893232 - RNA, 12 nt, Human
uuugauguaaua

SEQ ID NO: 3893233 - RNA, 15 nt, Human
uuugaugucaugugu

SEQ ID NO: 3893234 - RNA, 19 nt, Human
uuugaugugacaauaauau

SEQ ID NO: 3893235 - RNA, 14 nt, Human
uuugauguuaacac

SEQ ID NO: 3893236 - RNA, 16 nt, Human
uuugauguuaacacau

SEQ ID NO: 3893237 - RNA, 18 nt, Human
uuugauuaaauucuugca

SEQ ID NO: 3893238 - RNA, 22 nt, Human
uuugauuaguuuucuuguugcu

SEQ ID NO: 3893239 - RNA, 16 nt, Human
uuugauuauuguauuu

SEQ ID NO: 3893240 - RNA, 17 nt, Human
uuugauuauuuaagacu

SEQ ID NO: 3893241 - RNA, 14 nt, Human
uuugauuauuugca

SEQ ID NO: 3893242 - RNA, 16 nt, Human
uuugauuauuugcaug

SEQ ID NO: 3893243 - RNA, 22 nt, Human
uuugauucaaaauauuuaaaaa

SEQ ID NO: 3893244 - RNA, 19 nt, Human
uuugauucacauguuuuca

SEQ ID NO: 3893245 - RNA, 13 nt, Human
uuugauucuccuu

SEQ ID NO: 3893246 - RNA, 14 nt, Human
uuugauucuccuuc

SEQ ID NO: 3893247 - RNA, 16 nt, Human
uuugauucuccuucag

SEQ ID NO: 3893248 - RNA, 15 nt, Human
uuugauucugugugu

SEQ ID NO: 3893249 - RNA, 21 nt, Human
uuugauugaauaaugccacca

SEQ ID NO: 3893250 - RNA, 21 nt, Human
uuugauugagaguaacuuaag

SEQ ID NO: 3893251 - RNA, 15 nt, Human
uuugauugauuugaa

SEQ ID NO: 3893252 - RNA, 18 nt, Human
uuugauuuccaaguaaua

SEQ ID NO: 3893253 - RNA, 14 nt, Human
uuugauuugucacu

SEQ ID NO: 3893254 - RNA, 18 nt, Human
uuugauuuuuucaaauuu

SEQ ID NO: 3893255 - RNA, 17 nt, Human
uuugcaaaguacuguaa

SEQ ID NO: 3893256 - RNA, 19 nt, Human
uuugcaaaguauuguaaau

SEQ ID NO: 3893257 - RNA, 14 nt, Human
uuugcaaagugcaa

SEQ ID NO: 3893258 - RNA, 17 nt, Human
uuugcaaauauaaacau

SEQ ID NO: 3893259 - RNA, 14 nt, Human
uuugcaaccaggaa

SEQ ID NO: 3893260 - RNA, 20 nt, Human
uuugcaagggaaaagucucu

SEQ ID NO: 3893261 - RNA, 21 nt, Human
uuugcaagggaaaagucucuu

SEQ ID NO: 3893262 - RNA, 17 nt, Human
uuugcaagucauggcug

SEQ ID NO: 3893263 - RNA, 13 nt, Human
uuugcaagugaag

SEQ ID NO: 3893264 - RNA, 21 nt, Human
uuugcaagugaagguuuacaa

SEQ ID NO: 3893265 - RNA, 22 nt, Human
uuugcaagugaagguuuacaau

SEQ ID NO: 3893266 - RNA, 14 nt, Human
uuugcaagugcugg

SEQ ID NO: 3893267 - RNA, 13 nt, Human
uuugcaauaaugc

SEQ ID NO: 3893268 - RNA, 14 nt, Human
uuugcaauaaugca

SEQ ID NO: 3893269 - RNA, 17 nt, Human
uuugcacaaaaagauac

SEQ ID NO: 3893270 - RNA, 12 nt, Human
uuugcacagcuc

SEQ ID NO: 3893271 - RNA, 20 nt, Human
uuugcacccacugaaaggaa

SEQ ID NO: 3893272 - RNA, 18 nt, Human
uuugcaccccaugcuguu

SEQ ID NO: 3893273 - RNA, 20 nt, Human
uuugcaccccaugcuguuga

SEQ ID NO: 3893274 - RNA, 15 nt, Human
uuugcaccccuccca

SEQ ID NO: 3893275 - RNA, 13 nt, Human
uuugcaccugucc

SEQ ID NO: 3893276 - RNA, 17 nt, Human
uuugcacgacgcccucu

SEQ ID NO: 3893277 - RNA, 20 nt, Human
uuugcacuaaaucagagaca

SEQ ID NO: 3893278 - RNA, 21 nt, Human
uuugcacuaaaucagagacaa

SEQ ID NO: 3893279 - RNA, 16 nt, Human
uuugcacucaaaucuu

SEQ ID NO: 3893280 - RNA, 17 nt, Human
uuugcacuguaugcugg

SEQ ID NO: 3893281 - RNA, 14 nt, Human
uuugcagacaggca

SEQ ID NO: 3893282 - RNA, 11 nt, Human
uuugcagagua

SEQ ID NO: 3893283 - RNA, 16 nt, Human
uuugcagcgacuggca

SEQ ID NO: 3893284 - RNA, 21 nt, Human
uuugcagcugagagaaaauaa

SEQ ID NO: 3893285 - RNA, 15 nt, Human
uuugcagcuuccaau

SEQ ID NO: 3893286 - RNA, 16 nt, Human
uuugcaggcaugcaug

SEQ ID NO: 3893287 - RNA, 14 nt, Human
uuugcagggcagcc

SEQ ID NO: 3893288 - RNA, 16 nt, Human
uuugcagggcagcccc

SEQ ID NO: 3893289 - RNA, 10 nt, Human
uuugcaguaa

SEQ ID NO: 3893290 - RNA, 21 nt, Human
uuugcaguagagucaucucca

SEQ ID NO: 3893291 - RNA, 17 nt, Human
uuugcaguucuuuggcu

SEQ ID NO: 3893292 - RNA, 16 nt, Human
uuugcauaacaauucc

SEQ ID NO: 3893293 - RNA, 22 nt, Human
uuugcauaacaauuccucuacu

SEQ ID NO: 3893294 - RNA, 18 nt, Human
uuugcauaacguauaaaa

SEQ ID NO: 3893295 - RNA, 19 nt, Human
uuugcauaauaaaugcuuc

SEQ ID NO: 3893296 - RNA, 22 nt, Human
uuugcauacuuaccuagugaaa

SEQ ID NO: 3893297 - RNA, 14 nt, Human
uuugcaucugaaau

SEQ ID NO: 3893298 - RNA, 13 nt, Human
uuugcaugcaugc

SEQ ID NO: 3893299 - RNA, 20 nt, Human
uuugcauggcacuugcaucu

SEQ ID NO: 3893300 - RNA, 18 nt, Human
uuugcauguuauguuuaa

SEQ ID NO: 3893301 - RNA, 14 nt, Human
uuugcauguuccac

SEQ ID NO: 3893302 - RNA, 13 nt, Human
uuugcauucaaau

SEQ ID NO: 3893303 - RNA, 13 nt, Human
uuugcauucuccc

SEQ ID NO: 3893304 - RNA, 18 nt, Human
uuugcauucuuauucauc

SEQ ID NO: 3893305 - RNA, 19 nt, Human
uuugcauugaacacaaacu

SEQ ID NO: 3893306 - RNA, 21 nt, Human
uuugcauuucagaaagccuuu

SEQ ID NO: 3893307 - RNA, 21 nt, Human
uuugcauuuguuuauguaauu

SEQ ID NO: 3893308 - RNA, 19 nt, Human
uuugccaaaauaaugucuu

SEQ ID NO: 3893309 - RNA, 23 nt, Human
uuugccaaaauaaugucuuguua

SEQ ID NO: 3893310 - RNA, 23 nt, Human
uuugccaaaauucauuucuaauu

SEQ ID NO: 3893311 - RNA, 14 nt, Human
uuugccaacauugc

SEQ ID NO: 3893312 - RNA, 15 nt, Human
uuugccacagcuuuu

SEQ ID NO: 3893313 - RNA, 18 nt, Human
uuugccacagcuuuugca

SEQ ID NO: 3893314 - RNA, 18 nt, Human
uuugccacccucaugcug

SEQ ID NO: 3893315 - RNA, 20 nt, Human
uuugccagcugcugcuggau

SEQ ID NO: 3893316 - RNA, 14 nt, Human
uuugccauugugaa

SEQ ID NO: 3893317 - RNA, 11 nt, Human
uuugccauuug

SEQ ID NO: 3893318 - RNA, 21 nt, Human
uuugcccaaaauuuauuuuau

SEQ ID NO: 3893319 - RNA, 18 nt, Human
uuugcccaacaccagccc

SEQ ID NO: 3893320 - RNA, 23 nt, Human
uuugcccaacaccagccccugcc

SEQ ID NO: 3893321 - RNA, 21 nt, Human
uuugcccugcugcccuccccc

SEQ ID NO: 3893322 - RNA, 13 nt, Human
uuugcccuuuacu

SEQ ID NO: 3893323 - RNA, 22 nt, Human
uuugccuaauacauuaaagcag

SEQ ID NO: 3893324 - RNA, 14 nt, Human
uuugccugagggcg

SEQ ID NO: 3893325 - RNA, 13 nt, Human
uuugccuguaaca

SEQ ID NO: 3893326 - RNA, 14 nt, Human
uuugccuguaacaa

SEQ ID NO: 3893327 - RNA, 12 nt, Human
uuugccugugcc

SEQ ID NO: 3893328 - RNA, 19 nt, Human
uuugccuguucaguuacag

SEQ ID NO: 3893329 - RNA, 20 nt, Human
uuugccuguucaguuacaga

SEQ ID NO: 3893330 - RNA, 22 nt, Human
uuugccuuccuuucuccaggac

SEQ ID NO: 3893331 - RNA, 21 nt, Human
uuugccuugggcugcuccuca

SEQ ID NO: 3893332 - RNA, 22 nt, Human
uuugcgaauauuuuguaaauua

SEQ ID NO: 3893333 - RNA, 21 nt, Human
uuugcgcacaacuuaaaaagu

SEQ ID NO: 3893334 - RNA, 21 nt, Human
uuugcgcuccuggcccagccu

SEQ ID NO: 3893335 - RNA, 22 nt, Human
uuugcggccaguauuagacugg

SEQ ID NO: 3893336 - RNA, 22 nt, Human
uuugcuaacuagcuuggaaacu

SEQ ID NO: 3893337 - RNA, 21 nt, Human
uuugcuaaguaaaucucuucu

SEQ ID NO: 3893338 - RNA, 14 nt, Human
uuugcuaauuuuua

SEQ ID NO: 3893339 - RNA, 24 nt, Human
uuugcuacuguacauaaacaauga

SEQ ID NO: 3893340 - RNA, 19 nt, Human
uuugcuagacucuagacaa

SEQ ID NO: 3893341 - RNA, 24 nt, Human
uuugcuagcaguaaaagaugaagu

SEQ ID NO: 3893342 - RNA, 18 nt, Human
uuugcuaucuuaauuuug

SEQ ID NO: 3893343 - RNA, 19 nt, Human
uuugcuaucuuaauuuugg

SEQ ID NO: 3893344 - RNA, 13 nt, Human
uuugcuauugaca

SEQ ID NO: 3893345 - RNA, 23 nt, Human
uuugcuauugacaagucauuuua

SEQ ID NO: 3893346 - RNA, 17 nt, Human
uuugcucauauuuccca

SEQ ID NO: 3893347 - RNA, 21 nt, Human
uuugcuccccuuccccuuccu

SEQ ID NO: 3893348 - RNA, 22 nt, Human
uuugcuccccuuccccuuccuu

SEQ ID NO: 3893349 - RNA, 14 nt, Human
uuugcuccgaagcu

SEQ ID NO: 3893350 - RNA, 20 nt, Human
uuugcucucccgguucuucc

SEQ ID NO: 3893351 - RNA, 23 nt, Human
uuugcucuuguuuuuauuaauuu

SEQ ID NO: 3893352 - RNA, 18 nt, Human
uuugcugaacauuggaga

SEQ ID NO: 3893353 - RNA, 19 nt, Human
uuugcugauggucuggucu

SEQ ID NO: 3893354 - RNA, 19 nt, Human
uuugcugcacuuuuuacuu

SEQ ID NO: 3893355 - RNA, 15 nt, Human
uuugcugccaaaugc

SEQ ID NO: 3893356 - RNA, 20 nt, Human
uuugcugcuaauauuuuccu

SEQ ID NO: 3893357 - RNA, 22 nt, Human
uuugcugcugcccauguuucaa

SEQ ID NO: 3893358 - RNA, 13 nt, Human
uuugcugcuucug

SEQ ID NO: 3893359 - RNA, 15 nt, Human
uuugcuggaauaagu

SEQ ID NO: 3893360 - RNA, 20 nt, Human
uuugcuggagcucugcccau

SEQ ID NO: 3893361 - RNA, 22 nt, Human
uuugcuguaauguuaauauuga

SEQ ID NO: 3893362 - RNA, 15 nt, Human
uuugcugugaacaau

SEQ ID NO: 3893363 - RNA, 19 nt, Human
uuugcuuauuguuccaaga

SEQ ID NO: 3893364 - RNA, 18 nt, Human
uuugcuuuaauauaaaug

SEQ ID NO: 3893365 - RNA, 12 nt, Human
uuugcuuuaauu

SEQ ID NO: 3893366 - RNA, 17 nt, Human
uuugcuuuaauuuuagc

SEQ ID NO: 3893367 - RNA, 19 nt, Human
uuugcuuucgguuccaguu

SEQ ID NO: 3893368 - RNA, 15 nt, Human
uuugcuuugcuuucu

SEQ ID NO: 3893369 - RNA, 18 nt, Human
uuugcuuugcuuucugcu

SEQ ID NO: 3893370 - RNA, 16 nt, Human
uuugcuuugugauuuu

SEQ ID NO: 3893371 - RNA, 22 nt, Human
uuugcuuuuccuuuguuuuuau

SEQ ID NO: 3893372 - RNA, 15 nt, Human
uuuggaaaaauguuu

SEQ ID NO: 3893373 - RNA, 14 nt, Human
uuuggaaaagaaua

SEQ ID NO: 3893374 - RNA, 16 nt, Human
uuuggaaacuaauaaa

SEQ ID NO: 3893375 - RNA, 18 nt, Human
uuuggaaacuaauaaaau

SEQ ID NO: 3893376 - RNA, 14 nt, Human
agcugccuguaguu

SEQ ID NO: 3893377 - RNA, 19 nt, Human
agcugccuguaguuaggaa

SEQ ID NO: 3893378 - RNA, 20 nt, Human
agcugccuguaguuaggaaa

SEQ ID NO: 3893379 - RNA, 14 nt, Human
agcugccuguucag

SEQ ID NO: 3893380 - RNA, 16 nt, Human
agcugccuguucagcu

SEQ ID NO: 3893381 - RNA, 22 nt, Human
agcugccuguucagcuccagcu

SEQ ID NO: 3893382 - RNA, 20 nt, Human
agcugccuuagcuucaggaa

SEQ ID NO: 3893383 - RNA, 10 nt, Human
agcugccuuc

SEQ ID NO: 3893384 - RNA, 19 nt, Human
agcugccuucccuagcuuu

SEQ ID NO: 3893385 - RNA, 14 nt, Human
agcugccuuggcuc

SEQ ID NO: 3893386 - RNA, 20 nt, Human
agcugccuuggcucagacau

SEQ ID NO: 3893387 - RNA, 17 nt, Human
agcugcgcuugcuuuuc

SEQ ID NO: 3893388 - RNA, 13 nt, Human
agcugcgguccac

SEQ ID NO: 3893389 - RNA, 22 nt, Human
agcugcuaaaucuccuauuuuu

SEQ ID NO: 3893390 - RNA, 20 nt, Human
agcugcuacaaagaagacau

SEQ ID NO: 3893391 - RNA, 21 nt, Human
agcugcuacaaagaagacaug

SEQ ID NO: 3893392 - RNA, 22 nt, Human
agcugcuacaaagaagacaugu

SEQ ID NO: 3893393 - RNA, 21 nt, Human
agcugcuauccccaucucccu

SEQ ID NO: 3893394 - RNA, 23 nt, Human
agcugcuauccccaucucccugc

SEQ ID NO: 3893395 - RNA, 19 nt, Human
agcugcuauuuauuuuccu

SEQ ID NO: 3893396 - RNA, 19 nt, Human
agcugcucagaucccacuu

SEQ ID NO: 3893397 - RNA, 15 nt, Human
agcugcuccaggccu

SEQ ID NO: 3893398 - RNA, 18 nt, Human
agcugcuccaggccugca

SEQ ID NO: 3893399 - RNA, 17 nt, Human
agcugcuccccagcagc

SEQ ID NO: 3893400 - RNA, 19 nt, Human
agcugcuccccucccuccu

SEQ ID NO: 3893401 - RNA, 17 nt, Human
agcugcucccuggcauu

SEQ ID NO: 3893402 - RNA, 22 nt, Human
agcugcuccgaggacccaggaa

SEQ ID NO: 3893403 - RNA, 18 nt, Human
agcugcuccuagagggag

SEQ ID NO: 3893404 - RNA, 19 nt, Human
agcugcuccuagagggagg

SEQ ID NO: 3893405 - RNA, 14 nt, Human
agcugcucuauugu

SEQ ID NO: 3893406 - RNA, 16 nt, Human
agcugcucugagccac

SEQ ID NO: 3893407 - RNA, 14 nt, Human
agcugcucugccca

SEQ ID NO: 3893408 - RNA, 15 nt, Human
agcugcucugcccag

SEQ ID NO: 3893409 - RNA, 16 nt, Human
agcugcucugcccaga

SEQ ID NO: 3893410 - RNA, 18 nt, Human
agcugcucugcccagagc

SEQ ID NO: 3893411 - RNA, 15 nt, Human
agcugcugaaacaac

SEQ ID NO: 3893412 - RNA, 17 nt, Human
agcugcugaccaauugu

SEQ ID NO: 3893413 - RNA, 21 nt, Human
agcugcugaccaauugugcug

SEQ ID NO: 3893414 - RNA, 23 nt, Human
agcugcugaccaauugugcugcc

SEQ ID NO: 3893415 - RNA, 19 nt, Human
agcugcugagauccuggac

SEQ ID NO: 3893416 - RNA, 21 nt, Human
agcugcugagauccuggacug

SEQ ID NO: 3893417 - RNA, 16 nt, Human
agcugcugagccgcag

SEQ ID NO: 3893418 - RNA, 12 nt, Human
agcugcugccau

SEQ ID NO: 3893419 - RNA, 13 nt, Human
agcugcugcucug

SEQ ID NO: 3893420 - RNA, 18 nt, Human
agcugcugucuucuggac

SEQ ID NO: 3893421 - RNA, 12 nt, Human
agcugcuucucc

SEQ ID NO: 3893422 - RNA, 23 nt, Human
agcugcuucucccacuuggccaa

SEQ ID NO: 3893423 - RNA, 16 nt, Human
agcugcuugggcuuca

SEQ ID NO: 3893424 - RNA, 13 nt, Human
agcugcuuuguua

SEQ ID NO: 3893425 - RNA, 16 nt, Human
agcugcuuuguuaccu

SEQ ID NO: 3893426 - RNA, 17 nt, Human
agcugcuuuguuaccuu

SEQ ID NO: 3893427 - RNA, 21 nt, Human
agcugcuuuugucuaugggac

SEQ ID NO: 3893428 - RNA, 22 nt, Human
agcugcuuuugucuaugggacu

SEQ ID NO: 3893429 - RNA, 24 nt, Human
agcugcuuuugucuaugggacuca

SEQ ID NO: 3893430 - RNA, 12 nt, Human
agcuggaagcac

SEQ ID NO: 3893431 - RNA, 18 nt, Human
agcuggacagaggggacu

SEQ ID NO: 3893432 - RNA, 23 nt, Human
agcuggacagaggggacucuggg

SEQ ID NO: 3893433 - RNA, 15 nt, Human
agcuggaccaguggu

SEQ ID NO: 3893434 - RNA, 15 nt, Human
agcuggaccucacca

SEQ ID NO: 3893435 - RNA, 16 nt, Human
agcuggaccucaccaa

SEQ ID NO: 3893436 - RNA, 16 nt, Human
agcuggacucugcauc

SEQ ID NO: 3893437 - RNA, 15 nt, Human
agcuggagaggagcc

SEQ ID NO: 3893438 - RNA, 17 nt, Human
agcuggagaggagcccu

SEQ ID NO: 3893439 - RNA, 19 nt, Human
agcuggagaggagcccugc

SEQ ID NO: 3893440 - RNA, 22 nt, Human
agcuggagaugaggccagacca

SEQ ID NO: 3893441 - RNA, 23 nt, Human
agcuggagaugaggccagaccau

SEQ ID NO: 3893442 - RNA, 17 nt, Human
agcuggagccuggugcc

SEQ ID NO: 3893443 - RNA, 20 nt, Human
agcuggaggacuagaaccug

SEQ ID NO: 3893444 - RNA, 21 nt, Human
agcuggaggcaggggcuuccu

SEQ ID NO: 3893445 - RNA, 15 nt, Human
agcuggagugcagug

SEQ ID NO: 3893446 - RNA, 19 nt, Human
agcuggagugcaguggcau

SEQ ID NO: 3893447 - RNA, 22 nt, Human
agcuggaucuccauucucucag

SEQ ID NO: 3893448 - RNA, 15 nt, Human
agcuggcauuacagc

SEQ ID NO: 3893449 - RNA, 21 nt, Human
agcuggcauuacagcuggaga

SEQ ID NO: 3893450 - RNA, 13 nt, Human
agcuggccccgcc

SEQ ID NO: 3893451 - RNA, 14 nt, Human
agcuggccccgccg

SEQ ID NO: 3893452 - RNA, 15 nt, Human
agcuggccccgccgc

SEQ ID NO: 3893453 - RNA, 18 nt, Human
agcuggccgggagccuga

SEQ ID NO: 3893454 - RNA, 12 nt, Human
agcuggcuccag

SEQ ID NO: 3893455 - RNA, 13 nt, Human
agcuggcucugag

SEQ ID NO: 3893456 - RNA, 14 nt, Human
agcuggcucugagc

SEQ ID NO: 3893457 - RNA, 19 nt, Human
agcuggcucugagcgccuc

SEQ ID NO: 3893458 - RNA, 14 nt, Human
agcuggcucuguga

SEQ ID NO: 3893459 - RNA, 20 nt, Human
agcuggcucugugagggugc

SEQ ID NO: 3893460 - RNA, 22 nt, Human
agcuggcucugugagggugcug

SEQ ID NO: 3893461 - RNA, 14 nt, Human
agcuggcuggggug

SEQ ID NO: 3893462 - RNA, 20 nt, Human
agcuggcugggguggccugu

SEQ ID NO: 3893463 - RNA, 15 nt, Human
agcugggaccacagg

SEQ ID NO: 3893464 - RNA, 18 nt, Human
agcugggaccacaggugc

SEQ ID NO: 3893465 - RNA, 16 nt, Human
agcugggacuacaggc

SEQ ID NO: 3893466 - RNA, 15 nt, Human
agcugggaggaaaag

SEQ ID NO: 3893467 - RNA, 23 nt, Human
agcugggaggcaagaggggugga

SEQ ID NO: 3893468 - RNA, 14 nt, Human
agcugggaggcaug

SEQ ID NO: 3893469 - RNA, 16 nt, Human
agcugggaggcauggc

SEQ ID NO: 3893470 - RNA, 14 nt, Human
agcugggaucugac

SEQ ID NO: 3893471 - RNA, 19 nt, Human
agcugggaucugacugcac

SEQ ID NO: 3893472 - RNA, 23 nt, Human
agcugggaugauuggagggggga

SEQ ID NO: 3893473 - RNA, 22 nt, Human
agcugggauuacaggcuccugc

SEQ ID NO: 3893474 - RNA, 16 nt, Human
agcugggcagaaggcc

SEQ ID NO: 3893475 - RNA, 21 nt, Human
agcugggcaugguaccagccc

SEQ ID NO: 3893476 - RNA, 12 nt, Human
agcugggcccaa

SEQ ID NO: 3893477 - RNA, 22 nt, Human
agcugggccccagcccacccuc

SEQ ID NO: 3893478 - RNA, 15 nt, Human
agcugggcucugcca

SEQ ID NO: 3893479 - RNA, 22 nt, Human
agcugggcucugccacccuacc

SEQ ID NO: 3893480 - RNA, 20 nt, Human
agcuggggaagcuucuuaaa

SEQ ID NO: 3893481 - RNA, 18 nt, Human
agcuggggaggagcuuug

SEQ ID NO: 3893482 - RNA, 22 nt, Human
agcuggggaucccuccccccca

SEQ ID NO: 3893483 - RNA, 17 nt, Human
agcuggggccaggcugg

SEQ ID NO: 3893484 - RNA, 18 nt, Human
agcuggggcguggggagg

SEQ ID NO: 3893485 - RNA, 14 nt, Human
agcuggggugcagg

SEQ ID NO: 3893486 - RNA, 22 nt, Human
agcugggguggggaccucaggc

SEQ ID NO: 3893487 - RNA, 23 nt, Human
agcugggguggggaccucaggcc

SEQ ID NO: 3893488 - RNA, 14 nt, Human
agcugggucaggca

SEQ ID NO: 3893489 - RNA, 17 nt, Human
agcugggucaggcaggg

SEQ ID NO: 3893490 - RNA, 18 nt, Human
agcuggguggcacugcca

SEQ ID NO: 3893491 - RNA, 14 nt, Human
agcuggguuggaaa

SEQ ID NO: 3893492 - RNA, 13 nt, Human
agcugguaacauc

SEQ ID NO: 3893493 - RNA, 15 nt, Human
agcuggucccacuca

SEQ ID NO: 3893494 - RNA, 18 nt, Human
agcuggugagugaugcgg

SEQ ID NO: 3893495 - RNA, 13 nt, Human
agcuggugcauua

SEQ ID NO: 3893496 - RNA, 18 nt, Human
agcuggugcauuacagag

SEQ ID NO: 3893497 - RNA, 17 nt, Human
agcugguggaacauaug

SEQ ID NO: 3893498 - RNA, 15 nt, Human
agcugguggacccag

SEQ ID NO: 3893499 - RNA, 16 nt, Human
agcugguggcagaguc

SEQ ID NO: 3893500 - RNA, 20 nt, Human
agcugguguagcuacagaga

SEQ ID NO: 3893501 - RNA, 23 nt, Human
agcugguguagcuacagagaaac

SEQ ID NO: 3893502 - RNA, 19 nt, Human
agcugguuccugcuagaaa

SEQ ID NO: 3893503 - RNA, 16 nt, Human
agcugguugagguuuc

SEQ ID NO: 3893504 - RNA, 16 nt, Human
agcucccacaagccug

SEQ ID NO: 3893505 - RNA, 14 nt, Human
agcucccaccuccc

SEQ ID NO: 3893506 - RNA, 18 nt, Human
agcucccacuucugccag

SEQ ID NO: 3893507 - RNA, 23 nt, Human
agcucccaggaccacaggcucag

SEQ ID NO: 3893508 - RNA, 13 nt, Human
agcucccaggcau

SEQ ID NO: 3893509 - RNA, 13 nt, Human
agcucccaggccg

SEQ ID NO: 3893510 - RNA, 21 nt, Human
agcucccaggccgagaagcca

SEQ ID NO: 3893511 - RNA, 21 nt, Human
agcucccaggugcagccagag

SEQ ID NO: 3893512 - RNA, 13 nt, Human
agcucccauucua

SEQ ID NO: 3893513 - RNA, 23 nt, Human
agcucccauuucuacucucccau

SEQ ID NO: 3893514 - RNA, 20 nt, Human
agcuccccaccaccccagcu

SEQ ID NO: 3893515 - RNA, 18 nt, Human
agcuccccagaguccucu

SEQ ID NO: 3893516 - RNA, 15 nt, Human
agcuccccccaccuc

SEQ ID NO: 3893517 - RNA, 19 nt, Human
agcucccccgggaggggcc

SEQ ID NO: 3893518 - RNA, 13 nt, Human
agcucccccuguc

SEQ ID NO: 3893519 - RNA, 14 nt, Human
agcucccccugucc

SEQ ID NO: 3893520 - RNA, 21 nt, Human
agcucccccuguccccucagc

SEQ ID NO: 3893521 - RNA, 18 nt, Human
agcuccccuccccaacug

SEQ ID NO: 3893522 - RNA, 14 nt, Human
agcucccucccgca

SEQ ID NO: 3893523 - RNA, 14 nt, Human
agcucccugcccca

SEQ ID NO: 3893524 - RNA, 20 nt, Human
agcucccuggcuucuguggg

SEQ ID NO: 3893525 - RNA, 16 nt, Human
agcucccugugccccc

SEQ ID NO: 3893526 - RNA, 19 nt, Human
agcucccugugcccccagg

SEQ ID NO: 3893527 - RNA, 14 nt, Human
agcucccuucucug

SEQ ID NO: 3893528 - RNA, 20 nt, Human
agcuccgcuuucuacccagc

SEQ ID NO: 3893529 - RNA, 16 nt, Human
agcuccucacucaccu

SEQ ID NO: 3893530 - RNA, 12 nt, Human
agcuccucccac

SEQ ID NO: 3893531 - RNA, 22 nt, Human
agcuccuccgugcuuccucagu

SEQ ID NO: 3893532 - RNA, 13 nt, Human
agcuccuccuccc

SEQ ID NO: 3893533 - RNA, 14 nt, Human
agcuccuccucccu

SEQ ID NO: 3893534 - RNA, 17 nt, Human
agcuccuccucccugca

SEQ ID NO: 3893535 - RNA, 21 nt, Human
agcuccuccucccugcaucug

SEQ ID NO: 3893536 - RNA, 22 nt, Human
agcuccuccuugucuuggcagc

SEQ ID NO: 3893537 - RNA, 17 nt, Human
agcuccucgagggcagg

SEQ ID NO: 3893538 - RNA, 20 nt, Human
agcuccucgagggcagggac

SEQ ID NO: 3893539 - RNA, 16 nt, Human
agcuccucuccccagc

SEQ ID NO: 3893540 - RNA, 19 nt, Human
agcuccucuccccagccca

SEQ ID NO: 3893541 - RNA, 22 nt, Human
agcuccucuccccagcccagag

SEQ ID NO: 3893542 - RNA, 16 nt, Human
agcuccucuccuggag

SEQ ID NO: 3893543 - RNA, 17 nt, Human
agcuccucuccuggagg

SEQ ID NO: 3893544 - RNA, 20 nt, Human
agcuccucugggcaggaccu

SEQ ID NO: 3893545 - RNA, 18 nt, Human
agcuccucugucucgagc

SEQ ID NO: 3893546 - RNA, 10 nt, Human
agcuccugac

SEQ ID NO: 3893547 - RNA, 18 nt, Human
agcuccugacacugcugg

SEQ ID NO: 3893548 - RNA, 16 nt, Human
agcuccugaccaguug

SEQ ID NO: 3893549 - RNA, 13 nt, Human
agcuccuggggcg

SEQ ID NO: 3893550 - RNA, 20 nt, Human
agcuccuggucuugagaugu

SEQ ID NO: 3893551 - RNA, 14 nt, Human
agcuccuguccccu

SEQ ID NO: 3893552 - RNA, 21 nt, Human
agcuccuguccucccaucccc

SEQ ID NO: 3893553 - RNA, 15 nt, Human
agcuccuguggcccc

SEQ ID NO: 3893554 - RNA, 17 nt, Human
agcuccuuaaggcucuu

SEQ ID NO: 3893555 - RNA, 15 nt, Human
agcuccuucuguccu

SEQ ID NO: 3893556 - RNA, 16 nt, Human
agcuccuucuguccua

SEQ ID NO: 3893557 - RNA, 21 nt, Human
agcuccuugagggcaagagcc

SEQ ID NO: 3893558 - RNA, 17 nt, Human
agcuccuugggaggaag

SEQ ID NO: 3893559 - RNA, 19 nt, Human
agcuccuugggaggaagca

SEQ ID NO: 3893560 - RNA, 20 nt, Human
agcuccuugggaggaagcag

SEQ ID NO: 3893561 - RNA, 23 nt, Human
agcuccuugggaggaagcagaau

SEQ ID NO: 3893562 - RNA, 19 nt, Human
agcuccuugggaggcccca

SEQ ID NO: 3893563 - RNA, 22 nt, Human
agcuccuugggaggccccacug

SEQ ID NO: 3893564 - RNA, 19 nt, Human
agcuccuuuuccagagcau

SEQ ID NO: 3893565 - RNA, 17 nt, Human
agcucgaauuaagaaua

SEQ ID NO: 3893566 - RNA, 19 nt, Human
agcucgcaccccccuguuc

SEQ ID NO: 3893567 - RNA, 22 nt, Human
agcucgcaccccccuguucuaa

SEQ ID NO: 3893568 - RNA, 17 nt, Human
agcucgguggacccagg

SEQ ID NO: 3893569 - RNA, 18 nt, Human
agcucgguggacccaggg

SEQ ID NO: 3893570 - RNA, 20 nt, Human
agcucgguggacccagggau

SEQ ID NO: 3893571 - RNA, 20 nt, Human
agcucguguauccuggggcu

SEQ ID NO: 3893572 - RNA, 17 nt, Human
agcucuacccagggccu

SEQ ID NO: 3893573 - RNA, 20 nt, Human
agcucuacccagggccugca

SEQ ID NO: 3893574 - RNA, 17 nt, Human
agcucuagacaacccug

SEQ ID NO: 3893575 - RNA, 20 nt, Human
agcucuauuaagauuuccaa

SEQ ID NO: 3893576 - RNA, 12 nt, Human
agcucucagcca

SEQ ID NO: 3893577 - RNA, 17 nt, Human
agcucucaguugcagcc

SEQ ID NO: 3893578 - RNA, 13 nt, Human
agcucuccccuca

SEQ ID NO: 3893579 - RNA, 20 nt, Human
agcucucccucuggcccugc

SEQ ID NO: 3893580 - RNA, 17 nt, Human
agcucucggaacugcau

SEQ ID NO: 3893581 - RNA, 22 nt, Human
agcucucuaggccucuccaguu

SEQ ID NO: 3893582 - RNA, 18 nt, Human
agcucucuguauaaacau

SEQ ID NO: 3893583 - RNA, 16 nt, Human
agcucucuugccgagg

SEQ ID NO: 3893584 - RNA, 21 nt, Human
agcucucuugccgaggagcca

SEQ ID NO: 3893585 - RNA, 15 nt, Human
agcucugaaagagaa

SEQ ID NO: 3893586 - RNA, 22 nt, Human
agcucugaaagagaaacacgua

SEQ ID NO: 3893587 - RNA, 21 nt, Human
agcucugaagaacucucugga

SEQ ID NO: 3893588 - RNA, 13 nt, Human
agcucugagaggc

SEQ ID NO: 3893589 - RNA, 20 nt, Human
agcucugagaggcccuggau

SEQ ID NO: 3893590 - RNA, 21 nt, Human
agcucugagaggcccuggauc

SEQ ID NO: 3893591 - RNA, 23 nt, Human
agcucugagaggcccuggaucag

SEQ ID NO: 3893592 - RNA, 16 nt, Human
agcucugagcugucaa

SEQ ID NO: 3893593 - RNA, 20 nt, Human
agcucugaggacugcaccau

SEQ ID NO: 3893594 - RNA, 20 nt, Human
agcucugcaggcuuaauaaa

SEQ ID NO: 3893595 - RNA, 14 nt, Human
agcucugccgucuc

SEQ ID NO: 3893596 - RNA, 17 nt, Human
agcucugccgucucugg

SEQ ID NO: 3893597 - RNA, 18 nt, Human
agcucugccgucucugga

SEQ ID NO: 3893598 - RNA, 15 nt, Human
agcucugcuugccga

SEQ ID NO: 3893599 - RNA, 21 nt, Human
agcucugcuugccgaaacugg

SEQ ID NO: 3893600 - RNA, 23 nt, Human
agcucugcuugccgaaacuggaa

SEQ ID NO: 3893601 - RNA, 16 nt, Human
agcucuggagccaccu

SEQ ID NO: 3893602 - RNA, 12 nt, Human
agcucuggaggg

SEQ ID NO: 3893603 - RNA, 18 nt, Human
agcucuggaggggagggg

SEQ ID NO: 3893604 - RNA, 20 nt, Human
agcucuggaggggaggggga

SEQ ID NO: 3893605 - RNA, 12 nt, Human
agcucuggcuca

SEQ ID NO: 3893606 - RNA, 15 nt, Human
agcucuggcucacag

SEQ ID NO: 3893607 - RNA, 20 nt, Human
agcucuggcucacagacugg

SEQ ID NO: 3893608 - RNA, 16 nt, Human
agcucuggcugaaccc

SEQ ID NO: 3893609 - RNA, 21 nt, Human
agcucuggcugaacccugugc

SEQ ID NO: 3893610 - RNA, 12 nt, Human
agcucuggucca

SEQ ID NO: 3893611 - RNA, 17 nt, Human
agcucuggugacaccag

SEQ ID NO: 3893612 - RNA, 21 nt, Human
agcucuggugacaccagccuu

SEQ ID NO: 3893613 - RNA, 12 nt, Human
agcucuguauca

SEQ ID NO: 3893614 - RNA, 21 nt, Human
agcucuguccugggagugagc

SEQ ID NO: 3893615 - RNA, 15 nt, Human
agcucuguucuuccu

SEQ ID NO: 3893616 - RNA, 22 nt, Human
agcucuguucuuccucagccag

SEQ ID NO: 3893617 - RNA, 15 nt, Human
agcucuguuucgguu

SEQ ID NO: 3893618 - RNA, 18 nt, Human
agcucuuacucuuuccua

SEQ ID NO: 3893619 - RNA, 16 nt, Human
agcucuucaggccucc

SEQ ID NO: 3893620 - RNA, 19 nt, Human
agcucuuccuaucccucuc

SEQ ID NO: 3893621 - RNA, 15 nt, Human
agcucuucuccaggc

SEQ ID NO: 3893622 - RNA, 16 nt, Human
agcucuugcccuuccc

SEQ ID NO: 3893623 - RNA, 18 nt, Human
agcucuugcccuucccug

SEQ ID NO: 3893624 - RNA, 19 nt, Human
agcucuugcccuucccugu

SEQ ID NO: 3893625 - RNA, 22 nt, Human
agcucuugcccuucccuguccc

SEQ ID NO: 3893626 - RNA, 15 nt, Human
agcucuugcuaauca

SEQ ID NO: 3893627 - RNA, 19 nt, Human
agcucuugcuaaucagugu

SEQ ID NO: 3893628 - RNA, 23 nt, Human
agcucuugcuaaucagugucuca

SEQ ID NO: 3893629 - RNA, 15 nt, Human
agcucuuggagcugu

SEQ ID NO: 3893630 - RNA, 12 nt, Human
agcucuugugag

SEQ ID NO: 3893631 - RNA, 13 nt, Human
agcucuugugagg

SEQ ID NO: 3893632 - RNA, 17 nt, Human
agcucuuuccuccuucc

SEQ ID NO: 3893633 - RNA, 22 nt, Human
agcucuuuccuccuuccaugga

SEQ ID NO: 3893634 - RNA, 23 nt, Human
agcucuuuccuccuuccauggaa

SEQ ID NO: 3893635 - RNA, 15 nt, Human
agcucuuugucaggg

SEQ ID NO: 3893636 - RNA, 17 nt, Human
agcucuuugucagggag

SEQ ID NO: 3893637 - RNA, 11 nt, Human
agcucuuuuaa

SEQ ID NO: 3893638 - RNA, 13 nt, Human
agauucuuaauuc

SEQ ID NO: 3893639 - RNA, 12 nt, Human
agauucuugcau

SEQ ID NO: 3893640 - RNA, 21 nt, Human
agauucuuuccugaggcuggg

SEQ ID NO: 3893641 - RNA, 11 nt, Human
agauucuuuua

SEQ ID NO: 3893642 - RNA, 12 nt, Human
agauucuuuuaa

SEQ ID NO: 3893643 - RNA, 14 nt, Human
agauugaaaaucuu

SEQ ID NO: 3893644 - RNA, 13 nt, Human
agauugaccugga

SEQ ID NO: 3893645 - RNA, 17 nt, Human
agauugagaaggagaga

SEQ ID NO: 3893646 - RNA, 20 nt, Human
agauugagaccuacaggcug

SEQ ID NO: 3893647 - RNA, 20 nt, Human
agcaaaugucuuccuggauu

SEQ ID NO: 3893648 - RNA, 15 nt, Human
agcaaaugugaccug

SEQ ID NO: 3893649 - RNA, 16 nt, Human
agcaaauguggcuccu

SEQ ID NO: 3893650 - RNA, 13 nt, Human
agcaaauguuaca

SEQ ID NO: 3893651 - RNA, 15 nt, Human
agcaaauguuacaua

SEQ ID NO: 3893652 - RNA, 19 nt, Human
agcaaauguuacauagugu

SEQ ID NO: 3893653 - RNA, 14 nt, Human
agcaaauguuucug

SEQ ID NO: 3893654 - RNA, 19 nt, Human
agcaaauuaauuggcagca

SEQ ID NO: 3893655 - RNA, 20 nt, Human
agcaaauuuauaauuuuaag

SEQ ID NO: 3893656 - RNA, 14 nt, Human
agcaaauuucaaaa

SEQ ID NO: 3893657 - RNA, 24 nt, Human
agcaaauuucaaaagacauguugu

SEQ ID NO: 3893658 - RNA, 15 nt, Human
agcaaauuuucagca

SEQ ID NO: 3893659 - RNA, 23 nt, Human
agcaacaacaauugguaaaacuc

SEQ ID NO: 3893660 - RNA, 18 nt, Human
agcaacaauaaauagaca

SEQ ID NO: 3893661 - RNA, 18 nt, Human
agcaacacaaagcuuuug

SEQ ID NO: 3893662 - RNA, 20 nt, Human
agcaacacaagcuggaagca

SEQ ID NO: 3893663 - RNA, 13 nt, Human
agcaacacaaugu

SEQ ID NO: 3893664 - RNA, 11 nt, Human
agcaacacaga

SEQ ID NO: 3893665 - RNA, 15 nt, Human
agcaacacagaggaa

SEQ ID NO: 3893666 - RNA, 17 nt, Human
agcaacacagccugggc

SEQ ID NO: 3893667 - RNA, 18 nt, Human
agcaacacagccugggcc

SEQ ID NO: 3893668 - RNA, 21 nt, Human
agcaacacagccugggcccca

SEQ ID NO: 3893669 - RNA, 21 nt, Human
agcaacaggaaucaagagcug

SEQ ID NO: 3893670 - RNA, 23 nt, Human
agcaacaggaaucaagagcugcc

SEQ ID NO: 3893671 - RNA, 19 nt, Human
agcaacagguuuuauaauu

SEQ ID NO: 3893672 - RNA, 15 nt, Human
agcaacaucagcuug

SEQ ID NO: 3893673 - RNA, 15 nt, Human
agcaacaugcuucau

SEQ ID NO: 3893674 - RNA, 13 nt, Human
agcaacauggcuu

SEQ ID NO: 3893675 - RNA, 14 nt, Human
agcaacauggcuuu

SEQ ID NO: 3893676 - RNA, 15 nt, Human
agcaacauucauagu

SEQ ID NO: 3893677 - RNA, 22 nt, Human
agcaacauuuuacccacacaca

SEQ ID NO: 3893678 - RNA, 14 nt, Human
agcaaccccaggcu

SEQ ID NO: 3893679 - RNA, 21 nt, Human
agcaaccguggcccuuccugg

SEQ ID NO: 3893680 - RNA, 22 nt, Human
agcaaccguggcccuuccugga

SEQ ID NO: 3893681 - RNA, 15 nt, Human
agcaaccuacccagc

SEQ ID NO: 3893682 - RNA, 13 nt, Human
agcaaccucccaa

SEQ ID NO: 3893683 - RNA, 19 nt, Human
agcaaccuggguccaaaua

SEQ ID NO: 3893684 - RNA, 23 nt, Human
agcaaccuuucaccuuuguguau

SEQ ID NO: 3893685 - RNA, 19 nt, Human
agcaacgaucacaaaugac

SEQ ID NO: 3893686 - RNA, 20 nt, Human
agcaacgaucacaaaugacu

SEQ ID NO: 3893687 - RNA, 22 nt, Human
agcaacgaucacaaaugacuuu

SEQ ID NO: 3893688 - RNA, 23 nt, Human
agcaacgcaggcccccaggugcc

SEQ ID NO: 3893689 - RNA, 18 nt, Human
agcaacgcuauuccagcu

SEQ ID NO: 3893690 - RNA, 23 nt, Human
agcaacgcuauuccagcuguccc

SEQ ID NO: 3893691 - RNA, 13 nt, Human
agcaacggcacag

SEQ ID NO: 3893692 - RNA, 20 nt, Human
agcaacguagcuucuaccau

SEQ ID NO: 3893693 - RNA, 16 nt, Human
agcaacuaucagacua

SEQ ID NO: 3893694 - RNA, 12 nt, Human
agcaacugaaua

SEQ ID NO: 3893695 - RNA, 13 nt, Human
agcaacugaauaa

SEQ ID NO: 3893696 - RNA, 14 nt, Human
agcaacugaauaaa

SEQ ID NO: 3893697 - RNA, 15 nt, Human
agcaacugaauaaau

SEQ ID NO: 3893698 - RNA, 19 nt, Human
agcaacugaauaaauaccu

SEQ ID NO: 3893699 - RNA, 19 nt, Human
agcaacugcuguuggaagg

SEQ ID NO: 3893700 - RNA, 12 nt, Human
agcaacugggac

SEQ ID NO: 3893701 - RNA, 13 nt, Human
agcaacugucuau

SEQ ID NO: 3893702 - RNA, 16 nt, Human
agcaacugucuauuuc

SEQ ID NO: 3893703 - RNA, 21 nt, Human
agcaacugucuauuucugcug

SEQ ID NO: 3893704 - RNA, 13 nt, Human
agcaacuguuaug

SEQ ID NO: 3893705 - RNA, 21 nt, Human
agcaacuucuucuccaucccu

SEQ ID NO: 3893706 - RNA, 15 nt, Human
agcaacuugucuuuu

SEQ ID NO: 3893707 - RNA, 23 nt, Human
agcaacuugucuuuuucuggacu

SEQ ID NO: 3893708 - RNA, 17 nt, Human
agcaagaccccaucuca

SEQ ID NO: 3893709 - RNA, 17 nt, Human
agcaagacgcugugcug

SEQ ID NO: 3893710 - RNA, 16 nt, Human
agcaagacuguugcuc

SEQ ID NO: 3893711 - RNA, 12 nt, Human
agcaagagagau

SEQ ID NO: 3893712 - RNA, 15 nt, Human
agcaagagagauguu

SEQ ID NO: 3893713 - RNA, 17 nt, Human
agcaagagcuggcaaag

SEQ ID NO: 3893714 - RNA, 23 nt, Human
agcaagagcuggcaaagguggcu

SEQ ID NO: 3893715 - RNA, 12 nt, Human
agcaagaggagg

SEQ ID NO: 3893716 - RNA, 18 nt, Human
agcaagcauucagaagaa

SEQ ID NO: 3893717 - RNA, 11 nt, Human
agcaagcuccc

SEQ ID NO: 3893718 - RNA, 20 nt, Human
agcaagcucccaagggaugg

SEQ ID NO: 3893719 - RNA, 17 nt, Human
agcaagcugauuaaaug

SEQ ID NO: 3893720 - RNA, 22 nt, Human
agcaagcuuuuacaacagugcu

SEQ ID NO: 3893721 - RNA, 23 nt, Human
agcaagcuuuuuuauuuuuuaua

SEQ ID NO: 3893722 - RNA, 19 nt, Human
agcaaggagauuuacaacu

SEQ ID NO: 3893723 - RNA, 17 nt, Human
agcaaggaggcuggcug

SEQ ID NO: 3893724 - RNA, 13 nt, Human
agcaaggcaccug

SEQ ID NO: 3893725 - RNA, 17 nt, Human
agcaaggcccgagcagc

SEQ ID NO: 3893726 - RNA, 19 nt, Human
agcaaggcccgagcagcug

SEQ ID NO: 3893727 - RNA, 15 nt, Human
agcaaggcccugcug

SEQ ID NO: 3893728 - RNA, 17 nt, Human
agcaaggcccugcugcc

SEQ ID NO: 3893729 - RNA, 18 nt, Human
agcaaggcccugcugccc

SEQ ID NO: 3893730 - RNA, 21 nt, Human
agcaaggcgguggacuugaac

SEQ ID NO: 3893731 - RNA, 15 nt, Human
agcaaggggcucugc

SEQ ID NO: 3893732 - RNA, 18 nt, Human
agcaagggggugauguag

SEQ ID NO: 3893733 - RNA, 16 nt, Human
agcaagggugauggga

SEQ ID NO: 3893734 - RNA, 22 nt, Human
agcaagggugaugggaaagcau

SEQ ID NO: 3893735 - RNA, 23 nt, Human
agcaaggugcucacaccccauug

SEQ ID NO: 3893736 - RNA, 20 nt, Human
agcaagguggguggaaacua

SEQ ID NO: 3893737 - RNA, 18 nt, Human
agcaaguaaaaaggcuaa

SEQ ID NO: 3893738 - RNA, 22 nt, Human
agcaaguaaaaaggcuaaaugg

SEQ ID NO: 3893739 - RNA, 15 nt, Human
agcaaguagauaaau

SEQ ID NO: 3893740 - RNA, 14 nt, Human
agcaagucaggguu

SEQ ID NO: 3893741 - RNA, 14 nt, Human
agcaagucugcagg

SEQ ID NO: 3893742 - RNA, 23 nt, Human
agcaagugagacccugucucaaa

SEQ ID NO: 3893743 - RNA, 17 nt, Human
agcaagugagagagaug

SEQ ID NO: 3893744 - RNA, 18 nt, Human
agcaagugagagagaugg

SEQ ID NO: 3893745 - RNA, 24 nt, Human
agcaagugagagagaugggagcuc

SEQ ID NO: 3893746 - RNA, 16 nt, Human
agcaagugagagcugg

SEQ ID NO: 3893747 - RNA, 13 nt, Human
agcaagugguccu

SEQ ID NO: 3893748 - RNA, 23 nt, Human
agcaagugugaauacugcuugaa

SEQ ID NO: 3893749 - RNA, 17 nt, Human
agcaaguucuagagaag

SEQ ID NO: 3893750 - RNA, 21 nt, Human
agcaaguucuagagaagaggc

SEQ ID NO: 3893751 - RNA, 14 nt, Human
agcaauaaaugaau

SEQ ID NO: 3893752 - RNA, 16 nt, Human
agcaauaauuucugua

SEQ ID NO: 3893753 - RNA, 22 nt, Human
agcaauauauuaccagcaagaa

SEQ ID NO: 3893754 - RNA, 21 nt, Human
agcaauauuguauauuuuuau

SEQ ID NO: 3893755 - RNA, 22 nt, Human
agcaaucaagguuauaauuuuu

SEQ ID NO: 3893756 - RNA, 17 nt, Human
agcaauccauguuaguu

SEQ ID NO: 3893757 - RNA, 22 nt, Human
agcaauccauguuaguuuuuac

SEQ ID NO: 3893758 - RNA, 15 nt, Human
agcaauccucccacu

SEQ ID NO: 3893759 - RNA, 23 nt, Human
agcaauccucucaccucagccuc

SEQ ID NO: 3893760 - RNA, 15 nt, Human
agcaaucucuucauu

SEQ ID NO: 3893761 - RNA, 16 nt, Human
agcaaucugacccuau

SEQ ID NO: 3893762 - RNA, 15 nt, Human
agcaaugccugccca

SEQ ID NO: 3893763 - RNA, 21 nt, Human
agcaaugcugaugaaucacug

SEQ ID NO: 3893764 - RNA, 21 nt, Human
agcaauggacgguccgcagaa

SEQ ID NO: 3893765 - RNA, 16 nt, Human
agcaauggauauuugu

SEQ ID NO: 3893766 - RNA, 23 nt, Human
agcaauggugucaguauccaggc

SEQ ID NO: 3893767 - RNA, 14 nt, Human
agcaaugucugugc

SEQ ID NO: 3893768 - RNA, 14 nt, Human
agcaauuccaaccu

SEQ ID NO: 3893769 - RNA, 15 nt, Human
agcaauuccaaccuu

SEQ ID NO: 3893770 - RNA, 21 nt, Human
agcacaccaaucuuacuuugu

SEQ ID NO: 3893771 - RNA, 18 nt, Human
agcacacucauccccuca

SEQ ID NO: 3893772 - RNA, 20 nt, Human
agcacacucauccccucacu

SEQ ID NO: 3893773 - RNA, 15 nt, Human
agcacagaaaacuag

SEQ ID NO: 3893774 - RNA, 19 nt, Human
agcacagaaacagaggaga

SEQ ID NO: 3893775 - RNA, 16 nt, Human
agcacagaaggaggag

SEQ ID NO: 3893776 - RNA, 14 nt, Human
agcacagaauauuu

SEQ ID NO: 3893777 - RNA, 12 nt, Human
agcacagacccu

SEQ ID NO: 3893778 - RNA, 19 nt, Human
agcacagacccugcccugu

SEQ ID NO: 3893779 - RNA, 17 nt, Human
agcacagagaagacaaa

SEQ ID NO: 3893780 - RNA, 23 nt, Human
agcacagagagggggccaccucc

SEQ ID NO: 3893781 - RNA, 17 nt, Human
agcacagagagucugga

SEQ ID NO: 3893782 - RNA, 18 nt, Human
agcacagaggccuccugu

SEQ ID NO: 3893783 - RNA, 15 nt, Human
agcacagauggccag

SEQ ID NO: 3893784 - RNA, 20 nt, Human
agcacagauggccagccccu

SEQ ID NO: 3893785 - RNA, 19 nt, Human
agcacagcaaggaggcugg

SEQ ID NO: 3893786 - RNA, 10 nt, Human
agcacagcag

SEQ ID NO: 3893787 - RNA, 23 nt, Human
agcacagcagccuggggcuggcc

SEQ ID NO: 3893788 - RNA, 13 nt, Human
agcacagccaaca

SEQ ID NO: 3893789 - RNA, 12 nt, Human
agcacagcccuu

SEQ ID NO: 3893790 - RNA, 18 nt, Human
agcacagcucccugccaa

SEQ ID NO: 3893791 - RNA, 16 nt, Human
agcacagcuuagauuu

SEQ ID NO: 3893792 - RNA, 20 nt, Human
agcacagcuugaccugaggc

SEQ ID NO: 3893793 - RNA, 16 nt, Human
agcacaggcuaauuuu

SEQ ID NO: 3893794 - RNA, 12 nt, Human
agcacaggcuga

SEQ ID NO: 3893795 - RNA, 22 nt, Human
agcacaggcugagugcaggccc

SEQ ID NO: 3893796 - RNA, 21 nt, Human
agcacaggucccaccuccagc

SEQ ID NO: 3893797 - RNA, 19 nt, Human
agcacagugguggcagggc

SEQ ID NO: 3893798 - RNA, 16 nt, Human
agcacaguguuaaaug

SEQ ID NO: 3893799 - RNA, 18 nt, Human
agcacaguguuaaaugaa

SEQ ID NO: 3893800 - RNA, 19 nt, Human
agcacaguguuaaaugaaa

SEQ ID NO: 3893801 - RNA, 15 nt, Human
agcacaucucaacag

SEQ ID NO: 3893802 - RNA, 16 nt, Human
agcacaucucaacagg

SEQ ID NO: 3893803 - RNA, 23 nt, Human
agcacaugcccuaaugucuguau

SEQ ID NO: 3893804 - RNA, 16 nt, Human
agcacaugccucucuc

SEQ ID NO: 3893805 - RNA, 20 nt, Human
agcacaugcuggccagccug

SEQ ID NO: 3893806 - RNA, 16 nt, Human
agcacaugugcugccc

SEQ ID NO: 3893807 - RNA, 17 nt, Human
agcaccaaaauaagaaa

SEQ ID NO: 3893808 - RNA, 22 nt, Human
agcaccaaaucaaaaucucucc

SEQ ID NO: 3893809 - RNA, 22 nt, Human
agcaccaccaaacacaguguau

SEQ ID NO: 3893810 - RNA, 15 nt, Human
agcaccacccuccuu

SEQ ID NO: 3893811 - RNA, 14 nt, Human
agcaccagaaugua

SEQ ID NO: 3893812 - RNA, 17 nt, Human
agcaccagcuucuccag

SEQ ID NO: 3893813 - RNA, 18 nt, Human
agcaccagcuucuccagg

SEQ ID NO: 3893814 - RNA, 21 nt, Human
agcaccagcuucuccaggcuc

SEQ ID NO: 3893815 - RNA, 14 nt, Human
agcaccaggcacga

SEQ ID NO: 3893816 - RNA, 14 nt, Human
agcacccauuucaa

SEQ ID NO: 3893817 - RNA, 14 nt, Human
agcaccccaaggcu

SEQ ID NO: 3893818 - RNA, 14 nt, Human
agcaccccucucug

SEQ ID NO: 3893819 - RNA, 16 nt, Human
agcaccccucucugca

SEQ ID NO: 3893820 - RNA, 14 nt, Human
agcaccccuuccau

SEQ ID NO: 3893821 - RNA, 15 nt, Human
agcacccgggcucag

SEQ ID NO: 3893822 - RNA, 24 nt, Human
agcacccuauaaaucaacaccuua

SEQ ID NO: 3893823 - RNA, 16 nt, Human
agcaccgaauauugag

SEQ ID NO: 3893824 - RNA, 18 nt, Human
agcaccgaauauugagca

SEQ ID NO: 3893825 - RNA, 16 nt, Human
agcaccgccucuuccc

SEQ ID NO: 3893826 - RNA, 21 nt, Human
agcaccgcuuuuguucucgca

SEQ ID NO: 3893827 - RNA, 19 nt, Human
agcaccggaccagccuggc

SEQ ID NO: 3893828 - RNA, 19 nt, Human
agcaccgugucaagcugcu

SEQ ID NO: 3893829 - RNA, 22 nt, Human
agcaccgugucaagcugcucug

SEQ ID NO: 3893830 - RNA, 16 nt, Human
agcaccguucugugca

SEQ ID NO: 3893831 - RNA, 17 nt, Human
agcaccguucugugcac

SEQ ID NO: 3893832 - RNA, 14 nt, Human
agcaccuacagugu

SEQ ID NO: 3893833 - RNA, 19 nt, Human
agcaccuacaguguacagu

SEQ ID NO: 3893834 - RNA, 21 nt, Human
agcaccuacaguguacagucu

SEQ ID NO: 3893835 - RNA, 15 nt, Human
agcaccuacuuacau

SEQ ID NO: 3893836 - RNA, 14 nt, Human
agcaccucagccug

SEQ ID NO: 3893837 - RNA, 20 nt, Human
agcaccuccagccugaacag

SEQ ID NO: 3893838 - RNA, 16 nt, Human
agcaccuccaggccug

SEQ ID NO: 3893839 - RNA, 17 nt, Human
agcaccuccaggccugu

SEQ ID NO: 3893840 - RNA, 14 nt, Human
agcaccucccagcc

SEQ ID NO: 3893841 - RNA, 15 nt, Human
agcaccuccucagcc

SEQ ID NO: 3893842 - RNA, 16 nt, Human
agcaccugaacaguuu

SEQ ID NO: 3893843 - RNA, 22 nt, Human
agcaccugcccuaccugcccca

SEQ ID NO: 3893844 - RNA, 15 nt, Human
agcaccugccgaccu

SEQ ID NO: 3893845 - RNA, 20 nt, Human
agcaccugccgaccucgucc

SEQ ID NO: 3893846 - RNA, 22 nt, Human
agcaccugccgaccucguccuc

SEQ ID NO: 3893847 - RNA, 14 nt, Human
agcaccugccuccu

SEQ ID NO: 3893848 - RNA, 18 nt, Human
agcaccugccuccucguu

SEQ ID NO: 3893849 - RNA, 20 nt, Human
agcaccugcuucaugcucag

SEQ ID NO: 3893850 - RNA, 19 nt, Human
agcaccuuagacagucccu

SEQ ID NO: 3893851 - RNA, 20 nt, Human
agcaccuuagacagucccug

SEQ ID NO: 3893852 - RNA, 21 nt, Human
agcaccuuagacagucccugc

SEQ ID NO: 3893853 - RNA, 23 nt, Human
agcaccuuagacagucccugcca

SEQ ID NO: 3893854 - RNA, 19 nt, Human
agcaccuuccucacuucca

SEQ ID NO: 3893855 - RNA, 13 nt, Human
agcacgauuucug

SEQ ID NO: 3893856 - RNA, 21 nt, Human
agcacgauuucuguuuagaua

SEQ ID NO: 3893857 - RNA, 13 nt, Human
agcacggacaaua

SEQ ID NO: 3893858 - RNA, 17 nt, Human
agcacggacucuuacug

SEQ ID NO: 3893859 - RNA, 23 nt, Human
agcacuaaagcaguggacaccag

SEQ ID NO: 3893860 - RNA, 20 nt, Human
agcacuaaggugugcucuga

SEQ ID NO: 3893861 - RNA, 17 nt, Human
agcacuacucugugcca

SEQ ID NO: 3893862 - RNA, 14 nt, Human
agcacuacugggug

SEQ ID NO: 3893863 - RNA, 15 nt, Human
agcacuacugggugu

SEQ ID NO: 3893864 - RNA, 17 nt, Human
agcacuacuggguguca

SEQ ID NO: 3893865 - RNA, 19 nt, Human
agcacuacugggugucauu

SEQ ID NO: 3893866 - RNA, 20 nt, Human
agcacuacugggugucauuu

SEQ ID NO: 3893867 - RNA, 22 nt, Human
agcacuacugggugucauuuca

SEQ ID NO: 3893868 - RNA, 15 nt, Human
agcacucaggcucuc

SEQ ID NO: 3893869 - RNA, 17 nt, Human
agcacucaggcucucca

SEQ ID NO: 3893870 - RNA, 18 nt, Human
agcacucauuuucuauaa

SEQ ID NO: 3893871 - RNA, 21 nt, Human
agcacuccucgguacucccau

SEQ ID NO: 3893872 - RNA, 20 nt, Human
agcacuccugcuuaaucuuc

SEQ ID NO: 3893873 - RNA, 20 nt, Human
agcacucgcuagcaguggca

SEQ ID NO: 3893874 - RNA, 23 nt, Human
agcacucgcuagcaguggcaggc

SEQ ID NO: 3893875 - RNA, 19 nt, Human
agcacucugaguuuaccau

SEQ ID NO: 3893876 - RNA, 18 nt, Human
agcacugaaccugggaaa

SEQ ID NO: 3893877 - RNA, 13 nt, Human
agcacugacagau

SEQ ID NO: 3893878 - RNA, 23 nt, Human
agcacugacuagggaaaugauca

SEQ ID NO: 3893879 - RNA, 17 nt, Human
agcacugagcaaguuga

SEQ ID NO: 3893880 - RNA, 13 nt, Human
agcacugauuuca

SEQ ID NO: 3893881 - RNA, 12 nt, Human
agcacugccagg

SEQ ID NO: 3893882 - RNA, 13 nt, Human
agcacugccagga

SEQ ID NO: 3893883 - RNA, 17 nt, Human
agcacugccaggaggga

SEQ ID NO: 3893884 - RNA, 12 nt, Human
agcacugcccaa

SEQ ID NO: 3893885 - RNA, 13 nt, Human
agcaggaccucug

SEQ ID NO: 3893886 - RNA, 18 nt, Human
agcaggacuccaggccca

SEQ ID NO: 3893887 - RNA, 19 nt, Human
agcaggacuccaggcccaa

SEQ ID NO: 3893888 - RNA, 23 nt, Human
agcaggacuccaggcccaaggcu

SEQ ID NO: 3893889 - RNA, 16 nt, Human
agcaggacugaugucu

SEQ ID NO: 3893890 - RNA, 19 nt, Human
agcaggacugaugucuccu

SEQ ID NO: 3893891 - RNA, 22 nt, Human
agcaggagacgacaggcgagag

SEQ ID NO: 3893892 - RNA, 14 nt, Human
agcaggagaggaga

SEQ ID NO: 3893893 - RNA, 23 nt, Human
agcaggagauugagaaggagaga

SEQ ID NO: 3893894 - RNA, 14 nt, Human
agcaggaggccagg

SEQ ID NO: 3893895 - RNA, 15 nt, Human
agcaggaggccaggc

SEQ ID NO: 3893896 - RNA, 15 nt, Human
agcaggaggccccug

SEQ ID NO: 3893897 - RNA, 16 nt, Human
agcaggaggccccugg

SEQ ID NO: 3893898 - RNA, 16 nt, Human
agcaggaggccuagga

SEQ ID NO: 3893899 - RNA, 18 nt, Human
agcaggagggacagucuc

SEQ ID NO: 3893900 - RNA, 20 nt, Human
agcaggaguggugcagacag

SEQ ID NO: 3893901 - RNA, 21 nt, Human
agcaggauuuuuuuguagaga

SEQ ID NO: 3893902 - RNA, 16 nt, Human
agcaggcagccagcau

SEQ ID NO: 3893903 - RNA, 18 nt, Human
agcaggccaaggucugag

SEQ ID NO: 3893904 - RNA, 22 nt, Human
agcaggccaaggucugagccac

SEQ ID NO: 3893905 - RNA, 19 nt, Human
agcaggccagguccagaga

SEQ ID NO: 3893906 - RNA, 13 nt, Human
agcaggcccaccu

SEQ ID NO: 3893907 - RNA, 12 nt, Human
agcaggccuugc

SEQ ID NO: 3893908 - RNA, 21 nt, Human
agcaggccuuuugauauuaaa

SEQ ID NO: 3893909 - RNA, 17 nt, Human
agcaggcgcugugcuau

SEQ ID NO: 3893910 - RNA, 21 nt, Human
agcaggcgguggggagagaug

SEQ ID NO: 3893911 - RNA, 16 nt, Human
agcaggcuacugucag

SEQ ID NO: 3893912 - RNA, 17 nt, Human
agcaggcucgggcuccc

SEQ ID NO: 3893913 - RNA, 21 nt, Human
agcaggcucucaggccagcug

SEQ ID NO: 3893914 - RNA, 20 nt, Human
agcaggcugccagugccugg

SEQ ID NO: 3893915 - RNA, 16 nt, Human
agcaggcuggcagcuc

SEQ ID NO: 3893916 - RNA, 17 nt, Human
agcaggcuggcagcucu

SEQ ID NO: 3893917 - RNA, 22 nt, Human
agcaggcuucuaugaaagacuc

SEQ ID NO: 3893918 - RNA, 15 nt, Human
agcagggaaacagcu

SEQ ID NO: 3893919 - RNA, 12 nt, Human
agcagggaaggc

SEQ ID NO: 3893920 - RNA, 19 nt, Human
agcagggauuaaccucugc

SEQ ID NO: 3893921 - RNA, 14 nt, Human
agcagggcucagcg

SEQ ID NO: 3893922 - RNA, 15 nt, Human
agcagggcucagcgg

SEQ ID NO: 3893923 - RNA, 16 nt, Human
agcaggggcuacaaga

SEQ ID NO: 3893924 - RNA, 18 nt, Human
agcagggucuuuucaucu

SEQ ID NO: 3893925 - RNA, 22 nt, Human
agcagggucuuuucaucuggga

SEQ ID NO: 3893926 - RNA, 19 nt, Human
agcagggugggcuuguggg

SEQ ID NO: 3893927 - RNA, 17 nt, Human
agcaggguguugggaua

SEQ ID NO: 3893928 - RNA, 23 nt, Human
agcaggugauuggaccaggccau

SEQ ID NO: 3893929 - RNA, 16 nt, Human
agcaggugcugcuacc

SEQ ID NO: 3893930 - RNA, 16 nt, Human
agcagguggcaucucu

SEQ ID NO: 3893931 - RNA, 17 nt, Human
agcaggugguccugaga

SEQ ID NO: 3893932 - RNA, 18 nt, Human
agcaggugguccugagac

SEQ ID NO: 3893933 - RNA, 18 nt, Human
agcaggugugagggcagu

SEQ ID NO: 3893934 - RNA, 14 nt, Human
agcagguuaaaugu

SEQ ID NO: 3893935 - RNA, 15 nt, Human
agcagguuaaauguu

SEQ ID NO: 3893936 - RNA, 16 nt, Human
agcagguuaaauguuu

SEQ ID NO: 3893937 - RNA, 14 nt, Human
agcagguuagagaa

SEQ ID NO: 3893938 - RNA, 23 nt, Human
agcagguucccaagcucagaggc

SEQ ID NO: 3893939 - RNA, 20 nt, Human
agcagguugaggggcuccug

SEQ ID NO: 3893940 - RNA, 22 nt, Human
agcagguugaggggcuccugga

SEQ ID NO: 3893941 - RNA, 18 nt, Human
agcagguugauaaaucau

SEQ ID NO: 3893942 - RNA, 14 nt, Human
agcagguuucaagg

SEQ ID NO: 3893943 - RNA, 17 nt, Human
agcagguuuuucuccuc

SEQ ID NO: 3893944 - RNA, 13 nt, Human
agcaguaaaauag

SEQ ID NO: 3893945 - RNA, 20 nt, Human
agcaguaaauuugcuagcag

SEQ ID NO: 3893946 - RNA, 14 nt, Human
agcaguagacauuu

SEQ ID NO: 3893947 - RNA, 23 nt, Human
agcaguagacauuuuaacaagaa

SEQ ID NO: 3893948 - RNA, 16 nt, Human
agcaguauauuaguau

SEQ ID NO: 3893949 - RNA, 13 nt, Human
agcaguauuuugg

SEQ ID NO: 3893950 - RNA, 16 nt, Human
agcaguccccuucccu

SEQ ID NO: 3893951 - RNA, 17 nt, Human
agcagucgugccugugu

SEQ ID NO: 3893952 - RNA, 19 nt, Human
agcagucgugccugugucc

SEQ ID NO: 3893953 - RNA, 21 nt, Human
agcagucuacccaccucagcc

SEQ ID NO: 3893954 - RNA, 15 nt, Human
agcagucucugccuu

SEQ ID NO: 3893955 - RNA, 20 nt, Human
agcagucucugccuugccuu

SEQ ID NO: 3893956 - RNA, 21 nt, Human
agcagugagaaaaagcuccug

SEQ ID NO: 3893957 - RNA, 16 nt, Human
agcagugagagcagau

SEQ ID NO: 3893958 - RNA, 13 nt, Human
agcagugagcaga

SEQ ID NO: 3893959 - RNA, 22 nt, Human
agcagugagccgcaucuucucc

SEQ ID NO: 3893960 - RNA, 17 nt, Human
agcagugcaugcugucc

SEQ ID NO: 3893961 - RNA, 16 nt, Human
agcagugcccaggugg

SEQ ID NO: 3893962 - RNA, 23 nt, Human
agcagugcccagguggcugugga

SEQ ID NO: 3893963 - RNA, 16 nt, Human
agcagugccuuccaua

SEQ ID NO: 3893964 - RNA, 16 nt, Human
agcgggucugcuccca

SEQ ID NO: 3893965 - RNA, 19 nt, Human
agcgguaccaaugcagaac

SEQ ID NO: 3893966 - RNA, 22 nt, Human
agcggucucaggcuggugggag

SEQ ID NO: 3893967 - RNA, 23 nt, Human
agcggucucaggcuggugggagg

SEQ ID NO: 3893968 - RNA, 15 nt, Human
agcgguggcccuguc

SEQ ID NO: 3893969 - RNA, 19 nt, Human
agcgguuuggggagcagag

SEQ ID NO: 3893970 - RNA, 22 nt, Human
agcgguuuggggagcagagaca

SEQ ID NO: 3893971 - RNA, 13 nt, Human
agcguaaaauggu

SEQ ID NO: 3893972 - RNA, 18 nt, Human
agcguacucaucaucaac

SEQ ID NO: 3893973 - RNA, 23 nt, Human
agcguagcuaagugaaaagguca

SEQ ID NO: 3893974 - RNA, 17 nt, Human
agcguagugcagcaggg

SEQ ID NO: 3893975 - RNA, 23 nt, Human
agcgucaggguuggugugcugag

SEQ ID NO: 3893976 - RNA, 13 nt, Human
agcgucccagucu

SEQ ID NO: 3893977 - RNA, 16 nt, Human
agcgucccagucucug

SEQ ID NO: 3893978 - RNA, 18 nt, Human
agcgucccagucucuggc

SEQ ID NO: 3893979 - RNA, 15 nt, Human
agcguccuccucugu

SEQ ID NO: 3893980 - RNA, 19 nt, Human
agcguccuccucugugacc

SEQ ID NO: 3893981 - RNA, 15 nt, Human
agcgugagccacugc

SEQ ID NO: 3893982 - RNA, 20 nt, Human
agcgugcuccagccuggcuc

SEQ ID NO: 3893983 - RNA, 13 nt, Human
agcguggacuggu

SEQ ID NO: 3893984 - RNA, 21 nt, Human
agcguggcgcaguggcccuga

SEQ ID NO: 3893985 - RNA, 24 nt, Human
agcguggcgcaguggcccugagca

SEQ ID NO: 3893986 - RNA, 17 nt, Human
agcguggcugugcucuc

SEQ ID NO: 3893987 - RNA, 20 nt, Human
agcgugguggacaugcacag

SEQ ID NO: 3893988 - RNA, 23 nt, Human
agcgugguggacaugcacagcua

SEQ ID NO: 3893989 - RNA, 18 nt, Human
agcguguuuacaugugua

SEQ ID NO: 3893990 - RNA, 12 nt, Human
agcguucuugua

SEQ ID NO: 3893991 - RNA, 14 nt, Human
agcguugcaugucg

SEQ ID NO: 3893992 - RNA, 21 nt, Human
agcguuugaggggcuggccuu

SEQ ID NO: 3893993 - RNA, 22 nt, Human
agcguuugcccaaaucugccua

SEQ ID NO: 3893994 - RNA, 22 nt, Human
agcguuuugcaagguaaaauuu

SEQ ID NO: 3893995 - RNA, 19 nt, Human
agcguuuuuuaaauguaua

SEQ ID NO: 3893996 - RNA, 20 nt, Human
agcguuuuuuaaauguauac

SEQ ID NO: 3893997 - RNA, 18 nt, Human
agcuaaacuccuuccugg

SEQ ID NO: 3893998 - RNA, 23 nt, Human
agcuaaacuccuuccuggccuga

SEQ ID NO: 3893999 - RNA, 13 nt, Human
agcuaaagaggcu

SEQ ID NO: 3894000 - RNA, 15 nt, Human
agcuaaagaggcuga

SEQ ID NO: 3894001 - RNA, 16 nt, Human
agcuaacacacagcuc

SEQ ID NO: 3894002 - RNA, 18 nt, Human
agcuaacacacagcuccc

SEQ ID NO: 3894003 - RNA, 16 nt, Human
agcuaacagggaaggc

SEQ ID NO: 3894004 - RNA, 20 nt, Human
agcuaacagggaaggcaggc

SEQ ID NO: 3894005 - RNA, 22 nt, Human
agcuaacauuuuaaauaaaaga

SEQ ID NO: 3894006 - RNA, 19 nt, Human
agcuaacccagguccccuc

SEQ ID NO: 3894007 - RNA, 15 nt, Human
agcuaaccuuauccu

SEQ ID NO: 3894008 - RNA, 16 nt, Human
agcuaacuguaaauca

SEQ ID NO: 3894009 - RNA, 17 nt, Human adenovirus A
agccccuuaccaacacc

SEQ ID NO: 3894010 - RNA, 12 nt, Human adenovirus A
agccgucaaaau

SEQ ID NO: 3894011 - RNA, 15 nt, Human adenovirus A
agccugaaaaauaaa

SEQ ID NO: 3894012 - RNA, 12 nt, Human adenovirus A
agccuggauaaa

SEQ ID NO: 3894013 - RNA, 15 nt, Human adenovirus A
agcgacgagcaauua

SEQ ID NO: 3894014 - RNA, 17 nt, Human adenovirus A
agcgaucccauagcuca

SEQ ID NO: 3894015 - RNA, 13 nt, Human adenovirus A
agcgcacuggcau

SEQ ID NO: 3894016 - RNA, 15 nt, Human adenovirus A
agcgccagaggacca

SEQ ID NO: 3894017 - RNA, 17 nt, Human adenovirus A
agcgccgagccacagcc

SEQ ID NO: 3894018 - RNA, 17 nt, Human adenovirus A
agcggcauuccccaucc

SEQ ID NO: 3894019 - RNA, 18 nt, Human adenovirus A
agcggggaggaagcugag

SEQ ID NO: 3894020 - RNA, 14 nt, Human adenovirus A
agcggucuuaaaaa

SEQ ID NO: 3894021 - RNA, 18 nt, Human adenovirus A
agcgucuucguacuuaaa

SEQ ID NO: 3894022 - RNA, 21 nt, Human adenovirus A
agcguuucagcgccaacaaaa

SEQ ID NO: 3894023 - RNA, 16 nt, Human adenovirus A
agcuaaaucugccacu

SEQ ID NO: 3894024 - RNA, 19 nt, Human adenovirus A
agcuaagcgucugcauauc

SEQ ID NO: 3894025 - RNA, 23 nt, Human adenovirus A
agcuaugaugcgggcagccaggc

SEQ ID NO: 3894026 - RNA, 20 nt, Human adenovirus A
agcucaguuauauuuucuau

SEQ ID NO: 3894027 - RNA, 20 nt, Human adenovirus A
agcucaugugaaggcgccag

SEQ ID NO: 3894028 - RNA, 18 nt, Human adenovirus A
agcucauuggaguacaag

SEQ ID NO: 3894029 - RNA, 13 nt, Human adenovirus A
agcugaaaacaac

SEQ ID NO: 3894030 - RNA, 18 nt, Human adenovirus A
agcugaaaacaacugcac

SEQ ID NO: 3894031 - RNA, 13 nt, Human adenovirus A
agcugacggccau

SEQ ID NO: 3894032 - RNA, 19 nt, Human adenovirus A
agcugccguucguccucuu

SEQ ID NO: 3894033 - RNA, 17 nt, Human adenovirus A
agcuggcgggagggcau

SEQ ID NO: 3894034 - RNA, 18 nt, Human adenovirus A
agcuggguugguguugcu

SEQ ID NO: 3894035 - RNA, 14 nt, Human adenovirus A
agcuuagccuuaau

SEQ ID NO: 3894036 - RNA, 16 nt, Human adenovirus A
agcuuagccuuaauaa

SEQ ID NO: 3894037 - RNA, 19 nt, Human adenovirus A
agcuucagaugacuggaca

SEQ ID NO: 3894038 - RNA, 20 nt, Human adenovirus A
agcuucagaugacuggacag

SEQ ID NO: 3894039 - RNA, 21 nt, Human adenovirus A
agcuucuccagacaacuucau

SEQ ID NO: 3894040 - RNA, 22 nt, Human adenovirus A
agcuugaaacucuaacugcuca

SEQ ID NO: 3894041 - RNA, 17 nt, Human adenovirus A
aggaaaacaaacaacga

SEQ ID NO: 3894042 - RNA, 21 nt, Human adenovirus A
aggaaagacagccaagaccag

SEQ ID NO: 3894043 - RNA, 20 nt, Human adenovirus A
aggaacuccgcgcaaggagc

SEQ ID NO: 3894044 - RNA, 13 nt, Human adenovirus A
aggaagacagcau

SEQ ID NO: 3894045 - RNA, 15 nt, Human adenovirus A
aggaaugucuucacu

SEQ ID NO: 3894046 - RNA, 23 nt, Human adenovirus A
aggacacggaguguaccuugauc

SEQ ID NO: 3894047 - RNA, 15 nt, Human adenovirus A
aggaccccaaggcau

SEQ ID NO: 3894048 - RNA, 18 nt, Human adenovirus A
aggaggacuuugagccag

SEQ ID NO: 3894049 - RNA, 17 nt, Human adenovirus A
aggagguauuccuccuu

SEQ ID NO: 3894050 - RNA, 23 nt, Human adenovirus A
aggauccagaggaggaggaggaa

SEQ ID NO: 3894051 - RNA, 14 nt, Human adenovirus A
aggauguugggccc

SEQ ID NO: 3894052 - RNA, 17 nt, Human adenovirus A
aggauugggaguucaaa

SEQ ID NO: 3894053 - RNA, 12 nt, Human adenovirus A
aggcaaagaaca

SEQ ID NO: 3894054 - RNA, 12 nt, Human adenovirus A
aggcaacagaug

SEQ ID NO: 3894055 - RNA, 16 nt, Human adenovirus A
aggcaauuucugccau

SEQ ID NO: 3894056 - RNA, 14 nt, Human adenovirus A
aggcauuaaauggu

SEQ ID NO: 3894057 - RNA, 14 nt, Human adenovirus A
aggcgcuccuaaug

SEQ ID NO: 3894058 - RNA, 15 nt, Human adenovirus A
aggcggucugccauu

SEQ ID NO: 3894059 - RNA, 16 nt, Human adenovirus A
aggcugucacuuugca

SEQ ID NO: 3894060 - RNA, 21 nt, Human adenovirus A
agggagauguccuguuuaaac

SEQ ID NO: 3894061 - RNA, 22 nt, Human adenovirus A
agggcaaccacggccucagcag

SEQ ID NO: 3894062 - RNA, 12 nt, Human adenovirus A
aggggcucuuuu

SEQ ID NO: 3894063 - RNA, 19 nt, Human adenovirus A
agguaauuuucauucuucc

SEQ ID NO: 3894064 - RNA, 20 nt, Human adenovirus A
aggucgaggacuuggaagaa

SEQ ID NO: 3894065 - RNA, 14 nt, Human adenovirus A
agguggcuggacug

SEQ ID NO: 3894066 - RNA, 15 nt, Human adenovirus A
agguggcuggacugc

SEQ ID NO: 3894067 - RNA, 18 nt, Human adenovirus A
agguuccguuccuguugc

SEQ ID NO: 3894068 - RNA, 17 nt, Human adenovirus A
agguuuuuacauuccag

SEQ ID NO: 3894069 - RNA, 20 nt, Human adenovirus A
agguuuuuugggaugaaaaa

SEQ ID NO: 3894070 - RNA, 12 nt, Human adenovirus A
aguaaaaaaagc

SEQ ID NO: 3894071 - RNA, 22 nt, Human adenovirus A
aguaaaucuuccgccaaaggua

SEQ ID NO: 3894072 - RNA, 14 nt, Human adenovirus A
aguaggcuaacugu

SEQ ID NO: 3894073 - RNA, 22 nt, Human adenovirus A
aguaugcugaagaaacagaaga

SEQ ID NO: 3894074 - RNA, 21 nt, Human adenovirus A
aguauggugacgguucuucuc

SEQ ID NO: 3894075 - RNA, 14 nt, Human adenovirus A
aguauuuuguaaag

SEQ ID NO: 3894076 - RNA, 12 nt, Human adenovirus A
agucagcugcaa

SEQ ID NO: 3894077 - RNA, 17 nt, Human adenovirus A
aguccaagcaaguacaa

SEQ ID NO: 3894078 - RNA, 14 nt, Human adenovirus A
aguccaauuucguu

SEQ ID NO: 3894079 - RNA, 23 nt, Human adenovirus A
aguccguuuucuucuugagccca

SEQ ID NO: 3894080 - RNA, 18 nt, Human adenovirus A
agucgcaauuagggccag

SEQ ID NO: 3894081 - RNA, 19 nt, Human adenovirus A
agugaauggaacaccagca

SEQ ID NO: 3894082 - RNA, 22 nt, Human adenovirus A
agugaccgggacgcgugugcca

SEQ ID NO: 3894083 - RNA, 23 nt, Human adenovirus A
agugcccucacacuuaacacaag

SEQ ID NO: 3894084 - RNA, 19 nt, Human adenovirus A
agugcuggaaagugacauu

SEQ ID NO: 3894085 - RNA, 23 nt, Human adenovirus A
agugguauuccgcgguccuccuc

SEQ ID NO: 3894086 - RNA, 22 nt, Human adenovirus A
aguguacgcagacgaugacauu

SEQ ID NO: 3894087 - RNA, 15 nt, Human adenovirus A
aguguacuuggugga

SEQ ID NO: 3894088 - RNA, 17 nt, Human adenovirus A
aguguauggaaaaaacg

SEQ ID NO: 3894089 - RNA, 21 nt, Human adenovirus A
agugucauuuacugcagccug

SEQ ID NO: 3894090 - RNA, 12 nt, Human adenovirus A
agugucccaaca

SEQ ID NO: 3894091 - RNA, 20 nt, Human adenovirus A
aguguuuguuugaaaaaugu

SEQ ID NO: 3894092 - RNA, 18 nt, Human adenovirus A
aguuaauugauuuacaaa

SEQ ID NO: 3894093 - RNA, 17 nt, Human adenovirus A
aguuauauuuucuaugc

SEQ ID NO: 3894094 - RNA, 19 nt, Human adenovirus A
aguucaugcuaaaagcuuc

SEQ ID NO: 3894095 - RNA, 18 nt, Human adenovirus A
aguucuaaugcaaguugu

SEQ ID NO: 3894096 - RNA, 16 nt, Human adenovirus A
aguucuguuucaugua

SEQ ID NO: 3894097 - RNA, 13 nt, Human adenovirus A
aguugacuggcau

SEQ ID NO: 3894098 - RNA, 15 nt, Human adenovirus A
aguuuaaaggcauua

SEQ ID NO: 3894099 - RNA, 22 nt, Human adenovirus A
aguuuaacgaggugcagcugcc

SEQ ID NO: 3894100 - RNA, 14 nt, Human adenovirus A
aguuucuccuucua

SEQ ID NO: 3894101 - RNA, 19 nt, Human adenovirus A
aguuuucuuuuuucuuaca

SEQ ID NO: 3894102 - RNA, 22 nt, Human adenovirus A
auaaaacuaccugauaacaaga

SEQ ID NO: 3894103 - RNA, 14 nt, Human adenovirus A
auaaaauuucuaga

SEQ ID NO: 3894104 - RNA, 14 nt, Human adenovirus A
auaaacaucucaua

SEQ ID NO: 3894105 - RNA, 21 nt, Human adenovirus A
auaaagcgcagaguauccaca

SEQ ID NO: 3894106 - RNA, 21 nt, Human adenovirus A
auaaagcguucuguggauggg

SEQ ID NO: 3894107 - RNA, 14 nt, Human adenovirus A
auaacacagcuucu

SEQ ID NO: 3894108 - RNA, 14 nt, Human adenovirus A
auaaccaaucuaca

SEQ ID NO: 3894109 - RNA, 16 nt, Human adenovirus A
auaagcauuagagucg

SEQ ID NO: 3894110 - RNA, 20 nt, Human adenovirus A
auaauguaauugaaguaagc

SEQ ID NO: 3894111 - RNA, 13 nt, Human adenovirus A
auacaauguggcc

SEQ ID NO: 3894112 - RNA, 23 nt, Human adenovirus A
auacacucauguauuuuuucaaa

SEQ ID NO: 3894113 - RNA, 19 nt, Human adenovirus A
auacauaauuuuaaaguaa

SEQ ID NO: 3894114 - RNA, 22 nt, Human adenovirus A
auacauauaugggcucuuuuag

SEQ ID NO: 3894115 - RNA, 21 nt, Human adenovirus A
auaccacuuggcagcugccgu

SEQ ID NO: 3894116 - RNA, 17 nt, Human adenovirus A
auaccuuaaaaacuguu

SEQ ID NO: 3894117 - RNA, 21 nt, Human adenovirus A
auacgcgugguuaaacugccu

SEQ ID NO: 3894118 - RNA, 13 nt, Human adenovirus A
auacuaaagaaac

SEQ ID NO: 3894119 - RNA, 20 nt, Human adenovirus A
auacuaaauaucgcagcugg

SEQ ID NO: 3894120 - RNA, 13 nt, Human adenovirus A
auagaaaguuugg

SEQ ID NO: 3894121 - RNA, 16 nt, Human adenovirus A
auagcaacaacgcugg

SEQ ID NO: 3894122 - RNA, 18 nt, Human adenovirus A
auagcugaaccccagggu

SEQ ID NO: 3894123 - RNA, 15 nt, Human adenovirus A
auaggcauugggaau

SEQ ID NO: 3894124 - RNA, 16 nt, Human adenovirus A
auaggccaaacagcug

SEQ ID NO: 3894125 - RNA, 19 nt, Human adenovirus A
uuuguagcugaaaacaacu

SEQ ID NO: 3894126 - RNA, 15 nt, Human adenovirus A
uuuguauucugcuaa

SEQ ID NO: 3894127 - RNA, 16 nt, Human adenovirus A
uuuuaccuaaaccaca

SEQ ID NO: 3894128 - RNA, 14 nt, Human adenovirus A
uuuucuuagaugca

SEQ ID NO: 3894129 - RNA, 12 nt, Human adenovirus A
ccaguuaaugcu

SEQ ID NO: 3894130 - RNA, 19 nt, Human adenovirus A
ccaguuucaauugcagaac

SEQ ID NO: 3894131 - RNA, 20 nt, Human adenovirus A
ccaguuucaauugcagaacu

SEQ ID NO: 3894132 - RNA, 11 nt, Human adenovirus A
ccauaguucuu

SEQ ID NO: 3894133 - RNA, 20 nt, Human adenovirus A
ccauaucugaucgcucuuca

SEQ ID NO: 3894134 - RNA, 23 nt, Human adenovirus A
ccauccgugcguuaccacccuag

SEQ ID NO: 3894135 - RNA, 22 nt, Human adenovirus A
ccaucuugcuuguuuaaacauu

SEQ ID NO: 3894136 - RNA, 11 nt, Human adenovirus A
ccaugagcccg

SEQ ID NO: 3894137 - RNA, 16 nt, Human adenovirus A
ccaugcaaagccagcc

SEQ ID NO: 3894138 - RNA, 13 nt, Human adenovirus A
ccauggcuuccau

SEQ ID NO: 3894139 - RNA, 20 nt, Human adenovirus A
ccaugggaauagugcucuaa

SEQ ID NO: 3894140 - RNA, 12 nt, Human adenovirus A
ccauugacaaag

SEQ ID NO: 3894141 - RNA, 19 nt, Human adenovirus A
ccauugggagucagacccg

SEQ ID NO: 3894142 - RNA, 19 nt, Human adenovirus A
ccauuguaaaugcuuuguu

SEQ ID NO: 3894143 - RNA, 19 nt, Human adenovirus A
ccauuugaucagaaaaaac

SEQ ID NO: 3894144 - RNA, 21 nt, Human adenovirus A
ccauuuugguuucgccaagua

SEQ ID NO: 3894145 - RNA, 14 nt, Human adenovirus A
cccaacccuuccca

SEQ ID NO: 3894146 - RNA, 14 nt, Human adenovirus A
cccaacuuaacgca

SEQ ID NO: 3894147 - RNA, 13 nt, Human adenovirus A
cccaagggugcag

SEQ ID NO: 3894148 - RNA, 18 nt, Human adenovirus A
cccaaucaaauuacacac

SEQ ID NO: 3894149 - RNA, 14 nt, Human adenovirus A
cccacagccagugg

SEQ ID NO: 3894150 - RNA, 22 nt, Human adenovirus A
cccagggcaaccacggccucag

SEQ ID NO: 3894151 - RNA, 13 nt, Human adenovirus A
cccccguuaccaa

SEQ ID NO: 3894152 - RNA, 22 nt, Human adenovirus A
cccgcgguuuuggcggccaugc

SEQ ID NO: 3894153 - RNA, 23 nt, Human adenovirus A
cccgcgguuuuggcggccaugca

SEQ ID NO: 3894154 - RNA, 19 nt, Human adenovirus A
cccggauccguuccaacca

SEQ ID NO: 3894155 - RNA, 23 nt, Human adenovirus A
cccggcguaaccaaauacugcua

SEQ ID NO: 3894156 - RNA, 14 nt, Human adenovirus A
cccuacgugccucc

SEQ ID NO: 3894157 - RNA, 21 nt, Human adenovirus A
cccuccuggauuuuacacugg

SEQ ID NO: 3894158 - RNA, 20 nt, Human adenovirus A
cccucuuggccagcugcccu

SEQ ID NO: 3894159 - RNA, 17 nt, Human adenovirus A
cccugucaacagcauug

SEQ ID NO: 3894160 - RNA, 13 nt, Human adenovirus A
ccgaaagaccacu

SEQ ID NO: 3894161 - RNA, 13 nt, Human adenovirus A
ccgacaacacugu

SEQ ID NO: 3894162 - RNA, 14 nt, Human adenovirus A
ccgccgccaaaccg

SEQ ID NO: 3894163 - RNA, 17 nt, Human adenovirus A
ccgcggcgucagcagac

SEQ ID NO: 3894164 - RNA, 20 nt, Human adenovirus A
ccgcuacaccacguaaucaa

SEQ ID NO: 3894165 - RNA, 14 nt, Human adenovirus A
ccggcuuguugaau

SEQ ID NO: 3894166 - RNA, 21 nt, Human adenovirus A
ccguacaaggcauuggaaagc

SEQ ID NO: 3894167 - RNA, 21 nt, Human adenovirus A
ccguacaugggcaccuggaac

SEQ ID NO: 3894168 - RNA, 14 nt, Human adenovirus A
ccguuccuguugca

SEQ ID NO: 3894169 - RNA, 16 nt, Human adenovirus A
ccuaaauauuguauuu

SEQ ID NO: 3894170 - RNA, 21 nt, Human adenovirus A
ccuaauggagugucacugccg

SEQ ID NO: 3894171 - RNA, 20 nt, Human adenovirus A
ccuacacuuacgaauggaac

SEQ ID NO: 3894172 - RNA, 20 nt, Human adenovirus A
ccuacccuucuuuauguuuu

SEQ ID NO: 3894173 - RNA, 22 nt, Human adenovirus A
ccuacuuuguauacucuggaac

SEQ ID NO: 3894174 - RNA, 23 nt, Human adenovirus A
ccuaggcaacguuggcagcgacg

SEQ ID NO: 3894175 - RNA, 15 nt, Human adenovirus A
ccuauagaggcuggc

SEQ ID NO: 3894176 - RNA, 23 nt, Human adenovirus A
ccuccccuguggagccacugcua

SEQ ID NO: 3894177 - RNA, 12 nt, Human adenovirus A
ccuccuggaggu

SEQ ID NO: 3894178 - RNA, 17 nt, Human adenovirus A
ccucgaccugcaugucc

SEQ ID NO: 3894179 - RNA, 22 nt, Human adenovirus A
ccugacgccuucauacccaacu

SEQ ID NO: 3894180 - RNA, 12 nt, Human adenovirus A
ccugacgcucug

SEQ ID NO: 3894181 - RNA, 21 nt, Human adenovirus A
ccugauaacaagaacaccuac

SEQ ID NO: 3894182 - RNA, 22 nt, Human adenovirus A
ccugaugcuuuucgccagcagc

SEQ ID NO: 3894183 - RNA, 20 nt, Human adenovirus A
ccugauuucuaacuuguuuc

SEQ ID NO: 3894184 - RNA, 17 nt, Human adenovirus A
ccugccggucgagcgcg

SEQ ID NO: 3894185 - RNA, 19 nt, Human adenovirus A
ccugccggucgagcgcgga

SEQ ID NO: 3894186 - RNA, 16 nt, Human adenovirus A
ccugcgacaaaugcga

SEQ ID NO: 3894187 - RNA, 16 nt, Human adenovirus A
ccuggagcuguccaug

SEQ ID NO: 3894188 - RNA, 20 nt, Human adenovirus A
ccuggcaaacggguggaaaa

SEQ ID NO: 3894189 - RNA, 14 nt, Human adenovirus A
ccugguaaaacaag

SEQ ID NO: 3894190 - RNA, 20 nt, Human adenovirus A
ccugucuuaaaaucuccuga

SEQ ID NO: 3894191 - RNA, 15 nt, Human adenovirus A
ccugugcaaacugca

SEQ ID NO: 3894192 - RNA, 11 nt, Human adenovirus A
ccuguggagcc

SEQ ID NO: 3894193 - RNA, 12 nt, Human adenovirus A
ccuguggagcca

SEQ ID NO: 3894194 - RNA, 15 nt, Human adenovirus A
ccuuauccuuccagu

SEQ ID NO: 3894195 - RNA, 13 nt, Human adenovirus A
ccuugcaggcuuc

SEQ ID NO: 3894196 - RNA, 15 nt, Human adenovirus A
ccuuugcucaggcgc

SEQ ID NO: 3894197 - RNA, 23 nt, Human adenovirus A
cgaaaaaaaucacuuccgcauau

SEQ ID NO: 3894198 - RNA, 16 nt, Human adenovirus A
cgaaagaccacuaaaa

SEQ ID NO: 3894199 - RNA, 10 nt, Human adenovirus A
cgacaaaugc

SEQ ID NO: 3894200 - RNA, 12 nt, Human adenovirus A
cgacaacacugu

SEQ ID NO: 3894201 - RNA, 16 nt, Human adenovirus A
cgaccgccgccaaacc

SEQ ID NO: 3894202 - RNA, 18 nt, Human adenovirus A
cgacgcaaaaaaggggca

SEQ ID NO: 3894203 - RNA, 15 nt, Human adenovirus A
cgacgggccaggcgc

SEQ ID NO: 3894204 - RNA, 16 nt, Human adenovirus A
cgacgggccaggcgca

SEQ ID NO: 3894205 - RNA, 18 nt, Human adenovirus A
cgacguugcaagaggaga

SEQ ID NO: 3894206 - RNA, 16 nt, Human adenovirus A
cgagaacggagagggu

SEQ ID NO: 3894207 - RNA, 12 nt, Human adenovirus A
cgagccagcuga

SEQ ID NO: 3894208 - RNA, 15 nt, Human adenovirus A
cgagcuaaccgcagc

SEQ ID NO: 3894209 - RNA, 19 nt, Human adenovirus A
cgagcucccggaggaagcg

SEQ ID NO: 3894210 - RNA, 20 nt, Human adenovirus A
cgagcucccggaggaagcgg

SEQ ID NO: 3894211 - RNA, 14 nt, Human adenovirus A
cgaggucaagaaca

SEQ ID NO: 3894212 - RNA, 14 nt, Human adenovirus A
cgauguuauugacu

SEQ ID NO: 3894213 - RNA, 13 nt, Human adenovirus A
cgauuccaaggaa

SEQ ID NO: 3894214 - RNA, 15 nt, Human adenovirus A
cgauuuuccaaaugu

SEQ ID NO: 3894215 - RNA, 22 nt, Human adenovirus A
cgcaauuagggccagcauugcc

SEQ ID NO: 3894216 - RNA, 16 nt, Human adenovirus A
cgcacggccaaugccc

SEQ ID NO: 3894217 - RNA, 21 nt, Human adenovirus A
cgcagaccuacgguggcagcc

SEQ ID NO: 3894218 - RNA, 20 nt, Human adenovirus A
cgcagacgaugacauuuugg

SEQ ID NO: 3894219 - RNA, 15 nt, Human adenovirus A
cgcagcaacgcucaa

SEQ ID NO: 3894220 - RNA, 19 nt, Human adenovirus A
cgcagccgcgcagaugagc

SEQ ID NO: 3894221 - RNA, 17 nt, Human adenovirus A
cgcaggagaaaauaaca

SEQ ID NO: 3894222 - RNA, 19 nt, Human adenovirus A
cgcaguccugaugcuuuuc

SEQ ID NO: 3894223 - RNA, 23 nt, Human adenovirus A
cgcaguggucuuacaugcacauc

SEQ ID NO: 3894224 - RNA, 23 nt, Human adenovirus A
cgcaugcguaucucacuuaaguc

SEQ ID NO: 3894225 - RNA, 16 nt, Human adenovirus A
cgccauccgcaggcag

SEQ ID NO: 3894226 - RNA, 18 nt, Human adenovirus A
cgcccacucuccugagcg

SEQ ID NO: 3894227 - RNA, 20 nt, Human adenovirus A
cgcccuuacagaucacggga

SEQ ID NO: 3894228 - RNA, 14 nt, Human adenovirus A
cgcgaaacuggggg

SEQ ID NO: 3894229 - RNA, 16 nt, Human adenovirus A
cgcgcacugggccagg

SEQ ID NO: 3894230 - RNA, 14 nt, Human adenovirus A
cgcgcggccagagc

SEQ ID NO: 3894231 - RNA, 18 nt, Human adenovirus A
cgcgugccaggcauuucc

SEQ ID NO: 3894232 - RNA, 12 nt, Human adenovirus A
cgcuccauccaa

SEQ ID NO: 3894233 - RNA, 13 nt, Human adenovirus A
cgcucucaccgcu

SEQ ID NO: 3894234 - RNA, 22 nt, Human adenovirus A
cgcucuggcaggggaagguguu

SEQ ID NO: 3894235 - RNA, 12 nt, Human adenovirus A
cgcugcagcuuc

SEQ ID NO: 3894236 - RNA, 16 nt, Human adenovirus A
cgcuggggcacagcuu

SEQ ID NO: 3894237 - RNA, 16 nt, Human adenovirus A
cgcuuuugccagacua

SEQ ID NO: 3894238 - RNA, 14 nt, Human adenovirus A
cggaaaucugaaaa

SEQ ID NO: 3894239 - RNA, 17 nt, Human adenovirus A
cggacagagcauucaug

SEQ ID NO: 3894240 - RNA, 18 nt, Human adenovirus A
cggacgcuggcaaugaca

SEQ ID NO: 3894241 - RNA, 16 nt, Human adenovirus A
cggaggaaagggcuga

SEQ ID NO: 3894242 - RNA, 21 nt, Human adenovirus A
cggaguucccacagaacauac

SEQ ID NO: 3894243 - RNA, 22 nt, Human adenovirus A
cggcaccuuuuaccuaaaccac

SEQ ID NO: 3894244 - RNA, 21 nt, Human adenovirus A
cggccuguuuuguuguauguu

SEQ ID NO: 3894245 - RNA, 18 nt, Human adenovirus A
cggcgauugauaucuuga

SEQ ID NO: 3894246 - RNA, 14 nt, Human adenovirus A
cuuaagcagugaaa

SEQ ID NO: 3894247 - RNA, 22 nt, Human adenovirus A
cuuaaggcgggguauguuuaga

SEQ ID NO: 3894248 - RNA, 18 nt, Human adenovirus A
cuuaagucuuuacaauaa

SEQ ID NO: 3894249 - RNA, 20 nt, Human adenovirus A
cuuaaugaacaaugcuauua

SEQ ID NO: 3894250 - RNA, 22 nt, Human adenovirus A
cuuaauuucaugguuugcuaac

SEQ ID NO: 3894251 - RNA, 12 nt, Human adenovirus A
cuuaauuucuag

SEQ ID NO: 3894252 - RNA, 14 nt, Human adenovirus A
cuuacauuuaauaa

SEQ ID NO: 3894253 - RNA, 16 nt, Human adenovirus A
cuuaccaaagccaugg

SEQ ID NO: 3894254 - RNA, 19 nt, Human adenovirus A
cuuacuacgacuugcuaac

SEQ ID NO: 3894255 - RNA, 18 nt, Human adenovirus A
cuuaguaacagcauauga

SEQ ID NO: 3894256 - RNA, 15 nt, Human adenovirus A
cuuaguuguaaauuc

SEQ ID NO: 3894257 - RNA, 20 nt, Human adenovirus A
cuucaaaguaccuuacaaac

SEQ ID NO: 3894258 - RNA, 18 nt, Human adenovirus A
cuucagcguccaugaaug

SEQ ID NO: 3894259 - RNA, 17 nt, Human adenovirus A
cuucauacccaacuuug

SEQ ID NO: 3894260 - RNA, 13 nt, Human adenovirus A
cuucaucuuuucu

SEQ ID NO: 3894261 - RNA, 15 nt, Human adenovirus A
cuuccaucaccuuug

SEQ ID NO: 3894262 - RNA, 12 nt, Human adenovirus A
cuuccuccugga

SEQ ID NO: 3894263 - RNA, 23 nt, Human adenovirus A
cuucguaaaagucuacugcaaaa

SEQ ID NO: 3894264 - RNA, 14 nt, Human adenovirus A
cuucuacuuuagaa

SEQ ID NO: 3894265 - RNA, 22 nt, Human adenovirus A
cuucucccugugcuucggcaag

SEQ ID NO: 3894266 - RNA, 10 nt, Human adenovirus A
cuucugccua

SEQ ID NO: 3894267 - RNA, 19 nt, Human adenovirus A
cuugagccuggauaaagcg

SEQ ID NO: 3894268 - RNA, 17 nt, Human adenovirus A
cuugcacaaauggaccc

SEQ ID NO: 3894269 - RNA, 18 nt, Human adenovirus A
cuugccgaaugcgcauac

SEQ ID NO: 3894270 - RNA, 17 nt, Human adenovirus A
cuugcuuccagacaaaa

SEQ ID NO: 3894271 - RNA, 19 nt, Human adenovirus A
cuuggaagaaugggaggag

SEQ ID NO: 3894272 - RNA, 21 nt, Human adenovirus A
cuuggaagaaugggaggagga

SEQ ID NO: 3894273 - RNA, 19 nt, Human adenovirus A
cuuggaauaaaauuucuag

SEQ ID NO: 3894274 - RNA, 20 nt, Human adenovirus A
cuuggaauaaaauuucuaga

SEQ ID NO: 3894275 - RNA, 22 nt, Human adenovirus A
cuuggcuucgaaugcugugaca

SEQ ID NO: 3894276 - RNA, 17 nt, Human adenovirus A
cuuggugguucugccuc

SEQ ID NO: 3894277 - RNA, 16 nt, Human adenovirus A
cuugucaacuacauaa

SEQ ID NO: 3894278 - RNA, 16 nt, Human adenovirus A
cuuguuuaaacauucg

SEQ ID NO: 3894279 - RNA, 21 nt, Human adenovirus A
cuuuaacggcgcgcaguccug

SEQ ID NO: 3894280 - RNA, 15 nt, Human adenovirus A
cuuuaagggcuggcg

SEQ ID NO: 3894281 - RNA, 22 nt, Human adenovirus A
cuuuaagggcuggcgcuuccau

SEQ ID NO: 3894282 - RNA, 16 nt, Human adenovirus A
cuuuaauaaaaacacu

SEQ ID NO: 3894283 - RNA, 14 nt, Human adenovirus A
cuuuaauguuucag

SEQ ID NO: 3894284 - RNA, 14 nt, Human adenovirus A
cuuucagcccauga

SEQ ID NO: 3894285 - RNA, 17 nt, Human adenovirus A
cuuuccaccucuaccuc

SEQ ID NO: 3894286 - RNA, 22 nt, Human adenovirus A
cuuucuaagguguguaaacaca

SEQ ID NO: 3894287 - RNA, 18 nt, Human adenovirus A
cuuugaauaguucaucuu

SEQ ID NO: 3894288 - RNA, 15 nt, Human adenovirus A
cuuugacaacauugc

SEQ ID NO: 3894289 - RNA, 18 nt, Human adenovirus A
cuuuggacuucugccuac

SEQ ID NO: 3894290 - RNA, 16 nt, Human adenovirus A
cuuuggaggcagcugg

SEQ ID NO: 3894291 - RNA, 21 nt, Human adenovirus A
cuuuguagaagcuuauguaca

SEQ ID NO: 3894292 - RNA, 14 nt, Human adenovirus A
cuuugugacuuccc

SEQ ID NO: 3894293 - RNA, 14 nt, Human adenovirus A
cuuuucaaacuuua

SEQ ID NO: 3894294 - RNA, 17 nt, Human adenovirus A
cuuuucuagaacaaaaa

SEQ ID NO: 3894295 - RNA, 16 nt, Human adenovirus A
cuuuucuuacauuacc

SEQ ID NO: 3894296 - RNA, 21 nt, Human adenovirus A
cuuuucuucguugagccaugu

SEQ ID NO: 3894297 - RNA, 20 nt, Human adenovirus A
cuuuuuuuuuccauaguucu

SEQ ID NO: 3894298 - RNA, 14 nt, Human adenovirus A
gaaacucccuuagu

SEQ ID NO: 3894299 - RNA, 14 nt, Human adenovirus A
gaaagaucacagcc

SEQ ID NO: 3894300 - RNA, 18 nt, Human adenovirus A
gaaagaucacagccagau

SEQ ID NO: 3894301 - RNA, 16 nt, Human adenovirus A
gaaagcagaugggaaa

SEQ ID NO: 3894302 - RNA, 21 nt, Human adenovirus A
gaaagcuuagccuuaauaacc

SEQ ID NO: 3894303 - RNA, 19 nt, Human adenovirus A
gaaaugcgagacugcaggu

SEQ ID NO: 3894304 - RNA, 17 nt, Human adenovirus A
gaacaaacagugccugu

SEQ ID NO: 3894305 - RNA, 22 nt, Human adenovirus A
gaacaaacgguuacagaggaac

SEQ ID NO: 3894306 - RNA, 23 nt, Human adenovirus A
gaacaaacgguuacagaggaacg

SEQ ID NO: 3894307 - RNA, 16 nt, Human adenovirus A
gaacacuuagagggag

SEQ ID NO: 3894308 - RNA, 17 nt, Human adenovirus A
gaacaucgcaaaacacg

SEQ ID NO: 3894309 - RNA, 15 nt, Human adenovirus A
gaaccgucugcauga

SEQ ID NO: 3894310 - RNA, 16 nt, Human adenovirus A
gaaccuuucaagaaag

SEQ ID NO: 3894311 - RNA, 16 nt, Human adenovirus A
gaacgacgaagucaca

SEQ ID NO: 3894312 - RNA, 23 nt, Human adenovirus A
gaacgcauauugcgcuauguaca

SEQ ID NO: 3894313 - RNA, 21 nt, Human adenovirus A
gaacggaacuacucagaacaa

SEQ ID NO: 3894314 - RNA, 21 nt, Human adenovirus A
gaacggucgauuucggcggcg

SEQ ID NO: 3894315 - RNA, 20 nt, Human adenovirus A
gaacguaacuuucaaaaaag

SEQ ID NO: 3894316 - RNA, 19 nt, Human adenovirus A
gaacuauuucuuguucuuc

SEQ ID NO: 3894317 - RNA, 16 nt, Human adenovirus A
gaacucgagugcaugc

SEQ ID NO: 3894318 - RNA, 17 nt, Human adenovirus A
gaacucgagugcaugca

SEQ ID NO: 3894319 - RNA, 13 nt, Human adenovirus A
gaacuugggcuac

SEQ ID NO: 3894320 - RNA, 17 nt, Human adenovirus A
gaagauuucugcuguca

SEQ ID NO: 3894321 - RNA, 13 nt, Human adenovirus A
gaagcacuggcaa

SEQ ID NO: 3894322 - RNA, 18 nt, Human adenovirus A
gaagccauguuaagaaau

SEQ ID NO: 3894323 - RNA, 15 nt, Human adenovirus A
gaaggaaaugauggc

SEQ ID NO: 3894324 - RNA, 17 nt, Human adenovirus A
gaaggguggggugcugc

SEQ ID NO: 3894325 - RNA, 19 nt, Human adenovirus A
gaagugccucaaagugaag

SEQ ID NO: 3894326 - RNA, 16 nt, Human adenovirus A
gaaucggcaacagcag

SEQ ID NO: 3894327 - RNA, 12 nt, Human adenovirus A
gaaugcucugga

SEQ ID NO: 3894328 - RNA, 20 nt, Human adenovirus A
gaaugggaggaaagacagcc

SEQ ID NO: 3894329 - RNA, 21 nt, Human adenovirus A
gaauuauucccgcagccaaca

SEQ ID NO: 3894330 - RNA, 22 nt, Human adenovirus A
gaauucgcaggcggucugccau

SEQ ID NO: 3894331 - RNA, 13 nt, Human adenovirus A
gaauuugaaaaca

SEQ ID NO: 3894332 - RNA, 12 nt, Human adenovirus A
gacaaaaagacu

SEQ ID NO: 3894333 - RNA, 19 nt, Human adenovirus A
gacaacauccuuuuucuac

SEQ ID NO: 3894334 - RNA, 17 nt, Human adenovirus A
gacaccauugaaaccag

SEQ ID NO: 3894335 - RNA, 18 nt, Human adenovirus A
gacacggcacgcggccgu

SEQ ID NO: 3894336 - RNA, 20 nt, Human adenovirus A
gacagagcgcggcugcgaca

SEQ ID NO: 3894337 - RNA, 17 nt, Human adenovirus A
gacagcuuuuauaugcg

SEQ ID NO: 3894338 - RNA, 24 nt, Human adenovirus A
gacagcuuuuauaugcgcauggcu

SEQ ID NO: 3894339 - RNA, 15 nt, Human adenovirus A
gacauaauuuuccca

SEQ ID NO: 3894340 - RNA, 22 nt, Human adenovirus A
gaccaaacgcaaguucaaagaa

SEQ ID NO: 3894341 - RNA, 18 nt, Human adenovirus A
gaccaauuaacaguuugc

SEQ ID NO: 3894342 - RNA, 15 nt, Human adenovirus A
gaccacagguggugg

SEQ ID NO: 3894343 - RNA, 12 nt, Human adenovirus A
gaccccaaggca

SEQ ID NO: 3894344 - RNA, 20 nt, Human adenovirus A
gacgaagcgucagcucguug

SEQ ID NO: 3894345 - RNA, 18 nt, Human adenovirus A
gacgagcaauuaacuaag

SEQ ID NO: 3894346 - RNA, 14 nt, Human adenovirus A
gacgcagugaguga

SEQ ID NO: 3894347 - RNA, 21 nt, Human adenovirus A
gacgccaacaggaucaaaaaa

SEQ ID NO: 3894348 - RNA, 18 nt, Human adenovirus A
gacgggagcaggaacaga

SEQ ID NO: 3894349 - RNA, 12 nt, Human adenovirus A
gacuaaaacaaa

SEQ ID NO: 3894350 - RNA, 15 nt, Human adenovirus A
gacucggcauaauac

SEQ ID NO: 3894351 - RNA, 21 nt, Human adenovirus A
gacugcagguuuagggccggu

SEQ ID NO: 3894352 - RNA, 16 nt, Human adenovirus A
gacugcugcgugagga

SEQ ID NO: 3894353 - RNA, 16 nt, Human adenovirus A
gacuggcugcuuugcg

SEQ ID NO: 3894354 - RNA, 13 nt, Human adenovirus A
gacugucaguguc

SEQ ID NO: 3894355 - RNA, 23 nt, Human adenovirus A
gacuguccagggcuuuuggcuuc

SEQ ID NO: 3894356 - RNA, 21 nt, Human adenovirus A
gacuuauuuuugauucaaaca

SEQ ID NO: 3894357 - RNA, 22 nt, Human adenovirus A
gagacgggccgcagcugcggcc

SEQ ID NO: 3894358 - RNA, 21 nt, Human adenovirus A
gagaucggcacgagccagcug

SEQ ID NO: 3894359 - RNA, 17 nt, Human adenovirus A
gagauuacgugcgagac

SEQ ID NO: 3894360 - RNA, 14 nt, Human adenovirus A
gagcagcaaaugcc

SEQ ID NO: 3894361 - RNA, 16 nt, Human adenovirus A
gagccguccagcagug

SEQ ID NO: 3894362 - RNA, 13 nt, Human adenovirus A
uaaccgcccccac

SEQ ID NO: 3894363 - RNA, 23 nt, Human adenovirus A
uaaccugggauacuaccgcugcu

SEQ ID NO: 3894364 - RNA, 13 nt, Human adenovirus A
uaaccuugcaaaa

SEQ ID NO: 3894365 - RNA, 17 nt, Human adenovirus A
uaacgaggugcagcugc

SEQ ID NO: 3894366 - RNA, 19 nt, Human adenovirus A
uaacgcuaccaccuaagaa

SEQ ID NO: 3894367 - RNA, 15 nt, Human adenovirus A
uaacuccgggagugu

SEQ ID NO: 3894368 - RNA, 13 nt, Human adenovirus A
uaagacuuacccc

SEQ ID NO: 3894369 - RNA, 21 nt, Human adenovirus A
uaagagcaaagguaucucuga

SEQ ID NO: 3894370 - RNA, 14 nt, Human adenovirus A
uaagauuguaauuu

SEQ ID NO: 3894371 - RNA, 22 nt, Human adenovirus A
uaaggcggcguccuuucucugu

SEQ ID NO: 3894372 - RNA, 13 nt, Human adenovirus A
uaaguuuaaaggc

SEQ ID NO: 3894373 - RNA, 13 nt, Human adenovirus A
uaauacuggcuaa

SEQ ID NO: 3894374 - RNA, 13 nt, Human adenovirus A
uaaucacaacaca

SEQ ID NO: 3894375 - RNA, 16 nt, Human adenovirus A
uaaucacaacacagca

SEQ ID NO: 3894376 - RNA, 16 nt, Human adenovirus A
uaauccuaggcaaaga

SEQ ID NO: 3894377 - RNA, 14 nt, Human adenovirus A
uaaugaaaacaaug

SEQ ID NO: 3894378 - RNA, 20 nt, Human adenovirus A
uaaugaggcuuuucauccag

SEQ ID NO: 3894379 - RNA, 13 nt, Human adenovirus A
uaaugcagcuuca

SEQ ID NO: 3894380 - RNA, 23 nt, Human adenovirus A
uaauggagcggcugacagagcgc

SEQ ID NO: 3894381 - RNA, 17 nt, Human adenovirus A
uaauuaagcgagcccaa

SEQ ID NO: 3894382 - RNA, 18 nt, Human adenovirus A
uaauugauuuacaaaccg

SEQ ID NO: 3894383 - RNA, 18 nt, Human adenovirus A
uaauuuuagauguuaauu

SEQ ID NO: 3894384 - RNA, 18 nt, Human adenovirus A
uacaaaaaguaacaacag

SEQ ID NO: 3894385 - RNA, 22 nt, Human adenovirus A
uacaaacuggaacuuaacaacu

SEQ ID NO: 3894386 - RNA, 13 nt, Human adenovirus A
uacaaaucuuuca

SEQ ID NO: 3894387 - RNA, 14 nt, Human adenovirus A
uacaaaucuuucaa

SEQ ID NO: 3894388 - RNA, 18 nt, Human adenovirus A
uacaaaugcuuagucauu

SEQ ID NO: 3894389 - RNA, 21 nt, Human adenovirus A
uacaacauuggauaccaaggu

SEQ ID NO: 3894390 - RNA, 19 nt, Human adenovirus A
uacaacugcuccccucaac

SEQ ID NO: 3894391 - RNA, 19 nt, Human adenovirus A
uacaagcacgccaaagcca

SEQ ID NO: 3894392 - RNA, 23 nt, Human adenovirus A
uacaaggaccgcauguauucuuu

SEQ ID NO: 3894393 - RNA, 11 nt, Human adenovirus A
uacaaggcauu

SEQ ID NO: 3894394 - RNA, 21 nt, Human adenovirus A
uacagaaaaaaauugccaacc

SEQ ID NO: 3894395 - RNA, 19 nt, Human adenovirus A
uacagccccuuugaagagc

SEQ ID NO: 3894396 - RNA, 15 nt, Human adenovirus A
uacauaauccagcaa

SEQ ID NO: 3894397 - RNA, 19 nt, Human adenovirus A
uacauccuuccauugugcc

SEQ ID NO: 3894398 - RNA, 21 nt, Human adenovirus A
uacauccuuccauugugccca

SEQ ID NO: 3894399 - RNA, 17 nt, Human adenovirus A
uacaucuuuuacuaaaa

SEQ ID NO: 3894400 - RNA, 18 nt, Human adenovirus A
uacauuaggcuccacacc

SEQ ID NO: 3894401 - RNA, 22 nt, Human adenovirus A
uaccaaauuauugcuuuccucu

SEQ ID NO: 3894402 - RNA, 15 nt, Human adenovirus A
uaccaacaccucaca

SEQ ID NO: 3894403 - RNA, 21 nt, Human adenovirus A
uaccaagguuuuuacauucca

SEQ ID NO: 3894404 - RNA, 12 nt, Human adenovirus A
uaccaaugaggc

SEQ ID NO: 3894405 - RNA, 22 nt, Human adenovirus A
uacccggcgauugauaucuuga

SEQ ID NO: 3894406 - RNA, 15 nt, Human adenovirus A
uaccgccugaagaag

SEQ ID NO: 3894407 - RNA, 23 nt, Human adenovirus A
uacgcagggaaaaauucuagccc

SEQ ID NO: 3894408 - RNA, 16 nt, Human adenovirus A
uacgguggcagccaag

SEQ ID NO: 3894409 - RNA, 18 nt, Human adenovirus A
uacuaaagaaacaaacua

SEQ ID NO: 3894410 - RNA, 16 nt, Human adenovirus A
uacuaacaccaaacuc

SEQ ID NO: 3894411 - RNA, 22 nt, Human adenovirus A
uacuaccgucaucucuacagcc

SEQ ID NO: 3894412 - RNA, 23 nt, Human adenovirus A
uacugaaaaauagugacguaaau

SEQ ID NO: 3894413 - RNA, 16 nt, Human adenovirus A
uacugcagccugucuu

SEQ ID NO: 3894414 - RNA, 16 nt, Human adenovirus A
uacugccaguucaugc

SEQ ID NO: 3894415 - RNA, 23 nt, Human adenovirus A
uacuucaccgcgcaagcuuucau

SEQ ID NO: 3894416 - RNA, 17 nt, Human adenovirus A
uacuuguaacuguggaa

SEQ ID NO: 3894417 - RNA, 24 nt, Human adenovirus A
uagaagccauguuaagaaaugaca

SEQ ID NO: 3894418 - RNA, 17 nt, Human adenovirus A
uagaaucggcaacagca

SEQ ID NO: 3894419 - RNA, 15 nt, Human adenovirus A
uagagcguucuggga

SEQ ID NO: 3894420 - RNA, 12 nt, Human adenovirus A
uagaugugcugu

SEQ ID NO: 3894421 - RNA, 12 nt, Human adenovirus A
uagcaaagccau

SEQ ID NO: 3894422 - RNA, 15 nt, Human adenovirus A
uagcagccuuuauuu

SEQ ID NO: 3894423 - RNA, 16 nt, Human adenovirus A
uagcccaauugcaugc

SEQ ID NO: 3894424 - RNA, 17 nt, Human adenovirus A
uagccgcagcaccugga

SEQ ID NO: 3894425 - RNA, 18 nt, Human adenovirus A
uagccugcuuucagcacu

SEQ ID NO: 3894426 - RNA, 17 nt, Human adenovirus A
uagcugcaguuugucau

SEQ ID NO: 3894427 - RNA, 19 nt, Human adenovirus A
uaggcagcagcagcaacac

SEQ ID NO: 3894428 - RNA, 17 nt, Human adenovirus A
uagggaugcaaugcuua

SEQ ID NO: 3894429 - RNA, 20 nt, Human adenovirus A
uaggggaugguuuaacauuc

SEQ ID NO: 3894430 - RNA, 11 nt, Human adenovirus A
uagucauauag

SEQ ID NO: 3894431 - RNA, 15 nt, Human adenovirus A
uaguccaguauaagg

SEQ ID NO: 3894432 - RNA, 13 nt, Human adenovirus A
uaguccguuuucu

SEQ ID NO: 3894433 - RNA, 16 nt, Human adenovirus A
uagucgcgcacugggc

SEQ ID NO: 3894434 - RNA, 11 nt, Human adenovirus A
uaguucaucuu

SEQ ID NO: 3894435 - RNA, 14 nt, Human adenovirus A
uaguuccguaaaga

SEQ ID NO: 3894436 - RNA, 21 nt, Human adenovirus A
uaguugcagcagaauuacugc

SEQ ID NO: 3894437 - RNA, 12 nt, Human adenovirus A
uaguuucuccac

SEQ ID NO: 3894438 - RNA, 11 nt, Human adenovirus A
uauacaaacuu

SEQ ID NO: 3894439 - RNA, 18 nt, Human adenovirus A
uauaguacugcuuccagg

SEQ ID NO: 3894440 - RNA, 21 nt, Human adenovirus A
uaucgcaccucguccuuuuug

SEQ ID NO: 3894441 - RNA, 12 nt, Human adenovirus A
uaucgcagcugg

SEQ ID NO: 3894442 - RNA, 15 nt, Human adenovirus A
uaugagucaaaguau

SEQ ID NO: 3894443 - RNA, 21 nt, Human adenovirus A
uaugcauagcuuacaaagggc

SEQ ID NO: 3894444 - RNA, 15 nt, Human adenovirus A
uauggauguuggaag

SEQ ID NO: 3894445 - RNA, 17 nt, Human adenovirus A
uauugccaccuuuuguu

SEQ ID NO: 3894446 - RNA, 22 nt, Human adenovirus A
ucaaacagccgaaagaccacua

SEQ ID NO: 3894447 - RNA, 18 nt, Human adenovirus A
ucaaacauuaugcuggaa

SEQ ID NO: 3894448 - RNA, 18 nt, Human adenovirus A
ucaaacgccgacgcugcu

SEQ ID NO: 3894449 - RNA, 20 nt, Human adenovirus A
ucaaacugccugacugaacc

SEQ ID NO: 3894450 - RNA, 16 nt, Human adenovirus A
ucaaaggcaggcauua

SEQ ID NO: 3894451 - RNA, 15 nt, Human adenovirus A
ucaacgugucaguuu

SEQ ID NO: 3894452 - RNA, 10 nt, Human adenovirus A
ucaauguuuu

SEQ ID NO: 3894453 - RNA, 13 nt, Human adenovirus A
ucacacuuaacac

SEQ ID NO: 3894454 - RNA, 16 nt, Human adenovirus A
ucacagccagaucaaa

SEQ ID NO: 3894455 - RNA, 18 nt, Human adenovirus A
ucacagcuuauucgccag

SEQ ID NO: 3894456 - RNA, 22 nt, Human adenovirus A
ucaccaugggaauagugcucua

SEQ ID NO: 3894457 - RNA, 12 nt, Human adenovirus A
ucaccuccaggu

SEQ ID NO: 3894458 - RNA, 13 nt, Human adenovirus A
ucacgccguagac

SEQ ID NO: 3894459 - RNA, 13 nt, Human adenovirus A
ucagccagagccg

SEQ ID NO: 3894460 - RNA, 22 nt, Human adenovirus A
ucagccagagccgcaaguagga

SEQ ID NO: 3894461 - RNA, 18 nt, Human adenovirus A
ucaggaagauuauacaaa

SEQ ID NO: 3894462 - RNA, 18 nt, Human adenovirus A
ucaguacacuuuaaaugc

SEQ ID NO: 3894463 - RNA, 16 nt, Human adenovirus A
ucaguguccaucagcc

SEQ ID NO: 3894464 - RNA, 21 nt, Human adenovirus A
ucauaagacaaagccucugua

SEQ ID NO: 3894465 - RNA, 12 nt, Human adenovirus A
ucauaagcugug

SEQ ID NO: 3894466 - RNA, 21 nt, Human adenovirus A
ucauaccuuaaaaacuguuca

SEQ ID NO: 3894467 - RNA, 19 nt, Human adenovirus A
ucauauugugagccacagu

SEQ ID NO: 3894468 - RNA, 14 nt, Human adenovirus A
ucaucaaacugccu

SEQ ID NO: 3894469 - RNA, 23 nt, Human adenovirus A
ucaucaacauuaaccuaugcaac

SEQ ID NO: 3894470 - RNA, 16 nt, Human adenovirus A
ucauccacaucuacaa

SEQ ID NO: 3894471 - RNA, 15 nt, Human adenovirus A
ucauccgcccaaacu

SEQ ID NO: 3894472 - RNA, 15 nt, Human adenovirus A
ucauccucagcuccg

SEQ ID NO: 3894473 - RNA, 16 nt, Human adenovirus A
ucaucucuacagcccc

SEQ ID NO: 3894474 - RNA, 12 nt, Human adenovirus A
ucaugaaacucu

SEQ ID NO: 3894475 - RNA, 16 nt, Human adenovirus A
ucauggagaaggacaa

SEQ ID NO: 3894476 - RNA, 23 nt, Human adenovirus A
ucauguaaaaugggaaaugaggc

SEQ ID NO: 3894477 - RNA, 22 nt, Human adenovirus A
ucauugguaccuucgaaaugca

SEQ ID NO: 3894478 - RNA, 20 nt, Human adenovirus A
uccaaauguucaacaacagc

SEQ ID NO: 3894479 - RNA, 15 nt, Human adenovirus A
agauuauacaaacuu

SEQ ID NO: 3894480 - RNA, 15 nt, Human adenovirus A
agauucuucuuccca

SEQ ID NO: 3894481 - RNA, 17 nt, Human adenovirus A
agcaaaacgcugggcuc

SEQ ID NO: 3894482 - RNA, 17 nt, Human adenovirus A
agcaaaccacugcaaug

SEQ ID NO: 3894483 - RNA, 13 nt, Human adenovirus A
agcaacuuuuuaa

SEQ ID NO: 3894484 - RNA, 19 nt, Human adenovirus A
agcaacuuuuuaaccacug

SEQ ID NO: 3894485 - RNA, 12 nt, Human adenovirus A
agcaagcggcac

SEQ ID NO: 3894486 - RNA, 21 nt, Human adenovirus A
agcacgccaaagccacaccuc

SEQ ID NO: 3894487 - RNA, 21 nt, Human adenovirus A
agcauucaugcugauguuugu

SEQ ID NO: 3894488 - RNA, 19 nt, Human adenovirus A
agccaaaccggccagaugc

SEQ ID NO: 3894489 - RNA, 23 nt, Human adenovirus A
agccaacuuaguaacagcauaug

SEQ ID NO: 3894490 - RNA, 14 nt, Human adenovirus A
agccauggaugaau

SEQ ID NO: 3894491 - RNA, 17 nt, Human adenovirus A
agcccaauugcaugcua

SEQ ID NO: 3894492 - RNA, 20 nt, Human adenovirus A
agcccgcgaaaaaaaucacu

SEQ ID NO: 3894493 - RNA, 15 nt, Human adenovirus A
agccgcagcaccugg

SEQ ID NO: 3894494 - RNA, 16 nt, Human adenovirus A
agccguagacgagguc

SEQ ID NO: 3894495 - RNA, 18 nt, Human adenovirus A
agccuucauuccuucaga

SEQ ID NO: 3894496 - RNA, 20 nt, Human adenovirus A
agccuucuggcguuacagcu

SEQ ID NO: 3894497 - RNA, 19 nt, Human adenovirus A
agcgacacuaucaccgccg

SEQ ID NO: 3894498 - RNA, 16 nt, Human adenovirus A
agcggcugacagagcg

SEQ ID NO: 3894499 - RNA, 16 nt, Human adenovirus A
agcgguaugucggccu

SEQ ID NO: 3894500 - RNA, 12 nt, Human adenovirus A
agcuaaaacaag

SEQ ID NO: 3894501 - RNA, 14 nt, Human adenovirus A
agcuauaaaaagag

SEQ ID NO: 3894502 - RNA, 15 nt, Human adenovirus A
agcugacggccauug

SEQ ID NO: 3894503 - RNA, 16 nt, Human adenovirus A
agcugagcaaugcuac

SEQ ID NO: 3894504 - RNA, 18 nt, Human adenovirus A
agcugaugcuacuaccca

SEQ ID NO: 3894505 - RNA, 23 nt, Human adenovirus A
agcugccaccgucaauucuucuu

SEQ ID NO: 3894506 - RNA, 15 nt, Human adenovirus A
agcuuaccacucaga

SEQ ID NO: 3894507 - RNA, 22 nt, Human adenovirus A
agcuucuaaaagagccacagcu

SEQ ID NO: 3894508 - RNA, 17 nt, Human adenovirus A
agcuucuacuuuagaag

SEQ ID NO: 3894509 - RNA, 16 nt, Human adenovirus A
aggaaaugauggcuuu

SEQ ID NO: 3894510 - RNA, 14 nt, Human adenovirus A
aggaagaacaucca

SEQ ID NO: 3894511 - RNA, 18 nt, Human adenovirus A
aggaagcaggugaugaag

SEQ ID NO: 3894512 - RNA, 16 nt, Human adenovirus A
aggaagguuccaagga

SEQ ID NO: 3894513 - RNA, 23 nt, Human adenovirus A
aggaauaucaacugcuaugugca

SEQ ID NO: 3894514 - RNA, 15 nt, Human adenovirus A
aggacaauccaagga

SEQ ID NO: 3894515 - RNA, 18 nt, Human adenovirus A
aggacacuggcaguuuag

SEQ ID NO: 3894516 - RNA, 23 nt, Human adenovirus A
aggagaaaauaacacauaagcau

SEQ ID NO: 3894517 - RNA, 13 nt, Human adenovirus A
aggagcagaaauc

SEQ ID NO: 3894518 - RNA, 15 nt, Human adenovirus A
aggagcuaaaacaag

SEQ ID NO: 3894519 - RNA, 18 nt, Human adenovirus A
aggagcuaaaacaagguc

SEQ ID NO: 3894520 - RNA, 15 nt, Human adenovirus A
aggagcugagaagug

SEQ ID NO: 3894521 - RNA, 14 nt, Human adenovirus A
aggaggaagaacau

SEQ ID NO: 3894522 - RNA, 17 nt, Human adenovirus A
aggagguggcuggacug

SEQ ID NO: 3894523 - RNA, 14 nt, Human adenovirus A
aggcauuuccaggu

SEQ ID NO: 3894524 - RNA, 21 nt, Human adenovirus A
aggccuaauggagugucacug

SEQ ID NO: 3894525 - RNA, 23 nt, Human adenovirus A
aggcgaucguucaacuuugucca

SEQ ID NO: 3894526 - RNA, 14 nt, Human adenovirus A
aggcgcucagugcg

SEQ ID NO: 3894527 - RNA, 19 nt, Human adenovirus A
aggcgcuccauccaaaacu

SEQ ID NO: 3894528 - RNA, 20 nt, Human adenovirus A
aggcguagaugugcugugga

SEQ ID NO: 3894529 - RNA, 12 nt, Human adenovirus A
aggcuggagcuu

SEQ ID NO: 3894530 - RNA, 22 nt, Human adenovirus A
agggcacaauaguuuaauguuu

SEQ ID NO: 3894531 - RNA, 21 nt, Human adenovirus A
agggcguacaguuuuggagcc

SEQ ID NO: 3894532 - RNA, 19 nt, Human adenovirus A
aggggaagguguugagccc

SEQ ID NO: 3894533 - RNA, 20 nt, Human adenovirus A
aggggaagguguugagcccg

SEQ ID NO: 3894534 - RNA, 14 nt, Human adenovirus A
agggguacuggauc

SEQ ID NO: 3894535 - RNA, 22 nt, Human adenovirus A
aggggucuauccuucaguggua

SEQ ID NO: 3894536 - RNA, 13 nt, Human adenovirus A
aggguacagugga

SEQ ID NO: 3894537 - RNA, 19 nt, Human adenovirus A
agggucggugauggaaacg

SEQ ID NO: 3894538 - RNA, 14 nt, Human adenovirus A
aggguuugcauuua

SEQ ID NO: 3894539 - RNA, 23 nt, Human adenovirus A
agguaaugguagaggaaaagcug

SEQ ID NO: 3894540 - RNA, 16 nt, Human adenovirus A
agguauuccuccuuau

SEQ ID NO: 3894541 - RNA, 22 nt, Human adenovirus A
aggugacaugauaugaaguuuu

SEQ ID NO: 3894542 - RNA, 24 nt, Human adenovirus A
aggugcaagaaggccauguacuug

SEQ ID NO: 3894543 - RNA, 19 nt, Human adenovirus A
agguguaaccagcugggca

SEQ ID NO: 3894544 - RNA, 16 nt, Human adenovirus A
agguuagccugaaaaa

SEQ ID NO: 3894545 - RNA, 14 nt, Human adenovirus A
agguuuaauguuua

SEQ ID NO: 3894546 - RNA, 22 nt, Human adenovirus A
agguuuaggucgggaugaaaaa

SEQ ID NO: 3894547 - RNA, 24 nt, Human adenovirus A
aguaacaacacgggcuggggacug

SEQ ID NO: 3894548 - RNA, 17 nt, Human adenovirus A
aguaagcgccagucgcc

SEQ ID NO: 3894549 - RNA, 14 nt, Human adenovirus A
aguacaaauuuuuc

SEQ ID NO: 3894550 - RNA, 18 nt, Human adenovirus A
aguacgucagaauguggu

SEQ ID NO: 3894551 - RNA, 13 nt, Human adenovirus A
aguagccuugcag

SEQ ID NO: 3894552 - RNA, 15 nt, Human adenovirus A
agucaacuaaaaauu

SEQ ID NO: 3894553 - RNA, 14 nt, Human adenovirus A
agucaccaccagcg

SEQ ID NO: 3894554 - RNA, 21 nt, Human adenovirus A
agucacucaagcggcauuccc

SEQ ID NO: 3894555 - RNA, 23 nt, Human adenovirus A
agucagacccgacggaguguuuc

SEQ ID NO: 3894556 - RNA, 14 nt, Human adenovirus A
agucauauagcuca

SEQ ID NO: 3894557 - RNA, 20 nt, Human adenovirus A
agucccauuacaguaauaaa

SEQ ID NO: 3894558 - RNA, 17 nt, Human adenovirus A
agucgcaauuagggcca

SEQ ID NO: 3894559 - RNA, 15 nt, Human adenovirus A
agucgcacuuuuuaa

SEQ ID NO: 3894560 - RNA, 19 nt, Human adenovirus A
agucgccgugguugguggg

SEQ ID NO: 3894561 - RNA, 17 nt, Human adenovirus A
agucucaaaagcagcca

SEQ ID NO: 3894562 - RNA, 23 nt, Human adenovirus A
agucuugaaugcucuggacaugg

SEQ ID NO: 3894563 - RNA, 21 nt, Human adenovirus A
agugaauggaacaccagcauu

SEQ ID NO: 3894564 - RNA, 20 nt, Human adenovirus A
agugaggacacugaaggcau

SEQ ID NO: 3894565 - RNA, 24 nt, Human adenovirus A
agugccucaaagugaaguguauca

SEQ ID NO: 3894566 - RNA, 17 nt, Human adenovirus A
agugcuggaaagugaca

SEQ ID NO: 3894567 - RNA, 22 nt, Human adenovirus A
agugcuuucaacaaaaaaaaag

SEQ ID NO: 3894568 - RNA, 15 nt, Human adenovirus A
aguggcugcaagguc

SEQ ID NO: 3894569 - RNA, 12 nt, Human adenovirus A
aguguuucagcu

SEQ ID NO: 3894570 - RNA, 23 nt, Human adenovirus A
aguucuucuucgcuuucggaauc

SEQ ID NO: 3894571 - RNA, 11 nt, Human adenovirus A
aguugacuggc

SEQ ID NO: 3894572 - RNA, 11 nt, Human adenovirus A
aguuucuggag

SEQ ID NO: 3894573 - RNA, 16 nt, Human adenovirus A
auaaaacugauuuacc

SEQ ID NO: 3894574 - RNA, 18 nt, Human adenovirus A
gcaggaaaucugggagga

SEQ ID NO: 3894575 - RNA, 23 nt, Human adenovirus A
gcaggacuuuccggagaaagaau

SEQ ID NO: 3894576 - RNA, 16 nt, Human adenovirus A
gcaggaguugcaggau

SEQ ID NO: 3894577 - RNA, 17 nt, Human adenovirus A
gcaggcuggaggugcag

SEQ ID NO: 3894578 - RNA, 14 nt, Human adenovirus A
gcaguauggcagcu

SEQ ID NO: 3894579 - RNA, 11 nt, Human adenovirus A
gcauaaugaaa

SEQ ID NO: 3894580 - RNA, 20 nt, Human adenovirus A
gcauacccgaggacgcacug

SEQ ID NO: 3894581 - RNA, 15 nt, Human adenovirus A
gcauaugaacaaacg

SEQ ID NO: 3894582 - RNA, 19 nt, Human adenovirus A
gcaucuauaguaaaaaugc

SEQ ID NO: 3894583 - RNA, 14 nt, Human adenovirus A
gcauuaaagcaaac

SEQ ID NO: 3894584 - RNA, 15 nt, Human adenovirus A
gcauuaagccagaua

SEQ ID NO: 3894585 - RNA, 16 nt, Human adenovirus A
gcauucaccagccaca

SEQ ID NO: 3894586 - RNA, 19 nt, Human adenovirus A
gcauugcgauaaacuggau

SEQ ID NO: 3894587 - RNA, 14 nt, Human adenovirus A
gcauuucccaagau

SEQ ID NO: 3894588 - RNA, 13 nt, Human adenovirus A
gccaaacagcugu

SEQ ID NO: 3894589 - RNA, 16 nt, Human adenovirus A
gccaacaaaaaccccu

SEQ ID NO: 3894590 - RNA, 15 nt, Human adenovirus A
gccacagccccuagc

SEQ ID NO: 3894591 - RNA, 19 nt, Human adenovirus A
gccagauguaaaaguacgu

SEQ ID NO: 3894592 - RNA, 16 nt, Human adenovirus A
gccagcaagugccucc

SEQ ID NO: 3894593 - RNA, 18 nt, Human adenovirus A
gccauaauguaacccuuc

SEQ ID NO: 3894594 - RNA, 20 nt, Human adenovirus A
gccauccgcaaagaugaggc

SEQ ID NO: 3894595 - RNA, 22 nt, Human adenovirus A
gccaucuugcuuguuuaaacau

SEQ ID NO: 3894596 - RNA, 21 nt, Human adenovirus A
gccaugaacggggaauacuuu

SEQ ID NO: 3894597 - RNA, 15 nt, Human adenovirus A
gccauguugugcaua

SEQ ID NO: 3894598 - RNA, 14 nt, Human adenovirus A
gccauuuuggaagc

SEQ ID NO: 3894599 - RNA, 23 nt, Human adenovirus A
gcccaaacuuacaagcacgccaa

SEQ ID NO: 3894600 - RNA, 20 nt, Human adenovirus A
gcccagacguaggguacagu

SEQ ID NO: 3894601 - RNA, 14 nt, Human adenovirus A
gcccagcaugacca

SEQ ID NO: 3894602 - RNA, 23 nt, Human adenovirus A
gccccauccguggcaggccaucu

SEQ ID NO: 3894603 - RNA, 13 nt, Human adenovirus A
gcccgccuggcag

SEQ ID NO: 3894604 - RNA, 13 nt, Human adenovirus A
gcccugcuccgac

SEQ ID NO: 3894605 - RNA, 12 nt, Human adenovirus A
gccgcagcugcg

SEQ ID NO: 3894606 - RNA, 17 nt, Human adenovirus A
gccggaccccacaugau

SEQ ID NO: 3894607 - RNA, 14 nt, Human adenovirus A
gccuaauggagugu

SEQ ID NO: 3894608 - RNA, 14 nt, Human adenovirus A
gccuccgcugugcu

SEQ ID NO: 3894609 - RNA, 13 nt, Human adenovirus A
gccuccuucccau

SEQ ID NO: 3894610 - RNA, 14 nt, Human adenovirus A
gccucuucuucuuc

SEQ ID NO: 3894611 - RNA, 23 nt, Human adenovirus A
gccuucaaaacguguaccugccu

SEQ ID NO: 3894612 - RNA, 17 nt, Human adenovirus A
gccuucauuccuucaga

SEQ ID NO: 3894613 - RNA, 17 nt, Human adenovirus A
gcgaacaggagcugacg

SEQ ID NO: 3894614 - RNA, 17 nt, Human adenovirus A
gcgaacgggcagccugu

SEQ ID NO: 3894615 - RNA, 22 nt, Human adenovirus A
gcgaagaguuuuuacuuaaaaa

SEQ ID NO: 3894616 - RNA, 19 nt, Human adenovirus A
gcgacauuuagaccacugu

SEQ ID NO: 3894617 - RNA, 13 nt, Human adenovirus A
gcgaccucagccc

SEQ ID NO: 3894618 - RNA, 15 nt, Human adenovirus A
gcgagcccaacccau

SEQ ID NO: 3894619 - RNA, 14 nt, Human adenovirus A
gcgagcugccaccg

SEQ ID NO: 3894620 - RNA, 13 nt, Human adenovirus A
gcgaguaggaaga

SEQ ID NO: 3894621 - RNA, 16 nt, Human adenovirus A
gcgagucaccaucacu

SEQ ID NO: 3894622 - RNA, 18 nt, Human adenovirus A
gcgauacaacggccagcc

SEQ ID NO: 3894623 - RNA, 21 nt, Human adenovirus A
gcgcaaauuugaaccccaaga

SEQ ID NO: 3894624 - RNA, 20 nt, Human adenovirus A
gcgcagaccuacgguggcag

SEQ ID NO: 3894625 - RNA, 19 nt, Human adenovirus A
gcgcagaugagcuucuugc

SEQ ID NO: 3894626 - RNA, 21 nt, Human adenovirus A
gcgcccauaacaucaggagca

SEQ ID NO: 3894627 - RNA, 15 nt, Human adenovirus A
gcgcccuccaccgcc

SEQ ID NO: 3894628 - RNA, 19 nt, Human adenovirus A
gcgcggacgagcucccgga

SEQ ID NO: 3894629 - RNA, 15 nt, Human adenovirus A
gcgcucaaaggcagg

SEQ ID NO: 3894630 - RNA, 15 nt, Human adenovirus A
gcgcucagugcgagg

SEQ ID NO: 3894631 - RNA, 13 nt, Human adenovirus A
gcgcuccauccaa

SEQ ID NO: 3894632 - RNA, 20 nt, Human adenovirus A
gcgcuuuggaggcagcugga

SEQ ID NO: 3894633 - RNA, 16 nt, Human adenovirus A
gcggccacuaaagacc

SEQ ID NO: 3894634 - RNA, 16 nt, Human adenovirus A
gcggccauuggagccg

SEQ ID NO: 3894635 - RNA, 21 nt, Human adenovirus A
gcggccauuggagccguuccc

SEQ ID NO: 3894636 - RNA, 22 nt, Human adenovirus A
gcggcgagaaugggaggaaaga

SEQ ID NO: 3894637 - RNA, 14 nt, Human adenovirus A
gcggcguccuuucu

SEQ ID NO: 3894638 - RNA, 14 nt, Human adenovirus A
gcgggaagcggggg

SEQ ID NO: 3894639 - RNA, 15 nt, Human adenovirus A
gcggugguggagaag

SEQ ID NO: 3894640 - RNA, 20 nt, Human adenovirus A
gcgguuuaagaaaucuuuua

SEQ ID NO: 3894641 - RNA, 13 nt, Human adenovirus A
gcguacagccugg

SEQ ID NO: 3894642 - RNA, 20 nt, Human adenovirus A
gcgugaaguauuccaugagc

SEQ ID NO: 3894643 - RNA, 12 nt, Human adenovirus A
gcguggucagga

SEQ ID NO: 3894644 - RNA, 15 nt, Human adenovirus A
gcguguuagacaugg

SEQ ID NO: 3894645 - RNA, 12 nt, Human adenovirus A
gcguuuggaaac

SEQ ID NO: 3894646 - RNA, 20 nt, Human adenovirus A
gcuaaacgaccgccuuuucu

SEQ ID NO: 3894647 - RNA, 23 nt, Human adenovirus A
gcuaaccaggcauggccaucaua

SEQ ID NO: 3894648 - RNA, 17 nt, Human adenovirus A
cagcuucuaaaagagcc

SEQ ID NO: 3894649 - RNA, 19 nt, Human adenovirus A
caggaaaaaaaagaaaguu

SEQ ID NO: 3894650 - RNA, 14 nt, Human adenovirus A
caggacgcagaagc

SEQ ID NO: 3894651 - RNA, 23 nt, Human adenovirus A
caggaugaauuucagcgggguga

SEQ ID NO: 3894652 - RNA, 16 nt, Human adenovirus A
caggcauggccaucau

SEQ ID NO: 3894653 - RNA, 22 nt, Human adenovirus A
caggcuaaacgaccgccuuuuc

SEQ ID NO: 3894654 - RNA, 14 nt, Human adenovirus A
cagggauauguuuc

SEQ ID NO: 3894655 - RNA, 12 nt, Human adenovirus A
caggggccagcu

SEQ ID NO: 3894656 - RNA, 23 nt, Human adenovirus A
cagguauaaaggucgcacugagc

SEQ ID NO: 3894657 - RNA, 14 nt, Human adenovirus A
caguaauugaugag

SEQ ID NO: 3894658 - RNA, 16 nt, Human adenovirus A
caguacuucauauuug

SEQ ID NO: 3894659 - RNA, 14 nt, Human adenovirus A
cagucaaccgcgcu

SEQ ID NO: 3894660 - RNA, 20 nt, Human adenovirus A
cagucaaugcuucugaaaca

SEQ ID NO: 3894661 - RNA, 16 nt, Human adenovirus A
caguccugaugcuuuu

SEQ ID NO: 3894662 - RNA, 17 nt, Human adenovirus A
cagucgccgcagagagc

SEQ ID NO: 3894663 - RNA, 22 nt, Human adenovirus A
cagucuugaaugcucuggacau

SEQ ID NO: 3894664 - RNA, 18 nt, Human adenovirus A
cagugaagcaaaccacau

SEQ ID NO: 3894665 - RNA, 20 nt, Human adenovirus A
cagugagugaaucuguggau

SEQ ID NO: 3894666 - RNA, 18 nt, Human adenovirus A
cagugccagaagcacugg

SEQ ID NO: 3894667 - RNA, 20 nt, Human adenovirus A
cagugccagaagcacuggca

SEQ ID NO: 3894668 - RNA, 14 nt, Human adenovirus A
caguggacaaaaac

SEQ ID NO: 3894669 - RNA, 16 nt, Human adenovirus A
cagugucauuuacugc

SEQ ID NO: 3894670 - RNA, 12 nt, Human adenovirus A
caguguccauca

SEQ ID NO: 3894671 - RNA, 17 nt, Human adenovirus A
caguguuuucagcaauu

SEQ ID NO: 3894672 - RNA, 17 nt, Human adenovirus A
caguuacaacuugcuuc

SEQ ID NO: 3894673 - RNA, 22 nt, Human adenovirus A
caguuuuggagccaaaaaaaca

SEQ ID NO: 3894674 - RNA, 20 nt, Human adenovirus A
cauaacaucaggagcagaaa

SEQ ID NO: 3894675 - RNA, 21 nt, Human adenovirus A
cauaacaucaggagcagaaau

SEQ ID NO: 3894676 - RNA, 16 nt, Human adenovirus A
cauacaucaccucuuu

SEQ ID NO: 3894677 - RNA, 16 nt, Human adenovirus A
cauaccuuaaaaacug

SEQ ID NO: 3894678 - RNA, 20 nt, Human adenovirus A
cauauuaggcauaaugcagc

SEQ ID NO: 3894679 - RNA, 16 nt, Human adenovirus A
caucacucuauuucaa

SEQ ID NO: 3894680 - RNA, 19 nt, Human adenovirus A
caucagaaauuuguugcug

SEQ ID NO: 3894681 - RNA, 22 nt, Human adenovirus A
caucagacguacccuuuguuac

SEQ ID NO: 3894682 - RNA, 17 nt, Human adenovirus A
cauccgaggugacauga

SEQ ID NO: 3894683 - RNA, 23 nt, Human adenovirus A
caucuacagcgacaaagcacuau

SEQ ID NO: 3894684 - RNA, 17 nt, Human adenovirus A
caucuuaguaauggagu

SEQ ID NO: 3894685 - RNA, 16 nt, Human adenovirus A
caucuuuuacuaaaau

SEQ ID NO: 3894686 - RNA, 15 nt, Human adenovirus A
caugaagauuucugc

SEQ ID NO: 3894687 - RNA, 18 nt, Human adenovirus A
caugcgcgcggccagagc

SEQ ID NO: 3894688 - RNA, 22 nt, Human adenovirus A
caugcgggggaugaaggaagcg

SEQ ID NO: 3894689 - RNA, 16 nt, Human adenovirus A
caugcuaaaagcuucu

SEQ ID NO: 3894690 - RNA, 16 nt, Human adenovirus A
caugcucuagacauga

SEQ ID NO: 3894691 - RNA, 13 nt, Human adenovirus A
cauggaaaaacuu

SEQ ID NO: 3894692 - RNA, 17 nt, Human adenovirus A
cauggaaaaacuuggaa

SEQ ID NO: 3894693 - RNA, 21 nt, Human adenovirus A
cauggcuuccaugccuuuuuc

SEQ ID NO: 3894694 - RNA, 15 nt, Human adenovirus A
caugguaagcucuug

SEQ ID NO: 3894695 - RNA, 21 nt, Human adenovirus A
cauguaucagcagccaacuua

SEQ ID NO: 3894696 - RNA, 14 nt, Human adenovirus A
caugucaaugcagc

SEQ ID NO: 3894697 - RNA, 21 nt, Human adenovirus A
caugucgcauaaugaaaacaa

SEQ ID NO: 3894698 - RNA, 14 nt, Human adenovirus A
cauuaaagcaaacc

SEQ ID NO: 3894699 - RNA, 21 nt, Human adenovirus A
cauuaagaacacggugaaugu

SEQ ID NO: 3894700 - RNA, 21 nt, Human adenovirus A
cauuaauaauaaaaccauuuu

SEQ ID NO: 3894701 - RNA, 16 nt, Human adenovirus A
cauuauguaaagucag

SEQ ID NO: 3894702 - RNA, 12 nt, Human adenovirus A
cauucaccagcc

SEQ ID NO: 3894703 - RNA, 19 nt, Human adenovirus A
cauuccccauccaaaacca

SEQ ID NO: 3894704 - RNA, 22 nt, Human adenovirus A
cauuccuucagaauaaaacaag

SEQ ID NO: 3894705 - RNA, 15 nt, Human adenovirus A
cauucuugagccugg

SEQ ID NO: 3894706 - RNA, 16 nt, Human adenovirus A
cauucuuuucauuuuc

SEQ ID NO: 3894707 - RNA, 14 nt, Human adenovirus A
cauugacaaggaag

SEQ ID NO: 3894708 - RNA, 13 nt, Human adenovirus A
cauugcgcaaaau

SEQ ID NO: 3894709 - RNA, 22 nt, Human adenovirus A
cauuggucaagcgcagguagac

SEQ ID NO: 3894710 - RNA, 20 nt, Human adenovirus A
cauuguaacugaaaauggaa

SEQ ID NO: 3894711 - RNA, 21 nt, Human adenovirus A
cauuuacaguacaaauacagu

SEQ ID NO: 3894712 - RNA, 21 nt, Human adenovirus A
cauuuauaguggcacaacaca

SEQ ID NO: 3894713 - RNA, 19 nt, Human adenovirus A
ccaaaauuuucaacagaaa

SEQ ID NO: 3894714 - RNA, 23 nt, Human adenovirus A
ccaaaguucgccuacacaacaca

SEQ ID NO: 3894715 - RNA, 19 nt, Human adenovirus A
ccaaauauugcgcaggggu

SEQ ID NO: 3894716 - RNA, 17 nt, Human adenovirus A
ccaaaugaauuugaaau

SEQ ID NO: 3894717 - RNA, 18 nt, Human adenovirus A
ccaacuuaacgcaguagu

SEQ ID NO: 3894718 - RNA, 15 nt, Human adenovirus A
ccaagcaaguacaaa

SEQ ID NO: 3894719 - RNA, 20 nt, Human adenovirus A
ccaagcauauaaaacugauu

SEQ ID NO: 3894720 - RNA, 21 nt, Human adenovirus A
ccaaggaaaacuuuuguauuc

SEQ ID NO: 3894721 - RNA, 21 nt, Human adenovirus A
cgcccagacguaggguacagu

SEQ ID NO: 3894722 - RNA, 17 nt, Human adenovirus A
cgcccgcgccacggaca

SEQ ID NO: 3894723 - RNA, 12 nt, Human adenovirus A
cgccuuaauuuu

SEQ ID NO: 3894724 - RNA, 13 nt, Human adenovirus A
cgccuuuucuaga

SEQ ID NO: 3894725 - RNA, 21 nt, Human adenovirus A
cgcgcuuuggaggcagcugga

SEQ ID NO: 3894726 - RNA, 18 nt, Human adenovirus A
cgcggagacgggccgcag

SEQ ID NO: 3894727 - RNA, 15 nt, Human adenovirus A
cgcucauuugcgccc

SEQ ID NO: 3894728 - RNA, 23 nt, Human adenovirus A
cgcugccgacguugcaagaggag

SEQ ID NO: 3894729 - RNA, 13 nt, Human adenovirus A
cggaagaaaagcg

SEQ ID NO: 3894730 - RNA, 20 nt, Human adenovirus A
cggacaccuacuucacccug

SEQ ID NO: 3894731 - RNA, 19 nt, Human adenovirus A
cggacgagcucccggagga

SEQ ID NO: 3894732 - RNA, 13 nt, Human adenovirus A
cggcaacagcagc

SEQ ID NO: 3894733 - RNA, 19 nt, Human adenovirus A
cggcacaacagacugggga

SEQ ID NO: 3894734 - RNA, 22 nt, Human adenovirus A
cggcaggauccgcuaugagcac

SEQ ID NO: 3894735 - RNA, 14 nt, Human adenovirus A
cggccauaggcaug

SEQ ID NO: 3894736 - RNA, 13 nt, Human adenovirus A
cggccucagcagc

SEQ ID NO: 3894737 - RNA, 19 nt, Human adenovirus A
cggcgagaaugggaggaaa

SEQ ID NO: 3894738 - RNA, 20 nt, Human adenovirus A
cggcgguguaugccaacaaa

SEQ ID NO: 3894739 - RNA, 20 nt, Human adenovirus A
cggcuugagcaaaaauguuu

SEQ ID NO: 3894740 - RNA, 17 nt, Human adenovirus A
cgggacccugccgcugc

SEQ ID NO: 3894741 - RNA, 17 nt, Human adenovirus A
cgggagggacaagcuua

SEQ ID NO: 3894742 - RNA, 17 nt, Human adenovirus A
cgggaguguacacuaau

SEQ ID NO: 3894743 - RNA, 21 nt, Human adenovirus A
cgggcccauguaucagcagcc

SEQ ID NO: 3894744 - RNA, 22 nt, Human adenovirus A
cgggguugauuuuacagagagc

SEQ ID NO: 3894745 - RNA, 19 nt, Human adenovirus A
cggguaagagcaggcugga

SEQ ID NO: 3894746 - RNA, 19 nt, Human adenovirus A
cggucaggaugccucggag

SEQ ID NO: 3894747 - RNA, 22 nt, Human adenovirus A
cgguccuccucguacaggaauu

SEQ ID NO: 3894748 - RNA, 16 nt, Human adenovirus A
cggucgaccuguggca

SEQ ID NO: 3894749 - RNA, 17 nt, Human adenovirus A
cggucgaccuguggcac

SEQ ID NO: 3894750 - RNA, 15 nt, Human adenovirus A
cggugcacuuuucca

SEQ ID NO: 3894751 - RNA, 15 nt, Human adenovirus A
cguaaaaucuacaaa

SEQ ID NO: 3894752 - RNA, 12 nt, Human adenovirus A
cguacagccaga

SEQ ID NO: 3894753 - RNA, 22 nt, Human adenovirus A
cguaccuuuuguuagaugcagc

SEQ ID NO: 3894754 - RNA, 15 nt, Human adenovirus A
cguaggguacagugg

SEQ ID NO: 3894755 - RNA, 16 nt, Human adenovirus A
cguauuauggcuuuaa

SEQ ID NO: 3894756 - RNA, 17 nt, Human adenovirus A
cguauuuuuccuuugga

SEQ ID NO: 3894757 - RNA, 21 nt, Human adenovirus A
cgucaagacccacugcgucag

SEQ ID NO: 3894758 - RNA, 11 nt, Human adenovirus A
cgucacuuuga

SEQ ID NO: 3894759 - RNA, 13 nt, Human adenovirus A
cgucccaaaagca

SEQ ID NO: 3894760 - RNA, 14 nt, Human adenovirus A
cgucuuauuuuccu

SEQ ID NO: 3894761 - RNA, 22 nt, Human adenovirus A
cgucuucguacuuaaaaaaaca

SEQ ID NO: 3894762 - RNA, 23 nt, Human adenovirus A
cgugaauauuaaaaagcucugua

SEQ ID NO: 3894763 - RNA, 15 nt, Human adenovirus A
cguggaauuaaaagg

SEQ ID NO: 3894764 - RNA, 20 nt, Human adenovirus A
cgugguacgcauucaccagc

SEQ ID NO: 3894765 - RNA, 13 nt, Human adenovirus A
cguuaguaacaac

SEQ ID NO: 3894766 - RNA, 13 nt, Human adenovirus A
cguucuguggaug

SEQ ID NO: 3894767 - RNA, 22 nt, Human adenovirus A
cguucuuugguuugcaauacug

SEQ ID NO: 3894768 - RNA, 14 nt, Human adenovirus A
cguugcaagaggag

SEQ ID NO: 3894769 - RNA, 13 nt, Human adenovirus A
cguuuucugcagc

SEQ ID NO: 3894770 - RNA, 22 nt, Human adenovirus A
cuaaaagagccacagcucugau

SEQ ID NO: 3894771 - RNA, 21 nt, Human adenovirus A
cuaaacgaccgccuuuucuag

SEQ ID NO: 3894772 - RNA, 22 nt, Human adenovirus A
cuaaacgagggagauguccugu

SEQ ID NO: 3894773 - RNA, 18 nt, Human adenovirus A
cuaaccuggaucccgcgg

SEQ ID NO: 3894774 - RNA, 14 nt, Human adenovirus A
cuaacucugauuac

SEQ ID NO: 3894775 - RNA, 17 nt, Human adenovirus A
uucagaugacuggacag

SEQ ID NO: 3894776 - RNA, 23 nt, Human adenovirus A
uucagguuuuuggagguaucugu

SEQ ID NO: 3894777 - RNA, 21 nt, Human adenovirus A
uucauauauguaucuggacau

SEQ ID NO: 3894778 - RNA, 19 nt, Human adenovirus A
uucaucuuaguaauggagu

SEQ ID NO: 3894779 - RNA, 17 nt, Human adenovirus A
uuccacggugcacuuuu

SEQ ID NO: 3894780 - RNA, 22 nt, Human adenovirus A
uuccacggugcacuuuuccaau

SEQ ID NO: 3894781 - RNA, 19 nt, Human adenovirus A
uuccagacaaaaaaaauac

SEQ ID NO: 3894782 - RNA, 20 nt, Human adenovirus A
uuccagcgccaccugccauu

SEQ ID NO: 3894783 - RNA, 17 nt, Human adenovirus A
uucgagaucuaggcugu

SEQ ID NO: 3894784 - RNA, 19 nt, Human adenovirus A
uucgagaucuaggcugugg

SEQ ID NO: 3894785 - RNA, 20 nt, Human adenovirus A
uucgcaggcggucugccauu

SEQ ID NO: 3894786 - RNA, 23 nt, Human adenovirus A
uucuaccaaggaaaacuuuugua

SEQ ID NO: 3894787 - RNA, 13 nt, Human adenovirus A
uucuaccuccauu

SEQ ID NO: 3894788 - RNA, 22 nt, Human adenovirus A
uucuuccucgaccacagguggu

SEQ ID NO: 3894789 - RNA, 15 nt, Human adenovirus A
uucuucgacuuuugc

SEQ ID NO: 3894790 - RNA, 14 nt, Human adenovirus A
uucuuuagaaacuu

SEQ ID NO: 3894791 - RNA, 12 nt, Human adenovirus A
uugacuguuuua

SEQ ID NO: 3894792 - RNA, 14 nt, Human adenovirus A
uugauuuaggaggu

SEQ ID NO: 3894793 - RNA, 19 nt, Human adenovirus A
uugcaacgcaccuugcagg

SEQ ID NO: 3894794 - RNA, 14 nt, Human adenovirus A
uugcgagcugccac

SEQ ID NO: 3894795 - RNA, 19 nt, Human adenovirus A
uugcgccaccuuggcuuuc

SEQ ID NO: 3894796 - RNA, 13 nt, Human adenovirus A
uuggccagcugcc

SEQ ID NO: 3894797 - RNA, 17 nt, Human adenovirus A
uuggcuucgaaugcugu

SEQ ID NO: 3894798 - RNA, 23 nt, Human adenovirus A
uuguacggacaacauccuuuuuc

SEQ ID NO: 3894799 - RNA, 14 nt, Human adenovirus A
uuguauaaaaucau

SEQ ID NO: 3894800 - RNA, 11 nt, Human adenovirus A
uuguuaucuag

SEQ ID NO: 3894801 - RNA, 21 nt, Human adenovirus A
uuuaaucgccccgcugcaauu

SEQ ID NO: 3894802 - RNA, 21 nt, Human adenovirus A
uuuacaguacaaauacaguuu

SEQ ID NO: 3894803 - RNA, 19 nt, Human adenovirus A
uuuaccaaugaauuaaaua

SEQ ID NO: 3894804 - RNA, 15 nt, Human adenovirus A
uuuaccaggcaaaga

SEQ ID NO: 3894805 - RNA, 23 nt, Human adenovirus A
uuuagagggcgaacaguguuuuc

SEQ ID NO: 3894806 - RNA, 19 nt, Human adenovirus A
uuuauaaccaaucuacaaa

SEQ ID NO: 3894807 - RNA, 18 nt, Human adenovirus A
uuuauuaaaaaucaaaug

SEQ ID NO: 3894808 - RNA, 15 nt, Human adenovirus A
uuuauuugaaguuuu

SEQ ID NO: 3894809 - RNA, 18 nt, Human adenovirus A
uuucaaaauaaacaucuc

SEQ ID NO: 3894810 - RNA, 15 nt, Human adenovirus A
uuucaaacguccagg

SEQ ID NO: 3894811 - RNA, 12 nt, Human adenovirus A
uuucaagaaagg

SEQ ID NO: 3894812 - RNA, 13 nt, Human adenovirus A
uuucaaucauuuc

SEQ ID NO: 3894813 - RNA, 20 nt, Human adenovirus A
uuucaauugcagaacuaucu

SEQ ID NO: 3894814 - RNA, 20 nt, Human adenovirus A
uuuccuguuacauaccuggc

SEQ ID NO: 3894815 - RNA, 11 nt, Human adenovirus A
uuucugccauu

SEQ ID NO: 3894816 - RNA, 23 nt, Human adenovirus A
uuugaaccugaaagaaaguucaa

SEQ ID NO: 3894817 - RNA, 20 nt, Human adenovirus A
uuugacccauuugacacauc

SEQ ID NO: 3894818 - RNA, 15 nt, Human adenovirus A
uuugaccggucaggc

SEQ ID NO: 3894819 - RNA, 12 nt, Human adenovirus A
uuugcauuuacu

SEQ ID NO: 3894820 - RNA, 13 nt, Human adenovirus A
uuugcauuuccca

SEQ ID NO: 3894821 - RNA, 19 nt, Human adenovirus A
uuugcgguguaccugauuu

SEQ ID NO: 3894822 - RNA, 17 nt, Human adenovirus A
uuuguaccgcgaagcca

SEQ ID NO: 3894823 - RNA, 14 nt, Human adenovirus A
uuuguguagagucu

SEQ ID NO: 3894824 - RNA, 21 nt, Human adenovirus A
uuuuaaauuguuccuguucua

SEQ ID NO: 3894825 - RNA, 16 nt, Human adenovirus A
uuuuucccacuuuaua

SEQ ID NO: 3894826 - RNA, 13 nt, Human adenovirus A
uuuuugaguacuc

SEQ ID NO: 3894827 - RNA, 12 nt, Human adenovirus A
uuuuuucuucuu

SEQ ID NO: 3894828 - RNA, 22 nt, Human adenovirus A
gccagccaagcguagccgcagc

SEQ ID NO: 3894829 - RNA, 18 nt, Human adenovirus A
gccagcucacggugucag

SEQ ID NO: 3894830 - RNA, 19 nt, Human adenovirus A
gccaggcauuuccaggugg

SEQ ID NO: 3894831 - RNA, 20 nt, Human adenovirus A
gccauccgcaggcaguacuu

SEQ ID NO: 3894832 - RNA, 15 nt, Human adenovirus A
gccaugcaaagccag

SEQ ID NO: 3894833 - RNA, 20 nt, Human adenovirus A
gccaugcgcgcggccagagc

SEQ ID NO: 3894834 - RNA, 22 nt, Human adenovirus A
gccaugcuaugcaggcagccgu

SEQ ID NO: 3894835 - RNA, 12 nt, Human adenovirus A
gcccagcuguuc

SEQ ID NO: 3894836 - RNA, 19 nt, Human adenovirus A
gcccauugagacaagugug

SEQ ID NO: 3894837 - RNA, 22 nt, Human adenovirus A
gccccacuaugcgggagggaca

SEQ ID NO: 3894838 - RNA, 18 nt, Human adenovirus A
gccccccuccccugugga

SEQ ID NO: 3894839 - RNA, 23 nt, Human adenovirus A
gccccccuccccuguggagccac

SEQ ID NO: 3894840 - RNA, 23 nt, Human adenovirus A
gcccccuaaacggcaagccaacg

SEQ ID NO: 3894841 - RNA, 15 nt, Human adenovirus A
gcccuauccgucucc

SEQ ID NO: 3894842 - RNA, 18 nt, Human adenovirus A
gccgcagcugcggccgca

SEQ ID NO: 3894843 - RNA, 19 nt, Human adenovirus A
gccgccuuagacaugacag

SEQ ID NO: 3894844 - RNA, 19 nt, Human adenovirus A
gccggcgaacgggcagccu

SEQ ID NO: 3894845 - RNA, 16 nt, Human adenovirus A
gccggucgcgagcugc

SEQ ID NO: 3894846 - RNA, 21 nt, Human adenovirus A
gccgucaaaauuuucucccca

SEQ ID NO: 3894847 - RNA, 17 nt, Human adenovirus A
gccguggcuagcuugcg

SEQ ID NO: 3894848 - RNA, 16 nt, Human adenovirus A
gccuacccuucuuuau

SEQ ID NO: 3894849 - RNA, 18 nt, Human adenovirus A
gccuaugugauaacccug

SEQ ID NO: 3894850 - RNA, 23 nt, Human adenovirus A
gccuccuauguuagcgccagagg

SEQ ID NO: 3894851 - RNA, 19 nt, Human adenovirus A
gccucgcaccagaaagcag

SEQ ID NO: 3894852 - RNA, 14 nt, Human adenovirus A
gccugaagaagaac

SEQ ID NO: 3894853 - RNA, 22 nt, Human adenovirus A
gccuguugaauuuggguaaggg

SEQ ID NO: 3894854 - RNA, 22 nt, Human adenovirus A
gccuuaaauaaggcugcuagga

SEQ ID NO: 3894855 - RNA, 17 nt, Human adenovirus A
gcgacagaguugcuuuu

SEQ ID NO: 3894856 - RNA, 13 nt, Human adenovirus A
gcgacggcggcgc

SEQ ID NO: 3894857 - RNA, 14 nt, Human adenovirus A
gcgacucagugacc

SEQ ID NO: 3894858 - RNA, 15 nt, Human adenovirus A
gcgagcgcauagaaa

SEQ ID NO: 3894859 - RNA, 16 nt, Human adenovirus A
gcgccaggauguuggg

SEQ ID NO: 3894860 - RNA, 22 nt, Human adenovirus A
gcgcgcccggcucccacgccgc

SEQ ID NO: 3894861 - RNA, 19 nt, Human adenovirus A
gcgcuggcucaacgagagc

SEQ ID NO: 3894862 - RNA, 13 nt, Human adenovirus A
gcggcacaacaga

SEQ ID NO: 3894863 - RNA, 22 nt, Human adenovirus A
gcggcauuccccauccaaaacc

SEQ ID NO: 3894864 - RNA, 14 nt, Human adenovirus A
gcggccuguuuugu

SEQ ID NO: 3894865 - RNA, 18 nt, Human adenovirus A
gcggcguaguaugcgcag

SEQ ID NO: 3894866 - RNA, 17 nt, Human adenovirus A
gcggguaagagcaggcu

SEQ ID NO: 3894867 - RNA, 18 nt, Human adenovirus A
gcggucuuaaaaauuuug

SEQ ID NO: 3894868 - RNA, 15 nt, Human adenovirus A
gcgguggaacugcag

SEQ ID NO: 3894869 - RNA, 12 nt, Human adenovirus A
gcguacagccag

SEQ ID NO: 3894870 - RNA, 17 nt, Human adenovirus A
gcgucagcucguugaug

SEQ ID NO: 3894871 - RNA, 15 nt, Human adenovirus A
gcgugccaggcauuu

SEQ ID NO: 3894872 - RNA, 18 nt, Human adenovirus A
gcuaaauguaacugagga

SEQ ID NO: 3894873 - RNA, 17 nt, Human adenovirus A
gcuaacgccaccagcgu

SEQ ID NO: 3894874 - RNA, 17 nt, Human adenovirus A
gcuacaaaguccucagg

SEQ ID NO: 3894875 - RNA, 20 nt, Human adenovirus A
gcuaguucuuacuuugacau

SEQ ID NO: 3894876 - RNA, 15 nt, Human adenovirus A
gcuauguacagcaau

SEQ ID NO: 3894877 - RNA, 16 nt, Human adenovirus A
gcuauguacagcaauc

SEQ ID NO: 3894878 - RNA, 15 nt, Human adenovirus A
gcucaaagaaacagc

SEQ ID NO: 3894879 - RNA, 17 nt, Human adenovirus A
gcucaacgagagcgcuu

SEQ ID NO: 3894880 - RNA, 13 nt, Human adenovirus A
gcucagcuggaag

SEQ ID NO: 3894881 - RNA, 17 nt, Human adenovirus A
gcucaguuauauuuucu

SEQ ID NO: 3894882 - RNA, 13 nt, Human adenovirus A
gcucccgccauug

SEQ ID NO: 3894883 - RNA, 18 nt, Human adenovirus A
gcuccgacaacagcugcu

SEQ ID NO: 3894884 - RNA, 14 nt, Human adenovirus A
gcuccugcauuaau

SEQ ID NO: 3894885 - RNA, 20 nt, Human adenovirus A
gcucgcugguccccagaugu

SEQ ID NO: 3894886 - RNA, 23 nt, Human adenovirus A
gcugaagaggaggguuugcauuu

SEQ ID NO: 3894887 - RNA, 24 nt, Human adenovirus A
gcugacauaauuuucccagaaagg

SEQ ID NO: 3894888 - RNA, 16 nt, Human adenovirus A
gcugacauacacugua

SEQ ID NO: 3894889 - RNA, 13 nt, Human adenovirus A
gcugauuaugcau

SEQ ID NO: 3894890 - RNA, 18 nt, Human adenovirus A
gcugcaaggucauuagau

SEQ ID NO: 3894891 - RNA, 23 nt, Human adenovirus A
gcugcaauuucuuucauuaggcu

SEQ ID NO: 3894892 - RNA, 19 nt, Human adenovirus A
gcugcaguuugucauuacu

SEQ ID NO: 3894893 - RNA, 17 nt, Human adenovirus A
uaaaggucgcacugagc

SEQ ID NO: 3894894 - RNA, 15 nt, Human adenovirus A
uaaaguaaauuaaau

SEQ ID NO: 3894895 - RNA, 17 nt, Human adenovirus A
uaaaguaaauuaaaugg

SEQ ID NO: 3894896 - RNA, 22 nt, Human adenovirus A
uaaagucagacuauuacacuca

SEQ ID NO: 3894897 - RNA, 22 nt, Human adenovirus A
uaaauacugguauuuaaaaucu

SEQ ID NO: 3894898 - RNA, 22 nt, Human adenovirus A
uaaauauaucuuuuaacaacaa

SEQ ID NO: 3894899 - RNA, 20 nt, Human adenovirus A
uaaaugcggaagaagaacgc

SEQ ID NO: 3894900 - RNA, 16 nt, Human adenovirus A
uaaauggauacucuuu

SEQ ID NO: 3894901 - RNA, 21 nt, Human adenovirus A
uaaauggcgaccucuaacaaa

SEQ ID NO: 3894902 - RNA, 13 nt, Human adenovirus A
uaacaacagucag

SEQ ID NO: 3894903 - RNA, 20 nt, Human adenovirus A
uaacaguuugcgugccuggc

SEQ ID NO: 3894904 - RNA, 20 nt, Human adenovirus A
uaacauguuuaugcgcugua

SEQ ID NO: 3894905 - RNA, 14 nt, Human adenovirus A
uaacauuagcaguc

SEQ ID NO: 3894906 - RNA, 17 nt, Human adenovirus A
uaaccuguccuuaagac

SEQ ID NO: 3894907 - RNA, 12 nt, Human adenovirus A
uaaccuuuccac

SEQ ID NO: 3894908 - RNA, 18 nt, Human adenovirus A
uaacuuuauauugcauuu

SEQ ID NO: 3894909 - RNA, 18 nt, Human adenovirus A
uaagaggagacaacuuua

SEQ ID NO: 3894910 - RNA, 16 nt, Human adenovirus A
uaagcgauuuuccaaa

SEQ ID NO: 3894911 - RNA, 12 nt, Human adenovirus A
uaagcuugcaua

SEQ ID NO: 3894912 - RNA, 19 nt, Human adenovirus A
uaagggcgcccuccaccgc

SEQ ID NO: 3894913 - RNA, 11 nt, Human adenovirus A
uaagggcuggc

SEQ ID NO: 3894914 - RNA, 16 nt, Human adenovirus A
uaaguguucgcaacaa

SEQ ID NO: 3894915 - RNA, 17 nt, Human adenovirus A
uaaguuuaaaggcauua

SEQ ID NO: 3894916 - RNA, 22 nt, Human adenovirus A
uaauaaagcuaaaucugccacu

SEQ ID NO: 3894917 - RNA, 22 nt, Human adenovirus A
uaauaauugaguaacuucaaca

SEQ ID NO: 3894918 - RNA, 23 nt, Human adenovirus A
uaauaucauuaaauaauauuuug

SEQ ID NO: 3894919 - RNA, 20 nt, Human adenovirus A
uaaucaagacggucagcaag

SEQ ID NO: 3894920 - RNA, 23 nt, Human adenovirus A
uaaugaugauacucgacaucguu

SEQ ID NO: 3894921 - RNA, 14 nt, Human adenovirus A
uaaugcaucuuugg

SEQ ID NO: 3894922 - RNA, 20 nt, Human adenovirus A
uaauggaguuguagacauag

SEQ ID NO: 3894923 - RNA, 20 nt, Human adenovirus A
uaauugaguaacuucaacau

SEQ ID NO: 3894924 - RNA, 22 nt, Human adenovirus A
uaauuuuccagcgccaccugcc

SEQ ID NO: 3894925 - RNA, 20 nt, Human adenovirus A
uacaaagccaggcacagcag

SEQ ID NO: 3894926 - RNA, 15 nt, Human adenovirus A
uacaaaucuuucaau

SEQ ID NO: 3894927 - RNA, 14 nt, Human adenovirus A
uacaacaguacagg

SEQ ID NO: 3894928 - RNA, 17 nt, Human adenovirus A
uacaacuugcacaaaug

SEQ ID NO: 3894929 - RNA, 22 nt, Human adenovirus A
uacaaguuccggaguucccaca

SEQ ID NO: 3894930 - RNA, 12 nt, Human adenovirus A
uacacauaaaga

SEQ ID NO: 3894931 - RNA, 20 nt, Human adenovirus A
uacacuggcuggcuuuugga

SEQ ID NO: 3894932 - RNA, 13 nt, Human adenovirus A
uacagauuuaagg

SEQ ID NO: 3894933 - RNA, 14 nt, Human adenovirus A
uacauaccuggcaa

SEQ ID NO: 3894934 - RNA, 22 nt, Human adenovirus A
uaccgcucgucaagccuaccug

SEQ ID NO: 3894935 - RNA, 18 nt, Human adenovirus A
uaccgugggacaacuuuu

SEQ ID NO: 3894936 - RNA, 18 nt, Human adenovirus A
uaccuacuccuacaaggc

SEQ ID NO: 3894937 - RNA, 15 nt, Human adenovirus A
uaccucaaaagcgaa

SEQ ID NO: 3894938 - RNA, 16 nt, Human adenovirus A
uaccucacuuacauua

SEQ ID NO: 3894939 - RNA, 20 nt, Human adenovirus A
uaccugagcggcaagaacaa

SEQ ID NO: 3894940 - RNA, 16 nt, Human adenovirus A
uacgcuugugcagccu

SEQ ID NO: 3894941 - RNA, 19 nt, Human adenovirus A
uacggagggaagaaacagu

SEQ ID NO: 3894942 - RNA, 13 nt, Human adenovirus A
uacggcugucaug

SEQ ID NO: 3894943 - RNA, 17 nt, Human adenovirus A
uacgguggcagccaagc

SEQ ID NO: 3894944 - RNA, 16 nt, Human adenovirus A
uacucaucagagggaa

SEQ ID NO: 3894945 - RNA, 19 nt, Human adenovirus A
uacugcccugguuccccaa

SEQ ID NO: 3894946 - RNA, 22 nt, Human adenovirus A
uacuucaccgcgcaagcuuuca

SEQ ID NO: 3894947 - RNA, 12 nt, Human adenovirus A
uacuugaacaac

SEQ ID NO: 3894948 - RNA, 14 nt, Human adenovirus A
uacuuuacaaaugc

SEQ ID NO: 3894949 - RNA, 20 nt, Human adenovirus A
uagaaucggcaacagcagca

SEQ ID NO: 3894950 - RNA, 15 nt, Human adenovirus A
uagacgaacaaacuu

SEQ ID NO: 3894951 - RNA, 19 nt, Human adenovirus A
uagagcaaacuacauugca

SEQ ID NO: 3894952 - RNA, 17 nt, Human adenovirus A
uagauacaagcgacaga

SEQ ID NO: 3894953 - RNA, 16 nt, Human adenovirus A
uagcaaagccauccgc

SEQ ID NO: 3894954 - RNA, 12 nt, Human adenovirus A
uagcgccagagg

SEQ ID NO: 3894955 - RNA, 14 nt, Human adenovirus A
uagcguccacacag

SEQ ID NO: 3894956 - RNA, 15 nt, Human adenovirus A
uaggcaauuucugcc

SEQ ID NO: 3894957 - RNA, 23 nt, Human adenovirus A
uaguagagacaaugaaacuuuua

SEQ ID NO: 3894958 - RNA, 14 nt, Human adenovirus A
uaguccaagcaagu

SEQ ID NO: 3894959 - RNA, 17 nt, Human adenovirus A
uaguccguuuucuucuu

SEQ ID NO: 3894960 - RNA, 17 nt, Human adenovirus A
uaguugccacgcuuuga

SEQ ID NO: 3894961 - RNA, 20 nt, Human adenovirus A
uaugaacacuuagagggagg

SEQ ID NO: 3894962 - RNA, 15 nt, Human adenovirus A
uaugcccagcaugac

SEQ ID NO: 3894963 - RNA, 21 nt, Human adenovirus A
uaugcgggagggacaagcuua

SEQ ID NO: 3894964 - RNA, 19 nt, Human adenovirus A
uaugcgugagggugccacc

SEQ ID NO: 3894965 - RNA, 20 nt, Human adenovirus A
uauggagugugcuauuaaag

SEQ ID NO: 3894966 - RNA, 20 nt, Human adenovirus A
uauguacauaauccagcaag

SEQ ID NO: 3894967 - RNA, 22 nt, Human adenovirus A
uauuauugaagggaauggcuau

SEQ ID NO: 3894968 - RNA, 15 nt, Human adenovirus A
uauugauaaaacggu

SEQ ID NO: 3894969 - RNA, 13 nt, Human adenovirus A
uauugguggaaaa

SEQ ID NO: 3894970 - RNA, 14 nt, Human adenovirus A
uauuuuuucaaaau

SEQ ID NO: 3894971 - RNA, 22 nt, Human adenovirus A
ucaaaaaagcaaaguacaacca

SEQ ID NO: 3894972 - RNA, 20 nt, Human adenovirus A
ucaaaauaaucaauuuugca

SEQ ID NO: 3894973 - RNA, 22 nt, Human adenovirus A
ucaaagaagagcugcugcaggc

SEQ ID NO: 3894974 - RNA, 15 nt, Human adenovirus A
ucaaauggcucuucg

SEQ ID NO: 3894975 - RNA, 16 nt, Human adenovirus A
ucaacagaaaguugua

SEQ ID NO: 3894976 - RNA, 17 nt, Human adenovirus A
ucaacauaguagagaca

SEQ ID NO: 3894977 - RNA, 14 nt, Human adenovirus A
ucaacccaaacugu

SEQ ID NO: 3894978 - RNA, 18 nt, Human adenovirus A
ucaacgacuaaaacaaau

SEQ ID NO: 3894979 - RNA, 14 nt, Human adenovirus A
ucaagaaaaaccac

SEQ ID NO: 3894980 - RNA, 15 nt, Human adenovirus A
ucaagaaaggcaucu

SEQ ID NO: 3894981 - RNA, 16 nt, Human adenovirus A
ucaagacggucagcaa

SEQ ID NO: 3894982 - RNA, 20 nt, Human adenovirus A
ucaagccuaccugacacuac

SEQ ID NO: 3894983 - RNA, 20 nt, Human adenovirus A
ucaauaccacuuggcagcug

SEQ ID NO: 3894984 - RNA, 20 nt, Human adenovirus A
ucaaugcuucugaaacaaau

SEQ ID NO: 3894985 - RNA, 16 nt, Human adenovirus A
ucacacuuaacacaag

SEQ ID NO: 3894986 - RNA, 16 nt, Human adenovirus A
ucacaucaaccccuac

SEQ ID NO: 3894987 - RNA, 13 nt, Human adenovirus A
ucaccaaaguaau

SEQ ID NO: 3894988 - RNA, 21 nt, Human adenovirus A
ucaccaugggaauagugcucu

SEQ ID NO: 3894989 - RNA, 13 nt, Human adenovirus A
ucaccgcuacacc

SEQ ID NO: 3894990 - RNA, 17 nt, Human adenovirus A
ucaccuuugugugcuac

SEQ ID NO: 3894991 - RNA, 15 nt, Human adenovirus A
ucagaagccagcagc

SEQ ID NO: 3894992 - RNA, 16 nt, Human adenovirus A
ucagaagccagcagca

SEQ ID NO: 3894993 - RNA, 17 nt, Human adenovirus A
ucagaagccagcagcaa

SEQ ID NO: 3894994 - RNA, 15 nt, Human adenovirus A
ucagaugacuggaca

SEQ ID NO: 3894995 - RNA, 11 nt, Human adenovirus A
ucagccagagc

SEQ ID NO: 3894996 - RNA, 14 nt, Human adenovirus A
ucagcgccaacaaa

SEQ ID NO: 3894997 - RNA, 18 nt, Human adenovirus A
ucagcgccgagccacagc

SEQ ID NO: 3894998 - RNA, 16 nt, Human adenovirus A
ucagcuaacaaugcag

SEQ ID NO: 3894999 - RNA, 11 nt, Human adenovirus A
ucagcugcaaa

SEQ ID NO: 3895000 - RNA, 12 nt, Human adenovirus A
ucagcugcaaac

SEQ ID NO: 3895001 - RNA, 21 nt, Human adenovirus A
ucauaagcugugaaaaugcgu

SEQ ID NO: 3895002 - RNA, 23 nt, Human adenovirus A
ucauacauaauuuuaaaguaaau

SEQ ID NO: 3895003 - RNA, 17 nt, Human adenovirus A
ucaugguuugcuaacag

SEQ ID NO: 3895004 - RNA, 21 nt, Human adenovirus A
ucauguggucaggucuaucaa

SEQ ID NO: 3895005 - RNA, 13 nt, Human adenovirus A
ucauuccuucaga

SEQ ID NO: 3895006 - RNA, 11 nt, Human adenovirus A
uccaaaaccag

SEQ ID NO: 3895007 - RNA, 15 nt, Human adenovirus A
uccaaauggacgagg

SEQ ID NO: 3895008 - RNA, 15 nt, Human adenovirus A
uccaacugauuuuca

SEQ ID NO: 3895009 - RNA, 14 nt, Human adenovirus A
uccaagaucuuugu

SEQ ID NO: 3895010 - RNA, 10 nt, Human adenovirus A
augcaaagcc

SEQ ID NO: 3895011 - RNA, 13 nt, Human adenovirus A
augcauaauuaaa

SEQ ID NO: 3895012 - RNA, 14 nt, Human adenovirus A
augcauaauuaaac

SEQ ID NO: 3895013 - RNA, 19 nt, Human adenovirus A
augcccugcaaaaagaaaa

SEQ ID NO: 3895014 - RNA, 13 nt, Human adenovirus A
augccgcaguggu

SEQ ID NO: 3895015 - RNA, 21 nt, Human adenovirus A
augccuaaugugagugcuuac

SEQ ID NO: 3895016 - RNA, 18 nt, Human adenovirus A
augcugauguuuguaaaa

SEQ ID NO: 3895017 - RNA, 13 nt, Human adenovirus A
augcuuggaagaa

SEQ ID NO: 3895018 - RNA, 16 nt, Human adenovirus A
augcuuuucgccagca

SEQ ID NO: 3895019 - RNA, 19 nt, Human adenovirus A
augcuuuucgccagcagcc

SEQ ID NO: 3895020 - RNA, 21 nt, Human adenovirus A
auggaacaauugcuucugagu

SEQ ID NO: 3895021 - RNA, 12 nt, Human adenovirus A
auggaaccccaa

SEQ ID NO: 3895022 - RNA, 20 nt, Human adenovirus A
auggaccuacuuacuggggu

SEQ ID NO: 3895023 - RNA, 18 nt, Human adenovirus A
auggagugcuggaaagug

SEQ ID NO: 3895024 - RNA, 17 nt, Human adenovirus A
auggaguuggaaacugu

SEQ ID NO: 3895025 - RNA, 19 nt, Human adenovirus A
auggcagcggcgccacccu

SEQ ID NO: 3895026 - RNA, 14 nt, Human adenovirus A
auggcgaccagugu

SEQ ID NO: 3895027 - RNA, 19 nt, Human adenovirus A
auggggucaugaaaguaaa

SEQ ID NO: 3895028 - RNA, 12 nt, Human adenovirus A
auggucuucaag

SEQ ID NO: 3895029 - RNA, 22 nt, Human adenovirus A
auguaaaggaggcgcuggcuca

SEQ ID NO: 3895030 - RNA, 16 nt, Human adenovirus A
auguauucagcuucag

SEQ ID NO: 3895031 - RNA, 23 nt, Human adenovirus A
auguauucuuucuuuagaaacuu

SEQ ID NO: 3895032 - RNA, 16 nt, Human adenovirus A
augucgcauaaugaaa

SEQ ID NO: 3895033 - RNA, 22 nt, Human adenovirus A
augucggccugacgcucuggca

SEQ ID NO: 3895034 - RNA, 22 nt, Human adenovirus A
augucuaugggggcgcuaacgg

SEQ ID NO: 3895035 - RNA, 13 nt, Human adenovirus A
augugcuguggaa

SEQ ID NO: 3895036 - RNA, 15 nt, Human adenovirus A
auguggagcuuucaa

SEQ ID NO: 3895037 - RNA, 13 nt, Human adenovirus A
augugguccaggg

SEQ ID NO: 3895038 - RNA, 22 nt, Human adenovirus A
auguuaauuaucccuuugaugc

SEQ ID NO: 3895039 - RNA, 18 nt, Human adenovirus A
auguuagguuugcuggag

SEQ ID NO: 3895040 - RNA, 20 nt, Human adenovirus A
auuaaacaacaaaacacuga

SEQ ID NO: 3895041 - RNA, 14 nt, Human adenovirus A
auuaacaguuugcg

SEQ ID NO: 3895042 - RNA, 20 nt, Human adenovirus A
auuacaugaagauuucugcu

SEQ ID NO: 3895043 - RNA, 18 nt, Human adenovirus A
auuacuaccgucaucucu

SEQ ID NO: 3895044 - RNA, 14 nt, Human adenovirus A
auuacugccaguuc

SEQ ID NO: 3895045 - RNA, 15 nt, Human adenovirus A
auuacuugaacaacu

SEQ ID NO: 3895046 - RNA, 15 nt, Human adenovirus A
auuaggcuccacacc

SEQ ID NO: 3895047 - RNA, 13 nt, Human adenovirus A
auuaggcuuucuu

SEQ ID NO: 3895048 - RNA, 23 nt, Human adenovirus A
auuaguaccgaaaaagguuuaau

SEQ ID NO: 3895049 - RNA, 14 nt, Human adenovirus A
auuaugguucagcu

SEQ ID NO: 3895050 - RNA, 20 nt, Human adenovirus A
auucaggugccgcaaaaauu

SEQ ID NO: 3895051 - RNA, 21 nt, Human adenovirus A
auucaggugccgcaaaaauuu

SEQ ID NO: 3895052 - RNA, 18 nt, Human adenovirus A
auuccuccuuauccuucc

SEQ ID NO: 3895053 - RNA, 20 nt, Human adenovirus A
auugaaaacguuaaagcugg

SEQ ID NO: 3895054 - RNA, 20 nt, Human adenovirus A
auugaaccgguugaaacaga

SEQ ID NO: 3895055 - RNA, 15 nt, Human adenovirus A
auugaguugcacaua

SEQ ID NO: 3895056 - RNA, 22 nt, Human adenovirus A
auugauaaaacgguuaagcugg

SEQ ID NO: 3895057 - RNA, 18 nt, Human adenovirus A
auugauacacaccucauu

SEQ ID NO: 3895058 - RNA, 18 nt, Human adenovirus A
auugcaacgcaaucagaa

SEQ ID NO: 3895059 - RNA, 20 nt, Human adenovirus A
auugcaacgcaaucagaaug

SEQ ID NO: 3895060 - RNA, 13 nt, Human adenovirus A
auugcgcaggggu

SEQ ID NO: 3895061 - RNA, 16 nt, Human adenovirus A
auuggaguacaagcuu

SEQ ID NO: 3895062 - RNA, 18 nt, Human adenovirus A
auuggcuucagcauuuug

SEQ ID NO: 3895063 - RNA, 13 nt, Human adenovirus A
auuguaaaugcuu

SEQ ID NO: 3895064 - RNA, 17 nt, Human adenovirus A
auuguagccugcuuuca

SEQ ID NO: 3895065 - RNA, 13 nt, Human adenovirus A
auuuaaaaaccau

SEQ ID NO: 3895066 - RNA, 18 nt, Human adenovirus A
auuuaaaauuccauaauu

SEQ ID NO: 3895067 - RNA, 21 nt, Human adenovirus A
auuuagaggcuggagcuuuac

SEQ ID NO: 3895068 - RNA, 23 nt, Human adenovirus A
auuuauaaauguuagguuugcug

SEQ ID NO: 3895069 - RNA, 21 nt, Human adenovirus A
auuuauaguggcacaacacau

SEQ ID NO: 3895070 - RNA, 17 nt, Human adenovirus A
auuucaugguuugcuaa

SEQ ID NO: 3895071 - RNA, 23 nt, Human adenovirus A
auuucgauaaacaaaagcaaagc

SEQ ID NO: 3895072 - RNA, 14 nt, Human adenovirus A
auuucucuuuucuu

SEQ ID NO: 3895073 - RNA, 16 nt, Human adenovirus A
auuucucuuuucuuua

SEQ ID NO: 3895074 - RNA, 18 nt, Human adenovirus A
auuugauucaagaggaag

SEQ ID NO: 3895075 - RNA, 17 nt, Human adenovirus A
auuugcgcacugaaaaa

SEQ ID NO: 3895076 - RNA, 13 nt, Human adenovirus A
auuugcugaaaaa

SEQ ID NO: 3895077 - RNA, 21 nt, Human adenovirus A
auuuguuccuuuucacauuca

SEQ ID NO: 3895078 - RNA, 13 nt, Human adenovirus A
auuuuaaaguaaa

SEQ ID NO: 3895079 - RNA, 20 nt, Human adenovirus A
auuuuaaaguaaauuaaaug

SEQ ID NO: 3895080 - RNA, 24 nt, Human adenovirus A
auuuuauccuacaaaaaguaacaa

SEQ ID NO: 3895081 - RNA, 13 nt, Human adenovirus A
auuuuuugggaac

SEQ ID NO: 3895082 - RNA, 13 nt, Human adenovirus A
caaaaaaaaagcg

SEQ ID NO: 3895083 - RNA, 21 nt, Human adenovirus A
caaaaacaccuuuuguuaauu

SEQ ID NO: 3895084 - RNA, 18 nt, Human adenovirus A
caaaacacugagcuccau

SEQ ID NO: 3895085 - RNA, 16 nt, Human adenovirus A
caaaagguugaggaau

SEQ ID NO: 3895086 - RNA, 22 nt, Human adenovirus A
caaaaguaauaucauuaaauaa

SEQ ID NO: 3895087 - RNA, 17 nt, Human adenovirus A
caaaauaaacaucucau

SEQ ID NO: 3895088 - RNA, 21 nt, Human adenovirus A
caaacaacgaaggccaaacca

SEQ ID NO: 3895089 - RNA, 15 nt, Human adenovirus A
caaacagccgaaaga

SEQ ID NO: 3895090 - RNA, 21 nt, Human adenovirus A
caaacccccaggaugauuuac

SEQ ID NO: 3895091 - RNA, 13 nt, Human adenovirus A
caaaccugacaga

SEQ ID NO: 3895092 - RNA, 16 nt, Human adenovirus A
caaacggguggaaaaa

SEQ ID NO: 3895093 - RNA, 23 nt, Human adenovirus A
caaacguuuuccggguuuugugu

SEQ ID NO: 3895094 - RNA, 17 nt, Human adenovirus A
caaacuggaacuuaaca

SEQ ID NO: 3895095 - RNA, 20 nt, Human adenovirus A
caaagccacuuuagccccag

SEQ ID NO: 3895096 - RNA, 20 nt, Human adenovirus A
caaagggggcgcacacuaau

SEQ ID NO: 3895097 - RNA, 20 nt, Human adenovirus A
caaaggugcuucccacauac

SEQ ID NO: 3895098 - RNA, 21 nt, Human adenovirus A
caaaggugcuucccacauaca

SEQ ID NO: 3895099 - RNA, 14 nt, Human adenovirus A
caaaguaccuuaca

SEQ ID NO: 3895100 - RNA, 13 nt, Human adenovirus A
cagcaagugccuc

SEQ ID NO: 3895101 - RNA, 15 nt, Human adenovirus A
cagcaauuacuugaa

SEQ ID NO: 3895102 - RNA, 17 nt, Human adenovirus A
cagcagcaacacuccau

SEQ ID NO: 3895103 - RNA, 16 nt, Human adenovirus A
cagcauaaaagcuuca

SEQ ID NO: 3895104 - RNA, 20 nt, Human adenovirus A
cagcauguccccgaaagccg

SEQ ID NO: 3895105 - RNA, 19 nt, Human adenovirus A
cagcauuaguucuuuucuu

SEQ ID NO: 3895106 - RNA, 19 nt, Human adenovirus A
cagccaaaacucagguagc

SEQ ID NO: 3895107 - RNA, 16 nt, Human adenovirus A
cagccaacaucaugaa

SEQ ID NO: 3895108 - RNA, 21 nt, Human adenovirus A
cagccagauguaaaaguacgu

SEQ ID NO: 3895109 - RNA, 21 nt, Human adenovirus A
cagccgaaagaccacuaaaag

SEQ ID NO: 3895110 - RNA, 17 nt, Human adenovirus A
cagcgacaaagcacuau

SEQ ID NO: 3895111 - RNA, 22 nt, Human adenovirus A
cagcgaccggcgaucaucgcgg

SEQ ID NO: 3895112 - RNA, 22 nt, Human adenovirus A
cagcgacgcaaaaaaggggcac

SEQ ID NO: 3895113 - RNA, 19 nt, Human adenovirus A
cagcgcacuggcauaagga

SEQ ID NO: 3895114 - RNA, 15 nt, Human adenovirus A
cagcgccaacaaaaa

SEQ ID NO: 3895115 - RNA, 17 nt, Human adenovirus A
cagcgccaccugccauu

SEQ ID NO: 3895116 - RNA, 16 nt, Human adenovirus A
cagcuaacaaugcagc

SEQ ID NO: 3895117 - RNA, 13 nt, Human adenovirus A
cagcuaacgccac

SEQ ID NO: 3895118 - RNA, 18 nt, Human adenovirus A
cagcuaacgccaccagcg

SEQ ID NO: 3895119 - RNA, 17 nt, Human adenovirus A
cagcugauuucagcuuc

SEQ ID NO: 3895120 - RNA, 17 nt, Human adenovirus A
cagcugccguucguccu

SEQ ID NO: 3895121 - RNA, 22 nt, Human adenovirus A
cagcuuuuauaugcgcauggcu

SEQ ID NO: 3895122 - RNA, 17 nt, Human adenovirus A
caggaaaaucccccucc

SEQ ID NO: 3895123 - RNA, 17 nt, Human adenovirus A
caggaaaucugggagga

SEQ ID NO: 3895124 - RNA, 16 nt, Human adenovirus A
caggaagagccucaau

SEQ ID NO: 3895125 - RNA, 13 nt, Human adenovirus A
caggaguugcagg

SEQ ID NO: 3895126 - RNA, 20 nt, Human adenovirus A
caggauccgcuaugagcaca

SEQ ID NO: 3895127 - RNA, 19 nt, Human adenovirus A
caggcgcggcgguguaugc

SEQ ID NO: 3895128 - RNA, 16 nt, Human adenovirus A
caggcuggaggugcag

SEQ ID NO: 3895129 - RNA, 22 nt, Human adenovirus A
cagggcauacgcuugugcagcc

SEQ ID NO: 3895130 - RNA, 21 nt, Human adenovirus A
caggggaagguguugagcccg

SEQ ID NO: 3895131 - RNA, 23 nt, Human adenovirus A
caggggugguggguuuggaugga

SEQ ID NO: 3895132 - RNA, 16 nt, Human adenovirus A
cagguauuacuaaaag

SEQ ID NO: 3895133 - RNA, 18 nt, Human adenovirus A
ccaguuuacuaacaccaa

SEQ ID NO: 3895134 - RNA, 21 nt, Human adenovirus A
ccaucuugcuuguuuaaacau

SEQ ID NO: 3895135 - RNA, 19 nt, Human adenovirus A
ccauggaucguauuauggc

SEQ ID NO: 3895136 - RNA, 21 nt, Human adenovirus A
ccaugguaaaaaggaagcagg

SEQ ID NO: 3895137 - RNA, 11 nt, Human adenovirus A
ccauguugcua

SEQ ID NO: 3895138 - RNA, 17 nt, Human adenovirus A
ccauuauuauggcaauu

SEQ ID NO: 3895139 - RNA, 18 nt, Human adenovirus A
ccauugugcccacgccug

SEQ ID NO: 3895140 - RNA, 17 nt, Human adenovirus A
ccauugugcuaaaugua

SEQ ID NO: 3895141 - RNA, 14 nt, Human adenovirus A
ccauuugacacauc

SEQ ID NO: 3895142 - RNA, 12 nt, Human adenovirus A
cccaacccuucc

SEQ ID NO: 3895143 - RNA, 16 nt, Human adenovirus A
cccaacugucaaaccu

SEQ ID NO: 3895144 - RNA, 17 nt, Human adenovirus A
cccaacuuaacgcagua

SEQ ID NO: 3895145 - RNA, 19 nt, Human adenovirus A
cccaacuuugacgcaguga

SEQ ID NO: 3895146 - RNA, 19 nt, Human adenovirus A
cccagcgguuuugcgccac

SEQ ID NO: 3895147 - RNA, 18 nt, Human adenovirus A
cccagcugacauacacug

SEQ ID NO: 3895148 - RNA, 12 nt, Human adenovirus A
ccccaaaagccc

SEQ ID NO: 3895149 - RNA, 17 nt, Human adenovirus A
ccccagcggcaguacgu

SEQ ID NO: 3895150 - RNA, 19 nt, Human adenovirus A
ccccgcgacacggcacgcg

SEQ ID NO: 3895151 - RNA, 21 nt, Human adenovirus A
ccccuaaacggcaagccaacg

SEQ ID NO: 3895152 - RNA, 16 nt, Human adenovirus A
ccccuccuucgcuguc

SEQ ID NO: 3895153 - RNA, 17 nt, Human adenovirus A
cccgcauguauggagga

SEQ ID NO: 3895154 - RNA, 12 nt, Human adenovirus A
cccgccuggcag

SEQ ID NO: 3895155 - RNA, 22 nt, Human adenovirus A
cccgcgaaaaaaaucacuuccg

SEQ ID NO: 3895156 - RNA, 15 nt, Human adenovirus A
cccguuccgcaagca

SEQ ID NO: 3895157 - RNA, 15 nt, Human adenovirus A
cccuccccuguggag

SEQ ID NO: 3895158 - RNA, 21 nt, Human adenovirus A
cccucccucuuggccagcugc

SEQ ID NO: 3895159 - RNA, 13 nt, Human adenovirus A
cccuccuaccacu

SEQ ID NO: 3895160 - RNA, 15 nt, Human adenovirus A
cccuuuaccaacacc

SEQ ID NO: 3895161 - RNA, 16 nt, Human adenovirus A
ccgacuaacaggugaa

SEQ ID NO: 3895162 - RNA, 13 nt, Human adenovirus A
ccgaggaauuuga

SEQ ID NO: 3895163 - RNA, 13 nt, Human adenovirus A
ccgaggugacaug

SEQ ID NO: 3895164 - RNA, 22 nt, Human adenovirus A
ccgcacguucaauaguggcugc

SEQ ID NO: 3895165 - RNA, 15 nt, Human adenovirus A
ccgcagucagugacc

SEQ ID NO: 3895166 - RNA, 20 nt, Human adenovirus A
ccgcaguggucuuacaugca

SEQ ID NO: 3895167 - RNA, 15 nt, Human adenovirus A
ccgcccaggcaggcg

SEQ ID NO: 3895168 - RNA, 13 nt, Human adenovirus A
ccgcgagcagcgg

SEQ ID NO: 3895169 - RNA, 14 nt, Human adenovirus A
ccgcgaucagccau

SEQ ID NO: 3895170 - RNA, 14 nt, Human adenovirus A
ccgcugcucagcuc

SEQ ID NO: 3895171 - RNA, 20 nt, Human adenovirus A
agcaauuacuugaacaacuu

SEQ ID NO: 3895172 - RNA, 14 nt, Human adenovirus A
agcacacugggaaa

SEQ ID NO: 3895173 - RNA, 12 nt, Human adenovirus A
agcaccccuucc

SEQ ID NO: 3895174 - RNA, 15 nt, Human adenovirus A
agcacuaaaaucccu

SEQ ID NO: 3895175 - RNA, 15 nt, Human adenovirus A
agcagaauuacugcc

SEQ ID NO: 3895176 - RNA, 23 nt, Human adenovirus A
agcagcggcuugagcaaaaaugu

SEQ ID NO: 3895177 - RNA, 16 nt, Human adenovirus A
agcauaugaacaaacg

SEQ ID NO: 3895178 - RNA, 13 nt, Human adenovirus A
agcaucccagcug

SEQ ID NO: 3895179 - RNA, 22 nt, Human adenovirus A
agcaucccagcugacauacacu

SEQ ID NO: 3895180 - RNA, 23 nt, Human adenovirus A
agcaucccagcugacauacacug

SEQ ID NO: 3895181 - RNA, 14 nt, Human adenovirus A
agcauuggaauuua

SEQ ID NO: 3895182 - RNA, 13 nt, Human adenovirus A
agccaaaaaaaca

SEQ ID NO: 3895183 - RNA, 17 nt, Human adenovirus A
agccaacauccagugcg

SEQ ID NO: 3895184 - RNA, 15 nt, Human adenovirus A
agccauccgcaaaga

SEQ ID NO: 3895185 - RNA, 19 nt, Human adenovirus A
agccaugcuaugcaggcag

SEQ ID NO: 3895186 - RNA, 22 nt, Human adenovirus A
agccauggaugaauugcagccu

SEQ ID NO: 3895187 - RNA, 17 nt, Human adenovirus A
agccgcaaguaggacca

SEQ ID NO: 3895188 - RNA, 19 nt, Human adenovirus A
agccgcagcaccuggagcg

SEQ ID NO: 3895189 - RNA, 15 nt, Human adenovirus A
agccgccauggaaau

SEQ ID NO: 3895190 - RNA, 16 nt, Human adenovirus A
agccuggagcugucca

SEQ ID NO: 3895191 - RNA, 21 nt, Human adenovirus A
agccuucauuccuucagaaua

SEQ ID NO: 3895192 - RNA, 15 nt, Human adenovirus A
agcgaacaggagcug

SEQ ID NO: 3895193 - RNA, 15 nt, Human adenovirus A
agcgacagaguugcu

SEQ ID NO: 3895194 - RNA, 16 nt, Human adenovirus A
agcgaugacucagcug

SEQ ID NO: 3895195 - RNA, 16 nt, Human adenovirus A
agcgcaacagcgcaug

SEQ ID NO: 3895196 - RNA, 15 nt, Human adenovirus A
agcgcacuggcauaa

SEQ ID NO: 3895197 - RNA, 15 nt, Human adenovirus A
agcgcgcgacuggcu

SEQ ID NO: 3895198 - RNA, 22 nt, Human adenovirus A
agcggcaagaacaauuucauca

SEQ ID NO: 3895199 - RNA, 13 nt, Human adenovirus A
agcggccacggcc

SEQ ID NO: 3895200 - RNA, 19 nt, Human adenovirus A
agcggccacggccggaugc

SEQ ID NO: 3895201 - RNA, 16 nt, Human adenovirus A
agcggccacuaaagac

SEQ ID NO: 3895202 - RNA, 22 nt, Human adenovirus A
agcggcuugagcaaaaauguuu

SEQ ID NO: 3895203 - RNA, 14 nt, Human adenovirus A
agcgguuauugauu

SEQ ID NO: 3895204 - RNA, 15 nt, Human adenovirus A
agcuaaaucugccac

SEQ ID NO: 3895205 - RNA, 13 nt, Human adenovirus A
agcuaauaccugu

SEQ ID NO: 3895206 - RNA, 12 nt, Human adenovirus A
agcuaugaugcg

SEQ ID NO: 3895207 - RNA, 20 nt, Human adenovirus A
agcuauugcaaaccuagcug

SEQ ID NO: 3895208 - RNA, 22 nt, Human adenovirus A
agcucugauuucgauaaacaaa

SEQ ID NO: 3895209 - RNA, 19 nt, Human adenovirus A
agcugaacgggggcgccuu

SEQ ID NO: 3895210 - RNA, 23 nt, Human adenovirus A
agcugcagagcuagcugacauaa

SEQ ID NO: 3895211 - RNA, 21 nt, Human adenovirus A
agcugccaccucuagaaacug

SEQ ID NO: 3895212 - RNA, 21 nt, Human adenovirus A
agcugccuccuuugccagaac

SEQ ID NO: 3895213 - RNA, 16 nt, Human adenovirus A
agcugcugcaggccuu

SEQ ID NO: 3895214 - RNA, 16 nt, Human adenovirus A
auaaaagcauacuuac

SEQ ID NO: 3895215 - RNA, 16 nt, Human adenovirus A
auaaaaggcuggaagu

SEQ ID NO: 3895216 - RNA, 17 nt, Human adenovirus A
auaaacaaaagcaaagc

SEQ ID NO: 3895217 - RNA, 18 nt, Human adenovirus A
auaaagcuggguuggugu

SEQ ID NO: 3895218 - RNA, 16 nt, Human adenovirus A
auaagaaagaggcagc

SEQ ID NO: 3895219 - RNA, 21 nt, Human adenovirus A
auaaggagacguuuuugccca

SEQ ID NO: 3895220 - RNA, 18 nt, Human adenovirus A
auaauuaaacccuuuagc

SEQ ID NO: 3895221 - RNA, 16 nt, Human adenovirus A
auacaacggccagcca

SEQ ID NO: 3895222 - RNA, 16 nt, Human adenovirus A
auacaguuuugaacaa

SEQ ID NO: 3895223 - RNA, 14 nt, Human adenovirus A
auaccaaaaacacc

SEQ ID NO: 3895224 - RNA, 15 nt, Human adenovirus A
auacucuuuaacauu

SEQ ID NO: 3895225 - RNA, 16 nt, Human adenovirus A
auacugcuagaacaag

SEQ ID NO: 3895226 - RNA, 15 nt, Human adenovirus A
auagaaaaagcuaca

SEQ ID NO: 3895227 - RNA, 14 nt, Human adenovirus A
auagaacuggaagg

SEQ ID NO: 3895228 - RNA, 15 nt, Human adenovirus A
auagcaacaacgcug

SEQ ID NO: 3895229 - RNA, 18 nt, Human adenovirus A
auaggaggaguuaaauaa

SEQ ID NO: 3895230 - RNA, 15 nt, Human adenovirus A
auagguauugauaaa

SEQ ID NO: 3895231 - RNA, 17 nt, Human adenovirus A
auaguucaucuuaguaa

SEQ ID NO: 3895232 - RNA, 17 nt, Human adenovirus A
auauaguacugcuucca

SEQ ID NO: 3895233 - RNA, 13 nt, Human adenovirus A
auaucaauguuuu

SEQ ID NO: 3895234 - RNA, 15 nt, Human adenovirus A
auaucacucuucgcu

SEQ ID NO: 3895235 - RNA, 16 nt, Human adenovirus A
auaucucauuugcaag

SEQ ID NO: 3895236 - RNA, 13 nt, Human adenovirus A
auaugcauuuaca

SEQ ID NO: 3895237 - RNA, 13 nt, Human adenovirus A
auaugggcgcaga

SEQ ID NO: 3895238 - RNA, 15 nt, Human adenovirus A
auauguaucuggaca

SEQ ID NO: 3895239 - RNA, 17 nt, Human adenovirus A
auauuaaaaagcucugu

SEQ ID NO: 3895240 - RNA, 22 nt, Human adenovirus A
auauuguagccugcuuucagca

SEQ ID NO: 3895241 - RNA, 14 nt, Human adenovirus A
aucagaagccagca

SEQ ID NO: 3895242 - RNA, 13 nt, Human adenovirus A
aucagccaugugc

SEQ ID NO: 3895243 - RNA, 14 nt, Human adenovirus A
aucaucaaacugcc

SEQ ID NO: 3895244 - RNA, 12 nt, Human adenovirus A
aucauuaaauaa

SEQ ID NO: 3895245 - RNA, 14 nt, Human adenovirus A
aucauuaagaacac

SEQ ID NO: 3895246 - RNA, 13 nt, Human adenovirus A
auccauuauuaug

SEQ ID NO: 3895247 - RNA, 20 nt, Human adenovirus A
auccauuuccaccaaaugcu

SEQ ID NO: 3895248 - RNA, 22 nt, Human adenovirus A
aucccgcgguuuuggcggccau

SEQ ID NO: 3895249 - RNA, 13 nt, Human adenovirus A
auccuagcguaca

SEQ ID NO: 3895250 - RNA, 14 nt, Human adenovirus A
aucggcggcgcgga

SEQ ID NO: 3895251 - RNA, 16 nt, Human adenovirus A
aucggcggcgcggacg

SEQ ID NO: 3895252 - RNA, 14 nt, Human adenovirus A
aucguucaacuuug

SEQ ID NO: 3895253 - RNA, 19 nt, Human adenovirus A
aucucacuuaagucuuuac

SEQ ID NO: 3895254 - RNA, 20 nt, Human adenovirus A
aucucacuuaagucuuuaca

SEQ ID NO: 3895255 - RNA, 13 nt, Human adenovirus A
aucuccauuccau

SEQ ID NO: 3895256 - RNA, 14 nt, Human adenovirus A
aucuguaaguuugu

SEQ ID NO: 3895257 - RNA, 15 nt, Human adenovirus A
aucugugucuuuacc

SEQ ID NO: 3895258 - RNA, 13 nt, Human adenovirus A
aucuguuuggcuc

SEQ ID NO: 3895259 - RNA, 18 nt, Human adenovirus A
aucuucaucuuuucuaga

SEQ ID NO: 3895260 - RNA, 20 nt, Human adenovirus A
augaaaaagucagcugcaaa

SEQ ID NO: 3895261 - RNA, 15 nt, Human adenovirus A
augaacaaaaucacc

SEQ ID NO: 3895262 - RNA, 14 nt, Human adenovirus A
augaaggaaugccu

SEQ ID NO: 3895263 - RNA, 17 nt, Human adenovirus A
augacaaugaauaagcc

SEQ ID NO: 3895264 - RNA, 21 nt, Human adenovirus A
augacaaugaauaagccaccg

SEQ ID NO: 3895265 - RNA, 21 nt, Human adenovirus A
augaccaaacgcaaguucaaa

SEQ ID NO: 3895266 - RNA, 21 nt, Human adenovirus A
augaccguuugcuaaccccaa

SEQ ID NO: 3895267 - RNA, 19 nt, Human adenovirus A
augacuaacgcuggggcac

SEQ ID NO: 3895268 - RNA, 14 nt, Human adenovirus A
augacuggacagcg

SEQ ID NO: 3895269 - RNA, 23 nt, Human adenovirus A
augaggaagcaauaaaacaagga

SEQ ID NO: 3895270 - RNA, 15 nt, Human adenovirus A
augaugccgcagugg

SEQ ID NO: 3895271 - RNA, 12 nt, Human adenovirus A
augcaaggcgcc

SEQ ID NO: 3895272 - RNA, 20 nt, Human adenovirus A
augcaguguaaccagaucua

SEQ ID NO: 3895273 - RNA, 14 nt, Human adenovirus A
augccaacaaaacu

SEQ ID NO: 3895274 - RNA, 22 nt, Human adenovirus A
augccagacacgcaucuugugu

SEQ ID NO: 3895275 - RNA, 15 nt, Human adenovirus A
augccaguuuacuga

SEQ ID NO: 3895276 - RNA, 19 nt, Human adenovirus A
augccaguuuacugacaga

SEQ ID NO: 3895277 - RNA, 14 nt, Human adenovirus A
augcccgccuggca

SEQ ID NO: 3895278 - RNA, 18 nt, Human adenovirus A
augcccugcaaaaagaaa

SEQ ID NO: 3895279 - RNA, 13 nt, Human adenovirus A
augccggcagcgg

SEQ ID NO: 3895280 - RNA, 18 nt, Human adenovirus A
augccuuuuucccaagcu

SEQ ID NO: 3895281 - RNA, 22 nt, Human adenovirus A
augcgacguuuuguuaccugug

SEQ ID NO: 3895282 - RNA, 19 nt, Human adenovirus A
augcgggagggacaagcuu

SEQ ID NO: 3895283 - RNA, 10 nt, Human adenovirus A
augcuggaac

SEQ ID NO: 3895284 - RNA, 17 nt, Human adenovirus A
augcuuagucauuacaa

SEQ ID NO: 3895285 - RNA, 20 nt, Human adenovirus A
auggaaagccgguuguaagc

SEQ ID NO: 3895286 - RNA, 15 nt, Human adenovirus A
auggacucaaauaaa

SEQ ID NO: 3895287 - RNA, 17 nt, Human adenovirus A
auggagcggcugacaga

SEQ ID NO: 3895288 - RNA, 18 nt, Human adenovirus A
auggaguuuagaaggaaa

SEQ ID NO: 3895289 - RNA, 20 nt, Human adenovirus A
auggcagcggcgccacccua

SEQ ID NO: 3895290 - RNA, 21 nt, Human adenovirus A
auggcuaugauuaaugucuaa

SEQ ID NO: 3895291 - RNA, 21 nt, Human adenovirus A
augggaggaaagacagccaag

SEQ ID NO: 3895292 - RNA, 14 nt, Human adenovirus A
augggcaccuggaa

SEQ ID NO: 3895293 - RNA, 21 nt, Human adenovirus A
augggcaccuggaacgagauc

SEQ ID NO: 3895294 - RNA, 16 nt, Human adenovirus A
augguaaaaaggaagc

SEQ ID NO: 3895295 - RNA, 13 nt, Human adenovirus A
augguagaggaaa

SEQ ID NO: 3895296 - RNA, 20 nt, Human adenovirus A
auggucuucaagaaaaacca

SEQ ID NO: 3895297 - RNA, 19 nt, Human adenovirus A
auggugacgguucuucuca

SEQ ID NO: 3895298 - RNA, 14 nt, Human adenovirus A
auguaucagcagcc

SEQ ID NO: 3895299 - RNA, 21 nt, Human adenovirus A
auguaugcccagcaugaccaa

SEQ ID NO: 3895300 - RNA, 15 nt, Human adenovirus A
augugaugaaaguag

SEQ ID NO: 3895301 - RNA, 21 nt, Human adenovirus A
augugcaaauauaaaagcaca

SEQ ID NO: 3895302 - RNA, 17 nt, Human adenovirus A
augugugcgcugugguu

SEQ ID NO: 3895303 - RNA, 19 nt, Human adenovirus A
auguuaauuaucccuuuga

SEQ ID NO: 3895304 - RNA, 20 nt, Human adenovirus A
auguucccaaauauccagga

SEQ ID NO: 3895305 - RNA, 15 nt, Human adenovirus A
auguucgaagcuaau

SEQ ID NO: 3895306 - RNA, 13 nt, Human adenovirus A
auuaaaagggaag

SEQ ID NO: 3895307 - RNA, 16 nt, Human adenovirus A
auuaacuuugaugaaa

SEQ ID NO: 3895308 - RNA, 21 nt, Human adenovirus A
auuacacucaggccauaaaga

SEQ ID NO: 3895309 - RNA, 15 nt, Human adenovirus A
auuaccgagcuccau

SEQ ID NO: 3895310 - RNA, 14 nt, Human adenovirus A
auuaucgcucuuuu

SEQ ID NO: 3895311 - RNA, 14 nt, Human adenovirus A
auuauuugaacaca

SEQ ID NO: 3895312 - RNA, 16 nt, Human adenovirus A
auucagcuaacaaugc

SEQ ID NO: 3895313 - RNA, 22 nt, Human adenovirus A
auucauauauguaucuggacau

SEQ ID NO: 3895314 - RNA, 13 nt, Human adenovirus A
auucaucaacauu

SEQ ID NO: 3895315 - RNA, 14 nt, Human adenovirus A
auucaucauuuguc

SEQ ID NO: 3895316 - RNA, 14 nt, Human adenovirus A
auuccauaauuaaa

SEQ ID NO: 3895317 - RNA, 20 nt, Human adenovirus A
auuccaugagcccggggacu

SEQ ID NO: 3895318 - RNA, 22 nt, Human adenovirus A
auucgcgugccaggcauuucca

SEQ ID NO: 3895319 - RNA, 15 nt, Human adenovirus A
auucuugagccugga

SEQ ID NO: 3895320 - RNA, 13 nt, Human adenovirus A
auugauacuuguu

SEQ ID NO: 3895321 - RNA, 23 nt, Human adenovirus A
auugcccccuuuaccaacaccaa

SEQ ID NO: 3895322 - RNA, 16 nt, Human adenovirus A
auugguggaaaaagau

SEQ ID NO: 3895323 - RNA, 14 nt, Human adenovirus A
auugguuccuaaua

SEQ ID NO: 3895324 - RNA, 22 nt, Human adenovirus A
auuguaagcgauuuuccaaaug

SEQ ID NO: 3895325 - RNA, 16 nt, Human adenovirus A
auuguagccugcuuuc

SEQ ID NO: 3895326 - RNA, 15 nt, Human adenovirus A
auugugggacuggga

SEQ ID NO: 3895327 - RNA, 16 nt, Human adenovirus A
auuguuaacacugccg

SEQ ID NO: 3895328 - RNA, 22 nt, Human adenovirus A
caaacuauauaaaucagccuuu

SEQ ID NO: 3895329 - RNA, 15 nt, Human adenovirus A
caaacuuacaagcac

SEQ ID NO: 3895330 - RNA, 16 nt, Human adenovirus A
caaagccacaccucca

SEQ ID NO: 3895331 - RNA, 14 nt, Human adenovirus A
caaagccaggcaca

SEQ ID NO: 3895332 - RNA, 21 nt, Human adenovirus A
caaaguaauauuguagccugc

SEQ ID NO: 3895333 - RNA, 13 nt, Human adenovirus A
caaagugaagugu

SEQ ID NO: 3895334 - RNA, 13 nt, Human adenovirus A
caaauccaaaagc

SEQ ID NO: 3895335 - RNA, 16 nt, Human adenovirus A
caaauccaaaagcaac

SEQ ID NO: 3895336 - RNA, 16 nt, Human adenovirus A
caaaugcccugcaaaa

SEQ ID NO: 3895337 - RNA, 19 nt, Human adenovirus A
caaaugcuuagucauuaca

SEQ ID NO: 3895338 - RNA, 15 nt, Human adenovirus A
caaauuugcauuucc

SEQ ID NO: 3895339 - RNA, 20 nt, Human adenovirus A
caacaacagcuucuaaaaga

SEQ ID NO: 3895340 - RNA, 22 nt, Human adenovirus A
caacaagaugaguaaagauauu

SEQ ID NO: 3895341 - RNA, 21 nt, Human adenovirus A
caacaagucuucugacauugc

SEQ ID NO: 3895342 - RNA, 19 nt, Human adenovirus A
caacaauggcauagaaagu

SEQ ID NO: 3895343 - RNA, 15 nt, Human adenovirus A
caacacaaaaaaaac

SEQ ID NO: 3895344 - RNA, 13 nt, Human adenovirus A
caacacagcacua

SEQ ID NO: 3895345 - RNA, 16 nt, Human adenovirus A
caacaccucacaaggu

SEQ ID NO: 3895346 - RNA, 21 nt, Human adenovirus A
caacagcggggaggaagcuga

SEQ ID NO: 3895347 - RNA, 12 nt, Human adenovirus A
caacaguacagg

SEQ ID NO: 3895348 - RNA, 20 nt, Human adenovirus A
caacccaaacuguacaagga

SEQ ID NO: 3895349 - RNA, 13 nt, Human adenovirus A
caaccucacugcu

SEQ ID NO: 3895350 - RNA, 13 nt, Human adenovirus A
caacgaaggccaa

SEQ ID NO: 3895351 - RNA, 21 nt, Human adenovirus A
caacggcaggaaaucugggag

SEQ ID NO: 3895352 - RNA, 22 nt, Human adenovirus A
caacugagacuucccacagcca

SEQ ID NO: 3895353 - RNA, 14 nt, Human adenovirus A
caacugcacuugaa

SEQ ID NO: 3895354 - RNA, 18 nt, Human adenovirus A
caacugucaaaccugaca

SEQ ID NO: 3895355 - RNA, 17 nt, Human adenovirus A
caacuugcuuccagaca

SEQ ID NO: 3895356 - RNA, 20 nt, Human adenovirus A
caagacguuccauggcuucg

SEQ ID NO: 3895357 - RNA, 20 nt, Human adenovirus A
caagacuauucuagcaaaau

SEQ ID NO: 3895358 - RNA, 15 nt, Human adenovirus A
caagaggaagaaaga

SEQ ID NO: 3895359 - RNA, 16 nt, Human adenovirus A
caagaggagaaggagg

SEQ ID NO: 3895360 - RNA, 18 nt, Human adenovirus A
caagcacgccaaagccac

SEQ ID NO: 3895361 - RNA, 18 nt, Human adenovirus A
caagcauuuuuuguugcu

SEQ ID NO: 3895362 - RNA, 22 nt, Human adenovirus A
caagcauuuuuuguugcuccag

SEQ ID NO: 3895363 - RNA, 14 nt, Human adenovirus A
caagccgcaggacu

SEQ ID NO: 3895364 - RNA, 15 nt, Human adenovirus A
caagccgcucucacc

SEQ ID NO: 3895365 - RNA, 19 nt, Human adenovirus A
caagccgcucucaccgcua

SEQ ID NO: 3895366 - RNA, 14 nt, Human adenovirus A
caagccuguaaaau

SEQ ID NO: 3895367 - RNA, 16 nt, Human adenovirus A
caagcggcgaaggccu

SEQ ID NO: 3895368 - RNA, 14 nt, Human adenovirus A
caagcuucccaacu

SEQ ID NO: 3895369 - RNA, 18 nt, Human adenovirus A
caaggaccgcauguauuc

SEQ ID NO: 3895370 - RNA, 15 nt, Human adenovirus A
caaggucaacuuaca

SEQ ID NO: 3895371 - RNA, 18 nt, Human adenovirus A
caagguuuuuacauucca

SEQ ID NO: 3895372 - RNA, 20 nt, Human adenovirus A
caaguugacuucgcacaggc

SEQ ID NO: 3895373 - RNA, 21 nt, Human adenovirus A
caaguugacuucgcacaggcg

SEQ ID NO: 3895374 - RNA, 19 nt, Human adenovirus A
caauaguggcugcaagguc

SEQ ID NO: 3895375 - RNA, 22 nt, Human adenovirus A
caaugacaaugaauaagccacc

SEQ ID NO: 3895376 - RNA, 16 nt, Human adenovirus A
caaugcagcuguggag

SEQ ID NO: 3895377 - RNA, 21 nt, Human adenovirus A
caauuuacauuuuaacuguga

SEQ ID NO: 3895378 - RNA, 21 nt, Human adenovirus A
caauuucuuccuccuggaggu

SEQ ID NO: 3895379 - RNA, 15 nt, Human adenovirus A
cacaaaauaccccua

SEQ ID NO: 3895380 - RNA, 17 nt, Human adenovirus A
cacaaauggacccauau

SEQ ID NO: 3895381 - RNA, 14 nt, Human adenovirus A
cacaaggaaaugag

SEQ ID NO: 3895382 - RNA, 14 nt, Human adenovirus A
cacaaguacaucca

SEQ ID NO: 3895383 - RNA, 17 nt, Human adenovirus A
cacaccaaacuggccau

SEQ ID NO: 3895384 - RNA, 14 nt, Human adenovirus A
cacacgcagcaacc

SEQ ID NO: 3895385 - RNA, 20 nt, Human adenovirus A
cacagaacauacaacuugca

SEQ ID NO: 3895386 - RNA, 15 nt, Human adenovirus A
cacagcacuaacaug

SEQ ID NO: 3895387 - RNA, 12 nt, Human adenovirus A
cacagccagugg

SEQ ID NO: 3895388 - RNA, 12 nt, Human adenovirus A
cacagcuuccag

SEQ ID NO: 3895389 - RNA, 14 nt, Human adenovirus A
cacaggauccacuu

SEQ ID NO: 3895390 - RNA, 13 nt, Human adenovirus A
cacaguaaucuuu

SEQ ID NO: 3895391 - RNA, 21 nt, Human adenovirus A
cacauugcgcaaaauugagga

SEQ ID NO: 3895392 - RNA, 15 nt, Human adenovirus A
cacccaagggugcag

SEQ ID NO: 3895393 - RNA, 16 nt, Human adenovirus A
cacccucccagacugc

SEQ ID NO: 3895394 - RNA, 21 nt, Human adenovirus A
caccgccaugcgcgcggccag

SEQ ID NO: 3895395 - RNA, 20 nt, Human adenovirus A
caccgucaauucuucuucca

SEQ ID NO: 3895396 - RNA, 16 nt, Human adenovirus A
caccucgcuccaauuu

SEQ ID NO: 3895397 - RNA, 20 nt, Human adenovirus A
caccucuagaaacugugccc

SEQ ID NO: 3895398 - RNA, 15 nt, Human adenovirus A
caccuuuuaccuaaa

SEQ ID NO: 3895399 - RNA, 17 nt, Human adenovirus A
cacgagccagcugaacg

SEQ ID NO: 3895400 - RNA, 22 nt, Human adenovirus A
cacgcaucuuguguuuaagccu

SEQ ID NO: 3895401 - RNA, 16 nt, Human adenovirus A
cacgccaaagccacac

SEQ ID NO: 3895402 - RNA, 12 nt, Human adenovirus A
cacgccguagac

SEQ ID NO: 3895403 - RNA, 13 nt, Human adenovirus A
cacggccucagca

SEQ ID NO: 3895404 - RNA, 16 nt, Human adenovirus A
cacuaccgucagugaa

SEQ ID NO: 3895405 - RNA, 15 nt, Human adenovirus A
cacuacgcccacuuc

SEQ ID NO: 3895406 - RNA, 16 nt, Human adenovirus A
cacuagucccauuaca

SEQ ID NO: 3895407 - RNA, 20 nt, Human adenovirus A
cacuagucccauuacaguaa

SEQ ID NO: 3895408 - RNA, 14 nt, Human adenovirus A
cacugaaaaaccaa

SEQ ID NO: 3895409 - RNA, 23 nt, Human adenovirus A
acgcaguuacaacuugcuuccag

SEQ ID NO: 3895410 - RNA, 17 nt, Human adenovirus A
acgccuuacauguggag

SEQ ID NO: 3895411 - RNA, 13 nt, Human adenovirus A
acgcuuugcuuga

SEQ ID NO: 3895412 - RNA, 23 nt, Human adenovirus A
acgcuuuuuugaguacucagccg

SEQ ID NO: 3895413 - RNA, 14 nt, Human adenovirus A
acggagacaaaauu

SEQ ID NO: 3895414 - RNA, 18 nt, Human adenovirus A
acguagucauauagcuca

SEQ ID NO: 3895415 - RNA, 21 nt, Human adenovirus A
acgucaccaccucaaaaucua

SEQ ID NO: 3895416 - RNA, 16 nt, Human adenovirus A
acgucgcuaaauggau

SEQ ID NO: 3895417 - RNA, 21 nt, Human adenovirus A
acguucccgcccuuacagauc

SEQ ID NO: 3895418 - RNA, 16 nt, Human adenovirus A
acuaacaaugcuuucc

SEQ ID NO: 3895419 - RNA, 22 nt, Human adenovirus A
acuaccccuccuucgcuguccc

SEQ ID NO: 3895420 - RNA, 20 nt, Human adenovirus A
acuaccgcugcucagcucca

SEQ ID NO: 3895421 - RNA, 13 nt, Human adenovirus A
acuagguauugau

SEQ ID NO: 3895422 - RNA, 18 nt, Human adenovirus A
acuauggaccuacuuacu

SEQ ID NO: 3895423 - RNA, 16 nt, Human adenovirus A
acuauucggaaaccau

SEQ ID NO: 3895424 - RNA, 15 nt, Human adenovirus A
acucaaaugugggcu

SEQ ID NO: 3895425 - RNA, 21 nt, Human adenovirus A
acucaacguagcuuuugacug

SEQ ID NO: 3895426 - RNA, 14 nt, Human adenovirus A
acucacuggccuga

SEQ ID NO: 3895427 - RNA, 16 nt, Human adenovirus A
acuccaggaaacauaa

SEQ ID NO: 3895428 - RNA, 15 nt, Human adenovirus A
acuccaucuguuuac

SEQ ID NO: 3895429 - RNA, 15 nt, Human adenovirus A
acucuaacugcucag

SEQ ID NO: 3895430 - RNA, 18 nt, Human adenovirus A
acucuccaauuuguggag

SEQ ID NO: 3895431 - RNA, 19 nt, Human adenovirus A
acucuccaauuuguggagg

SEQ ID NO: 3895432 - RNA, 20 nt, Human adenovirus A
acucuccugagcgucaccca

SEQ ID NO: 3895433 - RNA, 17 nt, Human adenovirus A
acucuggcgaagggccu

SEQ ID NO: 3895434 - RNA, 18 nt, Human adenovirus A
acugaauauuuagacuau

SEQ ID NO: 3895435 - RNA, 16 nt, Human adenovirus A
acugaugaucuucccg

SEQ ID NO: 3895436 - RNA, 20 nt, Human adenovirus A
acugauuuugcagguuuaaa

SEQ ID NO: 3895437 - RNA, 18 nt, Human adenovirus A
acugcaaaauugaaaaac

SEQ ID NO: 3895438 - RNA, 21 nt, Human adenovirus A
acugcagccugucuuaaaauc

SEQ ID NO: 3895439 - RNA, 21 nt, Human adenovirus A
acugccggucgcgaaacuggg

SEQ ID NO: 3895440 - RNA, 19 nt, Human adenovirus A
acugggaguugcgagcugc

SEQ ID NO: 3895441 - RNA, 19 nt, Human adenovirus A
acugguaacggucuucaag

SEQ ID NO: 3895442 - RNA, 17 nt, Human adenovirus A
acuguaaaaccuacaca

SEQ ID NO: 3895443 - RNA, 22 nt, Human adenovirus A
acuguagacgauguuauugacu

SEQ ID NO: 3895444 - RNA, 14 nt, Human adenovirus A
acugucccccacca

SEQ ID NO: 3895445 - RNA, 15 nt, Human adenovirus A
acugugcgguuuaag

SEQ ID NO: 3895446 - RNA, 18 nt, Human adenovirus A
acugugcugcaaaguuuu

SEQ ID NO: 3895447 - RNA, 18 nt, Human adenovirus A
acuguugaugcaguaauu

SEQ ID NO: 3895448 - RNA, 22 nt, Human adenovirus A
acuguuguauuauuugaacaca

SEQ ID NO: 3895449 - RNA, 14 nt, Human adenovirus A
acuuaauuucuaga

SEQ ID NO: 3895450 - RNA, 20 nt, Human adenovirus A
acuuagaccggauggguaca

SEQ ID NO: 3895451 - RNA, 16 nt, Human adenovirus A
acuuaguuacuuugua

SEQ ID NO: 3895452 - RNA, 16 nt, Human adenovirus A
acuuaucagccagagc

SEQ ID NO: 3895453 - RNA, 15 nt, Human adenovirus A
acuugggaaauuugu

SEQ ID NO: 3895454 - RNA, 16 nt, Human adenovirus A
acuugggaaauuuguc

SEQ ID NO: 3895455 - RNA, 16 nt, Human adenovirus A
acuuguuuuuucugac

SEQ ID NO: 3895456 - RNA, 20 nt, Human adenovirus A
acuuguuuuuucugacaugg

SEQ ID NO: 3895457 - RNA, 19 nt, Human adenovirus A
acuuuagaaaggauguaaa

SEQ ID NO: 3895458 - RNA, 19 nt, Human adenovirus A
acuuuagccccagcggcag

SEQ ID NO: 3895459 - RNA, 21 nt, Human adenovirus A
acuuugagcuuccagaggagc

SEQ ID NO: 3895460 - RNA, 17 nt, Human adenovirus A
acuuuucaaacuuuaca

SEQ ID NO: 3895461 - RNA, 14 nt, Human adenovirus A
agaaacugugcccg

SEQ ID NO: 3895462 - RNA, 18 nt, Human adenovirus A
agaagacaaagagugacu

SEQ ID NO: 3895463 - RNA, 21 nt, Human adenovirus A
agaaggaaaggcauggaaaaa

SEQ ID NO: 3895464 - RNA, 23 nt, Human adenovirus A
agaauaggggaugguuuaacauu

SEQ ID NO: 3895465 - RNA, 16 nt, Human adenovirus A
agaaucgcaagcaggc

SEQ ID NO: 3895466 - RNA, 15 nt, Human adenovirus A
agaaugaucacagca

SEQ ID NO: 3895467 - RNA, 15 nt, Human adenovirus A
agacaauuccaacga

SEQ ID NO: 3895468 - RNA, 13 nt, Human adenovirus A
agacaguuucauc

SEQ ID NO: 3895469 - RNA, 24 nt, Human adenovirus A
agacauauggcaccaaggcgugga

SEQ ID NO: 3895470 - RNA, 16 nt, Human adenovirus A
agaccaaaauuuucaa

SEQ ID NO: 3895471 - RNA, 16 nt, Human adenovirus A
agaccaaccaccgcca

SEQ ID NO: 3895472 - RNA, 16 nt, Human adenovirus A
agacgagguccaucac

SEQ ID NO: 3895473 - RNA, 21 nt, Human adenovirus A
agagaacaaacagugccuguu

SEQ ID NO: 3895474 - RNA, 15 nt, Human adenovirus A
agagagcuaagcgac

SEQ ID NO: 3895475 - RNA, 17 nt, Human adenovirus A
agagcacacugggaaau

SEQ ID NO: 3895476 - RNA, 13 nt, Human adenovirus A
agagcaggcugga

SEQ ID NO: 3895477 - RNA, 13 nt, Human adenovirus A
agaggaaaagcug

SEQ ID NO: 3895478 - RNA, 23 nt, Human adenovirus A
agaggagaaggaggaggagcgga

SEQ ID NO: 3895479 - RNA, 15 nt, Human adenovirus A
agaggcauaaaaacu

SEQ ID NO: 3895480 - RNA, 20 nt, Human adenovirus A
agauaacgcuaagcuuaaua

SEQ ID NO: 3895481 - RNA, 23 nt, Human adenovirus A
agauaacggaggaggagguggcu

SEQ ID NO: 3895482 - RNA, 20 nt, Human adenovirus A
agauauaguacugcuuccag

SEQ ID NO: 3895483 - RNA, 14 nt, Human adenovirus A
agaucacagccaga

SEQ ID NO: 3895484 - RNA, 18 nt, Human adenovirus A
agaucuuaggguuugauu

SEQ ID NO: 3895485 - RNA, 16 nt, Human adenovirus A
agaugagccuguauau

SEQ ID NO: 3895486 - RNA, 16 nt, Human adenovirus A
agaugcauccuguccu

SEQ ID NO: 3895487 - RNA, 12 nt, Human adenovirus A
agaugccuggca

SEQ ID NO: 3895488 - RNA, 14 nt, Human adenovirus A
agauuaccacgccc

SEQ ID NO: 3895489 - RNA, 14 nt, Human adenovirus A
agauucuucuuccc

SEQ ID NO: 3895490 - RNA, 14 nt, Human adenovirus A
agauuguaauuuuu

SEQ ID NO: 3895491 - RNA, 20 nt, Human adenovirus A
agcaaaaauguuuucuggau

SEQ ID NO: 3895492 - RNA, 13 nt, Human adenovirus A
agcaaaaugaauu

SEQ ID NO: 3895493 - RNA, 12 nt, Human adenovirus A
agcaaacacugc

SEQ ID NO: 3895494 - RNA, 11 nt, Human adenovirus A
agcaaagccau

SEQ ID NO: 3895495 - RNA, 17 nt, Human adenovirus A
agcaaaugcccugcaaa

SEQ ID NO: 3895496 - RNA, 18 nt, Human adenovirus A
agcacaacuccaugugga

SEQ ID NO: 3895497 - RNA, 14 nt, Human adenovirus A
agcaccugccgcca

SEQ ID NO: 3895498 - RNA, 19 nt, Human adenovirus A
agcacgccaaagccacacc

SEQ ID NO: 3895499 - RNA, 12 nt, Human adenovirus A
agcacuggcaac

SEQ ID NO: 3895500 - RNA, 15 nt, Human adenovirus A
agcagagucgagguc

SEQ ID NO: 3895501 - RNA, 12 nt, Human adenovirus A
agcagcgguggc

SEQ ID NO: 3895502 - RNA, 15 nt, Human adenovirus A
agcagcuuggcuaua

SEQ ID NO: 3895503 - RNA, 19 nt, Human adenovirus A
agcagguguaaccagcugg

SEQ ID NO: 3895504 - RNA, 10 nt, Human adenovirus A
agcagugaaa

SEQ ID NO: 3895505 - RNA, 13 nt, Human adenovirus A
agcagugcggccu

SEQ ID NO: 3895506 - RNA, 18 nt, Human adenovirus A
agcagugcggccuguugc

SEQ ID NO: 3895507 - RNA, 17 nt, Human adenovirus A
agcauaaaagcuucaau

SEQ ID NO: 3895508 - RNA, 14 nt, Human adenovirus A
agcauuaaacgcuu

SEQ ID NO: 3895509 - RNA, 19 nt, Human adenovirus A
agcauuaguucuuuucuuu

SEQ ID NO: 3895510 - RNA, 23 nt, Human adenovirus A
agcauuaguucuuuucuuuaugu

SEQ ID NO: 3895511 - RNA, 19 nt, Human adenovirus A
agcauucucuaacaagcug

SEQ ID NO: 3895512 - RNA, 11 nt, Human adenovirus A
agccacaggaa

SEQ ID NO: 3895513 - RNA, 18 nt, Human adenovirus A
agccacaguagacauugu

SEQ ID NO: 3895514 - RNA, 20 nt, Human adenovirus A
agccagauguaaaaguacgu

SEQ ID NO: 3895515 - RNA, 18 nt, Human adenovirus A
agccagcagcaaagaaag

SEQ ID NO: 3895516 - RNA, 15 nt, Human adenovirus A
agccaugcaaauagu

SEQ ID NO: 3895517 - RNA, 20 nt, Human adenovirus A
agccaugcuaugcaggcagc

SEQ ID NO: 3895518 - RNA, 15 nt, Human adenovirus A
agccauggcgaccag

SEQ ID NO: 3895519 - RNA, 17 nt, Human adenovirus A
agccauggcgaccagug

SEQ ID NO: 3895520 - RNA, 19 nt, Human adenovirus A
agccauugguuuaaugcau

SEQ ID NO: 3895521 - RNA, 23 nt, Human adenovirus A
agcccaacccauugacaaagaug

SEQ ID NO: 3895522 - RNA, 13 nt, Human adenovirus A
agcccaacccuuc

SEQ ID NO: 3895523 - RNA, 14 nt, Human adenovirus A
agcccaacccuucc

SEQ ID NO: 3895524 - RNA, 12 nt, Human adenovirus A
agcccacaagga

SEQ ID NO: 3895525 - RNA, 18 nt, Human adenovirus A
agcccccgcguccuccuu

SEQ ID NO: 3895526 - RNA, 16 nt, Human adenovirus A
cagcccaacccuuccc

SEQ ID NO: 3895527 - RNA, 21 nt, Human adenovirus A
cagccgcgcagaugagcuucu

SEQ ID NO: 3895528 - RNA, 17 nt, Human adenovirus A
cagccgcuaccaucacu

SEQ ID NO: 3895529 - RNA, 15 nt, Human adenovirus A
cagccuacaaugcaa

SEQ ID NO: 3895530 - RNA, 21 nt, Human adenovirus A
cagccuuuauuuaucugugcu

SEQ ID NO: 3895531 - RNA, 12 nt, Human adenovirus A
cagcgcacuggc

SEQ ID NO: 3895532 - RNA, 21 nt, Human adenovirus A
cagcuaacaaugcagcaaaca

SEQ ID NO: 3895533 - RNA, 20 nt, Human adenovirus A
cagcuacuaauuaagcgagc

SEQ ID NO: 3895534 - RNA, 23 nt, Human adenovirus A
cagcuccaaccaugaaaacagca

SEQ ID NO: 3895535 - RNA, 14 nt, Human adenovirus A
cagcucuugcagua

SEQ ID NO: 3895536 - RNA, 21 nt, Human adenovirus A
cagcugaacgacgaagucaca

SEQ ID NO: 3895537 - RNA, 22 nt, Human adenovirus A
cagcugccgucuucguggagaa

SEQ ID NO: 3895538 - RNA, 15 nt, Human adenovirus A
cagcugguauuuggc

SEQ ID NO: 3895539 - RNA, 11 nt, Human adenovirus A
cagcuguggaa

SEQ ID NO: 3895540 - RNA, 20 nt, Human adenovirus A
cagcuugcgggcggugcacg

SEQ ID NO: 3895541 - RNA, 18 nt, Human adenovirus A
caggaaaaaaaagaaagu

SEQ ID NO: 3895542 - RNA, 21 nt, Human adenovirus A
caggaaaaaaaagaaaguuua

SEQ ID NO: 3895543 - RNA, 15 nt, Human adenovirus A
caggaagagccucaa

SEQ ID NO: 3895544 - RNA, 19 nt, Human adenovirus A
caggaagagccucaauguc

SEQ ID NO: 3895545 - RNA, 16 nt, Human adenovirus A
caggaggacacuggca

SEQ ID NO: 3895546 - RNA, 13 nt, Human adenovirus A
caggcaaagaaca

SEQ ID NO: 3895547 - RNA, 16 nt, Human adenovirus A
caggcggucugccauu

SEQ ID NO: 3895548 - RNA, 18 nt, Human adenovirus A
caggcggucugccauucc

SEQ ID NO: 3895549 - RNA, 12 nt, Human adenovirus A
caggcuggaggu

SEQ ID NO: 3895550 - RNA, 22 nt, Human adenovirus A
cagggaagauuaaucacaucaa

SEQ ID NO: 3895551 - RNA, 12 nt, Human adenovirus A
caggugcaagaa

SEQ ID NO: 3895552 - RNA, 13 nt, Human adenovirus A
cagguggcagcga

SEQ ID NO: 3895553 - RNA, 17 nt, Human adenovirus A
cagguguauuagcacuu

SEQ ID NO: 3895554 - RNA, 15 nt, Human adenovirus A
caguacaaagccagg

SEQ ID NO: 3895555 - RNA, 17 nt, Human adenovirus A
caguacacuugggaaau

SEQ ID NO: 3895556 - RNA, 17 nt, Human adenovirus A
caguacgaggacugauc

SEQ ID NO: 3895557 - RNA, 22 nt, Human adenovirus A
caguaggcgaucguucaacuuu

SEQ ID NO: 3895558 - RNA, 17 nt, Human adenovirus A
caguaucaguggaguuc

SEQ ID NO: 3895559 - RNA, 11 nt, Human adenovirus A
caguauuuugu

SEQ ID NO: 3895560 - RNA, 16 nt, Human adenovirus A
cagucuguuuaguccu

SEQ ID NO: 3895561 - RNA, 19 nt, Human adenovirus A
cagucuugaaugcucugga

SEQ ID NO: 3895562 - RNA, 22 nt, Human adenovirus A
caguguuagucgcgcacugggc

SEQ ID NO: 3895563 - RNA, 18 nt, Human adenovirus A
caguucaugcuaaaagcu

SEQ ID NO: 3895564 - RNA, 13 nt, Human adenovirus A
caguuucuggagc

SEQ ID NO: 3895565 - RNA, 18 nt, Human adenovirus A
caguuugggcuaguucuu

SEQ ID NO: 3895566 - RNA, 21 nt, Human adenovirus A
cauaaagagucucaaaagcag

SEQ ID NO: 3895567 - RNA, 13 nt, Human adenovirus A
cauaacauguuua

SEQ ID NO: 3895568 - RNA, 15 nt, Human adenovirus A
cauaacauguuuaug

SEQ ID NO: 3895569 - RNA, 18 nt, Human adenovirus A
cauaauacgguguucuca

SEQ ID NO: 3895570 - RNA, 18 nt, Human adenovirus A
cauacaaaucagaagcca

SEQ ID NO: 3895571 - RNA, 22 nt, Human adenovirus A
cauacacucauguauuuuuuca

SEQ ID NO: 3895572 - RNA, 16 nt, Human adenovirus A
cauacauaauuuuaaa

SEQ ID NO: 3895573 - RNA, 15 nt, Human adenovirus A
cauacaucaccucuu

SEQ ID NO: 3895574 - RNA, 18 nt, Human adenovirus A
cauaccugggucacuuag

SEQ ID NO: 3895575 - RNA, 22 nt, Human adenovirus A
cauacgcuugugcagccuuucu

SEQ ID NO: 3895576 - RNA, 18 nt, Human adenovirus A
cauagccaaucaggcugu

SEQ ID NO: 3895577 - RNA, 14 nt, Human adenovirus A
cauaggagcugcac

SEQ ID NO: 3895578 - RNA, 17 nt, Human adenovirus A
caucagccgcccaagga

SEQ ID NO: 3895579 - RNA, 15 nt, Human adenovirus A
caucaggagcagaaa

SEQ ID NO: 3895580 - RNA, 12 nt, Human adenovirus A
cauccaaaacca

SEQ ID NO: 3895581 - RNA, 14 nt, Human adenovirus A
cauccgcaggcagu

SEQ ID NO: 3895582 - RNA, 20 nt, Human adenovirus A
cauccggcgcgcccggcucc

SEQ ID NO: 3895583 - RNA, 19 nt, Human adenovirus A
caucguaaacaacagacuu

SEQ ID NO: 3895584 - RNA, 18 nt, Human adenovirus A
caucucaccacugaaacu

SEQ ID NO: 3895585 - RNA, 15 nt, Human adenovirus A
caucucauaaucagu

SEQ ID NO: 3895586 - RNA, 19 nt, Human adenovirus A
caugauguuuaauaaagcg

SEQ ID NO: 3895587 - RNA, 22 nt, Human adenovirus A
caugauguuuaauaaagcgcag

SEQ ID NO: 3895588 - RNA, 15 nt, Human adenovirus A
caugcaaagccagcc

SEQ ID NO: 3895589 - RNA, 14 nt, Human adenovirus A
caugcuaaaagcuu

SEQ ID NO: 3895590 - RNA, 17 nt, Human adenovirus A
cauggacucuacuaaca

SEQ ID NO: 3895591 - RNA, 22 nt, Human adenovirus A
cauggcuaguucuuacuuugac

SEQ ID NO: 3895592 - RNA, 17 nt, Human adenovirus A
cauggcugaagaggagg

SEQ ID NO: 3895593 - RNA, 21 nt, Human adenovirus A
caugguuugcuaacagcucuc

SEQ ID NO: 3895594 - RNA, 18 nt, Human adenovirus A
cauguauaauaaaacugg

SEQ ID NO: 3895595 - RNA, 22 nt, Human adenovirus A
cauguuauuuaaaauuccauaa

SEQ ID NO: 3895596 - RNA, 21 nt, Human adenovirus A
cauuaaaaucaaccuuucgau

SEQ ID NO: 3895597 - RNA, 16 nt, Human adenovirus A
cauuacaauuaacugc

SEQ ID NO: 3895598 - RNA, 14 nt, Human adenovirus A
cauuaccagcagcc

SEQ ID NO: 3895599 - RNA, 18 nt, Human adenovirus A
cauuaccagcagccaaaa

SEQ ID NO: 3895600 - RNA, 13 nt, Human adenovirus A
cauuaccucugua

SEQ ID NO: 3895601 - RNA, 14 nt, Human adenovirus A
cauuacgcagggaa

SEQ ID NO: 3895602 - RNA, 21 nt, Human adenovirus A
cauuccugcagcacuguaaaa

SEQ ID NO: 3895603 - RNA, 18 nt, Human adenovirus A
cauucucuaacaagcugc

SEQ ID NO: 3895604 - RNA, 22 nt, Human adenovirus A
cauugccgcacggccaaugccc

SEQ ID NO: 3895605 - RNA, 21 nt, Human adenovirus A
cauugcgauaaacuggauuug

SEQ ID NO: 3895606 - RNA, 18 nt, Human adenovirus A
cauuggaguacaagcuug

SEQ ID NO: 3895607 - RNA, 20 nt, Human adenovirus A
cauugugcuaaauguaacug

SEQ ID NO: 3895608 - RNA, 17 nt, Human adenovirus A
cauuuaagcaacauuaa

SEQ ID NO: 3895609 - RNA, 18 nt, Human adenovirus A
cauuuacugcagccuguc

SEQ ID NO: 3895610 - RNA, 17 nt, Human adenovirus A
cauuugaucagaaaaaa

SEQ ID NO: 3895611 - RNA, 20 nt, Human adenovirus A
cauuugaucagaaaaaacua

SEQ ID NO: 3895612 - RNA, 14 nt, Human adenovirus A
cauuuguauucaua

SEQ ID NO: 3895613 - RNA, 13 nt, Human adenovirus A
ccaaaaacaccuu

SEQ ID NO: 3895614 - RNA, 22 nt, Human adenovirus A
ccaaaguucgccuacacaacac

SEQ ID NO: 3895615 - RNA, 18 nt, Human adenovirus A
ccaaauuuaaggccaggg

SEQ ID NO: 3895616 - RNA, 16 nt, Human adenovirus A
ccaacaugccaaacgu

SEQ ID NO: 3895617 - RNA, 13 nt, Human adenovirus A
ccaacccuuccca

SEQ ID NO: 3895618 - RNA, 13 nt, Human adenovirus A
ccaaccucacugc

SEQ ID NO: 3895619 - RNA, 20 nt, Human adenovirus A
ccaagaauaaaaacacacac

SEQ ID NO: 3895620 - RNA, 20 nt, Human adenovirus A
ccaaucaggcuguacagaaa

SEQ ID NO: 3895621 - RNA, 20 nt, Human adenovirus A
ccaaugaaacccgcugugag

SEQ ID NO: 3895622 - RNA, 20 nt, Human adenovirus A
ccaauuuguggaggaauuua

SEQ ID NO: 3895623 - RNA, 13 nt, Human adenovirus A
ccacaaagcagua

SEQ ID NO: 3895624 - RNA, 14 nt, Human adenovirus A
ccacaggugguggg

SEQ ID NO: 3895625 - RNA, 13 nt, Human adenovirus A
ccaccaccaaacu

SEQ ID NO: 3895626 - RNA, 13 nt, Human adenovirus A
ccaccgaaacgca

SEQ ID NO: 3895627 - RNA, 18 nt, Human adenovirus A
ccaccgacgaagcgucag

SEQ ID NO: 3895628 - RNA, 19 nt, Human adenovirus A
ccacgccuggguaccgugg

SEQ ID NO: 3895629 - RNA, 15 nt, Human adenovirus A
ccacucucgcaggcu

SEQ ID NO: 3895630 - RNA, 19 nt, Human adenovirus A
ccacugcgucaguaacaaa

SEQ ID NO: 3895631 - RNA, 23 nt, Human adenovirus A
ccacuuuaagucugucuguugcc

SEQ ID NO: 3895632 - RNA, 17 nt, Human adenovirus A
ccagaaaaaggaguucg

SEQ ID NO: 3895633 - RNA, 16 nt, Human adenovirus A
ccagaagcacuggcaa

SEQ ID NO: 3895634 - RNA, 19 nt, Human adenovirus A
ccagagcaccccuucccac

SEQ ID NO: 3895635 - RNA, 22 nt, Human adenovirus A
ccagauuucagcacgagagggg

SEQ ID NO: 3895636 - RNA, 11 nt, Human adenovirus A
ccagcagccaa

SEQ ID NO: 3895637 - RNA, 21 nt, Human adenovirus A
ccagcccaaccuguaacccaa

SEQ ID NO: 3895638 - RNA, 17 nt, Human adenovirus A
ccagcgccaccugccau

SEQ ID NO: 3895639 - RNA, 13 nt, Human adenovirus A
ccagcucuuggaa

SEQ ID NO: 3895640 - RNA, 15 nt, Human adenovirus A
ccagcucuuggaaua

SEQ ID NO: 3895641 - RNA, 14 nt, Human adenovirus A
ccagcucuuuugga

SEQ ID NO: 3895642 - RNA, 11 nt, Human adenovirus A
ccagugccgcc

SEQ ID NO: 3895643 - RNA, 13 nt, Human adenovirus A
gaucacagccaga

SEQ ID NO: 3895644 - RNA, 16 nt, Human adenovirus A
gauccagaggaggagg

SEQ ID NO: 3895645 - RNA, 23 nt, Human adenovirus A
gaucccguagguuccguuccugu

SEQ ID NO: 3895646 - RNA, 17 nt, Human adenovirus A
gaucguguuauguggcg

SEQ ID NO: 3895647 - RNA, 15 nt, Human adenovirus A
gaucugucagugaaa

SEQ ID NO: 3895648 - RNA, 20 nt, Human adenovirus A
gaugaaggucccuugcuuga

SEQ ID NO: 3895649 - RNA, 12 nt, Human adenovirus A
gaugcagcgacc

SEQ ID NO: 3895650 - RNA, 13 nt, Human adenovirus A
gaugcuuugggag

SEQ ID NO: 3895651 - RNA, 19 nt, Human adenovirus A
gauggaucuggagccacag

SEQ ID NO: 3895652 - RNA, 14 nt, Human adenovirus A
gauggguacagaug

SEQ ID NO: 3895653 - RNA, 21 nt, Human adenovirus A
gauggguguuuggcagcaaug

SEQ ID NO: 3895654 - RNA, 17 nt, Human adenovirus A
gauguugggcccaagau

SEQ ID NO: 3895655 - RNA, 16 nt, Human adenovirus A
gauucaaacaauaaca

SEQ ID NO: 3895656 - RNA, 15 nt, Human adenovirus A
gauucuucuucccaa

SEQ ID NO: 3895657 - RNA, 16 nt, Human adenovirus A
gauuucgauaaacaaa

SEQ ID NO: 3895658 - RNA, 16 nt, Human adenovirus A
gcaaaccuagcugcuc

SEQ ID NO: 3895659 - RNA, 20 nt, Human adenovirus A
gcaaagaaacacaugaugga

SEQ ID NO: 3895660 - RNA, 21 nt, Human adenovirus A
gcaaauaguuccguaaagacu

SEQ ID NO: 3895661 - RNA, 18 nt, Human adenovirus A
gcaaaugcccugcaaaaa

SEQ ID NO: 3895662 - RNA, 12 nt, Human adenovirus A
gcaacagcuauu

SEQ ID NO: 3895663 - RNA, 13 nt, Human adenovirus A
gcaaguaggacca

SEQ ID NO: 3895664 - RNA, 15 nt, Human adenovirus A
gcaauauuccagcuc

SEQ ID NO: 3895665 - RNA, 18 nt, Human adenovirus A
gcaaucuaguuucuuaca

SEQ ID NO: 3895666 - RNA, 16 nt, Human adenovirus A
gcaauuagggccagca

SEQ ID NO: 3895667 - RNA, 22 nt, Human adenovirus A
gcacaaguugcagggcgcccau

SEQ ID NO: 3895668 - RNA, 22 nt, Human adenovirus A
gcacaauaguuuaauguuuccc

SEQ ID NO: 3895669 - RNA, 17 nt, Human adenovirus A
gcacgccaaagccacac

SEQ ID NO: 3895670 - RNA, 13 nt, Human adenovirus A
gcacugggccagg

SEQ ID NO: 3895671 - RNA, 18 nt, Human adenovirus A
gcacuggucgcaccacug

SEQ ID NO: 3895672 - RNA, 13 nt, Human adenovirus A
gcacuuccuucag

SEQ ID NO: 3895673 - RNA, 20 nt, Human adenovirus A
gcagacgcaugaaggguggg

SEQ ID NO: 3895674 - RNA, 15 nt, Human adenovirus A
gcagcaaacacugcu

SEQ ID NO: 3895675 - RNA, 15 nt, Human adenovirus A
gcagcaacaaggaaa

SEQ ID NO: 3895676 - RNA, 21 nt, Human adenovirus A
gcagcugauuucagcuucuac

SEQ ID NO: 3895677 - RNA, 13 nt, Human adenovirus A
gcagcuggagugg

SEQ ID NO: 3895678 - RNA, 23 nt, Human adenovirus A
gcaggaaaucugggaggaagaau

SEQ ID NO: 3895679 - RNA, 13 nt, Human adenovirus A
gcaggcuggaggu

SEQ ID NO: 3895680 - RNA, 15 nt, Human adenovirus A
gcagguggcagcgau

SEQ ID NO: 3895681 - RNA, 22 nt, Human adenovirus A
gcaguaaaucuuccgccaaagg

SEQ ID NO: 3895682 - RNA, 20 nt, Human adenovirus A
gcaguaggugaaauaaaaaa

SEQ ID NO: 3895683 - RNA, 17 nt, Human adenovirus A
gcagucugacagcaauu

SEQ ID NO: 3895684 - RNA, 22 nt, Human adenovirus A
gcaucuauaguaaaaaugccag

SEQ ID NO: 3895685 - RNA, 16 nt, Human adenovirus A
gcauuaccagcagcca

SEQ ID NO: 3895686 - RNA, 17 nt, Human adenovirus A
gcauuaccagcagccaa

SEQ ID NO: 3895687 - RNA, 21 nt, Human adenovirus A
gcauuacgucgcuaaauggau

SEQ ID NO: 3895688 - RNA, 16 nt, Human adenovirus A
gcauuaguucuuuucu

SEQ ID NO: 3895689 - RNA, 21 nt, Human adenovirus A
gccaaacagcuguggaaagca

SEQ ID NO: 3895690 - RNA, 21 nt, Human adenovirus A
gccaacaaaacuuaucagcca

SEQ ID NO: 3895691 - RNA, 20 nt, Human adenovirus A
gccaacaucaugaaaacagc

SEQ ID NO: 3895692 - RNA, 15 nt, Human adenovirus A
gccaaucaggcugua

SEQ ID NO: 3895693 - RNA, 22 nt, Human adenovirus A
gccacaccuccacccaaucaaa

SEQ ID NO: 3895694 - RNA, 16 nt, Human adenovirus A
gccagaagcacuggca

SEQ ID NO: 3895695 - RNA, 22 nt, Human adenovirus A
gccagcaagugccuccucagua

SEQ ID NO: 3895696 - RNA, 15 nt, Human adenovirus A
ccggcguagaccaac

SEQ ID NO: 3895697 - RNA, 13 nt, Human adenovirus A
ccgggcaagcuuc

SEQ ID NO: 3895698 - RNA, 18 nt, Human adenovirus A
ccgguugaaacagacccc

SEQ ID NO: 3895699 - RNA, 14 nt, Human adenovirus A
ccgucgcuuucaac

SEQ ID NO: 3895700 - RNA, 18 nt, Human adenovirus A
ccgugcguuaccacccua

SEQ ID NO: 3895701 - RNA, 21 nt, Human adenovirus A
ccgugguuggugggcagggau

SEQ ID NO: 3895702 - RNA, 20 nt, Human adenovirus A
ccguucccugcguucacuua

SEQ ID NO: 3895703 - RNA, 20 nt, Human adenovirus A
ccguuuucuucuugagccca

SEQ ID NO: 3895704 - RNA, 20 nt, Human adenovirus A
ccuaauggagugucacugcc

SEQ ID NO: 3895705 - RNA, 16 nt, Human adenovirus A
ccuacacaacacaaaa

SEQ ID NO: 3895706 - RNA, 20 nt, Human adenovirus A
ccuacuguuaccaauggaac

SEQ ID NO: 3895707 - RNA, 22 nt, Human adenovirus A
ccuacuuacuggggugccuaau

SEQ ID NO: 3895708 - RNA, 16 nt, Human adenovirus A
ccuacuucacccuggg

SEQ ID NO: 3895709 - RNA, 17 nt, Human adenovirus A
ccuccccgcuauuuggg

SEQ ID NO: 3895710 - RNA, 18 nt, Human adenovirus A
ccucccucuuggccagcu

SEQ ID NO: 3895711 - RNA, 19 nt, Human adenovirus A
ccuccuauguuagcgccag

SEQ ID NO: 3895712 - RNA, 14 nt, Human adenovirus A
ccuccuuauccuuc

SEQ ID NO: 3895713 - RNA, 12 nt, Human adenovirus A
ccuccuucccau

SEQ ID NO: 3895714 - RNA, 11 nt, Human adenovirus A
ccucuucccaa

SEQ ID NO: 3895715 - RNA, 21 nt, Human adenovirus A
ccugaugcuuuucgccagcag

SEQ ID NO: 3895716 - RNA, 23 nt, Human adenovirus A
ccugcaguuauuggacaccaugg

SEQ ID NO: 3895717 - RNA, 16 nt, Human adenovirus A
ccugcgggaagcgggg

SEQ ID NO: 3895718 - RNA, 14 nt, Human adenovirus A
ccugcgguggugga

SEQ ID NO: 3895719 - RNA, 17 nt, Human adenovirus A
ccugcuccgacaacagc

SEQ ID NO: 3895720 - RNA, 17 nt, Human adenovirus A
ccuguaguugcagcaga

SEQ ID NO: 3895721 - RNA, 21 nt, Human adenovirus A
ccugucuacaaaucuuucaau

SEQ ID NO: 3895722 - RNA, 17 nt, Human adenovirus A
ccuucccaacuacuuua

SEQ ID NO: 3895723 - RNA, 22 nt, Human adenovirus A
ccuuccgugguuugguggaaaa

SEQ ID NO: 3895724 - RNA, 17 nt, Human adenovirus A
ccuucgaaaugcaggga

SEQ ID NO: 3895725 - RNA, 20 nt, Human adenovirus A
ccuucgcugucccgagcgcg

SEQ ID NO: 3895726 - RNA, 16 nt, Human adenovirus A
ccuucuacgcuuccaa

SEQ ID NO: 3895727 - RNA, 20 nt, Human adenovirus A
ccuuggaagaggugccuaaa

SEQ ID NO: 3895728 - RNA, 21 nt, Human adenovirus A
ccuuguggaauuccgcagugg

SEQ ID NO: 3895729 - RNA, 16 nt, Human adenovirus A
ccuuuaccaacaccaa

SEQ ID NO: 3895730 - RNA, 17 nt, Human adenovirus A
ccuuucucugugacaaa

SEQ ID NO: 3895731 - RNA, 23 nt, Human adenovirus A
ccuuugaagagcucgacaaggaa

SEQ ID NO: 3895732 - RNA, 14 nt, Human adenovirus A
cgaaacuguugacc

SEQ ID NO: 3895733 - RNA, 23 nt, Human adenovirus A
cgacaaaaauuuucccaacaaug

SEQ ID NO: 3895734 - RNA, 17 nt, Human adenovirus A
cgacacuaucaccgccg

SEQ ID NO: 3895735 - RNA, 22 nt, Human adenovirus A
cgaccgccuuuucuagaacaaa

SEQ ID NO: 3895736 - RNA, 16 nt, Human adenovirus A
cgacucauaagcugug

SEQ ID NO: 3895737 - RNA, 12 nt, Human adenovirus A
cgagacugcagg

SEQ ID NO: 3895738 - RNA, 12 nt, Human adenovirus A
cgagcugccacc

SEQ ID NO: 3895739 - RNA, 21 nt, Human adenovirus A
cgaguguuaauucccaucugu

SEQ ID NO: 3895740 - RNA, 18 nt, Human adenovirus A
cgaugaugccgcaguggu

SEQ ID NO: 3895741 - RNA, 13 nt, Human adenovirus A
cgauuaagacaua

SEQ ID NO: 3895742 - RNA, 17 nt, Human adenovirus A
cgauuauugucacauua

SEQ ID NO: 3895743 - RNA, 17 nt, Human adenovirus A
cgauuccaaggaauguc

SEQ ID NO: 3895744 - RNA, 15 nt, Human adenovirus A
cgcacugggccagga

SEQ ID NO: 3895745 - RNA, 18 nt, Human adenovirus A
cgcagcugcggccgcaac

SEQ ID NO: 3895746 - RNA, 12 nt, Human adenovirus A
cgccaagccugu

SEQ ID NO: 3895747 - RNA, 21 nt, Human adenovirus A
cgccaaguaacaacacgggcu

SEQ ID NO: 3895748 - RNA, 16 nt, Human adenovirus A
cgccaauaaaaacaac

SEQ ID NO: 3895749 - RNA, 18 nt, Human adenovirus A
cgccgcgacggcggcgca

SEQ ID NO: 3895750 - RNA, 17 nt, Human adenovirus A
cgccggcgaacgggcag

SEQ ID NO: 3895751 - RNA, 18 nt, Human adenovirus A
cgccggcgaacgggcagc

SEQ ID NO: 3895752 - RNA, 17 nt, Human adenovirus A
cgcgcaagcuuucauug

SEQ ID NO: 3895753 - RNA, 17 nt, Human adenovirus A
cgcgcacugggccagga

SEQ ID NO: 3895754 - RNA, 13 nt, Human adenovirus A
cgcgcgcauugcg

SEQ ID NO: 3895755 - RNA, 22 nt, Human adenovirus A
cgcggagacgggccgcagcugc

SEQ ID NO: 3895756 - RNA, 20 nt, Human adenovirus A
cgcggcgguguaugccaaca

SEQ ID NO: 3895757 - RNA, 22 nt, Human adenovirus A
cgcguuguacaaagggggcgca

SEQ ID NO: 3895758 - RNA, 20 nt, Human adenovirus A
cgcuacagauccauguugcu

SEQ ID NO: 3895759 - RNA, 18 nt, Human adenovirus A
cgcucaaaggcaggcauu

SEQ ID NO: 3895760 - RNA, 17 nt, Human adenovirus A
cgcucuggcaggggaag

SEQ ID NO: 3895761 - RNA, 13 nt, Human adenovirus A
cgcugcagcuucc

SEQ ID NO: 3895762 - RNA, 23 nt, Human adenovirus A
cgcuuuggaggcagcuggagugg

SEQ ID NO: 3895763 - RNA, 20 nt, Human adenovirus A
cgcuuuuuugaguacucagc

SEQ ID NO: 3895764 - RNA, 13 nt, Human adenovirus A
cggaggaaagggc

SEQ ID NO: 3895765 - RNA, 15 nt, Human adenovirus A
cggcaacagcagcaa

SEQ ID NO: 3895766 - RNA, 22 nt, Human adenovirus A
cggcaaguaaaacgcauuuugc

SEQ ID NO: 3895767 - RNA, 22 nt, Human adenovirus A
cggcaggaaaucugggaggaag

SEQ ID NO: 3895768 - RNA, 21 nt, Human adenovirus A
cggcauuuagaggcuggagcu

SEQ ID NO: 3895769 - RNA, 16 nt, Human adenovirus A
cggccauuggagccgu

SEQ ID NO: 3895770 - RNA, 22 nt, Human adenovirus A
cggcgaucaucgcggagagggc

SEQ ID NO: 3895771 - RNA, 16 nt, Human adenovirus A
cggcgcggcucaagac

SEQ ID NO: 3895772 - RNA, 20 nt, Human adenovirus A
cggcucuuuugcagcuccaa

SEQ ID NO: 3895773 - RNA, 20 nt, Human adenovirus A
cgggagcaggaacagaggac

SEQ ID NO: 3895774 - RNA, 19 nt, Human adenovirus A
cgggaugaaaaacgagcag

SEQ ID NO: 3895775 - RNA, 15 nt, Human adenovirus A
cgggcaccacagugg

SEQ ID NO: 3895776 - RNA, 11 nt, Human adenovirus A
cgggcucuggc

SEQ ID NO: 3895777 - RNA, 19 nt, Human adenovirus A
cgggcuggggacugggugc

SEQ ID NO: 3895778 - RNA, 22 nt, Human adenovirus A
cgggcuggggacugggugccgc

SEQ ID NO: 3895779 - RNA, 16 nt, Human adenovirus A
cggggcuacugcucau

SEQ ID NO: 3895780 - RNA, 21 nt, Human adenovirus A
cgggucggagaaccuuucaag

SEQ ID NO: 3895781 - RNA, 20 nt, Human adenovirus A
cggguggacggagccagcgu

SEQ ID NO: 3895782 - RNA, 19 nt, Human adenovirus A
cgguguaugccaacaaaac

SEQ ID NO: 3895783 - RNA, 15 nt, Human adenovirus A
cgguuccagaaggag

SEQ ID NO: 3895784 - RNA, 16 nt, Human adenovirus A
cguaaaauacacauaa

SEQ ID NO: 3895785 - RNA, 12 nt, Human adenovirus A
cguacacuggcu

SEQ ID NO: 3895786 - RNA, 18 nt, Human adenovirus A
cguacuuaaaaaaacaaa

SEQ ID NO: 3895787 - RNA, 23 nt, Human adenovirus A
cguagcaguaucaguggaguuca

SEQ ID NO: 3895788 - RNA, 21 nt, Human adenovirus A
cgucacccaagggugcagcuc

SEQ ID NO: 3895789 - RNA, 22 nt, Human adenovirus A
cguccaggcaggguuugcaaac

SEQ ID NO: 3895790 - RNA, 16 nt, Human adenovirus A
cgucgccagcaagugc

SEQ ID NO: 3895791 - RNA, 18 nt, Human adenovirus A
cgucggggcuacugcuca

SEQ ID NO: 3895792 - RNA, 22 nt, Human adenovirus A
cgucugcaguauuauuacucug

SEQ ID NO: 3895793 - RNA, 20 nt, Human adenovirus A
cgugaaguauuccaugagcc

SEQ ID NO: 3895794 - RNA, 13 nt, Human adenovirus A
cgugccaggcauu

SEQ ID NO: 3895795 - RNA, 18 nt, Human adenovirus A
cguggaacagccaaaccg

SEQ ID NO: 3895796 - RNA, 16 nt, Human adenovirus A
cguguacacaaugcau

SEQ ID NO: 3895797 - RNA, 23 nt, Human adenovirus A
cguguucacaauuuucugguggu

SEQ ID NO: 3895798 - RNA, 22 nt, Human adenovirus A
cguucaacuuuguccaguuuac

SEQ ID NO: 3895799 - RNA, 22 nt, Human adenovirus A
cguuccgucaaaaaagcaaagu

SEQ ID NO: 3895800 - RNA, 12 nt, Human adenovirus A
cguucuguggau

SEQ ID NO: 3895801 - RNA, 23 nt, Human adenovirus A
cguuguacaaagggggcgcacac

SEQ ID NO: 3895802 - RNA, 21 nt, Human adenovirus A
cguuucagcgccaacaaaaac

SEQ ID NO: 3895803 - RNA, 21 nt, Human adenovirus A
cuaaaacaaggucuagccaac

SEQ ID NO: 3895804 - RNA, 11 nt, Human adenovirus A
cuaaaacagaa

SEQ ID NO: 3895805 - RNA, 19 nt, Human adenovirus A
cuaaaagagccacagcucu

SEQ ID NO: 3895806 - RNA, 14 nt, Human adenovirus A
cuaaaauguauuca

SEQ ID NO: 3895807 - RNA, 15 nt, Human adenovirus A
cuaaacaaacuguua

SEQ ID NO: 3895808 - RNA, 12 nt, Human adenovirus A
cuaaauauugua

SEQ ID NO: 3895809 - RNA, 11 nt, Human adenovirus A
cuaacaccaaa

SEQ ID NO: 3895810 - RNA, 13 nt, Human adenovirus A
cuaacuguuaauc

SEQ ID NO: 3895811 - RNA, 20 nt, Human adenovirus A
cuaagggacaaguuaaaaga

SEQ ID NO: 3895812 - RNA, 22 nt, Human adenovirus A
cuaagugguugggaacagacaa

SEQ ID NO: 3895813 - RNA, 13 nt, Human adenovirus A
cuaauacaaaugc

SEQ ID NO: 3895814 - RNA, 13 nt, Human adenovirus A
cuacacaugaagg

SEQ ID NO: 3895815 - RNA, 12 nt, Human adenovirus A
cuacaggcaggg

SEQ ID NO: 3895816 - RNA, 16 nt, Human adenovirus A
cuacauuacgccccca

SEQ ID NO: 3895817 - RNA, 17 nt, Human adenovirus A
cuacauuacgcccccag

SEQ ID NO: 3895818 - RNA, 18 nt, Human adenovirus A
cuaccaccuaucccauga

SEQ ID NO: 3895819 - RNA, 17 nt, Human adenovirus A
cuacccaccaucuucau

SEQ ID NO: 3895820 - RNA, 19 nt, Human adenovirus A
cuaccgcugcucagcucca

SEQ ID NO: 3895821 - RNA, 16 nt, Human adenovirus A
cuaccgucaucucuac

SEQ ID NO: 3895822 - RNA, 20 nt, Human adenovirus A
cuaccugacacuacagagcu

SEQ ID NO: 3895823 - RNA, 21 nt, Human adenovirus A
cuaccugauaacaagaacacc

SEQ ID NO: 3895824 - RNA, 20 nt, Human adenovirus A
cuacggcugucauggagaag

SEQ ID NO: 3895825 - RNA, 18 nt, Human adenovirus A
cuacuacgugagaauugu

SEQ ID NO: 3895826 - RNA, 15 nt, Human adenovirus A
cuacuccuacaaggc

SEQ ID NO: 3895827 - RNA, 16 nt, Human adenovirus A
cuacugcgucucccca

SEQ ID NO: 3895828 - RNA, 20 nt, Human adenovirus A
cuacuuaaaagcaagcgcgc

SEQ ID NO: 3895829 - RNA, 18 nt, Human adenovirus A
cuacuucacccugggaaa

SEQ ID NO: 3895830 - RNA, 12 nt, Human adenovirus A
cuagauggggug

SEQ ID NO: 3895831 - RNA, 20 nt, Human adenovirus A
cuagcggugcccuaucuguu

SEQ ID NO: 3895832 - RNA, 16 nt, Human adenovirus A
cuagcguacagccaga

SEQ ID NO: 3895833 - RNA, 16 nt, Human adenovirus A
cuaggaaaacaaacaa

SEQ ID NO: 3895834 - RNA, 13 nt, Human adenovirus A
cuaggcuguggac

SEQ ID NO: 3895835 - RNA, 17 nt, Human adenovirus A
cuagucccauuacagua

SEQ ID NO: 3895836 - RNA, 17 nt, Human adenovirus A
cuagugcaacauuugua

SEQ ID NO: 3895837 - RNA, 20 nt, Human adenovirus A
cuaguuugguagcaaaagau

SEQ ID NO: 3895838 - RNA, 18 nt, Human adenovirus A
cuauaguaaaaaugccag

SEQ ID NO: 3895839 - RNA, 19 nt, Human adenovirus A
cuauauacaacucuacaaa

SEQ ID NO: 3895840 - RNA, 14 nt, Human adenovirus A
cuauauuaacuuua

SEQ ID NO: 3895841 - RNA, 16 nt, Human adenovirus A
cuauauuaacuuuaua

SEQ ID NO: 3895842 - RNA, 22 nt, Human adenovirus A
cuauggaccgguuuugacgaac

SEQ ID NO: 3895843 - RNA, 14 nt, Human adenovirus A
cuauugcgcagcaa

SEQ ID NO: 3895844 - RNA, 15 nt, Human adenovirus A
cucaaaagcagccau

SEQ ID NO: 3895845 - RNA, 22 nt, Human adenovirus A
cucacaaauuugcauuucccaa

SEQ ID NO: 3895846 - RNA, 13 nt, Human adenovirus A
cucacugcuuugc

SEQ ID NO: 3895847 - RNA, 20 nt, Human adenovirus A
cucauccauuauuauggcaa

SEQ ID NO: 3895848 - RNA, 14 nt, Human adenovirus A
cucauccucagcuc

SEQ ID NO: 3895849 - RNA, 19 nt, Human adenovirus A
cuccaaugaaacccgcugu

SEQ ID NO: 3895850 - RNA, 19 nt, Human adenovirus A
cuccagcuauaaaaagagu

SEQ ID NO: 3895851 - RNA, 21 nt, Human adenovirus A
cuccaggggaaacccauuugc

SEQ ID NO: 3895852 - RNA, 17 nt, Human adenovirus A
cuccauccaaaacuaac

SEQ ID NO: 3895853 - RNA, 20 nt, Human adenovirus A
cuccccuguggagccacugc

SEQ ID NO: 3895854 - RNA, 21 nt, Human adenovirus A
cucccgauaccaaaaacaccu

SEQ ID NO: 3895855 - RNA, 17 nt, Human adenovirus A
cucccucuuggccagcu

SEQ ID NO: 3895856 - RNA, 19 nt, Human adenovirus A
cucccucuuggccagcugc

SEQ ID NO: 3895857 - RNA, 18 nt, Human adenovirus A
cuccguguucccacagua

SEQ ID NO: 3895858 - RNA, 23 nt, Human adenovirus A
cuccguguucccacaguaggaag

SEQ ID NO: 3895859 - RNA, 16 nt, Human adenovirus A
cucgcaccagaaagca

SEQ ID NO: 3895860 - RNA, 18 nt, Human adenovirus A
cucgcaguauggcagcug

SEQ ID NO: 3895861 - RNA, 17 nt, Human adenovirus A
cucgccuggacacuauc

SEQ ID NO: 3895862 - RNA, 16 nt, Human adenovirus A
cucguugaugucaccu

SEQ ID NO: 3895863 - RNA, 22 nt, Human adenovirus A
cucuaacaaaggugcuucccac

SEQ ID NO: 3895864 - RNA, 18 nt, Human adenovirus A
cucuaacugcucagcugg

SEQ ID NO: 3895865 - RNA, 16 nt, Human adenovirus A
cucucgcuuaaagagu

SEQ ID NO: 3895866 - RNA, 23 nt, Human adenovirus A
cucuuacgaaaccgugauggcag

SEQ ID NO: 3895867 - RNA, 16 nt, Human adenovirus A
cucuuggccagcugcc

SEQ ID NO: 3895868 - RNA, 15 nt, Human adenovirus A
cucuuuuaagaucuu

SEQ ID NO: 3895869 - RNA, 13 nt, Human adenovirus A
cugaagaaacaga

SEQ ID NO: 3895870 - RNA, 18 nt, Human adenovirus A
cugaagugccucaaagug

SEQ ID NO: 3895871 - RNA, 21 nt, Human adenovirus A
cugacacuguggacaacuccu

SEQ ID NO: 3895872 - RNA, 17 nt, Human adenovirus A
cugacagacuugcaaac

SEQ ID NO: 3895873 - RNA, 21 nt, Human adenovirus A
cugacuauuucacaagacaca

SEQ ID NO: 3895874 - RNA, 22 nt, Human adenovirus A
cugagcccuauccgucuccagc

SEQ ID NO: 3895875 - RNA, 21 nt, Human adenovirus A
cugagucccggucuggugcaa

SEQ ID NO: 3895876 - RNA, 19 nt, Human adenovirus A
cugauauuaguaccgaaaa

SEQ ID NO: 3895877 - RNA, 14 nt, Human adenovirus A
cugauuuucaucug

SEQ ID NO: 3895878 - RNA, 13 nt, Human adenovirus A
cugcaaaaagaaa

SEQ ID NO: 3895879 - RNA, 15 nt, Human adenovirus A
cugcaacagccaagc

SEQ ID NO: 3895880 - RNA, 15 nt, Human adenovirus A
cugcaauuucuuuca

SEQ ID NO: 3895881 - RNA, 17 nt, Human adenovirus A
cugcacucucuggggaa

SEQ ID NO: 3895882 - RNA, 15 nt, Human adenovirus A
cugcagacaguggcu

SEQ ID NO: 3895883 - RNA, 19 nt, Human adenovirus A
cugcagacaguggcuuuuc

SEQ ID NO: 3895884 - RNA, 18 nt, Human adenovirus A
cugcauguccagauuuca

SEQ ID NO: 3895885 - RNA, 22 nt, Human adenovirus A
cugcccugauauaucaggaaaa

SEQ ID NO: 3895886 - RNA, 17 nt, Human adenovirus A
cugccuccuucccauuu

SEQ ID NO: 3895887 - RNA, 23 nt, Human adenovirus A
cugcgcugccguuuuuucagaug

SEQ ID NO: 3895888 - RNA, 12 nt, Human adenovirus A
cugcggccauga

SEQ ID NO: 3895889 - RNA, 23 nt, Human adenovirus A
cugcgucuccccauucgcagcau

SEQ ID NO: 3895890 - RNA, 19 nt, Human adenovirus A
cugcuaaacucacauugug

SEQ ID NO: 3895891 - RNA, 20 nt, Human adenovirus A
cugcuacuaacauuaaaaga

SEQ ID NO: 3895892 - RNA, 14 nt, Human adenovirus A
cugcucaaguugug

SEQ ID NO: 3895893 - RNA, 17 nt, Human adenovirus A
cugcuccgacaacagcu

SEQ ID NO: 3895894 - RNA, 15 nt, Human adenovirus A
cugcugcauugccac

SEQ ID NO: 3895895 - RNA, 15 nt, Human adenovirus A
cugcugucacugagc

SEQ ID NO: 3895896 - RNA, 17 nt, Human adenovirus A
cuggaacuuaacaacug

SEQ ID NO: 3895897 - RNA, 18 nt, Human adenovirus A
cuggccagugugcgcuuu

SEQ ID NO: 3895898 - RNA, 19 nt, Human adenovirus A
cuggcgaacaggaagagcc

SEQ ID NO: 3895899 - RNA, 14 nt, Human adenovirus A
cuggcuguggguga

SEQ ID NO: 3895900 - RNA, 22 nt, Human adenovirus A
cugggggcguacacuggcuggc

SEQ ID NO: 3895901 - RNA, 23 nt, Human adenovirus A
cugggguuaagcaguagaaagua

SEQ ID NO: 3895902 - RNA, 22 nt, Human adenovirus A
cugggugcgcgacucagugacc

SEQ ID NO: 3895903 - RNA, 15 nt, Human adenovirus A
cugguccccagaugu

SEQ ID NO: 3895904 - RNA, 19 nt, Human adenovirus A
cugguugagcgcuggccag

SEQ ID NO: 3895905 - RNA, 13 nt, Human adenovirus A
cuguaaaaaagug

SEQ ID NO: 3895906 - RNA, 18 nt, Human adenovirus A
cuguacgcaagcauuuuu

SEQ ID NO: 3895907 - RNA, 15 nt, Human adenovirus A
cugucacuuugcaac

SEQ ID NO: 3895908 - RNA, 19 nt, Human adenovirus A
cugucuuaaaaucuccuga

SEQ ID NO: 3895909 - RNA, 19 nt, Human adenovirus A
cugucuugucuugcauggu

SEQ ID NO: 3895910 - RNA, 15 nt, Human adenovirus A
cugugcuucggcaag

SEQ ID NO: 3895911 - RNA, 14 nt, Human adenovirus A
cuguggcaccugca

SEQ ID NO: 3895912 - RNA, 14 nt, Human adenovirus A
cuguguauacgccu

SEQ ID NO: 3895913 - RNA, 20 nt, Human adenovirus A
cuguuacauaccuggcaaac

SEQ ID NO: 3895914 - RNA, 14 nt, Human adenovirus A
cuguucauauugug

SEQ ID NO: 3895915 - RNA, 15 nt, Human adenovirus A
cuguucauauuguga

SEQ ID NO: 3895916 - RNA, 15 nt, Human adenovirus A
cuguuuaaacaucua

SEQ ID NO: 3895917 - RNA, 13 nt, Human adenovirus A
cuuaaaaacuguu

SEQ ID NO: 3895918 - RNA, 15 nt, Human adenovirus A
cuuaaauugagaugg

SEQ ID NO: 3895919 - RNA, 20 nt, Human adenovirus A
cuuaaggcgggguauguuua

SEQ ID NO: 3895920 - RNA, 21 nt, Human adenovirus A
cuuacgaaaccgugauggcag

SEQ ID NO: 3895921 - RNA, 16 nt, Human adenovirus A
cuuacuggggugccua

SEQ ID NO: 3895922 - RNA, 23 nt, Human adenovirus A
cuuaguaauggaguuggaaacug

SEQ ID NO: 3895923 - RNA, 19 nt, Human adenovirus A
cuuagucauuacaacauug

SEQ ID NO: 3895924 - RNA, 17 nt, Human adenovirus A
cuuaguuguaaauucua

SEQ ID NO: 3895925 - RNA, 13 nt, Human adenovirus A
cuuaucagccaga

SEQ ID NO: 3895926 - RNA, 19 nt, Human adenovirus A
cuuaugcgugagggugcca

SEQ ID NO: 3895927 - RNA, 22 nt, Human adenovirus A
cuuaugcucccacacgcagcaa

SEQ ID NO: 3895928 - RNA, 23 nt, Human adenovirus A
cuuauuuuauuccugauuucuaa

SEQ ID NO: 3895929 - RNA, 13 nt, Human adenovirus A
cuuauuuuccuuc

SEQ ID NO: 3895930 - RNA, 22 nt, Human adenovirus A
cuucaccgcgcugcggccauga

SEQ ID NO: 3895931 - RNA, 18 nt, Human adenovirus A
cuucaucgcuuucuucug

SEQ ID NO: 3895932 - RNA, 18 nt, Human adenovirus A
cuucccaaucccuaccca

SEQ ID NO: 3895933 - RNA, 16 nt, Human adenovirus A
cuucguugagccaugu

SEQ ID NO: 3895934 - RNA, 14 nt, Human adenovirus A
cuucucaucuuuuu

SEQ ID NO: 3895935 - RNA, 16 nt, Human adenovirus A
cuucucgaaaaaauua

SEQ ID NO: 3895936 - RNA, 14 nt, Human adenovirus A
cuucuugcugaaau

SEQ ID NO: 3895937 - RNA, 21 nt, Human adenovirus A
cuugaacaacuuuuaacauua

SEQ ID NO: 3895938 - RNA, 23 nt, Human adenovirus A
cuugcaggacgcagaagcucugu

SEQ ID NO: 3895939 - RNA, 11 nt, Human adenovirus A
cuugcuuccag

SEQ ID NO: 3895940 - RNA, 19 nt, Human adenovirus A
cuuggccaguuccccuaac

SEQ ID NO: 3895941 - RNA, 17 nt, Human adenovirus A
cuugggaaauuugucau

SEQ ID NO: 3895942 - RNA, 23 nt, Human adenovirus A
cuugguacccgccagugcuuuca

SEQ ID NO: 3895943 - RNA, 18 nt, Human adenovirus A
cuugguguuucaggaaaa

SEQ ID NO: 3895944 - RNA, 15 nt, Human adenovirus A
cuuguguuuaagccu

SEQ ID NO: 3895945 - RNA, 22 nt, Human adenovirus A
cuuguucuuccucuucuaccuc

SEQ ID NO: 3895946 - RNA, 17 nt, Human adenovirus A
cuuuaacggaaaacacg

SEQ ID NO: 3895947 - RNA, 17 nt, Human adenovirus A
cuuuacaaaugcaauuc

SEQ ID NO: 3895948 - RNA, 20 nt, Human adenovirus A
cuuuaccaacaccaacaguu

SEQ ID NO: 3895949 - RNA, 15 nt, Human adenovirus A
cuuuagaagccaugu

SEQ ID NO: 3895950 - RNA, 22 nt, Human adenovirus A
cuuuagguuagccugaaaaaua

SEQ ID NO: 3895951 - RNA, 22 nt, Human adenovirus A
cuuuauauugcauuuguccugu

SEQ ID NO: 3895952 - RNA, 15 nt, Human adenovirus A
cuuuccgccauggcu

SEQ ID NO: 3895953 - RNA, 14 nt, Human adenovirus A
cuuucucugugaca

SEQ ID NO: 3895954 - RNA, 12 nt, Human adenovirus A
cuuucuuuagaa

SEQ ID NO: 3895955 - RNA, 12 nt, Human adenovirus A
cuuuggaggcag

SEQ ID NO: 3895956 - RNA, 16 nt, Human adenovirus A
cuuugggagacagaac

SEQ ID NO: 3895957 - RNA, 19 nt, Human adenovirus A
cuuuuacuaaaaugcaaaa

SEQ ID NO: 3895958 - RNA, 19 nt, Human adenovirus A
cuuuucaaacuuuacaaac

SEQ ID NO: 3895959 - RNA, 14 nt, Human adenovirus A
cuuuugcagcucca

SEQ ID NO: 3895960 - RNA, 16 nt, Human adenovirus A
cuuuuguuagaugcag

SEQ ID NO: 3895961 - RNA, 20 nt, Human adenovirus A
gaaaaacaguacaaagccag

SEQ ID NO: 3895962 - RNA, 12 nt, Human adenovirus A
gaaaaaugugua

SEQ ID NO: 3895963 - RNA, 17 nt, Human adenovirus A
gaaaacagcagcgggca

SEQ ID NO: 3895964 - RNA, 23 nt, Human adenovirus A
gaaaagcauguccgcggggacag

SEQ ID NO: 3895965 - RNA, 11 nt, Human adenovirus A
gaaacgucacc

SEQ ID NO: 3895966 - RNA, 13 nt, Human adenovirus A
gaaacuguugacc

SEQ ID NO: 3895967 - RNA, 21 nt, Human adenovirus A
gaaagaagacuauagagagga

SEQ ID NO: 3895968 - RNA, 21 nt, Human adenovirus A
gaaagaggcagccguuucagg

SEQ ID NO: 3895969 - RNA, 21 nt, Human adenovirus A
gaaaguucaccuccagguaca

SEQ ID NO: 3895970 - RNA, 21 nt, Human adenovirus A
gaaauugucauaccuuaaaaa

SEQ ID NO: 3895971 - RNA, 12 nt, Human adenovirus A
gaacacacugau

SEQ ID NO: 3895972 - RNA, 22 nt, Human adenovirus A
gaacaguguuuucagcaauuac

SEQ ID NO: 3895973 - RNA, 20 nt, Human adenovirus A
gaacauacaacuugcacaaa

SEQ ID NO: 3895974 - RNA, 14 nt, Human adenovirus A
gaacgggcagccug

SEQ ID NO: 3895975 - RNA, 23 nt, Human adenovirus A
gaacgguugcuucuauugcuuuu

SEQ ID NO: 3895976 - RNA, 16 nt, Human adenovirus A
gaacuaaacaaacugu

SEQ ID NO: 3895977 - RNA, 13 nt, Human adenovirus A
gaacuaaaccuuc

SEQ ID NO: 3895978 - RNA, 17 nt, Human adenovirus A
gaacuaaaccuuccauc

SEQ ID NO: 3895979 - RNA, 13 nt, Human adenovirus A
gaacuaucuugca

SEQ ID NO: 3895980 - RNA, 14 nt, Human adenovirus A
gaagaaugggagga

SEQ ID NO: 3895981 - RNA, 21 nt, Human adenovirus A
gaagaccaguacgaggacuga

SEQ ID NO: 3895982 - RNA, 18 nt, Human adenovirus A
gaagagcucgacaaggaa

SEQ ID NO: 3895983 - RNA, 12 nt, Human adenovirus A
gaagagcugcug

SEQ ID NO: 3895984 - RNA, 13 nt, Human adenovirus A
gaagagcugcugc

SEQ ID NO: 3895985 - RNA, 15 nt, Human adenovirus A
gaagcaauaaaacaa

SEQ ID NO: 3895986 - RNA, 13 nt, Human adenovirus A
gaagcgggggaag

SEQ ID NO: 3895987 - RNA, 14 nt, Human adenovirus A
gaagcuucuuguac

SEQ ID NO: 3895988 - RNA, 19 nt, Human adenovirus A
gaagugaagauagacagcu

SEQ ID NO: 3895989 - RNA, 15 nt, Human adenovirus A
gaaugagaacuucug

SEQ ID NO: 3895990 - RNA, 18 nt, Human adenovirus A
gaauggaugcgcuccugg

SEQ ID NO: 3895991 - RNA, 14 nt, Human adenovirus A
gacaaagagugacu

SEQ ID NO: 3895992 - RNA, 14 nt, Human adenovirus A
gacaacagcgggga

SEQ ID NO: 3895993 - RNA, 18 nt, Human adenovirus A
gacaacagcugcugucac

SEQ ID NO: 3895994 - RNA, 12 nt, Human adenovirus A
gacaacauugcc

SEQ ID NO: 3895995 - RNA, 12 nt, Human adenovirus A
gacaacugaggu

SEQ ID NO: 3895996 - RNA, 15 nt, Human adenovirus A
gacaaggaagugaag

SEQ ID NO: 3895997 - RNA, 21 nt, Human adenovirus A
gacaccaugguaaaaaggaag

SEQ ID NO: 3895998 - RNA, 21 nt, Human adenovirus A
gacaccgcccaggcaggcgcg

SEQ ID NO: 3895999 - RNA, 16 nt, Human adenovirus A
gacacggcacgcggcc

SEQ ID NO: 3896000 - RNA, 14 nt, Human adenovirus A
gacacuacagagcu

SEQ ID NO: 3896001 - RNA, 18 nt, Human adenovirus A
gacagaaauacagagcug

SEQ ID NO: 3896002 - RNA, 17 nt, Human adenovirus A
gacagacuugcaaacag

SEQ ID NO: 3896003 - RNA, 14 nt, Human adenovirus A
gacagcauggagug

SEQ ID NO: 3896004 - RNA, 15 nt, Human adenovirus A
gacagcauggagugc

SEQ ID NO: 3896005 - RNA, 15 nt, Human adenovirus A
gacagucgcguggca

SEQ ID NO: 3896006 - RNA, 13 nt, Human adenovirus A
gacauccauguga

SEQ ID NO: 3896007 - RNA, 16 nt, Human adenovirus A
gacaucuuaaugccag

SEQ ID NO: 3896008 - RNA, 15 nt, Human adenovirus A
gacauggaaaaaaug

SEQ ID NO: 3896009 - RNA, 23 nt, Human adenovirus A
gacccaccaccaaacugcagccu

SEQ ID NO: 3896010 - RNA, 16 nt, Human adenovirus A
gacccggaggcaacag

SEQ ID NO: 3896011 - RNA, 15 nt, Human adenovirus A
gaccggucaggcgug

SEQ ID NO: 3896012 - RNA, 17 nt, Human adenovirus A
gaccuacuuacuggggu

SEQ ID NO: 3896013 - RNA, 16 nt, Human adenovirus A
gaccucagcccagggc

SEQ ID NO: 3896014 - RNA, 12 nt, Human adenovirus A
gacgcaaaaaag

SEQ ID NO: 3896015 - RNA, 19 nt, Human adenovirus A
gacgcaccgguugagcaga

SEQ ID NO: 3896016 - RNA, 19 nt, Human adenovirus A
gacgcagaagcucuguuca

SEQ ID NO: 3896017 - RNA, 23 nt, Human adenovirus A
gacgcagugagugaaucugugga

SEQ ID NO: 3896018 - RNA, 12 nt, Human adenovirus A
gacgggccaggc

SEQ ID NO: 3896019 - RNA, 15 nt, Human adenovirus A
gacgggccaggcgca

SEQ ID NO: 3896020 - RNA, 13 nt, Human adenovirus A
gacguaaugugcg

SEQ ID NO: 3896021 - RNA, 18 nt, Human adenovirus A
gacuccauaaggcggcgu

SEQ ID NO: 3896022 - RNA, 21 nt, Human adenovirus A
gacugagaaccgucugcauga

SEQ ID NO: 3896023 - RNA, 17 nt, Human adenovirus A
gacugucagugucuccg

SEQ ID NO: 3896024 - RNA, 20 nt, Human adenovirus A
gacuugcuaacuaccuagcu

SEQ ID NO: 3896025 - RNA, 13 nt, Human adenovirus A
gagacagaacacg

SEQ ID NO: 3896026 - RNA, 18 nt, Human adenovirus A
gagaucuaggcuguggac

SEQ ID NO: 3896027 - RNA, 23 nt, Human adenovirus A
gagcaaaucucagaaagccaacc

SEQ ID NO: 3896028 - RNA, 15 nt, Human adenovirus A
gagcacacugggaaa

SEQ ID NO: 3896029 - RNA, 12 nt, Human adenovirus A
gagcaccugggc

SEQ ID NO: 3896030 - RNA, 22 nt, Human adenovirus A
gagcacuaaaaucccuauggac

SEQ ID NO: 3896031 - RNA, 20 nt, Human adenovirus A
gagcaggcuggaggugcagg

SEQ ID NO: 3896032 - RNA, 13 nt, Human adenovirus A
gagcgcccuuaac

SEQ ID NO: 3896033 - RNA, 14 nt, Human adenovirus A
gagcggcugacaga

SEQ ID NO: 3896034 - RNA, 19 nt, Human adenovirus A
gagcguucgccagcucuug

SEQ ID NO: 3896035 - RNA, 14 nt, Human adenovirus A
gagcguucugggau

SEQ ID NO: 3896036 - RNA, 20 nt, Human adenovirus A
gagcuacgcaguuuuucuac

SEQ ID NO: 3896037 - RNA, 23 nt, Human adenovirus A
gagcucauccucagcuccgagau

SEQ ID NO: 3896038 - RNA, 22 nt, Human adenovirus A
gagcuccauucuugagccugga

SEQ ID NO: 3896039 - RNA, 14 nt, Human adenovirus A
gagcugcugcaggc

SEQ ID NO: 3896040 - RNA, 13 nt, Human adenovirus A
gaggacuuggaag

SEQ ID NO: 3896041 - RNA, 16 nt, Human adenovirus A
gaggacuuggaagaau

SEQ ID NO: 3896042 - RNA, 19 nt, Human adenovirus A
gaggagcacccccaggggc

SEQ ID NO: 3896043 - RNA, 15 nt, Human adenovirus A
gaggaggcggacagc

SEQ ID NO: 3896044 - RNA, 15 nt, Human adenovirus A
gaggcagcuggagug

SEQ ID NO: 3896045 - RNA, 15 nt, Human adenovirus A
gagguauuccuccuu

SEQ ID NO: 3896046 - RNA, 14 nt, Human adenovirus A
gagucucaaaagca

SEQ ID NO: 3896047 - RNA, 19 nt, Human adenovirus A
gauaaacuggauuugcgca

SEQ ID NO: 3896048 - RNA, 20 nt, Human adenovirus A
gauaauggggucaugaaagu

SEQ ID NO: 3896049 - RNA, 14 nt, Human adenovirus A
gauagcaaagccau

SEQ ID NO: 3896050 - RNA, 17 nt, Human adenovirus A
gauauaguacugcuucc

SEQ ID NO: 3896051 - RNA, 21 nt, Human adenovirus A
gaucaauuucuuccuccugga

SEQ ID NO: 3896052 - RNA, 16 nt, Human adenovirus A
acuuaccccugggcuu

SEQ ID NO: 3896053 - RNA, 20 nt, Human adenovirus A
acuuagagggaggcaauauu

SEQ ID NO: 3896054 - RNA, 21 nt, Human adenovirus A
acuuaucaagaaauaaccagu

SEQ ID NO: 3896055 - RNA, 12 nt, Human adenovirus A
acuuccuucaga

SEQ ID NO: 3896056 - RNA, 14 nt, Human adenovirus A
acuuuaauguuuca

SEQ ID NO: 3896057 - RNA, 14 nt, Human adenovirus A
acuuucaaaaaagc

SEQ ID NO: 3896058 - RNA, 20 nt, Human adenovirus A
acuuucuccaaaucuuaaau

SEQ ID NO: 3896059 - RNA, 21 nt, Human adenovirus A
acuuuguaccgcgaagccauu

SEQ ID NO: 3896060 - RNA, 21 nt, Human adenovirus A
acuuuuagggaugcaaugcuu

SEQ ID NO: 3896061 - RNA, 13 nt, Human adenovirus A
acuuuuuucccau

SEQ ID NO: 3896062 - RNA, 20 nt, Human adenovirus A
agaaaaaaaccuucgagaac

SEQ ID NO: 3896063 - RNA, 17 nt, Human adenovirus A
agaaaauaacacauaag

SEQ ID NO: 3896064 - RNA, 13 nt, Human adenovirus A
agaaacagcagca

SEQ ID NO: 3896065 - RNA, 18 nt, Human adenovirus A
agaaaguucaccuccagg

SEQ ID NO: 3896066 - RNA, 15 nt, Human adenovirus A
agaaauaaccagugu

SEQ ID NO: 3896067 - RNA, 20 nt, Human adenovirus A
agaaauacagagcugucaua

SEQ ID NO: 3896068 - RNA, 22 nt, Human adenovirus A
agaaaucuuuuaccaaugaauu

SEQ ID NO: 3896069 - RNA, 21 nt, Human adenovirus A
agaaccuuucaagaaaggcau

SEQ ID NO: 3896070 - RNA, 13 nt, Human adenovirus A
agaagagcugcug

SEQ ID NO: 3896071 - RNA, 23 nt, Human adenovirus A
agaaucggcaacagcagcaacaa

SEQ ID NO: 3896072 - RNA, 18 nt, Human adenovirus A
agaauuuuccgaaguacu

SEQ ID NO: 3896073 - RNA, 18 nt, Human adenovirus A
agacaaaaaaaauacuaa

SEQ ID NO: 3896074 - RNA, 14 nt, Human adenovirus A
agacaaagagugac

SEQ ID NO: 3896075 - RNA, 12 nt, Human adenovirus A
agaccaaaaagu

SEQ ID NO: 3896076 - RNA, 14 nt, Human adenovirus A
agacgacaacugag

SEQ ID NO: 3896077 - RNA, 18 nt, Human adenovirus A
agacguaaaccuugaaau

SEQ ID NO: 3896078 - RNA, 14 nt, Human adenovirus A
agacuucccacagc

SEQ ID NO: 3896079 - RNA, 18 nt, Human adenovirus A
agacuugcaaacagcaaa

SEQ ID NO: 3896080 - RNA, 12 nt, Human adenovirus A
agagcggcgaga

SEQ ID NO: 3896081 - RNA, 13 nt, Human adenovirus A
agaggaggguuug

SEQ ID NO: 3896082 - RNA, 17 nt, Human adenovirus A
agaguguguuuaaaugg

SEQ ID NO: 3896083 - RNA, 13 nt, Human adenovirus A
agauaaguuuaaa

SEQ ID NO: 3896084 - RNA, 14 nt, Human adenovirus A
agauccauguugcu

SEQ ID NO: 3896085 - RNA, 19 nt, Human adenovirus A
agauccguacaaggcauug

SEQ ID NO: 3896086 - RNA, 19 nt, Human adenovirus A
agaucuucguaggaaagau

SEQ ID NO: 3896087 - RNA, 18 nt, Human adenovirus A
agauuauacaaacuucau

SEQ ID NO: 3896088 - RNA, 12 nt, Human adenovirus A
agauuggcaaug

SEQ ID NO: 3896089 - RNA, 21 nt, Human adenovirus A
agauuguaauuuuuuucuccu

SEQ ID NO: 3896090 - RNA, 17 nt, Human adenovirus A
agauugucauccccaga

SEQ ID NO: 3896091 - RNA, 12 nt, Human adenovirus A
agcaaaguacaa

SEQ ID NO: 3896092 - RNA, 21 nt, Human adenovirus A
agcaaaugcauuaucaugaaa

SEQ ID NO: 3896093 - RNA, 22 nt, Human adenovirus A
agcaaaugcccugcaaaaagaa

SEQ ID NO: 3896094 - RNA, 17 nt, Human adenovirus A
agcaagugccuccucag

SEQ ID NO: 3896095 - RNA, 15 nt, Human adenovirus A
agcaauuacuugaac

SEQ ID NO: 3896096 - RNA, 18 nt, Human adenovirus A
agcacacugggaaaugau

SEQ ID NO: 3896097 - RNA, 17 nt, Human adenovirus A
agcagcaacaaggaaag

SEQ ID NO: 3896098 - RNA, 13 nt, Human adenovirus A
agcagccaaaacu

SEQ ID NO: 3896099 - RNA, 19 nt, Human adenovirus A
agcaggcuggaggugcagg

SEQ ID NO: 3896100 - RNA, 18 nt, Human adenovirus A
agcagguguaaccagcug

SEQ ID NO: 3896101 - RNA, 14 nt, Human adenovirus A
agcaguaucagugg

SEQ ID NO: 3896102 - RNA, 19 nt, Human adenovirus A
agcauaaaugggacaaguu

SEQ ID NO: 3896103 - RNA, 13 nt, Human adenovirus A
agcauguuaaaaa

SEQ ID NO: 3896104 - RNA, 16 nt, Human adenovirus A
agcauguuaaaaaacg

SEQ ID NO: 3896105 - RNA, 13 nt, Human adenovirus A
agcauuauuugcg

SEQ ID NO: 3896106 - RNA, 22 nt, Human adenovirus A
agccaaaaaaacagauucugga

SEQ ID NO: 3896107 - RNA, 15 nt, Human adenovirus A
agccacaugggaagg

SEQ ID NO: 3896108 - RNA, 15 nt, Human adenovirus A
agccaguacacuugg

SEQ ID NO: 3896109 - RNA, 22 nt, Human adenovirus A
agccauggcuuccaugccuuuu

SEQ ID NO: 3896110 - RNA, 14 nt, Human adenovirus A
agcccaacccauug

SEQ ID NO: 3896111 - RNA, 23 nt, Human adenovirus A
agcccccgcguccuccuucuguu

SEQ ID NO: 3896112 - RNA, 14 nt, Human adenovirus A
agcccgaaguugac

SEQ ID NO: 3896113 - RNA, 21 nt, Human adenovirus A
agcccgaaguugacuggcaug

SEQ ID NO: 3896114 - RNA, 20 nt, Human adenovirus A
agcccuauccgucuccagcu

SEQ ID NO: 3896115 - RNA, 18 nt, Human adenovirus A
agccgucuacucacagcu

SEQ ID NO: 3896116 - RNA, 19 nt, Human adenovirus A
agccuugucuacaacugcu

SEQ ID NO: 3896117 - RNA, 14 nt, Human adenovirus A
agcgccaccugcca

SEQ ID NO: 3896118 - RNA, 18 nt, Human adenovirus A
agcgccagucgccgcaga

SEQ ID NO: 3896119 - RNA, 19 nt, Human adenovirus A
agcgccccccuagcaguaa

SEQ ID NO: 3896120 - RNA, 13 nt, Human adenovirus A
agcgcgagaagaa

SEQ ID NO: 3896121 - RNA, 21 nt, Human adenovirus A
agcggcgagaaugggaggaaa

SEQ ID NO: 3896122 - RNA, 14 nt, Human adenovirus A
agcguucuguggau

SEQ ID NO: 3896123 - RNA, 20 nt, Human adenovirus A
agcuacccuucgcuaugaau

SEQ ID NO: 3896124 - RNA, 19 nt, Human adenovirus A
agcuacgcaguuuuucuac

SEQ ID NO: 3896125 - RNA, 19 nt, Human adenovirus A
agcuauuugagccuucauu

SEQ ID NO: 3896126 - RNA, 14 nt, Human adenovirus A
agcuccauggggcg

SEQ ID NO: 3896127 - RNA, 20 nt, Human adenovirus A
agcugaaacuaggggcuggc

SEQ ID NO: 3896128 - RNA, 19 nt, Human adenovirus A
agcugacgacaguagugua

SEQ ID NO: 3896129 - RNA, 19 nt, Human adenovirus A
agcugagcaaugcuacuaa

SEQ ID NO: 3896130 - RNA, 13 nt, Human adenovirus A
agcugcaguuugu

SEQ ID NO: 3896131 - RNA, 21 nt, Human adenovirus A
agcugccgucuucguggagaa

SEQ ID NO: 3896132 - RNA, 13 nt, Human adenovirus A
agcugugaaaaug

SEQ ID NO: 3896133 - RNA, 16 nt, Human adenovirus A
agcugugaaaaugcgu

SEQ ID NO: 3896134 - RNA, 23 nt, Human adenovirus A
agcuuaccacucagaccuuauga

SEQ ID NO: 3896135 - RNA, 20 nt, Human adenovirus A
agcuucagaaaaugccuguu

SEQ ID NO: 3896136 - RNA, 15 nt, Human adenovirus A
aggaaaagcugccac

SEQ ID NO: 3896137 - RNA, 23 nt, Human adenovirus A
aggaaaagcugccaccucuagaa

SEQ ID NO: 3896138 - RNA, 22 nt, Human adenovirus A
aggaaagacagccaagaccagu

SEQ ID NO: 3896139 - RNA, 19 nt, Human adenovirus A
aggaacuaaaccuuccauc

SEQ ID NO: 3896140 - RNA, 22 nt, Human adenovirus A
aggaacuaaaccuuccaucacc

SEQ ID NO: 3896141 - RNA, 21 nt, Human adenovirus A
aggaacuccgcgcaaggagcu

SEQ ID NO: 3896142 - RNA, 22 nt, Human adenovirus A
aggaagcaauaaaacaaggagc

SEQ ID NO: 3896143 - RNA, 17 nt, Human adenovirus A
aggaagguuccaaggac

SEQ ID NO: 3896144 - RNA, 15 nt, Human adenovirus A
aggaauacaagguag

SEQ ID NO: 3896145 - RNA, 17 nt, Human adenovirus A
aggaauuagcugaugcu

SEQ ID NO: 3896146 - RNA, 19 nt, Human adenovirus A
aggaauuuacuccaucugu

SEQ ID NO: 3896147 - RNA, 21 nt, Human adenovirus A
aggacccccagacacggagag

SEQ ID NO: 3896148 - RNA, 18 nt, Human adenovirus A
aggagaaaauaacacaua

SEQ ID NO: 3896149 - RNA, 18 nt, Human adenovirus A
aggagacguuuuugccca

SEQ ID NO: 3896150 - RNA, 22 nt, Human adenovirus A
aggagcggaacccugcgguggu

SEQ ID NO: 3896151 - RNA, 18 nt, Human adenovirus A
aggagguuuguaagcggu

SEQ ID NO: 3896152 - RNA, 21 nt, Human adenovirus A
aggauugguuccuaauacaaa

SEQ ID NO: 3896153 - RNA, 17 nt, Human adenovirus A
aggcaacauagccccag

SEQ ID NO: 3896154 - RNA, 14 nt, Human adenovirus A
aggcaaugggagau

SEQ ID NO: 3896155 - RNA, 21 nt, Human adenovirus A
aggcagccguuucaggaagga

SEQ ID NO: 3896156 - RNA, 22 nt, Human adenovirus A
aggcagccguuucaggaaggau

SEQ ID NO: 3896157 - RNA, 21 nt, Human adenovirus A
aggcauggaaaaacuuggaaa

SEQ ID NO: 3896158 - RNA, 14 nt, Human adenovirus A
aggccaaacagcug

SEQ ID NO: 3896159 - RNA, 19 nt, Human adenovirus A
aggccaaacagcuguggaa

SEQ ID NO: 3896160 - RNA, 22 nt, Human adenovirus A
aggccaucuugcuuguuuaaac

SEQ ID NO: 3896161 - RNA, 14 nt, Human adenovirus A
aggcgcgcggugga

SEQ ID NO: 3896162 - RNA, 22 nt, Human adenovirus A
aggcgcuugcgcguugaacccg

SEQ ID NO: 3896163 - RNA, 17 nt, Human adenovirus A
aggcuagugcccucaca

SEQ ID NO: 3896164 - RNA, 14 nt, Human adenovirus A
aggcuuucuucaaa

SEQ ID NO: 3896165 - RNA, 16 nt, Human adenovirus A
aggcuuucuucaaauc

SEQ ID NO: 3896166 - RNA, 13 nt, Human adenovirus A
agggaaauccaac

SEQ ID NO: 3896167 - RNA, 20 nt, Human adenovirus A
agggcuggcgcuuccauacc

SEQ ID NO: 3896168 - RNA, 19 nt, Human adenovirus A
agggcuuuuggcuucacua

SEQ ID NO: 3896169 - RNA, 18 nt, Human adenovirus A
aggggcacaugcggggga

SEQ ID NO: 3896170 - RNA, 14 nt, Human adenovirus A
aauuuucuccccac

SEQ ID NO: 3896171 - RNA, 20 nt, Human adenovirus A
acaaaaagacugucaguguc

SEQ ID NO: 3896172 - RNA, 20 nt, Human adenovirus A
acaaacacggauacuuaaua

SEQ ID NO: 3896173 - RNA, 16 nt, Human adenovirus A
acaaaugcgaccucag

SEQ ID NO: 3896174 - RNA, 20 nt, Human adenovirus A
acaacacggaguaaugaaca

SEQ ID NO: 3896175 - RNA, 13 nt, Human adenovirus A
acaacauugaacu

SEQ ID NO: 3896176 - RNA, 14 nt, Human adenovirus A
acaacgagcaagcc

SEQ ID NO: 3896177 - RNA, 23 nt, Human adenovirus A
acaacugcacuugaauauuucga

SEQ ID NO: 3896178 - RNA, 15 nt, Human adenovirus A
acaacuuaacaaauu

SEQ ID NO: 3896179 - RNA, 24 nt, Human adenovirus A
acaacuuuuaacauuagcagucug

SEQ ID NO: 3896180 - RNA, 14 nt, Human adenovirus A
acaagccgcaggac

SEQ ID NO: 3896181 - RNA, 14 nt, Human adenovirus A
acaagguggccgcc

SEQ ID NO: 3896182 - RNA, 17 nt, Human adenovirus A
acaaguuccggaguucc

SEQ ID NO: 3896183 - RNA, 12 nt, Human adenovirus A
acacaaagaaaa

SEQ ID NO: 3896184 - RNA, 13 nt, Human adenovirus A
acacauaaagagu

SEQ ID NO: 3896185 - RNA, 12 nt, Human adenovirus A
acaccuccaccc

SEQ ID NO: 3896186 - RNA, 23 nt, Human adenovirus A
acacgcuuuuacucacuggccug

SEQ ID NO: 3896187 - RNA, 18 nt, Human adenovirus A
acacucaggccauaaaga

SEQ ID NO: 3896188 - RNA, 20 nt, Human adenovirus A
acacugaaggcauuuaaggg

SEQ ID NO: 3896189 - RNA, 21 nt, Human adenovirus A
acacuguaagaggagacaacu

SEQ ID NO: 3896190 - RNA, 19 nt, Human adenovirus A
acacuuacgaauggaacuu

SEQ ID NO: 3896191 - RNA, 17 nt, Human adenovirus A
acacuuuaauaaaaaca

SEQ ID NO: 3896192 - RNA, 15 nt, Human adenovirus A
acacuuuccgccaug

SEQ ID NO: 3896193 - RNA, 13 nt, Human adenovirus A
acagaaccauggu

SEQ ID NO: 3896194 - RNA, 16 nt, Human adenovirus A
acagauguaaaggagg

SEQ ID NO: 3896195 - RNA, 16 nt, Human adenovirus A
acagcggggaggaagc

SEQ ID NO: 3896196 - RNA, 17 nt, Human adenovirus A
acagcuucuaaaagagc

SEQ ID NO: 3896197 - RNA, 22 nt, Human adenovirus A
acagcuucuaaaagagccacag

SEQ ID NO: 3896198 - RNA, 11 nt, Human adenovirus A
acaggcagggc

SEQ ID NO: 3896199 - RNA, 22 nt, Human adenovirus A
acaggcggguaagagcaggcug

SEQ ID NO: 3896200 - RNA, 15 nt, Human adenovirus A
acaguaucaauuuuu

SEQ ID NO: 3896201 - RNA, 14 nt, Human adenovirus A
acauaaagagucuc

SEQ ID NO: 3896202 - RNA, 14 nt, Human adenovirus A
acauaauuucccuc

SEQ ID NO: 3896203 - RNA, 21 nt, Human adenovirus A
acauaauuucccucacaaauu

SEQ ID NO: 3896204 - RNA, 17 nt, Human adenovirus A
acauacaucaccucuuu

SEQ ID NO: 3896205 - RNA, 13 nt, Human adenovirus A
acauaccuggcaa

SEQ ID NO: 3896206 - RNA, 21 nt, Human adenovirus A
acauaccuggcaaacugggau

SEQ ID NO: 3896207 - RNA, 21 nt, Human adenovirus A
acauacuagguauaagaaaga

SEQ ID NO: 3896208 - RNA, 23 nt, Human adenovirus A
acauaggcuggguuuauggaauu

SEQ ID NO: 3896209 - RNA, 18 nt, Human adenovirus A
acaucaauuuuucgucgc

SEQ ID NO: 3896210 - RNA, 22 nt, Human adenovirus A
acaucagacguacccuuuguua

SEQ ID NO: 3896211 - RNA, 23 nt, Human adenovirus A
acaugcgggggaugaaggaagcg

SEQ ID NO: 3896212 - RNA, 16 nt, Human adenovirus A
acauguggagcuuuca

SEQ ID NO: 3896213 - RNA, 18 nt, Human adenovirus A
acauguggagcuuucaac

SEQ ID NO: 3896214 - RNA, 20 nt, Human adenovirus A
acauucgcagcgcacuggca

SEQ ID NO: 3896215 - RNA, 19 nt, Human adenovirus A
accaaaauuuucaacagaa

SEQ ID NO: 3896216 - RNA, 14 nt, Human adenovirus A
accaaacgcaaguu

SEQ ID NO: 3896217 - RNA, 13 nt, Human adenovirus A
accaaagccaugg

SEQ ID NO: 3896218 - RNA, 18 nt, Human adenovirus A
accaaaugagcaaaacgc

SEQ ID NO: 3896219 - RNA, 19 nt, Human adenovirus A
accaaaugcucuuugcgca

SEQ ID NO: 3896220 - RNA, 20 nt, Human adenovirus A
accaccaaauuuaaggccag

SEQ ID NO: 3896221 - RNA, 18 nt, Human adenovirus A
accacggccucagcagcg

SEQ ID NO: 3896222 - RNA, 15 nt, Human adenovirus A
accacucgaguguac

SEQ ID NO: 3896223 - RNA, 17 nt, Human adenovirus A
accacuguagugcaaaa

SEQ ID NO: 3896224 - RNA, 14 nt, Human adenovirus A
accagaaaaacagu

SEQ ID NO: 3896225 - RNA, 13 nt, Human adenovirus A
accauccaaugga

SEQ ID NO: 3896226 - RNA, 18 nt, Human adenovirus A
acccaguuuuugcagugc

SEQ ID NO: 3896227 - RNA, 13 nt, Human adenovirus A
accccaaggcaug

SEQ ID NO: 3896228 - RNA, 15 nt, Human adenovirus A
acccgauaugaugca

SEQ ID NO: 3896229 - RNA, 15 nt, Human adenovirus A
acccucccucuuggc

SEQ ID NO: 3896230 - RNA, 14 nt, Human adenovirus A
accgccaugcgcgc

SEQ ID NO: 3896231 - RNA, 21 nt, Human adenovirus A
accgccguccuaugaggaagc

SEQ ID NO: 3896232 - RNA, 22 nt, Human adenovirus A
accgcgagcgcauagaaaaagc

SEQ ID NO: 3896233 - RNA, 14 nt, Human adenovirus A
accggcccuguugu

SEQ ID NO: 3896234 - RNA, 18 nt, Human adenovirus A
accgucaucucuacagcc

SEQ ID NO: 3896235 - RNA, 16 nt, Human adenovirus A
accuaaggcuucaaga

SEQ ID NO: 3896236 - RNA, 15 nt, Human adenovirus A
accuacacaugaagg

SEQ ID NO: 3896237 - RNA, 20 nt, Human adenovirus A
accuacuucacccugggaaa

SEQ ID NO: 3896238 - RNA, 20 nt, Human adenovirus A
accuaucccaugaccaagcc

SEQ ID NO: 3896239 - RNA, 14 nt, Human adenovirus A
accugaaagaaagu

SEQ ID NO: 3896240 - RNA, 13 nt, Human adenovirus A
accugacagacuu

SEQ ID NO: 3896241 - RNA, 22 nt, Human adenovirus A
accugagucccggucuggugca

SEQ ID NO: 3896242 - RNA, 15 nt, Human adenovirus A
accuguucuccccac

SEQ ID NO: 3896243 - RNA, 15 nt, Human adenovirus A
acgaacuacaacagc

SEQ ID NO: 3896244 - RNA, 19 nt, Human adenovirus A
acgacaacugagguaagug

SEQ ID NO: 3896245 - RNA, 21 nt, Human adenovirus A
acgagaaaguguuaaccauug

SEQ ID NO: 3896246 - RNA, 13 nt, Human adenovirus A
acgagugcuuucu

SEQ ID NO: 3896247 - RNA, 15 nt, Human adenovirus A
acgauaccacucgag

SEQ ID NO: 3896248 - RNA, 15 nt, Human adenovirus A
acgcacacaacagaa

SEQ ID NO: 3896249 - RNA, 20 nt, Human adenovirus A
acgcagaagcucuguucaau

SEQ ID NO: 3896250 - RNA, 16 nt, Human adenovirus A
acgcaugaaggguggg

SEQ ID NO: 3896251 - RNA, 15 nt, Human adenovirus A
acgccaaagccacac

SEQ ID NO: 3896252 - RNA, 12 nt, Human adenovirus A
acgccaccagcg

SEQ ID NO: 3896253 - RNA, 14 nt, Human adenovirus A
acgcucaaagaaac

SEQ ID NO: 3896254 - RNA, 15 nt, Human adenovirus A
acgcucuggcagggg

SEQ ID NO: 3896255 - RNA, 16 nt, Human adenovirus A
acggccggaugcagag

SEQ ID NO: 3896256 - RNA, 20 nt, Human adenovirus A
acgggaaaaaaaagaggaag

SEQ ID NO: 3896257 - RNA, 12 nt, Human adenovirus A
acgggccaggcg

SEQ ID NO: 3896258 - RNA, 16 nt, Human adenovirus A
acgggccgcagcugcg

SEQ ID NO: 3896259 - RNA, 14 nt, Human adenovirus A
acguaacuuucaaa

SEQ ID NO: 3896260 - RNA, 19 nt, Human adenovirus A
acuaaauaucgcagcuggu

SEQ ID NO: 3896261 - RNA, 17 nt, Human adenovirus A
acuaaauggaagacauc

SEQ ID NO: 3896262 - RNA, 11 nt, Human adenovirus A
acuaacaccaa

SEQ ID NO: 3896263 - RNA, 21 nt, Human adenovirus A
acuaacgcuggggcacagcuu

SEQ ID NO: 3896264 - RNA, 21 nt, Human adenovirus A
acuaaugaggcuuuucaucca

SEQ ID NO: 3896265 - RNA, 14 nt, Human adenovirus A
acuacucagaacaa

SEQ ID NO: 3896266 - RNA, 18 nt, Human adenovirus A
acuagguauaagaaagag

SEQ ID NO: 3896267 - RNA, 15 nt, Human adenovirus A
acuauucuagcaaaa

SEQ ID NO: 3896268 - RNA, 18 nt, Human adenovirus A
acucacccugugcuuaac

SEQ ID NO: 3896269 - RNA, 22 nt, Human adenovirus A
acucacuggccugaccauccaa

SEQ ID NO: 3896270 - RNA, 12 nt, Human adenovirus A
acucacuuugcc

SEQ ID NO: 3896271 - RNA, 22 nt, Human adenovirus A
acucagcgacaaaccuuuacug

SEQ ID NO: 3896272 - RNA, 20 nt, Human adenovirus A
acucaggauucgugggauac

SEQ ID NO: 3896273 - RNA, 14 nt, Human adenovirus A
acucauaagcugug

SEQ ID NO: 3896274 - RNA, 14 nt, Human adenovirus A
acuccaucuguuua

SEQ ID NO: 3896275 - RNA, 19 nt, Human adenovirus A
acucuacuaacaacuccag

SEQ ID NO: 3896276 - RNA, 22 nt, Human adenovirus A
acucuacuaacaacuccagaug

SEQ ID NO: 3896277 - RNA, 21 nt, Human adenovirus A
acugaaccauucccagguaau

SEQ ID NO: 3896278 - RNA, 19 nt, Human adenovirus A
acugaccaggucagcucag

SEQ ID NO: 3896279 - RNA, 14 nt, Human adenovirus A
acugcagccugucu

SEQ ID NO: 3896280 - RNA, 17 nt, Human adenovirus A
acuggauuugcgcacug

SEQ ID NO: 3896281 - RNA, 19 nt, Human adenovirus A
acuggcuaacgcuccaggg

SEQ ID NO: 3896282 - RNA, 22 nt, Human adenovirus A
acugggauggguguuuggcagc

SEQ ID NO: 3896283 - RNA, 16 nt, Human adenovirus A
acugggccaggaggac

SEQ ID NO: 3896284 - RNA, 13 nt, Human adenovirus A
acugggugccgcc

SEQ ID NO: 3896285 - RNA, 15 nt, Human adenovirus A
acuguaagaggagac

SEQ ID NO: 3896286 - RNA, 22 nt, Human adenovirus A
acuguagugcaaaauaaugacu

SEQ ID NO: 3896287 - RNA, 16 nt, Human adenovirus A
acuguccagggcuuuu

SEQ ID NO: 3896288 - RNA, 14 nt, Human adenovirus A
acuuaauacuggcu

SEQ ID NO: 3896289 - RNA, 13 nt, Human adenovirus A
aggguccagggac

SEQ ID NO: 3896290 - RNA, 20 nt, Human adenovirus A
agggugccacccccagugcc

SEQ ID NO: 3896291 - RNA, 17 nt, Human adenovirus A
aggguggggugcugccc

SEQ ID NO: 3896292 - RNA, 23 nt, Human adenovirus A
aggguuugcaaaccguaaacuua

SEQ ID NO: 3896293 - RNA, 20 nt, Human adenovirus A
agguagaggcauaaaaacuu

SEQ ID NO: 3896294 - RNA, 17 nt, Human adenovirus A
agguagcauuuuaacau

SEQ ID NO: 3896295 - RNA, 16 nt, Human adenovirus A
agguaggcuaaguuuu

SEQ ID NO: 3896296 - RNA, 16 nt, Human adenovirus A
agguauaacaaaauuc

SEQ ID NO: 3896297 - RNA, 16 nt, Human adenovirus A
agguauucagcugaac

SEQ ID NO: 3896298 - RNA, 17 nt, Human adenovirus A
aggucgaggacuuggaa

SEQ ID NO: 3896299 - RNA, 17 nt, Human adenovirus A
aggugcaagaaggccau

SEQ ID NO: 3896300 - RNA, 16 nt, Human adenovirus A
aggugcuucccacaua

SEQ ID NO: 3896301 - RNA, 11 nt, Human adenovirus A
agguggaaacc

SEQ ID NO: 3896302 - RNA, 21 nt, Human adenovirus A
agguggaaaccuagguuuaaa

SEQ ID NO: 3896303 - RNA, 20 nt, Human adenovirus A
aguaaagauauucccacgcc

SEQ ID NO: 3896304 - RNA, 12 nt, Human adenovirus A
aguaacaaacug

SEQ ID NO: 3896305 - RNA, 15 nt, Human adenovirus A
aguaacaacacgggc

SEQ ID NO: 3896306 - RNA, 17 nt, Human adenovirus A
aguaacuucaugucuau

SEQ ID NO: 3896307 - RNA, 13 nt, Human adenovirus A
aguaaugaacaag

SEQ ID NO: 3896308 - RNA, 14 nt, Human adenovirus A
aguaauggaguugg

SEQ ID NO: 3896309 - RNA, 15 nt, Human adenovirus A
aguacacuugggaaa

SEQ ID NO: 3896310 - RNA, 21 nt, Human adenovirus A
aguacaggcaacaugggugua

SEQ ID NO: 3896311 - RNA, 19 nt, Human adenovirus A
aguacguccgauaaaaaag

SEQ ID NO: 3896312 - RNA, 13 nt, Human adenovirus A
aguacugcuucca

SEQ ID NO: 3896313 - RNA, 15 nt, Human adenovirus A
aguaggcuaacuguu

SEQ ID NO: 3896314 - RNA, 14 nt, Human adenovirus A
aguauaagguauau

SEQ ID NO: 3896315 - RNA, 14 nt, Human adenovirus A
aguauuugucuccu

SEQ ID NO: 3896316 - RNA, 18 nt, Human adenovirus A
agucaaaguaugcugcac

SEQ ID NO: 3896317 - RNA, 14 nt, Human adenovirus A
agucacaaguacau

SEQ ID NO: 3896318 - RNA, 23 nt, Human adenovirus A
agucagcugcaaaccgcgcuuuu

SEQ ID NO: 3896319 - RNA, 21 nt, Human adenovirus A
agucaggcagaggacgagguc

SEQ ID NO: 3896320 - RNA, 17 nt, Human adenovirus A
agucccggucuggugca

SEQ ID NO: 3896321 - RNA, 15 nt, Human adenovirus A
agucugacagcaauu

SEQ ID NO: 3896322 - RNA, 20 nt, Human adenovirus A
agugaacccggacgcuggca

SEQ ID NO: 3896323 - RNA, 22 nt, Human adenovirus A
agugaauggaacaccagcauug

SEQ ID NO: 3896324 - RNA, 19 nt, Human adenovirus A
agugccagaagcacuggca

SEQ ID NO: 3896325 - RNA, 16 nt, Human adenovirus A
agugccucaaagugaa

SEQ ID NO: 3896326 - RNA, 20 nt, Human adenovirus A
agugcucuaauagaacugga

SEQ ID NO: 3896327 - RNA, 16 nt, Human adenovirus A
agugcuggaaagugac

SEQ ID NO: 3896328 - RNA, 17 nt, Human adenovirus A
aguggcacaacacauac

SEQ ID NO: 3896329 - RNA, 19 nt, Human adenovirus A
agugguauuccgcgguccu

SEQ ID NO: 3896330 - RNA, 13 nt, Human adenovirus A
agugucuccguau

SEQ ID NO: 3896331 - RNA, 19 nt, Human adenovirus A
agugucuuguuaauguuug

SEQ ID NO: 3896332 - RNA, 15 nt, Human adenovirus A
aguguuaaccauugu

SEQ ID NO: 3896333 - RNA, 12 nt, Human adenovirus A
aguuaaguuuga

SEQ ID NO: 3896334 - RNA, 23 nt, Human adenovirus A
aguuaauugauuuacaaaccgug

SEQ ID NO: 3896335 - RNA, 21 nt, Human adenovirus A
aguuaggucaucguaggacaa

SEQ ID NO: 3896336 - RNA, 15 nt, Human adenovirus A
aguucaaacagugga

SEQ ID NO: 3896337 - RNA, 16 nt, Human adenovirus A
aguucaccuccaggua

SEQ ID NO: 3896338 - RNA, 19 nt, Human adenovirus A
aguucaccuccagguacaa

SEQ ID NO: 3896339 - RNA, 21 nt, Human adenovirus A
aguuccguaaagacuccggaa

SEQ ID NO: 3896340 - RNA, 21 nt, Human adenovirus A
aguucgccuacacaacacaaa

SEQ ID NO: 3896341 - RNA, 22 nt, Human adenovirus A
aguugacgccccauccguggca

SEQ ID NO: 3896342 - RNA, 15 nt, Human adenovirus A
aguugcgagcugcca

SEQ ID NO: 3896343 - RNA, 17 nt, Human adenovirus A
aguuuacccgccagugu

SEQ ID NO: 3896344 - RNA, 19 nt, Human adenovirus A
aguuugacaccagaaacuu

SEQ ID NO: 3896345 - RNA, 15 nt, Human adenovirus A
aguuugguagcaaaa

SEQ ID NO: 3896346 - RNA, 13 nt, Human adenovirus A
auaaaaacacaca

SEQ ID NO: 3896347 - RNA, 15 nt, Human adenovirus A
auaaaaccugugccu

SEQ ID NO: 3896348 - RNA, 21 nt, Human adenovirus A
auaaaagcuucaauuugccua

SEQ ID NO: 3896349 - RNA, 14 nt, Human adenovirus A
auaaagaaaaaacu

SEQ ID NO: 3896350 - RNA, 23 nt, Human adenovirus A
auaaagaguuaauugauuuacaa

SEQ ID NO: 3896351 - RNA, 20 nt, Human adenovirus A
auaacuaacuuuaauguuuc

SEQ ID NO: 3896352 - RNA, 18 nt, Human adenovirus A
auaagcauuagagucgcc

SEQ ID NO: 3896353 - RNA, 16 nt, Human adenovirus A
auacaaaucagaagcc

SEQ ID NO: 3896354 - RNA, 21 nt, Human adenovirus A
auacacuccaggaaacauaaa

SEQ ID NO: 3896355 - RNA, 15 nt, Human adenovirus A
auacagauuuaaggg

SEQ ID NO: 3896356 - RNA, 20 nt, Human adenovirus A
auacauaauuuuaaaguaaa

SEQ ID NO: 3896357 - RNA, 22 nt, Human adenovirus A
auaccaguuucaauugcagaac

SEQ ID NO: 3896358 - RNA, 17 nt, Human adenovirus A
auaccuggcaaacuggg

SEQ ID NO: 3896359 - RNA, 20 nt, Human adenovirus A
auaccuggcaaacugggaug

SEQ ID NO: 3896360 - RNA, 12 nt, Human adenovirus A
auacuaaagaaa

SEQ ID NO: 3896361 - RNA, 17 nt, Human adenovirus A
auacuaacaaugcuuuc

SEQ ID NO: 3896362 - RNA, 11 nt, Human adenovirus A
auacucuggaa

SEQ ID NO: 3896363 - RNA, 12 nt, Human adenovirus A
auacugggugcg

SEQ ID NO: 3896364 - RNA, 18 nt, Human adenovirus A
auagagauaagcaggaaa

SEQ ID NO: 3896365 - RNA, 13 nt, Human adenovirus A
auagcaaagccau

SEQ ID NO: 3896366 - RNA, 13 nt, Human adenovirus A
auagcugaacccc

SEQ ID NO: 3896367 - RNA, 13 nt, Human adenovirus A
auaggaggaguua

SEQ ID NO: 3896368 - RNA, 18 nt, Human adenovirus A
auaguaaaaaugccagga

SEQ ID NO: 3896369 - RNA, 13 nt, Human adenovirus A
auauaguacugcu

SEQ ID NO: 3896370 - RNA, 15 nt, Human adenovirus A
auauauccuugcaaa

SEQ ID NO: 3896371 - RNA, 20 nt, Human adenovirus A
auauuaaaaagcucuguaag

SEQ ID NO: 3896372 - RNA, 21 nt, Human adenovirus A
auauucgcgugccaggcauuu

SEQ ID NO: 3896373 - RNA, 16 nt, Human adenovirus A
auauugcauuuguccu

SEQ ID NO: 3896374 - RNA, 18 nt, Human adenovirus A
auauuuugccagcucuug

SEQ ID NO: 3896375 - RNA, 18 nt, Human adenovirus A
aucaacgacuaaaacaaa

SEQ ID NO: 3896376 - RNA, 21 nt, Human adenovirus A
aucaacgacuaaaacaaaucu

SEQ ID NO: 3896377 - RNA, 19 nt, Human adenovirus A
aucaagcauguuaaaaaac

SEQ ID NO: 3896378 - RNA, 16 nt, Human adenovirus A
aucaaggaaauacuau

SEQ ID NO: 3896379 - RNA, 10 nt, Human adenovirus A
aucacuuccg

SEQ ID NO: 3896380 - RNA, 14 nt, Human adenovirus A
aucaguggaguuca

SEQ ID NO: 3896381 - RNA, 15 nt, Human adenovirus A
aucaucaaacugccu

SEQ ID NO: 3896382 - RNA, 14 nt, Human adenovirus A
aucaugaaaacagc

SEQ ID NO: 3896383 - RNA, 21 nt, Human adenovirus A
aucaugauguuuaauaaagcg

SEQ ID NO: 3896384 - RNA, 21 nt, Human adenovirus A
auccaaguucuaaugcaaguu

SEQ ID NO: 3896385 - RNA, 19 nt, Human adenovirus A
aucccagcugacauacacu

SEQ ID NO: 3896386 - RNA, 17 nt, Human adenovirus A
aucccuugcuugcuuac

SEQ ID NO: 3896387 - RNA, 16 nt, Human adenovirus A
auccguggcaggccau

SEQ ID NO: 3896388 - RNA, 17 nt, Human adenovirus A
auccuacaaaaaguaac

SEQ ID NO: 3896389 - RNA, 16 nt, Human adenovirus A
auccuaggcaaagaaa

SEQ ID NO: 3896390 - RNA, 18 nt, Human adenovirus A
aucgccccgcugcaauuu

SEQ ID NO: 3896391 - RNA, 20 nt, Human adenovirus A
aucuacagcgacaaagcacu

SEQ ID NO: 3896392 - RNA, 21 nt, Human adenovirus A
aucucaccuggaccuuuaacg

SEQ ID NO: 3896393 - RNA, 24 nt, Human adenovirus A
aucucacuuaagucuuuacaauaa

SEQ ID NO: 3896394 - RNA, 17 nt, Human adenovirus A
aucugaucgcucuucaa

SEQ ID NO: 3896395 - RNA, 15 nt, Human adenovirus A
aucugccacuacccg

SEQ ID NO: 3896396 - RNA, 22 nt, Human adenovirus A
aucugcgccacaauaacuacaa

SEQ ID NO: 3896397 - RNA, 12 nt, Human adenovirus A
aucugucggcgu

SEQ ID NO: 3896398 - RNA, 13 nt, Human adenovirus A
aucuucaaacacc

SEQ ID NO: 3896399 - RNA, 16 nt, Human adenovirus A
aucuucaucuuuucua

SEQ ID NO: 3896400 - RNA, 16 nt, Human adenovirus A
aucuuccgccaaaggu

SEQ ID NO: 3896401 - RNA, 15 nt, Human adenovirus A
aucuuggaguguacc

SEQ ID NO: 3896402 - RNA, 14 nt, Human adenovirus A
augaaaacagcauu

SEQ ID NO: 3896403 - RNA, 22 nt, Human adenovirus A
augaaacccgcugugagcaaau

SEQ ID NO: 3896404 - RNA, 21 nt, Human adenovirus A
augaacaaacgguuacagagg

SEQ ID NO: 3896405 - RNA, 14 nt, Human adenovirus A
augaagcacgcaga

SEQ ID NO: 3896406 - RNA, 15 nt, Human adenovirus A
augaugcgggcagcc

SEQ ID NO: 3896407 - RNA, 21 nt, Human adenovirus A
augauuaaacaacaaaacacu

SEQ ID NO: 3896408 - RNA, 15 nt, Human adenovirus A
uucgucgcuguuuug

SEQ ID NO: 3896409 - RNA, 22 nt, Human adenovirus A
uucuacuuuagaagccauguua

SEQ ID NO: 3896410 - RNA, 16 nt, Human adenovirus A
uucuagcaaaaugaau

SEQ ID NO: 3896411 - RNA, 11 nt, Human adenovirus A
uucuccaaauc

SEQ ID NO: 3896412 - RNA, 22 nt, Human adenovirus A
uucuccaaaucuuaaauggaag

SEQ ID NO: 3896413 - RNA, 18 nt, Human adenovirus A
uucuccuuuuuuuuucca

SEQ ID NO: 3896414 - RNA, 12 nt, Human adenovirus A
uucugcugucau

SEQ ID NO: 3896415 - RNA, 14 nt, Human adenovirus A
uucugcugucauuu

SEQ ID NO: 3896416 - RNA, 14 nt, Human adenovirus A
uucuggaauaacaa

SEQ ID NO: 3896417 - RNA, 14 nt, Human adenovirus A
uucuuaagcaguga

SEQ ID NO: 3896418 - RNA, 21 nt, Human adenovirus A
uucuuaguaggcuaacuguua

SEQ ID NO: 3896419 - RNA, 15 nt, Human adenovirus A
uucuuuacaacugua

SEQ ID NO: 3896420 - RNA, 15 nt, Human adenovirus A
uucuuugguuugcaa

SEQ ID NO: 3896421 - RNA, 22 nt, Human adenovirus A
uugaaaagacugagaaccgucu

SEQ ID NO: 3896422 - RNA, 21 nt, Human adenovirus A
uugaaccagcgucccaaaagc

SEQ ID NO: 3896423 - RNA, 20 nt, Human adenovirus A
uugaauaguucaucuuagua

SEQ ID NO: 3896424 - RNA, 20 nt, Human adenovirus A
uugacaaacgcccugcuccg

SEQ ID NO: 3896425 - RNA, 18 nt, Human adenovirus A
uugagcccgaaguugacu

SEQ ID NO: 3896426 - RNA, 20 nt, Human adenovirus A
uugaguaacuucaacauuua

SEQ ID NO: 3896427 - RNA, 20 nt, Human adenovirus A
uugauacuuguuuuuucuga

SEQ ID NO: 3896428 - RNA, 17 nt, Human adenovirus A
uugcaagcgaucccaua

SEQ ID NO: 3896429 - RNA, 22 nt, Human adenovirus A
uugcagcagaauuacugccagu

SEQ ID NO: 3896430 - RNA, 10 nt, Human adenovirus A
uugcauggug

SEQ ID NO: 3896431 - RNA, 15 nt, Human adenovirus A
uugccuacccggcag

SEQ ID NO: 3896432 - RNA, 18 nt, Human adenovirus A
uugcgcuauguacagcaa

SEQ ID NO: 3896433 - RNA, 16 nt, Human adenovirus A
uugcuaaauuggccuu

SEQ ID NO: 3896434 - RNA, 16 nt, Human adenovirus A
uuggaaacugugcugc

SEQ ID NO: 3896435 - RNA, 22 nt, Human adenovirus A
uuggagccccuuaccaacaccu

SEQ ID NO: 3896436 - RNA, 16 nt, Human adenovirus A
uuggaguuggaagaag

SEQ ID NO: 3896437 - RNA, 19 nt, Human adenovirus A
uuggccaccauagccccuc

SEQ ID NO: 3896438 - RNA, 16 nt, Human adenovirus A
uuggcuuucgaggggu

SEQ ID NO: 3896439 - RNA, 19 nt, Human adenovirus A
uugguuaagcgccggaccc

SEQ ID NO: 3896440 - RNA, 16 nt, Human adenovirus A
uugugguucaggaacg

SEQ ID NO: 3896441 - RNA, 22 nt, Human adenovirus A
uuuaagucgagauucauaccug

SEQ ID NO: 3896442 - RNA, 19 nt, Human adenovirus A
uuuaauacugaaaaauagu

SEQ ID NO: 3896443 - RNA, 16 nt, Human adenovirus A
uuuaauuaacauucug

SEQ ID NO: 3896444 - RNA, 12 nt, Human adenovirus A
uuuagguccugu

SEQ ID NO: 3896445 - RNA, 16 nt, Human adenovirus A
uuuaguggcaaucaaa

SEQ ID NO: 3896446 - RNA, 22 nt, Human adenovirus A
uuuaugccuaaugugagugcuu

SEQ ID NO: 3896447 - RNA, 12 nt, Human adenovirus A
uuuauuggccug

SEQ ID NO: 3896448 - RNA, 14 nt, Human adenovirus A
uuucacauucaacu

SEQ ID NO: 3896449 - RNA, 13 nt, Human adenovirus A
uuucagcacugcg

SEQ ID NO: 3896450 - RNA, 22 nt, Human adenovirus A
uuucauuaggcuuucuuccauu

SEQ ID NO: 3896451 - RNA, 14 nt, Human adenovirus A
uuucccucuuccca

SEQ ID NO: 3896452 - RNA, 14 nt, Human adenovirus A
uuucguuccagacu

SEQ ID NO: 3896453 - RNA, 15 nt, Human adenovirus A
uuucugacaugguaa

SEQ ID NO: 3896454 - RNA, 14 nt, Human adenovirus A
uuugaaccugaaag

SEQ ID NO: 3896455 - RNA, 14 nt, Human adenovirus A
uuugaccggucagg

SEQ ID NO: 3896456 - RNA, 14 nt, Human adenovirus A
uuugagauuggcaa

SEQ ID NO: 3896457 - RNA, 16 nt, Human adenovirus A
uuugaguacucagccg

SEQ ID NO: 3896458 - RNA, 17 nt, Human adenovirus A
uuugcaaggcgguauuu

SEQ ID NO: 3896459 - RNA, 18 nt, Human adenovirus A
uuugcuggagauaaguuu

SEQ ID NO: 3896460 - RNA, 13 nt, Human adenovirus A
uuuggagccccuu

SEQ ID NO: 3896461 - RNA, 21 nt, Human adenovirus A
uuuggcggccaugcaaagcca

SEQ ID NO: 3896462 - RNA, 19 nt, Human adenovirus A
uuuguccaguuuacuaaca

SEQ ID NO: 3896463 - RNA, 15 nt, Human adenovirus A
uuugugccucgucag

SEQ ID NO: 3896464 - RNA, 15 nt, Human adenovirus A
uuuuaacugugaaaa

SEQ ID NO: 3896465 - RNA, 23 nt, Human adenovirus A
uuuuaagaagcaccacaucuuug

SEQ ID NO: 3896466 - RNA, 14 nt, Human adenovirus A
uuuucaguggacaa

SEQ ID NO: 3896467 - RNA, 23 nt, Human adenovirus A
uuuucuagaacaaaaaggaggaa

SEQ ID NO: 3896468 - RNA, 18 nt, Human adenovirus A
uuuucuuacauuacccaa

SEQ ID NO: 3896469 - RNA, 14 nt, Human adenovirus A
uuuuguuucuucua

SEQ ID NO: 3896470 - RNA, 21 nt, Human adenovirus A
ugaugccacuugaauucugga

SEQ ID NO: 3896471 - RNA, 20 nt, Human adenovirus A
ugaugcuuuucgccagcagc

SEQ ID NO: 3896472 - RNA, 22 nt, Human adenovirus A
ugauuucgauaaacaaaagcaa

SEQ ID NO: 3896473 - RNA, 23 nt, Human adenovirus A
ugcaaaaagaaaaugaacaaaau

SEQ ID NO: 3896474 - RNA, 17 nt, Human adenovirus A
ugcaaauucaucaacau

SEQ ID NO: 3896475 - RNA, 17 nt, Human adenovirus A
ugcaagaggagaaggag

SEQ ID NO: 3896476 - RNA, 16 nt, Human adenovirus A
ugcaaugcuuaacaua

SEQ ID NO: 3896477 - RNA, 18 nt, Human adenovirus A
ugcacguacuagccccug

SEQ ID NO: 3896478 - RNA, 16 nt, Human adenovirus A
ugcagccugucuuaaa

SEQ ID NO: 3896479 - RNA, 21 nt, Human adenovirus A
ugcagcgugcggccuguuuug

SEQ ID NO: 3896480 - RNA, 18 nt, Human adenovirus A
ugcaggcuaauuugugga

SEQ ID NO: 3896481 - RNA, 18 nt, Human adenovirus A
ugcaggcuucucgaaaaa

SEQ ID NO: 3896482 - RNA, 22 nt, Human adenovirus A
ugcaguuuuuuuuccacacauc

SEQ ID NO: 3896483 - RNA, 17 nt, Human adenovirus A
ugcaucguaaacaacag

SEQ ID NO: 3896484 - RNA, 21 nt, Human adenovirus A
ugcaucguaaacaacagacuu

SEQ ID NO: 3896485 - RNA, 14 nt, Human adenovirus A
ugcauuaccagcag

SEQ ID NO: 3896486 - RNA, 17 nt, Human adenovirus A
ugcauuaucaugaaacu

SEQ ID NO: 3896487 - RNA, 14 nt, Human adenovirus A
ugcauuuaguguuu

SEQ ID NO: 3896488 - RNA, 20 nt, Human adenovirus A
ugcauuuuauuauuugcugc

SEQ ID NO: 3896489 - RNA, 18 nt, Human adenovirus A
ugccaccucuagaaacug

SEQ ID NO: 3896490 - RNA, 23 nt, Human adenovirus A
ugccacgcuuugaccggucaggc

SEQ ID NO: 3896491 - RNA, 22 nt, Human adenovirus A
ugccauuaauugaucaauuucu

SEQ ID NO: 3896492 - RNA, 12 nt, Human adenovirus A
ugcccugcaaaa

SEQ ID NO: 3896493 - RNA, 18 nt, Human adenovirus A
ugccgcccgcauguaugg

SEQ ID NO: 3896494 - RNA, 14 nt, Human adenovirus A
ugccguuggcagag

SEQ ID NO: 3896495 - RNA, 22 nt, Human adenovirus A
ugccuacccggcaguaaaucuu

SEQ ID NO: 3896496 - RNA, 21 nt, Human adenovirus A
ugccuuaggcagcagcagcaa

SEQ ID NO: 3896497 - RNA, 14 nt, Human adenovirus A
ugcgaccgggcacc

SEQ ID NO: 3896498 - RNA, 21 nt, Human adenovirus A
ugcgacguuuuguuaccugug

SEQ ID NO: 3896499 - RNA, 21 nt, Human adenovirus A
ugcgccuauauuauagguaac

SEQ ID NO: 3896500 - RNA, 19 nt, Human adenovirus A
ugcguagcaguaucagugg

SEQ ID NO: 3896501 - RNA, 23 nt, Human adenovirus A
ugcuaagggacaaguuaaaagac

SEQ ID NO: 3896502 - RNA, 16 nt, Human adenovirus A
ugcuaugugcaaauau

SEQ ID NO: 3896503 - RNA, 13 nt, Human adenovirus A
ugcuccuuuucuu

SEQ ID NO: 3896504 - RNA, 17 nt, Human adenovirus A
ugcucgaccguuuucac

SEQ ID NO: 3896505 - RNA, 17 nt, Human adenovirus A
ugcucuaauagaacugg

SEQ ID NO: 3896506 - RNA, 17 nt, Human adenovirus A
ugcuggugaaagaucac

SEQ ID NO: 3896507 - RNA, 16 nt, Human adenovirus A
ugcuuuccaaaugccc

SEQ ID NO: 3896508 - RNA, 23 nt, Human adenovirus A
ugcuuuuagaugucgaaugcagg

SEQ ID NO: 3896509 - RNA, 17 nt, Human adenovirus A
uggaaaaaaugaaaguu

SEQ ID NO: 3896510 - RNA, 13 nt, Human adenovirus A
uggaaaaacaacu

SEQ ID NO: 3896511 - RNA, 21 nt, Human adenovirus A
uggaaaccuagguuuaaaucu

SEQ ID NO: 3896512 - RNA, 22 nt, Human adenovirus A
uggaacaacaggugcaagaagg

SEQ ID NO: 3896513 - RNA, 23 nt, Human adenovirus A
uggaacaacaggugcaagaaggc

SEQ ID NO: 3896514 - RNA, 15 nt, Human adenovirus A
uggaacccuuacacu

SEQ ID NO: 3896515 - RNA, 20 nt, Human adenovirus A
uggaacucgagugcaugcau

SEQ ID NO: 3896516 - RNA, 18 nt, Human adenovirus A
uggaagaaugggaggagg

SEQ ID NO: 3896517 - RNA, 14 nt, Human adenovirus A
uggaauaagguuuc

SEQ ID NO: 3896518 - RNA, 10 nt, Human adenovirus A
uggacacuau

SEQ ID NO: 3896519 - RNA, 21 nt, Human adenovirus A
uggaccuacuuacuggggugc

SEQ ID NO: 3896520 - RNA, 14 nt, Human adenovirus A
uggacggagccagc

SEQ ID NO: 3896521 - RNA, 19 nt, Human adenovirus A
uggacguuaguaacaacaa

SEQ ID NO: 3896522 - RNA, 22 nt, Human adenovirus A
uggagcggucuuaaaaauuuug

SEQ ID NO: 3896523 - RNA, 17 nt, Human adenovirus A
uggaggcagcuggagug

SEQ ID NO: 3896524 - RNA, 13 nt, Human adenovirus A
uggaguuggaaac

SEQ ID NO: 3896525 - RNA, 14 nt, Human adenovirus A
uggauguuggaagg

SEQ ID NO: 3896526 - RNA, 16 nt, Human adenovirus A
uggcagcugauuucag

SEQ ID NO: 3896527 - RNA, 14 nt, Human adenovirus A
uggccagcugcccu

SEQ ID NO: 3896528 - RNA, 18 nt, Human adenovirus A
uggcgcuacggcugucau

SEQ ID NO: 3896529 - RNA, 22 nt, Human adenovirus A
uggcuacgugcgccaagccugu

SEQ ID NO: 3896530 - RNA, 21 nt, Human adenovirus A
uggcuguugcuguaaggaacg

SEQ ID NO: 3896531 - RNA, 17 nt, Human adenovirus A
ugggacauaauuucccu

SEQ ID NO: 3896532 - RNA, 14 nt, Human adenovirus A
ugggaggaaagaca

SEQ ID NO: 3896533 - RNA, 13 nt, Human adenovirus A
ugggaggaagaau

SEQ ID NO: 3896534 - RNA, 22 nt, Human adenovirus A
uggucccuacccgauaugaugc

SEQ ID NO: 3896535 - RNA, 23 nt, Human adenovirus A
uggucuggcuucgggaauuaaug

SEQ ID NO: 3896536 - RNA, 23 nt, Human adenovirus A
ugguggaaaaagaucaaggaaau

SEQ ID NO: 3896537 - RNA, 20 nt, Human adenovirus A
ugguucugccucuucuucuu

SEQ ID NO: 3896538 - RNA, 15 nt, Human adenovirus A
uguaaaugcuuuguu

SEQ ID NO: 3896539 - RNA, 22 nt, Human adenovirus A
uguaacuguggaacucgagugc

SEQ ID NO: 3896540 - RNA, 20 nt, Human adenovirus A
uguacagaaaaaaauugcca

SEQ ID NO: 3896541 - RNA, 20 nt, Human adenovirus A
uguacagcaaucuguaaguu

SEQ ID NO: 3896542 - RNA, 20 nt, Human adenovirus A
uguaguggggauugggaagg

SEQ ID NO: 3896543 - RNA, 22 nt, Human adenovirus A
uguauaaauucuuaaacaaucu

SEQ ID NO: 3896544 - RNA, 19 nt, Human adenovirus A
uguauacucuggaaccauu

SEQ ID NO: 3896545 - RNA, 16 nt, Human adenovirus A
uguaucagucuggacc

SEQ ID NO: 3896546 - RNA, 15 nt, Human adenovirus A
uguccccgaaagccg

SEQ ID NO: 3896547 - RNA, 18 nt, Human adenovirus A
uguccccgaaagccgcaa

SEQ ID NO: 3896548 - RNA, 21 nt, Human adenovirus A
ugucggccugacgcucuggca

SEQ ID NO: 3896549 - RNA, 16 nt, Human adenovirus A
ugucuccucuguaguu

SEQ ID NO: 3896550 - RNA, 13 nt, Human adenovirus A
ugucuuguuaaug

SEQ ID NO: 3896551 - RNA, 15 nt, Human adenovirus A
uguggcccaaugcaa

SEQ ID NO: 3896552 - RNA, 15 nt, Human adenovirus A
uguguccuuggaaga

SEQ ID NO: 3896553 - RNA, 10 nt, Human adenovirus A
uguuaaccau

SEQ ID NO: 3896554 - RNA, 20 nt, Human adenovirus A
uguucaauaaauacugcucc

SEQ ID NO: 3896555 - RNA, 21 nt, Human adenovirus A
uguuuggcagcaaugcuugga

SEQ ID NO: 3896556 - RNA, 16 nt, Human adenovirus A
uuaaccauuguaaaug

SEQ ID NO: 3896557 - RNA, 19 nt, Human adenovirus A
uuaagaucuucguaggaaa

SEQ ID NO: 3896558 - RNA, 22 nt, Human adenovirus A
uuaagcgacgaucuuggagugu

SEQ ID NO: 3896559 - RNA, 17 nt, Human adenovirus A
uuaagggcguacaguuu

SEQ ID NO: 3896560 - RNA, 20 nt, Human adenovirus A
uuaauccuaggcaaagaaac

SEQ ID NO: 3896561 - RNA, 23 nt, Human adenovirus A
uuaaugcaucuuugggacuuugu

SEQ ID NO: 3896562 - RNA, 23 nt, Human adenovirus A
uuaaugguguagcugcaguuugu

SEQ ID NO: 3896563 - RNA, 14 nt, Human adenovirus A
uuaauguuucaggu

SEQ ID NO: 3896564 - RNA, 15 nt, Human adenovirus A
uuacaacuugcuucc

SEQ ID NO: 3896565 - RNA, 21 nt, Human adenovirus A
uuacagaggaacguaacuuuc

SEQ ID NO: 3896566 - RNA, 21 nt, Human adenovirus A
uuaccagaaugaucacagcaa

SEQ ID NO: 3896567 - RNA, 21 nt, Human adenovirus A
uuacucgauuuaauuaacauu

SEQ ID NO: 3896568 - RNA, 12 nt, Human adenovirus A
uuacucugcuaa

SEQ ID NO: 3896569 - RNA, 16 nt, Human adenovirus A
uuacuugaacaacuuu

SEQ ID NO: 3896570 - RNA, 20 nt, Human adenovirus A
uuaguaacagcauaugaaca

SEQ ID NO: 3896571 - RNA, 23 nt, Human adenovirus A
uuaguccugcaguuauuggacac

SEQ ID NO: 3896572 - RNA, 15 nt, Human adenovirus A
uuaucuucaaaucau

SEQ ID NO: 3896573 - RNA, 11 nt, Human adenovirus A
uuaucuuggua

SEQ ID NO: 3896574 - RNA, 13 nt, Human adenovirus A
uuauguaugaaca

SEQ ID NO: 3896575 - RNA, 13 nt, Human adenovirus A
uuauuugaacaca

SEQ ID NO: 3896576 - RNA, 15 nt, Human adenovirus A
uucaaacuuuacaaa

SEQ ID NO: 3896577 - RNA, 19 nt, Human adenovirus A
uucaacaggcgggaaaagu

SEQ ID NO: 3896578 - RNA, 20 nt, Human adenovirus A
uucaccgcgcugcggccaug

SEQ ID NO: 3896579 - RNA, 14 nt, Human adenovirus A
uucagcaguugcaa

SEQ ID NO: 3896580 - RNA, 18 nt, Human adenovirus A
uucagccacucaaacauu

SEQ ID NO: 3896581 - RNA, 18 nt, Human adenovirus A
uuccaaccaaaggagaaa

SEQ ID NO: 3896582 - RNA, 17 nt, Human adenovirus A
uuccaauggucuucaag

SEQ ID NO: 3896583 - RNA, 16 nt, Human adenovirus A
uuccaccaaaugcucu

SEQ ID NO: 3896584 - RNA, 17 nt, Human adenovirus A
uucccaagauuuaauuu

SEQ ID NO: 3896585 - RNA, 23 nt, Human adenovirus A
uuccccgauaagauuguaauuuu

SEQ ID NO: 3896586 - RNA, 18 nt, Human adenovirus A
uuccggaguucccacaga

SEQ ID NO: 3896587 - RNA, 16 nt, Human adenovirus A
cgcugaaacagcaggg

SEQ ID NO: 3896588 - RNA, 20 nt, Human adenovirus A
cgcugacgggagcaggaaca

SEQ ID NO: 3896589 - RNA, 23 nt, Human adenovirus A
cgcugacgggagcaggaacagag

SEQ ID NO: 3896590 - RNA, 15 nt, Human adenovirus A
cgcugcagcuuccgc

SEQ ID NO: 3896591 - RNA, 15 nt, Human adenovirus A
cgcugcucagcucca

SEQ ID NO: 3896592 - RNA, 22 nt, Human adenovirus A
cgcuguugggacagcaagcagc

SEQ ID NO: 3896593 - RNA, 21 nt, Human adenovirus A
cgcuuucccgagaaccagaua

SEQ ID NO: 3896594 - RNA, 15 nt, Human adenovirus A
cgcuuuugccagacu

SEQ ID NO: 3896595 - RNA, 16 nt, Human adenovirus A
cggaacuauuucuugu

SEQ ID NO: 3896596 - RNA, 16 nt, Human adenovirus A
cggaaugauuaaacaa

SEQ ID NO: 3896597 - RNA, 14 nt, Human adenovirus A
cggacaguagcugc

SEQ ID NO: 3896598 - RNA, 14 nt, Human adenovirus A
cggcaaaaaacgaa

SEQ ID NO: 3896599 - RNA, 20 nt, Human adenovirus A
cggcacaacagacuggggaa

SEQ ID NO: 3896600 - RNA, 14 nt, Human adenovirus A
cggcaugcugaaac

SEQ ID NO: 3896601 - RNA, 14 nt, Human adenovirus A
cggcauuccccauc

SEQ ID NO: 3896602 - RNA, 13 nt, Human adenovirus A
cggccagccaagc

SEQ ID NO: 3896603 - RNA, 15 nt, Human adenovirus A
cggcgaacgggcagc

SEQ ID NO: 3896604 - RNA, 19 nt, Human adenovirus A
cggcguaguaugcgcagac

SEQ ID NO: 3896605 - RNA, 15 nt, Human adenovirus A
cgggcagccaggcgg

SEQ ID NO: 3896606 - RNA, 14 nt, Human adenovirus A
cgggccgcagcugc

SEQ ID NO: 3896607 - RNA, 19 nt, Human adenovirus A
cgggcuguaucuguugaau

SEQ ID NO: 3896608 - RNA, 21 nt, Human adenovirus A
cggggaauacuuuacaaaugc

SEQ ID NO: 3896609 - RNA, 16 nt, Human adenovirus A
cggggaggaagcugag

SEQ ID NO: 3896610 - RNA, 17 nt, Human adenovirus A
cggguccugcgggaagc

SEQ ID NO: 3896611 - RNA, 15 nt, Human adenovirus A
cgguggaacugcaga

SEQ ID NO: 3896612 - RNA, 20 nt, Human adenovirus A
cgguggaacugcagacagug

SEQ ID NO: 3896613 - RNA, 22 nt, Human adenovirus A
cgguggaacugcagacaguggc

SEQ ID NO: 3896614 - RNA, 17 nt, Human adenovirus A
cguacuuguaacugugg

SEQ ID NO: 3896615 - RNA, 17 nt, Human adenovirus A
cgucaaaaaagcaaagu

SEQ ID NO: 3896616 - RNA, 18 nt, Human adenovirus A
cgucuucguggagaagcg

SEQ ID NO: 3896617 - RNA, 18 nt, Human adenovirus A
cgugaauauuaaaaagcu

SEQ ID NO: 3896618 - RNA, 15 nt, Human adenovirus A
cgugauggcagcggc

SEQ ID NO: 3896619 - RNA, 16 nt, Human adenovirus A
cgugcaucaguguaaa

SEQ ID NO: 3896620 - RNA, 19 nt, Human adenovirus A
cgugucuucucccugugcu

SEQ ID NO: 3896621 - RNA, 14 nt, Human adenovirus A
cguuacagcuucag

SEQ ID NO: 3896622 - RNA, 13 nt, Human adenovirus A
cguuuggaaacug

SEQ ID NO: 3896623 - RNA, 15 nt, Human adenovirus A
cguuuggaaacugua

SEQ ID NO: 3896624 - RNA, 19 nt, Human adenovirus A
cguuuugugcccguggauc

SEQ ID NO: 3896625 - RNA, 10 nt, Human adenovirus A
cuaaaacaga

SEQ ID NO: 3896626 - RNA, 16 nt, Human adenovirus A
cuaaaccaagccaugc

SEQ ID NO: 3896627 - RNA, 17 nt, Human adenovirus A
cuaaaccaagccaugcu

SEQ ID NO: 3896628 - RNA, 22 nt, Human adenovirus A
cuaaaugcaucauuacuucaaa

SEQ ID NO: 3896629 - RNA, 22 nt, Human adenovirus A
cuaaccccaaaugaauuugaaa

SEQ ID NO: 3896630 - RNA, 19 nt, Human adenovirus A
cuaacgcuggggcacagcu

SEQ ID NO: 3896631 - RNA, 13 nt, Human adenovirus A
cuaacuaccuagc

SEQ ID NO: 3896632 - RNA, 23 nt, Human adenovirus A
cuaaggagguuuguaagcgguuu

SEQ ID NO: 3896633 - RNA, 16 nt, Human adenovirus A
cuaauacuuccauccg

SEQ ID NO: 3896634 - RNA, 21 nt, Human adenovirus A
cuacaucuuuuacuaaaaugc

SEQ ID NO: 3896635 - RNA, 23 nt, Human adenovirus A
cuaccaaggaaaacuuuuguauu

SEQ ID NO: 3896636 - RNA, 22 nt, Human adenovirus A
cuaccugacacuacagagcuca

SEQ ID NO: 3896637 - RNA, 17 nt, Human adenovirus A
cuacgcucguccaacca

SEQ ID NO: 3896638 - RNA, 16 nt, Human adenovirus A
cuacgguggcagccaa

SEQ ID NO: 3896639 - RNA, 17 nt, Human adenovirus A
cuacgguggcagccaag

SEQ ID NO: 3896640 - RNA, 16 nt, Human adenovirus A
cuacgugagaauuguu

SEQ ID NO: 3896641 - RNA, 22 nt, Human adenovirus A
cuagaggcgugccguuggcaga

SEQ ID NO: 3896642 - RNA, 23 nt, Human adenovirus A
cuagaugaagcgcagcagaaccc

SEQ ID NO: 3896643 - RNA, 18 nt, Human adenovirus A
cuagcccaauugcaugcu

SEQ ID NO: 3896644 - RNA, 13 nt, Human adenovirus A
cuaggggcuggcu

SEQ ID NO: 3896645 - RNA, 22 nt, Human adenovirus A
cuaguccguuuucuucuugagc

SEQ ID NO: 3896646 - RNA, 22 nt, Human adenovirus A
cuaugacccuugagcugccucc

SEQ ID NO: 3896647 - RNA, 17 nt, Human adenovirus A
cuaugaugcgggcagcc

SEQ ID NO: 3896648 - RNA, 21 nt, Human adenovirus A
cuauguaaguaggauagcacc

SEQ ID NO: 3896649 - RNA, 17 nt, Human adenovirus A
cuauucggaaaccauga

SEQ ID NO: 3896650 - RNA, 19 nt, Human adenovirus A
cucaaaagcgaagaucagu

SEQ ID NO: 3896651 - RNA, 20 nt, Human adenovirus A
cucaaagaaacagcagcaac

SEQ ID NO: 3896652 - RNA, 18 nt, Human adenovirus A
cucaacgugucaguuucu

SEQ ID NO: 3896653 - RNA, 19 nt, Human adenovirus A
cucacgacacgucacaucc

SEQ ID NO: 3896654 - RNA, 15 nt, Human adenovirus A
cucagaaagccaacc

SEQ ID NO: 3896655 - RNA, 14 nt, Human adenovirus A
cucaggacaugaug

SEQ ID NO: 3896656 - RNA, 18 nt, Human adenovirus A
cucauguauuuuuucaaa

SEQ ID NO: 3896657 - RNA, 18 nt, Human adenovirus A
cuccaauuuuuugauuac

SEQ ID NO: 3896658 - RNA, 12 nt, Human adenovirus A
cuccaucuguuu

SEQ ID NO: 3896659 - RNA, 14 nt, Human adenovirus A
cuccccacagcugg

SEQ ID NO: 3896660 - RNA, 19 nt, Human adenovirus A
cuccccacagcuggcgcac

SEQ ID NO: 3896661 - RNA, 14 nt, Human adenovirus A
cuccccuguggagc

SEQ ID NO: 3896662 - RNA, 18 nt, Human adenovirus A
cuccccuguggagccacu

SEQ ID NO: 3896663 - RNA, 14 nt, Human adenovirus A
cuccgacaacagcu

SEQ ID NO: 3896664 - RNA, 20 nt, Human adenovirus A
cuccuccgugaguuggccug

SEQ ID NO: 3896665 - RNA, 23 nt, Human adenovirus A
cuccugacccaccaccaaacugc

SEQ ID NO: 3896666 - RNA, 12 nt, Human adenovirus A
cuccuuaauuuc

SEQ ID NO: 3896667 - RNA, 20 nt, Human adenovirus A
cucgcauaaauucgcgggcu

SEQ ID NO: 3896668 - RNA, 19 nt, Human adenovirus A
cucgcgcuuuggaggcagc

SEQ ID NO: 3896669 - RNA, 18 nt, Human adenovirus A
cucguaaaaucuacaaaa

SEQ ID NO: 3896670 - RNA, 15 nt, Human adenovirus A
cucuaacaagcugcg

SEQ ID NO: 3896671 - RNA, 14 nt, Human adenovirus A
cucuaagcuuagau

SEQ ID NO: 3896672 - RNA, 18 nt, Human adenovirus A
cucuaaguucuguuucau

SEQ ID NO: 3896673 - RNA, 23 nt, Human adenovirus A
cucuacagccccuuugaagagcu

SEQ ID NO: 3896674 - RNA, 14 nt, Human adenovirus A
cucugaaacaugcu

SEQ ID NO: 3896675 - RNA, 21 nt, Human adenovirus A
cucugauuucgauaaacaaaa

SEQ ID NO: 3896676 - RNA, 18 nt, Human adenovirus A
cucuggcgaacaggaaga

SEQ ID NO: 3896677 - RNA, 22 nt, Human adenovirus A
cucuguucaauaaauacugcuc

SEQ ID NO: 3896678 - RNA, 13 nt, Human adenovirus A
cucuuaaugcagg

SEQ ID NO: 3896679 - RNA, 20 nt, Human adenovirus A
cucuucuaucaucaaacugc

SEQ ID NO: 3896680 - RNA, 14 nt, Human adenovirus A
cucuuggccagcug

SEQ ID NO: 3896681 - RNA, 10 nt, Human adenovirus A
cucuuuucuu

SEQ ID NO: 3896682 - RNA, 14 nt, Human adenovirus A
cucuuuucuuuacc

SEQ ID NO: 3896683 - RNA, 17 nt, Human adenovirus A
cugaaacaaauauuuac

SEQ ID NO: 3896684 - RNA, 12 nt, Human adenovirus A
cugaagaggagg

SEQ ID NO: 3896685 - RNA, 21 nt, Human adenovirus A
cugacagagcgcggcugcgac

SEQ ID NO: 3896686 - RNA, 15 nt, Human adenovirus A
cugacgauaacguuc

SEQ ID NO: 3896687 - RNA, 14 nt, Human adenovirus A
cugacgucacuggc

SEQ ID NO: 3896688 - RNA, 12 nt, Human adenovirus A
cugacugaacca

SEQ ID NO: 3896689 - RNA, 16 nt, Human adenovirus A
cugagacgaagaaaua

SEQ ID NO: 3896690 - RNA, 17 nt, Human adenovirus A
cugaggcggcuggugcu

SEQ ID NO: 3896691 - RNA, 20 nt, Human adenovirus A
cugauggugccuaagcggca

SEQ ID NO: 3896692 - RNA, 16 nt, Human adenovirus A
cugauuaugcauuuua

SEQ ID NO: 3896693 - RNA, 10 nt, Human adenovirus A
cugcagagca

SEQ ID NO: 3896694 - RNA, 13 nt, Human adenovirus A
cugcaguaaauuc

SEQ ID NO: 3896695 - RNA, 13 nt, Human adenovirus A
cugcauuggguga

SEQ ID NO: 3896696 - RNA, 21 nt, Human adenovirus A
cugccauugccgcacggccaa

SEQ ID NO: 3896697 - RNA, 15 nt, Human adenovirus A
cugcgugaggaggac

SEQ ID NO: 3896698 - RNA, 17 nt, Human adenovirus A
cugcuagaacaagccgc

SEQ ID NO: 3896699 - RNA, 19 nt, Human adenovirus A
cugcuagaacaagccgcuc

SEQ ID NO: 3896700 - RNA, 16 nt, Human adenovirus A
cugcuaugugcaaaua

SEQ ID NO: 3896701 - RNA, 16 nt, Human adenovirus A
cugcuuucagcacugc

SEQ ID NO: 3896702 - RNA, 22 nt, Human adenovirus A
cuggaaaacauaugcacaagag

SEQ ID NO: 3896703 - RNA, 18 nt, Human adenovirus A
cuggacagcggccaugga

SEQ ID NO: 3896704 - RNA, 19 nt, Human adenovirus A
cuggaccuuuaacggaaaa

SEQ ID NO: 3896705 - RNA, 18 nt, Human adenovirus A
cuggacugccgacaacac

SEQ ID NO: 3896706 - RNA, 19 nt, Human adenovirus A
accccuaacugcccagcug

SEQ ID NO: 3896707 - RNA, 18 nt, Human adenovirus A
acccuauuuuuugggaac

SEQ ID NO: 3896708 - RNA, 21 nt, Human adenovirus A
acccucccucuuggccagcug

SEQ ID NO: 3896709 - RNA, 15 nt, Human adenovirus A
acccuccguguuccc

SEQ ID NO: 3896710 - RNA, 15 nt, Human adenovirus A
acccucgccuuugga

SEQ ID NO: 3896711 - RNA, 12 nt, Human adenovirus A
acccuucccaac

SEQ ID NO: 3896712 - RNA, 21 nt, Human adenovirus A
acccuuccccaccuuucuggu

SEQ ID NO: 3896713 - RNA, 20 nt, Human adenovirus A
accgacgaagcgucagcucg

SEQ ID NO: 3896714 - RNA, 23 nt, Human adenovirus A
accgccaugcgcgcggccagagc

SEQ ID NO: 3896715 - RNA, 20 nt, Human adenovirus A
accguucuuugguuugcaau

SEQ ID NO: 3896716 - RNA, 17 nt, Human adenovirus A
accuaucccaugaccaa

SEQ ID NO: 3896717 - RNA, 19 nt, Human adenovirus A
accugggauacuaccgcug

SEQ ID NO: 3896718 - RNA, 18 nt, Human adenovirus A
accuucuggcuuguaugc

SEQ ID NO: 3896719 - RNA, 21 nt, Human adenovirus A
accuucuggcuuguaugcuca

SEQ ID NO: 3896720 - RNA, 18 nt, Human adenovirus A
accuuuaauacugaaaaa

SEQ ID NO: 3896721 - RNA, 19 nt, Human adenovirus A
accuuugugugcuacugcg

SEQ ID NO: 3896722 - RNA, 16 nt, Human adenovirus A
acgaacugaaaauaaa

SEQ ID NO: 3896723 - RNA, 18 nt, Human adenovirus A
acgaccgccuuuucuaga

SEQ ID NO: 3896724 - RNA, 19 nt, Human adenovirus A
acgaccgccuuuucuagaa

SEQ ID NO: 3896725 - RNA, 14 nt, Human adenovirus A
acgacuaaaacaaa

SEQ ID NO: 3896726 - RNA, 23 nt, Human adenovirus A
acgaggcggugagcauccaaaug

SEQ ID NO: 3896727 - RNA, 22 nt, Human adenovirus A
acgaggguuuuguccuuccagg

SEQ ID NO: 3896728 - RNA, 14 nt, Human adenovirus A
acgaguacaugaac

SEQ ID NO: 3896729 - RNA, 17 nt, Human adenovirus A
acgaugacgaagaccag

SEQ ID NO: 3896730 - RNA, 18 nt, Human adenovirus A
acgaugacgaagaccagu

SEQ ID NO: 3896731 - RNA, 20 nt, Human adenovirus A
acgcaacaacugagacuucc

SEQ ID NO: 3896732 - RNA, 20 nt, Human adenovirus A
acgcaagcgugcaaacagac

SEQ ID NO: 3896733 - RNA, 19 nt, Human adenovirus A
acgccuuacauguggagcu

SEQ ID NO: 3896734 - RNA, 18 nt, Human adenovirus A
acgcgaugaagcacgcag

SEQ ID NO: 3896735 - RNA, 22 nt, Human adenovirus A
acgcguccaccucacccuuaga

SEQ ID NO: 3896736 - RNA, 17 nt, Human adenovirus A
acgcucaaagaaacagc

SEQ ID NO: 3896737 - RNA, 21 nt, Human adenovirus A
acgcucaaagaaacagcagca

SEQ ID NO: 3896738 - RNA, 14 nt, Human adenovirus A
acgcugcccacuca

SEQ ID NO: 3896739 - RNA, 22 nt, Human adenovirus A
acggagacccagaaaaaggagu

SEQ ID NO: 3896740 - RNA, 12 nt, Human adenovirus A
acggaugaaagc

SEQ ID NO: 3896741 - RNA, 17 nt, Human adenovirus A
acggugucagaauaaca

SEQ ID NO: 3896742 - RNA, 20 nt, Human adenovirus A
acguacuagagcacaugaag

SEQ ID NO: 3896743 - RNA, 20 nt, Human adenovirus A
acgucaccaccucaaaaucu

SEQ ID NO: 3896744 - RNA, 22 nt, Human adenovirus A
acguccaggcaggguuugcaaa

SEQ ID NO: 3896745 - RNA, 21 nt, Human adenovirus A
acguuuacaaagcacugggca

SEQ ID NO: 3896746 - RNA, 22 nt, Human adenovirus A
acuaaugguuacugaagugccu

SEQ ID NO: 3896747 - RNA, 17 nt, Human adenovirus A
acuacagacaaacaagu

SEQ ID NO: 3896748 - RNA, 23 nt, Human adenovirus A
acuacccggcgauugauaucuug

SEQ ID NO: 3896749 - RNA, 13 nt, Human adenovirus A
acuacuaccacug

SEQ ID NO: 3896750 - RNA, 22 nt, Human adenovirus A
acuagccccugucaacagcauu

SEQ ID NO: 3896751 - RNA, 14 nt, Human adenovirus A
acuauagagaggaa

SEQ ID NO: 3896752 - RNA, 16 nt, Human adenovirus A
acuauugacuuaauga

SEQ ID NO: 3896753 - RNA, 15 nt, Human adenovirus A
acucacgagaaagug

SEQ ID NO: 3896754 - RNA, 15 nt, Human adenovirus A
acucauaccccaaga

SEQ ID NO: 3896755 - RNA, 14 nt, Human adenovirus A
acucaucagaggga

SEQ ID NO: 3896756 - RNA, 19 nt, Human adenovirus A
acuccauguggagguauaa

SEQ ID NO: 3896757 - RNA, 15 nt, Human adenovirus A
acuccgggaguguac

SEQ ID NO: 3896758 - RNA, 20 nt, Human adenovirus A
acucuccaauuuguggagga

SEQ ID NO: 3896759 - RNA, 13 nt, Human adenovirus A
acugaaaauggaa

SEQ ID NO: 3896760 - RNA, 23 nt, Human adenovirus A
acugaaacucccuuaguuguaaa

SEQ ID NO: 3896761 - RNA, 13 nt, Human adenovirus A
acugaucggccgu

SEQ ID NO: 3896762 - RNA, 15 nt, Human adenovirus A
acugauuuucaucug

SEQ ID NO: 3896763 - RNA, 13 nt, Human adenovirus A
acugcagccuguc

SEQ ID NO: 3896764 - RNA, 14 nt, Human adenovirus A
acugcauuggguga

SEQ ID NO: 3896765 - RNA, 15 nt, Human adenovirus A
acugcucagcuggaa

SEQ ID NO: 3896766 - RNA, 15 nt, Human adenovirus A
acugcuuugcucgag

SEQ ID NO: 3896767 - RNA, 17 nt, Human adenovirus A
acuggacagcggccaug

SEQ ID NO: 3896768 - RNA, 23 nt, Human adenovirus A
acuggccugaccauccaauggau

SEQ ID NO: 3896769 - RNA, 15 nt, Human adenovirus A
acugguuagagccau

SEQ ID NO: 3896770 - RNA, 18 nt, Human adenovirus A
acuguaagaggagacaac

SEQ ID NO: 3896771 - RNA, 19 nt, Human adenovirus A
acuguaugcgcgccuuaau

SEQ ID NO: 3896772 - RNA, 14 nt, Human adenovirus A
acuuaaaaaaggac

SEQ ID NO: 3896773 - RNA, 13 nt, Human adenovirus A
acuuaaaagcaag

SEQ ID NO: 3896774 - RNA, 16 nt, Human adenovirus A
acuuaccaaagccaug

SEQ ID NO: 3896775 - RNA, 22 nt, Human adenovirus A
acuuauuacugguacuaugacu

SEQ ID NO: 3896776 - RNA, 13 nt, Human adenovirus A
acuuauugcugcg

SEQ ID NO: 3896777 - RNA, 17 nt, Human adenovirus A
acuucacccugggaaac

SEQ ID NO: 3896778 - RNA, 20 nt, Human adenovirus A
acuucacccugggaaacaag

SEQ ID NO: 3896779 - RNA, 14 nt, Human adenovirus A
acuucauauuugcu

SEQ ID NO: 3896780 - RNA, 17 nt, Human adenovirus A
acuucccaaauuuucca

SEQ ID NO: 3896781 - RNA, 21 nt, Human adenovirus A
acuuggcuucgaaugcuguga

SEQ ID NO: 3896782 - RNA, 13 nt, Human adenovirus A
acuuuagccccag

SEQ ID NO: 3896783 - RNA, 19 nt, Human adenovirus A
acuuuauauugcauuuguc

SEQ ID NO: 3896784 - RNA, 23 nt, Human adenovirus A
agaaaaacaguacaaagccaggc

SEQ ID NO: 3896785 - RNA, 12 nt, Human adenovirus A
agaaacaaacua

SEQ ID NO: 3896786 - RNA, 19 nt, Human adenovirus A
agaaaggauguaaacauga

SEQ ID NO: 3896787 - RNA, 14 nt, Human adenovirus A
agaaaucuugaagu

SEQ ID NO: 3896788 - RNA, 14 nt, Human adenovirus A
agaacauacaacuu

SEQ ID NO: 3896789 - RNA, 20 nt, Human adenovirus A
agaacccaguaugcugaaga

SEQ ID NO: 3896790 - RNA, 14 nt, Human adenovirus A
agaagacaaagagu

SEQ ID NO: 3896791 - RNA, 14 nt, Human adenovirus A
agaagccagcagca

SEQ ID NO: 3896792 - RNA, 19 nt, Human adenovirus A
agaagcuuauguacauaau

SEQ ID NO: 3896793 - RNA, 19 nt, Human adenovirus A
agaaugggaggaaagacag

SEQ ID NO: 3896794 - RNA, 19 nt, Human adenovirus A
agacaccgcccaggcaggc

SEQ ID NO: 3896795 - RNA, 14 nt, Human adenovirus A
agaccaaaugccag

SEQ ID NO: 3896796 - RNA, 18 nt, Human adenovirus A
agaccacugucgccaacc

SEQ ID NO: 3896797 - RNA, 14 nt, Human adenovirus A
agacguaggguaca

SEQ ID NO: 3896798 - RNA, 18 nt, Human adenovirus A
agacguaggguacagugg

SEQ ID NO: 3896799 - RNA, 21 nt, Human adenovirus A
agacugagaaccgucugcaug

SEQ ID NO: 3896800 - RNA, 23 nt, Human adenovirus A
agacuuaccccugggcuuuggac

SEQ ID NO: 3896801 - RNA, 15 nt, Human adenovirus A
agagaacaaacagug

SEQ ID NO: 3896802 - RNA, 14 nt, Human adenovirus A
agagagugcccccc

SEQ ID NO: 3896803 - RNA, 15 nt, Human adenovirus A
agagcaaagguaucu

SEQ ID NO: 3896804 - RNA, 17 nt, Human adenovirus A
agagcguucugggaugc

SEQ ID NO: 3896805 - RNA, 19 nt, Human adenovirus A
agagcuaagcgacaaagag

SEQ ID NO: 3896806 - RNA, 13 nt, Human adenovirus A
agaggaagaaaga

SEQ ID NO: 3896807 - RNA, 22 nt, Human adenovirus A
agaggaagaagucgccgcggcg

SEQ ID NO: 3896808 - RNA, 10 nt, Human adenovirus A
agaggcuggc

SEQ ID NO: 3896809 - RNA, 19 nt, Human adenovirus A
agagggcgaacaguguuuu

SEQ ID NO: 3896810 - RNA, 16 nt, Human adenovirus A
agaucuucguaggaaa

SEQ ID NO: 3896811 - RNA, 13 nt, Human adenovirus A
agaugaggcuggu

SEQ ID NO: 3896812 - RNA, 23 nt, Human adenovirus A
agaugcauccuguccugcgacaa

SEQ ID NO: 3896813 - RNA, 15 nt, Human adenovirus A
agauguaaaggaggc

SEQ ID NO: 3896814 - RNA, 17 nt, Human adenovirus A
agauguaaaggaggcgc

SEQ ID NO: 3896815 - RNA, 22 nt, Human adenovirus A
agauuguaauuuuuuucuccuu

SEQ ID NO: 3896816 - RNA, 15 nt, Human adenovirus A
agauuuaauuucaga

SEQ ID NO: 3896817 - RNA, 17 nt, Human adenovirus A
agauuuguuccuuuuca

SEQ ID NO: 3896818 - RNA, 16 nt, Human adenovirus A
agcaaaacgcugggcu

SEQ ID NO: 3896819 - RNA, 23 nt, Human adenovirus A
agcaaagccauccgcaaagauga

SEQ ID NO: 3896820 - RNA, 17 nt, Human adenovirus A
agcaaccaaaugagcaa

SEQ ID NO: 3896821 - RNA, 22 nt, Human adenovirus A
agcaacuuuuuaaccacuguag

SEQ ID NO: 3896822 - RNA, 20 nt, Human adenovirus A
agcaagcagcgccaaauaga

SEQ ID NO: 3896823 - RNA, 11 nt, Human adenovirus A
agcaaguaaac

SEQ ID NO: 3896824 - RNA, 20 nt, Human adenovirus A
aaauacacauaaagagucuc

SEQ ID NO: 3896825 - RNA, 18 nt, Human adenovirus A
aaauacugcucccucucg

SEQ ID NO: 3896826 - RNA, 19 nt, Human adenovirus A
aaauaguuccguaaagacu

SEQ ID NO: 3896827 - RNA, 14 nt, Human adenovirus A
aaauauccaaagua

SEQ ID NO: 3896828 - RNA, 12 nt, Human adenovirus A
aaauaugcugua

SEQ ID NO: 3896829 - RNA, 16 nt, Human adenovirus A
aaaucagaagccagca

SEQ ID NO: 3896830 - RNA, 23 nt, Human adenovirus A
aaaucucgucggcggacagagca

SEQ ID NO: 3896831 - RNA, 14 nt, Human adenovirus A
aaaugaccccaucu

SEQ ID NO: 3896832 - RNA, 18 nt, Human adenovirus A
aaaugcauuaucaugaaa

SEQ ID NO: 3896833 - RNA, 19 nt, Human adenovirus A
aaaugcccugcaaaaagaa

SEQ ID NO: 3896834 - RNA, 14 nt, Human adenovirus A
aaauggaacccuua

SEQ ID NO: 3896835 - RNA, 17 nt, Human adenovirus A
aaauguguacuugcuuu

SEQ ID NO: 3896836 - RNA, 18 nt, Human adenovirus A
aaauguucaacaacagcu

SEQ ID NO: 3896837 - RNA, 14 nt, Human adenovirus A
aaauuacaaaggca

SEQ ID NO: 3896838 - RNA, 12 nt, Human adenovirus A
aacaaaacacug

SEQ ID NO: 3896839 - RNA, 21 nt, Human adenovirus A
aacaaacuguuagacagagca

SEQ ID NO: 3896840 - RNA, 14 nt, Human adenovirus A
aacaacaagcuaau

SEQ ID NO: 3896841 - RNA, 22 nt, Human adenovirus A
aacaacagcuucuaaaagagcc

SEQ ID NO: 3896842 - RNA, 18 nt, Human adenovirus A
aacaacaggugcaagaag

SEQ ID NO: 3896843 - RNA, 21 nt, Human adenovirus A
aacacguuaccaauacagaua

SEQ ID NO: 3896844 - RNA, 20 nt, Human adenovirus A
aacaguuugcgugccuggcu

SEQ ID NO: 3896845 - RNA, 12 nt, Human adenovirus A
aacauaagauca

SEQ ID NO: 3896846 - RNA, 21 nt, Human adenovirus A
aacauccuuuuucuacaggca

SEQ ID NO: 3896847 - RNA, 21 nt, Human adenovirus A
aacaucuacagcgacaaagca

SEQ ID NO: 3896848 - RNA, 23 nt, Human adenovirus A
aacaugcuuuagguuagccugaa

SEQ ID NO: 3896849 - RNA, 13 nt, Human adenovirus A
aacauuaaaagac

SEQ ID NO: 3896850 - RNA, 14 nt, Human adenovirus A
aacauuaaaagacg

SEQ ID NO: 3896851 - RNA, 23 nt, Human adenovirus A
aaccaaaggagaaaagcggccac

SEQ ID NO: 3896852 - RNA, 21 nt, Human adenovirus A
aaccacuugcgccaaguugag

SEQ ID NO: 3896853 - RNA, 17 nt, Human adenovirus A
aaccaugaaaacagcau

SEQ ID NO: 3896854 - RNA, 20 nt, Human adenovirus A
aaccauucccuauuuagacg

SEQ ID NO: 3896855 - RNA, 16 nt, Human adenovirus A
aacccacgauccagua

SEQ ID NO: 3896856 - RNA, 18 nt, Human adenovirus A
aaccccaaaugggacugg

SEQ ID NO: 3896857 - RNA, 18 nt, Human adenovirus A
aacccuuuagcaguugcu

SEQ ID NO: 3896858 - RNA, 13 nt, Human adenovirus A
aaccuuugacaaa

SEQ ID NO: 3896859 - RNA, 16 nt, Human adenovirus A
aacgcaaguucaaaga

SEQ ID NO: 3896860 - RNA, 16 nt, Human adenovirus A
aacgcaccuugcagga

SEQ ID NO: 3896861 - RNA, 15 nt, Human adenovirus A
aacgcugaugccacu

SEQ ID NO: 3896862 - RNA, 20 nt, Human adenovirus A
aacggaucuugggcaaaaua

SEQ ID NO: 3896863 - RNA, 17 nt, Human adenovirus A
aacggcgcgcaguccug

SEQ ID NO: 3896864 - RNA, 15 nt, Human adenovirus A
aacgggcagccuguc

SEQ ID NO: 3896865 - RNA, 14 nt, Human adenovirus A
aacgucgccugagu

SEQ ID NO: 3896866 - RNA, 23 nt, Human adenovirus A
aacuaguuuacccgccaguguua

SEQ ID NO: 3896867 - RNA, 23 nt, Human adenovirus A
aacugauggugccuaagcggcaa

SEQ ID NO: 3896868 - RNA, 15 nt, Human adenovirus A
aacugcagacagugg

SEQ ID NO: 3896869 - RNA, 22 nt, Human adenovirus A
aacugcuccccucaacagcaca

SEQ ID NO: 3896870 - RNA, 19 nt, Human adenovirus A
aacuguuagacagagcacu

SEQ ID NO: 3896871 - RNA, 15 nt, Human adenovirus A
aacuuaacaacugau

SEQ ID NO: 3896872 - RNA, 14 nt, Human adenovirus A
aacuuaacccuccc

SEQ ID NO: 3896873 - RNA, 21 nt, Human adenovirus A
aacuucgccaauaaaaacaac

SEQ ID NO: 3896874 - RNA, 13 nt, Human adenovirus A
aacuuuuaacauu

SEQ ID NO: 3896875 - RNA, 13 nt, Human adenovirus A
aagaaaaugaaca

SEQ ID NO: 3896876 - RNA, 14 nt, Human adenovirus A
aagaaacagcagca

SEQ ID NO: 3896877 - RNA, 15 nt, Human adenovirus A
aagaaauaaccagug

SEQ ID NO: 3896878 - RNA, 14 nt, Human adenovirus A
aagaaucgcaagca

SEQ ID NO: 3896879 - RNA, 23 nt, Human adenovirus A
aagaaucuugggagagucaggca

SEQ ID NO: 3896880 - RNA, 19 nt, Human adenovirus A
aagacacauugacuguuuc

SEQ ID NO: 3896881 - RNA, 13 nt, Human adenovirus A
aagacagcaugga

SEQ ID NO: 3896882 - RNA, 15 nt, Human adenovirus A
aagacugagaaccgu

SEQ ID NO: 3896883 - RNA, 14 nt, Human adenovirus A
aagagccacagcuc

SEQ ID NO: 3896884 - RNA, 14 nt, Human adenovirus A
aagagcugcugcag

SEQ ID NO: 3896885 - RNA, 18 nt, Human adenovirus A
aagaucaaggaaauacua

SEQ ID NO: 3896886 - RNA, 17 nt, Human adenovirus A
aagaugcaaacuugcaa

SEQ ID NO: 3896887 - RNA, 20 nt, Human adenovirus A
aagauguaugaguaagagca

SEQ ID NO: 3896888 - RNA, 13 nt, Human adenovirus A
aagcaaaguacaa

SEQ ID NO: 3896889 - RNA, 15 nt, Human adenovirus A
aagcaaguacaaagg

SEQ ID NO: 3896890 - RNA, 14 nt, Human adenovirus A
aagcacugccuguu

SEQ ID NO: 3896891 - RNA, 14 nt, Human adenovirus A
aagcagcgccaaau

SEQ ID NO: 3896892 - RNA, 11 nt, Human adenovirus A
aagcaggaaaa

SEQ ID NO: 3896893 - RNA, 14 nt, Human adenovirus A
aagcaggagaacaa

SEQ ID NO: 3896894 - RNA, 16 nt, Human adenovirus A
aagcauauaaaacuga

SEQ ID NO: 3896895 - RNA, 21 nt, Human adenovirus A
aagccauggcgaccaguguuc

SEQ ID NO: 3896896 - RNA, 19 nt, Human adenovirus A
aagcgaccucugaaacaug

SEQ ID NO: 3896897 - RNA, 21 nt, Human adenovirus A
aagcggcacaacagacugggg

SEQ ID NO: 3896898 - RNA, 21 nt, Human adenovirus A
aagcugaaacuaggggcuggc

SEQ ID NO: 3896899 - RNA, 20 nt, Human adenovirus A
aagcuuucauugguccaggc

SEQ ID NO: 3896900 - RNA, 15 nt, Human adenovirus A
aaggaggaagaacau

SEQ ID NO: 3896901 - RNA, 13 nt, Human adenovirus A
aaggcaggcauua

SEQ ID NO: 3896902 - RNA, 23 nt, Human adenovirus A
aaggcauggaaaaacuuggaaac

SEQ ID NO: 3896903 - RNA, 17 nt, Human adenovirus A
aaggcugcuaggauuga

SEQ ID NO: 3896904 - RNA, 20 nt, Human adenovirus A
aaggggaggaccccaaggca

SEQ ID NO: 3896905 - RNA, 17 nt, Human adenovirus A
aagggugguugcaaagu

SEQ ID NO: 3896906 - RNA, 13 nt, Human adenovirus A
aagguagcuccag

SEQ ID NO: 3896907 - RNA, 15 nt, Human adenovirus A
aagguauucagcuga

SEQ ID NO: 3896908 - RNA, 13 nt, Human adenovirus A
aaggugguggcaa

SEQ ID NO: 3896909 - RNA, 15 nt, Human adenovirus A
aagguguugagcccg

SEQ ID NO: 3896910 - RNA, 15 nt, Human adenovirus A
aagguuuaauguuua

SEQ ID NO: 3896911 - RNA, 15 nt, Human adenovirus A
aaguaccaggaagcu

SEQ ID NO: 3896912 - RNA, 19 nt, Human adenovirus A
aaguaucugcccauuuuug

SEQ ID NO: 3896913 - RNA, 15 nt, Human adenovirus A
aagucauccaaagau

SEQ ID NO: 3896914 - RNA, 22 nt, Human adenovirus A
aagucgcaauuagggccagcau

SEQ ID NO: 3896915 - RNA, 13 nt, Human adenovirus A
aagugacauugga

SEQ ID NO: 3896916 - RNA, 14 nt, Human adenovirus A
aagugccuccucag

SEQ ID NO: 3896917 - RNA, 13 nt, Human adenovirus A
aaguguaauuuuc

SEQ ID NO: 3896918 - RNA, 20 nt, Human adenovirus A
aaguguuuguuugaaaaaug

SEQ ID NO: 3896919 - RNA, 21 nt, Human adenovirus A
aaguucaccggugaagaugau

SEQ ID NO: 3896920 - RNA, 14 nt, Human adenovirus A
aaguucuguuucau

SEQ ID NO: 3896921 - RNA, 12 nt, Human adenovirus A
aaguuuaaaggc

SEQ ID NO: 3896922 - RNA, 15 nt, Human adenovirus A
aauaaaauaaaacuu

SEQ ID NO: 3896923 - RNA, 21 nt, Human adenovirus A
aauaaacgguuccuuagccuu

SEQ ID NO: 3896924 - RNA, 13 nt, Human adenovirus A
aauaaauacugcu

SEQ ID NO: 3896925 - RNA, 12 nt, Human adenovirus A
aauaacacauaa

SEQ ID NO: 3896926 - RNA, 18 nt, Human adenovirus A
aauagcacuuuggauggc

SEQ ID NO: 3896927 - RNA, 21 nt, Human adenovirus A
aauauuguagccugcuuucag

SEQ ID NO: 3896928 - RNA, 16 nt, Human adenovirus A
aauauuguauuuccag

SEQ ID NO: 3896929 - RNA, 21 nt, Human adenovirus A
aauauuuagacuauaaucccu

SEQ ID NO: 3896930 - RNA, 13 nt, Human adenovirus A
aauccacaaagca

SEQ ID NO: 3896931 - RNA, 12 nt, Human adenovirus A
aaucuuaaaugg

SEQ ID NO: 3896932 - RNA, 20 nt, Human adenovirus A
aaugaaaguugguaagcgac

SEQ ID NO: 3896933 - RNA, 13 nt, Human adenovirus A
aaugcaaaaugga

SEQ ID NO: 3896934 - RNA, 17 nt, Human adenovirus A
aaugcauuaccagcagc

SEQ ID NO: 3896935 - RNA, 16 nt, Human adenovirus A
aaugcccccauccagg

SEQ ID NO: 3896936 - RNA, 17 nt, Human adenovirus A
aaugcucuggacaugga

SEQ ID NO: 3896937 - RNA, 22 nt, Human adenovirus A
aaugcuuagucauuacaacauu

SEQ ID NO: 3896938 - RNA, 22 nt, Human adenovirus A
aaugcuuuccauuuuucuuuua

SEQ ID NO: 3896939 - RNA, 15 nt, Human adenovirus A
aauguguuccaguau

SEQ ID NO: 3896940 - RNA, 21 nt, Human adenovirus A
aauguuuucuggaucagaaac

SEQ ID NO: 3896941 - RNA, 12 nt, Human adenovirus A
aauuaacugcac

SEQ ID NO: 3896942 - RNA, 17 nt, Human adenovirus A
aauuacuaaaacaguaa

SEQ ID NO: 3896943 - RNA, 18 nt, Human adenovirus A
aauuacuugaacaacuuu

SEQ ID NO: 3896944 - RNA, 14 nt, Human adenovirus A
aauuccgcagugga

SEQ ID NO: 3896945 - RNA, 20 nt, Human adenovirus A
aauucgcaggcggucugcca

SEQ ID NO: 3896946 - RNA, 13 nt, Human adenovirus A
aauucuuaaacaa

SEQ ID NO: 3896947 - RNA, 17 nt, Human adenovirus A
aauugaaguaagcuguu

SEQ ID NO: 3896948 - RNA, 18 nt, Human adenovirus A
aauugaugagguaguggc

SEQ ID NO: 3896949 - RNA, 22 nt, Human adenovirus A
aauuugucugaaaauugcauga

SEQ ID NO: 3896950 - RNA, 19 nt, Human adenovirus A
aauuuuaaaggguccaggg

SEQ ID NO: 3896951 - RNA, 21 nt, Human adenovirus A
ugccccccuccccuguggagc

SEQ ID NO: 3896952 - RNA, 13 nt, Human adenovirus A
ugcccucacacuu

SEQ ID NO: 3896953 - RNA, 21 nt, Human adenovirus A
ugcccugauauaucaggaaaa

SEQ ID NO: 3896954 - RNA, 13 nt, Human adenovirus A
ugccgacaacacu

SEQ ID NO: 3896955 - RNA, 18 nt, Human adenovirus A
ugccgcacggccaaugcc

SEQ ID NO: 3896956 - RNA, 15 nt, Human adenovirus A
ugccuuaggcagcag

SEQ ID NO: 3896957 - RNA, 21 nt, Human adenovirus A
ugcgaccgggcaccacagugg

SEQ ID NO: 3896958 - RNA, 18 nt, Human adenovirus A
ugcgaguaggaagacagc

SEQ ID NO: 3896959 - RNA, 22 nt, Human adenovirus A
ugcgaguaggaagacagcaugg

SEQ ID NO: 3896960 - RNA, 13 nt, Human adenovirus A
ugcgcauggcuuu

SEQ ID NO: 3896961 - RNA, 14 nt, Human adenovirus A
ugcgcgcggccaga

SEQ ID NO: 3896962 - RNA, 16 nt, Human adenovirus A
ugcgcuuuaaacugag

SEQ ID NO: 3896963 - RNA, 17 nt, Human adenovirus A
ugcguuucuuaccuugc

SEQ ID NO: 3896964 - RNA, 15 nt, Human adenovirus A
ugcucagcuggaaga

SEQ ID NO: 3896965 - RNA, 18 nt, Human adenovirus A
ugcuccccucaacagcac

SEQ ID NO: 3896966 - RNA, 18 nt, Human adenovirus A
ugcuccgacaacagcugc

SEQ ID NO: 3896967 - RNA, 22 nt, Human adenovirus A
ugcucguaaaaucuacaaaagu

SEQ ID NO: 3896968 - RNA, 17 nt, Human adenovirus A
ugcuggaaccugaagug

SEQ ID NO: 3896969 - RNA, 22 nt, Human adenovirus A
ugcuguacgcaaacucagccca

SEQ ID NO: 3896970 - RNA, 14 nt, Human adenovirus A
ugcuguucuuagua

SEQ ID NO: 3896971 - RNA, 16 nt, Human adenovirus A
ugcuuagucauuacaa

SEQ ID NO: 3896972 - RNA, 19 nt, Human adenovirus A
ugcuuagucauuacaacau

SEQ ID NO: 3896973 - RNA, 16 nt, Human adenovirus A
ugcuuuucgccagcag

SEQ ID NO: 3896974 - RNA, 20 nt, Human adenovirus A
uggaaaaagaucaaggaaau

SEQ ID NO: 3896975 - RNA, 16 nt, Human adenovirus A
uggaaaacauaugcac

SEQ ID NO: 3896976 - RNA, 13 nt, Human adenovirus A
uggaacaccagca

SEQ ID NO: 3896977 - RNA, 16 nt, Human adenovirus A
uggacguuaguaacaa

SEQ ID NO: 3896978 - RNA, 19 nt, Human adenovirus A
uggagccaaaaaaacagau

SEQ ID NO: 3896979 - RNA, 20 nt, Human adenovirus A
uggagcgagaucuuccaaca

SEQ ID NO: 3896980 - RNA, 16 nt, Human adenovirus A
uggagcuuucaacccc

SEQ ID NO: 3896981 - RNA, 11 nt, Human adenovirus A
uggaggcagcu

SEQ ID NO: 3896982 - RNA, 23 nt, Human adenovirus A
uggaguggcgauuccaaggaaug

SEQ ID NO: 3896983 - RNA, 19 nt, Human adenovirus A
uggagugugcuauuaaagc

SEQ ID NO: 3896984 - RNA, 14 nt, Human adenovirus A
uggauagcaaagcc

SEQ ID NO: 3896985 - RNA, 19 nt, Human adenovirus A
uggaucguauuauggcuuu

SEQ ID NO: 3896986 - RNA, 22 nt, Human adenovirus A
uggaucuggagccacaggaaag

SEQ ID NO: 3896987 - RNA, 21 nt, Human adenovirus A
uggauuacaugucaaugcagc

SEQ ID NO: 3896988 - RNA, 18 nt, Human adenovirus A
uggauuugauucaagagg

SEQ ID NO: 3896989 - RNA, 12 nt, Human adenovirus A
uggcacaacaca

SEQ ID NO: 3896990 - RNA, 17 nt, Human adenovirus A
uggcacauaacacagcu

SEQ ID NO: 3896991 - RNA, 20 nt, Human adenovirus A
uggcagcaaugcuuggaaga

SEQ ID NO: 3896992 - RNA, 22 nt, Human adenovirus A
uggcagcaaugcuuggaagaaa

SEQ ID NO: 3896993 - RNA, 17 nt, Human adenovirus A
uggcagcggcgccaccc

SEQ ID NO: 3896994 - RNA, 17 nt, Human adenovirus A
uggcagcugauuucagc

SEQ ID NO: 3896995 - RNA, 22 nt, Human adenovirus A
uggcaggaguugcaggaugaau

SEQ ID NO: 3896996 - RNA, 15 nt, Human adenovirus A
uggccagugugcgcu

SEQ ID NO: 3896997 - RNA, 22 nt, Human adenovirus A
uggccauaauguaacccuuccc

SEQ ID NO: 3896998 - RNA, 23 nt, Human adenovirus A
uggccauaauguaacccuucccc

SEQ ID NO: 3896999 - RNA, 23 nt, Human adenovirus A
uggcucaacgagagcgcuuucau

SEQ ID NO: 3897000 - RNA, 13 nt, Human adenovirus A
uggcugaagagga

SEQ ID NO: 3897001 - RNA, 15 nt, Human adenovirus A
uggcuuuaggccauc

SEQ ID NO: 3897002 - RNA, 17 nt, Human adenovirus A
ugggaagggcaaaagua

SEQ ID NO: 3897003 - RNA, 21 nt, Human adenovirus A
ugggaauauagccgccaugga

SEQ ID NO: 3897004 - RNA, 19 nt, Human adenovirus A
ugggacaaguugcuuucca

SEQ ID NO: 3897005 - RNA, 17 nt, Human adenovirus A
ugggaguucaaacagug

SEQ ID NO: 3897006 - RNA, 20 nt, Human adenovirus A
ugggauacuaccgcugcuca

SEQ ID NO: 3897007 - RNA, 17 nt, Human adenovirus A
ugggccuucggaagaaa

SEQ ID NO: 3897008 - RNA, 16 nt, Human adenovirus A
ugggcggcauuuagag

SEQ ID NO: 3897009 - RNA, 22 nt, Human adenovirus A
uggggugcugcccuuccuaauu

SEQ ID NO: 3897010 - RNA, 22 nt, Human adenovirus A
uggguccuacggagggaagaaa

SEQ ID NO: 3897011 - RNA, 15 nt, Human adenovirus A
uggguuuggauggaa

SEQ ID NO: 3897012 - RNA, 20 nt, Human adenovirus A
ugguaacauguccauuuugg

SEQ ID NO: 3897013 - RNA, 12 nt, Human adenovirus A
ugguccaggcua

SEQ ID NO: 3897014 - RNA, 22 nt, Human adenovirus A
uggucuucaucgcuuucuucug

SEQ ID NO: 3897015 - RNA, 15 nt, Human adenovirus A
ugguggguuuggaug

SEQ ID NO: 3897016 - RNA, 19 nt, Human adenovirus A
ugguuacugaagugccuca

SEQ ID NO: 3897017 - RNA, 17 nt, Human adenovirus A
ugguugggaacagacaa

SEQ ID NO: 3897018 - RNA, 15 nt, Human adenovirus A
ugguuuaauauacaa

SEQ ID NO: 3897019 - RNA, 17 nt, Human adenovirus A
uguaaagauuugaaauu

SEQ ID NO: 3897020 - RNA, 23 nt, Human adenovirus A
uguaaccagagcaccccuuccca

SEQ ID NO: 3897021 - RNA, 17 nt, Human adenovirus A
uguaaccagcugggcag

SEQ ID NO: 3897022 - RNA, 14 nt, Human adenovirus A
uguaacccuucccc

SEQ ID NO: 3897023 - RNA, 13 nt, Human adenovirus A
uguaaguaggaua

SEQ ID NO: 3897024 - RNA, 13 nt, Human adenovirus A
uguaauaaagcua

SEQ ID NO: 3897025 - RNA, 18 nt, Human adenovirus A
uguacuugacucuggcga

SEQ ID NO: 3897026 - RNA, 18 nt, Human adenovirus A
uguagaagcuuauguaca

SEQ ID NO: 3897027 - RNA, 17 nt, Human adenovirus A
uguagagucuuggaaua

SEQ ID NO: 3897028 - RNA, 20 nt, Human adenovirus A
uguagcugaaaacaacugca

SEQ ID NO: 3897029 - RNA, 13 nt, Human adenovirus A
uguauaaaaucau

SEQ ID NO: 3897030 - RNA, 19 nt, Human adenovirus A
uguauauuaagguacauug

SEQ ID NO: 3897031 - RNA, 14 nt, Human adenovirus A
uguaucagcagcca

SEQ ID NO: 3897032 - RNA, 14 nt, Human adenovirus A
uguaucuguugaau

SEQ ID NO: 3897033 - RNA, 14 nt, Human adenovirus A
uguaugaacacuua

SEQ ID NO: 3897034 - RNA, 15 nt, Human adenovirus A
uguauguucuuacac

SEQ ID NO: 3897035 - RNA, 13 nt, Human adenovirus A
uguauuagcacuu

SEQ ID NO: 3897036 - RNA, 21 nt, Human adenovirus A
uguauuggccgggcaagcuuc

SEQ ID NO: 3897037 - RNA, 22 nt, Human adenovirus A
uguccacuugcggaacaauaaa

SEQ ID NO: 3897038 - RNA, 14 nt, Human adenovirus A
uguccagauuucag

SEQ ID NO: 3897039 - RNA, 11 nt, Human adenovirus A
uguccuuccag

SEQ ID NO: 3897040 - RNA, 21 nt, Human adenovirus A
uguccuuggaagaggugccua

SEQ ID NO: 3897041 - RNA, 21 nt, Human adenovirus A
ugucuguugccaauccucuga

SEQ ID NO: 3897042 - RNA, 22 nt, Human adenovirus A
ugugagggccgaugcauacaug

SEQ ID NO: 3897043 - RNA, 15 nt, Human adenovirus A
ugugauuauguauga

SEQ ID NO: 3897044 - RNA, 12 nt, Human adenovirus A
ugugcugcaaac

SEQ ID NO: 3897045 - RNA, 16 nt, Human adenovirus A
ugugcugcaaaguuuu

SEQ ID NO: 3897046 - RNA, 22 nt, Human adenovirus A
uguggacccuauuuuuugggaa

SEQ ID NO: 3897047 - RNA, 16 nt, Human adenovirus A
uguggcaccugcaaau

SEQ ID NO: 3897048 - RNA, 15 nt, Human adenovirus A
ugugugcugcaaaca

SEQ ID NO: 3897049 - RNA, 14 nt, Human adenovirus A
uguuaacacugccg

SEQ ID NO: 3897050 - RNA, 13 nt, Human adenovirus A
uguuaucuucaaa

SEQ ID NO: 3897051 - RNA, 14 nt, Human adenovirus A
uuaaaagaccaaaa

SEQ ID NO: 3897052 - RNA, 14 nt, Human adenovirus A
uuaaauauaucuuu

SEQ ID NO: 3897053 - RNA, 16 nt, Human adenovirus A
uuaaccacuguagugc

SEQ ID NO: 3897054 - RNA, 22 nt, Human adenovirus A
uuaacuaguuuacccgccagug

SEQ ID NO: 3897055 - RNA, 23 nt, Human adenovirus A
uuaagaacacggugaauguguuc

SEQ ID NO: 3897056 - RNA, 18 nt, Human adenovirus A
uuaaugcuggaugcuuug

SEQ ID NO: 3897057 - RNA, 23 nt, Human adenovirus A
uuaauuacuccauguuaaguuug

SEQ ID NO: 3897058 - RNA, 18 nt, Human adenovirus A
uuacaagcacgccaaagc

SEQ ID NO: 3897059 - RNA, 18 nt, Human adenovirus A
uuacaggaggaggaggaa

SEQ ID NO: 3897060 - RNA, 22 nt, Human adenovirus A
uuaccaccaaauuuaaggccag

SEQ ID NO: 3897061 - RNA, 20 nt, Human adenovirus A
uuacccgcagcugucucuac

SEQ ID NO: 3897062 - RNA, 15 nt, Human adenovirus A
uuacugguacuauga

SEQ ID NO: 3897063 - RNA, 21 nt, Human adenovirus A
uuagcucauuggaguacaagc

SEQ ID NO: 3897064 - RNA, 22 nt, Human adenovirus A
uuagucgcgcacugggccagga

SEQ ID NO: 3897065 - RNA, 11 nt, Human adenovirus A
uuauuggccug

SEQ ID NO: 3897066 - RNA, 18 nt, Human adenovirus A
uucaaacaauaacauugc

SEQ ID NO: 3897067 - RNA, 14 nt, Human adenovirus A
uucaauaaauacug

SEQ ID NO: 3897068 - RNA, 15 nt, Human adenovirus A
uucagaauaaaacaa

SEQ ID NO: 3897069 - RNA, 14 nt, Human adenovirus A
uaaaacugauuuac

SEQ ID NO: 3897070 - RNA, 12 nt, Human adenovirus A
uaaaagcaagcg

SEQ ID NO: 3897071 - RNA, 16 nt, Human adenovirus A
uaaaauacacauaaag

SEQ ID NO: 3897072 - RNA, 19 nt, Human adenovirus A
uaaaauuucuaauguggag

SEQ ID NO: 3897073 - RNA, 23 nt, Human adenovirus A
uaaacaaaagcaaagcaaaugca

SEQ ID NO: 3897074 - RNA, 23 nt, Human adenovirus A
uaaacaucuacagcgacaaagca

SEQ ID NO: 3897075 - RNA, 15 nt, Human adenovirus A
uaaacaucucauaau

SEQ ID NO: 3897076 - RNA, 15 nt, Human adenovirus A
uaaaccaagccaugc

SEQ ID NO: 3897077 - RNA, 23 nt, Human adenovirus A
uaaacugaggcggcuggugcuga

SEQ ID NO: 3897078 - RNA, 11 nt, Human adenovirus A
uaaacugccuc

SEQ ID NO: 3897079 - RNA, 16 nt, Human adenovirus A
uaaacugucuguaaaa

SEQ ID NO: 3897080 - RNA, 12 nt, Human adenovirus A
uaaagaguaaaa

SEQ ID NO: 3897081 - RNA, 21 nt, Human adenovirus A
uaaaggcuagugcccucacac

SEQ ID NO: 3897082 - RNA, 21 nt, Human adenovirus A
uaaaucuuccgccaaagguaa

SEQ ID NO: 3897083 - RNA, 20 nt, Human adenovirus A
uaacaaaggugcuucccaca

SEQ ID NO: 3897084 - RNA, 13 nt, Human adenovirus A
uaacaacaagcua

SEQ ID NO: 3897085 - RNA, 17 nt, Human adenovirus A
uaacacaagagcgcccu

SEQ ID NO: 3897086 - RNA, 17 nt, Human adenovirus A
uaacauucugcagagca

SEQ ID NO: 3897087 - RNA, 21 nt, Human adenovirus A
uaacauugccuuaggcagcag

SEQ ID NO: 3897088 - RNA, 18 nt, Human adenovirus A
uaacucuuguaaagauuu

SEQ ID NO: 3897089 - RNA, 22 nt, Human adenovirus A
uaacugaaaauggaacccuuac

SEQ ID NO: 3897090 - RNA, 13 nt, Human adenovirus A
uaacuucuaccca

SEQ ID NO: 3897091 - RNA, 22 nt, Human adenovirus A
uaacuucuacccaguuuuugca

SEQ ID NO: 3897092 - RNA, 13 nt, Human adenovirus A
uaagaaagaggca

SEQ ID NO: 3897093 - RNA, 19 nt, Human adenovirus A
uaagaucuucguaggaaag

SEQ ID NO: 3897094 - RNA, 19 nt, Human adenovirus A
uaaggcauguuugacaaga

SEQ ID NO: 3897095 - RNA, 16 nt, Human adenovirus A
uaauaauugaguaacu

SEQ ID NO: 3897096 - RNA, 17 nt, Human adenovirus A
uaauagcacuuuggaug

SEQ ID NO: 3897097 - RNA, 22 nt, Human adenovirus A
uaaucaagacggucagcaagga

SEQ ID NO: 3897098 - RNA, 23 nt, Human adenovirus A
uaaucacacuuacccuuuuaaug

SEQ ID NO: 3897099 - RNA, 15 nt, Human adenovirus A
uaauguaacccuucc

SEQ ID NO: 3897100 - RNA, 14 nt, Human adenovirus A
uaauugaaguaagc

SEQ ID NO: 3897101 - RNA, 21 nt, Human adenovirus A
uaauugcuaauggaagaccuu

SEQ ID NO: 3897102 - RNA, 12 nt, Human adenovirus A
uacaaagccagg

SEQ ID NO: 3897103 - RNA, 22 nt, Human adenovirus A
uacaaaguccucagguaguggg

SEQ ID NO: 3897104 - RNA, 17 nt, Human adenovirus A
uacaaccacucucgcag

SEQ ID NO: 3897105 - RNA, 14 nt, Human adenovirus A
uacaacuugcuucc

SEQ ID NO: 3897106 - RNA, 14 nt, Human adenovirus A
uacaagcacgccaa

SEQ ID NO: 3897107 - RNA, 18 nt, Human adenovirus A
uacacgcugcccacucag

SEQ ID NO: 3897108 - RNA, 17 nt, Human adenovirus A
uacacuuaugcucccac

SEQ ID NO: 3897109 - RNA, 22 nt, Human adenovirus A
uacacuuuaaaugcggaagaag

SEQ ID NO: 3897110 - RNA, 11 nt, Human adenovirus A
uacagagagca

SEQ ID NO: 3897111 - RNA, 22 nt, Human adenovirus A
uacagaggaacguaacuuucaa

SEQ ID NO: 3897112 - RNA, 14 nt, Human adenovirus A
uacaggcagggcau

SEQ ID NO: 3897113 - RNA, 16 nt, Human adenovirus A
uacauacacucaugua

SEQ ID NO: 3897114 - RNA, 14 nt, Human adenovirus A
uacaugccgcaaau

SEQ ID NO: 3897115 - RNA, 20 nt, Human adenovirus A
uaccaauacuguuaccaaug

SEQ ID NO: 3897116 - RNA, 20 nt, Human adenovirus A
uaccagaaugaucacagcaa

SEQ ID NO: 3897117 - RNA, 14 nt, Human adenovirus A
uacccaccaucuuc

SEQ ID NO: 3897118 - RNA, 13 nt, Human adenovirus A
uacccgccagugu

SEQ ID NO: 3897119 - RNA, 13 nt, Human adenovirus A
uacgcuggcugug

SEQ ID NO: 3897120 - RNA, 17 nt, Human adenovirus A
uacucggaauugucacc

SEQ ID NO: 3897121 - RNA, 12 nt, Human adenovirus A
uacugcuuccag

SEQ ID NO: 3897122 - RNA, 19 nt, Human adenovirus A
uacuguugcuaauugcccc

SEQ ID NO: 3897123 - RNA, 22 nt, Human adenovirus A
uacuuaccggaaaucugaaaau

SEQ ID NO: 3897124 - RNA, 21 nt, Human adenovirus A
uacuuggcuaguagagacauc

SEQ ID NO: 3897125 - RNA, 12 nt, Human adenovirus A
uacuuguuguau

SEQ ID NO: 3897126 - RNA, 13 nt, Human adenovirus A
uagaaaaagcuac

SEQ ID NO: 3897127 - RNA, 21 nt, Human adenovirus A
uagaacaaaaaggaggaagaa

SEQ ID NO: 3897128 - RNA, 23 nt, Human adenovirus A
uagacauagccaaucaggcugua

SEQ ID NO: 3897129 - RNA, 19 nt, Human adenovirus A
uagacauuguuggccugua

SEQ ID NO: 3897130 - RNA, 20 nt, Human adenovirus A
uagaccaaaugccagugagg

SEQ ID NO: 3897131 - RNA, 17 nt, Human adenovirus A
uagacggcaccuuuuac

SEQ ID NO: 3897132 - RNA, 13 nt, Human adenovirus A
uagagaggaauuu

SEQ ID NO: 3897133 - RNA, 15 nt, Human adenovirus A
uagagauaagcagga

SEQ ID NO: 3897134 - RNA, 17 nt, Human adenovirus A
uagagccaugggaggau

SEQ ID NO: 3897135 - RNA, 22 nt, Human adenovirus A
uagagucuuuuucccauugguc

SEQ ID NO: 3897136 - RNA, 16 nt, Human adenovirus A
uagaugugcuguggaa

SEQ ID NO: 3897137 - RNA, 13 nt, Human adenovirus A
uagcguacagcca

SEQ ID NO: 3897138 - RNA, 14 nt, Human adenovirus A
uaggcauuaaaugg

SEQ ID NO: 3897139 - RNA, 23 nt, Human adenovirus A
uagguauaagaaagaggcagccg

SEQ ID NO: 3897140 - RNA, 18 nt, Human adenovirus A
uaguacuccuauguaagu

SEQ ID NO: 3897141 - RNA, 19 nt, Human adenovirus A
uaguaggcuaacuguuaau

SEQ ID NO: 3897142 - RNA, 15 nt, Human adenovirus A
uaguucuuuucuuua

SEQ ID NO: 3897143 - RNA, 11 nt, Human adenovirus A
uaguugccacg

SEQ ID NO: 3897144 - RNA, 17 nt, Human adenovirus A
uaguuguggucuagagu

SEQ ID NO: 3897145 - RNA, 18 nt, Human adenovirus A
uauaccaugauggagugg

SEQ ID NO: 3897146 - RNA, 12 nt, Human adenovirus A
uauacugggugc

SEQ ID NO: 3897147 - RNA, 17 nt, Human adenovirus A
uauaguggcacaacaca

SEQ ID NO: 3897148 - RNA, 15 nt, Human adenovirus A
uauauccuugcaaaa

SEQ ID NO: 3897149 - RNA, 23 nt, Human adenovirus A
uauauuaagguacauuggcauua

SEQ ID NO: 3897150 - RNA, 13 nt, Human adenovirus A
uaucagccagagc

SEQ ID NO: 3897151 - RNA, 21 nt, Human adenovirus A
uaugaugcgggcagccaggcg

SEQ ID NO: 3897152 - RNA, 20 nt, Human adenovirus A
uaugccaucucgauccagca

SEQ ID NO: 3897153 - RNA, 13 nt, Human adenovirus A
uaugcccagcaug

SEQ ID NO: 3897154 - RNA, 14 nt, Human adenovirus A
uaugcccagcauga

SEQ ID NO: 3897155 - RNA, 16 nt, Human adenovirus A
uaugcuacaaaguccu

SEQ ID NO: 3897156 - RNA, 21 nt, Human adenovirus A
uaugcucccacacgcagcaac

SEQ ID NO: 3897157 - RNA, 17 nt, Human adenovirus A
uauggaaauccaaacuu

SEQ ID NO: 3897158 - RNA, 20 nt, Human adenovirus A
uaugugaucauaacauguuu

SEQ ID NO: 3897159 - RNA, 15 nt, Human adenovirus A
uauguuaaauuaaag

SEQ ID NO: 3897160 - RNA, 14 nt, Human adenovirus A
uauuaacuuuauau

SEQ ID NO: 3897161 - RNA, 15 nt, Human adenovirus A
uauugaguugcacau

SEQ ID NO: 3897162 - RNA, 14 nt, Human adenovirus A
uauugcgcagcaac

SEQ ID NO: 3897163 - RNA, 23 nt, Human adenovirus A
uauuucuuguucuuccucuucua

SEQ ID NO: 3897164 - RNA, 23 nt, Human adenovirus A
ucaaaaaagcaaaguacaaccac

SEQ ID NO: 3897165 - RNA, 14 nt, Human adenovirus A
ucaaacaauaacau

SEQ ID NO: 3897166 - RNA, 19 nt, Human adenovirus A
ucaaacaccugcaguaaau

SEQ ID NO: 3897167 - RNA, 22 nt, Human adenovirus A
ucaaacaccugcaguaaauuca

SEQ ID NO: 3897168 - RNA, 15 nt, Human adenovirus A
ucaaagaaacagcag

SEQ ID NO: 3897169 - RNA, 14 nt, Human adenovirus A
ucaaaggcaggcau

SEQ ID NO: 3897170 - RNA, 20 nt, Human adenovirus A
ucaaaguaccuuacaaacga

SEQ ID NO: 3897171 - RNA, 15 nt, Human adenovirus A
ucaaaguaugcugca

SEQ ID NO: 3897172 - RNA, 20 nt, Human adenovirus A
ucaacagaaucaaucucagu

SEQ ID NO: 3897173 - RNA, 16 nt, Human adenovirus A
ucaacgacuaaaacaa

SEQ ID NO: 3897174 - RNA, 21 nt, Human adenovirus A
ucaacgacuaaaacaaaucua

SEQ ID NO: 3897175 - RNA, 20 nt, Human adenovirus A
ucaagacguuccauggcuuc

SEQ ID NO: 3897176 - RNA, 19 nt, Human adenovirus A
ucaagacuauucuagcaaa

SEQ ID NO: 3897177 - RNA, 14 nt, Human adenovirus A
ucaaggaaauacua

SEQ ID NO: 3897178 - RNA, 16 nt, Human adenovirus A
ucaauaguugccacgc

SEQ ID NO: 3897179 - RNA, 17 nt, Human adenovirus A
ucaaugcagcuguggag

SEQ ID NO: 3897180 - RNA, 16 nt, Human adenovirus A
ucaauucuucuuccaa

SEQ ID NO: 3897181 - RNA, 19 nt, Human adenovirus A
ucaauuugccuaaaagcua

SEQ ID NO: 3897182 - RNA, 17 nt, Human adenovirus A
ucaauuuugcaagugua

SEQ ID NO: 3897183 - RNA, 15 nt, Human adenovirus A
ucacaagacacauug

SEQ ID NO: 3897184 - RNA, 16 nt, Human adenovirus A
ucacaaggucuuaaac

SEQ ID NO: 3897185 - RNA, 20 nt, Human adenovirus A
ucacaaggucuuaaacuuuc

SEQ ID NO: 3897186 - RNA, 22 nt, Human adenovirus A
ucacacccuccguguucccaca

SEQ ID NO: 3897187 - RNA, 19 nt, Human adenovirus A
ucaccgcgcugcggccaug

SEQ ID NO: 3897188 - RNA, 23 nt, Human adenovirus A
ucaccuggaccuuuaacggaaaa

SEQ ID NO: 3897189 - RNA, 23 nt, Human adenovirus A
ucacugccgcugcaaucuuugca

SEQ ID NO: 3897190 - RNA, 15 nt, Human adenovirus A
ucagauagcaagcgu

SEQ ID NO: 3897191 - RNA, 16 nt, Human adenovirus A
ucagauccuuagauuu

SEQ ID NO: 3897192 - RNA, 16 nt, Human adenovirus A
ucagauuuugugccua

SEQ ID NO: 3897193 - RNA, 11 nt, Human adenovirus A
ucagcacugcg

SEQ ID NO: 3897194 - RNA, 18 nt, Human adenovirus A
ucagcaguugcaagcgau

SEQ ID NO: 3897195 - RNA, 18 nt, Human adenovirus A
ucagcgagucaccaucac

SEQ ID NO: 3897196 - RNA, 13 nt, Human adenovirus A
ucagcuucuccag

SEQ ID NO: 3897197 - RNA, 16 nt, Human adenovirus A
ucaggcagaggacgag

SEQ ID NO: 3897198 - RNA, 19 nt, Human adenovirus A
ucagucagagagaaaagca

SEQ ID NO: 3897199 - RNA, 16 nt, Human adenovirus A
ucauaagacaaagccu

SEQ ID NO: 3897200 - RNA, 21 nt, Human adenovirus A
ucauccacaucuacaaagcgg

SEQ ID NO: 3897201 - RNA, 21 nt, Human adenovirus A
ucauccgcauuuaagcaacau

SEQ ID NO: 3897202 - RNA, 14 nt, Human adenovirus A
ucauccucagcucc

SEQ ID NO: 3897203 - RNA, 15 nt, Human adenovirus A
ucaucucuacagccc

SEQ ID NO: 3897204 - RNA, 14 nt, Human adenovirus A
ucaugaaaacagca

SEQ ID NO: 3897205 - RNA, 20 nt, Human adenovirus A
ucaugguuugcuaacagcuc

SEQ ID NO: 3897206 - RNA, 12 nt, Human adenovirus A
ucauuccuucag

SEQ ID NO: 3897207 - RNA, 19 nt, Human adenovirus A
ucauuugcgcccacagggu

SEQ ID NO: 3897208 - RNA, 19 nt, Human adenovirus A
uccaaauguucaacaacag

SEQ ID NO: 3897209 - RNA, 15 nt, Human adenovirus A
uccaaccaaaggaga

SEQ ID NO: 3897210 - RNA, 22 nt, Human adenovirus A
uccaaccaacgaacacggagga

SEQ ID NO: 3897211 - RNA, 15 nt, Human adenovirus A
uccaauggucuucaa

SEQ ID NO: 3897212 - RNA, 16 nt, Human adenovirus A
uccacacaucucaccu

SEQ ID NO: 3897213 - RNA, 23 nt, Human adenovirus A
uccaccgccauccgcaggcagua

SEQ ID NO: 3897214 - RNA, 13 nt, Human adenovirus A
uccagaggaggag

SEQ ID NO: 3897215 - RNA, 23 nt, Human adenovirus A
ucccacgccgcgccccacuuccu

SEQ ID NO: 3897216 - RNA, 20 nt, Human adenovirus A
ucccgaguguuuagcccccu

SEQ ID NO: 3897217 - RNA, 20 nt, Human adenovirus A
uccgcauugguugcccccuc

SEQ ID NO: 3897218 - RNA, 15 nt, Human adenovirus A
uccgccuaaggaaag

SEQ ID NO: 3897219 - RNA, 15 nt, Human adenovirus A
uccuacauuggaguu

SEQ ID NO: 3897220 - RNA, 14 nt, Human adenovirus A
uccucgaaagcgag

SEQ ID NO: 3897221 - RNA, 18 nt, Human adenovirus A
uccucuucugcugcauug

SEQ ID NO: 3897222 - RNA, 20 nt, Human adenovirus A
uccugcuccuuuucuuacau

SEQ ID NO: 3897223 - RNA, 14 nt, Human adenovirus A
ucgacgggccaggc

SEQ ID NO: 3897224 - RNA, 20 nt, Human adenovirus A
ucgagaucuaggcuguggac

SEQ ID NO: 3897225 - RNA, 21 nt, Human adenovirus A
ucgcaauuagggccagcauug

SEQ ID NO: 3897226 - RNA, 17 nt, Human adenovirus A
ucgcaguauggcagcug

SEQ ID NO: 3897227 - RNA, 18 nt, Human adenovirus A
ucgcgcacugggccagga

SEQ ID NO: 3897228 - RNA, 12 nt, Human adenovirus A
ucgcggagaggg

SEQ ID NO: 3897229 - RNA, 17 nt, Human adenovirus A
ucgcugguccccagaug

SEQ ID NO: 3897230 - RNA, 14 nt, Human adenovirus A
ucgcuuucuucugc

SEQ ID NO: 3897231 - RNA, 17 nt, Human adenovirus A
ucggaagaaaagcgugg

SEQ ID NO: 3897232 - RNA, 17 nt, Human adenovirus A
ucggcaacagcagcaac

SEQ ID NO: 3897233 - RNA, 17 nt, Human adenovirus A
ucgggaauuaauggagu

SEQ ID NO: 3897234 - RNA, 13 nt, Human adenovirus A
ucguacuuaaaaa

SEQ ID NO: 3897235 - RNA, 20 nt, Human adenovirus A
ucguacuuaaaaaaacaaaa

SEQ ID NO: 3897236 - RNA, 21 nt, Human adenovirus A
ucgucuuauuuuccuucuucc

SEQ ID NO: 3897237 - RNA, 18 nt, Human adenovirus A
ucuaaaccuauaacaaug

SEQ ID NO: 3897238 - RNA, 22 nt, Human adenovirus A
ucuaacaagcugcgcugccguu

SEQ ID NO: 3897239 - RNA, 18 nt, Human adenovirus A
ucuaagccaugcaaauag

SEQ ID NO: 3897240 - RNA, 20 nt, Human adenovirus A
ucuaagguguguaaacacau

SEQ ID NO: 3897241 - RNA, 14 nt, Human adenovirus A
ucuaaugcaaguug

SEQ ID NO: 3897242 - RNA, 22 nt, Human adenovirus A
ucuaaugcaaguuguaaggcau

SEQ ID NO: 3897243 - RNA, 23 nt, Human adenovirus A
ucucaaaagcagccauaaugccu

SEQ ID NO: 3897244 - RNA, 14 nt, Human adenovirus A
ucucuaacaagcug

SEQ ID NO: 3897245 - RNA, 22 nt, Human adenovirus A
ucugccauuaauugaucaauuu

SEQ ID NO: 3897246 - RNA, 17 nt, Human adenovirus A
ucuggcgaacaggaaga

SEQ ID NO: 3897247 - RNA, 16 nt, Human adenovirus A
ucuguaguuucuuuac

SEQ ID NO: 3897248 - RNA, 14 nt, Human adenovirus A
ucuguuauguaugc

SEQ ID NO: 3897249 - RNA, 23 nt, Human adenovirus A
ucuguucaauaaauacugcuccc

SEQ ID NO: 3897250 - RNA, 15 nt, Human adenovirus A
ucuuaggguuugauu

SEQ ID NO: 3897251 - RNA, 14 nt, Human adenovirus A
ucuucaaacaccug

SEQ ID NO: 3897252 - RNA, 22 nt, Human adenovirus A
ucuucaucuuuucuagaugaag

SEQ ID NO: 3897253 - RNA, 20 nt, Human adenovirus A
ucuucggguggacggagcca

SEQ ID NO: 3897254 - RNA, 13 nt, Human adenovirus A
ucuucuucccaau

SEQ ID NO: 3897255 - RNA, 18 nt, Human adenovirus A
ucuugaaugcucuggaca

SEQ ID NO: 3897256 - RNA, 22 nt, Human adenovirus A
ucuugaccaccguucccuauca

SEQ ID NO: 3897257 - RNA, 16 nt, Human adenovirus A
ucuugcugaaaugcgc

SEQ ID NO: 3897258 - RNA, 20 nt, Human adenovirus A
ucuuggucgucacacccucc

SEQ ID NO: 3897259 - RNA, 20 nt, Human adenovirus A
ucuuuguguguuucuaaaac

SEQ ID NO: 3897260 - RNA, 15 nt, Human adenovirus A
ucuuuugcagcucca

SEQ ID NO: 3897261 - RNA, 16 nt, Human adenovirus A
ugaaaagacugagaac

SEQ ID NO: 3897262 - RNA, 16 nt, Human adenovirus A
ugaaagaucacagcca

SEQ ID NO: 3897263 - RNA, 14 nt, Human adenovirus A
ugaaagucaaguca

SEQ ID NO: 3897264 - RNA, 23 nt, Human adenovirus A
ugaagaagaaccuaacugucauc

SEQ ID NO: 3897265 - RNA, 14 nt, Human adenovirus A
ugaagauagacagc

SEQ ID NO: 3897266 - RNA, 23 nt, Human adenovirus A
ugaagcaaaccacauaggcauug

SEQ ID NO: 3897267 - RNA, 18 nt, Human adenovirus A
ugaagugccucaaaguga

SEQ ID NO: 3897268 - RNA, 19 nt, Human adenovirus A
ugaaucgcagucaccacca

SEQ ID NO: 3897269 - RNA, 11 nt, Human adenovirus A
ugacaaagaug

SEQ ID NO: 3897270 - RNA, 17 nt, Human adenovirus A
ugacaaugaauaagcca

SEQ ID NO: 3897271 - RNA, 21 nt, Human adenovirus A
ugacaaugcccgccuggcagu

SEQ ID NO: 3897272 - RNA, 21 nt, Human adenovirus A
ugacaccaacgaccagucuuu

SEQ ID NO: 3897273 - RNA, 20 nt, Human adenovirus A
ugacggugccccucgaccug

SEQ ID NO: 3897274 - RNA, 22 nt, Human adenovirus A
ugacuggacagcggccauggau

SEQ ID NO: 3897275 - RNA, 12 nt, Human adenovirus A
ugacuggcaugg

SEQ ID NO: 3897276 - RNA, 12 nt, Human adenovirus A
ugagaacuucug

SEQ ID NO: 3897277 - RNA, 19 nt, Human adenovirus A
ugagcaaaucucagaaagc

SEQ ID NO: 3897278 - RNA, 19 nt, Human adenovirus A
ugaggacacugaaggcauu

SEQ ID NO: 3897279 - RNA, 13 nt, Human adenovirus A
ugagguguaccug

SEQ ID NO: 3897280 - RNA, 20 nt, Human adenovirus A
ugaguaaagauauucccacg

SEQ ID NO: 3897281 - RNA, 17 nt, Human adenovirus A
ugagucgcuguugggac

SEQ ID NO: 3897282 - RNA, 19 nt, Human adenovirus A
ugagucgcuguugggacag

SEQ ID NO: 3897283 - RNA, 19 nt, Human adenovirus A
ugagugggcagaauuugug

SEQ ID NO: 3897284 - RNA, 17 nt, Human adenovirus A
ugaucacagcaacuuuu

SEQ ID NO: 3897285 - RNA, 18 nt, Human adenovirus A
ugaucacagcaacuuuuu

SEQ ID NO: 3897286 - RNA, 15 nt, Human adenovirus A
ugauucuucagagca

SEQ ID NO: 3897287 - RNA, 20 nt, Human adenovirus A
ugcaaaauggacucaaauaa

SEQ ID NO: 3897288 - RNA, 17 nt, Human adenovirus A
ugcaaguuguaaggcau

SEQ ID NO: 3897289 - RNA, 13 nt, Human adenovirus A
ugcaaucuuugca

SEQ ID NO: 3897290 - RNA, 11 nt, Human adenovirus A
ugcaaugcagc

SEQ ID NO: 3897291 - RNA, 14 nt, Human adenovirus A
ugcacuuccuucag

SEQ ID NO: 3897292 - RNA, 12 nt, Human adenovirus A
ugcagcagaauu

SEQ ID NO: 3897293 - RNA, 15 nt, Human adenovirus A
ugcagccucauacaa

SEQ ID NO: 3897294 - RNA, 16 nt, Human adenovirus A
ugcagccuuucuuaaa

SEQ ID NO: 3897295 - RNA, 23 nt, Human adenovirus A
ugcagggaccgcagucugacagc

SEQ ID NO: 3897296 - RNA, 20 nt, Human adenovirus A
ugcauauauccuugcaaaaa

SEQ ID NO: 3897297 - RNA, 20 nt, Human adenovirus A
ugcaucucaccacugaaacu

SEQ ID NO: 3897298 - RNA, 19 nt, Human adenovirus A
ugccaccaguuggaagaau

SEQ ID NO: 3897299 - RNA, 17 nt, Human adenovirus A
ugccagaagcacuggca

SEQ ID NO: 3897300 - RNA, 23 nt, Human adenovirus A
ugccagacuacguuuuacauccu

SEQ ID NO: 3897301 - RNA, 11 nt, Human adenovirus A
ugccagcucuu

SEQ ID NO: 3897302 - RNA, 19 nt, Human adenovirus A
ugccagcucuuggaauaaa

SEQ ID NO: 3897303 - RNA, 18 nt, Human adenovirus A
ugccaggacaaagauuuu

SEQ ID NO: 3897304 - RNA, 17 nt, Human adenovirus A
ugccaggcauuuccagg

SEQ ID NO: 3897305 - RNA, 15 nt, Human adenovirus A
ugccaguuguauaaa

SEQ ID NO: 3897306 - RNA, 23 nt, Human adenovirus A
ggcgguucggguccugcgggaag

SEQ ID NO: 3897307 - RNA, 17 nt, Human adenovirus A
ggcguacagccuggagc

SEQ ID NO: 3897308 - RNA, 20 nt, Human adenovirus A
ggcgugccguuggcagaguc

SEQ ID NO: 3897309 - RNA, 21 nt, Human adenovirus A
ggcuagcuugcgaaacccacg

SEQ ID NO: 3897310 - RNA, 13 nt, Human adenovirus A
ggcugacagagcg

SEQ ID NO: 3897311 - RNA, 12 nt, Human adenovirus A
ggcuggcuugcc

SEQ ID NO: 3897312 - RNA, 21 nt, Human adenovirus A
ggcuggggacugggugccgcc

SEQ ID NO: 3897313 - RNA, 16 nt, Human adenovirus A
ggcuguauacuacccc

SEQ ID NO: 3897314 - RNA, 20 nt, Human adenovirus A
ggcuucgaaugcugugacac

SEQ ID NO: 3897315 - RNA, 20 nt, Human adenovirus A
gggauuauaaaaggcuggaa

SEQ ID NO: 3897316 - RNA, 13 nt, Human adenovirus A
gggcagccaggcg

SEQ ID NO: 3897317 - RNA, 12 nt, Human adenovirus A
gggccaggagga

SEQ ID NO: 3897318 - RNA, 23 nt, Human adenovirus A
gggccaggcgcauugggcggcga

SEQ ID NO: 3897319 - RNA, 20 nt, Human adenovirus A
gggcccaagaugugugcgcu

SEQ ID NO: 3897320 - RNA, 13 nt, Human adenovirus A
gggcgacuacccg

SEQ ID NO: 3897321 - RNA, 23 nt, Human adenovirus A
gggcuguaucuguugaaugaggu

SEQ ID NO: 3897322 - RNA, 22 nt, Human adenovirus A
ggguacuggaucguggucccag

SEQ ID NO: 3897323 - RNA, 18 nt, Human adenovirus A
ggguguauuggccgggca

SEQ ID NO: 3897324 - RNA, 19 nt, Human adenovirus A
gguaccauagcgaggaacc

SEQ ID NO: 3897325 - RNA, 17 nt, Human adenovirus A
gguaccuucgaaaugca

SEQ ID NO: 3897326 - RNA, 18 nt, Human adenovirus A
gguacuuuuccuugugga

SEQ ID NO: 3897327 - RNA, 16 nt, Human adenovirus A
gguagacgaacaaacu

SEQ ID NO: 3897328 - RNA, 18 nt, Human adenovirus A
ggucagauccuuagauuu

SEQ ID NO: 3897329 - RNA, 18 nt, Human adenovirus A
ggucgcaccacuguagac

SEQ ID NO: 3897330 - RNA, 23 nt, Human adenovirus A
ggucggugguuacucgauuuaau

SEQ ID NO: 3897331 - RNA, 14 nt, Human adenovirus A
ggucuuaaacuuuc

SEQ ID NO: 3897332 - RNA, 22 nt, Human adenovirus A
ggugaaagaagacuauagagag

SEQ ID NO: 3897333 - RNA, 18 nt, Human adenovirus A
ggugauaagcuccugcau

SEQ ID NO: 3897334 - RNA, 14 nt, Human adenovirus A
ggugcagcucgccc

SEQ ID NO: 3897335 - RNA, 15 nt, Human adenovirus A
gguggacaacaaguc

SEQ ID NO: 3897336 - RNA, 15 nt, Human adenovirus A
gguguuuggcagcaa

SEQ ID NO: 3897337 - RNA, 18 nt, Human adenovirus A
gguucgacgggccaggcg

SEQ ID NO: 3897338 - RNA, 19 nt, Human adenovirus A
gguugauuuuacagagagc

SEQ ID NO: 3897339 - RNA, 19 nt, Human adenovirus A
guaaacuuaacucaggcuu

SEQ ID NO: 3897340 - RNA, 17 nt, Human adenovirus A
guaaauucaguagauuu

SEQ ID NO: 3897341 - RNA, 13 nt, Human adenovirus A
guaacucuuguaa

SEQ ID NO: 3897342 - RNA, 11 nt, Human adenovirus A
guacacuggcu

SEQ ID NO: 3897343 - RNA, 14 nt, Human adenovirus A
guacagccagaugu

SEQ ID NO: 3897344 - RNA, 19 nt, Human adenovirus A
guaccauagcgaggaaccc

SEQ ID NO: 3897345 - RNA, 16 nt, Human adenovirus A
guacgcguccaccuca

SEQ ID NO: 3897346 - RNA, 13 nt, Human adenovirus A
guacucaucagag

SEQ ID NO: 3897347 - RNA, 15 nt, Human adenovirus A
guacuuaaaaaaaca

SEQ ID NO: 3897348 - RNA, 21 nt, Human adenovirus A
guagacauagccaaucaggcu

SEQ ID NO: 3897349 - RNA, 15 nt, Human adenovirus A
guagagacaucagau

SEQ ID NO: 3897350 - RNA, 17 nt, Human adenovirus A
guagaggaaaagcugcc

SEQ ID NO: 3897351 - RNA, 13 nt, Human adenovirus A
guagagucuuuuu

SEQ ID NO: 3897352 - RNA, 19 nt, Human adenovirus A
guauuauuugaacacacug

SEQ ID NO: 3897353 - RNA, 12 nt, Human adenovirus A
gucaaucauguu

SEQ ID NO: 3897354 - RNA, 17 nt, Human adenovirus A
gucaauucuucuuccaa

SEQ ID NO: 3897355 - RNA, 14 nt, Human adenovirus A
gucacaacaagaug

SEQ ID NO: 3897356 - RNA, 16 nt, Human adenovirus A
gucacaaguacaucca

SEQ ID NO: 3897357 - RNA, 17 nt, Human adenovirus A
gucacagucacaaggua

SEQ ID NO: 3897358 - RNA, 22 nt, Human adenovirus A
gucaccaucacugacgcccgcc

SEQ ID NO: 3897359 - RNA, 23 nt, Human adenovirus A
gucacucaagcggcauuccccau

SEQ ID NO: 3897360 - RNA, 17 nt, Human adenovirus A
gucagauagcaagcgua

SEQ ID NO: 3897361 - RNA, 15 nt, Human adenovirus A
gucagcucaggacau

SEQ ID NO: 3897362 - RNA, 23 nt, Human adenovirus A
gucauagcaacaacgcugggcau

SEQ ID NO: 3897363 - RNA, 15 nt, Human adenovirus A
gucauggagaaggac

SEQ ID NO: 3897364 - RNA, 16 nt, Human adenovirus A
gucccggucuggugca

SEQ ID NO: 3897365 - RNA, 14 nt, Human adenovirus A
guccuuccagggac

SEQ ID NO: 3897366 - RNA, 20 nt, Human adenovirus A
gucgaccuguggcaccugca

SEQ ID NO: 3897367 - RNA, 17 nt, Human adenovirus A
gucgaggacuuggaaga

SEQ ID NO: 3897368 - RNA, 13 nt, Human adenovirus A
gucgcaccacugu

SEQ ID NO: 3897369 - RNA, 15 nt, Human adenovirus A
gucgccgcagagagc

SEQ ID NO: 3897370 - RNA, 22 nt, Human adenovirus A
gucggaaugauuaaacaacaaa

SEQ ID NO: 3897371 - RNA, 17 nt, Human adenovirus A
gucggagaaccuuucaa

SEQ ID NO: 3897372 - RNA, 18 nt, Human adenovirus A
gucuacaacugcuccccu

SEQ ID NO: 3897373 - RNA, 21 nt, Human adenovirus A
gucugccauuccccacacguc

SEQ ID NO: 3897374 - RNA, 16 nt, Human adenovirus A
gucuuacaugcacauc

SEQ ID NO: 3897375 - RNA, 14 nt, Human adenovirus A
gucuugccugcgga

SEQ ID NO: 3897376 - RNA, 17 nt, Human adenovirus A
gucuuuaccuacuuuga

SEQ ID NO: 3897377 - RNA, 18 nt, Human adenovirus A
gugaaagugaauacuuaa

SEQ ID NO: 3897378 - RNA, 15 nt, Human adenovirus A
gugaagauagacagc

SEQ ID NO: 3897379 - RNA, 21 nt, Human adenovirus A
gugaagcaaaccacauaggca

SEQ ID NO: 3897380 - RNA, 11 nt, Human adenovirus A
gugacuuccca

SEQ ID NO: 3897381 - RNA, 17 nt, Human adenovirus A
gugagcauccaaaugga

SEQ ID NO: 3897382 - RNA, 13 nt, Human adenovirus A
gugaguuggccug

SEQ ID NO: 3897383 - RNA, 18 nt, Human adenovirus A
gugauaagcuccugcauu

SEQ ID NO: 3897384 - RNA, 16 nt, Human adenovirus A
gugaugaaaguagaaa

SEQ ID NO: 3897385 - RNA, 23 nt, Human adenovirus A
gugcaaaacuuucuaccaaggaa

SEQ ID NO: 3897386 - RNA, 12 nt, Human adenovirus A
gugcacgucaca

SEQ ID NO: 3897387 - RNA, 12 nt, Human adenovirus A
gugccaggcauu

SEQ ID NO: 3897388 - RNA, 18 nt, Human adenovirus A
gugccaggcauuuccagg

SEQ ID NO: 3897389 - RNA, 20 nt, Human adenovirus A
gugccaggcauuuccaggug

SEQ ID NO: 3897390 - RNA, 16 nt, Human adenovirus A
gugccuauauauuuua

SEQ ID NO: 3897391 - RNA, 16 nt, Human adenovirus A
gugcuacugcgucucc

SEQ ID NO: 3897392 - RNA, 16 nt, Human adenovirus A
gugcugauugcuggcc

SEQ ID NO: 3897393 - RNA, 21 nt, Human adenovirus A
guggaaagcaucacacagaaa

SEQ ID NO: 3897394 - RNA, 16 nt, Human adenovirus A
guggauaccacagaau

SEQ ID NO: 3897395 - RNA, 15 nt, Human adenovirus A
guggcuaggaaaaca

SEQ ID NO: 3897396 - RNA, 15 nt, Human adenovirus A
guguaauuuuccagc

SEQ ID NO: 3897397 - RNA, 22 nt, Human adenovirus A
guguacuugguggacaacaagu

SEQ ID NO: 3897398 - RNA, 15 nt, Human adenovirus A
gugugcugcaaacau

SEQ ID NO: 3897399 - RNA, 18 nt, Human adenovirus A
guguucccacaguaggaa

SEQ ID NO: 3897400 - RNA, 15 nt, Human adenovirus A
guguugcuuugaaua

SEQ ID NO: 3897401 - RNA, 11 nt, Human adenovirus A
guuaaauuaaa

SEQ ID NO: 3897402 - RNA, 13 nt, Human adenovirus A
guuaaauuaaaga

SEQ ID NO: 3897403 - RNA, 21 nt, Human adenovirus A
guuaaguuugacaccagaaac

SEQ ID NO: 3897404 - RNA, 16 nt, Human adenovirus A
guuacauaccuggcaa

SEQ ID NO: 3897405 - RNA, 18 nt, Human adenovirus A
guuaccugugcugaugga

SEQ ID NO: 3897406 - RNA, 13 nt, Human adenovirus A
guuacugaagugc

SEQ ID NO: 3897407 - RNA, 21 nt, Human adenovirus A
guuagcaacuauccuguaguu

SEQ ID NO: 3897408 - RNA, 22 nt, Human adenovirus A
guucaacaacagcuucuaaaag

SEQ ID NO: 3897409 - RNA, 21 nt, Human adenovirus A
guucccaaauauccaggagga

SEQ ID NO: 3897410 - RNA, 17 nt, Human adenovirus A
guucgacgggccaggcg

SEQ ID NO: 3897411 - RNA, 18 nt, Human adenovirus A
guucuccccacgugugcc

SEQ ID NO: 3897412 - RNA, 21 nt, Human adenovirus A
guugcaagcgaucccauagcu

SEQ ID NO: 3897413 - RNA, 21 nt, Human adenovirus A
guugcuuuccaaaugccccca

SEQ ID NO: 3897414 - RNA, 15 nt, Human adenovirus A
guuggaaacugugcu

SEQ ID NO: 3897415 - RNA, 15 nt, Human adenovirus A
guuguggauaccaca

SEQ ID NO: 3897416 - RNA, 22 nt, Human adenovirus A
guuuaaaucuuucugcuccccu

SEQ ID NO: 3897417 - RNA, 13 nt, Human adenovirus A
guuuagaaggaaa

SEQ ID NO: 3897418 - RNA, 15 nt, Human adenovirus A
guuuccgauaaugag

SEQ ID NO: 3897419 - RNA, 12 nt, Human adenovirus A
guuucuucuaaa

SEQ ID NO: 3897420 - RNA, 13 nt, Human adenovirus A
guuugacaccaga

SEQ ID NO: 3897421 - RNA, 15 nt, Human adenovirus A
guuuggaaacuguau

SEQ ID NO: 3897422 - RNA, 23 nt, Human adenovirus A
guuuugagcggaagccuucaaaa

SEQ ID NO: 3897423 - RNA, 21 nt, Human adenovirus A
guuuuggcggccaugcaaagc

SEQ ID NO: 3897424 - RNA, 17 nt, Human adenovirus A
uaaaaaauuacaaaggc

SEQ ID NO: 3897425 - RNA, 13 nt, Human adenovirus A
aaaaaacaguuuc

SEQ ID NO: 3897426 - RNA, 23 nt, Human adenovirus A
aaaaagcaaaguacaaccacucu

SEQ ID NO: 3897427 - RNA, 13 nt, Human adenovirus A
aaaaaucaaaugg

SEQ ID NO: 3897428 - RNA, 17 nt, Human adenovirus A
aaaaaucaaauggcucu

SEQ ID NO: 3897429 - RNA, 19 nt, Human adenovirus A
aaaaauguguacuugcuuu

SEQ ID NO: 3897430 - RNA, 20 nt, Human adenovirus A
aaaacacgucggaaugauua

SEQ ID NO: 3897431 - RNA, 11 nt, Human adenovirus A
aaaacacugag

SEQ ID NO: 3897432 - RNA, 16 nt, Human adenovirus A
aaaacgagcagcaaau

SEQ ID NO: 3897433 - RNA, 20 nt, Human adenovirus A
aaaagagccacagcucugau

SEQ ID NO: 3897434 - RNA, 19 nt, Human adenovirus A
aaaagcagccauaaugccu

SEQ ID NO: 3897435 - RNA, 17 nt, Human adenovirus A
aaaagcauacuuaccaa

SEQ ID NO: 3897436 - RNA, 24 nt, Human adenovirus A
aaaagcugccaccucuagaaacug

SEQ ID NO: 3897437 - RNA, 20 nt, Human adenovirus A
aaaagcuuuaauaaccaugu

SEQ ID NO: 3897438 - RNA, 13 nt, Human adenovirus A
aaaaggcuggaag

SEQ ID NO: 3897439 - RNA, 17 nt, Human adenovirus A
aaaagucuacucauacc

SEQ ID NO: 3897440 - RNA, 16 nt, Human adenovirus A
aaaauaaaacuuccaa

SEQ ID NO: 3897441 - RNA, 16 nt, Human adenovirus A
aaaauauguuaaauua

SEQ ID NO: 3897442 - RNA, 21 nt, Human adenovirus A
aaaaugcaaaauggacucaaa

SEQ ID NO: 3897443 - RNA, 15 nt, Human adenovirus A
aaaauggaacccuua

SEQ ID NO: 3897444 - RNA, 17 nt, Human adenovirus A
aaaauuuucaacagaaa

SEQ ID NO: 3897445 - RNA, 16 nt, Human adenovirus A
aaacaaaagcaaagca

SEQ ID NO: 3897446 - RNA, 19 nt, Human adenovirus A
aaacaaaagcaaagcaaau

SEQ ID NO: 3897447 - RNA, 15 nt, Human adenovirus A
aaacaacgaaggcca

SEQ ID NO: 3897448 - RNA, 19 nt, Human adenovirus A
aaacacuguaagaggagac

SEQ ID NO: 3897449 - RNA, 18 nt, Human adenovirus A
aaacagauucuggagaau

SEQ ID NO: 3897450 - RNA, 21 nt, Human adenovirus A
aaacaggcuauugcgcagcaa

SEQ ID NO: 3897451 - RNA, 16 nt, Human adenovirus A
aaacaguacaaagcca

SEQ ID NO: 3897452 - RNA, 13 nt, Human adenovirus A
aaacauaaaacua

SEQ ID NO: 3897453 - RNA, 16 nt, Human adenovirus A
aaaccggccagaugcu

SEQ ID NO: 3897454 - RNA, 21 nt, Human adenovirus A
aaaccggcgaggaacuaaacc

SEQ ID NO: 3897455 - RNA, 17 nt, Human adenovirus A
aaaccgucgcuuucaac

SEQ ID NO: 3897456 - RNA, 13 nt, Human adenovirus A
aaaccuagcugcu

SEQ ID NO: 3897457 - RNA, 17 nt, Human adenovirus A
aaacgaccgccuuuucu

SEQ ID NO: 3897458 - RNA, 13 nt, Human adenovirus A
aaacucuaacugc

SEQ ID NO: 3897459 - RNA, 18 nt, Human adenovirus A
aaacugaggcggcuggug

SEQ ID NO: 3897460 - RNA, 23 nt, Human adenovirus A
aaacuucgccaauaaaaacaacg

SEQ ID NO: 3897461 - RNA, 17 nt, Human adenovirus A
aaagacuccggaaacaa

SEQ ID NO: 3897462 - RNA, 15 nt, Human adenovirus A
aaagaucacagccag

SEQ ID NO: 3897463 - RNA, 13 nt, Human adenovirus A
aaagcaaaguaca

SEQ ID NO: 3897464 - RNA, 22 nt, Human adenovirus A
aaagcaaauuacgcaacaacug

SEQ ID NO: 3897465 - RNA, 17 nt, Human adenovirus A
aaagcauaauaugguuu

SEQ ID NO: 3897466 - RNA, 13 nt, Human adenovirus A
aaagcaucccagc

SEQ ID NO: 3897467 - RNA, 18 nt, Human adenovirus A
aaaggaagcugcuguucu

SEQ ID NO: 3897468 - RNA, 16 nt, Human adenovirus A
aaaguaccaggaagcu

SEQ ID NO: 3897469 - RNA, 13 nt, Human adenovirus A
aaagucacaaggg

SEQ ID NO: 3897470 - RNA, 15 nt, Human adenovirus A
aaauaaccaguguua

SEQ ID NO: 3897471 - RNA, 15 nt, Human adenovirus A
aaauacacauaaaga

SEQ ID NO: 3897472 - RNA, 12 nt, Human adenovirus A
aaauauccagga

SEQ ID NO: 3897473 - RNA, 19 nt, Human adenovirus A
aaaucugaaaauacaucau

SEQ ID NO: 3897474 - RNA, 18 nt, Human adenovirus A
aaaugccuguuuuguauu

SEQ ID NO: 3897475 - RNA, 23 nt, Human adenovirus A
aaaugcuuuguuggauagcaaag

SEQ ID NO: 3897476 - RNA, 21 nt, Human adenovirus A
aaauggaacccuuacacucaa

SEQ ID NO: 3897477 - RNA, 20 nt, Human adenovirus A
aaaugguaggacgcugaaac

SEQ ID NO: 3897478 - RNA, 13 nt, Human adenovirus A
aaauuacacacua

SEQ ID NO: 3897479 - RNA, 21 nt, Human adenovirus A
aaauuguuuuuguucuuuuaa

SEQ ID NO: 3897480 - RNA, 18 nt, Human adenovirus A
aaauuuguugcuguugcc

SEQ ID NO: 3897481 - RNA, 14 nt, Human adenovirus A
aacacauacaguaa

SEQ ID NO: 3897482 - RNA, 19 nt, Human adenovirus A
aacacggaggacaauccaa

SEQ ID NO: 3897483 - RNA, 21 nt, Human adenovirus A
aacacgggcuggggacugggu

SEQ ID NO: 3897484 - RNA, 16 nt, Human adenovirus A
aacacgguacuuuucc

SEQ ID NO: 3897485 - RNA, 21 nt, Human adenovirus A
aacacugucagugaagcaaac

SEQ ID NO: 3897486 - RNA, 15 nt, Human adenovirus A
aacagacaauuccaa

SEQ ID NO: 3897487 - RNA, 20 nt, Human adenovirus A
aacagacuggggaauuugca

SEQ ID NO: 3897488 - RNA, 16 nt, Human adenovirus A
aacagcaaacuuucuc

SEQ ID NO: 3897489 - RNA, 22 nt, Human adenovirus A
aacagcgcaugcguaucucacu

SEQ ID NO: 3897490 - RNA, 13 nt, Human adenovirus A
aacagcuucuaaa

SEQ ID NO: 3897491 - RNA, 22 nt, Human adenovirus A
aacagcuucuaaaagagccaca

SEQ ID NO: 3897492 - RNA, 15 nt, Human adenovirus A
aacaucaacugugcu

SEQ ID NO: 3897493 - RNA, 16 nt, Human adenovirus A
aacaucgcaaaacacg

SEQ ID NO: 3897494 - RNA, 17 nt, Human adenovirus A
aacaucgcaaaacacgu

SEQ ID NO: 3897495 - RNA, 12 nt, Human adenovirus A
aaccaaauacug

SEQ ID NO: 3897496 - RNA, 18 nt, Human adenovirus A
aaccacauaggcauuggg

SEQ ID NO: 3897497 - RNA, 22 nt, Human adenovirus A
aaccaccgccaugcgcgcggcc

SEQ ID NO: 3897498 - RNA, 15 nt, Human adenovirus A
aaccacgaaaacggu

SEQ ID NO: 3897499 - RNA, 14 nt, Human adenovirus A
aaccacggccucag

SEQ ID NO: 3897500 - RNA, 23 nt, Human adenovirus A
aaccagcugggcagaaagcaaau

SEQ ID NO: 3897501 - RNA, 19 nt, Human adenovirus A
aaccauuuuauuagcucau

SEQ ID NO: 3897502 - RNA, 16 nt, Human adenovirus A
aacccaaacuguacaa

SEQ ID NO: 3897503 - RNA, 15 nt, Human adenovirus A
aacccugaauguuug

SEQ ID NO: 3897504 - RNA, 11 nt, Human adenovirus A
aacccuucccc

SEQ ID NO: 3897505 - RNA, 17 nt, Human adenovirus A
aaccgauugggaaaaag

SEQ ID NO: 3897506 - RNA, 15 nt, Human adenovirus A
aaccgucgcuuucaa

SEQ ID NO: 3897507 - RNA, 20 nt, Human adenovirus A
aaccugaucuagaaauugau

SEQ ID NO: 3897508 - RNA, 16 nt, Human adenovirus A
aacgaaaaugugccua

SEQ ID NO: 3897509 - RNA, 17 nt, Human adenovirus A
aacgaggugcagcugcc

SEQ ID NO: 3897510 - RNA, 12 nt, Human adenovirus A
aacgcugggcuc

SEQ ID NO: 3897511 - RNA, 22 nt, Human adenovirus A
aacggcgcgcaguccugaugcu

SEQ ID NO: 3897512 - RNA, 13 nt, Human adenovirus A
aacuacaaaaaag

SEQ ID NO: 3897513 - RNA, 17 nt, Human adenovirus A
aacuauggaaauccaaa

SEQ ID NO: 3897514 - RNA, 22 nt, Human adenovirus A
aacucagcccaugcucuagaca

SEQ ID NO: 3897515 - RNA, 21 nt, Human adenovirus A
cagcaaacuuucuccaaaucu

SEQ ID NO: 3897516 - RNA, 21 nt, Human adenovirus A
cagcaaagaaaguucaccucc

SEQ ID NO: 3897517 - RNA, 22 nt, Human adenovirus A
cagcaaagaaaguucaccucca

SEQ ID NO: 3897518 - RNA, 17 nt, Human adenovirus A
cagcaacggcaggaaau

SEQ ID NO: 3897519 - RNA, 14 nt, Human adenovirus A
cagcacgagagggg

SEQ ID NO: 3897520 - RNA, 20 nt, Human adenovirus A
cagcagugcggccuguugcc

SEQ ID NO: 3897521 - RNA, 16 nt, Human adenovirus A
cagccacaccgcggcg

SEQ ID NO: 3897522 - RNA, 15 nt, Human adenovirus A
cagccauaaugccuu

SEQ ID NO: 3897523 - RNA, 17 nt, Human adenovirus A
cagcccaacccuuccca

SEQ ID NO: 3897524 - RNA, 16 nt, Human adenovirus A
cagccgcuaccaucac

SEQ ID NO: 3897525 - RNA, 17 nt, Human adenovirus A
cagccguuucaggaagg

SEQ ID NO: 3897526 - RNA, 15 nt, Human adenovirus A
cagccugucuacaaa

SEQ ID NO: 3897527 - RNA, 16 nt, Human adenovirus A
cagccugucuacaaau

SEQ ID NO: 3897528 - RNA, 17 nt, Human adenovirus A
cagcgccaacaaaaacc

SEQ ID NO: 3897529 - RNA, 16 nt, Human adenovirus A
cagcgccgagccacag

SEQ ID NO: 3897530 - RNA, 14 nt, Human adenovirus A
cagcggggaggaag

SEQ ID NO: 3897531 - RNA, 16 nt, Human adenovirus A
cagcggggaggaagcu

SEQ ID NO: 3897532 - RNA, 15 nt, Human adenovirus A
cagcguccaugaaug

SEQ ID NO: 3897533 - RNA, 22 nt, Human adenovirus A
cagcucuuuuggauguaaaaaa

SEQ ID NO: 3897534 - RNA, 16 nt, Human adenovirus A
cagcugacgacaguag

SEQ ID NO: 3897535 - RNA, 20 nt, Human adenovirus A
cagcugcggccgcaacagcu

SEQ ID NO: 3897536 - RNA, 18 nt, Human adenovirus A
cagcuucagaugacugga

SEQ ID NO: 3897537 - RNA, 15 nt, Human adenovirus A
caggaggacacuggc

SEQ ID NO: 3897538 - RNA, 15 nt, Human adenovirus A
caggcaguacuucau

SEQ ID NO: 3897539 - RNA, 22 nt, Human adenovirus A
cagguaauacuuaauuucuaga

SEQ ID NO: 3897540 - RNA, 20 nt, Human adenovirus A
cagguauaaaggucgcacug

SEQ ID NO: 3897541 - RNA, 18 nt, Human adenovirus A
caggucccguaaaauaca

SEQ ID NO: 3897542 - RNA, 13 nt, Human adenovirus A
caguaacaaacug

SEQ ID NO: 3897543 - RNA, 13 nt, Human adenovirus A
caguaaucuuuuu

SEQ ID NO: 3897544 - RNA, 22 nt, Human adenovirus A
caguagauuuacauuaggcucc

SEQ ID NO: 3897545 - RNA, 18 nt, Human adenovirus A
caguaugcugaagaaaca

SEQ ID NO: 3897546 - RNA, 13 nt, Human adenovirus A
cagucaccaccag

SEQ ID NO: 3897547 - RNA, 22 nt, Human adenovirus A
cagucgcguggcauuugugccu

SEQ ID NO: 3897548 - RNA, 23 nt, Human adenovirus A
cagucuguuuaguccugcaguua

SEQ ID NO: 3897549 - RNA, 14 nt, Human adenovirus A
cagugaagcaaacc

SEQ ID NO: 3897550 - RNA, 17 nt, Human adenovirus A
cagugcggccuguugcc

SEQ ID NO: 3897551 - RNA, 18 nt, Human adenovirus A
caguggacaaaaacuaug

SEQ ID NO: 3897552 - RNA, 13 nt, Human adenovirus A
caguuuuaagccc

SEQ ID NO: 3897553 - RNA, 22 nt, Human adenovirus A
cauaaaagcuucaauuugccua

SEQ ID NO: 3897554 - RNA, 15 nt, Human adenovirus A
cauaagcugugaaaa

SEQ ID NO: 3897555 - RNA, 19 nt, Human adenovirus A
cauaaggagacguuuuugc

SEQ ID NO: 3897556 - RNA, 18 nt, Human adenovirus A
cauaauguaacccuuccc

SEQ ID NO: 3897557 - RNA, 15 nt, Human adenovirus A
cauaauuaaaggcgc

SEQ ID NO: 3897558 - RNA, 16 nt, Human adenovirus A
cauaauuuuaaaguaa

SEQ ID NO: 3897559 - RNA, 23 nt, Human adenovirus A
cauaccaguuaaugcuggaugcu

SEQ ID NO: 3897560 - RNA, 20 nt, Human adenovirus A
cauaccugggauuguguccu

SEQ ID NO: 3897561 - RNA, 20 nt, Human adenovirus A
cauacuuaccaaagccaugg

SEQ ID NO: 3897562 - RNA, 15 nt, Human adenovirus A
cauagccccaggucc

SEQ ID NO: 3897563 - RNA, 14 nt, Human adenovirus A
cauagccccucuaa

SEQ ID NO: 3897564 - RNA, 20 nt, Human adenovirus A
cauaggcaugugguccaggg

SEQ ID NO: 3897565 - RNA, 22 nt, Human adenovirus A
cauaguagagacaaugaaacuu

SEQ ID NO: 3897566 - RNA, 17 nt, Human adenovirus A
cauaguucuugauuuag

SEQ ID NO: 3897567 - RNA, 16 nt, Human adenovirus A
cauauagcucauguga

SEQ ID NO: 3897568 - RNA, 14 nt, Human adenovirus A
cauauuguggagaa

SEQ ID NO: 3897569 - RNA, 13 nt, Human adenovirus A
caucauacauaau

SEQ ID NO: 3897570 - RNA, 18 nt, Human adenovirus A
caucaugaaaacagcagc

SEQ ID NO: 3897571 - RNA, 19 nt, Human adenovirus A
cauccguggcaggccaucu

SEQ ID NO: 3897572 - RNA, 19 nt, Human adenovirus A
caucuaaaccuauaacaau

SEQ ID NO: 3897573 - RNA, 17 nt, Human adenovirus A
caucuauaguaaaaaug

SEQ ID NO: 3897574 - RNA, 21 nt, Human adenovirus A
caucuauaguaaaaaugccag

SEQ ID NO: 3897575 - RNA, 22 nt, Human adenovirus A
caucuauaguaaaaaugccagg

SEQ ID NO: 3897576 - RNA, 20 nt, Human adenovirus A
caucuggggggucggcaucu

SEQ ID NO: 3897577 - RNA, 14 nt, Human adenovirus A
caucuguuuacuuc

SEQ ID NO: 3897578 - RNA, 14 nt, Human adenovirus A
caugaaaacagcau

SEQ ID NO: 3897579 - RNA, 16 nt, Human adenovirus A
caugaccauguaauaa

SEQ ID NO: 3897580 - RNA, 18 nt, Human adenovirus A
caugauggaucaaaaaca

SEQ ID NO: 3897581 - RNA, 18 nt, Human adenovirus A
caugauguuaccaccgau

SEQ ID NO: 3897582 - RNA, 13 nt, Human adenovirus A
caugcaaagccag

SEQ ID NO: 3897583 - RNA, 22 nt, Human adenovirus A
caugcaucguuuuuucuccgac

SEQ ID NO: 3897584 - RNA, 23 nt, Human adenovirus A
caugcgcgcggccagagcguugg

SEQ ID NO: 3897585 - RNA, 17 nt, Human adenovirus A
caugcuauuaagcaagc

SEQ ID NO: 3897586 - RNA, 20 nt, Human adenovirus A
caugcuuuagguuagccuga

SEQ ID NO: 3897587 - RNA, 22 nt, Human adenovirus A
cauggaucguauuauggcuuua

SEQ ID NO: 3897588 - RNA, 19 nt, Human adenovirus A
cauggaugaauugcagccu

SEQ ID NO: 3897589 - RNA, 22 nt, Human adenovirus A
cauggcacauaacacagcuucu

SEQ ID NO: 3897590 - RNA, 13 nt, Human adenovirus A
cauggcuuccaug

SEQ ID NO: 3897591 - RNA, 20 nt, Human adenovirus A
caugggcaucuugcaugaaa

SEQ ID NO: 3897592 - RNA, 16 nt, Human adenovirus A
cauggugauuaaauau

SEQ ID NO: 3897593 - RNA, 17 nt, Human adenovirus A
caugugcgcacacuaau

SEQ ID NO: 3897594 - RNA, 17 nt, Human adenovirus A
cauguggagcuuucaac

SEQ ID NO: 3897595 - RNA, 16 nt, Human adenovirus A
cauguguugugcacuu

SEQ ID NO: 3897596 - RNA, 20 nt, Human adenovirus A
cauuaagaacacggugaaug

SEQ ID NO: 3897597 - RNA, 22 nt, Human adenovirus A
cauuaccagcagccaaaacuca

SEQ ID NO: 3897598 - RNA, 19 nt, Human adenovirus A
cauuaccgagcuccauggg

SEQ ID NO: 3897599 - RNA, 18 nt, Human adenovirus A
cauuacuuuuaaauacug

SEQ ID NO: 3897600 - RNA, 17 nt, Human adenovirus A
cauuaucaugaaacucu

SEQ ID NO: 3897601 - RNA, 16 nt, Human adenovirus A
cauucaugcugauguu

SEQ ID NO: 3897602 - RNA, 21 nt, Human adenovirus A
cauuccagagagcuacaagga

SEQ ID NO: 3897603 - RNA, 15 nt, Human adenovirus A
cauuccccaguuuaa

SEQ ID NO: 3897604 - RNA, 13 nt, Human adenovirus A
cauucgcagcgca

SEQ ID NO: 3897605 - RNA, 16 nt, Human adenovirus A
cauugaaaccagcgcc

SEQ ID NO: 3897606 - RNA, 18 nt, Human adenovirus A
cauugcgauaaacuggau

SEQ ID NO: 3897607 - RNA, 17 nt, Human adenovirus A
cauuggaguuaaguuug

SEQ ID NO: 3897608 - RNA, 13 nt, Human adenovirus A
cauuuacugcagc

SEQ ID NO: 3897609 - RNA, 15 nt, Human adenovirus A
cauuuauaaauguua

SEQ ID NO: 3897610 - RNA, 18 nt, Human adenovirus A
cauuugcgcccagacgua

SEQ ID NO: 3897611 - RNA, 21 nt, Human adenovirus A
cauuugugccucgucagaaca

SEQ ID NO: 3897612 - RNA, 16 nt, Human adenovirus A
cauuuuucccacuuua

SEQ ID NO: 3897613 - RNA, 21 nt, Human adenovirus A
ccaaauauccaggaggaauau

SEQ ID NO: 3897614 - RNA, 23 nt, Human adenovirus A
ccaacaaaacuuaucagccagag

SEQ ID NO: 3897615 - RNA, 20 nt, Human adenovirus A
ccaacggcacaugcgagcca

SEQ ID NO: 3897616 - RNA, 16 nt, Human adenovirus A
ccaagcguagccgcag

SEQ ID NO: 3897617 - RNA, 16 nt, Human adenovirus A
ccaaggaugacaacau

SEQ ID NO: 3897618 - RNA, 13 nt, Human adenovirus A
ccaauccaaaccc

SEQ ID NO: 3897619 - RNA, 18 nt, Human adenovirus A
ccaauuucguuccagacu

SEQ ID NO: 3897620 - RNA, 21 nt, Human adenovirus A
ccacagcuggcgcacaaguug

SEQ ID NO: 3897621 - RNA, 14 nt, Human adenovirus A
ccacauacaucacc

SEQ ID NO: 3897622 - RNA, 19 nt, Human adenovirus A
ccaccaaacugcagccuca

SEQ ID NO: 3897623 - RNA, 22 nt, Human adenovirus A
ccacccuguacgcaagcauuuu

SEQ ID NO: 3897624 - RNA, 18 nt, Human adenovirus A
ccaccgaucgcucgcagc

SEQ ID NO: 3897625 - RNA, 22 nt, Human adenovirus A
ccaccgucaauucuucuuccaa

SEQ ID NO: 3897626 - RNA, 16 nt, Human adenovirus A
ccaccguggcucccac

SEQ ID NO: 3897627 - RNA, 14 nt, Human adenovirus A
ccaccucuagaaac

SEQ ID NO: 3897628 - RNA, 17 nt, Human adenovirus A
ccaccuuggcuuucgag

SEQ ID NO: 3897629 - RNA, 20 nt, Human adenovirus A
ccacgccgcgccccacuucc

SEQ ID NO: 3897630 - RNA, 18 nt, Human adenovirus A
ccacgccuggguaccgug

SEQ ID NO: 3897631 - RNA, 12 nt, Human adenovirus A
ccacucuccuga

SEQ ID NO: 3897632 - RNA, 20 nt, Human adenovirus A
ccacugcgucaguaacaaac

SEQ ID NO: 3897633 - RNA, 23 nt, Human adenovirus A
ccacuguuguauuauuugaacac

SEQ ID NO: 3897634 - RNA, 14 nt, Human adenovirus A
ccagaagcacuggc

SEQ ID NO: 3897635 - RNA, 17 nt, Human adenovirus A
ccagagcaccccuuccc

SEQ ID NO: 3897636 - RNA, 15 nt, Human adenovirus A
ccagauuguggaaua

SEQ ID NO: 3897637 - RNA, 22 nt, Human adenovirus A
ccagcguucgcuuugacaacau

SEQ ID NO: 3897638 - RNA, 20 nt, Human adenovirus A
ccagcucacggugucagaau

SEQ ID NO: 3897639 - RNA, 19 nt, Human adenovirus A
ccagcugaacgggggcgcc

SEQ ID NO: 3897640 - RNA, 13 nt, Human adenovirus A
ccaggaagcugag

SEQ ID NO: 3897641 - RNA, 20 nt, Human adenovirus A
ccaggcauuuccaggugggg

SEQ ID NO: 3897642 - RNA, 15 nt, Human adenovirus A
ccaguacacuuggga

SEQ ID NO: 3897643 - RNA, 19 nt, Human adenovirus A
ccagugcuuucaacaaaaa

SEQ ID NO: 3897644 - RNA, 16 nt, Human adenovirus A
ccaguuuaaaggcugu

SEQ ID NO: 3897645 - RNA, 19 nt, Human adenovirus A
ccaucagaaauuuguugcu

SEQ ID NO: 3897646 - RNA, 17 nt, Human adenovirus A
ccauccguggcaggcca

SEQ ID NO: 3897647 - RNA, 11 nt, Human adenovirus A
ccaugcaaagc

SEQ ID NO: 3897648 - RNA, 15 nt, Human adenovirus A
ccauguaucagcagc

SEQ ID NO: 3897649 - RNA, 18 nt, Human adenovirus A
ccauguaucagcagccaa

SEQ ID NO: 3897650 - RNA, 20 nt, Human adenovirus A
ccauguaucagcagccaacu

SEQ ID NO: 3897651 - RNA, 22 nt, Human adenovirus A
ccauguggagguauaacaaaau

SEQ ID NO: 3897652 - RNA, 15 nt, Human adenovirus A
ccauuagcauagcca

SEQ ID NO: 3897653 - RNA, 19 nt, Human adenovirus A
cccaagcuaaccgcuuuuc

SEQ ID NO: 3897654 - RNA, 23 nt, Human adenovirus A
cccacgccgcgccccacuuccuc

SEQ ID NO: 3897655 - RNA, 22 nt, Human adenovirus A
cccagugccgccuuagacauga

SEQ ID NO: 3897656 - RNA, 12 nt, Human adenovirus A
cccccuccugga

SEQ ID NO: 3897657 - RNA, 23 nt, Human adenovirus A
cccccuuuguagcugaaaacaac

SEQ ID NO: 3897658 - RNA, 14 nt, Human adenovirus A
ccccuguggagcca

SEQ ID NO: 3897659 - RNA, 18 nt, Human adenovirus A
cccgacggaguguuucag

SEQ ID NO: 3897660 - RNA, 21 nt, Human adenovirus A
cccgacggaguguuucagcuc

SEQ ID NO: 3897661 - RNA, 21 nt, Human adenovirus A
cccgcgaaaaaaaucacuucc

SEQ ID NO: 3897662 - RNA, 14 nt, Human adenovirus A
cccggcguaaccaa

SEQ ID NO: 3897663 - RNA, 14 nt, Human adenovirus A
cccucuccaaugaa

SEQ ID NO: 3897664 - RNA, 16 nt, Human adenovirus A
ccgaggacgcacuggu

SEQ ID NO: 3897665 - RNA, 12 nt, Human adenovirus A
ccgcaaaacagg

SEQ ID NO: 3897666 - RNA, 17 nt, Human adenovirus A
ccgcacggccaaugccc

SEQ ID NO: 3897667 - RNA, 17 nt, Human adenovirus A
ccgcagcugucucuacc

SEQ ID NO: 3897668 - RNA, 20 nt, Human adenovirus A
ccgcgaaaaaaaucacuucc

SEQ ID NO: 3897669 - RNA, 15 nt, Human adenovirus A
ccgcgccccacuucc

SEQ ID NO: 3897670 - RNA, 19 nt, Human adenovirus A
ccgcgcgcggacuuucaac

SEQ ID NO: 3897671 - RNA, 15 nt, Human adenovirus A
ccgcgcugcggccau

SEQ ID NO: 3897672 - RNA, 18 nt, Human adenovirus A
ccgcgguuuuggcggcca

SEQ ID NO: 3897673 - RNA, 20 nt, Human adenovirus A
ccgcugugagcaaaucucag

SEQ ID NO: 3897674 - RNA, 17 nt, Human adenovirus A
ccggaguacgucagaau

SEQ ID NO: 3897675 - RNA, 21 nt, Human adenovirus A
ccggcuaauguuccgcguggu

SEQ ID NO: 3897676 - RNA, 16 nt, Human adenovirus A
ccgguugagcagaacu

SEQ ID NO: 3897677 - RNA, 17 nt, Human adenovirus A
ccguaaaauacacauaa

SEQ ID NO: 3897678 - RNA, 15 nt, Human adenovirus A
ccgucaucucuacag

SEQ ID NO: 3897679 - RNA, 18 nt, Human adenovirus A
ccgucuucguggagaagc

SEQ ID NO: 3897680 - RNA, 15 nt, Human adenovirus A
ccguuccuguugcau

SEQ ID NO: 3897681 - RNA, 18 nt, Human adenovirus A
ccuaaaauuuuugaaggu

SEQ ID NO: 3897682 - RNA, 17 nt, Human adenovirus A
ccuaauacaaaugcuua

SEQ ID NO: 3897683 - RNA, 21 nt, Human adenovirus A
ccuacauuggaguuggaagaa

SEQ ID NO: 3897684 - RNA, 12 nt, Human adenovirus A
ccuaccacugua

SEQ ID NO: 3897685 - RNA, 14 nt, Human adenovirus A
ccuacgguggcagc

SEQ ID NO: 3897686 - RNA, 20 nt, Human adenovirus A
ccuacuucacccugggaaac

SEQ ID NO: 3897687 - RNA, 17 nt, Human adenovirus A
ccuagcguacagccaga

SEQ ID NO: 3897688 - RNA, 15 nt, Human adenovirus A
ccuauccgucuccag

SEQ ID NO: 3897689 - RNA, 14 nt, Human adenovirus A
ccuaucuguugcua

SEQ ID NO: 3897690 - RNA, 22 nt, Human adenovirus A
ccucguacaggaauucugacca

SEQ ID NO: 3897691 - RNA, 17 nt, Human adenovirus A
ccugacacuacagagcu

SEQ ID NO: 3897692 - RNA, 17 nt, Human adenovirus A
ccugaguugggauuaca

SEQ ID NO: 3897693 - RNA, 12 nt, Human adenovirus A
ccugcagcacug

SEQ ID NO: 3897694 - RNA, 19 nt, Human adenovirus A
ccugccauugccgcacggc

SEQ ID NO: 3897695 - RNA, 22 nt, Human adenovirus A
ccuggagcgagaucuuccaaca

SEQ ID NO: 3897696 - RNA, 16 nt, Human adenovirus A
ccuggaggucuccaug

SEQ ID NO: 3897697 - RNA, 23 nt, Human adenovirus A
ccuggcaguuuuaaagcgcaaua

SEQ ID NO: 3897698 - RNA, 13 nt, Human adenovirus A
ccuguucucccca

SEQ ID NO: 3897699 - RNA, 20 nt, Human adenovirus A
ccuuaacuucuacccaguuu

SEQ ID NO: 3897700 - RNA, 17 nt, Human adenovirus A
ccuuacagaucacggga

SEQ ID NO: 3897701 - RNA, 14 nt, Human adenovirus A
ccuuagaagacaaa

SEQ ID NO: 3897702 - RNA, 18 nt, Human adenovirus A
ccuucaauuggaacagua

SEQ ID NO: 3897703 - RNA, 18 nt, Human adenovirus A
ccuucgaaaugcagggac

SEQ ID NO: 3897704 - RNA, 23 nt, Human adenovirus A
ccuucgagaacuaaacaaacugu

SEQ ID NO: 3897705 - RNA, 22 nt, Human adenovirus A
ccuucuggcguuacagcuucag

SEQ ID NO: 3897706 - RNA, 16 nt, Human adenovirus A
ccuucuuuauguuuua

SEQ ID NO: 3897707 - RNA, 14 nt, Human adenovirus A
ccuugaaaugccag

SEQ ID NO: 3897708 - RNA, 20 nt, Human adenovirus A
ccuugcagcgguuguaauaa

SEQ ID NO: 3897709 - RNA, 23 nt, Human adenovirus A
ccuugcuugacucucgggcgagu

SEQ ID NO: 3897710 - RNA, 12 nt, Human adenovirus A
ccuuugacaaac

SEQ ID NO: 3897711 - RNA, 14 nt, Human adenovirus A
cgaaaacagucugc

SEQ ID NO: 3897712 - RNA, 15 nt, Human adenovirus A
cgaacaguguuuuca

SEQ ID NO: 3897713 - RNA, 15 nt, Human adenovirus A
cgacaacagcugcug

SEQ ID NO: 3897714 - RNA, 16 nt, Human adenovirus A
cgacauuuagaccacu

SEQ ID NO: 3897715 - RNA, 21 nt, Human adenovirus A
cgaccuucauuuuuucugggg

SEQ ID NO: 3897716 - RNA, 13 nt, Human adenovirus A
cgacgggccaggc

SEQ ID NO: 3897717 - RNA, 22 nt, Human adenovirus A
cgacuaaugguuacugaagugc

SEQ ID NO: 3897718 - RNA, 19 nt, Human adenovirus A
cgagaaaguguuaaccauu

SEQ ID NO: 3897719 - RNA, 18 nt, Human adenovirus A
cgagaagaaguagccauu

SEQ ID NO: 3897720 - RNA, 13 nt, Human adenovirus A
cgagacugcauuu

SEQ ID NO: 3897721 - RNA, 14 nt, Human adenovirus A
cgaggcggugagca

SEQ ID NO: 3897722 - RNA, 15 nt, Human adenovirus A
cgagucaccaucacu

SEQ ID NO: 3897723 - RNA, 19 nt, Human adenovirus A
cgauaaacaaaagcaaagc

SEQ ID NO: 3897724 - RNA, 13 nt, Human adenovirus A
cgauaugaugcaa

SEQ ID NO: 3897725 - RNA, 20 nt, Human adenovirus A
cgaucguucaacuuugucca

SEQ ID NO: 3897726 - RNA, 17 nt, Human adenovirus A
cgaugaagcacgcagag

SEQ ID NO: 3897727 - RNA, 21 nt, Human adenovirus A
cgaugcucgcaaguaccgcgc

SEQ ID NO: 3897728 - RNA, 12 nt, Human adenovirus A
cgauuccaagga

SEQ ID NO: 3897729 - RNA, 23 nt, Human adenovirus A
cgcaagcuuucauugguccaggc

SEQ ID NO: 3897730 - RNA, 23 nt, Human adenovirus A
cgcaaguucaaagaagagcugcu

SEQ ID NO: 3897731 - RNA, 18 nt, Human adenovirus A
cgcaccgguugagcagaa

SEQ ID NO: 3897732 - RNA, 19 nt, Human adenovirus A
cgcacuggucgcaccacug

SEQ ID NO: 3897733 - RNA, 18 nt, Human adenovirus A
cgcagaagcucuguucaa

SEQ ID NO: 3897734 - RNA, 14 nt, Human adenovirus A
cgcagacggcugcg

SEQ ID NO: 3897735 - RNA, 15 nt, Human adenovirus A
cgcaggcuugcuaaa

SEQ ID NO: 3897736 - RNA, 20 nt, Human adenovirus A
cgcagucuuaguuuggcaga

SEQ ID NO: 3897737 - RNA, 15 nt, Human adenovirus A
cgcauuuuucccacu

SEQ ID NO: 3897738 - RNA, 17 nt, Human adenovirus A
cgccagcaagugccucc

SEQ ID NO: 3897739 - RNA, 20 nt, Human adenovirus A
cgcccauaacaucaggagca

SEQ ID NO: 3897740 - RNA, 14 nt, Human adenovirus A
cgccgcgacggcgg

SEQ ID NO: 3897741 - RNA, 13 nt, Human adenovirus A
cgccguccuauga

SEQ ID NO: 3897742 - RNA, 22 nt, Human adenovirus A
cgccugaaauauauggcccauc

SEQ ID NO: 3897743 - RNA, 14 nt, Human adenovirus A
cgccuuaacuucua

SEQ ID NO: 3897744 - RNA, 19 nt, Human adenovirus A
cgcgauacaacggccagcc

SEQ ID NO: 3897745 - RNA, 14 nt, Human adenovirus A
cgcgcaaguugacu

SEQ ID NO: 3897746 - RNA, 12 nt, Human adenovirus A
cgcgccacggac

SEQ ID NO: 3897747 - RNA, 20 nt, Human adenovirus A
cgcggccguacaugggcacc

SEQ ID NO: 3897748 - RNA, 14 nt, Human adenovirus A
cgcggggacagcgc

SEQ ID NO: 3897749 - RNA, 20 nt, Human adenovirus A
cgcguggcauuugugccucg

SEQ ID NO: 3897750 - RNA, 19 nt, Human adenovirus A
cgcgugucuucucccugug

SEQ ID NO: 3897751 - RNA, 16 nt, Human adenovirus A
cgcucgucaagccuac

SEQ ID NO: 3897752 - RNA, 21 nt, Human adenovirus A
aacucuaacugcucagcugga

SEQ ID NO: 3897753 - RNA, 23 nt, Human adenovirus A
aacugcuccccucaacagcacag

SEQ ID NO: 3897754 - RNA, 21 nt, Human adenovirus A
aacugggggcguacacuggcu

SEQ ID NO: 3897755 - RNA, 12 nt, Human adenovirus A
aacuuuagaaag

SEQ ID NO: 3897756 - RNA, 19 nt, Human adenovirus A
aacuuucuaccaaggaaaa

SEQ ID NO: 3897757 - RNA, 15 nt, Human adenovirus A
aacuuuuuacuaacu

SEQ ID NO: 3897758 - RNA, 20 nt, Human adenovirus A
aagaaagagaacaaacagug

SEQ ID NO: 3897759 - RNA, 16 nt, Human adenovirus A
aagaaggagaaggcau

SEQ ID NO: 3897760 - RNA, 17 nt, Human adenovirus A
aagaccaaaauuuucaa

SEQ ID NO: 3897761 - RNA, 14 nt, Human adenovirus A
aagaccaauccaaa

SEQ ID NO: 3897762 - RNA, 15 nt, Human adenovirus A
aagacuauagagagg

SEQ ID NO: 3897763 - RNA, 13 nt, Human adenovirus A
aagagcugcugca

SEQ ID NO: 3897764 - RNA, 18 nt, Human adenovirus A
aagagcuuaugcauagcu

SEQ ID NO: 3897765 - RNA, 21 nt, Human adenovirus A
aagcaaaccacauaggcauug

SEQ ID NO: 3897766 - RNA, 12 nt, Human adenovirus A
aagcaaaccacu

SEQ ID NO: 3897767 - RNA, 20 nt, Human adenovirus A
aagcaauaaaacaaggagcc

SEQ ID NO: 3897768 - RNA, 17 nt, Human adenovirus A
aagcagccauaaugccu

SEQ ID NO: 3897769 - RNA, 13 nt, Human adenovirus A
aagcaguagaaag

SEQ ID NO: 3897770 - RNA, 21 nt, Human adenovirus A
aagcauacuuaccaaagccau

SEQ ID NO: 3897771 - RNA, 16 nt, Human adenovirus A
aagcaucacacagaaa

SEQ ID NO: 3897772 - RNA, 18 nt, Human adenovirus A
aagcgacaaagagcuuau

SEQ ID NO: 3897773 - RNA, 18 nt, Human adenovirus A
aagcgacagaguugcuuu

SEQ ID NO: 3897774 - RNA, 23 nt, Human adenovirus A
aagcgcgacuaguccguuuucuu

SEQ ID NO: 3897775 - RNA, 23 nt, Human adenovirus A
aagcgcucgcgcuuuggaggcag

SEQ ID NO: 3897776 - RNA, 23 nt, Human adenovirus A
aagcgguaugucggccugacgcu

SEQ ID NO: 3897777 - RNA, 16 nt, Human adenovirus A
aagcuauuugagccuu

SEQ ID NO: 3897778 - RNA, 13 nt, Human adenovirus A
aagcucuguucaa

SEQ ID NO: 3897779 - RNA, 16 nt, Human adenovirus A
aaggagguuuguaagc

SEQ ID NO: 3897780 - RNA, 22 nt, Human adenovirus A
aaggauugguuccuaauacaaa

SEQ ID NO: 3897781 - RNA, 20 nt, Human adenovirus A
aaggcaucuagccagucaca

SEQ ID NO: 3897782 - RNA, 23 nt, Human adenovirus A
aaggccauguacuugacucuggc

SEQ ID NO: 3897783 - RNA, 12 nt, Human adenovirus A
aaggguccaggg

SEQ ID NO: 3897784 - RNA, 17 nt, Human adenovirus A
aaggguggggugcugcc

SEQ ID NO: 3897785 - RNA, 19 nt, Human adenovirus A
aagguaaugagcgcaguga

SEQ ID NO: 3897786 - RNA, 16 nt, Human adenovirus A
aagguacauuggcauu

SEQ ID NO: 3897787 - RNA, 22 nt, Human adenovirus A
aaguaaaccccuaacugcccag

SEQ ID NO: 3897788 - RNA, 15 nt, Human adenovirus A
aaguaaauuaaaugg

SEQ ID NO: 3897789 - RNA, 17 nt, Human adenovirus A
aagucaacccaaacugu

SEQ ID NO: 3897790 - RNA, 11 nt, Human adenovirus A
aagugccucaa

SEQ ID NO: 3897791 - RNA, 22 nt, Human adenovirus A
aaguuguggauaccacagaaua

SEQ ID NO: 3897792 - RNA, 14 nt, Human adenovirus A
aaguuuuguuucuu

SEQ ID NO: 3897793 - RNA, 14 nt, Human adenovirus A
aauaaaacuuccaa

SEQ ID NO: 3897794 - RNA, 16 nt, Human adenovirus A
aauaaaauuucuagaa

SEQ ID NO: 3897795 - RNA, 15 nt, Human adenovirus A
aauaauaaaaccauu

SEQ ID NO: 3897796 - RNA, 20 nt, Human adenovirus A
aauaaugcauuaccagcagc

SEQ ID NO: 3897797 - RNA, 17 nt, Human adenovirus A
aauacagucaaugcuuc

SEQ ID NO: 3897798 - RNA, 17 nt, Human adenovirus A
aauacugaaaaauagug

SEQ ID NO: 3897799 - RNA, 14 nt, Human adenovirus A
aauacugaacuauu

SEQ ID NO: 3897800 - RNA, 15 nt, Human adenovirus A
aauacuguuaccaau

SEQ ID NO: 3897801 - RNA, 21 nt, Human adenovirus A
aauaggggaugguuuaacauu

SEQ ID NO: 3897802 - RNA, 19 nt, Human adenovirus A
aauaguggcugcaagguca

SEQ ID NO: 3897803 - RNA, 16 nt, Human adenovirus A
aauaguuuaauguuuc

SEQ ID NO: 3897804 - RNA, 14 nt, Human adenovirus A
aaucagaagccagc

SEQ ID NO: 3897805 - RNA, 20 nt, Human adenovirus A
aauccaaggaugacaacauu

SEQ ID NO: 3897806 - RNA, 21 nt, Human adenovirus A
aaucccucgcccgcacaguca

SEQ ID NO: 3897807 - RNA, 16 nt, Human adenovirus A
aaucuacaaacuggaa

SEQ ID NO: 3897808 - RNA, 15 nt, Human adenovirus A
aaugcagcaaacacu

SEQ ID NO: 3897809 - RNA, 15 nt, Human adenovirus A
aaugcagcuguggag

SEQ ID NO: 3897810 - RNA, 22 nt, Human adenovirus A
aaugcaucuuugggacuuugua

SEQ ID NO: 3897811 - RNA, 18 nt, Human adenovirus A
aaugcccccauccaggug

SEQ ID NO: 3897812 - RNA, 20 nt, Human adenovirus A
aaugccuguuuuguauuauu

SEQ ID NO: 3897813 - RNA, 19 nt, Human adenovirus A
aaugcgccugcuuaaaauc

SEQ ID NO: 3897814 - RNA, 22 nt, Human adenovirus A
aauggaacuuuagaaaggaugu

SEQ ID NO: 3897815 - RNA, 19 nt, Human adenovirus A
aauggaguuggaaacugug

SEQ ID NO: 3897816 - RNA, 20 nt, Human adenovirus A
aaugguaggacgcugaaaca

SEQ ID NO: 3897817 - RNA, 22 nt, Human adenovirus A
aaugucuguuauguaugcccag

SEQ ID NO: 3897818 - RNA, 23 nt, Human adenovirus A
aauuucccucuucccaacuguca

SEQ ID NO: 3897819 - RNA, 18 nt, Human adenovirus A
aauuucuaauguggagcu

SEQ ID NO: 3897820 - RNA, 16 nt, Human adenovirus A
aauuuuauuggccuga

SEQ ID NO: 3897821 - RNA, 19 nt, Human adenovirus A
aauuuuuuagauuguuaua

SEQ ID NO: 3897822 - RNA, 20 nt, Human adenovirus A
acaaaucagaagccagcagc

SEQ ID NO: 3897823 - RNA, 21 nt, Human adenovirus A
acaacagcggcguaaacucau

SEQ ID NO: 3897824 - RNA, 22 nt, Human adenovirus A
acaacagcggcguaaacucaug

SEQ ID NO: 3897825 - RNA, 13 nt, Human adenovirus A
acaacaguacagg

SEQ ID NO: 3897826 - RNA, 23 nt, Human adenovirus A
acaacagucaguguccaucagcc

SEQ ID NO: 3897827 - RNA, 14 nt, Human adenovirus A
acaacauugaacuu

SEQ ID NO: 3897828 - RNA, 21 nt, Human adenovirus A
acaaccacucucgcaggcuug

SEQ ID NO: 3897829 - RNA, 16 nt, Human adenovirus A
acaacugcacuugaau

SEQ ID NO: 3897830 - RNA, 15 nt, Human adenovirus A
acaacuuuuaacauu

SEQ ID NO: 3897831 - RNA, 19 nt, Human adenovirus A
acaagaugaguaaagauau

SEQ ID NO: 3897832 - RNA, 17 nt, Human adenovirus A
acaagcacgccaaagcc

SEQ ID NO: 3897833 - RNA, 15 nt, Human adenovirus A
acaagcugcgcugcc

SEQ ID NO: 3897834 - RNA, 18 nt, Human adenovirus A
acaaggaccguuuucugc

SEQ ID NO: 3897835 - RNA, 22 nt, Human adenovirus A
acaaggaccguuuucugcagcg

SEQ ID NO: 3897836 - RNA, 20 nt, Human adenovirus A
acaaggucuuaaacuuucuu

SEQ ID NO: 3897837 - RNA, 14 nt, Human adenovirus A
acaagugaggcgcu

SEQ ID NO: 3897838 - RNA, 19 nt, Human adenovirus A
acaccuuuuguuaauuaag

SEQ ID NO: 3897839 - RNA, 13 nt, Human adenovirus A
acacgcugcccug

SEQ ID NO: 3897840 - RNA, 17 nt, Human adenovirus A
acacgguacuuuuccuu

SEQ ID NO: 3897841 - RNA, 18 nt, Human adenovirus A
acacuuacccuuuuaaug

SEQ ID NO: 3897842 - RNA, 20 nt, Human adenovirus A
acagaguugcuuuuagaugu

SEQ ID NO: 3897843 - RNA, 18 nt, Human adenovirus A
acagcagcaacaaggaaa

SEQ ID NO: 3897844 - RNA, 21 nt, Human adenovirus A
acagcuucagaugacuggaca

SEQ ID NO: 3897845 - RNA, 22 nt, Human adenovirus A
acagcuucagaugacuggacag

SEQ ID NO: 3897846 - RNA, 21 nt, Human adenovirus A
acagcuucuacuuuagaagcc

SEQ ID NO: 3897847 - RNA, 21 nt, Human adenovirus A
acaggaauucugaccacucug

SEQ ID NO: 3897848 - RNA, 19 nt, Human adenovirus A
acagguaguuuaagguggu

SEQ ID NO: 3897849 - RNA, 16 nt, Human adenovirus A
acaguaaccauuacuu

SEQ ID NO: 3897850 - RNA, 16 nt, Human adenovirus A
acaguugaaaaaggaa

SEQ ID NO: 3897851 - RNA, 13 nt, Human adenovirus A
acaguuuaacaca

SEQ ID NO: 3897852 - RNA, 15 nt, Human adenovirus A
acauaauccagcaag

SEQ ID NO: 3897853 - RNA, 23 nt, Human adenovirus A
acauacaacuugcacaaauggac

SEQ ID NO: 3897854 - RNA, 17 nt, Human adenovirus A
acauaggcauugggaau

SEQ ID NO: 3897855 - RNA, 21 nt, Human adenovirus A
acaugaagauuucugcuguca

SEQ ID NO: 3897856 - RNA, 16 nt, Human adenovirus A
acaugguaagcucuug

SEQ ID NO: 3897857 - RNA, 22 nt, Human adenovirus A
acauugcccuguaugcuaacuu

SEQ ID NO: 3897858 - RNA, 12 nt, Human adenovirus A
acauuuuaacug

SEQ ID NO: 3897859 - RNA, 12 nt, Human adenovirus A
accaaacugcag

SEQ ID NO: 3897860 - RNA, 13 nt, Human adenovirus A
accaacaaacacg

SEQ ID NO: 3897861 - RNA, 21 nt, Human adenovirus A
accaagcccucuccaaugaaa

SEQ ID NO: 3897862 - RNA, 20 nt, Human adenovirus A
accaccgaucgcucgcagcg

SEQ ID NO: 3897863 - RNA, 15 nt, Human adenovirus A
accaccucaaaaucu

SEQ ID NO: 3897864 - RNA, 19 nt, Human adenovirus A
accacggccucagcagcgg

SEQ ID NO: 3897865 - RNA, 19 nt, Human adenovirus A
accacucugacacaaaagc

SEQ ID NO: 3897866 - RNA, 18 nt, Human adenovirus A
accagcgucccaaaagca

SEQ ID NO: 3897867 - RNA, 11 nt, Human adenovirus A
accaggaagcu

SEQ ID NO: 3897868 - RNA, 18 nt, Human adenovirus A
accauguaauaauugagu

SEQ ID NO: 3897869 - RNA, 15 nt, Human adenovirus A
accauugaaaccagc

SEQ ID NO: 3897870 - RNA, 15 nt, Human adenovirus A
auccuguaguugcag

SEQ ID NO: 3897871 - RNA, 14 nt, Human adenovirus A
aucgcaagcaggcg

SEQ ID NO: 3897872 - RNA, 16 nt, Human adenovirus A
aucguauuauggcuuu

SEQ ID NO: 3897873 - RNA, 15 nt, Human adenovirus A
aucucagaaagccaa

SEQ ID NO: 3897874 - RNA, 13 nt, Human adenovirus A
aucuccugccacc

SEQ ID NO: 3897875 - RNA, 23 nt, Human adenovirus A
aucuggagcggucuuaaaaauuu

SEQ ID NO: 3897876 - RNA, 13 nt, Human adenovirus A
aucuuaaauggaa

SEQ ID NO: 3897877 - RNA, 19 nt, Human adenovirus A
augaaguuuugauuguauu

SEQ ID NO: 3897878 - RNA, 16 nt, Human adenovirus A
augauaaccuugcaaa

SEQ ID NO: 3897879 - RNA, 17 nt, Human adenovirus A
augauagagauaagcag

SEQ ID NO: 3897880 - RNA, 22 nt, Human adenovirus A
augauuuaagaguaguacaaau

SEQ ID NO: 3897881 - RNA, 12 nt, Human adenovirus A
augcaaagccag

SEQ ID NO: 3897882 - RNA, 14 nt, Human adenovirus A
augcaaagccagcc

SEQ ID NO: 3897883 - RNA, 14 nt, Human adenovirus A
augcagaggaaacc

SEQ ID NO: 3897884 - RNA, 18 nt, Human adenovirus A
augcgcauacccauucca

SEQ ID NO: 3897885 - RNA, 17 nt, Human adenovirus A
augcgggcagccaggcg

SEQ ID NO: 3897886 - RNA, 17 nt, Human adenovirus A
augcgggggaugaagga

SEQ ID NO: 3897887 - RNA, 15 nt, Human adenovirus A
augcuaugcaggcag

SEQ ID NO: 3897888 - RNA, 18 nt, Human adenovirus A
auggaaaaacuuggaaac

SEQ ID NO: 3897889 - RNA, 16 nt, Human adenovirus A
auggaaccccaaaucg

SEQ ID NO: 3897890 - RNA, 14 nt, Human adenovirus A
auggaauuacauuu

SEQ ID NO: 3897891 - RNA, 16 nt, Human adenovirus A
auggagugucacugcc

SEQ ID NO: 3897892 - RNA, 21 nt, Human adenovirus A
auggaguuggaaacugugcug

SEQ ID NO: 3897893 - RNA, 14 nt, Human adenovirus A
auggaucuggagcc

SEQ ID NO: 3897894 - RNA, 15 nt, Human adenovirus A
auggaugcgcuccug

SEQ ID NO: 3897895 - RNA, 17 nt, Human adenovirus A
auggcugaagaggaggg

SEQ ID NO: 3897896 - RNA, 23 nt, Human adenovirus A
auggcuucguaaaagucuacugc

SEQ ID NO: 3897897 - RNA, 12 nt, Human adenovirus A
augggaggagga

SEQ ID NO: 3897898 - RNA, 20 nt, Human adenovirus A
augggguggagauuuaaaaa

SEQ ID NO: 3897899 - RNA, 15 nt, Human adenovirus A
auggugauuaaauau

SEQ ID NO: 3897900 - RNA, 16 nt, Human adenovirus A
augguguuaugaaucu

SEQ ID NO: 3897901 - RNA, 23 nt, Human adenovirus A
auguaaacccuuuuaaccaccac

SEQ ID NO: 3897902 - RNA, 20 nt, Human adenovirus A
auguaaaggaggcgcuggcu

SEQ ID NO: 3897903 - RNA, 14 nt, Human adenovirus A
auguaucuggacau

SEQ ID NO: 3897904 - RNA, 14 nt, Human adenovirus A
augucgaaugcagg

SEQ ID NO: 3897905 - RNA, 15 nt, Human adenovirus A
augugauaacccuga

SEQ ID NO: 3897906 - RNA, 17 nt, Human adenovirus A
augugaugaaaguagaa

SEQ ID NO: 3897907 - RNA, 14 nt, Human adenovirus A
augugaugccggca

SEQ ID NO: 3897908 - RNA, 22 nt, Human adenovirus A
augugcuauuguuaacacugcc

SEQ ID NO: 3897909 - RNA, 15 nt, Human adenovirus A
auguguugugcacuu

SEQ ID NO: 3897910 - RNA, 23 nt, Human adenovirus A
auguguugugcacuuccuucaga

SEQ ID NO: 3897911 - RNA, 19 nt, Human adenovirus A
auguuaaauuaaagaugcc

SEQ ID NO: 3897912 - RNA, 13 nt, Human adenovirus A
auguuaaguuugg

SEQ ID NO: 3897913 - RNA, 19 nt, Human adenovirus A
auuaaaagggaagccaugg

SEQ ID NO: 3897914 - RNA, 21 nt, Human adenovirus A
auuaacuaagugguugggaac

SEQ ID NO: 3897915 - RNA, 14 nt, Human adenovirus A
auuacaugcuggau

SEQ ID NO: 3897916 - RNA, 23 nt, Human adenovirus A
auuaggcuuucuuccauuugauc

SEQ ID NO: 3897917 - RNA, 19 nt, Human adenovirus A
auuaguaacuccgggagug

SEQ ID NO: 3897918 - RNA, 14 nt, Human adenovirus A
auuaucaugaaacu

SEQ ID NO: 3897919 - RNA, 20 nt, Human adenovirus A
auuaugcuggaaccugaagu

SEQ ID NO: 3897920 - RNA, 21 nt, Human adenovirus A
auucagcuaacaaugcagcaa

SEQ ID NO: 3897921 - RNA, 18 nt, Human adenovirus A
auucauauuguggagaac

SEQ ID NO: 3897922 - RNA, 18 nt, Human adenovirus A
auucccagguaauuuuca

SEQ ID NO: 3897923 - RNA, 13 nt, Human adenovirus A
auuccgcagugga

SEQ ID NO: 3897924 - RNA, 20 nt, Human adenovirus A
auuccuuuggacgagggaaa

SEQ ID NO: 3897925 - RNA, 18 nt, Human adenovirus A
auucgcagcgcacuggca

SEQ ID NO: 3897926 - RNA, 16 nt, Human adenovirus A
auucgcgugccaggca

SEQ ID NO: 3897927 - RNA, 18 nt, Human adenovirus A
auucuggagaauaagcau

SEQ ID NO: 3897928 - RNA, 14 nt, Human adenovirus A
auucuguuggacac

SEQ ID NO: 3897929 - RNA, 18 nt, Human adenovirus A
auucuuccacuguuguau

SEQ ID NO: 3897930 - RNA, 18 nt, Human adenovirus A
auugaagggaauggcuau

SEQ ID NO: 3897931 - RNA, 15 nt, Human adenovirus A
auugaauaaaagcau

SEQ ID NO: 3897932 - RNA, 20 nt, Human adenovirus A
auugccgcacggccaaugcc

SEQ ID NO: 3897933 - RNA, 16 nt, Human adenovirus A
auugcgauaaacugga

SEQ ID NO: 3897934 - RNA, 21 nt, Human adenovirus A
auuggaguacaagcuugacug

SEQ ID NO: 3897935 - RNA, 14 nt, Human adenovirus A
auuguuaacacugc

SEQ ID NO: 3897936 - RNA, 14 nt, Human adenovirus A
auuuacugcagccu

SEQ ID NO: 3897937 - RNA, 15 nt, Human adenovirus A
auuucacaagacaca

SEQ ID NO: 3897938 - RNA, 14 nt, Human adenovirus A
auuucccucuuccc

SEQ ID NO: 3897939 - RNA, 16 nt, Human adenovirus A
auuucccucuucccaa

SEQ ID NO: 3897940 - RNA, 21 nt, Human adenovirus A
auuucgauaaacaaaagcaaa

SEQ ID NO: 3897941 - RNA, 14 nt, Human adenovirus A
auuucuuccuccug

SEQ ID NO: 3897942 - RNA, 18 nt, Human adenovirus A
auuucuuguucuuccucu

SEQ ID NO: 3897943 - RNA, 12 nt, Human adenovirus A
auuugaaugcgu

SEQ ID NO: 3897944 - RNA, 21 nt, Human adenovirus A
auuugcugaaaaaagucugga

SEQ ID NO: 3897945 - RNA, 15 nt, Human adenovirus A
auuuguugcuguugc

SEQ ID NO: 3897946 - RNA, 16 nt, Human adenovirus A
auuuugccagcucuug

SEQ ID NO: 3897947 - RNA, 16 nt, Human adenovirus A
caaaaaguaaacuguc

SEQ ID NO: 3897948 - RNA, 14 nt, Human adenovirus A
caaaaaguaacaac

SEQ ID NO: 3897949 - RNA, 12 nt, Human adenovirus A
caaaacacaaau

SEQ ID NO: 3897950 - RNA, 20 nt, Human adenovirus A
caaaagauccguacaaggca

SEQ ID NO: 3897951 - RNA, 23 nt, Human adenovirus A
caaaauaccccuauccugucgag

SEQ ID NO: 3897952 - RNA, 17 nt, Human adenovirus A
caaaaucuaagccaugc

SEQ ID NO: 3897953 - RNA, 23 nt, Human adenovirus A
gagcucccggaggaagcggcggu

SEQ ID NO: 3897954 - RNA, 17 nt, Human adenovirus A
gagcugcugcaggccuu

SEQ ID NO: 3897955 - RNA, 21 nt, Human adenovirus A
gaggcgcgcgaguuaagaaaa

SEQ ID NO: 3897956 - RNA, 14 nt, Human adenovirus A
gaggcgcuggcuca

SEQ ID NO: 3897957 - RNA, 17 nt, Human adenovirus A
gaggcguagaugugcug

SEQ ID NO: 3897958 - RNA, 13 nt, Human adenovirus A
gaggcuggcacgc

SEQ ID NO: 3897959 - RNA, 14 nt, Human adenovirus A
gaggucuccauguc

SEQ ID NO: 3897960 - RNA, 15 nt, Human adenovirus A
gagucucaaaagcag

SEQ ID NO: 3897961 - RNA, 21 nt, Human adenovirus A
gaguuaggucaucguaggaca

SEQ ID NO: 3897962 - RNA, 22 nt, Human adenovirus A
gauacagcgcugauuaugcauu

SEQ ID NO: 3897963 - RNA, 14 nt, Human adenovirus A
gauagcaagcguaa

SEQ ID NO: 3897964 - RNA, 13 nt, Human adenovirus A
gauagcaccugcc

SEQ ID NO: 3897965 - RNA, 18 nt, Human adenovirus A
gauauaguacugcuucca

SEQ ID NO: 3897966 - RNA, 23 nt, Human adenovirus A
gauauaguacugcuuccagguug

SEQ ID NO: 3897967 - RNA, 20 nt, Human adenovirus A
gaucaacgacuaaaacaaau

SEQ ID NO: 3897968 - RNA, 18 nt, Human adenovirus A
gaucggcacgagccagcu

SEQ ID NO: 3897969 - RNA, 14 nt, Human adenovirus A
gaucuagaaauuga

SEQ ID NO: 3897970 - RNA, 21 nt, Human adenovirus A
gaucuagaaauugauggaaga

SEQ ID NO: 3897971 - RNA, 22 nt, Human adenovirus A
gaucuucggguggacggagcca

SEQ ID NO: 3897972 - RNA, 20 nt, Human adenovirus A
gaugaaaaacgagcagcaaa

SEQ ID NO: 3897973 - RNA, 21 nt, Human adenovirus A
gaugcauaaugcggacgggcg

SEQ ID NO: 3897974 - RNA, 20 nt, Human adenovirus A
gaugcaugggcuaaaccaag

SEQ ID NO: 3897975 - RNA, 16 nt, Human adenovirus A
gaugcgagcaauaacc

SEQ ID NO: 3897976 - RNA, 17 nt, Human adenovirus A
gaugcgggcagccaggc

SEQ ID NO: 3897977 - RNA, 16 nt, Human adenovirus A
gauggaucaaaaacaa

SEQ ID NO: 3897978 - RNA, 22 nt, Human adenovirus A
gauggauuaccuucaccgcgcu

SEQ ID NO: 3897979 - RNA, 20 nt, Human adenovirus A
gauggguguuuggcagcaau

SEQ ID NO: 3897980 - RNA, 19 nt, Human adenovirus A
gauuaaauauaucuuuuaa

SEQ ID NO: 3897981 - RNA, 22 nt, Human adenovirus A
gauuacaugucaaugcagcugu

SEQ ID NO: 3897982 - RNA, 16 nt, Human adenovirus A
gauuaugguucagcuu

SEQ ID NO: 3897983 - RNA, 17 nt, Human adenovirus A
gauucauauuguggaga

SEQ ID NO: 3897984 - RNA, 14 nt, Human adenovirus A
gauucuucuuccca

SEQ ID NO: 3897985 - RNA, 15 nt, Human adenovirus A
gauugcgaacaacaa

SEQ ID NO: 3897986 - RNA, 14 nt, Human adenovirus A
gauuucagcuucua

SEQ ID NO: 3897987 - RNA, 15 nt, Human adenovirus A
gauuucugcugucau

SEQ ID NO: 3897988 - RNA, 17 nt, Human adenovirus A
gcaaagaaacacaugau

SEQ ID NO: 3897989 - RNA, 17 nt, Human adenovirus A
gcaaauauaaaagcaca

SEQ ID NO: 3897990 - RNA, 17 nt, Human adenovirus A
gcaaaucucagaaagcc

SEQ ID NO: 3897991 - RNA, 20 nt, Human adenovirus A
gcaaaugcauuaucaugaaa

SEQ ID NO: 3897992 - RNA, 19 nt, Human adenovirus A
gcaaaugcccugcaaaaag

SEQ ID NO: 3897993 - RNA, 18 nt, Human adenovirus A
gcaaauuacgcaacaacu

SEQ ID NO: 3897994 - RNA, 20 nt, Human adenovirus A
gcaacagcagcaacaaggaa

SEQ ID NO: 3897995 - RNA, 22 nt, Human adenovirus A
gcaacauaccauauuuucuuua

SEQ ID NO: 3897996 - RNA, 23 nt, Human adenovirus A
gcaacuuuuuaaccacuguagug

SEQ ID NO: 3897997 - RNA, 16 nt, Human adenovirus A
gcaagaggagaaggag

SEQ ID NO: 3897998 - RNA, 18 nt, Human adenovirus A
gcaagcgugcaaacagac

SEQ ID NO: 3897999 - RNA, 20 nt, Human adenovirus A
gcaaguguaauuuuccagcg

SEQ ID NO: 3898000 - RNA, 17 nt, Human adenovirus A
gcaauaaaauaggggua

SEQ ID NO: 3898001 - RNA, 16 nt, Human adenovirus A
gcaauauuccagcucu

SEQ ID NO: 3898002 - RNA, 20 nt, Human adenovirus A
gcacaggcggguaagagcag

SEQ ID NO: 3898003 - RNA, 23 nt, Human adenovirus A
gcaccuugcaggacgcagaagcu

SEQ ID NO: 3898004 - RNA, 16 nt, Human adenovirus A
gcacgagccagcugaa

SEQ ID NO: 3898005 - RNA, 21 nt, Human adenovirus A
gcacugaaaaaccaacaaaca

SEQ ID NO: 3898006 - RNA, 14 nt, Human adenovirus A
gcacugggccagga

SEQ ID NO: 3898007 - RNA, 15 nt, Human adenovirus A
gcagacaagguggcc

SEQ ID NO: 3898008 - RNA, 13 nt, Human adenovirus A
gcagacaguggcu

SEQ ID NO: 3898009 - RNA, 18 nt, Human adenovirus A
gcagaccuacgguggcag

SEQ ID NO: 3898010 - RNA, 18 nt, Human adenovirus A
gcagcaaaugcccugcaa

SEQ ID NO: 3898011 - RNA, 16 nt, Human adenovirus A
gcagcaacaaggaaag

SEQ ID NO: 3898012 - RNA, 17 nt, Human adenovirus A
gcagcaaugcuuggaag

SEQ ID NO: 3898013 - RNA, 15 nt, Human adenovirus A
gcagcaccuggagcg

SEQ ID NO: 3898014 - RNA, 18 nt, Human adenovirus A
gcaggcuggaggugcagg

SEQ ID NO: 3898015 - RNA, 16 nt, Human adenovirus A
gcaguauaccucuaaa

SEQ ID NO: 3898016 - RNA, 20 nt, Human adenovirus A
gcaguauaccucuaaaaaca

SEQ ID NO: 3898017 - RNA, 20 nt, Human adenovirus A
gcagucuugaaugcucugga

SEQ ID NO: 3898018 - RNA, 19 nt, Human adenovirus A
gcaguuuagaggccacacu

SEQ ID NO: 3898019 - RNA, 15 nt, Human adenovirus A
gcauagaaaaagcua

SEQ ID NO: 3898020 - RNA, 14 nt, Human adenovirus A
gcaucgacagugag

SEQ ID NO: 3898021 - RNA, 15 nt, Human adenovirus A
gcaucugcacgguaa

SEQ ID NO: 3898022 - RNA, 12 nt, Human adenovirus A
gcaucuguucca

SEQ ID NO: 3898023 - RNA, 14 nt, Human adenovirus A
gcaucuugcaugaa

SEQ ID NO: 3898024 - RNA, 19 nt, Human adenovirus A
gcauggaaaaacuuggaaa

SEQ ID NO: 3898025 - RNA, 19 nt, Human adenovirus A
gcauguuugacaagauugu

SEQ ID NO: 3898026 - RNA, 13 nt, Human adenovirus A
gcauuaggccauc

SEQ ID NO: 3898027 - RNA, 12 nt, Human adenovirus A
gcauuaguucuu

SEQ ID NO: 3898028 - RNA, 21 nt, Human adenovirus A
gcauuccccauccaaaaccag

SEQ ID NO: 3898029 - RNA, 18 nt, Human adenovirus A
gccaagcgcucgcgcuuu

SEQ ID NO: 3898030 - RNA, 14 nt, Human adenovirus A
gccaaucaggcugu

SEQ ID NO: 3898031 - RNA, 13 nt, Human adenovirus A
gccacaccuccac

SEQ ID NO: 3898032 - RNA, 15 nt, Human adenovirus A
gccacaccuccaccc

SEQ ID NO: 3898033 - RNA, 17 nt, Human adenovirus A
gccacaccuccacccaa

SEQ ID NO: 3898034 - RNA, 15 nt, Human adenovirus A
gccacaugggaaggg

SEQ ID NO: 3898035 - RNA, 15 nt, Human adenovirus A
gccaccauagccccu

SEQ ID NO: 3898036 - RNA, 23 nt, Human adenovirus A
gccacccuacgugccuccccgcu

SEQ ID NO: 3898037 - RNA, 21 nt, Human adenovirus A
gccacgcuuugaccggucagg

SEQ ID NO: 3898038 - RNA, 22 nt, Human adenovirus A
gccacgcuuugaccggucaggc

SEQ ID NO: 3898039 - RNA, 14 nt, Human adenovirus A
gccagaacccacua

SEQ ID NO: 3898040 - RNA, 16 nt, Human adenovirus A
gccagcagcaaagaaa

SEQ ID NO: 3898041 - RNA, 17 nt, Human adenovirus A
gccaggguaaugguggc

SEQ ID NO: 3898042 - RNA, 18 nt, Human adenovirus A
gccaguacacuugggaaa

SEQ ID NO: 3898043 - RNA, 21 nt, Human adenovirus A
gccaguucguacgcguccacc

SEQ ID NO: 3898044 - RNA, 18 nt, Human adenovirus A
gccaucggccauaggcau

SEQ ID NO: 3898045 - RNA, 16 nt, Human adenovirus A
gccaugcaaagccagc

SEQ ID NO: 3898046 - RNA, 17 nt, Human adenovirus A
gccauuccugcagcacu

SEQ ID NO: 3898047 - RNA, 17 nt, Human adenovirus A
gccauuuuggaagcagu

SEQ ID NO: 3898048 - RNA, 16 nt, Human adenovirus A
gcccacaaggaaauga

SEQ ID NO: 3898049 - RNA, 15 nt, Human adenovirus A
gcccagcuguucuua

SEQ ID NO: 3898050 - RNA, 18 nt, Human adenovirus A
gcccauguaucagcagcc

SEQ ID NO: 3898051 - RNA, 12 nt, Human adenovirus A
gccccacuuccu

SEQ ID NO: 3898052 - RNA, 21 nt, Human adenovirus A
gccccauccguggcaggccau

SEQ ID NO: 3898053 - RNA, 13 nt, Human adenovirus A
gcccgccgccgga

SEQ ID NO: 3898054 - RNA, 17 nt, Human adenovirus A
gccgacguugcaagagg

SEQ ID NO: 3898055 - RNA, 14 nt, Human adenovirus A
gccgcaaaacaggc

SEQ ID NO: 3898056 - RNA, 15 nt, Human adenovirus A
gccguaccuuuuguu

SEQ ID NO: 3898057 - RNA, 15 nt, Human adenovirus A
gccuaaaagcuauuu

SEQ ID NO: 3898058 - RNA, 16 nt, Human adenovirus A
gccuacacaacacaaa

SEQ ID NO: 3898059 - RNA, 17 nt, Human adenovirus A
gccucauacaagagcua

SEQ ID NO: 3898060 - RNA, 15 nt, Human adenovirus A
gccugacgcucuggc

SEQ ID NO: 3898061 - RNA, 22 nt, Human adenovirus A
gccuguuuuguauuauugaagg

SEQ ID NO: 3898062 - RNA, 16 nt, Human adenovirus A
gccuucauuccuucag

SEQ ID NO: 3898063 - RNA, 21 nt, Human adenovirus A
gcgacaaagagcuuaugcaua

SEQ ID NO: 3898064 - RNA, 18 nt, Human adenovirus A
gcgagcgacugcugcgug

SEQ ID NO: 3898065 - RNA, 13 nt, Human adenovirus A
gcgagcugccacc

SEQ ID NO: 3898066 - RNA, 21 nt, Human adenovirus A
gcgagucaccaucacugacgc

SEQ ID NO: 3898067 - RNA, 17 nt, Human adenovirus A
gcgcaccaucuccauuc

SEQ ID NO: 3898068 - RNA, 16 nt, Human adenovirus A
gcgcacugggccagga

SEQ ID NO: 3898069 - RNA, 14 nt, Human adenovirus A
uccaauuuguggag

SEQ ID NO: 3898070 - RNA, 21 nt, Human adenovirus A
uccaggggaaacccauuugca

SEQ ID NO: 3898071 - RNA, 15 nt, Human adenovirus A
uccagucauagcaac

SEQ ID NO: 3898072 - RNA, 22 nt, Human adenovirus A
uccauaaggcggcguccuuucu

SEQ ID NO: 3898073 - RNA, 19 nt, Human adenovirus A
uccaucuguuuacuucaau

SEQ ID NO: 3898074 - RNA, 23 nt, Human adenovirus A
ucccagcuaacgccaccagcgug

SEQ ID NO: 3898075 - RNA, 17 nt, Human adenovirus A
ucccauuggucccaucc

SEQ ID NO: 3898076 - RNA, 23 nt, Human adenovirus A
ucccgcgguuuuggcggccaugc

SEQ ID NO: 3898077 - RNA, 14 nt, Human adenovirus A
ucccucuucccaac

SEQ ID NO: 3898078 - RNA, 15 nt, Human adenovirus A
uccggaaacaacacg

SEQ ID NO: 3898079 - RNA, 15 nt, Human adenovirus A
uccuaaaacugcucu

SEQ ID NO: 3898080 - RNA, 20 nt, Human adenovirus A
uccuaccacuguacuuuugc

SEQ ID NO: 3898081 - RNA, 22 nt, Human adenovirus A
uccuaggcaacguuggcagcga

SEQ ID NO: 3898082 - RNA, 13 nt, Human adenovirus A
uccuccuggaggu

SEQ ID NO: 3898083 - RNA, 21 nt, Human adenovirus A
uccucuguaguuucuuuacaa

SEQ ID NO: 3898084 - RNA, 15 nt, Human adenovirus A
uccugcgacaaaugc

SEQ ID NO: 3898085 - RNA, 19 nt, Human adenovirus A
uccuguaguugcagcagaa

SEQ ID NO: 3898086 - RNA, 15 nt, Human adenovirus A
ucgagaacuaaacaa

SEQ ID NO: 3898087 - RNA, 20 nt, Human adenovirus A
ucgcaauuagggccagcauu

SEQ ID NO: 3898088 - RNA, 20 nt, Human adenovirus A
ucgccagcaagugccuccuc

SEQ ID NO: 3898089 - RNA, 12 nt, Human adenovirus A
ucgccagcagcc

SEQ ID NO: 3898090 - RNA, 23 nt, Human adenovirus A
ucgccuaaaaacuaaagaaacuc

SEQ ID NO: 3898091 - RNA, 16 nt, Human adenovirus A
ucgcgcauaggaggag

SEQ ID NO: 3898092 - RNA, 22 nt, Human adenovirus A
ucgcuuucaaccaagcccucuc

SEQ ID NO: 3898093 - RNA, 20 nt, Human adenovirus A
ucggcacgagccagcugaac

SEQ ID NO: 3898094 - RNA, 17 nt, Human adenovirus A
ucgggcgaguucuccau

SEQ ID NO: 3898095 - RNA, 16 nt, Human adenovirus A
ucguccaagaucuuug

SEQ ID NO: 3898096 - RNA, 23 nt, Human adenovirus A
ucuaaaagagccacagcucugau

SEQ ID NO: 3898097 - RNA, 17 nt, Human adenovirus A
ucuaaauccgcauuggu

SEQ ID NO: 3898098 - RNA, 18 nt, Human adenovirus A
ucuaacugcucagcugga

SEQ ID NO: 3898099 - RNA, 13 nt, Human adenovirus A
ucuaccaaggaaa

SEQ ID NO: 3898100 - RNA, 21 nt, Human adenovirus A
ucuacccaguuuuugcagugc

SEQ ID NO: 3898101 - RNA, 20 nt, Human adenovirus A
ucuacuaacaacuccagaug

SEQ ID NO: 3898102 - RNA, 14 nt, Human adenovirus A
ucuacucauacccc

SEQ ID NO: 3898103 - RNA, 20 nt, Human adenovirus A
ucuagccaacauccagugcg

SEQ ID NO: 3898104 - RNA, 13 nt, Human adenovirus A
ucuaguccaagca

SEQ ID NO: 3898105 - RNA, 13 nt, Human adenovirus A
ucucagugucauu

SEQ ID NO: 3898106 - RNA, 14 nt, Human adenovirus A
ucucagugucauuu

SEQ ID NO: 3898107 - RNA, 20 nt, Human adenovirus A
ucuccuaaauauccaaagua

SEQ ID NO: 3898108 - RNA, 13 nt, Human adenovirus A
ucucgauccagca

SEQ ID NO: 3898109 - RNA, 17 nt, Human adenovirus A
ucucgcagcucuuauuu

SEQ ID NO: 3898110 - RNA, 12 nt, Human adenovirus A
ucugcugucauu

SEQ ID NO: 3898111 - RNA, 19 nt, Human adenovirus A
ucuggaucuucaaacaccu

SEQ ID NO: 3898112 - RNA, 16 nt, Human adenovirus A
ucugggguuaagcagu

SEQ ID NO: 3898113 - RNA, 23 nt, Human adenovirus A
ucuuaguuuggcagacaaggugg

SEQ ID NO: 3898114 - RNA, 22 nt, Human adenovirus A
ucuucguggagaagcggagcca

SEQ ID NO: 3898115 - RNA, 18 nt, Human adenovirus A
ucuugcauuaaccuuucc

SEQ ID NO: 3898116 - RNA, 20 nt, Human adenovirus A
ucuugcuuuaagggcuggcg

SEQ ID NO: 3898117 - RNA, 11 nt, Human adenovirus A
ucuuggagugu

SEQ ID NO: 3898118 - RNA, 17 nt, Human adenovirus A
ucuuuacaacuguaugc

SEQ ID NO: 3898119 - RNA, 17 nt, Human adenovirus A
ugaaaaacgagcagcaa

SEQ ID NO: 3898120 - RNA, 13 nt, Human adenovirus A
ugaaaguagaaau

SEQ ID NO: 3898121 - RNA, 15 nt, Human adenovirus A
ugaaaguagaaaucu

SEQ ID NO: 3898122 - RNA, 22 nt, Human adenovirus A
ugaaauaaagcguucuguggau

SEQ ID NO: 3898123 - RNA, 13 nt, Human adenovirus A
ugaacaaaaucac

SEQ ID NO: 3898124 - RNA, 23 nt, Human adenovirus A
ugaacgucgccugaguuaucuug

SEQ ID NO: 3898125 - RNA, 18 nt, Human adenovirus A
ugaaguguaucagucugg

SEQ ID NO: 3898126 - RNA, 22 nt, Human adenovirus A
ugaaguuuugauuguauuuuga

SEQ ID NO: 3898127 - RNA, 19 nt, Human adenovirus A
ugaauaagccaccgcucau

SEQ ID NO: 3898128 - RNA, 15 nt, Human adenovirus A
ugaauacuuaaauga

SEQ ID NO: 3898129 - RNA, 15 nt, Human adenovirus A
ugaaugcucuggaca

SEQ ID NO: 3898130 - RNA, 19 nt, Human adenovirus A
ugaauggaacaccagcauu

SEQ ID NO: 3898131 - RNA, 18 nt, Human adenovirus A
ugaauuguauaaauucuu

SEQ ID NO: 3898132 - RNA, 21 nt, Human adenovirus A
ugaauuguauaaauucuuaaa

SEQ ID NO: 3898133 - RNA, 14 nt, Human adenovirus A
ugacaacauugccc

SEQ ID NO: 3898134 - RNA, 13 nt, Human adenovirus A
ugacacaucagac

SEQ ID NO: 3898135 - RNA, 19 nt, Human adenovirus A
ugacacuguggacaacucc

SEQ ID NO: 3898136 - RNA, 14 nt, Human adenovirus A
ugacauugcuucau

SEQ ID NO: 3898137 - RNA, 21 nt, Human adenovirus A
ugaccccaucuuguuuccagu

SEQ ID NO: 3898138 - RNA, 23 nt, Human adenovirus A
ugaccgaauccacaaagcaguaa

SEQ ID NO: 3898139 - RNA, 20 nt, Human adenovirus A
ugacuggacagcggccaugg

SEQ ID NO: 3898140 - RNA, 14 nt, Human adenovirus A
ugagacuucccaca

SEQ ID NO: 3898141 - RNA, 21 nt, Human adenovirus A
ugagacuucccacagccagug

SEQ ID NO: 3898142 - RNA, 17 nt, Human adenovirus A
ugagccauguugugcau

SEQ ID NO: 3898143 - RNA, 20 nt, Human adenovirus A
ugagcccgaaguugacuggc

SEQ ID NO: 3898144 - RNA, 17 nt, Human adenovirus A
ugaggagcugagaagug

SEQ ID NO: 3898145 - RNA, 15 nt, Human adenovirus A
ugagugggcagaauu

SEQ ID NO: 3898146 - RNA, 21 nt, Human adenovirus A
ugauagagauaagcaggaaaa

SEQ ID NO: 3898147 - RNA, 15 nt, Human adenovirus A
ugauaucuugaaucu

SEQ ID NO: 3898148 - RNA, 20 nt, Human adenovirus A
ugaucaauuucuuccuccug

SEQ ID NO: 3898149 - RNA, 16 nt, Human adenovirus A
ugaucugucagugaaa

SEQ ID NO: 3898150 - RNA, 17 nt, Human adenovirus A
ugauggaucuggagcca

SEQ ID NO: 3898151 - RNA, 14 nt, Human adenovirus A
ugauuucagcuucu

SEQ ID NO: 3898152 - RNA, 14 nt, Human adenovirus A
ugauuuuacagaga

SEQ ID NO: 3898153 - RNA, 16 nt, Human adenovirus A
ugauuuuauccuacaa

SEQ ID NO: 3898154 - RNA, 12 nt, Human adenovirus A
ugcaaacagcaa

SEQ ID NO: 3898155 - RNA, 19 nt, Human adenovirus A
ugcaagaggagaaggagga

SEQ ID NO: 3898156 - RNA, 14 nt, Human adenovirus A
ugcaagugauaguu

SEQ ID NO: 3898157 - RNA, 12 nt, Human adenovirus A
ugcaaugcuuaa

SEQ ID NO: 3898158 - RNA, 19 nt, Human adenovirus A
ugcacaucgccggucagga

SEQ ID NO: 3898159 - RNA, 17 nt, Human adenovirus A
ugcacguacuagccccu

SEQ ID NO: 3898160 - RNA, 14 nt, Human adenovirus A
ugcagagcauugug

SEQ ID NO: 3898161 - RNA, 19 nt, Human adenovirus A
ugcagccuacaaugcaacu

SEQ ID NO: 3898162 - RNA, 16 nt, Human adenovirus A
ugcaggacgcagaagc

SEQ ID NO: 3898163 - RNA, 16 nt, Human adenovirus A
ugcaggaucaaaacac

SEQ ID NO: 3898164 - RNA, 21 nt, Human adenovirus A
ugcagguaauacuuaauuucu

SEQ ID NO: 3898165 - RNA, 14 nt, Human adenovirus A
ugcauagcuuacaa

SEQ ID NO: 3898166 - RNA, 17 nt, Human adenovirus A
ugcaucauuacuucaaa

SEQ ID NO: 3898167 - RNA, 17 nt, Human adenovirus A
ugcaucuacgaacgcaa

SEQ ID NO: 3898168 - RNA, 17 nt, Human adenovirus A
ugcauguccagauuuca

SEQ ID NO: 3898169 - RNA, 16 nt, Human adenovirus A
ugcauuaccagcagcc

SEQ ID NO: 3898170 - RNA, 20 nt, Human adenovirus A
ugccggauugcgaacaacaa

SEQ ID NO: 3898171 - RNA, 15 nt, Human adenovirus A
ugcgaacaacaacaa

SEQ ID NO: 3898172 - RNA, 17 nt, Human adenovirus A
ugcguagcaguaucagu

SEQ ID NO: 3898173 - RNA, 15 nt, Human adenovirus A
ugcuaaauuggccuu

SEQ ID NO: 3898174 - RNA, 20 nt, Human adenovirus A
ugcuauuauugagcauuauu

SEQ ID NO: 3898175 - RNA, 22 nt, Human adenovirus A
ugcuccaguuauugacaaacgc

SEQ ID NO: 3898176 - RNA, 18 nt, Human adenovirus A
ugcucguaaaaucuacaa

SEQ ID NO: 3898177 - RNA, 14 nt, Human adenovirus A
ugcucuggacaugg

SEQ ID NO: 3898178 - RNA, 21 nt, Human adenovirus A
ugcugcacaauuaucgcucuu

SEQ ID NO: 3898179 - RNA, 21 nt, Human adenovirus A
ugcuggugaaagaucacagcc

SEQ ID NO: 3898180 - RNA, 14 nt, Human adenovirus A
ugcugucacugagc

SEQ ID NO: 3898181 - RNA, 23 nt, Human adenovirus A
ugcuucauugaauuaccagaaug

SEQ ID NO: 3898182 - RNA, 17 nt, Human adenovirus A
uggaaaaacuuggaaac

SEQ ID NO: 3898183 - RNA, 18 nt, Human adenovirus A
uggaaagcauuuuggauu

SEQ ID NO: 3898184 - RNA, 23 nt, Human adenovirus A
uggaaauuaauuugcaggcuaau

SEQ ID NO: 3898185 - RNA, 16 nt, Human adenovirus A
aagcuugaaacucuaa

SEQ ID NO: 3898186 - RNA, 11 nt, Human adenovirus A
aaggaaaguaa

SEQ ID NO: 3898187 - RNA, 17 nt, Human adenovirus A
aaggaaaugauggcuuu

SEQ ID NO: 3898188 - RNA, 22 nt, Human adenovirus A
aaggaagccacaugggaagggu

SEQ ID NO: 3898189 - RNA, 23 nt, Human adenovirus A
aaggaagcugcuguucuuaguag

SEQ ID NO: 3898190 - RNA, 13 nt, Human adenovirus A
aaggagaaaagcg

SEQ ID NO: 3898191 - RNA, 17 nt, Human adenovirus A
aaggauugguuccuaau

SEQ ID NO: 3898192 - RNA, 17 nt, Human adenovirus A
aaggcauuggaaagcag

SEQ ID NO: 3898193 - RNA, 20 nt, Human adenovirus A
aaggcgcuccauccaaaacu

SEQ ID NO: 3898194 - RNA, 17 nt, Human adenovirus A
aagggcgcccuccaccg

SEQ ID NO: 3898195 - RNA, 14 nt, Human adenovirus A
aaggggaggacccc

SEQ ID NO: 3898196 - RNA, 13 nt, Human adenovirus A
aagucaacccaaa

SEQ ID NO: 3898197 - RNA, 18 nt, Human adenovirus A
aagucaacccaaacugua

SEQ ID NO: 3898198 - RNA, 23 nt, Human adenovirus A
aagucuggaucuucaaacaccug

SEQ ID NO: 3898199 - RNA, 15 nt, Human adenovirus A
aagucuucugacauu

SEQ ID NO: 3898200 - RNA, 18 nt, Human adenovirus A
aaguggaucuccugccac

SEQ ID NO: 3898201 - RNA, 12 nt, Human adenovirus A
aaguuuaaagga

SEQ ID NO: 3898202 - RNA, 12 nt, Human adenovirus A
aauaauaucaau

SEQ ID NO: 3898203 - RNA, 15 nt, Human adenovirus A
aauacuggcuaacgc

SEQ ID NO: 3898204 - RNA, 19 nt, Human adenovirus A
aauacugguauuuaaaauc

SEQ ID NO: 3898205 - RNA, 13 nt, Human adenovirus A
aauaucaacugcu

SEQ ID NO: 3898206 - RNA, 14 nt, Human adenovirus A
aauaucaauguuuu

SEQ ID NO: 3898207 - RNA, 16 nt, Human adenovirus A
aauaucucauuugcaa

SEQ ID NO: 3898208 - RNA, 14 nt, Human adenovirus A
aaucaaauuacaca

SEQ ID NO: 3898209 - RNA, 20 nt, Human adenovirus A
aaucauacaaaucagaagcc

SEQ ID NO: 3898210 - RNA, 18 nt, Human adenovirus A
aauccucugacuauuuca

SEQ ID NO: 3898211 - RNA, 18 nt, Human adenovirus A
aaucggcaacagcagcaa

SEQ ID NO: 3898212 - RNA, 15 nt, Human adenovirus A
aaucucagaaagcca

SEQ ID NO: 3898213 - RNA, 14 nt, Human adenovirus A
aaucuuaaauggaa

SEQ ID NO: 3898214 - RNA, 16 nt, Human adenovirus A
aaugaaaguugcauuu

SEQ ID NO: 3898215 - RNA, 12 nt, Human adenovirus A
aaugaacaaaau

SEQ ID NO: 3898216 - RNA, 12 nt, Human adenovirus A
aaugaacaaugc

SEQ ID NO: 3898217 - RNA, 14 nt, Human adenovirus A
aaugcaaaauggac

SEQ ID NO: 3898218 - RNA, 24 nt, Human adenovirus A
aaugcaauaugacuaaggauuggu

SEQ ID NO: 3898219 - RNA, 14 nt, Human adenovirus A
aaugcccugcaaaa

SEQ ID NO: 3898220 - RNA, 22 nt, Human adenovirus A
aaugcuggaugcuuugggagac

SEQ ID NO: 3898221 - RNA, 15 nt, Human adenovirus A
aauggagugucacug

SEQ ID NO: 3898222 - RNA, 22 nt, Human adenovirus A
aaugguuacugaagugccucaa

SEQ ID NO: 3898223 - RNA, 13 nt, Human adenovirus A
aauuaaacccuuu

SEQ ID NO: 3898224 - RNA, 18 nt, Human adenovirus A
aauuaauggaguuguaga

SEQ ID NO: 3898225 - RNA, 12 nt, Human adenovirus A
aauuacauuuau

SEQ ID NO: 3898226 - RNA, 20 nt, Human adenovirus A
aauuacuuaccggaaaucug

SEQ ID NO: 3898227 - RNA, 15 nt, Human adenovirus A
aauuacuugaacaac

SEQ ID NO: 3898228 - RNA, 14 nt, Human adenovirus A
aauugcagaacuau

SEQ ID NO: 3898229 - RNA, 18 nt, Human adenovirus A
aauuugccuaaaagcuau

SEQ ID NO: 3898230 - RNA, 21 nt, Human adenovirus A
aauuuuuugccaucagaaauu

SEQ ID NO: 3898231 - RNA, 22 nt, Human adenovirus A
acaaaaaacggaucuauuguua

SEQ ID NO: 3898232 - RNA, 12 nt, Human adenovirus A
acaaaacacaaa

SEQ ID NO: 3898233 - RNA, 21 nt, Human adenovirus A
acaaaacuuaucagccagagc

SEQ ID NO: 3898234 - RNA, 17 nt, Human adenovirus A
acaaaauaccccuaucc

SEQ ID NO: 3898235 - RNA, 19 nt, Human adenovirus A
acaaaaucaccaugggaau

SEQ ID NO: 3898236 - RNA, 22 nt, Human adenovirus A
acaaacaacgaaggccaaacca

SEQ ID NO: 3898237 - RNA, 17 nt, Human adenovirus A
acaaauuugcauuuccc

SEQ ID NO: 3898238 - RNA, 13 nt, Human adenovirus A
acaacaaaacacu

SEQ ID NO: 3898239 - RNA, 18 nt, Human adenovirus A
acaacaaaacacugagcu

SEQ ID NO: 3898240 - RNA, 15 nt, Human adenovirus A
acaacaagcuaauug

SEQ ID NO: 3898241 - RNA, 17 nt, Human adenovirus A
acaacacaaaaaaaacc

SEQ ID NO: 3898242 - RNA, 19 nt, Human adenovirus A
acaacacggaguaaugaac

SEQ ID NO: 3898243 - RNA, 12 nt, Human adenovirus A
acaacagcugcu

SEQ ID NO: 3898244 - RNA, 14 nt, Human adenovirus A
acaacgaaggccaa

SEQ ID NO: 3898245 - RNA, 21 nt, Human adenovirus A
acaacucuacuuaaaagcaag

SEQ ID NO: 3898246 - RNA, 11 nt, Human adenovirus A
acaagccgcag

SEQ ID NO: 3898247 - RNA, 13 nt, Human adenovirus A
acaaguuaaaaga

SEQ ID NO: 3898248 - RNA, 18 nt, Human adenovirus A
acaauaaucacaacacag

SEQ ID NO: 3898249 - RNA, 18 nt, Human adenovirus A
acaauggcauagaaaguu

SEQ ID NO: 3898250 - RNA, 16 nt, Human adenovirus A
acacaaaacacaaauu

SEQ ID NO: 3898251 - RNA, 14 nt, Human adenovirus A
acacaaaagcucua

SEQ ID NO: 3898252 - RNA, 20 nt, Human adenovirus A
acacaaucugccgcaagugc

SEQ ID NO: 3898253 - RNA, 23 nt, Human adenovirus A
acacaugauggaucuggagccac

SEQ ID NO: 3898254 - RNA, 14 nt, Human adenovirus A
acacauuaaaaugu

SEQ ID NO: 3898255 - RNA, 21 nt, Human adenovirus A
acacauugacuguuuccacug

SEQ ID NO: 3898256 - RNA, 22 nt, Human adenovirus A
acaccaugguaaaaaggaagca

SEQ ID NO: 3898257 - RNA, 19 nt, Human adenovirus A
acaccuuggucucgcagcu

SEQ ID NO: 3898258 - RNA, 18 nt, Human adenovirus A
acacgcuuuuacucacug

SEQ ID NO: 3898259 - RNA, 23 nt, Human adenovirus A
acacuauacgcgugguuaaacug

SEQ ID NO: 3898260 - RNA, 18 nt, Human adenovirus A
acacuguggacaacuccu

SEQ ID NO: 3898261 - RNA, 12 nt, Human adenovirus A
acacuuaacaca

SEQ ID NO: 3898262 - RNA, 13 nt, Human adenovirus A
acagaaauacaga

SEQ ID NO: 3898263 - RNA, 21 nt, Human adenovirus A
acagacaccgcccaggcaggc

SEQ ID NO: 3898264 - RNA, 21 nt, Human adenovirus A
acagacgaauaagcucggcca

SEQ ID NO: 3898265 - RNA, 21 nt, Human adenovirus A
acagcaacuuuuuaaccacug

SEQ ID NO: 3898266 - RNA, 23 nt, Human adenovirus A
acagcacuaacauguuauuuaaa

SEQ ID NO: 3898267 - RNA, 20 nt, Human adenovirus A
acagcauggagugcuggaaa

SEQ ID NO: 3898268 - RNA, 20 nt, Human adenovirus A
acagcauuggaauuuaacuu

SEQ ID NO: 3898269 - RNA, 18 nt, Human adenovirus A
acagccuagacgaggauc

SEQ ID NO: 3898270 - RNA, 17 nt, Human adenovirus A
acagcgcgcaaguugac

SEQ ID NO: 3898271 - RNA, 19 nt, Human adenovirus A
acagcggcguaaacucaug

SEQ ID NO: 3898272 - RNA, 22 nt, Human adenovirus A
acagcucugauuucgauaaaca

SEQ ID NO: 3898273 - RNA, 14 nt, Human adenovirus A
acaggaaagcuuaa

SEQ ID NO: 3898274 - RNA, 11 nt, Human adenovirus A
acaggaagagc

SEQ ID NO: 3898275 - RNA, 15 nt, Human adenovirus A
acaggugaaagugaa

SEQ ID NO: 3898276 - RNA, 13 nt, Human adenovirus A
acaguagcugcag

SEQ ID NO: 3898277 - RNA, 19 nt, Human adenovirus A
acaguagcugcagagcuag

SEQ ID NO: 3898278 - RNA, 22 nt, Human adenovirus A
acaguauugugggacugggagu

SEQ ID NO: 3898279 - RNA, 15 nt, Human adenovirus A
acagucacaagguag

SEQ ID NO: 3898280 - RNA, 16 nt, Human adenovirus A
acaguugacgccccau

SEQ ID NO: 3898281 - RNA, 14 nt, Human adenovirus A
acauaacacagcuu

SEQ ID NO: 3898282 - RNA, 17 nt, Human adenovirus A
acauauggcaccaaggc

SEQ ID NO: 3898283 - RNA, 16 nt, Human adenovirus A
acaucacucuauuuca

SEQ ID NO: 3898284 - RNA, 17 nt, Human adenovirus A
acaucguccaagaucuu

SEQ ID NO: 3898285 - RNA, 22 nt, Human adenovirus A
acaucuuuuacuaaaaugcaaa

SEQ ID NO: 3898286 - RNA, 23 nt, Human adenovirus A
acaugauggaucuggagccacag

SEQ ID NO: 3898287 - RNA, 19 nt, Human adenovirus A
acaugauucuucagagcac

SEQ ID NO: 3898288 - RNA, 18 nt, Human adenovirus A
acaugcuggauuacaugu

SEQ ID NO: 3898289 - RNA, 15 nt, Human adenovirus A
acauuaggcuccaca

SEQ ID NO: 3898290 - RNA, 19 nt, Human adenovirus A
acauucaaauuccugugca

SEQ ID NO: 3898291 - RNA, 17 nt, Human adenovirus A
acauuccagagagcuac

SEQ ID NO: 3898292 - RNA, 16 nt, Human adenovirus A
acauugcauucagaga

SEQ ID NO: 3898293 - RNA, 15 nt, Human adenovirus A
acauuuagaccacug

SEQ ID NO: 3898294 - RNA, 13 nt, Human adenovirus A
acauuuaggcuua

SEQ ID NO: 3898295 - RNA, 20 nt, Human adenovirus A
accaaaaacaccuuuuguua

SEQ ID NO: 3898296 - RNA, 15 nt, Human adenovirus A
accaaacuggccaug

SEQ ID NO: 3898297 - RNA, 11 nt, Human adenovirus A
accaaagccau

SEQ ID NO: 3898298 - RNA, 14 nt, Human adenovirus A
accaagcccucucc

SEQ ID NO: 3898299 - RNA, 13 nt, Human adenovirus A
accacaucuuugg

SEQ ID NO: 3898300 - RNA, 20 nt, Human adenovirus A
accacccuagcauucucuaa

SEQ ID NO: 3898301 - RNA, 17 nt, Human adenovirus A
accacguacgaccacug

SEQ ID NO: 3898302 - RNA, 16 nt, Human adenovirus A
accacugaaacucccu

SEQ ID NO: 3898303 - RNA, 23 nt, Human adenovirus A
accagagcaccccuucccaccuu

SEQ ID NO: 3898304 - RNA, 15 nt, Human adenovirus A
accagcgucccaaaa

SEQ ID NO: 3898305 - RNA, 22 nt, Human adenovirus A
accaggcauggccaucauacau

SEQ ID NO: 3898306 - RNA, 17 nt, Human adenovirus A
accaugaaaacagcauu

SEQ ID NO: 3898307 - RNA, 13 nt, Human adenovirus A
accauggaauuuu

SEQ ID NO: 3898308 - RNA, 16 nt, Human adenovirus A
accauugaaaccagcg

SEQ ID NO: 3898309 - RNA, 14 nt, Human adenovirus A
accccaaaagcccg

SEQ ID NO: 3898310 - RNA, 15 nt, Human adenovirus A
accccaaaagcccgc

SEQ ID NO: 3898311 - RNA, 15 nt, Human adenovirus A
accccauuguaacug

SEQ ID NO: 3898312 - RNA, 12 nt, Human adenovirus A
acccccagugcc

SEQ ID NO: 3898313 - RNA, 17 nt, Human adenovirus A
acccuuacacucaagcu

SEQ ID NO: 3898314 - RNA, 15 nt, Human adenovirus A
acccuuccccaccuu

SEQ ID NO: 3898315 - RNA, 14 nt, Human adenovirus A
acccuuuagcaguu

SEQ ID NO: 3898316 - RNA, 14 nt, Human adenovirus A
accgauugggacag

SEQ ID NO: 3898317 - RNA, 15 nt, Human adenovirus A
accgcucgucaagcc

SEQ ID NO: 3898318 - RNA, 16 nt, Human adenovirus A
accguagaugggacac

SEQ ID NO: 3898319 - RNA, 23 nt, Human adenovirus A
accgugaauauuaaaaagcucug

SEQ ID NO: 3898320 - RNA, 23 nt, Human adenovirus A
accguucccuaucauuaagaaca

SEQ ID NO: 3898321 - RNA, 20 nt, Human adenovirus A
accuacgguggcagccaagc

SEQ ID NO: 3898322 - RNA, 13 nt, Human adenovirus A
accuagguuuaaa

SEQ ID NO: 3898323 - RNA, 18 nt, Human adenovirus A
accucacaaggucuuaaa

SEQ ID NO: 3898324 - RNA, 21 nt, Human adenovirus A
accuccauuauuucuuccucg

SEQ ID NO: 3898325 - RNA, 20 nt, Human adenovirus A
accucccgauaccaaaaaca

SEQ ID NO: 3898326 - RNA, 20 nt, Human adenovirus A
accugauuuucacauuugug

SEQ ID NO: 3898327 - RNA, 15 nt, Human adenovirus A
accuucgagaacuaa

SEQ ID NO: 3898328 - RNA, 18 nt, Human adenovirus A
accuugaaaugccagaca

SEQ ID NO: 3898329 - RNA, 16 nt, Human adenovirus A
acgaaggccaaaccau

SEQ ID NO: 3898330 - RNA, 14 nt, Human adenovirus A
acgagacucccccc

SEQ ID NO: 3898331 - RNA, 19 nt, Human adenovirus A
acgagcucccggaggaagc

SEQ ID NO: 3898332 - RNA, 19 nt, Human adenovirus A
acgcaagcgugcaaacaga

SEQ ID NO: 3898333 - RNA, 13 nt, Human adenovirus A
acgccaaagccac

SEQ ID NO: 3898334 - RNA, 13 nt, Human adenovirus A
acgccaacaggau

SEQ ID NO: 3898335 - RNA, 15 nt, Human adenovirus A
acgccccauccgugg

SEQ ID NO: 3898336 - RNA, 18 nt, Human adenovirus A
acgccuuacauguggagc

SEQ ID NO: 3898337 - RNA, 22 nt, Human adenovirus A
acgcgugguuaaacugccuccu

SEQ ID NO: 3898338 - RNA, 16 nt, Human adenovirus A
acgcuaaccaggcaug

SEQ ID NO: 3898339 - RNA, 21 nt, Human adenovirus A
acgcuauaacaguaccaaugu

SEQ ID NO: 3898340 - RNA, 19 nt, Human adenovirus A
acgcugcguuuugugcccg

SEQ ID NO: 3898341 - RNA, 15 nt, Human adenovirus A
acgcuugugcagccu

SEQ ID NO: 3898342 - RNA, 14 nt, Human adenovirus A
acggaacuacucag

SEQ ID NO: 3898343 - RNA, 13 nt, Human adenovirus A
acggcggcgcaua

SEQ ID NO: 3898344 - RNA, 15 nt, Human adenovirus A
acgggcagccugucu

SEQ ID NO: 3898345 - RNA, 19 nt, Human adenovirus A
acgggccgcagcugcggcc

SEQ ID NO: 3898346 - RNA, 15 nt, Human adenovirus A
acgggcgugugacug

SEQ ID NO: 3898347 - RNA, 16 nt, Human adenovirus A
acguaaaccuugaaau

SEQ ID NO: 3898348 - RNA, 21 nt, Human adenovirus A
acguaaugugcgcgucagggu

SEQ ID NO: 3898349 - RNA, 18 nt, Human adenovirus A
acguccaagcgguuauug

SEQ ID NO: 3898350 - RNA, 11 nt, Human adenovirus A
acgugugcccc

SEQ ID NO: 3898351 - RNA, 16 nt, Human adenovirus A
acguugcaagaggaga

SEQ ID NO: 3898352 - RNA, 18 nt, Human adenovirus A
acuaaaacaaaucuauca

SEQ ID NO: 3898353 - RNA, 14 nt, Human adenovirus A
acuaaagaaacaaa

SEQ ID NO: 3898354 - RNA, 18 nt, Human adenovirus A
acuaacaaugcuuuccau

SEQ ID NO: 3898355 - RNA, 23 nt, Human adenovirus A
acuaaccgucgccagcaagugcc

SEQ ID NO: 3898356 - RNA, 15 nt, Human adenovirus A
acuaccuagcuuacc

SEQ ID NO: 3898357 - RNA, 22 nt, Human adenovirus A
acuacuuuauaacuaacuuuaa

SEQ ID NO: 3898358 - RNA, 17 nt, Human adenovirus A
acuagaguguauggaaa

SEQ ID NO: 3898359 - RNA, 14 nt, Human adenovirus A
acuaggggcuggcu

SEQ ID NO: 3898360 - RNA, 15 nt, Human adenovirus A
acuauagagaggaau

SEQ ID NO: 3898361 - RNA, 14 nt, Human adenovirus A
acuaugagucaagu

SEQ ID NO: 3898362 - RNA, 20 nt, Human adenovirus A
acuccauaaggcggcguccu

SEQ ID NO: 3898363 - RNA, 21 nt, Human adenovirus A
acucuauugccaccuuuuguu

SEQ ID NO: 3898364 - RNA, 13 nt, Human adenovirus A
acucucuggggaa

SEQ ID NO: 3898365 - RNA, 19 nt, Human adenovirus A
acugaacuauuaagugaaa

SEQ ID NO: 3898366 - RNA, 13 nt, Human adenovirus A
acugaagugccuc

SEQ ID NO: 3898367 - RNA, 16 nt, Human adenovirus A
acugaggagcugagaa

SEQ ID NO: 3898368 - RNA, 16 nt, Human adenovirus A
acugcccagcuguucu

SEQ ID NO: 3898369 - RNA, 20 nt, Human adenovirus A
acugccccgggguuggugga

SEQ ID NO: 3898370 - RNA, 17 nt, Human adenovirus A
acugccgacaacacugu

SEQ ID NO: 3898371 - RNA, 21 nt, Human adenovirus A
acugcgucaguaacaaacugg

SEQ ID NO: 3898372 - RNA, 15 nt, Human adenovirus A
acugcgucuccccau

SEQ ID NO: 3898373 - RNA, 23 nt, Human adenovirus A
acugcgucuccccauucgcagca

SEQ ID NO: 3898374 - RNA, 16 nt, Human adenovirus A
acuggacagcggccau

SEQ ID NO: 3898375 - RNA, 23 nt, Human adenovirus A
acugggauggguguuuggcagca

SEQ ID NO: 3898376 - RNA, 12 nt, Human adenovirus A
acugggccagga

SEQ ID NO: 3898377 - RNA, 19 nt, Human adenovirus A
acuggggaauuugcauaug

SEQ ID NO: 3898378 - RNA, 16 nt, Human adenovirus A
acugguacuaugacug

SEQ ID NO: 3898379 - RNA, 15 nt, Human adenovirus A
acuuaccccugggcu

SEQ ID NO: 3898380 - RNA, 13 nt, Human adenovirus A
acuuacuacgacu

SEQ ID NO: 3898381 - RNA, 22 nt, Human adenovirus A
acuucaauccuuuuucgggcuc

SEQ ID NO: 3898382 - RNA, 21 nt, Human adenovirus A
acuuccucauccgcccaaacu

SEQ ID NO: 3898383 - RNA, 20 nt, Human adenovirus A
acuugggaaauuugucaugg

SEQ ID NO: 3898384 - RNA, 16 nt, Human adenovirus A
acuuguaacuguggaa

SEQ ID NO: 3898385 - RNA, 15 nt, Human adenovirus A
acuuuaugagucaaa

SEQ ID NO: 3898386 - RNA, 16 nt, Human adenovirus A
acuuucaaaaaagcuu

SEQ ID NO: 3898387 - RNA, 16 nt, Human adenovirus A
acuuuccgccauggcu

SEQ ID NO: 3898388 - RNA, 19 nt, Human adenovirus A
acuuuccggagaaagaauu

SEQ ID NO: 3898389 - RNA, 18 nt, Human adenovirus A
agaaaaaccaccaggugu

SEQ ID NO: 3898390 - RNA, 16 nt, Human adenovirus A
agaaacagcagcaacg

SEQ ID NO: 3898391 - RNA, 15 nt, Human adenovirus A
agaaaguuuaaagga

SEQ ID NO: 3898392 - RNA, 17 nt, Human adenovirus A
agaaaucccaccugagu

SEQ ID NO: 3898393 - RNA, 14 nt, Human adenovirus A
agaacaaacagugc

SEQ ID NO: 3898394 - RNA, 18 nt, Human adenovirus A
agaacacggugaaugugu

SEQ ID NO: 3898395 - RNA, 17 nt, Human adenovirus A
agaaccgucugcaugau

SEQ ID NO: 3898396 - RNA, 18 nt, Human adenovirus A
agaacuacaaaaaaguaa

SEQ ID NO: 3898397 - RNA, 15 nt, Human adenovirus A
agaagcuuauguaca

SEQ ID NO: 3898398 - RNA, 18 nt, Human adenovirus A
agaaucaaucucaguguc

SEQ ID NO: 3898399 - RNA, 21 nt, Human adenovirus A
agaaucaaucucagugucauu

SEQ ID NO: 3898400 - RNA, 13 nt, Human adenovirus A
agacaugacagcg

SEQ ID NO: 3898401 - RNA, 14 nt, Human adenovirus A
agacgaacaaacuu

SEQ ID NO: 3898402 - RNA, 15 nt, Human adenovirus A
agacggcugcgucgc

SEQ ID NO: 3898403 - RNA, 15 nt, Human adenovirus A
agacguuuuugccca

SEQ ID NO: 3898404 - RNA, 16 nt, Human adenovirus A
agacuauaaucccuug

SEQ ID NO: 3898405 - RNA, 13 nt, Human adenovirus A
gcuaagggacaag

SEQ ID NO: 3898406 - RNA, 15 nt, Human adenovirus A
gcuaagggacaaguu

SEQ ID NO: 3898407 - RNA, 13 nt, Human adenovirus A
gcuacaucuuuua

SEQ ID NO: 3898408 - RNA, 21 nt, Human adenovirus A
gcuacgagacuccccccgagg

SEQ ID NO: 3898409 - RNA, 20 nt, Human adenovirus A
gcuagcugacauaauuuucc

SEQ ID NO: 3898410 - RNA, 20 nt, Human adenovirus A
gcuaugagcacaagugaggc

SEQ ID NO: 3898411 - RNA, 17 nt, Human adenovirus A
gcuauuguuaacacugc

SEQ ID NO: 3898412 - RNA, 18 nt, Human adenovirus A
gcucaacgagagcgcuuu

SEQ ID NO: 3898413 - RNA, 14 nt, Human adenovirus A
gcucagcuccaccc

SEQ ID NO: 3898414 - RNA, 15 nt, Human adenovirus A
gcucauggcgggcuc

SEQ ID NO: 3898415 - RNA, 14 nt, Human adenovirus A
gcuccaaccaugaa

SEQ ID NO: 3898416 - RNA, 15 nt, Human adenovirus A
gcucccgcagugagg

SEQ ID NO: 3898417 - RNA, 22 nt, Human adenovirus A
gcucgcuuuacgcuggcugugg

SEQ ID NO: 3898418 - RNA, 14 nt, Human adenovirus A
gcucggccaccguc

SEQ ID NO: 3898419 - RNA, 12 nt, Human adenovirus A
gcucuaccuuaa

SEQ ID NO: 3898420 - RNA, 15 nt, Human adenovirus A
gcugaggaaaugcga

SEQ ID NO: 3898421 - RNA, 20 nt, Human adenovirus A
gcugagguuaaaaggaguga

SEQ ID NO: 3898422 - RNA, 23 nt, Human adenovirus A
gcugcacaauuaucgcucuuuua

SEQ ID NO: 3898423 - RNA, 21 nt, Human adenovirus A
gcugcccugauauaucaggaa

SEQ ID NO: 3898424 - RNA, 18 nt, Human adenovirus A
gcugcuacuaacauuaaa

SEQ ID NO: 3898425 - RNA, 11 nt, Human adenovirus A
gcuggaaccug

SEQ ID NO: 3898426 - RNA, 21 nt, Human adenovirus A
gcuggaugcuuugggagacag

SEQ ID NO: 3898427 - RNA, 20 nt, Human adenovirus A
gcuggcgggagggcauuaaa

SEQ ID NO: 3898428 - RNA, 15 nt, Human adenovirus A
gcugugaaaugaggc

SEQ ID NO: 3898429 - RNA, 16 nt, Human adenovirus A
gcuucacaauggucag

SEQ ID NO: 3898430 - RNA, 19 nt, Human adenovirus A
gcuuccguagccuugcagc

SEQ ID NO: 3898431 - RNA, 16 nt, Human adenovirus A
gcuucuaaaagagcca

SEQ ID NO: 3898432 - RNA, 21 nt, Human adenovirus A
gcuucuauugcuuuuuuggca

SEQ ID NO: 3898433 - RNA, 21 nt, Human adenovirus A
gcuugagcaaaaauguuuucu

SEQ ID NO: 3898434 - RNA, 21 nt, Human adenovirus A
gcuuggaagaaaaaaaccuuc

SEQ ID NO: 3898435 - RNA, 23 nt, Human adenovirus A
gcuuuguuggauagcaaagccau

SEQ ID NO: 3898436 - RNA, 23 nt, Human adenovirus A
gcuuuuccugagacaccaccucc

SEQ ID NO: 3898437 - RNA, 16 nt, Human adenovirus A
gcuuuucgccagcagc

SEQ ID NO: 3898438 - RNA, 11 nt, Human adenovirus A
ggaaaacuuuu

SEQ ID NO: 3898439 - RNA, 23 nt, Human adenovirus A
ggaaacaaguuuagaaaccccac

SEQ ID NO: 3898440 - RNA, 19 nt, Human adenovirus A
ggaacagacaccgcccagg

SEQ ID NO: 3898441 - RNA, 16 nt, Human adenovirus A
ggaaccccaaaucgca

SEQ ID NO: 3898442 - RNA, 18 nt, Human adenovirus A
ggaacugcagacaguggc

SEQ ID NO: 3898443 - RNA, 22 nt, Human adenovirus A
ggacagagcauucaugcugaug

SEQ ID NO: 3898444 - RNA, 14 nt, Human adenovirus A
ggacauaauuuccc

SEQ ID NO: 3898445 - RNA, 22 nt, Human adenovirus A
ggaccgcagucugacagcaauu

SEQ ID NO: 3898446 - RNA, 16 nt, Human adenovirus A
ggacgaccccgccgga

SEQ ID NO: 3898447 - RNA, 20 nt, Human adenovirus A
ggacggucgaccuguggcac

SEQ ID NO: 3898448 - RNA, 15 nt, Human adenovirus A
ggagaaccuuucaag

SEQ ID NO: 3898449 - RNA, 12 nt, Human adenovirus A
ggaggcagcugg

SEQ ID NO: 3898450 - RNA, 23 nt, Human adenovirus A
ggagggacaagcuuaccccgcca

SEQ ID NO: 3898451 - RNA, 17 nt, Human adenovirus A
ggaggguuugcauuuac

SEQ ID NO: 3898452 - RNA, 22 nt, Human adenovirus A
ggaguaauaaaaccugugccuc

SEQ ID NO: 3898453 - RNA, 23 nt, Human adenovirus A
ggagugucacugccgcugcaauc

SEQ ID NO: 3898454 - RNA, 21 nt, Human adenovirus A
ggauaauguaaacccuuuuaa

SEQ ID NO: 3898455 - RNA, 18 nt, Human adenovirus A
ggauacuuaauacuggcu

SEQ ID NO: 3898456 - RNA, 14 nt, Human adenovirus A
ggauagcaccugcc

SEQ ID NO: 3898457 - RNA, 12 nt, Human adenovirus A
ggauauaaagcu

SEQ ID NO: 3898458 - RNA, 20 nt, Human adenovirus A
ggaucaaaaacaaguuuccc

SEQ ID NO: 3898459 - RNA, 22 nt, Human adenovirus A
ggauccuagcguacagccagau

SEQ ID NO: 3898460 - RNA, 18 nt, Human adenovirus A
ggauggguguuuggcagc

SEQ ID NO: 3898461 - RNA, 19 nt, Human adenovirus A
ggauuguguccuuggaaga

SEQ ID NO: 3898462 - RNA, 22 nt, Human adenovirus A
ggcaaagaaacacaugauggau

SEQ ID NO: 3898463 - RNA, 16 nt, Human adenovirus A
ggcacaacagacuggg

SEQ ID NO: 3898464 - RNA, 22 nt, Human adenovirus A
ggcagcaaugcuuggaagaaaa

SEQ ID NO: 3898465 - RNA, 18 nt, Human adenovirus A
ggcagccaagcgcucgcg

SEQ ID NO: 3898466 - RNA, 12 nt, Human adenovirus A
ggcaggaguugc

SEQ ID NO: 3898467 - RNA, 17 nt, Human adenovirus A
ggcaggggaagguguug

SEQ ID NO: 3898468 - RNA, 22 nt, Human adenovirus A
ggcagucacaaguacauccagg

SEQ ID NO: 3898469 - RNA, 17 nt, Human adenovirus A
ggcaucuugcaugaaaa

SEQ ID NO: 3898470 - RNA, 20 nt, Human adenovirus A
ggcauuccccauccaaaacc

SEQ ID NO: 3898471 - RNA, 14 nt, Human adenovirus A
ggccagcauugccg

SEQ ID NO: 3898472 - RNA, 19 nt, Human adenovirus A
ggccagugugcgcuuuaaa

SEQ ID NO: 3898473 - RNA, 19 nt, Human adenovirus A
ggccauguacuugacucug

SEQ ID NO: 3898474 - RNA, 17 nt, Human adenovirus A
ggccauuuuggaagcag

SEQ ID NO: 3898475 - RNA, 16 nt, Human adenovirus A
ggcgaacaggaagagc

SEQ ID NO: 3898476 - RNA, 16 nt, Human adenovirus A
ggcgaggaacuaaacc

SEQ ID NO: 3898477 - RNA, 18 nt, Human adenovirus A
ggcgcggacgagcucccg

SEQ ID NO: 3898478 - RNA, 21 nt, Human adenovirus A
ggcgcuguaccgccugaagaa

SEQ ID NO: 3898479 - RNA, 19 nt, Human adenovirus A
ggcggguaagagcaggcug

SEQ ID NO: 3898480 - RNA, 12 nt, Human adenovirus A
ggcggugagcau

SEQ ID NO: 3898481 - RNA, 17 nt, Human adenovirus A
ggcguacacuggcuggc

SEQ ID NO: 3898482 - RNA, 16 nt, Human adenovirus A
ggcuaggaaaacaaac

SEQ ID NO: 3898483 - RNA, 17 nt, Human adenovirus A
ggcuccacaccuugguc

SEQ ID NO: 3898484 - RNA, 13 nt, Human adenovirus A
ggcuuaugcaagg

SEQ ID NO: 3898485 - RNA, 21 nt, Human adenovirus A
gggaaaaaaaagaggaagaag

SEQ ID NO: 3898486 - RNA, 23 nt, Human adenovirus A
gggaccgcagucugacagcaauu

SEQ ID NO: 3898487 - RNA, 14 nt, Human adenovirus A
gggaguugcgagcu

SEQ ID NO: 3898488 - RNA, 20 nt, Human adenovirus A
gggauacuaccgcugcucag

SEQ ID NO: 3898489 - RNA, 23 nt, Human adenovirus A
gggauggguguuuggcagcaaug

SEQ ID NO: 3898490 - RNA, 19 nt, Human adenovirus A
gggauuguguccuuggaag

SEQ ID NO: 3898491 - RNA, 21 nt, Human adenovirus A
gggcagccaggcgggcugcaa

SEQ ID NO: 3898492 - RNA, 20 nt, Human adenovirus A
gggcagcccaacccuuccca

SEQ ID NO: 3898493 - RNA, 15 nt, Human adenovirus A
gggcaucuugcauga

SEQ ID NO: 3898494 - RNA, 16 nt, Human adenovirus A
gggcauggugauuaaa

SEQ ID NO: 3898495 - RNA, 13 nt, Human adenovirus A
gggccgcagcugc

SEQ ID NO: 3898496 - RNA, 15 nt, Human adenovirus A
ggggauugggaaggg

SEQ ID NO: 3898497 - RNA, 15 nt, Human adenovirus A
ggggcuacugcucau

SEQ ID NO: 3898498 - RNA, 14 nt, Human adenovirus A
ggguucgugcucca

SEQ ID NO: 3898499 - RNA, 14 nt, Human adenovirus A
gguaagugggugga

SEQ ID NO: 3898500 - RNA, 20 nt, Human adenovirus A
gguacccgccagugcuuuca

SEQ ID NO: 3898501 - RNA, 20 nt, Human adenovirus A
gguacuuuuccuuguggaau

SEQ ID NO: 3898502 - RNA, 18 nt, Human adenovirus A
gguaguuuaagguggugg

SEQ ID NO: 3898503 - RNA, 22 nt, Human adenovirus A
ggucaagaacacgaacugaaaa

SEQ ID NO: 3898504 - RNA, 21 nt, Human adenovirus A
ggucuuaaaaauuuugguucc

SEQ ID NO: 3898505 - RNA, 21 nt, Human adenovirus A
ggugaaugggguacgagcccg

SEQ ID NO: 3898506 - RNA, 20 nt, Human adenovirus A
gguggggaaaaugguggugc

SEQ ID NO: 3898507 - RNA, 15 nt, Human adenovirus A
gguggggugcugccc

SEQ ID NO: 3898508 - RNA, 22 nt, Human adenovirus A
gguuagaacuuucuaaggugug

SEQ ID NO: 3898509 - RNA, 14 nt, Human adenovirus A
gguucucuuucaac

SEQ ID NO: 3898510 - RNA, 13 nt, Human adenovirus A
gguuuaauguuua

SEQ ID NO: 3898511 - RNA, 21 nt, Human adenovirus A
guaacuuucaaaaaagcuuua

SEQ ID NO: 3898512 - RNA, 18 nt, Human adenovirus A
guaagagcaggcuggagg

SEQ ID NO: 3898513 - RNA, 19 nt, Human adenovirus A
guaaugagcgcagugauga

SEQ ID NO: 3898514 - RNA, 21 nt, Human adenovirus A
guaauggguucaagcgaacag

SEQ ID NO: 3898515 - RNA, 23 nt, Human adenovirus A
guaauuggcaaaguacccuaaac

SEQ ID NO: 3898516 - RNA, 23 nt, Human adenovirus A
guaauuuuccagcgccaccugcc

SEQ ID NO: 3898517 - RNA, 18 nt, Human adenovirus A
guaauuuuuuucuccuuu

SEQ ID NO: 3898518 - RNA, 12 nt, Human adenovirus A
guacaaagccag

SEQ ID NO: 3898519 - RNA, 13 nt, Human adenovirus A
guacaaagccagg

SEQ ID NO: 3898520 - RNA, 17 nt, Human adenovirus A
guacacuaaugaggcuu

SEQ ID NO: 3898521 - RNA, 14 nt, Human adenovirus A
guacccgccagugc

SEQ ID NO: 3898522 - RNA, 15 nt, Human adenovirus A
guaccgcgaagccau

SEQ ID NO: 3898523 - RNA, 13 nt, Human adenovirus A
guacgaaacuguu

SEQ ID NO: 3898524 - RNA, 17 nt, Human adenovirus A
guacgcaaacucagccc

SEQ ID NO: 3898525 - RNA, 21 nt, Human adenovirus A
guacgcauucaccagccacac

SEQ ID NO: 3898526 - RNA, 19 nt, Human adenovirus A
guacucaacgugucaguuu

SEQ ID NO: 3898527 - RNA, 18 nt, Human adenovirus A
guagaccugcaagacaga

SEQ ID NO: 3898528 - RNA, 20 nt, Human adenovirus A
guagccauugguuuaaugca

SEQ ID NO: 3898529 - RNA, 15 nt, Human adenovirus A
guagccuugcaggcu

SEQ ID NO: 3898530 - RNA, 16 nt, Human adenovirus A
guagccuugcaggcuu

SEQ ID NO: 3898531 - RNA, 18 nt, Human adenovirus A
guaguaugcgcagacgca

SEQ ID NO: 3898532 - RNA, 13 nt, Human adenovirus A
guaguugcgcaag

SEQ ID NO: 3898533 - RNA, 16 nt, Human adenovirus A
guauaagaaagaggca

SEQ ID NO: 3898534 - RNA, 12 nt, Human adenovirus A
guaugccaacaa

SEQ ID NO: 3898535 - RNA, 14 nt, Human adenovirus A
guaugcgcagacgc

SEQ ID NO: 3898536 - RNA, 22 nt, Human adenovirus A
guauguucccauugacaaggaa

SEQ ID NO: 3898537 - RNA, 15 nt, Human adenovirus A
guauucauauaugua

SEQ ID NO: 3898538 - RNA, 13 nt, Human adenovirus A
gucaaaaaagcaa

SEQ ID NO: 3898539 - RNA, 18 nt, Human adenovirus A
gucaaaguaugcugcaca

SEQ ID NO: 3898540 - RNA, 13 nt, Human adenovirus A
gucaacuacauaa

SEQ ID NO: 3898541 - RNA, 22 nt, Human adenovirus A
gucacaaguacauccagggcac

SEQ ID NO: 3898542 - RNA, 13 nt, Human adenovirus A
gucagacuauuac

SEQ ID NO: 3898543 - RNA, 18 nt, Human adenovirus A
gucaggcgugcgcagucu

SEQ ID NO: 3898544 - RNA, 13 nt, Human adenovirus A
gucaguguccauc

SEQ ID NO: 3898545 - RNA, 17 nt, Human adenovirus A
gucaucucuacagcccc

SEQ ID NO: 3898546 - RNA, 12 nt, Human adenovirus A
guccacacaguu

SEQ ID NO: 3898547 - RNA, 11 nt, Human adenovirus A
gucccauccaa

SEQ ID NO: 3898548 - RNA, 20 nt, Human adenovirus A
gucccgcccgcguuuggaaa

SEQ ID NO: 3898549 - RNA, 11 nt, Human adenovirus A
guccuacggag

SEQ ID NO: 3898550 - RNA, 13 nt, Human adenovirus A
guccucuuccucu

SEQ ID NO: 3898551 - RNA, 12 nt, Human adenovirus A
guccuuccaggg

SEQ ID NO: 3898552 - RNA, 24 nt, Human adenovirus A
gucgccgcggcgucagcagacggc

SEQ ID NO: 3898553 - RNA, 16 nt, Human adenovirus A
gucgcgagcugcgccg

SEQ ID NO: 3898554 - RNA, 16 nt, Human adenovirus A
gucgcuuucaaccaag

SEQ ID NO: 3898555 - RNA, 21 nt, Human adenovirus A
gucgugguggaagcuggccau

SEQ ID NO: 3898556 - RNA, 22 nt, Human adenovirus A
uacgcaaacucagcccaugcuc

SEQ ID NO: 3898557 - RNA, 14 nt, Human adenovirus A
uacggacagucugu

SEQ ID NO: 3898558 - RNA, 14 nt, Human adenovirus A
uacgguggcagcca

SEQ ID NO: 3898559 - RNA, 16 nt, Human adenovirus A
uacuaaaagcuuuaau

SEQ ID NO: 3898560 - RNA, 12 nt, Human adenovirus A
uacuaacaacuc

SEQ ID NO: 3898561 - RNA, 22 nt, Human adenovirus A
uacuagccccugucaacagcau

SEQ ID NO: 3898562 - RNA, 14 nt, Human adenovirus A
uacucuuauaaaau

SEQ ID NO: 3898563 - RNA, 15 nt, Human adenovirus A
uacugcucccucucg

SEQ ID NO: 3898564 - RNA, 16 nt, Human adenovirus A
uacugucccccaccag

SEQ ID NO: 3898565 - RNA, 22 nt, Human adenovirus A
uacuuacagggagauacaucua

SEQ ID NO: 3898566 - RNA, 20 nt, Human adenovirus A
uacuucaccgcgcaagcuuu

SEQ ID NO: 3898567 - RNA, 15 nt, Human adenovirus A
uagaaacugugcccg

SEQ ID NO: 3898568 - RNA, 19 nt, Human adenovirus A
uagacaucgcgcauaggag

SEQ ID NO: 3898569 - RNA, 20 nt, Human adenovirus A
uagagcacaugaagguggau

SEQ ID NO: 3898570 - RNA, 13 nt, Human adenovirus A
uagagggaggcaa

SEQ ID NO: 3898571 - RNA, 19 nt, Human adenovirus A
uagauacaagcgacagagu

SEQ ID NO: 3898572 - RNA, 12 nt, Human adenovirus A
uagauuucuuga

SEQ ID NO: 3898573 - RNA, 20 nt, Human adenovirus A
uagccugcuuucagcacugc

SEQ ID NO: 3898574 - RNA, 16 nt, Human adenovirus A
uaggauagcaccugcc

SEQ ID NO: 3898575 - RNA, 15 nt, Human adenovirus A
uaggcauaaugcagc

SEQ ID NO: 3898576 - RNA, 23 nt, Human adenovirus A
uagguguaagucacguguucaca

SEQ ID NO: 3898577 - RNA, 17 nt, Human adenovirus A
uaguaacauuuguguag

SEQ ID NO: 3898578 - RNA, 15 nt, Human adenovirus A
uaguucugcacgggc

SEQ ID NO: 3898579 - RNA, 16 nt, Human adenovirus A
uauaagaaagaggcag

SEQ ID NO: 3898580 - RNA, 15 nt, Human adenovirus A
uauaaucuccaaaua

SEQ ID NO: 3898581 - RNA, 16 nt, Human adenovirus A
uauacgccuccuaugu

SEQ ID NO: 3898582 - RNA, 16 nt, Human adenovirus A
uauaguaaaaaugcca

SEQ ID NO: 3898583 - RNA, 13 nt, Human adenovirus A
uauaguggcacaa

SEQ ID NO: 3898584 - RNA, 17 nt, Human adenovirus A
uaugaccuuaaucuguu

SEQ ID NO: 3898585 - RNA, 19 nt, Human adenovirus A
uaugcaaggcgccgcagac

SEQ ID NO: 3898586 - RNA, 20 nt, Human adenovirus A
caggucccguaaaauacaca

SEQ ID NO: 3898587 - RNA, 15 nt, Human adenovirus A
cagguguacuggucc

SEQ ID NO: 3898588 - RNA, 15 nt, Human adenovirus A
cagucaccaccagcg

SEQ ID NO: 3898589 - RNA, 23 nt, Human adenovirus A
cagucagagagaaaagcaugucc

SEQ ID NO: 3898590 - RNA, 19 nt, Human adenovirus A
cagugagccguccagcagu

SEQ ID NO: 3898591 - RNA, 17 nt, Human adenovirus A
cagugagugaaucugug

SEQ ID NO: 3898592 - RNA, 16 nt, Human adenovirus A
caguuuaacacauaca

SEQ ID NO: 3898593 - RNA, 19 nt, Human adenovirus A
caguuuuggagccaaaaaa

SEQ ID NO: 3898594 - RNA, 15 nt, Human adenovirus A
caguuuuugcagugc

SEQ ID NO: 3898595 - RNA, 15 nt, Human adenovirus A
cauaaugaaaacaau

SEQ ID NO: 3898596 - RNA, 23 nt, Human adenovirus A
cauaauuaaacccuuuagcaguu

SEQ ID NO: 3898597 - RNA, 15 nt, Human adenovirus A
cauacaguaagcaca

SEQ ID NO: 3898598 - RNA, 15 nt, Human adenovirus A
cauacauacacucau

SEQ ID NO: 3898599 - RNA, 18 nt, Human adenovirus A
cauacuuaccaaagccau

SEQ ID NO: 3898600 - RNA, 14 nt, Human adenovirus A
cauagaaaaucuuu

SEQ ID NO: 3898601 - RNA, 16 nt, Human adenovirus A
cauagcuuacaaaggg

SEQ ID NO: 3898602 - RNA, 18 nt, Human adenovirus A
cauaguuucgguuacugc

SEQ ID NO: 3898603 - RNA, 21 nt, Human adenovirus A
cauauaaaacugauuuaccgc

SEQ ID NO: 3898604 - RNA, 20 nt, Human adenovirus A
cauccagauauaguacugcu

SEQ ID NO: 3898605 - RNA, 21 nt, Human adenovirus A
cauccaugugaugccggcagc

SEQ ID NO: 3898606 - RNA, 17 nt, Human adenovirus A
cauccccagacaguuuc

SEQ ID NO: 3898607 - RNA, 16 nt, Human adenovirus A
cauccguggcaggcca

SEQ ID NO: 3898608 - RNA, 14 nt, Human adenovirus A
cauccucagcuccg

SEQ ID NO: 3898609 - RNA, 14 nt, Human adenovirus A
caucgcaaaacacg

SEQ ID NO: 3898610 - RNA, 18 nt, Human adenovirus A
caucgccggucaggaugc

SEQ ID NO: 3898611 - RNA, 18 nt, Human adenovirus A
caucuaaaccuauaacaa

SEQ ID NO: 3898612 - RNA, 20 nt, Human adenovirus A
caucuagccagucacaguca

SEQ ID NO: 3898613 - RNA, 15 nt, Human adenovirus A
caucuuaaugccagu

SEQ ID NO: 3898614 - RNA, 13 nt, Human adenovirus A
caucuuuuuaugc

SEQ ID NO: 3898615 - RNA, 14 nt, Human adenovirus A
cauggcugaagagg

SEQ ID NO: 3898616 - RNA, 16 nt, Human adenovirus A
cauggcugaagaggag

SEQ ID NO: 3898617 - RNA, 20 nt, Human adenovirus A
cauggguguauuggccgggc

SEQ ID NO: 3898618 - RNA, 21 nt, Human adenovirus A
cauguaaaaugggaaaugagg

SEQ ID NO: 3898619 - RNA, 16 nt, Human adenovirus A
cauguauaauaaaacu

SEQ ID NO: 3898620 - RNA, 20 nt, Human adenovirus A
cauguggucaggucuaucaa

SEQ ID NO: 3898621 - RNA, 14 nt, Human adenovirus A
cauguuaaaaaacg

SEQ ID NO: 3898622 - RNA, 18 nt, Human adenovirus A
cauguuaagaaaugacac

SEQ ID NO: 3898623 - RNA, 11 nt, Human adenovirus A
cauuacaguag

SEQ ID NO: 3898624 - RNA, 22 nt, Human adenovirus A
cauuacccaagaauaaaaacac

SEQ ID NO: 3898625 - RNA, 23 nt, Human adenovirus A
cauuacccaagaauaaaaacaca

SEQ ID NO: 3898626 - RNA, 17 nt, Human adenovirus A
cauuacuccuaaaacug

SEQ ID NO: 3898627 - RNA, 15 nt, Human adenovirus A
cauuaucaugaaacu

SEQ ID NO: 3898628 - RNA, 16 nt, Human adenovirus A
cauucaacugaccagg

SEQ ID NO: 3898629 - RNA, 19 nt, Human adenovirus A
cauucgcagcgcacuggca

SEQ ID NO: 3898630 - RNA, 15 nt, Human adenovirus A
cauucuuccacuguu

SEQ ID NO: 3898631 - RNA, 12 nt, Human adenovirus A
cauugaaaccag

SEQ ID NO: 3898632 - RNA, 19 nt, Human adenovirus A
cauugacaaagaugcaaac

SEQ ID NO: 3898633 - RNA, 13 nt, Human adenovirus A
cauugcaacgcaa

SEQ ID NO: 3898634 - RNA, 22 nt, Human adenovirus A
cauuggcgcuacggcugucaug

SEQ ID NO: 3898635 - RNA, 16 nt, Human adenovirus A
cauuguaaaugcuuug

SEQ ID NO: 3898636 - RNA, 20 nt, Human adenovirus A
cauuguuggccuguauguga

SEQ ID NO: 3898637 - RNA, 23 nt, Human adenovirus A
cauuuauaguggcacaacacaua

SEQ ID NO: 3898638 - RNA, 19 nt, Human adenovirus A
cauuuuggagcaagcggca

SEQ ID NO: 3898639 - RNA, 18 nt, Human adenovirus A
cauuuuuugaaaagacug

SEQ ID NO: 3898640 - RNA, 15 nt, Human adenovirus A
cauuuuuuguugcuc

SEQ ID NO: 3898641 - RNA, 18 nt, Human adenovirus A
ccaacaugaggcgguggu

SEQ ID NO: 3898642 - RNA, 21 nt, Human adenovirus A
ccaacgcgugaaucgcaguca

SEQ ID NO: 3898643 - RNA, 14 nt, Human adenovirus A
ccaacugguugggu

SEQ ID NO: 3898644 - RNA, 18 nt, Human adenovirus A
ccaagcguagccgcagca

SEQ ID NO: 3898645 - RNA, 14 nt, Human adenovirus A
ccaaguaacaacac

SEQ ID NO: 3898646 - RNA, 16 nt, Human adenovirus A
ccaauaaagaaaaaac

SEQ ID NO: 3898647 - RNA, 14 nt, Human adenovirus A
ccacacgcagcaac

SEQ ID NO: 3898648 - RNA, 18 nt, Human adenovirus A
ccacagccagugggucca

SEQ ID NO: 3898649 - RNA, 11 nt, Human adenovirus A
ccacaggaaag

SEQ ID NO: 3898650 - RNA, 15 nt, Human adenovirus A
ccacagguggugggg

SEQ ID NO: 3898651 - RNA, 17 nt, Human adenovirus A
ccaccgccaugcgcgcg

SEQ ID NO: 3898652 - RNA, 20 nt, Human adenovirus A
ccaccgccaugcgcgcggcc

SEQ ID NO: 3898653 - RNA, 23 nt, Human adenovirus A
ccacggacaccuacuucacccug

SEQ ID NO: 3898654 - RNA, 21 nt, Human adenovirus A
ccacuaaagaccgaugcguua

SEQ ID NO: 3898655 - RNA, 21 nt, Human adenovirus A
ccacuugguguuucaggaaaa

SEQ ID NO: 3898656 - RNA, 19 nt, Human adenovirus A
ccagaaaguaucugcccau

SEQ ID NO: 3898657 - RNA, 20 nt, Human adenovirus A
ccagagcaccccuucccacc

SEQ ID NO: 3898658 - RNA, 16 nt, Human adenovirus A
ccagauuguggaauaa

SEQ ID NO: 3898659 - RNA, 15 nt, Human adenovirus A
ccagcgccaccugcc

SEQ ID NO: 3898660 - RNA, 18 nt, Human adenovirus A
ccagcuaacgccaccagc

SEQ ID NO: 3898661 - RNA, 16 nt, Human adenovirus A
ccaggcaggcgcggcg

SEQ ID NO: 3898662 - RNA, 15 nt, Human adenovirus A
ccaggcgggcugcaa

SEQ ID NO: 3898663 - RNA, 16 nt, Human adenovirus A
ccaggcgggcugcaac

SEQ ID NO: 3898664 - RNA, 14 nt, Human adenovirus A
ccaggggugguggg

SEQ ID NO: 3898665 - RNA, 14 nt, Human adenovirus A
ccagguaauuuuca

SEQ ID NO: 3898666 - RNA, 22 nt, Human adenovirus A
ccaguguuagucgcgcacuggg

SEQ ID NO: 3898667 - RNA, 21 nt, Human adenovirus A
uccaaugaaacccgcugugag

SEQ ID NO: 3898668 - RNA, 16 nt, Human adenovirus A
uccacggugcacuuuu

SEQ ID NO: 3898669 - RNA, 19 nt, Human adenovirus A
uccagaaaguaucugccca

SEQ ID NO: 3898670 - RNA, 13 nt, Human adenovirus A
uccagagcccccg

SEQ ID NO: 3898671 - RNA, 20 nt, Human adenovirus A
uccaucaccuuugugugcua

SEQ ID NO: 3898672 - RNA, 21 nt, Human adenovirus A
uccauguggagguauaacaaa

SEQ ID NO: 3898673 - RNA, 23 nt, Human adenovirus A
uccauguuaaguuugggaaaguu

SEQ ID NO: 3898674 - RNA, 17 nt, Human adenovirus A
ucccacauacaucaccu

SEQ ID NO: 3898675 - RNA, 22 nt, Human adenovirus A
ucccauagcucaguuauauuuu

SEQ ID NO: 3898676 - RNA, 13 nt, Human adenovirus A
ucccauuacagua

SEQ ID NO: 3898677 - RNA, 20 nt, Human adenovirus A
ucccauuacaguagagucuu

SEQ ID NO: 3898678 - RNA, 19 nt, Human adenovirus A
ucccgauaccaaaaacacc

SEQ ID NO: 3898679 - RNA, 20 nt, Human adenovirus A
ucccgauaccaaaaacaccu

SEQ ID NO: 3898680 - RNA, 19 nt, Human adenovirus A
ucccucuuggccagcugcc

SEQ ID NO: 3898681 - RNA, 15 nt, Human adenovirus A
ucccugugcuucggc

SEQ ID NO: 3898682 - RNA, 23 nt, Human adenovirus A
uccgauaaaaaagguagcuccag

SEQ ID NO: 3898683 - RNA, 18 nt, Human adenovirus A
uccgcguggucaggaaga

SEQ ID NO: 3898684 - RNA, 16 nt, Human adenovirus A
uccguacaaggcauug

SEQ ID NO: 3898685 - RNA, 14 nt, Human adenovirus A
uccguggcaggcca

SEQ ID NO: 3898686 - RNA, 14 nt, Human adenovirus A
uccuaaugcuucac

SEQ ID NO: 3898687 - RNA, 20 nt, Human adenovirus A
uccuacaaggcucgcuuuac

SEQ ID NO: 3898688 - RNA, 20 nt, Human adenovirus A
uccucuuccucuucugcugc

SEQ ID NO: 3898689 - RNA, 14 nt, Human adenovirus A
uccucuucugcugc

SEQ ID NO: 3898690 - RNA, 22 nt, Human adenovirus A
uccugaugcuuuucgccagcag

SEQ ID NO: 3898691 - RNA, 19 nt, Human adenovirus A
uccugauuguagcuacaga

SEQ ID NO: 3898692 - RNA, 21 nt, Human adenovirus A
uccugcgacaaaugcgaccuc

SEQ ID NO: 3898693 - RNA, 13 nt, Human adenovirus A
uccuuucucugug

SEQ ID NO: 3898694 - RNA, 16 nt, Human adenovirus A
uccuuuucuuacauua

SEQ ID NO: 3898695 - RNA, 18 nt, Human adenovirus A
uccuuuuucuacaggcag

SEQ ID NO: 3898696 - RNA, 22 nt, Human adenovirus A
ucgacagugagccguccagcag

SEQ ID NO: 3898697 - RNA, 19 nt, Human adenovirus A
ucgaccuguggcaccugca

SEQ ID NO: 3898698 - RNA, 19 nt, Human adenovirus A
ucgagaucuaggcugugga

SEQ ID NO: 3898699 - RNA, 23 nt, Human adenovirus A
ucgcagcugacaucuuaaugcca

SEQ ID NO: 3898700 - RNA, 13 nt, Human adenovirus A
ucgcgacaacagc

SEQ ID NO: 3898701 - RNA, 15 nt, Human adenovirus A
ucgcuuuugccagac

SEQ ID NO: 3898702 - RNA, 15 nt, Human adenovirus A
ucggcggacagagca

SEQ ID NO: 3898703 - RNA, 21 nt, Human adenovirus A
ucggcuguauacuaccccucc

SEQ ID NO: 3898704 - RNA, 23 nt, Human adenovirus A
ucguccaaccaacgaacacggag

SEQ ID NO: 3898705 - RNA, 22 nt, Human adenovirus A
ucguguuauguggcgcauccca

SEQ ID NO: 3898706 - RNA, 20 nt, Human adenovirus A
ucuaaaguaccaggaagcug

SEQ ID NO: 3898707 - RNA, 23 nt, Human adenovirus A
ucuaaugcaaguuguaaggcaug

SEQ ID NO: 3898708 - RNA, 18 nt, Human adenovirus A
ucuacaacgagcaagccg

SEQ ID NO: 3898709 - RNA, 16 nt, Human adenovirus A
ucuacuguugaugcag

SEQ ID NO: 3898710 - RNA, 11 nt, Human adenovirus A
ucuagaaacug

SEQ ID NO: 3898711 - RNA, 16 nt, Human adenovirus A
ucuagaacaaaaagga

SEQ ID NO: 3898712 - RNA, 18 nt, Human adenovirus A
ucuagugcaacauuugua

SEQ ID NO: 3898713 - RNA, 15 nt, Human adenovirus A
ucuauagguacgaaa

SEQ ID NO: 3898714 - RNA, 18 nt, Human adenovirus A
ucuauaguaaaaaugcca

SEQ ID NO: 3898715 - RNA, 13 nt, Human adenovirus A
ucucauaaucagu

SEQ ID NO: 3898716 - RNA, 13 nt, Human adenovirus A
ucucuacagcccc

SEQ ID NO: 3898717 - RNA, 14 nt, Human adenovirus A
ucucuuuucuuuac

SEQ ID NO: 3898718 - RNA, 14 nt, Human adenovirus A
ucugcccauuuuug

SEQ ID NO: 3898719 - RNA, 14 nt, Human adenovirus A
ucuggaucuucaaa

SEQ ID NO: 3898720 - RNA, 19 nt, Human adenovirus A
ucuguguauacgccuccua

SEQ ID NO: 3898721 - RNA, 13 nt, Human adenovirus A
ucuuaaaaauuuu

SEQ ID NO: 3898722 - RNA, 18 nt, Human adenovirus A
ucuuacaugggcaucuug

SEQ ID NO: 3898723 - RNA, 18 nt, Human adenovirus A
ucuucagagcacacuggg

SEQ ID NO: 3898724 - RNA, 21 nt, Human adenovirus A
ucuucccaacugucaaaccug

SEQ ID NO: 3898725 - RNA, 18 nt, Human adenovirus A
ucuuuaaaaaucacaaaa

SEQ ID NO: 3898726 - RNA, 13 nt, Human adenovirus A
ucuuuagaaacuu

SEQ ID NO: 3898727 - RNA, 14 nt, Human adenovirus A
ucuuuugcagcucc

SEQ ID NO: 3898728 - RNA, 11 nt, Human adenovirus A
ugaacacacug

SEQ ID NO: 3898729 - RNA, 14 nt, Human adenovirus A
ugaacgauuuuaug

SEQ ID NO: 3898730 - RNA, 15 nt, Human adenovirus A
ugaaggcauuuaagg

SEQ ID NO: 3898731 - RNA, 13 nt, Human adenovirus A
ugaaucuguggau

SEQ ID NO: 3898732 - RNA, 20 nt, Human adenovirus A
ugaaugcguaaaucucgcag

SEQ ID NO: 3898733 - RNA, 23 nt, Human adenovirus A
ugaauguguuccaguauuuugua

SEQ ID NO: 3898734 - RNA, 18 nt, Human adenovirus A
ugaauguuuguacacuuu

SEQ ID NO: 3898735 - RNA, 15 nt, Human adenovirus A
ugacaaacguuuucc

SEQ ID NO: 3898736 - RNA, 18 nt, Human adenovirus A
ugaccaccuuacccuguc

SEQ ID NO: 3898737 - RNA, 20 nt, Human adenovirus A
ugacccaccaccaaacugca

SEQ ID NO: 3898738 - RNA, 12 nt, Human adenovirus A
ugacuggacagc

SEQ ID NO: 3898739 - RNA, 20 nt, Human adenovirus A
ugaggacacugaaggcauuu

SEQ ID NO: 3898740 - RNA, 16 nt, Human adenovirus A
ugaguaacuucaacau

SEQ ID NO: 3898741 - RNA, 22 nt, Human adenovirus A
ugaguuaucuugguaggcaauu

SEQ ID NO: 3898742 - RNA, 12 nt, Human adenovirus A
ugauaugaaguu

SEQ ID NO: 3898743 - RNA, 14 nt, Human adenovirus A
ugaucgcucuucaa

SEQ ID NO: 3898744 - RNA, 16 nt, Human adenovirus A
ugaugcauaaugcgga

SEQ ID NO: 3898745 - RNA, 14 nt, Human adenovirus A
caacaaaacacuga

SEQ ID NO: 3898746 - RNA, 21 nt, Human adenovirus A
caacaaaacuuaucagccaga

SEQ ID NO: 3898747 - RNA, 14 nt, Human adenovirus A
caacaacagcuucu

SEQ ID NO: 3898748 - RNA, 13 nt, Human adenovirus A
caacaagaugagu

SEQ ID NO: 3898749 - RNA, 17 nt, Human adenovirus A
caacaccaacaguuuaa

SEQ ID NO: 3898750 - RNA, 16 nt, Human adenovirus A
caacaguacaggcaac

SEQ ID NO: 3898751 - RNA, 19 nt, Human adenovirus A
caacauugcccuguaugcu

SEQ ID NO: 3898752 - RNA, 21 nt, Human adenovirus A
caaccguuuagagccgcggcc

SEQ ID NO: 3898753 - RNA, 19 nt, Human adenovirus A
caaccuauuaaccugggau

SEQ ID NO: 3898754 - RNA, 13 nt, Human adenovirus A
caacguagcuuuu

SEQ ID NO: 3898755 - RNA, 23 nt, Human adenovirus A
caacguagcuuuugacuguuccu

SEQ ID NO: 3898756 - RNA, 14 nt, Human adenovirus A
caacugauuuucau

SEQ ID NO: 3898757 - RNA, 17 nt, Human adenovirus A
caacuuaacccucccuc

SEQ ID NO: 3898758 - RNA, 18 nt, Human adenovirus A
caacuuuuaacauuagca

SEQ ID NO: 3898759 - RNA, 18 nt, Human adenovirus A
caagaaggccauguacuu

SEQ ID NO: 3898760 - RNA, 15 nt, Human adenovirus A
caagacagaaauaca

SEQ ID NO: 3898761 - RNA, 23 nt, Human adenovirus A
caagaccaguucgcccuccuagg

SEQ ID NO: 3898762 - RNA, 18 nt, Human adenovirus A
caagacggucagcaagga

SEQ ID NO: 3898763 - RNA, 19 nt, Human adenovirus A
caagauccggugacuuuuc

SEQ ID NO: 3898764 - RNA, 16 nt, Human adenovirus A
caagcacgccaaagcc

SEQ ID NO: 3898765 - RNA, 19 nt, Human adenovirus A
caagcacgccaaagccaca

SEQ ID NO: 3898766 - RNA, 23 nt, Human adenovirus A
caagcauguuaaaaaacgggaaa

SEQ ID NO: 3898767 - RNA, 13 nt, Human adenovirus A
caagcgcugaaac

SEQ ID NO: 3898768 - RNA, 17 nt, Human adenovirus A
caagcgugcaaacagac

SEQ ID NO: 3898769 - RNA, 11 nt, Human adenovirus A
caagcugaaac

SEQ ID NO: 3898770 - RNA, 13 nt, Human adenovirus A
caaggaaauacua

SEQ ID NO: 3898771 - RNA, 15 nt, Human adenovirus A
caaggcguggaacag

SEQ ID NO: 3898772 - RNA, 23 nt, Human adenovirus A
caagucuucugacauugcuucau

SEQ ID NO: 3898773 - RNA, 18 nt, Human adenovirus A
caaguucaaagaagagcu

SEQ ID NO: 3898774 - RNA, 21 nt, Human adenovirus A
caauaaaacaaggagccgcuc

SEQ ID NO: 3898775 - RNA, 17 nt, Human adenovirus A
caauaaagaaaaaacuu

SEQ ID NO: 3898776 - RNA, 20 nt, Human adenovirus A
caauaaauacugcucccucu

SEQ ID NO: 3898777 - RNA, 16 nt, Human adenovirus A
caauacugaauauuua

SEQ ID NO: 3898778 - RNA, 13 nt, Human adenovirus A
caauauuccagcu

SEQ ID NO: 3898779 - RNA, 23 nt, Human adenovirus A
caauccaaggaugacaacauuga

SEQ ID NO: 3898780 - RNA, 13 nt, Human adenovirus A
caaucucaguguc

SEQ ID NO: 3898781 - RNA, 15 nt, Human adenovirus A
caaugaaacccgcug

SEQ ID NO: 3898782 - RNA, 20 nt, Human adenovirus A
caaugaauaagccaccgcuc

SEQ ID NO: 3898783 - RNA, 15 nt, Human adenovirus A
caaugacaaugaaua

SEQ ID NO: 3898784 - RNA, 21 nt, Human adenovirus A
caaugcagcuguggagggcau

SEQ ID NO: 3898785 - RNA, 20 nt, Human adenovirus A
caauuugccuaaaagcuauu

SEQ ID NO: 3898786 - RNA, 11 nt, Human adenovirus A
cacaaaacaca

SEQ ID NO: 3898787 - RNA, 15 nt, Human adenovirus A
cacaaaacacaaauu

SEQ ID NO: 3898788 - RNA, 23 nt, Human adenovirus A
cacaauaacuacaaacaguuuca

SEQ ID NO: 3898789 - RNA, 14 nt, Human adenovirus A
cacaaugcauuaau

SEQ ID NO: 3898790 - RNA, 23 nt, Human adenovirus A
cacacuaauagcgcgagaagaag

SEQ ID NO: 3898791 - RNA, 13 nt, Human adenovirus A
cacagcuggcgca

SEQ ID NO: 3898792 - RNA, 22 nt, Human adenovirus A
cacagcuggcgcacaaguugca

SEQ ID NO: 3898793 - RNA, 14 nt, Human adenovirus A
cacagucacaaggu

SEQ ID NO: 3898794 - RNA, 13 nt, Human adenovirus A
cacauacaucacc

SEQ ID NO: 3898795 - RNA, 12 nt, Human adenovirus A
cacaucuacaaa

SEQ ID NO: 3898796 - RNA, 21 nt, Human adenovirus A
cacaugauggaucuggagcca

SEQ ID NO: 3898797 - RNA, 14 nt, Human adenovirus A
cacaugucuccuuc

SEQ ID NO: 3898798 - RNA, 20 nt, Human adenovirus A
cacauucaacugaccagguc

SEQ ID NO: 3898799 - RNA, 16 nt, Human adenovirus A
caccaaacgcccgcua

SEQ ID NO: 3898800 - RNA, 20 nt, Human adenovirus A
caccaaauuuaaggccaggg

SEQ ID NO: 3898801 - RNA, 15 nt, Human adenovirus A
caccaccaaacugca

SEQ ID NO: 3898802 - RNA, 20 nt, Human adenovirus A
caccagguguauuagcacuu

SEQ ID NO: 3898803 - RNA, 21 nt, Human adenovirus A
caccaugguaaaaaggaagca

SEQ ID NO: 3898804 - RNA, 15 nt, Human adenovirus A
caccgcccaggcagg

SEQ ID NO: 3898805 - RNA, 21 nt, Human adenovirus A
caccgcucccgccauuggcgc

SEQ ID NO: 3898806 - RNA, 23 nt, Human adenovirus A
caccucaaaaucuaagccaugca

SEQ ID NO: 3898807 - RNA, 11 nt, Human adenovirus A
caccugccauu

SEQ ID NO: 3898808 - RNA, 14 nt, Human adenovirus A
caccuuuuguuaau

SEQ ID NO: 3898809 - RNA, 19 nt, Human adenovirus A
cacgccaaagccacaccuc

SEQ ID NO: 3898810 - RNA, 20 nt, Human adenovirus A
cacgccaaagccacaccucc

SEQ ID NO: 3898811 - RNA, 21 nt, Human adenovirus A
cacggccggaugcagaggaaa

SEQ ID NO: 3898812 - RNA, 22 nt, Human adenovirus A
cacgggcccauguaucagcagc

SEQ ID NO: 3898813 - RNA, 21 nt, Human adenovirus A
cacgggcuggggacugggugc

SEQ ID NO: 3898814 - RNA, 18 nt, Human adenovirus A
cacgguuccacggugcac

SEQ ID NO: 3898815 - RNA, 15 nt, Human adenovirus A
cacucugacacaaaa

SEQ ID NO: 3898816 - RNA, 23 nt, Human adenovirus A
cacuggcaacauaccauauuuuc

SEQ ID NO: 3898817 - RNA, 15 nt, Human adenovirus A
cacuggcuggcuuuu

SEQ ID NO: 3898818 - RNA, 14 nt, Human adenovirus A
cacuguaagaggag

SEQ ID NO: 3898819 - RNA, 15 nt, Human adenovirus A
cacuguagugcaaaa

SEQ ID NO: 3898820 - RNA, 23 nt, Human adenovirus A
cacugucagugaagcaaaccaca

SEQ ID NO: 3898821 - RNA, 17 nt, Human adenovirus A
cacuguuguauuauuug

SEQ ID NO: 3898822 - RNA, 20 nt, Human adenovirus A
cacuuggcuucgaaugcugu

SEQ ID NO: 3898823 - RNA, 21 nt, Human adenovirus A
cacuuuaauaaaaacacugug

SEQ ID NO: 3898824 - RNA, 23 nt, Human adenovirus A
cagaacauguuucgcgacaacag

SEQ ID NO: 3898825 - RNA, 23 nt, Human adenovirus A
cagaaggaguaauaaaaccugug

SEQ ID NO: 3898826 - RNA, 13 nt, Human adenovirus A
cagaauauaagaa

SEQ ID NO: 3898827 - RNA, 18 nt, Human adenovirus A
cagaauauaagaacuaca

SEQ ID NO: 3898828 - RNA, 15 nt, Human adenovirus A
cagacaguggcuuuu

SEQ ID NO: 3898829 - RNA, 23 nt, Human adenovirus A
cagacuaaauggaagacaucaau

SEQ ID NO: 3898830 - RNA, 17 nt, Human adenovirus A
cagagcacacugggaaa

SEQ ID NO: 3898831 - RNA, 14 nt, Human adenovirus A
cagagcgcggcugc

SEQ ID NO: 3898832 - RNA, 17 nt, Human adenovirus A
cagaugauggaaagccg

SEQ ID NO: 3898833 - RNA, 22 nt, Human adenovirus A
cagaugggaaaaucaauaccac

SEQ ID NO: 3898834 - RNA, 20 nt, Human adenovirus A
cagauguaacaggcggcucc

SEQ ID NO: 3898835 - RNA, 18 nt, Human adenovirus A
cagauuaagcaacauacu

SEQ ID NO: 3898836 - RNA, 14 nt, Human adenovirus A
cagcaaacacugcu

SEQ ID NO: 3898837 - RNA, 16 nt, Human adenovirus A
gaaacuuucagcccau

SEQ ID NO: 3898838 - RNA, 18 nt, Human adenovirus A
gaaaguaacucuuguaaa

SEQ ID NO: 3898839 - RNA, 14 nt, Human adenovirus A
gaaaugaggcgcgc

SEQ ID NO: 3898840 - RNA, 22 nt, Human adenovirus A
gaacaacuuuuaacauuagcag

SEQ ID NO: 3898841 - RNA, 17 nt, Human adenovirus A
gaacaauaaaaaaaaca

SEQ ID NO: 3898842 - RNA, 15 nt, Human adenovirus A
gaacaauuucaucaa

SEQ ID NO: 3898843 - RNA, 19 nt, Human adenovirus A
gaacacgguacuuuuccuu

SEQ ID NO: 3898844 - RNA, 17 nt, Human adenovirus A
gaacagacaccgcccag

SEQ ID NO: 3898845 - RNA, 15 nt, Human adenovirus A
gaacaucaacugugc

SEQ ID NO: 3898846 - RNA, 13 nt, Human adenovirus A
gaaccuuugacaa

SEQ ID NO: 3898847 - RNA, 17 nt, Human adenovirus A
gaacggagagggugacg

SEQ ID NO: 3898848 - RNA, 14 nt, Human adenovirus A
gaacgguugcuucu

SEQ ID NO: 3898849 - RNA, 14 nt, Human adenovirus A
gaacuaaacaaacu

SEQ ID NO: 3898850 - RNA, 22 nt, Human adenovirus A
gaacuauuaagugaaagucaag

SEQ ID NO: 3898851 - RNA, 18 nt, Human adenovirus A
gaagaauggcuguugaug

SEQ ID NO: 3898852 - RNA, 14 nt, Human adenovirus A
gaagagcugcugca

SEQ ID NO: 3898853 - RNA, 19 nt, Human adenovirus A
gaagcgguaugucggccug

SEQ ID NO: 3898854 - RNA, 17 nt, Human adenovirus A
gaagcugagcaaugcua

SEQ ID NO: 3898855 - RNA, 13 nt, Human adenovirus A
gaagcuggccaua

SEQ ID NO: 3898856 - RNA, 23 nt, Human adenovirus A
gaaggucagauucuucuucccaa

SEQ ID NO: 3898857 - RNA, 13 nt, Human adenovirus A
gaaguaagcuguu

SEQ ID NO: 3898858 - RNA, 16 nt, Human adenovirus A
gaaguaagcuguuuua

SEQ ID NO: 3898859 - RNA, 22 nt, Human adenovirus A
gaaguagccauugguuuaaugc

SEQ ID NO: 3898860 - RNA, 23 nt, Human adenovirus A
gaaguauuccaugagcccgggga

SEQ ID NO: 3898861 - RNA, 20 nt, Human adenovirus A
gaagucaacuaaaaauuguu

SEQ ID NO: 3898862 - RNA, 16 nt, Human adenovirus A
gaauaaaauuucuaga

SEQ ID NO: 3898863 - RNA, 12 nt, Human adenovirus A
gaaucuguggau

SEQ ID NO: 3898864 - RNA, 14 nt, Human adenovirus A
gaauuacuaaaaca

SEQ ID NO: 3898865 - RNA, 15 nt, Human adenovirus A
gacaacuuaacaaau

SEQ ID NO: 3898866 - RNA, 16 nt, Human adenovirus A
gacaaguugcuuucca

SEQ ID NO: 3898867 - RNA, 16 nt, Human adenovirus A
gacaccgcccaggcag

SEQ ID NO: 3898868 - RNA, 18 nt, Human adenovirus A
gacaccgcccaggcaggc

SEQ ID NO: 3898869 - RNA, 15 nt, Human adenovirus A
gacagaguugcuuuu

SEQ ID NO: 3898870 - RNA, 12 nt, Human adenovirus A
gacagcaagcag

SEQ ID NO: 3898871 - RNA, 13 nt, Human adenovirus A
gacagugugagug

SEQ ID NO: 3898872 - RNA, 14 nt, Human adenovirus A
gacaguuucaucac

SEQ ID NO: 3898873 - RNA, 21 nt, Human adenovirus A
gacauccaugugaugccggca

SEQ ID NO: 3898874 - RNA, 12 nt, Human adenovirus A
gacccauauuag

SEQ ID NO: 3898875 - RNA, 23 nt, Human adenovirus A
gacccgacggaguguuucagcuc

SEQ ID NO: 3898876 - RNA, 12 nt, Human adenovirus A
gaccugcaacag

SEQ ID NO: 3898877 - RNA, 17 nt, Human adenovirus A
gacgcucuggcagggga

SEQ ID NO: 3898878 - RNA, 13 nt, Human adenovirus A
gacgggccaggcg

SEQ ID NO: 3898879 - RNA, 12 nt, Human adenovirus A
gacucagugacc

SEQ ID NO: 3898880 - RNA, 15 nt, Human adenovirus A
gacucauaagcugug

SEQ ID NO: 3898881 - RNA, 11 nt, Human adenovirus A
gacuuccaggu

SEQ ID NO: 3898882 - RNA, 15 nt, Human adenovirus A
gacuucccacagcca

SEQ ID NO: 3898883 - RNA, 22 nt, Human adenovirus A
gacuuggaagaaugggaggagg

SEQ ID NO: 3898884 - RNA, 15 nt, Human adenovirus A
gacuuuguagaagcu

SEQ ID NO: 3898885 - RNA, 18 nt, Human adenovirus A
gagaaccgucugcaugau

SEQ ID NO: 3898886 - RNA, 15 nt, Human adenovirus A
gagaagcggagccac

SEQ ID NO: 3898887 - RNA, 16 nt, Human adenovirus A
gagaaggacaaaaguc

SEQ ID NO: 3898888 - RNA, 23 nt, Human adenovirus A
gagacuucccacagccagugggu

SEQ ID NO: 3898889 - RNA, 23 nt, Human adenovirus A
gagauuggcaauguuaccugcca

SEQ ID NO: 3898890 - RNA, 15 nt, Human adenovirus A
gagcaccccuuccca

SEQ ID NO: 3898891 - RNA, 17 nt, Human adenovirus A
gagccacagccccuagc

SEQ ID NO: 3898892 - RNA, 13 nt, Human adenovirus A
gagccacagcucu

SEQ ID NO: 3898893 - RNA, 19 nt, Human adenovirus A
gagccacuucauucaucau

SEQ ID NO: 3898894 - RNA, 14 nt, Human adenovirus A
gagccauguugugc

SEQ ID NO: 3898895 - RNA, 20 nt, Human adenovirus A
gagcccgaaguugacuggca

SEQ ID NO: 3898896 - RNA, 20 nt, Human adenovirus A
gagcccggcguaaccaaaua

SEQ ID NO: 3898897 - RNA, 22 nt, Human adenovirus A
gagcccuauccgucuccagcua

SEQ ID NO: 3898898 - RNA, 15 nt, Human adenovirus A
gagcgcccuuaacca

SEQ ID NO: 3898899 - RNA, 18 nt, Human adenovirus A
gagcggcugacagagcgc

SEQ ID NO: 3898900 - RNA, 23 nt, Human adenovirus A
gagcuguccaugguaucagucag

SEQ ID NO: 3898901 - RNA, 17 nt, Human adenovirus A
gaggaauaucaacugcu

SEQ ID NO: 3898902 - RNA, 16 nt, Human adenovirus A
gaggacgaccccgccg

SEQ ID NO: 3898903 - RNA, 22 nt, Human adenovirus A
gaggcguagaugugcuguggaa

SEQ ID NO: 3898904 - RNA, 21 nt, Human adenovirus A
gagggugccacccccagugcc

SEQ ID NO: 3898905 - RNA, 14 nt, Human adenovirus A
gaggucaagaacac

SEQ ID NO: 3898906 - RNA, 14 nt, Human adenovirus A
auuuaaggccaggg

SEQ ID NO: 3898907 - RNA, 11 nt, Human adenovirus A
auuuaggacac

SEQ ID NO: 3898908 - RNA, 20 nt, Human adenovirus A
auuuccagguggggaaaaug

SEQ ID NO: 3898909 - RNA, 16 nt, Human adenovirus A
auuucuaauguggagc

SEQ ID NO: 3898910 - RNA, 12 nt, Human adenovirus A
auuucuuccucc

SEQ ID NO: 3898911 - RNA, 19 nt, Human adenovirus A
auuugaaauuuuuaagugg

SEQ ID NO: 3898912 - RNA, 14 nt, Human adenovirus A
auuugaacacacug

SEQ ID NO: 3898913 - RNA, 15 nt, Human adenovirus A
auuugacuuccaggu

SEQ ID NO: 3898914 - RNA, 14 nt, Human adenovirus A
auuugaucagaaaa

SEQ ID NO: 3898915 - RNA, 19 nt, Human adenovirus A
auuuggauuuucugaucaa

SEQ ID NO: 3898916 - RNA, 20 nt, Human adenovirus A
auuugucugaaaauugcaug

SEQ ID NO: 3898917 - RNA, 13 nt, Human adenovirus A
auuuuaacuguga

SEQ ID NO: 3898918 - RNA, 18 nt, Human adenovirus A
auuuuauccuacaaaaag

SEQ ID NO: 3898919 - RNA, 16 nt, Human adenovirus A
auuuuauuauuugcug

SEQ ID NO: 3898920 - RNA, 17 nt, Human adenovirus A
auuuucuccccacagcu

SEQ ID NO: 3898921 - RNA, 22 nt, Human adenovirus A
auuuugcaaguguaauuuucca

SEQ ID NO: 3898922 - RNA, 15 nt, Human adenovirus A
auuuugccagcucuu

SEQ ID NO: 3898923 - RNA, 19 nt, Human adenovirus A
auuuuucuuuuauuucucu

SEQ ID NO: 3898924 - RNA, 19 nt, Human adenovirus A
auuuuuugggaaccuuuga

SEQ ID NO: 3898925 - RNA, 21 nt, Human adenovirus A
caaaaauuuucccaacaaugg

SEQ ID NO: 3898926 - RNA, 17 nt, Human adenovirus A
caaaaggcgcuccuaau

SEQ ID NO: 3898927 - RNA, 20 nt, Human adenovirus A
caaaauaccccuauccuguc

SEQ ID NO: 3898928 - RNA, 17 nt, Human adenovirus A
caaaauugaggaauguc

SEQ ID NO: 3898929 - RNA, 18 nt, Human adenovirus A
caaacacggauacuuaau

SEQ ID NO: 3898930 - RNA, 18 nt, Human adenovirus A
caaacagccgaaagacca

SEQ ID NO: 3898931 - RNA, 15 nt, Human adenovirus A
caaacagcuguggaa

SEQ ID NO: 3898932 - RNA, 10 nt, Human adenovirus A
caaacagugc

SEQ ID NO: 3898933 - RNA, 18 nt, Human adenovirus A
caaacgauuauugucaca

SEQ ID NO: 3898934 - RNA, 20 nt, Human adenovirus A
caaacggguggaaaaacaac

SEQ ID NO: 3898935 - RNA, 12 nt, Human adenovirus A
caaacuacauag

SEQ ID NO: 3898936 - RNA, 19 nt, Human adenovirus A
cuaacugcucagcuggaag

SEQ ID NO: 3898937 - RNA, 21 nt, Human adenovirus A
cuaagaaggcacccucccaga

SEQ ID NO: 3898938 - RNA, 12 nt, Human adenovirus A
cuaauagcacuu

SEQ ID NO: 3898939 - RNA, 22 nt, Human adenovirus A
cuaauugcccccuuuaccaaca

SEQ ID NO: 3898940 - RNA, 14 nt, Human adenovirus A
cuacaacugcuccc

SEQ ID NO: 3898941 - RNA, 14 nt, Human adenovirus A
cuacacaacacaaa

SEQ ID NO: 3898942 - RNA, 15 nt, Human adenovirus A
cuacacaacacaaaa

SEQ ID NO: 3898943 - RNA, 21 nt, Human adenovirus A
cuacauuggaguuggaagaag

SEQ ID NO: 3898944 - RNA, 17 nt, Human adenovirus A
cuaccaccuaagaaggc

SEQ ID NO: 3898945 - RNA, 14 nt, Human adenovirus A
cuaccugacacuac

SEQ ID NO: 3898946 - RNA, 15 nt, Human adenovirus A
cuacgcugguaacua

SEQ ID NO: 3898947 - RNA, 20 nt, Human adenovirus A
cuacgugcgccaagccugua

SEQ ID NO: 3898948 - RNA, 19 nt, Human adenovirus A
cuacuaacaacuccagaug

SEQ ID NO: 3898949 - RNA, 16 nt, Human adenovirus A
cuacucacgagaaagu

SEQ ID NO: 3898950 - RNA, 20 nt, Human adenovirus A
cuacuucaccgcgcaagcuu

SEQ ID NO: 3898951 - RNA, 22 nt, Human adenovirus A
cuacuuuauaacuaacuuuaau

SEQ ID NO: 3898952 - RNA, 20 nt, Human adenovirus A
cuagagcacaugaaggugga

SEQ ID NO: 3898953 - RNA, 18 nt, Human adenovirus A
cuagccaacauccagugc

SEQ ID NO: 3898954 - RNA, 19 nt, Human adenovirus A
cuagccaacauccagugcg

SEQ ID NO: 3898955 - RNA, 20 nt, Human adenovirus A
cuagccccugucaacagcau

SEQ ID NO: 3898956 - RNA, 17 nt, Human adenovirus A
cuagcuuaccacucaga

SEQ ID NO: 3898957 - RNA, 23 nt, Human adenovirus A
cuaguucuugucaacuacauaaa

SEQ ID NO: 3898958 - RNA, 22 nt, Human adenovirus A
cuauaacaguaccaaugugcag

SEQ ID NO: 3898959 - RNA, 18 nt, Human adenovirus A
cuaucaaacuauauaaau

SEQ ID NO: 3898960 - RNA, 17 nt, Human adenovirus A
cuaucaucaaacugccu

SEQ ID NO: 3898961 - RNA, 12 nt, Human adenovirus A
cuaugaaucuuu

SEQ ID NO: 3898962 - RNA, 20 nt, Human adenovirus A
cuaugaugcgggcagccagg

SEQ ID NO: 3898963 - RNA, 16 nt, Human adenovirus A
cuauuguuaacacugc

SEQ ID NO: 3898964 - RNA, 13 nt, Human adenovirus A
cucaaaaacucca

SEQ ID NO: 3898965 - RNA, 21 nt, Human adenovirus A
cucaaacgccgacgcugcuac

SEQ ID NO: 3898966 - RNA, 16 nt, Human adenovirus A
cucaaagugaagugua

SEQ ID NO: 3898967 - RNA, 18 nt, Human adenovirus A
cucacauuguguaaccag

SEQ ID NO: 3898968 - RNA, 15 nt, Human adenovirus A
cucacuuaagucuuu

SEQ ID NO: 3898969 - RNA, 16 nt, Human adenovirus A
cucacuuugccuaccc

SEQ ID NO: 3898970 - RNA, 17 nt, Human adenovirus A
cucauccgcccaaacuu

SEQ ID NO: 3898971 - RNA, 15 nt, Human adenovirus A
cucaugaccauguaa

SEQ ID NO: 3898972 - RNA, 12 nt, Human adenovirus A
cucauuugcaag

SEQ ID NO: 3898973 - RNA, 20 nt, Human adenovirus A
cuccaaccaugaaaacagca

SEQ ID NO: 3898974 - RNA, 19 nt, Human adenovirus A
cuccaauuuguggaggaau

SEQ ID NO: 3898975 - RNA, 14 nt, Human adenovirus A
cuccauggggcgcg

SEQ ID NO: 3898976 - RNA, 13 nt, Human adenovirus A
cucccacccauga

SEQ ID NO: 3898977 - RNA, 12 nt, Human adenovirus A
cuccccacagcu

SEQ ID NO: 3898978 - RNA, 15 nt, Human adenovirus A
cuccccauucgcagc

SEQ ID NO: 3898979 - RNA, 13 nt, Human adenovirus A
cuccccuguggag

SEQ ID NO: 3898980 - RNA, 22 nt, Human adenovirus A
cuccgugaguuggccuggaaau

SEQ ID NO: 3898981 - RNA, 21 nt, Human adenovirus A
cuccuauguuagcgccagagg

SEQ ID NO: 3898982 - RNA, 12 nt, Human adenovirus A
cuccugccacca

SEQ ID NO: 3898983 - RNA, 14 nt, Human adenovirus A
cuccuuauccuucc

SEQ ID NO: 3898984 - RNA, 15 nt, Human adenovirus A
cucgcagcucuuauu

SEQ ID NO: 3898985 - RNA, 17 nt, Human adenovirus A
cucgcagcucuuauuuu

SEQ ID NO: 3898986 - RNA, 17 nt, Human adenovirus A
cucgucaagccuaccug

SEQ ID NO: 3898987 - RNA, 21 nt, Human adenovirus A
cucuaaguucuguuucaugua

SEQ ID NO: 3898988 - RNA, 14 nt, Human adenovirus A
cucuccaauuugug

SEQ ID NO: 3898989 - RNA, 17 nt, Human adenovirus A
cucuggcgaacaggaag

SEQ ID NO: 3898990 - RNA, 18 nt, Human adenovirus A
cucuguaguuucuuuaca

SEQ ID NO: 3898991 - RNA, 22 nt, Human adenovirus A
cucuuauaggccaaacagcugu

SEQ ID NO: 3898992 - RNA, 14 nt, Human adenovirus A
cucuucccaacugu

SEQ ID NO: 3898993 - RNA, 16 nt, Human adenovirus A
cucuuuugcagcucca

SEQ ID NO: 3898994 - RNA, 13 nt, Human adenovirus A
cugaaaacaacug

SEQ ID NO: 3898995 - RNA, 15 nt, Human adenovirus A
cugaacgggggcgcc

SEQ ID NO: 3898996 - RNA, 23 nt, Human adenovirus A
cugaagcgcgugucuucucccug

SEQ ID NO: 3898997 - RNA, 16 nt, Human adenovirus A
cugaaggcauuuaagg

SEQ ID NO: 3898998 - RNA, 15 nt, Human adenovirus A
cugaagugccucaaa

SEQ ID NO: 3898999 - RNA, 14 nt, Human adenovirus A
cugacauacacugu

SEQ ID NO: 3899000 - RNA, 16 nt, Human adenovirus A
cugacgggagcaggaa

SEQ ID NO: 3899001 - RNA, 15 nt, Human adenovirus A
cugacgucacuggcg

SEQ ID NO: 3899002 - RNA, 14 nt, Human adenovirus A
cugacuauuucaca

SEQ ID NO: 3899003 - RNA, 15 nt, Human adenovirus A
cugacuauuucacaa

SEQ ID NO: 3899004 - RNA, 18 nt, Human adenovirus A
cugagaaccgucugcaug

SEQ ID NO: 3899005 - RNA, 19 nt, Human adenovirus A
cugagacuucccacagcca

SEQ ID NO: 3899006 - RNA, 14 nt, Human adenovirus A
cugagcaaugcuac

SEQ ID NO: 3899007 - RNA, 22 nt, Human adenovirus A
cugaggaaaugcgagacugcag

SEQ ID NO: 3899008 - RNA, 22 nt, Human adenovirus A
cugauaacaagaacaccuacga

SEQ ID NO: 3899009 - RNA, 18 nt, Human adenovirus A
cugaucuagaaauugaug

SEQ ID NO: 3899010 - RNA, 19 nt, Human adenovirus A
cugcaaaccgcgcuuuucu

SEQ ID NO: 3899011 - RNA, 15 nt, Human adenovirus A
cugcacuaacucuga

SEQ ID NO: 3899012 - RNA, 12 nt, Human adenovirus A
cugcagcuuccg

SEQ ID NO: 3899013 - RNA, 16 nt, Human adenovirus A
cugccaccgucaauuc

SEQ ID NO: 3899014 - RNA, 21 nt, Human adenovirus A
cugccgccacgaaugcuggcg

SEQ ID NO: 3899015 - RNA, 13 nt, Human adenovirus A
cugccgcugcaau

SEQ ID NO: 3899016 - RNA, 23 nt, Human adenovirus A
cugccgcugcaaucuuugcaccc

SEQ ID NO: 3899017 - RNA, 24 nt, Human adenovirus A
cugccgcugcguagcaguaucagu

SEQ ID NO: 3899018 - RNA, 15 nt, Human adenovirus A
cugccuaccugcgca

SEQ ID NO: 3899019 - RNA, 20 nt, Human adenovirus A
cugccugacugaaccauucc

SEQ ID NO: 3899020 - RNA, 13 nt, Human adenovirus A
cugccuguugaau

SEQ ID NO: 3899021 - RNA, 19 nt, Human adenovirus A
cugcgggaagcgggggaag

SEQ ID NO: 3899022 - RNA, 19 nt, Human adenovirus A
cugcggugguggagaagua

SEQ ID NO: 3899023 - RNA, 23 nt, Human adenovirus A
cugcguucacuuacccgcagcug

SEQ ID NO: 3899024 - RNA, 12 nt, Human adenovirus A
cugcucagcugg

SEQ ID NO: 3899025 - RNA, 15 nt, Human adenovirus A
cugcugucauuugug

SEQ ID NO: 3899026 - RNA, 23 nt, Human adenovirus A
cuggaaccauucccuauuuagac

SEQ ID NO: 3899027 - RNA, 21 nt, Human adenovirus A
cuggaagucaacuaaaaauug

SEQ ID NO: 3899028 - RNA, 19 nt, Human adenovirus A
cuggaauaacaagccuagg

SEQ ID NO: 3899029 - RNA, 17 nt, Human adenovirus A
cuggacagcggccaugg

SEQ ID NO: 3899030 - RNA, 14 nt, Human adenovirus A
cuggacauggaaaa

SEQ ID NO: 3899031 - RNA, 18 nt, Human adenovirus A
cuggagcagguguaacca

SEQ ID NO: 3899032 - RNA, 15 nt, Human adenovirus A
cuggcgaacaggaag

SEQ ID NO: 3899033 - RNA, 23 nt, Human adenovirus A
cuggugguauuggaacucuccaa

SEQ ID NO: 3899034 - RNA, 23 nt, Human adenovirus A
cuguacagaaaaaaauugccaac

SEQ ID NO: 3899035 - RNA, 17 nt, Human adenovirus A
cugucaaaccugacaga

SEQ ID NO: 3899036 - RNA, 16 nt, Human adenovirus A
cugucaacagcauugg

SEQ ID NO: 3899037 - RNA, 21 nt, Human adenovirus A
cugucgagcuaaccgcagccg

SEQ ID NO: 3899038 - RNA, 17 nt, Human adenovirus A
cugugacaaaaagacug

SEQ ID NO: 3899039 - RNA, 22 nt, Human adenovirus A
cugugagugcugauugcuggcc

SEQ ID NO: 3899040 - RNA, 17 nt, Human adenovirus A
cuguggacccuauuuuu

SEQ ID NO: 3899041 - RNA, 23 nt, Human adenovirus A
cuguuacauaccuggcaaacugg

SEQ ID NO: 3899042 - RNA, 18 nt, Human adenovirus A
cuguucuuaguaggcuaa

SEQ ID NO: 3899043 - RNA, 15 nt, Human adenovirus A
cuguugggacagcaa

SEQ ID NO: 3899044 - RNA, 16 nt, Human adenovirus A
cuuaaaaaaacaaaac

SEQ ID NO: 3899045 - RNA, 14 nt, Human adenovirus A
cuuaacaaaaaacg

SEQ ID NO: 3899046 - RNA, 15 nt, Human adenovirus A
cuuaacccucccucu

SEQ ID NO: 3899047 - RNA, 22 nt, Human adenovirus A
cuuaaugccaguuguauaaaau

SEQ ID NO: 3899048 - RNA, 10 nt, Human adenovirus A
cuuacaguau

SEQ ID NO: 3899049 - RNA, 14 nt, Human adenovirus A
cuuacauuauguaa

SEQ ID NO: 3899050 - RNA, 23 nt, Human adenovirus A
cuuagaagacaaagagugacuca

SEQ ID NO: 3899051 - RNA, 17 nt, Human adenovirus A
cuuagauuuuucaucug

SEQ ID NO: 3899052 - RNA, 21 nt, Human adenovirus A
cuuaguaacagcauaugaaca

SEQ ID NO: 3899053 - RNA, 13 nt, Human adenovirus A
cuuaguauuuguc

SEQ ID NO: 3899054 - RNA, 18 nt, Human adenovirus A
cuuagucauuacaacauu

SEQ ID NO: 3899055 - RNA, 16 nt, Human adenovirus A
cacuguaagaggagac

SEQ ID NO: 3899056 - RNA, 22 nt, Human adenovirus A
cacugucgccaaccucacugcu

SEQ ID NO: 3899057 - RNA, 23 nt, Human adenovirus A
cacuuacgaauggaacuuuagaa

SEQ ID NO: 3899058 - RNA, 19 nt, Human adenovirus A
cacuuauugcugcggccau

SEQ ID NO: 3899059 - RNA, 22 nt, Human adenovirus A
cacuucauuuuaauauuggcac

SEQ ID NO: 3899060 - RNA, 17 nt, Human adenovirus A
cacuuuauaugcuauuu

SEQ ID NO: 3899061 - RNA, 13 nt, Human adenovirus A
cagaaaaaaauug

SEQ ID NO: 3899062 - RNA, 22 nt, Human adenovirus A
cagaaaaacaguacaaagccag

SEQ ID NO: 3899063 - RNA, 13 nt, Human adenovirus A
cagaaaaaguuuc

SEQ ID NO: 3899064 - RNA, 13 nt, Human adenovirus A
cagaaagccaacc

SEQ ID NO: 3899065 - RNA, 18 nt, Human adenovirus A
cagaaaguuguagauggu

SEQ ID NO: 3899066 - RNA, 15 nt, Human adenovirus A
cagaacauacaacuu

SEQ ID NO: 3899067 - RNA, 20 nt, Human adenovirus A
cagaagccagcagcaaagaa

SEQ ID NO: 3899068 - RNA, 15 nt, Human adenovirus A
cagaauaaaacaagc

SEQ ID NO: 3899069 - RNA, 18 nt, Human adenovirus A
cagacaguggcuuuuccu

SEQ ID NO: 3899070 - RNA, 20 nt, Human adenovirus A
cagacuacguuuuacauccu

SEQ ID NO: 3899071 - RNA, 14 nt, Human adenovirus A
cagagcacuaaaau

SEQ ID NO: 3899072 - RNA, 19 nt, Human adenovirus A
cagagggaaagguauucag

SEQ ID NO: 3899073 - RNA, 22 nt, Human adenovirus A
cagauacuggugcguccaccag

SEQ ID NO: 3899074 - RNA, 17 nt, Human adenovirus A
cagaugacuggacagcg

SEQ ID NO: 3899075 - RNA, 20 nt, Human adenovirus A
cagaugacuggacagcggcc

SEQ ID NO: 3899076 - RNA, 14 nt, Human adenovirus A
cagauguaaaagua

SEQ ID NO: 3899077 - RNA, 23 nt, Human adenovirus A
cagcaaagaaaguucaccuccag

SEQ ID NO: 3899078 - RNA, 16 nt, Human adenovirus A
cagcagcagcaacacu

SEQ ID NO: 3899079 - RNA, 15 nt, Human adenovirus A
cagcagcgguggcgc

SEQ ID NO: 3899080 - RNA, 17 nt, Human adenovirus A
cagcauaaaagcuucaa

SEQ ID NO: 3899081 - RNA, 13 nt, Human adenovirus A
cagcauggagugc

SEQ ID NO: 3899082 - RNA, 23 nt, Human adenovirus A
cagcccaacccuucccaacuacu

SEQ ID NO: 3899083 - RNA, 15 nt, Human adenovirus A
cagccuagacgagga

SEQ ID NO: 3899084 - RNA, 18 nt, Human adenovirus A
cagcgagucaccaucacu

SEQ ID NO: 3899085 - RNA, 16 nt, Human adenovirus A
cagcggcgccacccua

SEQ ID NO: 3899086 - RNA, 19 nt, Human adenovirus A
cagcggggaggaagcugag

SEQ ID NO: 3899087 - RNA, 17 nt, Human adenovirus A
cagcgguaguuguugcu

SEQ ID NO: 3899088 - RNA, 19 nt, Human adenovirus A
cagcgucccaaaagcaucc

SEQ ID NO: 3899089 - RNA, 20 nt, Human adenovirus A
cagcguuggcguuccgucaa

SEQ ID NO: 3899090 - RNA, 21 nt, Human adenovirus A
cagcugacgacaguaguguau

SEQ ID NO: 3899091 - RNA, 14 nt, Human adenovirus A
cagcugcugucacu

SEQ ID NO: 3899092 - RNA, 22 nt, Human adenovirus A
cagcuguggagggcauggcuga

SEQ ID NO: 3899093 - RNA, 11 nt, Human adenovirus A
aaaaauguuuu

SEQ ID NO: 3899094 - RNA, 16 nt, Human adenovirus A
aaaaauguuuucugga

SEQ ID NO: 3899095 - RNA, 20 nt, Human adenovirus A
aaaaauuuucccaacaaugg

SEQ ID NO: 3899096 - RNA, 14 nt, Human adenovirus A
aaaacaaguuuccc

SEQ ID NO: 3899097 - RNA, 12 nt, Human adenovirus A
aaaacagcagcg

SEQ ID NO: 3899098 - RNA, 21 nt, Human adenovirus A
aaaagcaaccaaaugagcaaa

SEQ ID NO: 3899099 - RNA, 18 nt, Human adenovirus A
aaaagugugguaacaugu

SEQ ID NO: 3899100 - RNA, 20 nt, Human adenovirus A
aaaauagggguaaugugguu

SEQ ID NO: 3899101 - RNA, 17 nt, Human adenovirus A
aaaauucggcuauuuac

SEQ ID NO: 3899102 - RNA, 18 nt, Human adenovirus A
aaaauuuucccaacaaug

SEQ ID NO: 3899103 - RNA, 13 nt, Human adenovirus A
aaacaaacuacau

SEQ ID NO: 3899104 - RNA, 16 nt, Human adenovirus A
aaacaacaaaacacug

SEQ ID NO: 3899105 - RNA, 24 nt, Human adenovirus A
aaacaaggucuagccaacauccag

SEQ ID NO: 3899106 - RNA, 12 nt, Human adenovirus A
aaacacacacaa

SEQ ID NO: 3899107 - RNA, 19 nt, Human adenovirus A
aaacacaugauggaucugg

SEQ ID NO: 3899108 - RNA, 16 nt, Human adenovirus A
aaacacugagcuccau

SEQ ID NO: 3899109 - RNA, 23 nt, Human adenovirus A
aaacaggcuauugcgcagcaacg

SEQ ID NO: 3899110 - RNA, 22 nt, Human adenovirus A
aaacagugccuguugaucuguc

SEQ ID NO: 3899111 - RNA, 22 nt, Human adenovirus A
aaacauucgcagcgcacuggca

SEQ ID NO: 3899112 - RNA, 22 nt, Human adenovirus A
aaacuggauuugcgcacugaaa

SEQ ID NO: 3899113 - RNA, 14 nt, Human adenovirus A
aaagaaacagcagc

SEQ ID NO: 3899114 - RNA, 10 nt, Human adenovirus A
aaagaaacuc

SEQ ID NO: 3899115 - RNA, 20 nt, Human adenovirus A
aaagaauuauucccgcagcc

SEQ ID NO: 3899116 - RNA, 13 nt, Human adenovirus A
aaagccaaauggu

SEQ ID NO: 3899117 - RNA, 20 nt, Human adenovirus A
aaagcgcagaguauccacac

SEQ ID NO: 3899118 - RNA, 17 nt, Human adenovirus A
aaagcuaaaucugccac

SEQ ID NO: 3899119 - RNA, 23 nt, Human adenovirus A
aaagcuggguugguguugcuuug

SEQ ID NO: 3899120 - RNA, 17 nt, Human adenovirus A
aaagcuuaaccgccccc

SEQ ID NO: 3899121 - RNA, 14 nt, Human adenovirus A
aaagcuucaauuug

SEQ ID NO: 3899122 - RNA, 16 nt, Human adenovirus A
aaagcuucaauuugcc

SEQ ID NO: 3899123 - RNA, 23 nt, Human adenovirus A
aaaggaggaagaacauccaacug

SEQ ID NO: 3899124 - RNA, 21 nt, Human adenovirus A
aaaggcaggcauuaccucugu

SEQ ID NO: 3899125 - RNA, 15 nt, Human adenovirus A
aaaggcauggaaaaa

SEQ ID NO: 3899126 - RNA, 13 nt, Human adenovirus A
aaaguaugcugca

SEQ ID NO: 3899127 - RNA, 18 nt, Human adenovirus A
aaagucauccaaagauca

SEQ ID NO: 3899128 - RNA, 13 nt, Human adenovirus A
aaagucuguugcg

SEQ ID NO: 3899129 - RNA, 16 nt, Human adenovirus A
aaauaguuccguaaag

SEQ ID NO: 3899130 - RNA, 13 nt, Human adenovirus A
aaauaucauauac

SEQ ID NO: 3899131 - RNA, 19 nt, Human adenovirus A
aaaucagaagccagcagca

SEQ ID NO: 3899132 - RNA, 17 nt, Human adenovirus A
aaaucccuauggaccgg

SEQ ID NO: 3899133 - RNA, 21 nt, Human adenovirus A
aaauggauacucuuuaacauu

SEQ ID NO: 3899134 - RNA, 14 nt, Human adenovirus A
aaaugggaaaugag

SEQ ID NO: 3899135 - RNA, 17 nt, Human adenovirus A
aaaugugccuaugaccc

SEQ ID NO: 3899136 - RNA, 12 nt, Human adenovirus A
aaauguguacuu

SEQ ID NO: 3899137 - RNA, 22 nt, Human adenovirus A
aaauugcucgaugaugcauaau

SEQ ID NO: 3899138 - RNA, 16 nt, Human adenovirus A
aaauuucccucuuccc

SEQ ID NO: 3899139 - RNA, 19 nt, Human adenovirus A
aacaacgcugggcauggug

SEQ ID NO: 3899140 - RNA, 20 nt, Human adenovirus A
aacaacucuacuuaaaagca

SEQ ID NO: 3899141 - RNA, 22 nt, Human adenovirus A
aacaacugcacuugaauauuuc

SEQ ID NO: 3899142 - RNA, 20 nt, Human adenovirus A
aacaagcgaccucugaaaca

SEQ ID NO: 3899143 - RNA, 15 nt, Human adenovirus A
aacaaguuuagaaac

SEQ ID NO: 3899144 - RNA, 17 nt, Human adenovirus A
aacaauugcuucugagu

SEQ ID NO: 3899145 - RNA, 18 nt, Human adenovirus A
aacaauuugcaucucacc

SEQ ID NO: 3899146 - RNA, 17 nt, Human adenovirus A
aacacacugauuuugca

SEQ ID NO: 3899147 - RNA, 18 nt, Human adenovirus A
aacacaguuuaacacaua

SEQ ID NO: 3899148 - RNA, 23 nt, Human adenovirus A
aacacaguuuaacacauacagua

SEQ ID NO: 3899149 - RNA, 14 nt, Human adenovirus A
aacacaugucuccu

SEQ ID NO: 3899150 - RNA, 20 nt, Human adenovirus A
aacacggaguaaugaacaag

SEQ ID NO: 3899151 - RNA, 13 nt, Human adenovirus A
aacagcuauugca

SEQ ID NO: 3899152 - RNA, 15 nt, Human adenovirus A
aacaguacaaagcca

SEQ ID NO: 3899153 - RNA, 16 nt, Human adenovirus A
aacaguacaaagccag

SEQ ID NO: 3899154 - RNA, 22 nt, Human adenovirus A
aacaguacaaagccaggcacag

SEQ ID NO: 3899155 - RNA, 17 nt, Human adenovirus A
aacaguaccaaugugca

SEQ ID NO: 3899156 - RNA, 20 nt, Human adenovirus A
aacaucaugaaaacagcagc

SEQ ID NO: 3899157 - RNA, 18 nt, Human adenovirus A
aacaugauucuucagagc

SEQ ID NO: 3899158 - RNA, 12 nt, Human adenovirus A
aacauuaaaaga

SEQ ID NO: 3899159 - RNA, 19 nt, Human adenovirus A
aacauuagcagucugguac

SEQ ID NO: 3899160 - RNA, 13 nt, Human adenovirus A
aacauucgcagcg

SEQ ID NO: 3899161 - RNA, 16 nt, Human adenovirus A
aaccaaucuacaaacu

SEQ ID NO: 3899162 - RNA, 20 nt, Human adenovirus A
aaccagagcaccccuuccca

SEQ ID NO: 3899163 - RNA, 12 nt, Human adenovirus A
aaccagcugggc

SEQ ID NO: 3899164 - RNA, 18 nt, Human adenovirus A
aaccagcugggcagaaag

SEQ ID NO: 3899165 - RNA, 17 nt, Human adenovirus A
aaccaugacuauugacu

SEQ ID NO: 3899166 - RNA, 18 nt, Human adenovirus A
aacccauuugcaucugca

SEQ ID NO: 3899167 - RNA, 13 nt, Human adenovirus A
aaccccaaaagcc

SEQ ID NO: 3899168 - RNA, 21 nt, Human adenovirus A
aaccgucgccagcaagugccu

SEQ ID NO: 3899169 - RNA, 19 nt, Human adenovirus A
aacgaccgccuuuucuaga

SEQ ID NO: 3899170 - RNA, 20 nt, Human adenovirus A
aacgaccgccuuuucuagaa

SEQ ID NO: 3899171 - RNA, 23 nt, Human adenovirus A
aacgagggagauguccuguuuaa

SEQ ID NO: 3899172 - RNA, 15 nt, Human adenovirus A
aacgcucguugccca

SEQ ID NO: 3899173 - RNA, 11 nt, Human adenovirus A
aacggagaggg

SEQ ID NO: 3899174 - RNA, 15 nt, Human adenovirus A
aacggaggaggaggu

SEQ ID NO: 3899175 - RNA, 14 nt, Human adenovirus A
aacuaacuuuaaug

SEQ ID NO: 3899176 - RNA, 18 nt, Human adenovirus A
aacuaacuuuaauguuuc

SEQ ID NO: 3899177 - RNA, 19 nt, Human adenovirus A
aacucuacuuaaaagcaag

SEQ ID NO: 3899178 - RNA, 19 nt, Human adenovirus A
aacugaccaggucagcuca

SEQ ID NO: 3899179 - RNA, 18 nt, Human adenovirus A
aacugccuccuucccauu

SEQ ID NO: 3899180 - RNA, 16 nt, Human adenovirus A
aacuuaguaacagcau

SEQ ID NO: 3899181 - RNA, 15 nt, Human adenovirus A
aacuuaucagccaga

SEQ ID NO: 3899182 - RNA, 14 nt, Human adenovirus A
aacuuuaauguuuc

SEQ ID NO: 3899183 - RNA, 14 nt, Human adenovirus A
aagaaaagcgugga

SEQ ID NO: 3899184 - RNA, 15 nt, Human adenovirus A
aagaaaaugaacaaa

SEQ ID NO: 3899185 - RNA, 13 nt, Human adenovirus A
aagaaacagcagc

SEQ ID NO: 3899186 - RNA, 21 nt, Human adenovirus A
aagaacacggugaauguguuc

SEQ ID NO: 3899187 - RNA, 13 nt, Human adenovirus A
aagaagaacgcau

SEQ ID NO: 3899188 - RNA, 16 nt, Human adenovirus A
aagaaugggaggagga

SEQ ID NO: 3899189 - RNA, 12 nt, Human adenovirus A
aagacagaaaua

SEQ ID NO: 3899190 - RNA, 20 nt, Human adenovirus A
aagacagaaauacagagcug

SEQ ID NO: 3899191 - RNA, 24 nt, Human adenovirus A
aagacagaaauacagagcugucau

SEQ ID NO: 3899192 - RNA, 23 nt, Human adenovirus A
aagacgcaccgguugagcagaac

SEQ ID NO: 3899193 - RNA, 13 nt, Human adenovirus A
aagagccacagcu

SEQ ID NO: 3899194 - RNA, 12 nt, Human adenovirus A
aagaggaggguu

SEQ ID NO: 3899195 - RNA, 15 nt, Human adenovirus A
aagauacuaccuacu

SEQ ID NO: 3899196 - RNA, 16 nt, Human adenovirus A
aagaucaguagcuaag

SEQ ID NO: 3899197 - RNA, 20 nt, Human adenovirus A
aagauccguacaaggcauug

SEQ ID NO: 3899198 - RNA, 18 nt, Human adenovirus A
aagaucuucguaggaaag

SEQ ID NO: 3899199 - RNA, 23 nt, Human adenovirus A
aagauguaugaguaagagcaaag

SEQ ID NO: 3899200 - RNA, 12 nt, Human adenovirus A
aagcaaaugcau

SEQ ID NO: 3899201 - RNA, 15 nt, Human adenovirus A
aagcaauaaaacaag

SEQ ID NO: 3899202 - RNA, 14 nt, Human adenovirus A
aagcagccauaaug

SEQ ID NO: 3899203 - RNA, 16 nt, Human adenovirus A
aagcaguagaaaguag

SEQ ID NO: 3899204 - RNA, 14 nt, Human adenovirus A
aagccaacggcaca

SEQ ID NO: 3899205 - RNA, 15 nt, Human adenovirus A
aagcgacgagcaauu

SEQ ID NO: 3899206 - RNA, 14 nt, Human adenovirus A
aagcgaugacucag

SEQ ID NO: 3899207 - RNA, 13 nt, Human adenovirus A
aagcgcaauauug

SEQ ID NO: 3899208 - RNA, 16 nt, Human adenovirus A
aagcgucccaugagcu

SEQ ID NO: 3899209 - RNA, 15 nt, Human adenovirus A
aagcgugaguaagcc

SEQ ID NO: 3899210 - RNA, 19 nt, Human adenovirus A
aagcuauuugagccuucau

SEQ ID NO: 3899211 - RNA, 22 nt, Human adenovirus A
aagcugaaacuaggggcuggcu

SEQ ID NO: 3899212 - RNA, 20 nt, Human adenovirus A
aaaaaaccuucgagaacuaa

SEQ ID NO: 3899213 - RNA, 13 nt, Human adenovirus A
aaaacaaaaccac

SEQ ID NO: 3899214 - RNA, 22 nt, Human adenovirus A
aaaacaguuucuggagcaggug

SEQ ID NO: 3899215 - RNA, 20 nt, Human adenovirus A
aaaacaucacucuauuucaa

SEQ ID NO: 3899216 - RNA, 21 nt, Human adenovirus A
aaaacuuaaugcccaagguca

SEQ ID NO: 3899217 - RNA, 13 nt, Human adenovirus A
aaaagaucaagga

SEQ ID NO: 3899218 - RNA, 16 nt, Human adenovirus A
aaaagcacaacuccau

SEQ ID NO: 3899219 - RNA, 20 nt, Human adenovirus A
aaaauaacacauaagcauua

SEQ ID NO: 3899220 - RNA, 17 nt, Human adenovirus A
aaaaucauacaaaucag

SEQ ID NO: 3899221 - RNA, 17 nt, Human adenovirus A
aaaaugaugacuucaac

SEQ ID NO: 3899222 - RNA, 21 nt, Human adenovirus A
aaaaugcguuuaguccaauuu

SEQ ID NO: 3899223 - RNA, 23 nt, Human adenovirus A
aaaauuacaaaggcauuaagcca

SEQ ID NO: 3899224 - RNA, 14 nt, Human adenovirus A
aaacacaugaugga

SEQ ID NO: 3899225 - RNA, 20 nt, Human adenovirus A
aaacagcaaacuuucuccaa

SEQ ID NO: 3899226 - RNA, 12 nt, Human adenovirus A
aaacagcagcaa

SEQ ID NO: 3899227 - RNA, 20 nt, Human adenovirus A
aaacaguauugugggacugg

SEQ ID NO: 3899228 - RNA, 19 nt, Human adenovirus A
aaacauaaaacuaccugau

SEQ ID NO: 3899229 - RNA, 17 nt, Human adenovirus A
aaaccacguacgaccac

SEQ ID NO: 3899230 - RNA, 22 nt, Human adenovirus A
aaacccaauuaguaacuccggg

SEQ ID NO: 3899231 - RNA, 13 nt, Human adenovirus A
aaacgagcagcaa

SEQ ID NO: 3899232 - RNA, 19 nt, Human adenovirus A
aaagaauuauucccgcagc

SEQ ID NO: 3899233 - RNA, 14 nt, Human adenovirus A
aaagaccccauugu

SEQ ID NO: 3899234 - RNA, 14 nt, Human adenovirus A
aaagaucaguagcu

SEQ ID NO: 3899235 - RNA, 18 nt, Human adenovirus A
aaagcagaugggaaaauc

SEQ ID NO: 3899236 - RNA, 18 nt, Human adenovirus A
aaagcagccauaaugccu

SEQ ID NO: 3899237 - RNA, 16 nt, Human adenovirus A
aaaguagaaaucucgu

SEQ ID NO: 3899238 - RNA, 14 nt, Human adenovirus A
aaaguaucugccca

SEQ ID NO: 3899239 - RNA, 22 nt, Human adenovirus A
aaagucagacuauuacacucag

SEQ ID NO: 3899240 - RNA, 21 nt, Human adenovirus A
aaaguggucagauccuuagau

SEQ ID NO: 3899241 - RNA, 22 nt, Human adenovirus A
aaauaaagcguucuguggaugg

SEQ ID NO: 3899242 - RNA, 22 nt, Human adenovirus A
aaauaaugcauuaccagcagcc

SEQ ID NO: 3899243 - RNA, 16 nt, Human adenovirus A
aaauacgaaaacaguc

SEQ ID NO: 3899244 - RNA, 16 nt, Human adenovirus A
aaauauaaaagcacaa

SEQ ID NO: 3899245 - RNA, 17 nt, Human adenovirus A
aaauauuuacuaugauu

SEQ ID NO: 3899246 - RNA, 15 nt, Human adenovirus A
aaaucauacaaauca

SEQ ID NO: 3899247 - RNA, 12 nt, Human adenovirus A
aaaugaccccau

SEQ ID NO: 3899248 - RNA, 21 nt, Human adenovirus A
aaaugaucuucggguggacgg

SEQ ID NO: 3899249 - RNA, 14 nt, Human adenovirus A
aaauuccugugcaa

SEQ ID NO: 3899250 - RNA, 19 nt, Human adenovirus A
aaauuguguacuuuucaaa

SEQ ID NO: 3899251 - RNA, 22 nt, Human adenovirus A
aaauuugcauuucccaagauuu

SEQ ID NO: 3899252 - RNA, 20 nt, Human adenovirus A
aacaaaagcaaagcaaaugc

SEQ ID NO: 3899253 - RNA, 13 nt, Human adenovirus A
aacaacaaaacac

SEQ ID NO: 3899254 - RNA, 22 nt, Human adenovirus A
aacaaccucccgauaccaaaaa

SEQ ID NO: 3899255 - RNA, 17 nt, Human adenovirus A
aacaaugaaaguugcau

SEQ ID NO: 3899256 - RNA, 20 nt, Human adenovirus A
aacaaugaaaguugcauuua

SEQ ID NO: 3899257 - RNA, 20 nt, Human adenovirus A
aacacggaggacaauccaag

SEQ ID NO: 3899258 - RNA, 20 nt, Human adenovirus A
aacagaaaguuguagauggu

SEQ ID NO: 3899259 - RNA, 12 nt, Human adenovirus A
aacagaccccaa

SEQ ID NO: 3899260 - RNA, 21 nt, Human adenovirus A
aacagacgaauaagcucggcc

SEQ ID NO: 3899261 - RNA, 14 nt, Human adenovirus A
aacagacgcucucc

SEQ ID NO: 3899262 - RNA, 19 nt, Human adenovirus A
aacagcaaacuuucuccaa

SEQ ID NO: 3899263 - RNA, 14 nt, Human adenovirus A
aacaguaccaaugu

SEQ ID NO: 3899264 - RNA, 20 nt, Human adenovirus A
aacagucaguguccaucagc

SEQ ID NO: 3899265 - RNA, 13 nt, Human adenovirus A
aacaguuucugga

SEQ ID NO: 3899266 - RNA, 13 nt, Human adenovirus A
aacauaaaacuac

SEQ ID NO: 3899267 - RNA, 15 nt, Human adenovirus A
aacaucgcaaaacac

SEQ ID NO: 3899268 - RNA, 14 nt, Human adenovirus A
aaccaaauacugcu

SEQ ID NO: 3899269 - RNA, 20 nt, Human adenovirus A
aaccaagcccucuccaauga

SEQ ID NO: 3899270 - RNA, 19 nt, Human adenovirus A
aaccacggccucagcagcg

SEQ ID NO: 3899271 - RNA, 14 nt, Human adenovirus A
aacccggccaagga

SEQ ID NO: 3899272 - RNA, 13 nt, Human adenovirus A
aaccguuuagagc

SEQ ID NO: 3899273 - RNA, 16 nt, Human adenovirus A
aaccuacacaugaagg

SEQ ID NO: 3899274 - RNA, 15 nt, Human adenovirus A
aacgcaagcgugcaa

SEQ ID NO: 3899275 - RNA, 19 nt, Human adenovirus A
aacgccaccagcgugccca

SEQ ID NO: 3899276 - RNA, 14 nt, Human adenovirus A
aacgggcagccugu

SEQ ID NO: 3899277 - RNA, 13 nt, Human adenovirus A
aacggguggaaaa

SEQ ID NO: 3899278 - RNA, 18 nt, Human adenovirus A
aacggguggaaaaacaac

SEQ ID NO: 3899279 - RNA, 16 nt, Human adenovirus A
aacgguuaagcugggu

SEQ ID NO: 3899280 - RNA, 22 nt, Human adenovirus A
aacguagcuuuugacuguuccu

SEQ ID NO: 3899281 - RNA, 21 nt, Human adenovirus A
aacuaaccgucgccagcaagu

SEQ ID NO: 3899282 - RNA, 18 nt, Human adenovirus A
aacuacauuacgccccca

SEQ ID NO: 3899283 - RNA, 17 nt, Human adenovirus A
aacuaccugauaacaag

SEQ ID NO: 3899284 - RNA, 14 nt, Human adenovirus A
aacuacucagaaca

SEQ ID NO: 3899285 - RNA, 18 nt, Human adenovirus A
aacuaugccaguuuacug

SEQ ID NO: 3899286 - RNA, 15 nt, Human adenovirus A
aacuccgcgcaagga

SEQ ID NO: 3899287 - RNA, 16 nt, Human adenovirus A
aacugcagacaguggc

SEQ ID NO: 3899288 - RNA, 22 nt, Human adenovirus A
aacugggggcguacacuggcug

SEQ ID NO: 3899289 - RNA, 23 nt, Human adenovirus A
aacuuucuccaaaucuuaaaugg

SEQ ID NO: 3899290 - RNA, 13 nt, Human adenovirus A
aagaaugggagga

SEQ ID NO: 3899291 - RNA, 22 nt, Human adenovirus A
aagaccccauuguaacugaaaa

SEQ ID NO: 3899292 - RNA, 16 nt, Human adenovirus A
aagagguaucgcagcc

SEQ ID NO: 3899293 - RNA, 20 nt, Human adenovirus A
aagaucuucguaggaaagau

SEQ ID NO: 3899294 - RNA, 17 nt, Human adenovirus A
aagaugauugaaccuga

SEQ ID NO: 3899295 - RNA, 23 nt, Human adenovirus A
aagcaaaccacugcaaugcagcc

SEQ ID NO: 3899296 - RNA, 16 nt, Human adenovirus A
aagcacgccaaagcca

SEQ ID NO: 3899297 - RNA, 21 nt, Human adenovirus A
aagcagcgccaaauagagcaa

SEQ ID NO: 3899298 - RNA, 16 nt, Human adenovirus A
aagcaguagugccguc

SEQ ID NO: 3899299 - RNA, 23 nt, Human adenovirus A
aagccacuuuagccccagcggca

SEQ ID NO: 3899300 - RNA, 22 nt, Human adenovirus A
aagccgucuacucacagcuuau

SEQ ID NO: 3899301 - RNA, 20 nt, Human adenovirus A
aagccuagggggggagccgu

SEQ ID NO: 3899302 - RNA, 18 nt, Human adenovirus A
aagcgaagaucaguugca

SEQ ID NO: 3899303 - RNA, 13 nt, Human adenovirus A
aagcgcugaaaca

SEQ ID NO: 3899304 - RNA, 16 nt, Human adenovirus A
aagcgucacuacagac

SEQ ID NO: 3899305 - RNA, 15 nt, Human adenovirus A
aagcuaauaccuguc

SEQ ID NO: 3899306 - RNA, 22 nt, Human adenovirus A
aagcucuguucaauaaauacug

SEQ ID NO: 3899307 - RNA, 22 nt, Human adenovirus A
aaggaaaguaacucuuguaaag

SEQ ID NO: 3899308 - RNA, 14 nt, Human adenovirus A
aaggaggaagaaca

SEQ ID NO: 3899309 - RNA, 21 nt, Human adenovirus A
aagguacuaacauuaagcgac

SEQ ID NO: 3899310 - RNA, 14 nt, Human adenovirus A
aagguguguaaaca

SEQ ID NO: 3899311 - RNA, 18 nt, Human adenovirus A
aaguacuacuaccacugu

SEQ ID NO: 3899312 - RNA, 20 nt, Human adenovirus A
aaguaggauagcaccugccg

SEQ ID NO: 3899313 - RNA, 22 nt, Human adenovirus A
aagucacguguucacaauuuuc

SEQ ID NO: 3899314 - RNA, 17 nt, Human adenovirus A
aagugucuuguuaaugu

SEQ ID NO: 3899315 - RNA, 23 nt, Human adenovirus A
aaguucaaagaagagcugcugca

SEQ ID NO: 3899316 - RNA, 16 nt, Human adenovirus A
aauaaagaaaaaacuu

SEQ ID NO: 3899317 - RNA, 20 nt, Human adenovirus A
aauaaucaauuuugcaagug

SEQ ID NO: 3899318 - RNA, 15 nt, Human adenovirus A
aauaauuggcuucag

SEQ ID NO: 3899319 - RNA, 13 nt, Human adenovirus A
aauaccugucuug

SEQ ID NO: 3899320 - RNA, 21 nt, Human adenovirus A
aauauaaaagcacaacuccau

SEQ ID NO: 3899321 - RNA, 19 nt, Human adenovirus A
aauauugagguuacucacu

SEQ ID NO: 3899322 - RNA, 15 nt, Human adenovirus A
aauauuguauuucca

SEQ ID NO: 3899323 - RNA, 22 nt, Human adenovirus A
aaucagaagccagcagcaaaga

SEQ ID NO: 3899324 - RNA, 18 nt, Human adenovirus A
aaucaggcuguacagaaa

SEQ ID NO: 3899325 - RNA, 19 nt, Human adenovirus A
aauccaaggaugacaacau

SEQ ID NO: 3899326 - RNA, 12 nt, Human adenovirus A
aaucggcggcgc

SEQ ID NO: 3899327 - RNA, 14 nt, Human adenovirus A
auauaaaguuuaaa

SEQ ID NO: 3899328 - RNA, 18 nt, Human adenovirus A
auauagccgccauggaaa

SEQ ID NO: 3899329 - RNA, 18 nt, Human adenovirus A
auauaguacugcuuccag

SEQ ID NO: 3899330 - RNA, 11 nt, Human adenovirus A
auaugcauuua

SEQ ID NO: 3899331 - RNA, 18 nt, Human adenovirus A
auaugcuauuuuucagca

SEQ ID NO: 3899332 - RNA, 16 nt, Human adenovirus A
auauuaaaaagcucug

SEQ ID NO: 3899333 - RNA, 14 nt, Human adenovirus A
auauucccacgccu

SEQ ID NO: 3899334 - RNA, 20 nt, Human adenovirus A
auauuugcugaaaaaagucu

SEQ ID NO: 3899335 - RNA, 23 nt, Human adenovirus A
aucaaauuguaagcgauuuucca

SEQ ID NO: 3899336 - RNA, 17 nt, Human adenovirus A
aucaacuuaacccuccc

SEQ ID NO: 3899337 - RNA, 16 nt, Human adenovirus A
aucagaagccagcagc

SEQ ID NO: 3899338 - RNA, 13 nt, Human adenovirus A
aucagcagccaac

SEQ ID NO: 3899339 - RNA, 17 nt, Human adenovirus A
aucagccuuucucuaca

SEQ ID NO: 3899340 - RNA, 15 nt, Human adenovirus A
aucaguguaaaaaag

SEQ ID NO: 3899341 - RNA, 22 nt, Human adenovirus A
aucauacauaauuuuaaaguaa

SEQ ID NO: 3899342 - RNA, 15 nt, Human adenovirus A
aucauaguugugguc

SEQ ID NO: 3899343 - RNA, 14 nt, Human adenovirus A
aucauauacauaua

SEQ ID NO: 3899344 - RNA, 16 nt, Human adenovirus A
auccuacaaaaaguaa

SEQ ID NO: 3899345 - RNA, 17 nt, Human adenovirus A
auccuagcguacagcca

SEQ ID NO: 3899346 - RNA, 19 nt, Human adenovirus A
auccuagcguacagccaga

SEQ ID NO: 3899347 - RNA, 17 nt, Human adenovirus A
auccuaggcaaagaaac

SEQ ID NO: 3899348 - RNA, 23 nt, Human adenovirus A
auccugucgagcuaaccgcagcc

SEQ ID NO: 3899349 - RNA, 20 nt, Human adenovirus A
auccuuagauuuuucaucug

SEQ ID NO: 3899350 - RNA, 22 nt, Human adenovirus A
auccuuccauugugcccacgcc

SEQ ID NO: 3899351 - RNA, 19 nt, Human adenovirus A
auccuuuuucuacaggcag

SEQ ID NO: 3899352 - RNA, 18 nt, Human adenovirus A
aucggcaacagcagcaac

SEQ ID NO: 3899353 - RNA, 19 nt, Human adenovirus A
aucucuacagccccuuuga

SEQ ID NO: 3899354 - RNA, 23 nt, Human adenovirus A
aucuugggcaaaauaugcuguac

SEQ ID NO: 3899355 - RNA, 17 nt, Human adenovirus A
aucuuguuuccagugcg

SEQ ID NO: 3899356 - RNA, 13 nt, Human adenovirus A
augaaaacaaugu

SEQ ID NO: 3899357 - RNA, 23 nt, Human adenovirus A
augaaaguugcauuuaauggcau

SEQ ID NO: 3899358 - RNA, 11 nt, Human adenovirus A
augaacaaugc

SEQ ID NO: 3899359 - RNA, 11 nt, Human adenovirus A
augaauuaaau

SEQ ID NO: 3899360 - RNA, 14 nt, Human adenovirus A
augaauuaaauaaa

SEQ ID NO: 3899361 - RNA, 16 nt, Human adenovirus A
augaauuugaaauaaa

SEQ ID NO: 3899362 - RNA, 20 nt, Human adenovirus A
augagcaaaacgcugggcuc

SEQ ID NO: 3899363 - RNA, 14 nt, Human adenovirus A
augagccugaaccu

SEQ ID NO: 3899364 - RNA, 14 nt, Human adenovirus A
augaggcagucaca

SEQ ID NO: 3899365 - RNA, 19 nt, Human adenovirus A
augaugcgggcagccaggc

SEQ ID NO: 3899366 - RNA, 20 nt, Human adenovirus A
augaugcgggcagccaggcg

SEQ ID NO: 3899367 - RNA, 14 nt, Human adenovirus A
augauggaaagccg

SEQ ID NO: 3899368 - RNA, 12 nt, Human adenovirus A
augauggcuuuu

SEQ ID NO: 3899369 - RNA, 16 nt, Human adenovirus A
augcacaagagcggcg

SEQ ID NO: 3899370 - RNA, 14 nt, Human adenovirus A
augcagcaaacacu

SEQ ID NO: 3899371 - RNA, 13 nt, Human adenovirus A
augcagcugugga

SEQ ID NO: 3899372 - RNA, 14 nt, Human adenovirus A
augcgcauggcuuu

SEQ ID NO: 3899373 - RNA, 21 nt, Human adenovirus A
augcgcccggaacuauuucuu

SEQ ID NO: 3899374 - RNA, 16 nt, Human adenovirus A
augcgggcagccaggc

SEQ ID NO: 3899375 - RNA, 20 nt, Human adenovirus A
augcgugagggugccacccc

SEQ ID NO: 3899376 - RNA, 23 nt, Human adenovirus A
augcguuacccuagaaaagucaa

SEQ ID NO: 3899377 - RNA, 13 nt, Human adenovirus A
augcucuggacau

SEQ ID NO: 3899378 - RNA, 19 nt, Human adenovirus A
augcuuuagguuagccuga

SEQ ID NO: 3899379 - RNA, 14 nt, Human adenovirus A
auggaaaaaacgaa

SEQ ID NO: 3899380 - RNA, 14 nt, Human adenovirus A
auggaacaccagca

SEQ ID NO: 3899381 - RNA, 14 nt, Human adenovirus A
auggagaaggacaa

SEQ ID NO: 3899382 - RNA, 18 nt, Human adenovirus A
augggaggaaagacagcc

SEQ ID NO: 3899383 - RNA, 10 nt, Human adenovirus A
augguuuaac

SEQ ID NO: 3899384 - RNA, 14 nt, Human adenovirus A
auguaaaaaaauac

SEQ ID NO: 3899385 - RNA, 23 nt, Human adenovirus A
auguaacugaggagcugagaagu

SEQ ID NO: 3899386 - RNA, 23 nt, Human adenovirus A
auguaaguaggauagcaccugcc

SEQ ID NO: 3899387 - RNA, 18 nt, Human adenovirus A
augucaccuaaggcuuca

SEQ ID NO: 3899388 - RNA, 15 nt, Human adenovirus A
auguccuacauugga

SEQ ID NO: 3899389 - RNA, 21 nt, Human adenovirus A
augucggccugacgcucuggc

SEQ ID NO: 3899390 - RNA, 17 nt, Human adenovirus A
augugaaggcgccagga

SEQ ID NO: 3899391 - RNA, 22 nt, Human adenovirus A
augugcaaauauaaaagcacaa

SEQ ID NO: 3899392 - RNA, 22 nt, Human adenovirus A
auguucccauugacaaggaagu

SEQ ID NO: 3899393 - RNA, 13 nt, Human adenovirus A
auuaaaaugugcc

SEQ ID NO: 3899394 - RNA, 14 nt, Human adenovirus A
auuaccagcagcca

SEQ ID NO: 3899395 - RNA, 19 nt, Human adenovirus A
auuaccagcagccaaaacu

SEQ ID NO: 3899396 - RNA, 15 nt, Human adenovirus A
auuacuuuuaaauac

SEQ ID NO: 3899397 - RNA, 18 nt, Human adenovirus A
auuagcacuuaauuacaa

SEQ ID NO: 3899398 - RNA, 15 nt, Human adenovirus A
auuaguucuuuucuu

SEQ ID NO: 3899399 - RNA, 15 nt, Human adenovirus A
auuauuugugugcug

SEQ ID NO: 3899400 - RNA, 21 nt, Human adenovirus A
auucauauauguaucuggaca

SEQ ID NO: 3899401 - RNA, 13 nt, Human adenovirus A
auucauauugugg

SEQ ID NO: 3899402 - RNA, 14 nt, Human adenovirus A
auuccaugagcccg

SEQ ID NO: 3899403 - RNA, 20 nt, Human adenovirus A
auucgcaggcggucugccau

SEQ ID NO: 3899404 - RNA, 15 nt, Human adenovirus A
auucggcuauuuaca

SEQ ID NO: 3899405 - RNA, 16 nt, Human adenovirus A
auucuagcaaaaugaa

SEQ ID NO: 3899406 - RNA, 17 nt, Human adenovirus A
auucuuucuuuagaaac

SEQ ID NO: 3899407 - RNA, 16 nt, Human adenovirus A
auugaaguaagcuguu

SEQ ID NO: 3899408 - RNA, 17 nt, Human adenovirus A
auugacucgguaguggc

SEQ ID NO: 3899409 - RNA, 22 nt, Human adenovirus A
auugcaggggcucuuuuaagau

SEQ ID NO: 3899410 - RNA, 19 nt, Human adenovirus A
auugcgcaaaauugaggaa

SEQ ID NO: 3899411 - RNA, 16 nt, Human adenovirus A
auuggaaagcagcuug

SEQ ID NO: 3899412 - RNA, 12 nt, Human adenovirus A
auugggaguuca

SEQ ID NO: 3899413 - RNA, 18 nt, Human adenovirus A
auuggucccauccaaguu

SEQ ID NO: 3899414 - RNA, 14 nt, Human adenovirus A
auugucacauuaca

SEQ ID NO: 3899415 - RNA, 15 nt, Human adenovirus A
auuguuggccuguau

SEQ ID NO: 3899416 - RNA, 14 nt, Human adenovirus A
auuuaauuucagau

SEQ ID NO: 3899417 - RNA, 14 nt, Human adenovirus A
auuucuagaaauuu

SEQ ID NO: 3899418 - RNA, 19 nt, Human adenovirus A
auuucuuccuccuggaggu

SEQ ID NO: 3899419 - RNA, 13 nt, Human adenovirus A
auuugaacacacu

SEQ ID NO: 3899420 - RNA, 22 nt, Human adenovirus A
auuugaaugcguaaaucucgca

SEQ ID NO: 3899421 - RNA, 15 nt, Human adenovirus A
auuugccggaaggaa

SEQ ID NO: 3899422 - RNA, 18 nt, Human adenovirus A
auuugcgaguaggaagac

SEQ ID NO: 3899423 - RNA, 13 nt, Human adenovirus A
auuugucuccucu

SEQ ID NO: 3899424 - RNA, 14 nt, Human adenovirus A
auuuuccaaauguu

SEQ ID NO: 3899425 - RNA, 19 nt, Human adenovirus A
auuuucuuuaaaaaucaca

SEQ ID NO: 3899426 - RNA, 15 nt, Human adenovirus A
auuuugauuauuaua

SEQ ID NO: 3899427 - RNA, 16 nt, Human adenovirus A
auuuugcagguuuaaa

SEQ ID NO: 3899428 - RNA, 13 nt, Human adenovirus A
caaaaaaacagau

SEQ ID NO: 3899429 - RNA, 15 nt, Human adenovirus A
caaaaaaacagauuc

SEQ ID NO: 3899430 - RNA, 13 nt, Human adenovirus A
caaaaaagcuuua

SEQ ID NO: 3899431 - RNA, 19 nt, Human adenovirus A
caaaaauguuuucuggauc

SEQ ID NO: 3899432 - RNA, 13 nt, Human adenovirus A
caaaaccaggucc

SEQ ID NO: 3899433 - RNA, 18 nt, Human adenovirus A
caaaacucacccugugcu

SEQ ID NO: 3899434 - RNA, 19 nt, Human adenovirus A
caaaacuuucuaccaagga

SEQ ID NO: 3899435 - RNA, 21 nt, Human adenovirus A
caaaagcaaccaaaugagcaa

SEQ ID NO: 3899436 - RNA, 20 nt, Human adenovirus A
caaaaucuaagccaugcaaa

SEQ ID NO: 3899437 - RNA, 15 nt, Human adenovirus A
caaacagacccuugg

SEQ ID NO: 3899438 - RNA, 16 nt, Human adenovirus A
caaacaguggacauuc

SEQ ID NO: 3899439 - RNA, 13 nt, Human adenovirus A
caaaccggccaga

SEQ ID NO: 3899440 - RNA, 15 nt, Human adenovirus A
caaaccuagcugcuc

SEQ ID NO: 3899441 - RNA, 21 nt, Human adenovirus A
caaaccugacagacuugcaaa

SEQ ID NO: 3899442 - RNA, 19 nt, Human adenovirus A
caaacgguuacagaggaac

SEQ ID NO: 3899443 - RNA, 12 nt, Human adenovirus A
caaagaaaacau

SEQ ID NO: 3899444 - RNA, 18 nt, Human adenovirus A
caaagaaaguucaccucc

SEQ ID NO: 3899445 - RNA, 11 nt, Human adenovirus A
uggaacaccag

SEQ ID NO: 3899446 - RNA, 18 nt, Human adenovirus A
uggaacugcagacagugg

SEQ ID NO: 3899447 - RNA, 15 nt, Human adenovirus A
uggaacuuaacaacu

SEQ ID NO: 3899448 - RNA, 14 nt, Human adenovirus A
uggaagcuggccau

SEQ ID NO: 3899449 - RNA, 15 nt, Human adenovirus A
uggaagcuggccaua

SEQ ID NO: 3899450 - RNA, 18 nt, Human adenovirus A
uggaauuauguaagguua

SEQ ID NO: 3899451 - RNA, 14 nt, Human adenovirus A
uggacauccaugug

SEQ ID NO: 3899452 - RNA, 21 nt, Human adenovirus A
uggagcagguguaaccagcug

SEQ ID NO: 3899453 - RNA, 18 nt, Human adenovirus A
uggaguuuagaaggaaag

SEQ ID NO: 3899454 - RNA, 15 nt, Human adenovirus A
uggaucaaaaacaag

SEQ ID NO: 3899455 - RNA, 13 nt, Human adenovirus A
uggauccaaugga

SEQ ID NO: 3899456 - RNA, 15 nt, Human adenovirus A
uggcagcggcgccac

SEQ ID NO: 3899457 - RNA, 16 nt, Human adenovirus A
uggcaggaguugcagg

SEQ ID NO: 3899458 - RNA, 20 nt, Human adenovirus A
uggccauaauguaacccuuc

SEQ ID NO: 3899459 - RNA, 17 nt, Human adenovirus A
uggcuggacugccgaca

SEQ ID NO: 3899460 - RNA, 20 nt, Human adenovirus A
uggcuucacuagaccuuugu

SEQ ID NO: 3899461 - RNA, 14 nt, Human adenovirus A
uggcuucagcauuu

SEQ ID NO: 3899462 - RNA, 13 nt, Human adenovirus A
uggcuuuuggaug

SEQ ID NO: 3899463 - RNA, 17 nt, Human adenovirus A
ugggaggauauggagug

SEQ ID NO: 3899464 - RNA, 17 nt, Human adenovirus A
ugggaggcguagaugug

SEQ ID NO: 3899465 - RNA, 16 nt, Human adenovirus A
ugggcaucuugcauga

SEQ ID NO: 3899466 - RNA, 20 nt, Human adenovirus A
ugggcaucuugcaugaaaac

SEQ ID NO: 3899467 - RNA, 17 nt, Human adenovirus A
ugggcuuauaccuacca

SEQ ID NO: 3899468 - RNA, 19 nt, Human adenovirus A
ugguacgcauucaccagcc

SEQ ID NO: 3899469 - RNA, 20 nt, Human adenovirus A
ugguuacugaagugccucaa

SEQ ID NO: 3899470 - RNA, 13 nt, Human adenovirus A
ugguuuaacauuc

SEQ ID NO: 3899471 - RNA, 21 nt, Human adenovirus A
uguaaaaaaguguuuguuuga

SEQ ID NO: 3899472 - RNA, 15 nt, Human adenovirus A
uguaaaaugggaaau

SEQ ID NO: 3899473 - RNA, 18 nt, Human adenovirus A
uguaaccagagcaccccu

SEQ ID NO: 3899474 - RNA, 14 nt, Human adenovirus A
uguaaccagcuggg

SEQ ID NO: 3899475 - RNA, 20 nt, Human adenovirus A
uguaagcgacgagcaauuaa

SEQ ID NO: 3899476 - RNA, 17 nt, Human adenovirus A
uguagauaauccaguca

SEQ ID NO: 3899477 - RNA, 14 nt, Human adenovirus A
uguauacugggugc

SEQ ID NO: 3899478 - RNA, 16 nt, Human adenovirus A
uguccccgaaagccgc

SEQ ID NO: 3899479 - RNA, 23 nt, Human adenovirus A
uguccuacauuggaguuggaaga

SEQ ID NO: 3899480 - RNA, 13 nt, Human adenovirus A
ugucgaaugcagg

SEQ ID NO: 3899481 - RNA, 16 nt, Human adenovirus A
ugucuacaacugcucc

SEQ ID NO: 3899482 - RNA, 20 nt, Human adenovirus A
ugugagggccgaugcauaca

SEQ ID NO: 3899483 - RNA, 18 nt, Human adenovirus A
ugugcaaauauaaaagca

SEQ ID NO: 3899484 - RNA, 17 nt, Human adenovirus A
ugugcuauuaaagcuuu

SEQ ID NO: 3899485 - RNA, 20 nt, Human adenovirus A
ugugcuauuaaagcuuuugc

SEQ ID NO: 3899486 - RNA, 14 nt, Human adenovirus A
uguggaaagcauuu

SEQ ID NO: 3899487 - RNA, 18 nt, Human adenovirus A
uguggaauaauaguuccc

SEQ ID NO: 3899488 - RNA, 15 nt, Human adenovirus A
uguggucuagaguua

SEQ ID NO: 3899489 - RNA, 13 nt, Human adenovirus A
uguuaccaaugga

SEQ ID NO: 3899490 - RNA, 20 nt, Human adenovirus A
uguuaugcuugccaagcuug

SEQ ID NO: 3899491 - RNA, 17 nt, Human adenovirus A
uguucaacaacagcuuc

SEQ ID NO: 3899492 - RNA, 13 nt, Human adenovirus A
uguugaaugaggu

SEQ ID NO: 3899493 - RNA, 21 nt, Human adenovirus A
uguuuacuucaauccuuuuuc

SEQ ID NO: 3899494 - RNA, 15 nt, Human adenovirus A
uguuugacaagauug

SEQ ID NO: 3899495 - RNA, 15 nt, Human adenovirus A
uguuuguuugaaaaa

SEQ ID NO: 3899496 - RNA, 15 nt, Human adenovirus A
uuaaaaauuugcaag

SEQ ID NO: 3899497 - RNA, 16 nt, Human adenovirus A
uuaaaauuccauaauu

SEQ ID NO: 3899498 - RNA, 15 nt, Human adenovirus A
uuaaagcaaaccacu

SEQ ID NO: 3899499 - RNA, 16 nt, Human adenovirus A
uuaaauaauauuuugc

SEQ ID NO: 3899500 - RNA, 19 nt, Human adenovirus A
uuaaauugagaugguguua

SEQ ID NO: 3899501 - RNA, 13 nt, Human adenovirus A
uuaagaaaucuuu

SEQ ID NO: 3899502 - RNA, 10 nt, Human adenovirus A
uuaauguuuc

SEQ ID NO: 3899503 - RNA, 21 nt, Human adenovirus A
uuacaacuugcuuccagacaa

SEQ ID NO: 3899504 - RNA, 22 nt, Human adenovirus A
uuacaagcacgccaaagccaca

SEQ ID NO: 3899505 - RNA, 20 nt, Human adenovirus A
uuacacucaggccauaaaga

SEQ ID NO: 3899506 - RNA, 18 nt, Human adenovirus A
uuacauuauguaaaguca

SEQ ID NO: 3899507 - RNA, 13 nt, Human adenovirus A
uuacgcuggcugu

SEQ ID NO: 3899508 - RNA, 18 nt, Human adenovirus A
uuacuuaccggaaaucug

SEQ ID NO: 3899509 - RNA, 21 nt, Human adenovirus A
uuagaagacaaagagugacuc

SEQ ID NO: 3899510 - RNA, 22 nt, Human adenovirus A
uuagccuuaauaaccgccccuc

SEQ ID NO: 3899511 - RNA, 20 nt, Human adenovirus A
uuagucgcgcacugggccag

SEQ ID NO: 3899512 - RNA, 13 nt, Human adenovirus A
uuaguuuggcaga

SEQ ID NO: 3899513 - RNA, 20 nt, Human adenovirus A
uuauaugcgcauggcuuuaa

SEQ ID NO: 3899514 - RNA, 12 nt, Human adenovirus A
uuauggcuuuaa

SEQ ID NO: 3899515 - RNA, 22 nt, Human adenovirus A
uuauuaaaaaucaaauggcucu

SEQ ID NO: 3899516 - RNA, 13 nt, Human adenovirus A
uuauucccgcagc

SEQ ID NO: 3899517 - RNA, 20 nt, Human adenovirus A
uuauucgauccauuuggauu

SEQ ID NO: 3899518 - RNA, 19 nt, Human adenovirus A
uuauuugcugcguaggaac

SEQ ID NO: 3899519 - RNA, 12 nt, Human adenovirus A
uucaacuuuguc

SEQ ID NO: 3899520 - RNA, 21 nt, Human adenovirus A
uucaagaaaggcaucuagcca

SEQ ID NO: 3899521 - RNA, 22 nt, Human adenovirus A
uucaagcgcgacuaguccguuu

SEQ ID NO: 3899522 - RNA, 23 nt, Human adenovirus A
uucagaauaaaacaagccgcagg

SEQ ID NO: 3899523 - RNA, 22 nt, Human adenovirus A
uucauguggucaggucuaucaa

SEQ ID NO: 3899524 - RNA, 23 nt, Human adenovirus A
uucauguggucaggucuaucaaa

SEQ ID NO: 3899525 - RNA, 14 nt, Human adenovirus A
uucccaaauaucca

SEQ ID NO: 3899526 - RNA, 21 nt, Human adenovirus A
uucccaaauauccaggaggaa

SEQ ID NO: 3899527 - RNA, 15 nt, Human adenovirus A
uucccaaauuuucca

SEQ ID NO: 3899528 - RNA, 15 nt, Human adenovirus A
uuccgcgaucagcca

SEQ ID NO: 3899529 - RNA, 17 nt, Human adenovirus A
uucgcagcgcacuggca

SEQ ID NO: 3899530 - RNA, 22 nt, Human adenovirus A
uucgcgacaacagcggggagga

SEQ ID NO: 3899531 - RNA, 22 nt, Human adenovirus A
uucuagaacaaaaaggaggaag

SEQ ID NO: 3899532 - RNA, 22 nt, Human adenovirus A
uucugaucaacgacuaaaacaa

SEQ ID NO: 3899533 - RNA, 21 nt, Human adenovirus A
uucuggcguuacagcuucaga

SEQ ID NO: 3899534 - RNA, 11 nt, Human adenovirus A
uucuuccaaca

SEQ ID NO: 3899535 - RNA, 16 nt, Human adenovirus A
uugaaugcguaaaucu

SEQ ID NO: 3899536 - RNA, 22 nt, Human adenovirus A
uugauucagcuaacaaugcagc

SEQ ID NO: 3899537 - RNA, 19 nt, Human adenovirus A
uugcaaacagcaaacuuuc

SEQ ID NO: 3899538 - RNA, 19 nt, Human adenovirus A
uugccgcacggccaaugcc

SEQ ID NO: 3899539 - RNA, 15 nt, Human adenovirus A
uugcgagcugccacc

SEQ ID NO: 3899540 - RNA, 14 nt, Human adenovirus A
uugcgauaaacugg

SEQ ID NO: 3899541 - RNA, 16 nt, Human adenovirus A
uuggaaagcagcuugg

SEQ ID NO: 3899542 - RNA, 18 nt, Human adenovirus A
uuggauagcaaagccauc

SEQ ID NO: 3899543 - RNA, 15 nt, Human adenovirus A
uuggccagcugcccu

SEQ ID NO: 3899544 - RNA, 12 nt, Human adenovirus A
uugggacagaac

SEQ ID NO: 3899545 - RNA, 21 nt, Human adenovirus A
uugggcgcccacucuccugag

SEQ ID NO: 3899546 - RNA, 20 nt, Human adenovirus A
uuggguccggcuuguugaau

SEQ ID NO: 3899547 - RNA, 16 nt, Human adenovirus A
uugucauuacugacca

SEQ ID NO: 3899548 - RNA, 14 nt, Human adenovirus A
uugugcauauuuuc

SEQ ID NO: 3899549 - RNA, 23 nt, Human adenovirus A
uuguguguuucuaaaacagaacc

SEQ ID NO: 3899550 - RNA, 12 nt, Human adenovirus A
uuuaaaaaucac

SEQ ID NO: 3899551 - RNA, 23 nt, Human adenovirus A
uuuaaaggaagcugcuguucuua

SEQ ID NO: 3899552 - RNA, 20 nt, Human adenovirus A
uuuaaaggcauuauguucga

SEQ ID NO: 3899553 - RNA, 14 nt, Human adenovirus A
uuuaacggaaaaca

SEQ ID NO: 3899554 - RNA, 13 nt, Human adenovirus A
uuuaaggccaggg

SEQ ID NO: 3899555 - RNA, 14 nt, Human adenovirus A
uuuacucacuggcc

SEQ ID NO: 3899556 - RNA, 13 nt, Human adenovirus A
uuuccaaaugccc

SEQ ID NO: 3899557 - RNA, 20 nt, Human adenovirus A
uuuccagcgccaccugccau

SEQ ID NO: 3899558 - RNA, 20 nt, Human adenovirus A
uuucccucacaaauuugcau

SEQ ID NO: 3899559 - RNA, 14 nt, Human adenovirus A
uuuccggagaaaga

SEQ ID NO: 3899560 - RNA, 20 nt, Human adenovirus A
uuucgguugaagugucuugu

SEQ ID NO: 3899561 - RNA, 16 nt, Human adenovirus A
uuugccagcucuugga

SEQ ID NO: 3899562 - RNA, 20 nt, Human adenovirus A
ccaaggcguggaacagccaa

SEQ ID NO: 3899563 - RNA, 21 nt, Human adenovirus A
ccaaggcguggaacagccaaa

SEQ ID NO: 3899564 - RNA, 21 nt, Human adenovirus A
ccaaggucaacuuacagcuag

SEQ ID NO: 3899565 - RNA, 22 nt, Human adenovirus A
ccacaaggaaaugaggaggagg

SEQ ID NO: 3899566 - RNA, 14 nt, Human adenovirus A
ccacacaucucacc

SEQ ID NO: 3899567 - RNA, 21 nt, Human adenovirus A
ccacaccuccacccaaucaaa

SEQ ID NO: 3899568 - RNA, 11 nt, Human adenovirus A
ccacagcucug

SEQ ID NO: 3899569 - RNA, 13 nt, Human adenovirus A
ccacaugggaagg

SEQ ID NO: 3899570 - RNA, 16 nt, Human adenovirus A
ccaccaaaugcucuuu

SEQ ID NO: 3899571 - RNA, 21 nt, Human adenovirus A
ccaccaaauuuaaggccaggg

SEQ ID NO: 3899572 - RNA, 12 nt, Human adenovirus A
ccaccagacccc

SEQ ID NO: 3899573 - RNA, 13 nt, Human adenovirus A
ccaccaguuggaa

SEQ ID NO: 3899574 - RNA, 13 nt, Human adenovirus A
ccacccccagugc

SEQ ID NO: 3899575 - RNA, 12 nt, Human adenovirus A
ccaccgccaugc

SEQ ID NO: 3899576 - RNA, 19 nt, Human adenovirus A
ccacgccuuacauguggag

SEQ ID NO: 3899577 - RNA, 14 nt, Human adenovirus A
ccacggccucagca

SEQ ID NO: 3899578 - RNA, 18 nt, Human adenovirus A
ccacggccucagcagcgg

SEQ ID NO: 3899579 - RNA, 17 nt, Human adenovirus A
ccacugcaaugcagccg

SEQ ID NO: 3899580 - RNA, 17 nt, Human adenovirus A
ccacugucgccaaccuc

SEQ ID NO: 3899581 - RNA, 22 nt, Human adenovirus A
ccagacacgcaucuuguguuua

SEQ ID NO: 3899582 - RNA, 13 nt, Human adenovirus A
ccagacaguuuca

SEQ ID NO: 3899583 - RNA, 13 nt, Human adenovirus A
ccagccuucuggc

SEQ ID NO: 3899584 - RNA, 10 nt, Human adenovirus A
ccagcucuug

SEQ ID NO: 3899585 - RNA, 16 nt, Human adenovirus A
ccagcucuuggaauaa

SEQ ID NO: 3899586 - RNA, 21 nt, Human adenovirus A
ccagcugcccugauauaucag

SEQ ID NO: 3899587 - RNA, 21 nt, Human adenovirus A
ccaggcacagcagacacaauc

SEQ ID NO: 3899588 - RNA, 21 nt, Human adenovirus A
ccaggguuugcuucagcaguu

SEQ ID NO: 3899589 - RNA, 12 nt, Human adenovirus A
ccagucacaguc

SEQ ID NO: 3899590 - RNA, 14 nt, Human adenovirus A
ccagucgccgcaga

SEQ ID NO: 3899591 - RNA, 22 nt, Human adenovirus A
ccauaaggcggcguccuuucuc

SEQ ID NO: 3899592 - RNA, 17 nt, Human adenovirus A
ccaugaaaacagcauua

SEQ ID NO: 3899593 - RNA, 16 nt, Human adenovirus A
ccaugacuauugacuu

SEQ ID NO: 3899594 - RNA, 17 nt, Human adenovirus A
ccauuacuuuuaaauac

SEQ ID NO: 3899595 - RNA, 13 nt, Human adenovirus A
cccaacccuuccc

SEQ ID NO: 3899596 - RNA, 11 nt, Human adenovirus A
cccaccguggc

SEQ ID NO: 3899597 - RNA, 20 nt, Human adenovirus A
cccacgccgcgccccacuuc

SEQ ID NO: 3899598 - RNA, 22 nt, Human adenovirus A
cccacgguauuggccauuccug

SEQ ID NO: 3899599 - RNA, 16 nt, Human adenovirus A
cccagacacggagagg

SEQ ID NO: 3899600 - RNA, 19 nt, Human adenovirus A
cccagacguaggguacagu

SEQ ID NO: 3899601 - RNA, 16 nt, Human adenovirus A
cccagcggcaguacgu

SEQ ID NO: 3899602 - RNA, 17 nt, Human adenovirus A
cccagcuaacgccacca

SEQ ID NO: 3899603 - RNA, 14 nt, Human adenovirus A
cccaggcaggcgcg

SEQ ID NO: 3899604 - RNA, 19 nt, Human adenovirus A
cccaguuuuugcagugcca

SEQ ID NO: 3899605 - RNA, 19 nt, Human adenovirus A
cccauaacaucaggagcag

SEQ ID NO: 3899606 - RNA, 19 nt, Human adenovirus A
cccaugaguaggcaaguug

SEQ ID NO: 3899607 - RNA, 15 nt, Human adenovirus A
agacuauagagagga

SEQ ID NO: 3899608 - RNA, 20 nt, Human adenovirus A
agacuccccccgaggaauuu

SEQ ID NO: 3899609 - RNA, 21 nt, Human adenovirus A
agacugcauuuaccuuuuccu

SEQ ID NO: 3899610 - RNA, 14 nt, Human adenovirus A
agacugcuguaaug

SEQ ID NO: 3899611 - RNA, 22 nt, Human adenovirus A
agacuucccacagccagugggu

SEQ ID NO: 3899612 - RNA, 12 nt, Human adenovirus A
agagacaaugaa

SEQ ID NO: 3899613 - RNA, 18 nt, Human adenovirus A
agagcacaugaaggugga

SEQ ID NO: 3899614 - RNA, 16 nt, Human adenovirus A
agagcauugugguuca

SEQ ID NO: 3899615 - RNA, 13 nt, Human adenovirus A
agagcuuaugcau

SEQ ID NO: 3899616 - RNA, 16 nt, Human adenovirus A
agagucaggcagagga

SEQ ID NO: 3899617 - RNA, 17 nt, Human adenovirus A
agagucaggcagaggac

SEQ ID NO: 3899618 - RNA, 22 nt, Human adenovirus A
agauaaguuuaaaggcauuaug

SEQ ID NO: 3899619 - RNA, 13 nt, Human adenovirus A
agaucaaggaaau

SEQ ID NO: 3899620 - RNA, 17 nt, Human adenovirus A
agauccguacaaggcau

SEQ ID NO: 3899621 - RNA, 17 nt, Human adenovirus A
agaucuuccaacaugag

SEQ ID NO: 3899622 - RNA, 14 nt, Human adenovirus A
agaugagccuguau

SEQ ID NO: 3899623 - RNA, 21 nt, Human adenovirus A
agaugcauccuguccugcgac

SEQ ID NO: 3899624 - RNA, 18 nt, Human adenovirus A
agauguaacaggcggcuc

SEQ ID NO: 3899625 - RNA, 16 nt, Human adenovirus A
agauguaauuaaugga

SEQ ID NO: 3899626 - RNA, 11 nt, Human adenovirus A
cccccagugcc

SEQ ID NO: 3899627 - RNA, 19 nt, Human adenovirus A
ccccgaggaauuugaaggc

SEQ ID NO: 3899628 - RNA, 18 nt, Human adenovirus A
ccccucgaccugcauguc

SEQ ID NO: 3899629 - RNA, 12 nt, Human adenovirus A
ccccuuugaaga

SEQ ID NO: 3899630 - RNA, 17 nt, Human adenovirus A
cccgccauuggcgcuac

SEQ ID NO: 3899631 - RNA, 23 nt, Human adenovirus A
cccgcgauuaugcaguguaacca

SEQ ID NO: 3899632 - RNA, 17 nt, Human adenovirus A
cccgcgguuuuggcggc

SEQ ID NO: 3899633 - RNA, 23 nt, Human adenovirus A
cccggaggaagcggcgguucggg

SEQ ID NO: 3899634 - RNA, 14 nt, Human adenovirus A
cccuaucuguugcu

SEQ ID NO: 3899635 - RNA, 21 nt, Human adenovirus A
cccucgaugaugccgcagugg

SEQ ID NO: 3899636 - RNA, 14 nt, Human adenovirus A
cccugauccggcaa

SEQ ID NO: 3899637 - RNA, 21 nt, Human adenovirus A
cccugcuccgacaacagcugc

SEQ ID NO: 3899638 - RNA, 14 nt, Human adenovirus A
cccuguggagccac

SEQ ID NO: 3899639 - RNA, 16 nt, Human adenovirus A
ccgaauauccaaaccc

SEQ ID NO: 3899640 - RNA, 18 nt, Human adenovirus A
ccgcaaagaugaggcugg

SEQ ID NO: 3899641 - RNA, 22 nt, Human adenovirus A
ccgcaacagcuauugcaaaccu

SEQ ID NO: 3899642 - RNA, 12 nt, Human adenovirus A
ccgcagccaaca

SEQ ID NO: 3899643 - RNA, 20 nt, Human adenovirus A
ccgccaugcgcgcggccaga

SEQ ID NO: 3899644 - RNA, 19 nt, Human adenovirus A
ccgcgguuuuggcggccau

SEQ ID NO: 3899645 - RNA, 14 nt, Human adenovirus A
ccgcguggucagga

SEQ ID NO: 3899646 - RNA, 17 nt, Human adenovirus A
ccgcugcucagcuccac

SEQ ID NO: 3899647 - RNA, 16 nt, Human adenovirus A
ccggucuggugcaauu

SEQ ID NO: 3899648 - RNA, 15 nt, Human adenovirus A
ccgguugaaacagac

SEQ ID NO: 3899649 - RNA, 16 nt, Human adenovirus A
ccguaaaauacacaua

SEQ ID NO: 3899650 - RNA, 13 nt, Human adenovirus A
ccgucgccagcaa

SEQ ID NO: 3899651 - RNA, 18 nt, Human adenovirus A
ccguggcucccacccaug

SEQ ID NO: 3899652 - RNA, 22 nt, Human adenovirus A
ccuacguuuacaaagcacuggg

SEQ ID NO: 3899653 - RNA, 22 nt, Human adenovirus A
ccuaucuguugcuacugcagac

SEQ ID NO: 3899654 - RNA, 16 nt, Human adenovirus A
ccucacugcuuugcuc

SEQ ID NO: 3899655 - RNA, 23 nt, Human adenovirus A
ccuccgugaguuggccuggaaau

SEQ ID NO: 3899656 - RNA, 21 nt, Human adenovirus A
ccuccuggaggucuccauguc

SEQ ID NO: 3899657 - RNA, 22 nt, Human adenovirus A
ccuccuuugccagaacccacua

SEQ ID NO: 3899658 - RNA, 21 nt, Human adenovirus A
ccugaaccuaauagcacuuug

SEQ ID NO: 3899659 - RNA, 16 nt, Human adenovirus A
ccugaccauccaaugg

SEQ ID NO: 3899660 - RNA, 14 nt, Human adenovirus A
ccugacgcucuggc

SEQ ID NO: 3899661 - RNA, 19 nt, Human adenovirus A
ccugacgcucuggcagggg

SEQ ID NO: 3899662 - RNA, 18 nt, Human adenovirus A
ccugcuccuuuucuuaca

SEQ ID NO: 3899663 - RNA, 22 nt, Human adenovirus A
ccugcuuaaaaucggcggcgcg

SEQ ID NO: 3899664 - RNA, 15 nt, Human adenovirus A
ccugcuuucagcacu

SEQ ID NO: 3899665 - RNA, 13 nt, Human adenovirus A
ccuggauaaagcg

SEQ ID NO: 3899666 - RNA, 15 nt, Human adenovirus A
ccuguggcaccugca

SEQ ID NO: 3899667 - RNA, 13 nt, Human adenovirus A
ccuguuuaaacau

SEQ ID NO: 3899668 - RNA, 18 nt, Human adenovirus A
ccuuauuugacuuccagg

SEQ ID NO: 3899669 - RNA, 17 nt, Human adenovirus A
ccuucuggcuuguaugc

SEQ ID NO: 3899670 - RNA, 13 nt, Human adenovirus A
ccuuggaagaggu

SEQ ID NO: 3899671 - RNA, 18 nt, Human adenovirus A
ccuuuucuagaacaaaaa

SEQ ID NO: 3899672 - RNA, 13 nt, Human adenovirus A
cgaaaaaaaucac

SEQ ID NO: 3899673 - RNA, 18 nt, Human adenovirus A
cgaaaaaaaucacuuccg

SEQ ID NO: 3899674 - RNA, 16 nt, Human adenovirus A
cgagaucggcacgagc

SEQ ID NO: 3899675 - RNA, 15 nt, Human adenovirus A
cgagcagcaaaugcc

SEQ ID NO: 3899676 - RNA, 23 nt, Human adenovirus A
cgagcgcauagaaaaagcuacau

SEQ ID NO: 3899677 - RNA, 18 nt, Human adenovirus A
cgagcuaaccgcagccgc

SEQ ID NO: 3899678 - RNA, 17 nt, Human adenovirus A
cgagcucccggaggaag

SEQ ID NO: 3899679 - RNA, 18 nt, Human adenovirus A
cgagggaaauccaacacc

SEQ ID NO: 3899680 - RNA, 20 nt, Human adenovirus A
cgagguaaugguagaggaaa

SEQ ID NO: 3899681 - RNA, 12 nt, Human adenovirus A
cgaggugcagcu

SEQ ID NO: 3899682 - RNA, 13 nt, Human adenovirus A
cgaggugcagcug

SEQ ID NO: 3899683 - RNA, 22 nt, Human adenovirus A
cgauccaguaauuggcaaagua

SEQ ID NO: 3899684 - RNA, 15 nt, Human adenovirus A
cgcaauuagggccag

SEQ ID NO: 3899685 - RNA, 23 nt, Human adenovirus A
cgcacguucaauaguggcugcaa

SEQ ID NO: 3899686 - RNA, 20 nt, Human adenovirus A
cgcagcaacgcucaaagaaa

SEQ ID NO: 3899687 - RNA, 17 nt, Human adenovirus A
cgcagcugcggccgcaa

SEQ ID NO: 3899688 - RNA, 16 nt, Human adenovirus A
cgcagucaccaccagc

SEQ ID NO: 3899689 - RNA, 16 nt, Human adenovirus A
cgcaguuuuucuacca

SEQ ID NO: 3899690 - RNA, 16 nt, Human adenovirus A
cgccaaagccacaccu

SEQ ID NO: 3899691 - RNA, 18 nt, Human adenovirus A
gucuacucacagcuuauu

SEQ ID NO: 3899692 - RNA, 15 nt, Human adenovirus A
gucuuaaacuuucuu

SEQ ID NO: 3899693 - RNA, 23 nt, Human adenovirus A
gugaacgcaagcgugcaaacaga

SEQ ID NO: 3899694 - RNA, 21 nt, Human adenovirus A
gugacaaugcccgccuggcag

SEQ ID NO: 3899695 - RNA, 22 nt, Human adenovirus A
gugagcaaaucucagaaagcca

SEQ ID NO: 3899696 - RNA, 13 nt, Human adenovirus A
gugagggugccac

SEQ ID NO: 3899697 - RNA, 20 nt, Human adenovirus A
gugauaacccugaauguuug

SEQ ID NO: 3899698 - RNA, 15 nt, Human adenovirus A
gugauaugcauuuac

SEQ ID NO: 3899699 - RNA, 16 nt, Human adenovirus A
gugcaaauauaaaagc

SEQ ID NO: 3899700 - RNA, 17 nt, Human adenovirus A
gugccacccccagugcc

SEQ ID NO: 3899701 - RNA, 22 nt, Human adenovirus A
gugcccccuaaacggcaagcca

SEQ ID NO: 3899702 - RNA, 16 nt, Human adenovirus A
gugccuccccgcuauu

SEQ ID NO: 3899703 - RNA, 20 nt, Human adenovirus A
gugcuguggaaagcauuuug

SEQ ID NO: 3899704 - RNA, 20 nt, Human adenovirus A
gugguacgcauucaccagcc

SEQ ID NO: 3899705 - RNA, 19 nt, Human adenovirus A
guguacuuuucaaacuuua

SEQ ID NO: 3899706 - RNA, 19 nt, Human adenovirus A
guguagguuucuacaucau

SEQ ID NO: 3899707 - RNA, 16 nt, Human adenovirus A
guuacugaagugccuc

SEQ ID NO: 3899708 - RNA, 15 nt, Human adenovirus A
guuagaacuuucuaa

SEQ ID NO: 3899709 - RNA, 15 nt, Human adenovirus A
guuauguaugcccag

SEQ ID NO: 3899710 - RNA, 21 nt, Human adenovirus A
guucaauaguugccacgcuuu

SEQ ID NO: 3899711 - RNA, 11 nt, Human adenovirus A
guuccaaggac

SEQ ID NO: 3899712 - RNA, 17 nt, Human adenovirus A
guuccauggcuucguaa

SEQ ID NO: 3899713 - RNA, 14 nt, Human adenovirus A
guucgcuuugacaa

SEQ ID NO: 3899714 - RNA, 17 nt, Human adenovirus A
guugacuucgcacaggc

SEQ ID NO: 3899715 - RNA, 19 nt, Human adenovirus A
guugcaacgcaccuugcag

SEQ ID NO: 3899716 - RNA, 17 nt, Human adenovirus A
guugcuuuccaaaugcc

SEQ ID NO: 3899717 - RNA, 15 nt, Human adenovirus A
guuuaaacuacacaa

SEQ ID NO: 3899718 - RNA, 16 nt, Human adenovirus A
guuuaaaggaagcugc

SEQ ID NO: 3899719 - RNA, 18 nt, Human adenovirus A
guuuaacgaggugcagcu

SEQ ID NO: 3899720 - RNA, 17 nt, Human adenovirus A
guuuaugcgcuguacca

SEQ ID NO: 3899721 - RNA, 13 nt, Human adenovirus A
guuucuacaucau

SEQ ID NO: 3899722 - RNA, 13 nt, Human adenovirus A
guuuuaaauuguu

SEQ ID NO: 3899723 - RNA, 16 nt, Human adenovirus A
uaaaaaaacaaaacca

SEQ ID NO: 3899724 - RNA, 13 nt, Human adenovirus A
uaaaaacacacac

SEQ ID NO: 3899725 - RNA, 17 nt, Human adenovirus A
uaaaacagaaccucuua

SEQ ID NO: 3899726 - RNA, 13 nt, Human adenovirus A
uaaaaucauacaa

SEQ ID NO: 3899727 - RNA, 17 nt, Human adenovirus A
uaaaaucauacaaauca

SEQ ID NO: 3899728 - RNA, 17 nt, Human adenovirus A
uaaacaaaagcaaagca

SEQ ID NO: 3899729 - RNA, 18 nt, Human adenovirus A
uaaacaaaagcaaagcaa

SEQ ID NO: 3899730 - RNA, 18 nt, Human adenovirus A
uaaagaaacaaacuacau

SEQ ID NO: 3899731 - RNA, 16 nt, Human adenovirus A
uaaagauuugaaauuu

SEQ ID NO: 3899732 - RNA, 23 nt, Human adenovirus A
uaaauggauacucuuuaacauuc

SEQ ID NO: 3899733 - RNA, 23 nt, Human adenovirus A
uaacaaaggugcuucccacauac

SEQ ID NO: 3899734 - RNA, 23 nt, Human adenovirus A
uaacaggugaaagugaauacuua

SEQ ID NO: 3899735 - RNA, 21 nt, Human adenovirus A
uaacaguaccaaugugcaggc

SEQ ID NO: 3899736 - RNA, 13 nt, Human adenovirus A
uaaccaaauacug

SEQ ID NO: 3899737 - RNA, 16 nt, Human adenovirus A
uaaccaaauacugcua

SEQ ID NO: 3899738 - RNA, 18 nt, Human adenovirus A
uaaccaaucuacaaacug

SEQ ID NO: 3899739 - RNA, 21 nt, Human adenovirus A
uaaccagagcaccccuuccca

SEQ ID NO: 3899740 - RNA, 14 nt, Human adenovirus A
uaacgaggugcagc

SEQ ID NO: 3899741 - RNA, 19 nt, Human adenovirus A
uaacugcucagcuggaaga

SEQ ID NO: 3899742 - RNA, 15 nt, Human adenovirus A
uaacuuuauauugca

SEQ ID NO: 3899743 - RNA, 14 nt, Human adenovirus A
uaagaaccaagcau

SEQ ID NO: 3899744 - RNA, 22 nt, Human adenovirus A
uaagcaggaaaaaaaagaaagu

SEQ ID NO: 3899745 - RNA, 20 nt, Human adenovirus A
uaagcgccggaccccacaug

SEQ ID NO: 3899746 - RNA, 23 nt, Human adenovirus A
uaaggauugguuccuaauacaaa

SEQ ID NO: 3899747 - RNA, 23 nt, Human adenovirus A
uaaggggaggaccccaaggcaug

SEQ ID NO: 3899748 - RNA, 18 nt, Human adenovirus A
uaauacuuaauuucuaga

SEQ ID NO: 3899749 - RNA, 12 nt, Human adenovirus A
uaauauuuugcc

SEQ ID NO: 3899750 - RNA, 17 nt, Human adenovirus A
uaauauuuugccagcuc

SEQ ID NO: 3899751 - RNA, 23 nt, Human adenovirus A
uaaucaagacggucagcaaggau

SEQ ID NO: 3899752 - RNA, 20 nt, Human adenovirus A
uaaucgccccgcugcaauuu

SEQ ID NO: 3899753 - RNA, 15 nt, Human adenovirus A
uaauuacuccauguu

SEQ ID NO: 3899754 - RNA, 16 nt, Human adenovirus A
uaauuaucccuuugau

SEQ ID NO: 3899755 - RNA, 12 nt, Human adenovirus A
uaauugauuuac

SEQ ID NO: 3899756 - RNA, 13 nt, Human adenovirus A
uacaaaggcauua

SEQ ID NO: 3899757 - RNA, 20 nt, Human adenovirus A
uacaaaucagaagccagcag

SEQ ID NO: 3899758 - RNA, 19 nt, Human adenovirus A
uacaacucuacaaaucuug

SEQ ID NO: 3899759 - RNA, 22 nt, Human adenovirus A
uacaacugcuccccucaacagc

SEQ ID NO: 3899760 - RNA, 18 nt, Human adenovirus A
uacaauaaucacaacaca

SEQ ID NO: 3899761 - RNA, 15 nt, Human adenovirus A
uacacaacacaaaaa

SEQ ID NO: 3899762 - RNA, 19 nt, Human adenovirus A
uacacacuacgcccacuuc

SEQ ID NO: 3899763 - RNA, 21 nt, Human adenovirus A
uacacccccuuuuacuucuuc

SEQ ID NO: 3899764 - RNA, 22 nt, Human adenovirus A
uacacucauguauuuuuucaaa

SEQ ID NO: 3899765 - RNA, 12 nt, Human adenovirus A
uacacuggcugg

SEQ ID NO: 3899766 - RNA, 21 nt, Human adenovirus A
uacaugaagauuucugcuguc

SEQ ID NO: 3899767 - RNA, 17 nt, Human adenovirus A
uacaugggcaccuggaa

SEQ ID NO: 3899768 - RNA, 12 nt, Human adenovirus A
uaccaaagccau

SEQ ID NO: 3899769 - RNA, 23 nt, Human adenovirus A
uaccaccaaauuuaaggccaggg

SEQ ID NO: 3899770 - RNA, 15 nt, Human adenovirus A
uaccaggaagcugag

SEQ ID NO: 3899771 - RNA, 12 nt, Human adenovirus A
uaccaugaugga

SEQ ID NO: 3899772 - RNA, 15 nt, Human adenovirus A
uaccccuauccuguc

SEQ ID NO: 3899773 - RNA, 15 nt, Human adenovirus A
uaccgucaucucuac

SEQ ID NO: 3899774 - RNA, 19 nt, Human adenovirus A
uaccugacacuacagagcu

SEQ ID NO: 3899775 - RNA, 14 nt, Human adenovirus A
uacgacccucugac

SEQ ID NO: 3899776 - RNA, 21 nt, Human adenovirus A
uacgagacuccccccgaggaa

SEQ ID NO: 3899777 - RNA, 13 nt, Human adenovirus A
aaaaaauugccaa

SEQ ID NO: 3899778 - RNA, 18 nt, Human adenovirus A
aaaaacuuggaaacgccu

SEQ ID NO: 3899779 - RNA, 20 nt, Human adenovirus A
aaaaagcuuuaauaaccaug

SEQ ID NO: 3899780 - RNA, 23 nt, Human adenovirus A
aaaaagcuuuaauaaccaugugc

SEQ ID NO: 3899781 - RNA, 16 nt, Human adenovirus A
aaaaaguaaacugucu

SEQ ID NO: 3899782 - RNA, 14 nt, Human adenovirus A
aaaaauuacaaagg

SEQ ID NO: 3899783 - RNA, 16 nt, Human adenovirus A
aaaagaaaaugaacaa

SEQ ID NO: 3899784 - RNA, 13 nt, Human adenovirus A
aaaagagccacag

SEQ ID NO: 3899785 - RNA, 23 nt, Human adenovirus A
aaaagcauacuuaccaaagccau

SEQ ID NO: 3899786 - RNA, 20 nt, Human adenovirus A
aaaagcguggaauuaaaagg

SEQ ID NO: 3899787 - RNA, 18 nt, Human adenovirus A
aaaagcuuuaauaaccau

SEQ ID NO: 3899788 - RNA, 14 nt, Human adenovirus A
aaaauaaucaauuu

SEQ ID NO: 3899789 - RNA, 17 nt, Human adenovirus A
aaaaucccccuccuacc

SEQ ID NO: 3899790 - RNA, 22 nt, Human adenovirus A
aaaaucuaagccaugcaaauag

SEQ ID NO: 3899791 - RNA, 24 nt, Human adenovirus A
aaaaucuaagccaugcaaauaguu

SEQ ID NO: 3899792 - RNA, 16 nt, Human adenovirus A
aaacauaugcacaaga

SEQ ID NO: 3899793 - RNA, 12 nt, Human adenovirus A
aaacaugcugua

SEQ ID NO: 3899794 - RNA, 23 nt, Human adenovirus A
aaacgaaucccucgcccgcacag

SEQ ID NO: 3899795 - RNA, 22 nt, Human adenovirus A
aaacgcugggcucgaggaccau

SEQ ID NO: 3899796 - RNA, 18 nt, Human adenovirus A
aaacucagcccaugcucu

SEQ ID NO: 3899797 - RNA, 19 nt, Human adenovirus A
aaacucccuuaguuguaaa

SEQ ID NO: 3899798 - RNA, 20 nt, Human adenovirus A
aaacuguauauuggcaggag

SEQ ID NO: 3899799 - RNA, 20 nt, Human adenovirus A
aaacuuaaauugagauggug

SEQ ID NO: 3899800 - RNA, 20 nt, Human adenovirus A
aaacuuucuaccaaggaaaa

SEQ ID NO: 3899801 - RNA, 13 nt, Human adenovirus A
aaagacagccaag

SEQ ID NO: 3899802 - RNA, 19 nt, Human adenovirus A
aaagaccccauuguaacug

SEQ ID NO: 3899803 - RNA, 12 nt, Human adenovirus A
aaagagccacag

SEQ ID NO: 3899804 - RNA, 13 nt, Human adenovirus A
aaagagccacagc

SEQ ID NO: 3899805 - RNA, 21 nt, Human adenovirus A
aaagagucucaaaagcagcca

SEQ ID NO: 3899806 - RNA, 15 nt, Human adenovirus A
aaagaucaaggaaau

SEQ ID NO: 3899807 - RNA, 12 nt, Human adenovirus A
aaagaucacagc

SEQ ID NO: 3899808 - RNA, 19 nt, Human adenovirus A
aaagaucaguagcuaagga

SEQ ID NO: 3899809 - RNA, 13 nt, Human adenovirus A
aaagcaaaugcau

SEQ ID NO: 3899810 - RNA, 19 nt, Human adenovirus A
aaagccaggcacagcagac

SEQ ID NO: 3899811 - RNA, 23 nt, Human adenovirus A
aaagcccgcgcgcggacuuucaa

SEQ ID NO: 3899812 - RNA, 14 nt, Human adenovirus A
aaagccgcaaaaca

SEQ ID NO: 3899813 - RNA, 16 nt, Human adenovirus A
aaagcgcagaguaucc

SEQ ID NO: 3899814 - RNA, 13 nt, Human adenovirus A
aaaggacuuuuuu

SEQ ID NO: 3899815 - RNA, 18 nt, Human adenovirus A
aaaguacccuaaacagua

SEQ ID NO: 3899816 - RNA, 16 nt, Human adenovirus A
aaagucuacugcaaaa

SEQ ID NO: 3899817 - RNA, 19 nt, Human adenovirus A
aaauaaagaguuaauugau

SEQ ID NO: 3899818 - RNA, 21 nt, Human adenovirus A
aaauaaugcauuaccagcagc

SEQ ID NO: 3899819 - RNA, 23 nt, Human adenovirus A
aaauaaugcauuaccagcagcca

SEQ ID NO: 3899820 - RNA, 19 nt, Human adenovirus A
ggcgcugacgggagcagga

SEQ ID NO: 3899821 - RNA, 20 nt, Human adenovirus A
ggcguaaccaaauacugcua

SEQ ID NO: 3899822 - RNA, 18 nt, Human adenovirus A
ggcgugguuaaacaggga

SEQ ID NO: 3899823 - RNA, 18 nt, Human adenovirus A
ggcguuagcguccacaca

SEQ ID NO: 3899824 - RNA, 14 nt, Human adenovirus A
ggcuccgaacaggu

SEQ ID NO: 3899825 - RNA, 11 nt, Human adenovirus A
ggcugaagagg

SEQ ID NO: 3899826 - RNA, 18 nt, Human adenovirus A
ggcugcgucgccggcgua

SEQ ID NO: 3899827 - RNA, 21 nt, Human adenovirus A
ggcuggcuuuuggauggaacc

SEQ ID NO: 3899828 - RNA, 19 nt, Human adenovirus A
ggcuucgaaugcugugaca

SEQ ID NO: 3899829 - RNA, 15 nt, Human adenovirus A
gggacagcaagcagc

SEQ ID NO: 3899830 - RNA, 16 nt, Human adenovirus A
gggacgcgugugccag

SEQ ID NO: 3899831 - RNA, 13 nt, Human adenovirus A
gggaggaggagga

SEQ ID NO: 3899832 - RNA, 16 nt, Human adenovirus A
gggauuaguucugcac

SEQ ID NO: 3899833 - RNA, 18 nt, Human adenovirus A
gggauuguguccuuggaa

SEQ ID NO: 3899834 - RNA, 16 nt, Human adenovirus A
gggcauggcugaagag

SEQ ID NO: 3899835 - RNA, 13 nt, Human adenovirus A
gggcauuaaagca

SEQ ID NO: 3899836 - RNA, 19 nt, Human adenovirus A
gggccaggaggacacuggc

SEQ ID NO: 3899837 - RNA, 17 nt, Human adenovirus A
gggcccagggguggugg

SEQ ID NO: 3899838 - RNA, 16 nt, Human adenovirus A
gggccggucgcgagcu

SEQ ID NO: 3899839 - RNA, 15 nt, Human adenovirus A
gggggaugaaggaag

SEQ ID NO: 3899840 - RNA, 15 nt, Human adenovirus A
ggguccugcgggaag

SEQ ID NO: 3899841 - RNA, 12 nt, Human adenovirus A
gggucggagaac

SEQ ID NO: 3899842 - RNA, 13 nt, Human adenovirus A
gggugauaugcau

SEQ ID NO: 3899843 - RNA, 15 nt, Human adenovirus A
ggguggagauuuaaa

SEQ ID NO: 3899844 - RNA, 19 nt, Human adenovirus A
gguaggcaauuucugccau

SEQ ID NO: 3899845 - RNA, 15 nt, Human adenovirus A
gguagucggccagca

SEQ ID NO: 3899846 - RNA, 23 nt, Human adenovirus A
gguaguuuaaggugguggcaacg

SEQ ID NO: 3899847 - RNA, 19 nt, Human adenovirus A
ggucagauucuucuuccca

SEQ ID NO: 3899848 - RNA, 15 nt, Human adenovirus A
ggucuagccaacauc

SEQ ID NO: 3899849 - RNA, 22 nt, Human adenovirus A
ggugagcuccgauggguuggga

SEQ ID NO: 3899850 - RNA, 18 nt, Human adenovirus A
gguggagauuuaaaaacc

SEQ ID NO: 3899851 - RNA, 20 nt, Human adenovirus A
gguggcgcuuucgggcucug

SEQ ID NO: 3899852 - RNA, 16 nt, Human adenovirus A
gguuaagcuggguggg

SEQ ID NO: 3899853 - RNA, 18 nt, Human adenovirus A
gguuacugaagugccuca

SEQ ID NO: 3899854 - RNA, 22 nt, Human adenovirus A
gguuuguggggugucugaucaa

SEQ ID NO: 3899855 - RNA, 22 nt, Human adenovirus A
guaaacaugauucuucagagca

SEQ ID NO: 3899856 - RNA, 16 nt, Human adenovirus A
guaaacucaugauggc

SEQ ID NO: 3899857 - RNA, 12 nt, Human adenovirus A
guaacuuucaaa

SEQ ID NO: 3899858 - RNA, 17 nt, Human adenovirus A
guaagaaccaagcauau

SEQ ID NO: 3899859 - RNA, 18 nt, Human adenovirus A
guacaaauuuuuccaccu

SEQ ID NO: 3899860 - RNA, 17 nt, Human adenovirus A
guacacaaugcauuaau

SEQ ID NO: 3899861 - RNA, 15 nt, Human adenovirus A
guacacuaaugaggc

SEQ ID NO: 3899862 - RNA, 17 nt, Human adenovirus A
guacagaggaaauugug

SEQ ID NO: 3899863 - RNA, 16 nt, Human adenovirus A
guacagauguaaagga

SEQ ID NO: 3899864 - RNA, 18 nt, Human adenovirus A
guacauaauccagcaagu

SEQ ID NO: 3899865 - RNA, 13 nt, Human adenovirus A
guacucaaaugug

SEQ ID NO: 3899866 - RNA, 16 nt, Human adenovirus A
guacugcuuccagguu

SEQ ID NO: 3899867 - RNA, 20 nt, Human adenovirus A
guacuuaaaaaaacaaaacc

SEQ ID NO: 3899868 - RNA, 21 nt, Human adenovirus A
guagccugcuuucagcacugc

SEQ ID NO: 3899869 - RNA, 22 nt, Human adenovirus A
guagcugaaaacaacugcacuu

SEQ ID NO: 3899870 - RNA, 15 nt, Human adenovirus A
guaggcuaacuguua

SEQ ID NO: 3899871 - RNA, 23 nt, Human adenovirus A
guaguagaccugcaagacagaaa

SEQ ID NO: 3899872 - RNA, 14 nt, Human adenovirus A
guagucggccagca

SEQ ID NO: 3899873 - RNA, 17 nt, Human adenovirus A
guagugggcacauugca

SEQ ID NO: 3899874 - RNA, 15 nt, Human adenovirus A
guauacagauuuaag

SEQ ID NO: 3899875 - RNA, 22 nt, Human adenovirus A
guauacugaugaucuucccgaa

SEQ ID NO: 3899876 - RNA, 19 nt, Human adenovirus A
guauucugcuaaacucaca

SEQ ID NO: 3899877 - RNA, 18 nt, Human adenovirus A
gucaaaccugacagacuu

SEQ ID NO: 3899878 - RNA, 17 nt, Human adenovirus A
gucacacccuccguguu

SEQ ID NO: 3899879 - RNA, 20 nt, Human adenovirus A
gucagauaacgcuaagcuua

SEQ ID NO: 3899880 - RNA, 19 nt, Human adenovirus A
gucauuuacugcagccugu

SEQ ID NO: 3899881 - RNA, 22 nt, Human adenovirus A
guccaggguuugcuucagcagu

SEQ ID NO: 3899882 - RNA, 17 nt, Human adenovirus A
gucgauuucggcggcgu

SEQ ID NO: 3899883 - RNA, 19 nt, Human adenovirus A
gucgcaauuagggccagca

SEQ ID NO: 3899884 - RNA, 13 nt, Human adenovirus A
gucgcuguuuuga

SEQ ID NO: 3899885 - RNA, 18 nt, Human adenovirus A
gucggaaugauuaaacaa

SEQ ID NO: 3899886 - RNA, 13 nt, Human adenovirus A
gucucaaaagcag

SEQ ID NO: 3899887 - RNA, 17 nt, Human adenovirus A
gucucaaaagcagccau

SEQ ID NO: 3899888 - RNA, 23 nt, Human adenovirus A
gucuggaucuucaaacaccugca

SEQ ID NO: 3899889 - RNA, 23 nt, Human adenovirus A
gucuguuuaguccugcaguuauu

SEQ ID NO: 3899890 - RNA, 23 nt, Human adenovirus A
gucuucguacuuaaaaaaacaaa

SEQ ID NO: 3899891 - RNA, 22 nt, Human adenovirus A
gugaaucgcagucaccaccagc

SEQ ID NO: 3899892 - RNA, 17 nt, Human adenovirus A
gugaauggaacaccagc

SEQ ID NO: 3899893 - RNA, 16 nt, Human adenovirus A
caaaauugaaaaacug

SEQ ID NO: 3899894 - RNA, 15 nt, Human adenovirus A
caaacaauaacauug

SEQ ID NO: 3899895 - RNA, 15 nt, Human adenovirus A
caaaccacauaggca

SEQ ID NO: 3899896 - RNA, 16 nt, Human adenovirus A
caaacccccaaaagcg

SEQ ID NO: 3899897 - RNA, 14 nt, Human adenovirus A
caaaccuuuacugc

SEQ ID NO: 3899898 - RNA, 16 nt, Human adenovirus A
caaacguccaggcagg

SEQ ID NO: 3899899 - RNA, 17 nt, Human adenovirus A
caaacguccaggcaggg

SEQ ID NO: 3899900 - RNA, 15 nt, Human adenovirus A
caaacuuucuccaaa

SEQ ID NO: 3899901 - RNA, 16 nt, Human adenovirus A
caaagaaacagcagca

SEQ ID NO: 3899902 - RNA, 13 nt, Human adenovirus A
caaagaagagcug

SEQ ID NO: 3899903 - RNA, 21 nt, Human adenovirus A
caaagaccccauuguaacuga

SEQ ID NO: 3899904 - RNA, 18 nt, Human adenovirus A
caaagaugcaaacuugca

SEQ ID NO: 3899905 - RNA, 18 nt, Human adenovirus A
caaagccauggcgaccag

SEQ ID NO: 3899906 - RNA, 21 nt, Human adenovirus A
caaaggagaaaagcggccacg

SEQ ID NO: 3899907 - RNA, 21 nt, Human adenovirus A
caaagguaaugagcgcaguga

SEQ ID NO: 3899908 - RNA, 19 nt, Human adenovirus A
caaagguaucucugaccau

SEQ ID NO: 3899909 - RNA, 16 nt, Human adenovirus A
caaaggugcuucccac

SEQ ID NO: 3899910 - RNA, 15 nt, Human adenovirus A
caaaguaauauugua

SEQ ID NO: 3899911 - RNA, 22 nt, Human adenovirus A
caaaguaauauuguagccugcu

SEQ ID NO: 3899912 - RNA, 19 nt, Human adenovirus A
caaaguucgccuacacaac

SEQ ID NO: 3899913 - RNA, 22 nt, Human adenovirus A
caaaucagaagccagcagcaaa

SEQ ID NO: 3899914 - RNA, 14 nt, Human adenovirus A
caaauccaaaagca

SEQ ID NO: 3899915 - RNA, 22 nt, Human adenovirus A
caaaugcgaccucagcccaggg

SEQ ID NO: 3899916 - RNA, 13 nt, Human adenovirus A
caaauuacacacu

SEQ ID NO: 3899917 - RNA, 14 nt, Human adenovirus A
caaauuacacacua

SEQ ID NO: 3899918 - RNA, 20 nt, Human adenovirus A
caaauuuuccauacacucau

SEQ ID NO: 3899919 - RNA, 15 nt, Human adenovirus A
gccgccgcugcagcu

SEQ ID NO: 3899920 - RNA, 23 nt, Human adenovirus A
gccgccguacuuguaacugugga

SEQ ID NO: 3899921 - RNA, 19 nt, Human adenovirus A
gccgcucugucaccuacca

SEQ ID NO: 3899922 - RNA, 17 nt, Human adenovirus A
gccggcgaacgggcagc

SEQ ID NO: 3899923 - RNA, 16 nt, Human adenovirus A
gccguccagcagugcg

SEQ ID NO: 3899924 - RNA, 21 nt, Human adenovirus A
gccugaaccuaauagcacuuu

SEQ ID NO: 3899925 - RNA, 15 nt, Human adenovirus A
gccugguaaaacaag

SEQ ID NO: 3899926 - RNA, 18 nt, Human adenovirus A
gccuuaaauaaggcugcu

SEQ ID NO: 3899927 - RNA, 14 nt, Human adenovirus A
gccuucauuccuuc

SEQ ID NO: 3899928 - RNA, 19 nt, Human adenovirus A
gcgacagaguugcuuuuag

SEQ ID NO: 3899929 - RNA, 19 nt, Human adenovirus A
gcgacucccuuccgugguu

SEQ ID NO: 3899930 - RNA, 16 nt, Human adenovirus A
gcgaucagccaugugc

SEQ ID NO: 3899931 - RNA, 18 nt, Human adenovirus A
gcgcagcagaacccagua

SEQ ID NO: 3899932 - RNA, 16 nt, Human adenovirus A
gcgcauugggcggcga

SEQ ID NO: 3899933 - RNA, 18 nt, Human adenovirus A
gcgcccacucuccugagc

SEQ ID NO: 3899934 - RNA, 13 nt, Human adenovirus A
gcgccccacuucc

SEQ ID NO: 3899935 - RNA, 20 nt, Human adenovirus A
gcgcgagaagaaguagccau

SEQ ID NO: 3899936 - RNA, 19 nt, Human adenovirus A
gcgcgcauacccgaggacg

SEQ ID NO: 3899937 - RNA, 13 nt, Human adenovirus A
gcgcgcggccaga

SEQ ID NO: 3899938 - RNA, 24 nt, Human adenovirus A
gcgcggacgagcucccggaggaag

SEQ ID NO: 3899939 - RNA, 23 nt, Human adenovirus A
gcgcggacuuucaacaggcggga

SEQ ID NO: 3899940 - RNA, 13 nt, Human adenovirus A
gcgcggccagagc

SEQ ID NO: 3899941 - RNA, 14 nt, Human adenovirus A
gcgcucaaaggcag

SEQ ID NO: 3899942 - RNA, 19 nt, Human adenovirus A
gcgcucaaaggcaggcauu

SEQ ID NO: 3899943 - RNA, 21 nt, Human adenovirus A
gcgcucgcgcuuuggaggcag

SEQ ID NO: 3899944 - RNA, 16 nt, Human adenovirus A
gcgcugacgggagcag

SEQ ID NO: 3899945 - RNA, 16 nt, Human adenovirus A
gcggcccgacgaggua

SEQ ID NO: 3899946 - RNA, 20 nt, Human adenovirus A
gcggcucuuuugcagcucca

SEQ ID NO: 3899947 - RNA, 19 nt, Human adenovirus A
gcgguggaacugcagacag

SEQ ID NO: 3899948 - RNA, 13 nt, Human adenovirus A
gcguacagccaga

SEQ ID NO: 3899949 - RNA, 20 nt, Human adenovirus A
gcguacaguuuuggagccaa

SEQ ID NO: 3899950 - RNA, 21 nt, Human adenovirus A
gcguagaccaaccaccgccau

SEQ ID NO: 3899951 - RNA, 22 nt, Human adenovirus A
gcgucacccaagggugcagcuc

SEQ ID NO: 3899952 - RNA, 19 nt, Human adenovirus A
gcgugccguuggcagaguc

SEQ ID NO: 3899953 - RNA, 15 nt, Human adenovirus A
gcguggaacagccaa

SEQ ID NO: 3899954 - RNA, 21 nt, Human adenovirus A
gcguugguucgacgggccagg

SEQ ID NO: 3899955 - RNA, 13 nt, Human adenovirus A
gcuaauaccuguc

SEQ ID NO: 3899956 - RNA, 18 nt, Human adenovirus A
gcuaaucaccucgcucca

SEQ ID NO: 3899957 - RNA, 14 nt, Human adenovirus A
gcuacaucuuuuac

SEQ ID NO: 3899958 - RNA, 23 nt, Human adenovirus A
gcuacaucuuuuacuaaaaugca

SEQ ID NO: 3899959 - RNA, 18 nt, Human adenovirus A
gcuaggcgacgccaacag

SEQ ID NO: 3899960 - RNA, 12 nt, Human adenovirus A
gcucagcuggaa

SEQ ID NO: 3899961 - RNA, 18 nt, Human adenovirus A
gcucccacacgcagcaac

SEQ ID NO: 3899962 - RNA, 18 nt, Human adenovirus A
gcucccacccaugauguu

SEQ ID NO: 3899963 - RNA, 20 nt, Human adenovirus A
gcucgcaaguaccgcgcgcc

SEQ ID NO: 3899964 - RNA, 15 nt, Human adenovirus A
gcucgcccgggacag

SEQ ID NO: 3899965 - RNA, 16 nt, Human adenovirus A
gcucuaauagaacugg

SEQ ID NO: 3899966 - RNA, 21 nt, Human adenovirus A
gcucugauuucgauaaacaaa

SEQ ID NO: 3899967 - RNA, 12 nt, Human adenovirus A
gcucuggcaggg

SEQ ID NO: 3899968 - RNA, 19 nt, Human adenovirus A
gcugaggaaaugcgagacu

SEQ ID NO: 3899969 - RNA, 16 nt, Human adenovirus A
gcugauggaaauuguc

SEQ ID NO: 3899970 - RNA, 15 nt, Human adenovirus A
gcugcaggccuuagc

SEQ ID NO: 3899971 - RNA, 23 nt, Human adenovirus A
gcugccuccuuugccagaaccca

SEQ ID NO: 3899972 - RNA, 15 nt, Human adenovirus A
gcugcgugaggagga

SEQ ID NO: 3899973 - RNA, 20 nt, Human adenovirus A
gcuggccccgcgacacggca

SEQ ID NO: 3899974 - RNA, 17 nt, Human adenovirus A
gcugggcucgaggacca

SEQ ID NO: 3899975 - RNA, 18 nt, Human adenovirus A
gcugggcucgaggaccau

SEQ ID NO: 3899976 - RNA, 18 nt, Human adenovirus A
gcugguaacuacuucacc

SEQ ID NO: 3899977 - RNA, 20 nt, Human adenovirus A
gcuggugaaagaucacagcc

SEQ ID NO: 3899978 - RNA, 17 nt, Human adenovirus A
gcuguaucuguugaaug

SEQ ID NO: 3899979 - RNA, 20 nt, Human adenovirus A
gcuguugggacagcaagcag

SEQ ID NO: 3899980 - RNA, 13 nt, Human adenovirus A
gcuuaacauagcu

SEQ ID NO: 3899981 - RNA, 18 nt, Human adenovirus A
gcuuaauaccuuugcuca

SEQ ID NO: 3899982 - RNA, 14 nt, Human adenovirus A
gcuuaccacucaga

SEQ ID NO: 3899983 - RNA, 19 nt, Human adenovirus A
gcuuagauggagguggaaa

SEQ ID NO: 3899984 - RNA, 20 nt, Human adenovirus A
gcuucaagacguuccauggc

SEQ ID NO: 3899985 - RNA, 15 nt, Human adenovirus A
gcuucagaugacugg

SEQ ID NO: 3899986 - RNA, 17 nt, Human adenovirus A
gcuuccaguucuucuuc

SEQ ID NO: 3899987 - RNA, 19 nt, Human adenovirus A
gcuuccgcggccgcuucua

SEQ ID NO: 3899988 - RNA, 19 nt, Human adenovirus A
gcuucuacuuuagaagcca

SEQ ID NO: 3899989 - RNA, 18 nt, Human adenovirus A
gcuuggaagaaaaaaacc

SEQ ID NO: 3899990 - RNA, 19 nt, Human adenovirus A
gcuuucaagauggccacuc

SEQ ID NO: 3899991 - RNA, 16 nt, Human adenovirus A
gcuuucgggcucuggc

SEQ ID NO: 3899992 - RNA, 17 nt, Human adenovirus A
gcuuuuuugaguacuca

SEQ ID NO: 3899993 - RNA, 15 nt, Human adenovirus A
ggaagaaagagaaca

SEQ ID NO: 3899994 - RNA, 21 nt, Human adenovirus A
ggaagacagcauggagugcug

SEQ ID NO: 3899995 - RNA, 16 nt, Human adenovirus A
ggaagguguugagccc

SEQ ID NO: 3899996 - RNA, 15 nt, Human adenovirus A
ggacaaguuaaaaga

SEQ ID NO: 3899997 - RNA, 17 nt, Human adenovirus A
ggacaauccaaggauga

SEQ ID NO: 3899998 - RNA, 13 nt, Human adenovirus A
ggacaccauggua

SEQ ID NO: 3899999 - RNA, 15 nt, Human adenovirus A
ggacaccauugaaac

SEQ ID NO: 3900000 - RNA, 15 nt, Human adenovirus A
ggaccccgaaaccca

SEQ ID NO: 3900001 - RNA, 11 nt, Human adenovirus A
ggacuuucaac

SEQ ID NO: 3900002 - RNA, 20 nt, Human adenovirus A
ggagcagguguaaccagcug

SEQ ID NO: 3900003 - RNA, 22 nt, Human adenovirus A
ggagcggcugacagagcgcggc

SEQ ID NO: 3900004 - RNA, 17 nt, Human adenovirus A
ggagcugcacguacuag

SEQ ID NO: 3900005 - RNA, 14 nt, Human adenovirus A
ggaggaagcugagg

SEQ ID NO: 3900006 - RNA, 20 nt, Human adenovirus A
ggaggagcuaaaacaagguc

SEQ ID NO: 3900007 - RNA, 16 nt, Human adenovirus A
ggaggcagcuggagug

SEQ ID NO: 3900008 - RNA, 19 nt, Human adenovirus A
ggaggugcucccgcaguga

SEQ ID NO: 3900009 - RNA, 23 nt, Human adenovirus A
ggaggugcucccgcagugaggac

SEQ ID NO: 3900010 - RNA, 20 nt, Human adenovirus A
ggaguguacacuaaugaggc

SEQ ID NO: 3900011 - RNA, 16 nt, Human adenovirus A
ggaguucccacagaac

SEQ ID NO: 3900012 - RNA, 16 nt, Human adenovirus A
ggaguuguagacauag

SEQ ID NO: 3900013 - RNA, 22 nt, Human adenovirus A
ggauacaauguggcccaaugca

SEQ ID NO: 3900014 - RNA, 12 nt, Human adenovirus A
ggauacagagga

SEQ ID NO: 3900015 - RNA, 19 nt, Human adenovirus A
ggauacuaccgcugcucag

SEQ ID NO: 3900016 - RNA, 15 nt, Human adenovirus A
ggaucuccugccacc

SEQ ID NO: 3900017 - RNA, 11 nt, Human adenovirus A
ggaucuucaaa

SEQ ID NO: 3900018 - RNA, 22 nt, Human adenovirus A
ggauggguguuuggcagcaaug

SEQ ID NO: 3900019 - RNA, 15 nt, Human adenovirus A
ggcaaagaacaucaa

SEQ ID NO: 3900020 - RNA, 20 nt, Human adenovirus A
ggcaagaacaauuucaucaa

SEQ ID NO: 3900021 - RNA, 18 nt, Human adenovirus A
ggcaauauuccagcucuu

SEQ ID NO: 3900022 - RNA, 13 nt, Human adenovirus A
ggcacaacagacu

SEQ ID NO: 3900023 - RNA, 19 nt, Human adenovirus A
ggcacauugcaacgcaauc

SEQ ID NO: 3900024 - RNA, 17 nt, Human adenovirus A
ggcagacaagguggccg

SEQ ID NO: 3900025 - RNA, 20 nt, Human adenovirus A
ggcagccguuucaggaagga

SEQ ID NO: 3900026 - RNA, 15 nt, Human adenovirus A
ggcagcggcgccacc

SEQ ID NO: 3900027 - RNA, 17 nt, Human adenovirus A
ggcagcgguaguuguug

SEQ ID NO: 3900028 - RNA, 13 nt, Human adenovirus A
ggcaggggaaggu

SEQ ID NO: 3900029 - RNA, 17 nt, Human adenovirus A
ggcaguacuucauauuu

SEQ ID NO: 3900030 - RNA, 16 nt, Human adenovirus A
ggcauuccccauccaa

SEQ ID NO: 3900031 - RNA, 17 nt, Human adenovirus A
ggccagcauaaaagcuu

SEQ ID NO: 3900032 - RNA, 12 nt, Human adenovirus A
ggccagcucacg

SEQ ID NO: 3900033 - RNA, 16 nt, Human adenovirus A
ggccggaugcagagga

SEQ ID NO: 3900034 - RNA, 14 nt, Human adenovirus A
ggcgaacaggaaga

SEQ ID NO: 3900035 - RNA, 12 nt, Human adenovirus A
ggcgccaggaug

SEQ ID NO: 3900036 - RNA, 17 nt, Human adenovirus A
ggcggcaugcugaaacc

SEQ ID NO: 3900037 - RNA, 21 nt, Human adenovirus A
ggcggccaugcaaagccagcc

SEQ ID NO: 3900038 - RNA, 16 nt, Human adenovirus A
gacgaggucgaggacu

SEQ ID NO: 3900039 - RNA, 23 nt, Human adenovirus A
gacgccccauccguggcaggcca

SEQ ID NO: 3900040 - RNA, 16 nt, Human adenovirus A
gacguaaauggccaaa

SEQ ID NO: 3900041 - RNA, 18 nt, Human adenovirus A
gacucauaagcugugaaa

SEQ ID NO: 3900042 - RNA, 13 nt, Human adenovirus A
gacugacuaugag

SEQ ID NO: 3900043 - RNA, 11 nt, Human adenovirus A
gacugagaacc

SEQ ID NO: 3900044 - RNA, 22 nt, Human adenovirus A
gacuuuuuugccugguaaaaca

SEQ ID NO: 3900045 - RNA, 13 nt, Human adenovirus A
gagaacuaaacaa

SEQ ID NO: 3900046 - RNA, 16 nt, Human adenovirus A
gagaagcggagccacu

SEQ ID NO: 3900047 - RNA, 13 nt, Human adenovirus A
gagauaagcagga

SEQ ID NO: 3900048 - RNA, 20 nt, Human adenovirus A
gagauguccuguuuaaacau

SEQ ID NO: 3900049 - RNA, 14 nt, Human adenovirus A
gagccacaggaaag

SEQ ID NO: 3900050 - RNA, 13 nt, Human adenovirus A
gagccccuuacca

SEQ ID NO: 3900051 - RNA, 15 nt, Human adenovirus A
gagcgccccccuagc

SEQ ID NO: 3900052 - RNA, 19 nt, Human adenovirus A
gagcuaagcgacaaagagc

SEQ ID NO: 3900053 - RNA, 14 nt, Human adenovirus A
gagcugccaccguc

SEQ ID NO: 3900054 - RNA, 13 nt, Human adenovirus A
gaggaaagacagc

SEQ ID NO: 3900055 - RNA, 22 nt, Human adenovirus A
gaggcagccguuucaggaagga

SEQ ID NO: 3900056 - RNA, 20 nt, Human adenovirus A
gagggcauggcugaagagga

SEQ ID NO: 3900057 - RNA, 22 nt, Human adenovirus A
gaggguaacuauucggaaacca

SEQ ID NO: 3900058 - RNA, 17 nt, Human adenovirus A
gagggucaggaaaccca

SEQ ID NO: 3900059 - RNA, 19 nt, Human adenovirus A
gaggugcucccgcagugag

SEQ ID NO: 3900060 - RNA, 14 nt, Human adenovirus A
gagguguaccuggc

SEQ ID NO: 3900061 - RNA, 21 nt, Human adenovirus A
gaguacacgcgcucaaaggca

SEQ ID NO: 3900062 - RNA, 17 nt, Human adenovirus A
gaguaccugagucccgg

SEQ ID NO: 3900063 - RNA, 18 nt, Human adenovirus A
gaguacucaucagaggga

SEQ ID NO: 3900064 - RNA, 13 nt, Human adenovirus A
gaguuagaggaaa

SEQ ID NO: 3900065 - RNA, 14 nt, Human adenovirus A
gauaaacaaaagca

SEQ ID NO: 3900066 - RNA, 15 nt, Human adenovirus A
gauaaacaaaagcaa

SEQ ID NO: 3900067 - RNA, 16 nt, Human adenovirus A
gauaaacaaaagcaaa

SEQ ID NO: 3900068 - RNA, 18 nt, Human adenovirus A
gauaacccugaauguuug

SEQ ID NO: 3900069 - RNA, 22 nt, Human adenovirus A
gauaagauuguaauuuuuuucu

SEQ ID NO: 3900070 - RNA, 22 nt, Human adenovirus A
gauacuaccgcugcucagcucc

SEQ ID NO: 3900071 - RNA, 16 nt, Human adenovirus A
gauagcccacaaggaa

SEQ ID NO: 3900072 - RNA, 17 nt, Human adenovirus A
gaucaacgacuaaaaca

SEQ ID NO: 3900073 - RNA, 14 nt, Human adenovirus A
gaucagaaaaaacu

SEQ ID NO: 3900074 - RNA, 18 nt, Human adenovirus A
gaucauaacauguuuaug

SEQ ID NO: 3900075 - RNA, 14 nt, Human adenovirus A
gauccagcaaacuu

SEQ ID NO: 3900076 - RNA, 17 nt, Human adenovirus A
gauccuuagauuuuuca

SEQ ID NO: 3900077 - RNA, 21 nt, Human adenovirus A
gaucuccugccaccaguugga

SEQ ID NO: 3900078 - RNA, 19 nt, Human adenovirus A
gaucuuuguaguagucuug

SEQ ID NO: 3900079 - RNA, 18 nt, Human adenovirus A
gaugacuggacagcggcc

SEQ ID NO: 3900080 - RNA, 15 nt, Human adenovirus A
gaugauggaaagccg

SEQ ID NO: 3900081 - RNA, 23 nt, Human adenovirus A
gaugcauaauuaaacccuuuagc

SEQ ID NO: 3900082 - RNA, 20 nt, Human adenovirus A
gaugcgaaccgauugggaaa

SEQ ID NO: 3900083 - RNA, 19 nt, Human adenovirus A
gauuacaugaagauuucug

SEQ ID NO: 3900084 - RNA, 13 nt, Human adenovirus A
gauugggaguuca

SEQ ID NO: 3900085 - RNA, 22 nt, Human adenovirus A
gauugggcgcccacucuccuga

SEQ ID NO: 3900086 - RNA, 18 nt, Human adenovirus A
gauuuaggagggucagga

SEQ ID NO: 3900087 - RNA, 16 nt, Human adenovirus A
gauuuaucuguggaau

SEQ ID NO: 3900088 - RNA, 21 nt, Human adenovirus A
gauuucuaacuuguuucuagu

SEQ ID NO: 3900089 - RNA, 12 nt, Human adenovirus A
gauuuuuguccc

SEQ ID NO: 3900090 - RNA, 15 nt, Human adenovirus A
gcaaaaaaggggcac

SEQ ID NO: 3900091 - RNA, 17 nt, Human adenovirus A
gcaaaaauuuuuugcca

SEQ ID NO: 3900092 - RNA, 18 nt, Human adenovirus A
gcaaaccacugcaaugca

SEQ ID NO: 3900093 - RNA, 15 nt, Human adenovirus A
gcaaacuacauugca

SEQ ID NO: 3900094 - RNA, 14 nt, Human adenovirus A
gcaaagaaacacau

SEQ ID NO: 3900095 - RNA, 15 nt, Human adenovirus A
gcaacagaugaugga

SEQ ID NO: 3900096 - RNA, 19 nt, Human adenovirus A
gcaacauagccccaggucc

SEQ ID NO: 3900097 - RNA, 18 nt, Human adenovirus A
gcaaccacggccucagca

SEQ ID NO: 3900098 - RNA, 18 nt, Human adenovirus A
gcaacgcaccuugcagga

SEQ ID NO: 3900099 - RNA, 15 nt, Human adenovirus A
gcaacggcaggaaau

SEQ ID NO: 3900100 - RNA, 16 nt, Human adenovirus A
gcaacuauuggacccu

SEQ ID NO: 3900101 - RNA, 15 nt, Human adenovirus A
gcaagaggagaagga

SEQ ID NO: 3900102 - RNA, 16 nt, Human adenovirus A
gcaagauccggugacu

SEQ ID NO: 3900103 - RNA, 14 nt, Human adenovirus A
gcaagguagcauuu

SEQ ID NO: 3900104 - RNA, 19 nt, Human adenovirus A
gcaauaaaacaaggagccg

SEQ ID NO: 3900105 - RNA, 12 nt, Human adenovirus A
gcaaucagaaug

SEQ ID NO: 3900106 - RNA, 19 nt, Human adenovirus A
gcaaugcagccgugcuaug

SEQ ID NO: 3900107 - RNA, 19 nt, Human adenovirus A
gcaauuagggccagcauug

SEQ ID NO: 3900108 - RNA, 20 nt, Human adenovirus A
gcacauugcaacgcaaucag

SEQ ID NO: 3900109 - RNA, 14 nt, Human adenovirus A
gcaccccuucccac

SEQ ID NO: 3900110 - RNA, 18 nt, Human adenovirus A
gcaccuuuaauacugaaa

SEQ ID NO: 3900111 - RNA, 15 nt, Human adenovirus A
gcacgccaaagccac

SEQ ID NO: 3900112 - RNA, 16 nt, Human adenovirus A
gcacuggcaacauacc

SEQ ID NO: 3900113 - RNA, 14 nt, Human adenovirus A
gcacuuccuucaga

SEQ ID NO: 3900114 - RNA, 20 nt, Human adenovirus A
gcagagcauugugguucagg

SEQ ID NO: 3900115 - RNA, 14 nt, Human adenovirus A
gcagcaacaaggaa

SEQ ID NO: 3900116 - RNA, 13 nt, Human adenovirus A
gcagcaacggcag

SEQ ID NO: 3900117 - RNA, 17 nt, Human adenovirus A
gcagccaaaacucaggu

SEQ ID NO: 3900118 - RNA, 19 nt, Human adenovirus A
gcagcccaacccuucccaa

SEQ ID NO: 3900119 - RNA, 17 nt, Human adenovirus A
gcagcugacaucuuaau

SEQ ID NO: 3900120 - RNA, 20 nt, Human adenovirus A
gcaggagaaaauaacacaua

SEQ ID NO: 3900121 - RNA, 12 nt, Human adenovirus A
gcaggaguugca

SEQ ID NO: 3900122 - RNA, 23 nt, Human adenovirus A
gcaggguaugggcccaggggugg

SEQ ID NO: 3900123 - RNA, 14 nt, Human adenovirus A
gcagugaggacacu

SEQ ID NO: 3900124 - RNA, 18 nt, Human adenovirus A
gcagugcggccuguugcc

SEQ ID NO: 3900125 - RNA, 22 nt, Human adenovirus A
gcaguuuuucuaccaaugaggc

SEQ ID NO: 3900126 - RNA, 17 nt, Human adenovirus A
gcauaaccacuugcgcc

SEQ ID NO: 3900127 - RNA, 16 nt, Human adenovirus A
gcauacaacuacggag

SEQ ID NO: 3900128 - RNA, 19 nt, Human adenovirus A
gcauacuuaccaaagccau

SEQ ID NO: 3900129 - RNA, 19 nt, Human adenovirus A
gcauauugcgcuauguaca

SEQ ID NO: 3900130 - RNA, 20 nt, Human adenovirus A
gcaucuagccagucacaguc

SEQ ID NO: 3900131 - RNA, 16 nt, Human adenovirus A
gcauuaaaugguuaac

SEQ ID NO: 3900132 - RNA, 13 nt, Human adenovirus A
gcauuaagccaga

SEQ ID NO: 3900133 - RNA, 19 nt, Human adenovirus A
gcauuggaaagcagcuugg

SEQ ID NO: 3900134 - RNA, 23 nt, Human adenovirus A
gcauuuaagcaacauuaaaauca

SEQ ID NO: 3900135 - RNA, 22 nt, Human adenovirus A
gccaacaaaacuuaucagccag

SEQ ID NO: 3900136 - RNA, 16 nt, Human adenovirus A
gccaaccucacugcuu

SEQ ID NO: 3900137 - RNA, 18 nt, Human adenovirus A
gccaaggacccccagaca

SEQ ID NO: 3900138 - RNA, 17 nt, Human adenovirus A
gccacacuuaacuuuuu

SEQ ID NO: 3900139 - RNA, 22 nt, Human adenovirus A
gccacacuuaacuuuuuacuaa

SEQ ID NO: 3900140 - RNA, 20 nt, Human adenovirus A
gccaccgucaauucuucuuc

SEQ ID NO: 3900141 - RNA, 22 nt, Human adenovirus A
gccacucaaacauuaugcugga

SEQ ID NO: 3900142 - RNA, 20 nt, Human adenovirus A
gccagaagcacuggcaacau

SEQ ID NO: 3900143 - RNA, 23 nt, Human adenovirus A
gccagccaagcguagccgcagca

SEQ ID NO: 3900144 - RNA, 16 nt, Human adenovirus A
gccagcucuugcagua

SEQ ID NO: 3900145 - RNA, 14 nt, Human adenovirus A
gccauccgcaggca

SEQ ID NO: 3900146 - RNA, 17 nt, Human adenovirus A
gccauuuugaaccagcg

SEQ ID NO: 3900147 - RNA, 11 nt, Human adenovirus A
gcccaagguca

SEQ ID NO: 3900148 - RNA, 21 nt, Human adenovirus A
gcccauaacaucaggagcaga

SEQ ID NO: 3900149 - RNA, 21 nt, Human adenovirus A
gcccaucggauaaccuuacca

SEQ ID NO: 3900150 - RNA, 19 nt, Human adenovirus A
gccccaagcuaaccgcuuu

SEQ ID NO: 3900151 - RNA, 20 nt, Human adenovirus A
gcccgcguuuggaaacugua

SEQ ID NO: 3900152 - RNA, 18 nt, Human adenovirus A
gcccuauccgucuccagc

SEQ ID NO: 3900153 - RNA, 23 nt, Human adenovirus A
gcccucuccaaugaaacccgcug

SEQ ID NO: 3900154 - RNA, 15 nt, Human adenovirus A
gcccugcuccgacaa

SEQ ID NO: 3900155 - RNA, 13 nt, Human adenovirus A
gccgcagagagcu

SEQ ID NO: 3900156 - RNA, 15 nt, Human adenovirus A
gccgcagcaccugga

SEQ ID NO: 3900157 - RNA, 12 nt, Human adenovirus A
cuggagaauaag

SEQ ID NO: 3900158 - RNA, 17 nt, Human adenovirus A
cuggaggucuccauguc

SEQ ID NO: 3900159 - RNA, 19 nt, Human adenovirus A
cuggcaguuuagaggccac

SEQ ID NO: 3900160 - RNA, 23 nt, Human adenovirus A
cuggccauaauguaacccuuccc

SEQ ID NO: 3900161 - RNA, 16 nt, Human adenovirus A
cuggcuuuuggaugga

SEQ ID NO: 3900162 - RNA, 21 nt, Human adenovirus A
cuggggugccuaauuguaugc

SEQ ID NO: 3900163 - RNA, 13 nt, Human adenovirus A
cuguaaaauuucu

SEQ ID NO: 3900164 - RNA, 13 nt, Human adenovirus A
cuguacugcaaac

SEQ ID NO: 3900165 - RNA, 22 nt, Human adenovirus A
cuguaguuucuuuacaacugua

SEQ ID NO: 3900166 - RNA, 18 nt, Human adenovirus A
cuguaucccaucccagcu

SEQ ID NO: 3900167 - RNA, 13 nt, Human adenovirus A
cugucaccuacca

SEQ ID NO: 3900168 - RNA, 15 nt, Human adenovirus A
cugucccccaccagu

SEQ ID NO: 3900169 - RNA, 14 nt, Human adenovirus A
cuguuagacagagc

SEQ ID NO: 3900170 - RNA, 12 nt, Human adenovirus A
cuguugauguga

SEQ ID NO: 3900171 - RNA, 21 nt, Human adenovirus A
cuguugcgccguagugcgcua

SEQ ID NO: 3900172 - RNA, 15 nt, Human adenovirus A
cuuaaaaaaacaaaa

SEQ ID NO: 3900173 - RNA, 15 nt, Human adenovirus A
cuuaaaaaaggacac

SEQ ID NO: 3900174 - RNA, 22 nt, Human adenovirus A
cuuaaagaguaaaaaaagcccg

SEQ ID NO: 3900175 - RNA, 19 nt, Human adenovirus A
cuuaaccgcccccaccgcu

SEQ ID NO: 3900176 - RNA, 20 nt, Human adenovirus A
cuuaauaguucaacauagua

SEQ ID NO: 3900177 - RNA, 12 nt, Human adenovirus A
cuuaaucuguuu

SEQ ID NO: 3900178 - RNA, 16 nt, Human adenovirus A
cuuacauaccaacaug

SEQ ID NO: 3900179 - RNA, 14 nt, Human adenovirus A
cuuaccaacaccuc

SEQ ID NO: 3900180 - RNA, 15 nt, Human adenovirus A
cuuacccgcagcugu

SEQ ID NO: 3900181 - RNA, 19 nt, Human adenovirus A
cuuacccgcagcugucucu

SEQ ID NO: 3900182 - RNA, 21 nt, Human adenovirus A
cuuacccgcagcugucucuac

SEQ ID NO: 3900183 - RNA, 21 nt, Human adenovirus A
cuuacccuagaccaaaugcca

SEQ ID NO: 3900184 - RNA, 15 nt, Human adenovirus A
cuuacucuauugcca

SEQ ID NO: 3900185 - RNA, 15 nt, Human adenovirus A
cuuagaugcauccug

SEQ ID NO: 3900186 - RNA, 19 nt, Human adenovirus A
cuuaguaacgcacacaaca

SEQ ID NO: 3900187 - RNA, 17 nt, Human adenovirus A
cuuaguuuuaaauuguu

SEQ ID NO: 3900188 - RNA, 23 nt, Human adenovirus A
cuuauaaaauuucccucuuccca

SEQ ID NO: 3900189 - RNA, 15 nt, Human adenovirus A
cuucaauaccaguuu

SEQ ID NO: 3900190 - RNA, 16 nt, Human adenovirus A
cuucacuacacuuucc

SEQ ID NO: 3900191 - RNA, 20 nt, Human adenovirus A
cuucagagcacacugggaaa

SEQ ID NO: 3900192 - RNA, 19 nt, Human adenovirus A
cuucagcguccaugaaugu

SEQ ID NO: 3900193 - RNA, 12 nt, Human adenovirus A
cuucaucuuuuc

SEQ ID NO: 3900194 - RNA, 22 nt, Human adenovirus A
cuuccaacuuauuacugguacu

SEQ ID NO: 3900195 - RNA, 15 nt, Human adenovirus A
cuuccgcggccgcuu

SEQ ID NO: 3900196 - RNA, 20 nt, Human adenovirus A
cuuccguagccuugcagcgg

SEQ ID NO: 3900197 - RNA, 16 nt, Human adenovirus A
cuuccucguugcgggg

SEQ ID NO: 3900198 - RNA, 22 nt, Human adenovirus A
cuuccuucagauuuugugccua

SEQ ID NO: 3900199 - RNA, 22 nt, Human adenovirus A
cuucuccagacaacuucauuuu

SEQ ID NO: 3900200 - RNA, 16 nt, Human adenovirus A
cuucucccugugcuuc

SEQ ID NO: 3900201 - RNA, 14 nt, Human adenovirus A
cuucugccuaccug

SEQ ID NO: 3900202 - RNA, 18 nt, Human adenovirus A
cuugcauuaaccuuucca

SEQ ID NO: 3900203 - RNA, 22 nt, Human adenovirus A
cuuggaagaaugggaggaggag

SEQ ID NO: 3900204 - RNA, 17 nt, Human adenovirus A
cuuggccaccauagccc

SEQ ID NO: 3900205 - RNA, 23 nt, Human adenovirus A
cuugguaggcaauuucugccauu

SEQ ID NO: 3900206 - RNA, 18 nt, Human adenovirus A
cuugugcagccuuucuua

SEQ ID NO: 3900207 - RNA, 20 nt, Human adenovirus A
cuuguggaauuccgcagugg

SEQ ID NO: 3900208 - RNA, 17 nt, Human adenovirus A
cuuuaaagguacuaaca

SEQ ID NO: 3900209 - RNA, 17 nt, Human adenovirus A
cuuuauaacuaacuuua

SEQ ID NO: 3900210 - RNA, 13 nt, Human adenovirus A
cuuuauugccuua

SEQ ID NO: 3900211 - RNA, 13 nt, Human adenovirus A
cuuucaacaaaaa

SEQ ID NO: 3900212 - RNA, 14 nt, Human adenovirus A
cuuucaacaaaaaa

SEQ ID NO: 3900213 - RNA, 13 nt, Human adenovirus A
cuuucagcccaug

SEQ ID NO: 3900214 - RNA, 18 nt, Human adenovirus A
cuuucucugugacaaaaa

SEQ ID NO: 3900215 - RNA, 14 nt, Human adenovirus A
cuuugacaacauug

SEQ ID NO: 3900216 - RNA, 18 nt, Human adenovirus A
cuuuuaaaaauuugcaag

SEQ ID NO: 3900217 - RNA, 21 nt, Human adenovirus A
cuuuuaacauuagcagucugg

SEQ ID NO: 3900218 - RNA, 23 nt, Human adenovirus A
cuuuuccauuagcauagccaugg

SEQ ID NO: 3900219 - RNA, 18 nt, Human adenovirus A
cuuuucuuuauguuaauc

SEQ ID NO: 3900220 - RNA, 16 nt, Human adenovirus A
cuuuugcagcuccaac

SEQ ID NO: 3900221 - RNA, 12 nt, Human adenovirus A
cuuuuuaaccac

SEQ ID NO: 3900222 - RNA, 17 nt, Human adenovirus A
cuuuuuucuuacaguau

SEQ ID NO: 3900223 - RNA, 16 nt, Human adenovirus A
gaaaaagcuacaucuu

SEQ ID NO: 3900224 - RNA, 12 nt, Human adenovirus A
gaaaaauaauau

SEQ ID NO: 3900225 - RNA, 16 nt, Human adenovirus A
gaaaagugacgucaca

SEQ ID NO: 3900226 - RNA, 18 nt, Human adenovirus A
gaaacacauuaaaaugug

SEQ ID NO: 3900227 - RNA, 14 nt, Human adenovirus A
gaaacagaagaaaa

SEQ ID NO: 3900228 - RNA, 13 nt, Human adenovirus A
gaaacagcagcaa

SEQ ID NO: 3900229 - RNA, 21 nt, Human adenovirus A
gaaaccagcgccgcaaacuug

SEQ ID NO: 3900230 - RNA, 18 nt, Human adenovirus A
gaaagagaacaaacagug

SEQ ID NO: 3900231 - RNA, 20 nt, Human adenovirus A
gaaaggcauggaaaaacuug

SEQ ID NO: 3900232 - RNA, 16 nt, Human adenovirus A
gaaagguauucagcug

SEQ ID NO: 3900233 - RNA, 23 nt, Human adenovirus A
gaaaguuguagauggucuggcuu

SEQ ID NO: 3900234 - RNA, 22 nt, Human adenovirus A
gaaauaaaaaauuacaaaggca

SEQ ID NO: 3900235 - RNA, 16 nt, Human adenovirus A
gaaaugguaggacgcu

SEQ ID NO: 3900236 - RNA, 14 nt, Human adenovirus A
gaacaaacagugcc

SEQ ID NO: 3900237 - RNA, 22 nt, Human adenovirus A
gaacaguaucuggagcggucuu

SEQ ID NO: 3900238 - RNA, 17 nt, Human adenovirus A
gaaccacgaaaacggug

SEQ ID NO: 3900239 - RNA, 15 nt, Human adenovirus A
gaaccugaaagaaag

SEQ ID NO: 3900240 - RNA, 15 nt, Human adenovirus A
gaacggacaguagcu

SEQ ID NO: 3900241 - RNA, 14 nt, Human adenovirus A
gaacugcagacagu

SEQ ID NO: 3900242 - RNA, 23 nt, Human adenovirus A
gaacuggaaggugacaaugcccg

SEQ ID NO: 3900243 - RNA, 18 nt, Human adenovirus A
gaagacuauagagaggaa

SEQ ID NO: 3900244 - RNA, 23 nt, Human adenovirus A
gaagauagacagcuuuuauaugc

SEQ ID NO: 3900245 - RNA, 19 nt, Human adenovirus A
gaagcgcgugucuucuccc

SEQ ID NO: 3900246 - RNA, 18 nt, Human adenovirus A
gaagcugaggaaaugcga

SEQ ID NO: 3900247 - RNA, 14 nt, Human adenovirus A
gaagcuuauguaca

SEQ ID NO: 3900248 - RNA, 16 nt, Human adenovirus A
gaagggacggcaagua

SEQ ID NO: 3900249 - RNA, 18 nt, Human adenovirus A
gaaggguggggugcugcc

SEQ ID NO: 3900250 - RNA, 14 nt, Human adenovirus A
gaaguaagcuguuu

SEQ ID NO: 3900251 - RNA, 15 nt, Human adenovirus A
gaauauaagaacuac

SEQ ID NO: 3900252 - RNA, 24 nt, Human adenovirus A
gaaucccucgcccgcacagucacu

SEQ ID NO: 3900253 - RNA, 20 nt, Human adenovirus A
gaaucggcaacagcagcaac

SEQ ID NO: 3900254 - RNA, 17 nt, Human adenovirus A
gaaugauuaaacaacaa

SEQ ID NO: 3900255 - RNA, 18 nt, Human adenovirus A
gaauuccgcaguggacag

SEQ ID NO: 3900256 - RNA, 18 nt, Human adenovirus A
gacaaagagcuuaugcau

SEQ ID NO: 3900257 - RNA, 14 nt, Human adenovirus A
gacacaaaagcucu

SEQ ID NO: 3900258 - RNA, 23 nt, Human adenovirus A
gacaccaacgaccagucuuuuaa

SEQ ID NO: 3900259 - RNA, 22 nt, Human adenovirus A
gacaccuacuucacccugggaa

SEQ ID NO: 3900260 - RNA, 16 nt, Human adenovirus A
gacagaacgugcuaca

SEQ ID NO: 3900261 - RNA, 17 nt, Human adenovirus A
gacaucaccacauugcg

SEQ ID NO: 3900262 - RNA, 23 nt, Human adenovirus A
gacauccaugugaugccggcagc

SEQ ID NO: 3900263 - RNA, 17 nt, Human adenovirus A
gacaugguaagcucuug

SEQ ID NO: 3900264 - RNA, 19 nt, Human adenovirus A
gaccaaaaaguaaacuguc

SEQ ID NO: 3900265 - RNA, 20 nt, Human adenovirus A
gaccaagccuauuuuaccca

SEQ ID NO: 3900266 - RNA, 23 nt, Human adenovirus A
gaccaauccaaacccccaaaagc

SEQ ID NO: 3900267 - RNA, 23 nt, Human adenovirus A
gaccccaucuuguuuccagugcg

SEQ ID NO: 3900268 - RNA, 16 nt, Human adenovirus A
gaccccuacuuuguau

SEQ ID NO: 3900269 - RNA, 20 nt, Human adenovirus A
gacccgauuacuuuuuucaa

SEQ ID NO: 3900270 - RNA, 15 nt, Human adenovirus A
gaccgccuuuucuag

SEQ ID NO: 3900271 - RNA, 17 nt, Human adenovirus A
gaccggauggguacaga

SEQ ID NO: 3900272 - RNA, 18 nt, Human adenovirus A
gaccgggcaccacagugg

SEQ ID NO: 3900273 - RNA, 16 nt, Human adenovirus A
gaccuuaaucuguuuu

SEQ ID NO: 3900274 - RNA, 14 nt, Human adenovirus A
gacgagcucccgga

SEQ ID NO: 3900275 - RNA, 15 nt, Human adenovirus A
agcuguggagggcau

SEQ ID NO: 3900276 - RNA, 17 nt, Human adenovirus A
agcuucaauuugccuaa

SEQ ID NO: 3900277 - RNA, 17 nt, Human adenovirus A
agcuuccaguucuucuu

SEQ ID NO: 3900278 - RNA, 23 nt, Human adenovirus A
agcuucuugcuuuaagggcuggc

SEQ ID NO: 3900279 - RNA, 17 nt, Human adenovirus A
agcuuggcuauagaucu

SEQ ID NO: 3900280 - RNA, 17 nt, Human adenovirus A
agcuuuaauaaccaugu

SEQ ID NO: 3900281 - RNA, 22 nt, Human adenovirus A
aggaaaaaaaagaaaguuuaaa

SEQ ID NO: 3900282 - RNA, 12 nt, Human adenovirus A
aggaaaagcugc

SEQ ID NO: 3900283 - RNA, 16 nt, Human adenovirus A
aggaaaaucccccucc

SEQ ID NO: 3900284 - RNA, 19 nt, Human adenovirus A
aggaaaugcgagacugcag

SEQ ID NO: 3900285 - RNA, 19 nt, Human adenovirus A
aggaacuccgcgcaaggag

SEQ ID NO: 3900286 - RNA, 19 nt, Human adenovirus A
aggaagccacaugggaagg

SEQ ID NO: 3900287 - RNA, 13 nt, Human adenovirus A
aggaagcugagga

SEQ ID NO: 3900288 - RNA, 24 nt, Human adenovirus A
aggacaaaagucuacucauacccc

SEQ ID NO: 3900289 - RNA, 14 nt, Human adenovirus A
aggagcuaaaacaa

SEQ ID NO: 3900290 - RNA, 19 nt, Human adenovirus A
aggaggacuuugagccaga

SEQ ID NO: 3900291 - RNA, 21 nt, Human adenovirus A
aggaggagguggcuggacugc

SEQ ID NO: 3900292 - RNA, 16 nt, Human adenovirus A
aggaggguuugcauuu

SEQ ID NO: 3900293 - RNA, 23 nt, Human adenovirus A
aggaguaauaaaaccugugccuc

SEQ ID NO: 3900294 - RNA, 18 nt, Human adenovirus A
aggaguuaaauaaugcau

SEQ ID NO: 3900295 - RNA, 16 nt, Human adenovirus A
aggauccagaggagga

SEQ ID NO: 3900296 - RNA, 20 nt, Human adenovirus A
aggcaaagaaacacaugaug

SEQ ID NO: 3900297 - RNA, 17 nt, Human adenovirus A
aggcaacagaugaugga

SEQ ID NO: 3900298 - RNA, 17 nt, Human adenovirus A
aggcaacguuggcagcg

SEQ ID NO: 3900299 - RNA, 16 nt, Human adenovirus A
aggcaaguuguggaua

SEQ ID NO: 3900300 - RNA, 17 nt, Human adenovirus A
aggcaucuagccaguca

SEQ ID NO: 3900301 - RNA, 12 nt, Human adenovirus A
aggcauuggaaa

SEQ ID NO: 3900302 - RNA, 21 nt, Human adenovirus A
aggcauuuccagguggggaaa

SEQ ID NO: 3900303 - RNA, 15 nt, Human adenovirus A
aggcuaaguuuuguu

SEQ ID NO: 3900304 - RNA, 22 nt, Human adenovirus A
aggcuaaguuuuguuucuucua

SEQ ID NO: 3900305 - RNA, 20 nt, Human adenovirus A
aggcuuucuucaaauccaaa

SEQ ID NO: 3900306 - RNA, 20 nt, Human adenovirus A
aggggucuauccuucagugg

SEQ ID NO: 3900307 - RNA, 16 nt, Human adenovirus A
aggggugguggguuug

SEQ ID NO: 3900308 - RNA, 21 nt, Human adenovirus A
aggguccggacguuccuccuu

SEQ ID NO: 3900309 - RNA, 16 nt, Human adenovirus A
aggguggggugcugcc

SEQ ID NO: 3900310 - RNA, 18 nt, Human adenovirus A
agguacagaggaaauugu

SEQ ID NO: 3900311 - RNA, 20 nt, Human adenovirus A
agguagugggcacauugcaa

SEQ ID NO: 3900312 - RNA, 20 nt, Human adenovirus A
aggucaucguaggacaacuu

SEQ ID NO: 3900313 - RNA, 24 nt, Human adenovirus A
aggugguaaauagggugaaagaag

SEQ ID NO: 3900314 - RNA, 16 nt, Human adenovirus A
agguguuaucuucaaa

SEQ ID NO: 3900315 - RNA, 20 nt, Human adenovirus A
aguaacuccgggaguguaca

SEQ ID NO: 3900316 - RNA, 16 nt, Human adenovirus A
aguaauaaaaccugug

SEQ ID NO: 3900317 - RNA, 22 nt, Human adenovirus A
aguaauggaguuggaaacugug

SEQ ID NO: 3900318 - RNA, 18 nt, Human adenovirus A
aguaccgcgcgcccgcug

SEQ ID NO: 3900319 - RNA, 18 nt, Human adenovirus A
aguacgacgaaguguacg

SEQ ID NO: 3900320 - RNA, 22 nt, Human adenovirus A
aguagccauugguuuaaugcau

SEQ ID NO: 3900321 - RNA, 20 nt, Human adenovirus A
aguauacugaugaucuuccc

SEQ ID NO: 3900322 - RNA, 15 nt, Human adenovirus A
aguaucugcccauuu

SEQ ID NO: 3900323 - RNA, 21 nt, Human adenovirus A
agucaaugcuucugaaacaaa

SEQ ID NO: 3900324 - RNA, 12 nt, Human adenovirus A
agucacaaggua

SEQ ID NO: 3900325 - RNA, 18 nt, Human adenovirus A
agucauugguaccuucga

SEQ ID NO: 3900326 - RNA, 20 nt, Human adenovirus A
agucgcacuuuuuaaaaaag

SEQ ID NO: 3900327 - RNA, 20 nt, Human adenovirus A
agucgcgcacugggccagga

SEQ ID NO: 3900328 - RNA, 22 nt, Human adenovirus A
agucgugguggaagcuggccau

SEQ ID NO: 3900329 - RNA, 23 nt, Human adenovirus A
agucucacguacuuacagggaga

SEQ ID NO: 3900330 - RNA, 21 nt, Human adenovirus A
agucuugaaugcucuggacau

SEQ ID NO: 3900331 - RNA, 19 nt, Human adenovirus A
agugcaaaauaaugacuau

SEQ ID NO: 3900332 - RNA, 19 nt, Human adenovirus A
agugcgguuccagaaggag

SEQ ID NO: 3900333 - RNA, 17 nt, Human adenovirus A
aguggggauugggaagg

SEQ ID NO: 3900334 - RNA, 18 nt, Human adenovirus A
agugucacugccgcugca

SEQ ID NO: 3900335 - RNA, 17 nt, Human adenovirus A
aguuaagaaaacgcauu

SEQ ID NO: 3900336 - RNA, 18 nt, Human adenovirus A
aguuaaguuugacaccag

SEQ ID NO: 3900337 - RNA, 16 nt, Human adenovirus A
aguuaaugcuggaugc

SEQ ID NO: 3900338 - RNA, 18 nt, Human adenovirus A
aguuacaacuugcuucca

SEQ ID NO: 3900339 - RNA, 13 nt, Human adenovirus A
aguucaaacagug

SEQ ID NO: 3900340 - RNA, 18 nt, Human adenovirus A
aguucaaagaagagcugc

SEQ ID NO: 3900341 - RNA, 19 nt, Human adenovirus A
aguucgccuacacaacaca

SEQ ID NO: 3900342 - RNA, 13 nt, Human adenovirus A
aguucuguuucau

SEQ ID NO: 3900343 - RNA, 22 nt, Human adenovirus A
aguugcacauauucgcgugcca

SEQ ID NO: 3900344 - RNA, 11 nt, Human adenovirus A
aguuggaaacu

SEQ ID NO: 3900345 - RNA, 13 nt, Human adenovirus A
aguuguaaggcau

SEQ ID NO: 3900346 - RNA, 17 nt, Human adenovirus A
aguuguggauaccacag

SEQ ID NO: 3900347 - RNA, 18 nt, Human adenovirus A
aguuuggcagacaaggug

SEQ ID NO: 3900348 - RNA, 22 nt, Human adenovirus A
aguuuugauuguauuuugagau

SEQ ID NO: 3900349 - RNA, 11 nt, Human adenovirus A
auaaaaaauua

SEQ ID NO: 3900350 - RNA, 17 nt, Human adenovirus A
cuuauuuuugauucaaa

SEQ ID NO: 3900351 - RNA, 19 nt, Human adenovirus A
cuucaagacguuccauggc

SEQ ID NO: 3900352 - RNA, 16 nt, Human adenovirus A
cuucaauuugccuaaa

SEQ ID NO: 3900353 - RNA, 14 nt, Human adenovirus A
cuucacccugggaa

SEQ ID NO: 3900354 - RNA, 12 nt, Human adenovirus A
cuucagcauuuu

SEQ ID NO: 3900355 - RNA, 16 nt, Human adenovirus A
cuuccauugugcccac

SEQ ID NO: 3900356 - RNA, 20 nt, Human adenovirus A
cuuccauuugaucagaaaaa

SEQ ID NO: 3900357 - RNA, 14 nt, Human adenovirus A
cuucgcgaaauugg

SEQ ID NO: 3900358 - RNA, 19 nt, Human adenovirus A
cuucuacaacgagcaagcc

SEQ ID NO: 3900359 - RNA, 17 nt, Human adenovirus A
cuucuacaaucacuugg

SEQ ID NO: 3900360 - RNA, 20 nt, Human adenovirus A
cuucuccagacaacuucauu

SEQ ID NO: 3900361 - RNA, 19 nt, Human adenovirus A
cuucugcugcauugccacu

SEQ ID NO: 3900362 - RNA, 16 nt, Human adenovirus A
cuucuuguacucaaau

SEQ ID NO: 3900363 - RNA, 23 nt, Human adenovirus A
cuugagcaaaaauguuuucugga

SEQ ID NO: 3900364 - RNA, 15 nt, Human adenovirus A
cuugagccuggauaa

SEQ ID NO: 3900365 - RNA, 16 nt, Human adenovirus A
cuugauccccaaaccg

SEQ ID NO: 3900366 - RNA, 17 nt, Human adenovirus A
cuugauggauuaccuuc

SEQ ID NO: 3900367 - RNA, 17 nt, Human adenovirus A
cuugcauuaaccuuucc

SEQ ID NO: 3900368 - RNA, 15 nt, Human adenovirus A
cuugccaagcuugaa

SEQ ID NO: 3900369 - RNA, 19 nt, Human adenovirus A
cuugcuuccagacaaaaaa

SEQ ID NO: 3900370 - RNA, 12 nt, Human adenovirus A
cuuggaguguac

SEQ ID NO: 3900371 - RNA, 14 nt, Human adenovirus A
cuuggccaguuccc

SEQ ID NO: 3900372 - RNA, 19 nt, Human adenovirus A
cuugggagagucaggcaga

SEQ ID NO: 3900373 - RNA, 19 nt, Human adenovirus A
cuuguacggacaacauccu

SEQ ID NO: 3900374 - RNA, 17 nt, Human adenovirus A
cuugugcagccuuucuu

SEQ ID NO: 3900375 - RNA, 15 nt, Human adenovirus A
cuuguuaauguuugu

SEQ ID NO: 3900376 - RNA, 15 nt, Human adenovirus A
cuuguuuccagugcg

SEQ ID NO: 3900377 - RNA, 23 nt, Human adenovirus A
cuuguuuccagugcgcgacaaaa

SEQ ID NO: 3900378 - RNA, 17 nt, Human adenovirus A
cuuuaauaaaaacacug

SEQ ID NO: 3900379 - RNA, 18 nt, Human adenovirus A
cuuuaauacugaaaaaua

SEQ ID NO: 3900380 - RNA, 21 nt, Human adenovirus A
cuuuacaaaccacuuaguuuu

SEQ ID NO: 3900381 - RNA, 16 nt, Human adenovirus A
cuuuaccaacaccaac

SEQ ID NO: 3900382 - RNA, 20 nt, Human adenovirus A
cuuuacucgccuaaaaacua

SEQ ID NO: 3900383 - RNA, 17 nt, Human adenovirus A
cuuuaggcauuaaaugg

SEQ ID NO: 3900384 - RNA, 17 nt, Human adenovirus A
cuuuagguuagccugaa

SEQ ID NO: 3900385 - RNA, 22 nt, Human adenovirus A
cuuucaaccaagcccucuccaa

SEQ ID NO: 3900386 - RNA, 15 nt, Human adenovirus A
cuuucuaccaaggaa

SEQ ID NO: 3900387 - RNA, 16 nt, Human adenovirus A
cuuugaccggucaggc

SEQ ID NO: 3900388 - RNA, 18 nt, Human adenovirus A
cuuugagccagaugaaca

SEQ ID NO: 3900389 - RNA, 16 nt, Human adenovirus A
cuuuuacucacuggcc

SEQ ID NO: 3900390 - RNA, 22 nt, Human adenovirus A
cuuuuagaugucgaaugcaggg

SEQ ID NO: 3900391 - RNA, 20 nt, Human adenovirus A
cuuuuaguacuccuauguaa

SEQ ID NO: 3900392 - RNA, 18 nt, Human adenovirus A
cuuuuauuucucuuuucu

SEQ ID NO: 3900393 - RNA, 12 nt, Human adenovirus A
cuuuucaaacuu

SEQ ID NO: 3900394 - RNA, 13 nt, Human adenovirus A
cuuuucauuuucg

SEQ ID NO: 3900395 - RNA, 22 nt, Human adenovirus A
gaaaaacaguacaaagccaggc

SEQ ID NO: 3900396 - RNA, 13 nt, Human adenovirus A
gaaaaagcuacau

SEQ ID NO: 3900397 - RNA, 18 nt, Human adenovirus A
gaaaacaauguucccaaa

SEQ ID NO: 3900398 - RNA, 17 nt, Human adenovirus A
gaaaagcugccaccucu

SEQ ID NO: 3900399 - RNA, 21 nt, Human adenovirus A
gaaacucuaacugcucagcug

SEQ ID NO: 3900400 - RNA, 12 nt, Human adenovirus A
uuaauacuggcu

SEQ ID NO: 3900401 - RNA, 16 nt, Human adenovirus A
uuacaaaggcauuaag

SEQ ID NO: 3900402 - RNA, 23 nt, Human adenovirus A
uuacaacuugcuuccagacaaaa

SEQ ID NO: 3900403 - RNA, 20 nt, Human adenovirus A
uuacaagcacgccaaagcca

SEQ ID NO: 3900404 - RNA, 20 nt, Human adenovirus A
uuacauaccuggcaaacugg

SEQ ID NO: 3900405 - RNA, 15 nt, Human adenovirus A
uuacauccuuccauu

SEQ ID NO: 3900406 - RNA, 22 nt, Human adenovirus A
uuacaugaagauuucugcuguc

SEQ ID NO: 3900407 - RNA, 17 nt, Human adenovirus A
uuacaugucaaugcagc

SEQ ID NO: 3900408 - RNA, 13 nt, Human adenovirus A
uuacauguggagc

SEQ ID NO: 3900409 - RNA, 19 nt, Human adenovirus A
uuacauguggagcuuucaa

SEQ ID NO: 3900410 - RNA, 19 nt, Human adenovirus A
uuacccuagaccaaaugcc

SEQ ID NO: 3900411 - RNA, 14 nt, Human adenovirus A
uuacuaaaacagua

SEQ ID NO: 3900412 - RNA, 17 nt, Human adenovirus A
uuagaaggaaaggcaug

SEQ ID NO: 3900413 - RNA, 12 nt, Human adenovirus A
uuagacagagca

SEQ ID NO: 3900414 - RNA, 19 nt, Human adenovirus A
uuagaccuucccaauguaa

SEQ ID NO: 3900415 - RNA, 17 nt, Human adenovirus A
uuaggcagcagcagcaa

SEQ ID NO: 3900416 - RNA, 14 nt, Human adenovirus A
uuaguguuguagau

SEQ ID NO: 3900417 - RNA, 19 nt, Human adenovirus A
uuauaugcgcauggcuuua

SEQ ID NO: 3900418 - RNA, 12 nt, Human adenovirus A
uuaugaaucuuu

SEQ ID NO: 3900419 - RNA, 17 nt, Human adenovirus A
uucaaacaccugcagua

SEQ ID NO: 3900420 - RNA, 17 nt, Human adenovirus A
uucaccgcgcaagcuuu

SEQ ID NO: 3900421 - RNA, 19 nt, Human adenovirus A
uucagcagagucgagguca

SEQ ID NO: 3900422 - RNA, 19 nt, Human adenovirus A
uucagguguuaucuucaaa

SEQ ID NO: 3900423 - RNA, 16 nt, Human adenovirus A
uucauugguccaggcu

SEQ ID NO: 3900424 - RNA, 14 nt, Human adenovirus A
uuccaccaaaugcu

SEQ ID NO: 3900425 - RNA, 22 nt, Human adenovirus A
uuccacugguaacggucuucaa

SEQ ID NO: 3900426 - RNA, 23 nt, Human adenovirus A
uuccacugguaacggucuucaag

SEQ ID NO: 3900427 - RNA, 23 nt, Human adenovirus A
uuccacuuauugcugcggccauu

SEQ ID NO: 3900428 - RNA, 19 nt, Human adenovirus A
uuccagcgccaccugccau

SEQ ID NO: 3900429 - RNA, 21 nt, Human adenovirus A
uuccccuauagaggcuggcac

SEQ ID NO: 3900430 - RNA, 20 nt, Human adenovirus A
uucccuaucauuaagaacac

SEQ ID NO: 3900431 - RNA, 13 nt, Human adenovirus A
uucccucuuccca

SEQ ID NO: 3900432 - RNA, 15 nt, Human adenovirus A
uucgacgggccaggc

SEQ ID NO: 3900433 - RNA, 20 nt, Human adenovirus A
uucgauaauggggucaugaa

SEQ ID NO: 3900434 - RNA, 18 nt, Human adenovirus A
uucgcaggagaaaauaac

SEQ ID NO: 3900435 - RNA, 14 nt, Human adenovirus A
uucuaaaagagcca

SEQ ID NO: 3900436 - RNA, 23 nt, Human adenovirus A
uucuaaaagagccacagcucuga

SEQ ID NO: 3900437 - RNA, 14 nt, Human adenovirus A
uucuaauguggagc

SEQ ID NO: 3900438 - RNA, 15 nt, Human adenovirus A
uucuaccaaggaaaa

SEQ ID NO: 3900439 - RNA, 14 nt, Human adenovirus A
uucugccuaccugc

SEQ ID NO: 3900440 - RNA, 12 nt, Human adenovirus A
uucuugcuuuaa

SEQ ID NO: 3900441 - RNA, 15 nt, Human adenovirus A
uucuuuaccuucugg

SEQ ID NO: 3900442 - RNA, 14 nt, Human adenovirus A
uugaacaauuaaaa

SEQ ID NO: 3900443 - RNA, 16 nt, Human adenovirus A
uugaaccgguugaaac

SEQ ID NO: 3900444 - RNA, 14 nt, Human adenovirus A
uugaauucuggaau

SEQ ID NO: 3900445 - RNA, 15 nt, Human adenovirus A
uugaguacucagccg

SEQ ID NO: 3900446 - RNA, 23 nt, Human adenovirus A
uugcaaaacggcuugccugacuu

SEQ ID NO: 3900447 - RNA, 23 nt, Human adenovirus A
uugcaagaggagaaggaggagga

SEQ ID NO: 3900448 - RNA, 18 nt, Human adenovirus A
uugcauauauccuugcaa

SEQ ID NO: 3900449 - RNA, 12 nt, Human adenovirus A
uugcauuuccca

SEQ ID NO: 3900450 - RNA, 13 nt, Human adenovirus A
uugcgcaagcgcu

SEQ ID NO: 3900451 - RNA, 20 nt, Human adenovirus A
uugcuucauugaauuaccag

SEQ ID NO: 3900452 - RNA, 22 nt, Human adenovirus A
uuggagcgccccccuagcagua

SEQ ID NO: 3900453 - RNA, 17 nt, Human adenovirus A
uuggauaccaagguuuu

SEQ ID NO: 3900454 - RNA, 16 nt, Human adenovirus A
uuggauagcaaagcca

SEQ ID NO: 3900455 - RNA, 15 nt, Human adenovirus A
uuggcagacaaggug

SEQ ID NO: 3900456 - RNA, 13 nt, Human adenovirus A
uuggcggccaugc

SEQ ID NO: 3900457 - RNA, 18 nt, Human adenovirus A
uuggguccuacggaggga

SEQ ID NO: 3900458 - RNA, 19 nt, Human adenovirus A
uugguucgacgggccaggc

SEQ ID NO: 3900459 - RNA, 13 nt, Human adenovirus A
uuguauaaauucu

SEQ ID NO: 3900460 - RNA, 20 nt, Human adenovirus A
uuguugaauucgcaggcggu

SEQ ID NO: 3900461 - RNA, 14 nt, Human adenovirus A
uuguuggauagcaa

SEQ ID NO: 3900462 - RNA, 14 nt, Human adenovirus A
uuuaaaaaccaucu

SEQ ID NO: 3900463 - RNA, 15 nt, Human adenovirus A
uuuaaaaucuugguc

SEQ ID NO: 3900464 - RNA, 18 nt, Human adenovirus A
uuuaauccuaggcaaaga

SEQ ID NO: 3900465 - RNA, 15 nt, Human adenovirus A
uuuaaugcaucuuug

SEQ ID NO: 3900466 - RNA, 14 nt, Human adenovirus A
uuuaauuaacauuc

SEQ ID NO: 3900467 - RNA, 17 nt, Human adenovirus A
uuuacuaaaaugcaaaa

SEQ ID NO: 3900468 - RNA, 13 nt, Human adenovirus A
uuuauccuacaaa

SEQ ID NO: 3900469 - RNA, 20 nt, Human adenovirus A
uuuaugcucguaaaaucuac

SEQ ID NO: 3900470 - RNA, 15 nt, Human adenovirus A
uuuauuaaaaaucaa

SEQ ID NO: 3900471 - RNA, 21 nt, Human adenovirus A
uuucaaacuuuacaaaccacu

SEQ ID NO: 3900472 - RNA, 20 nt, Human adenovirus A
uuucacauucaacugaccag

SEQ ID NO: 3900473 - RNA, 20 nt, Human adenovirus A
uuuccaccaaaugcucuuug

SEQ ID NO: 3900474 - RNA, 19 nt, Human adenovirus A
uuuccauuuuuugaaaaga

SEQ ID NO: 3900475 - RNA, 17 nt, Human adenovirus A
uuucuucaaauccaaaa

SEQ ID NO: 3900476 - RNA, 19 nt, Human adenovirus A
uuugaaaacauauuggccg

SEQ ID NO: 3900477 - RNA, 17 nt, Human adenovirus A
uuugagccagaugaaca

SEQ ID NO: 3900478 - RNA, 20 nt, Human adenovirus A
uuugagccagaugaacauuc

SEQ ID NO: 3900479 - RNA, 19 nt, Human adenovirus A
uuugcucgagacaucugug

SEQ ID NO: 3900480 - RNA, 14 nt, Human adenovirus A
uuuggaaacuguau

SEQ ID NO: 3900481 - RNA, 12 nt, Human adenovirus A
uuuggaggcagc

SEQ ID NO: 3900482 - RNA, 19 nt, Human adenovirus A
uuuggauguaaaaaaauac

SEQ ID NO: 3900483 - RNA, 15 nt, Human adenovirus A
uuugucauggaguuu

SEQ ID NO: 3900484 - RNA, 11 nt, Human adenovirus A
uuuuccaaaug

SEQ ID NO: 3900485 - RNA, 22 nt, Human adenovirus A
uuuucuuuaaaaaucacaaaau

SEQ ID NO: 3900486 - RNA, 15 nt, Human adenovirus A
uuuuguauucugcua

SEQ ID NO: 3900487 - RNA, 14 nt, Human adenovirus A
uuuuguuagaugca

SEQ ID NO: 3900488 - RNA, 18 nt, Human adenovirus A
gagguguaccuggcggcc

SEQ ID NO: 3900489 - RNA, 16 nt, Human adenovirus A
gaguaggaagacagca

SEQ ID NO: 3900490 - RNA, 13 nt, Human adenovirus A
gaguguauggaaa

SEQ ID NO: 3900491 - RNA, 20 nt, Human adenovirus A
gauacagcgcugauuaugca

SEQ ID NO: 3900492 - RNA, 14 nt, Human adenovirus A
gauaugaugcaaga

SEQ ID NO: 3900493 - RNA, 14 nt, Human adenovirus A
gauccagaggagga

SEQ ID NO: 3900494 - RNA, 16 nt, Human adenovirus A
gauccucgaaagcgag

SEQ ID NO: 3900495 - RNA, 14 nt, Human adenovirus A
gaucuauuguuaau

SEQ ID NO: 3900496 - RNA, 12 nt, Human adenovirus A
gaugaaggaagc

SEQ ID NO: 3900497 - RNA, 21 nt, Human adenovirus A
gaugauagagauaagcaggaa

SEQ ID NO: 3900498 - RNA, 19 nt, Human adenovirus A
gaugcuaagggacaaguua

SEQ ID NO: 3900499 - RNA, 15 nt, Human adenovirus A
gaugcuuugggagac

SEQ ID NO: 3900500 - RNA, 15 nt, Human adenovirus A
gauuguguccuugga

SEQ ID NO: 3900501 - RNA, 22 nt, Human adenovirus A
gauuuaaggggucuauccuuca

SEQ ID NO: 3900502 - RNA, 22 nt, Human adenovirus A
gauuugcgcacugaaaaaccaa

SEQ ID NO: 3900503 - RNA, 18 nt, Human adenovirus A
gcaaacaugcuguauccc

SEQ ID NO: 3900504 - RNA, 22 nt, Human adenovirus A
gcaaacgcugaugccacuugaa

SEQ ID NO: 3900505 - RNA, 15 nt, Human adenovirus A
gcaaacucagcccau

SEQ ID NO: 3900506 - RNA, 13 nt, Human adenovirus A
gcaaagaugaggc

SEQ ID NO: 3900507 - RNA, 13 nt, Human adenovirus A
gcaaagccagccu

SEQ ID NO: 3900508 - RNA, 17 nt, Human adenovirus A
gcaacauagccccaggu

SEQ ID NO: 3900509 - RNA, 17 nt, Human adenovirus A
gcaacguuggcagcgac

SEQ ID NO: 3900510 - RNA, 16 nt, Human adenovirus A
gcaagacagaaauaca

SEQ ID NO: 3900511 - RNA, 13 nt, Human adenovirus A
gcaaggcgccgca

SEQ ID NO: 3900512 - RNA, 20 nt, Human adenovirus A
gcaaggcgguauuugcuaua

SEQ ID NO: 3900513 - RNA, 21 nt, Human adenovirus A
gcaaguaggaccaagugaaug

SEQ ID NO: 3900514 - RNA, 15 nt, Human adenovirus A
gcaaugcuuggaaga

SEQ ID NO: 3900515 - RNA, 13 nt, Human adenovirus A
gcacaauaguuua

SEQ ID NO: 3900516 - RNA, 16 nt, Human adenovirus A
gcacacugggaaauga

SEQ ID NO: 3900517 - RNA, 21 nt, Human adenovirus A
gcacauauucgcgugccaggc

SEQ ID NO: 3900518 - RNA, 14 nt, Human adenovirus A
gcaccagaaagcag

SEQ ID NO: 3900519 - RNA, 17 nt, Human adenovirus A
gcaccaucuccauucca

SEQ ID NO: 3900520 - RNA, 19 nt, Human adenovirus A
gcacccccaggggccagcu

SEQ ID NO: 3900521 - RNA, 16 nt, Human adenovirus A
gcaccccuucccaccu

SEQ ID NO: 3900522 - RNA, 15 nt, Human adenovirus A
gcacgagccagcuga

SEQ ID NO: 3900523 - RNA, 14 nt, Human adenovirus A
gcacucucugggga

SEQ ID NO: 3900524 - RNA, 16 nt, Human adenovirus A
gcagagucuauugcgu

SEQ ID NO: 3900525 - RNA, 21 nt, Human adenovirus A
gcagaugagcuucuugcuuua

SEQ ID NO: 3900526 - RNA, 15 nt, Human adenovirus A
gcagaugauagagau

SEQ ID NO: 3900527 - RNA, 14 nt, Human adenovirus A
gcagcaaaugcccu

SEQ ID NO: 3900528 - RNA, 20 nt, Human adenovirus A
gcagcaacggcaggaaaucu

SEQ ID NO: 3900529 - RNA, 21 nt, Human adenovirus A
gcagcaaugcuuggaagaaaa

SEQ ID NO: 3900530 - RNA, 20 nt, Human adenovirus A
gcagcauguccccgaaagcc

SEQ ID NO: 3900531 - RNA, 16 nt, Human adenovirus A
gcagcgccaaauagag

SEQ ID NO: 3900532 - RNA, 19 nt, Human adenovirus A
gcagcuccaaccaugaaaa

SEQ ID NO: 3900533 - RNA, 21 nt, Human adenovirus A
gcagcuccaaccaugaaaaca

SEQ ID NO: 3900534 - RNA, 20 nt, Human adenovirus A
uaugcgcuguaccauacauu

SEQ ID NO: 3900535 - RNA, 21 nt, Human adenovirus A
uauuacacucaggccauaaag

SEQ ID NO: 3900536 - RNA, 19 nt, Human adenovirus A
uauuagcucauuggaguac

SEQ ID NO: 3900537 - RNA, 20 nt, Human adenovirus A
uauucgcgugccaggcauuu

SEQ ID NO: 3900538 - RNA, 19 nt, Human adenovirus A
uauuguauuuccagagccc

SEQ ID NO: 3900539 - RNA, 23 nt, Human adenovirus A
uauuuaaaauuccauaauuaaag

SEQ ID NO: 3900540 - RNA, 18 nt, Human adenovirus A
uauuucacaagacacauu

SEQ ID NO: 3900541 - RNA, 17 nt, Human adenovirus A
uauuucucuuuucuuua

SEQ ID NO: 3900542 - RNA, 23 nt, Human adenovirus A
uauuuuagagagugccccccucc

SEQ ID NO: 3900543 - RNA, 15 nt, Human adenovirus A
ucaaaauaaacaucu

SEQ ID NO: 3900544 - RNA, 16 nt, Human adenovirus A
ucaaacaauaacauug

SEQ ID NO: 3900545 - RNA, 14 nt, Human adenovirus A
ucaaacguccaggc

SEQ ID NO: 3900546 - RNA, 17 nt, Human adenovirus A
ucaaacuuuacaaacca

SEQ ID NO: 3900547 - RNA, 20 nt, Human adenovirus A
ucaaauuccugugcaaacug

SEQ ID NO: 3900548 - RNA, 18 nt, Human adenovirus A
ucaacacaguuuaacaca

SEQ ID NO: 3900549 - RNA, 15 nt, Human adenovirus A
ucaaccuauuaaccu

SEQ ID NO: 3900550 - RNA, 17 nt, Human adenovirus A
ucaacgugucaguuucu

SEQ ID NO: 3900551 - RNA, 12 nt, Human adenovirus A
ucaacugaccag

SEQ ID NO: 3900552 - RNA, 14 nt, Human adenovirus A
ucaagaaaggcauc

SEQ ID NO: 3900553 - RNA, 10 nt, Human adenovirus A
ucaaggaaau

SEQ ID NO: 3900554 - RNA, 15 nt, Human adenovirus A
ucaauuuugcaagug

SEQ ID NO: 3900555 - RNA, 16 nt, Human adenovirus A
ucacaacacagcacua

SEQ ID NO: 3900556 - RNA, 18 nt, Human adenovirus A
ucacaccaaacuggccau

SEQ ID NO: 3900557 - RNA, 17 nt, Human adenovirus A
ucacauuugugacugcu

SEQ ID NO: 3900558 - RNA, 15 nt, Human adenovirus A
ucaccacauugcgca

SEQ ID NO: 3900559 - RNA, 14 nt, Human adenovirus A
ucaccaccagcgcu

SEQ ID NO: 3900560 - RNA, 20 nt, Human adenovirus A
ucaccgcgcugcggccauga

SEQ ID NO: 3900561 - RNA, 16 nt, Human adenovirus A
ucaccguuguacgaua

SEQ ID NO: 3900562 - RNA, 22 nt, Human adenovirus A
ucaccuaccaccuaucccauga

SEQ ID NO: 3900563 - RNA, 20 nt, Human adenovirus A
ucacguggucguaacucaaa

SEQ ID NO: 3900564 - RNA, 16 nt, Human adenovirus A
ucacuacagacaaaca

SEQ ID NO: 3900565 - RNA, 18 nt, Human adenovirus A
ucacuuaagucuuuacaa

SEQ ID NO: 3900566 - RNA, 23 nt, Human adenovirus A
ucacuuacauuauguaaagucag

SEQ ID NO: 3900567 - RNA, 14 nt, Human adenovirus A
ucagaauaaaacaa

SEQ ID NO: 3900568 - RNA, 14 nt, Human adenovirus A
ucagauagcaagcg

SEQ ID NO: 3900569 - RNA, 23 nt, Human adenovirus A
ucagcagagucgaggucaagaac

SEQ ID NO: 3900570 - RNA, 20 nt, Human adenovirus A
ucagcucggaggguccggac

SEQ ID NO: 3900571 - RNA, 21 nt, Human adenovirus A
ucagugaaacgcccuagaugu

SEQ ID NO: 3900572 - RNA, 17 nt, Human adenovirus A
ucauacaaaucagaagc

SEQ ID NO: 3900573 - RNA, 21 nt, Human adenovirus A
ucauacaaaucagaagccagc

SEQ ID NO: 3900574 - RNA, 15 nt, Human adenovirus A
ucaucguaggacaac

SEQ ID NO: 3900575 - RNA, 21 nt, Human adenovirus A
ucaugucgcauaaugaaaaca

SEQ ID NO: 3900576 - RNA, 19 nt, Human adenovirus A
ucauugaauuaccagaaug

SEQ ID NO: 3900577 - RNA, 16 nt, Human adenovirus A
uccaacgaacuacaac

SEQ ID NO: 3900578 - RNA, 17 nt, Human adenovirus A
uccaaggaugacaacau

SEQ ID NO: 3900579 - RNA, 20 nt, Human adenovirus A
uccaaguucuaaugcaaguu

SEQ ID NO: 3900580 - RNA, 16 nt, Human adenovirus A
uccaauggucuucaag

SEQ ID NO: 3900581 - RNA, 17 nt, Human adenovirus A
uccagaggaggaggagg

SEQ ID NO: 3900582 - RNA, 17 nt, Human adenovirus A
uccagguguagguuucu

SEQ ID NO: 3900583 - RNA, 14 nt, Human adenovirus A
uccauaccugggau

SEQ ID NO: 3900584 - RNA, 20 nt, Human adenovirus A
uccauuuccaccaaaugcuc

SEQ ID NO: 3900585 - RNA, 14 nt, Human adenovirus A
ucccagacugcugu

SEQ ID NO: 3900586 - RNA, 14 nt, Human adenovirus A
ucccaucccagcua

SEQ ID NO: 3900587 - RNA, 19 nt, Human adenovirus A
ucccaugagcuccugaaag

SEQ ID NO: 3900588 - RNA, 18 nt, Human adenovirus A
uccccagacaguuucauc

SEQ ID NO: 3900589 - RNA, 13 nt, Human adenovirus A
uccccauccaaaa

SEQ ID NO: 3900590 - RNA, 12 nt, Human adenovirus A
uccccuguggag

SEQ ID NO: 3900591 - RNA, 22 nt, Human adenovirus A
uccccuguggagccacugcuac

SEQ ID NO: 3900592 - RNA, 19 nt, Human adenovirus A
uccgacaacagcugcuguc

SEQ ID NO: 3900593 - RNA, 23 nt, Human adenovirus A
uccgccauggcuacgugcgccaa

SEQ ID NO: 3900594 - RNA, 17 nt, Human adenovirus A
uccgcggggacagcgcg

SEQ ID NO: 3900595 - RNA, 18 nt, Human adenovirus A
uccuccauuacuaccguc

SEQ ID NO: 3900596 - RNA, 18 nt, Human adenovirus A
uccuccuuauccuuccag

SEQ ID NO: 3900597 - RNA, 22 nt, Human adenovirus A
uccugggacauaauuucccuca

SEQ ID NO: 3900598 - RNA, 19 nt, Human adenovirus A
uccuuagauuuuucaucug

SEQ ID NO: 3900599 - RNA, 13 nt, Human adenovirus A
ucgaccugcaugu

SEQ ID NO: 3900600 - RNA, 16 nt, Human adenovirus A
ucgcagcgcacuggca

SEQ ID NO: 3900601 - RNA, 22 nt, Human adenovirus A
ucgccagcaagugccuccucag

SEQ ID NO: 3900602 - RNA, 20 nt, Human adenovirus A
ucgcgcuuuggaggcagcug

SEQ ID NO: 3900603 - RNA, 17 nt, Human adenovirus A
ucgcuaugaaucuuuac

SEQ ID NO: 3900604 - RNA, 22 nt, Human adenovirus A
ucggggucucaauuaguaacaa

SEQ ID NO: 3900605 - RNA, 21 nt, Human adenovirus A
ucguacaggaauucugaccac

SEQ ID NO: 3900606 - RNA, 13 nt, Human adenovirus A
ucguuacuuuugc

SEQ ID NO: 3900607 - RNA, 14 nt, Human adenovirus A
ucuaccaaggaaaa

SEQ ID NO: 3900608 - RNA, 15 nt, Human adenovirus A
ucuacucauacccca

SEQ ID NO: 3900609 - RNA, 20 nt, Human adenovirus A
ucucaccacugaaacucccu

SEQ ID NO: 3900610 - RNA, 14 nt, Human adenovirus A
ucucagaaagccaa

SEQ ID NO: 3900611 - RNA, 15 nt, Human adenovirus A
ucuccaaaucuuaaa

SEQ ID NO: 3900612 - RNA, 23 nt, Human adenovirus A
ucucguugauuauaaucuccaaa

SEQ ID NO: 3900613 - RNA, 11 nt, Human adenovirus A
ucucuuucaac

SEQ ID NO: 3900614 - RNA, 18 nt, Human adenovirus A
ucugaucaacgacuaaaa

SEQ ID NO: 3900615 - RNA, 14 nt, Human adenovirus A
ucugcaugaugcau

SEQ ID NO: 3900616 - RNA, 17 nt, Human adenovirus A
ucugugagugcugauug

SEQ ID NO: 3900617 - RNA, 23 nt, Human adenovirus A
ucuguuauguaugcccagcauga

SEQ ID NO: 3900618 - RNA, 19 nt, Human adenovirus A
ucuuaaaaucuccugaacg

SEQ ID NO: 3900619 - RNA, 18 nt, Human adenovirus A
ucuuccaauggucuucaa

SEQ ID NO: 3900620 - RNA, 22 nt, Human adenovirus A
ucuucguaggaaagaucuucaa

SEQ ID NO: 3900621 - RNA, 15 nt, Human adenovirus A
ucuucuaucaucaaa

SEQ ID NO: 3900622 - RNA, 17 nt, Human adenovirus A
ucuucugacauugcuuc

SEQ ID NO: 3900623 - RNA, 17 nt, Human adenovirus A
ucuugccugcggacuga

SEQ ID NO: 3900624 - RNA, 23 nt, Human adenovirus A
ucuuggucgucacacccuccgug

SEQ ID NO: 3900625 - RNA, 13 nt, Human adenovirus A
ucuuuacaacugu

SEQ ID NO: 3900626 - RNA, 17 nt, Human adenovirus A
ucuuucuuuagaaacuu

SEQ ID NO: 3900627 - RNA, 18 nt, Human adenovirus A
ugaaaaaccaacaaacac

SEQ ID NO: 3900628 - RNA, 22 nt, Human adenovirus A
ugaaaacaauguucccaaauau

SEQ ID NO: 3900629 - RNA, 14 nt, Human adenovirus A
ugaaaauacaucau

SEQ ID NO: 3900630 - RNA, 17 nt, Human adenovirus A
ugaaagaucacagccag

SEQ ID NO: 3900631 - RNA, 16 nt, Human adenovirus A
ugaaccauucccaggu

SEQ ID NO: 3900632 - RNA, 15 nt, Human adenovirus A
ugaacccggccaagg

SEQ ID NO: 3900633 - RNA, 19 nt, Human adenovirus A
ugaaccgguugaaacagac

SEQ ID NO: 3900634 - RNA, 22 nt, Human adenovirus A
ugaacuauuaagugaaagucaa

SEQ ID NO: 3900635 - RNA, 15 nt, Human adenovirus A
ugaagcaaaccacau

SEQ ID NO: 3900636 - RNA, 22 nt, Human adenovirus A
ugaagugccucaaagugaagug

SEQ ID NO: 3900637 - RNA, 15 nt, Human adenovirus A
ugaaugcguaaaucu

SEQ ID NO: 3900638 - RNA, 16 nt, Human adenovirus A
ugacaaacgcccugcu

SEQ ID NO: 3900639 - RNA, 13 nt, Human adenovirus A
ugacaaggaagug

SEQ ID NO: 3900640 - RNA, 19 nt, Human adenovirus A
ugacuggacagcggccaug

SEQ ID NO: 3900641 - RNA, 19 nt, Human adenovirus A
ugacuucccaaauuuucca

SEQ ID NO: 3900642 - RNA, 20 nt, Human adenovirus A
ugacuuuucgcuccucgcgu

SEQ ID NO: 3900643 - RNA, 23 nt, Human adenovirus A
ugagaaccgucugcaugaugcau

SEQ ID NO: 3900644 - RNA, 19 nt, Human adenovirus A
ugagcagaacuugggcuac

SEQ ID NO: 3900645 - RNA, 24 nt, Human adenovirus A
ugagcccgaaguugacuggcaugg

SEQ ID NO: 3900646 - RNA, 22 nt, Human adenovirus A
ugagcgcugcggucuggggugc

SEQ ID NO: 3900647 - RNA, 19 nt, Human adenovirus A
ugaguaggcaaguugugga

SEQ ID NO: 3900648 - RNA, 18 nt, Human adenovirus A
ugaguugggauuacaugc

SEQ ID NO: 3900649 - RNA, 15 nt, Human adenovirus A
ugauaaccuugcaaa

SEQ ID NO: 3900650 - RNA, 17 nt, Human adenovirus A
ugaugcaguaauugaug

SEQ ID NO: 3900651 - RNA, 21 nt, Human adenovirus A
ugaugccgcaguggucuuaca

SEQ ID NO: 3900652 - RNA, 21 nt, Human adenovirus A
ugaugcuuuucgccagcagcc

SEQ ID NO: 3900653 - RNA, 15 nt, Human adenovirus A
ugaugugaugaaagu

SEQ ID NO: 3900654 - RNA, 20 nt, Human adenovirus A
ugauucaagaggaagaaaga

SEQ ID NO: 3900655 - RNA, 15 nt, Human adenovirus A
ugauuuacaaaccgu

SEQ ID NO: 3900656 - RNA, 15 nt, Human adenovirus A
ugauuuuacagagag

SEQ ID NO: 3900657 - RNA, 20 nt, Human adenovirus A
ugcaaguguaauuuuccagc

SEQ ID NO: 3900658 - RNA, 23 nt, Human adenovirus A
ugcacauauucgcgugccaggca

SEQ ID NO: 3900659 - RNA, 18 nt, Human adenovirus A
ugcaggaugaauuucagc

SEQ ID NO: 3900660 - RNA, 15 nt, Human adenovirus A
ugcauuaccagcagc

SEQ ID NO: 3900661 - RNA, 15 nt, Human adenovirus A
ugccagaagcacugg

SEQ ID NO: 3900662 - RNA, 18 nt, Human adenovirus A
ugcccugcaaaaagaaaa

SEQ ID NO: 3900663 - RNA, 17 nt, Human adenovirus A
ugccgacguugcaagag

SEQ ID NO: 3900664 - RNA, 19 nt, Human adenovirus A
ugccgacguugcaagagga

SEQ ID NO: 3900665 - RNA, 18 nt, Human adenovirus A
ugccgccacgaaugcugg

SEQ ID NO: 3900666 - RNA, 19 nt, Human adenovirus A
ugccgucuucguggagaag

SEQ ID NO: 3900667 - RNA, 18 nt, Human adenovirus A
ugccucaaagugaagugu

SEQ ID NO: 3900668 - RNA, 20 nt, Human adenovirus A
ugcgaaccgauugggaaaaa

SEQ ID NO: 3900669 - RNA, 22 nt, Human adenovirus A
ugcgacaaaugcgaccucagcc

SEQ ID NO: 3900670 - RNA, 14 nt, Human adenovirus A
ugcgaccucagccc

SEQ ID NO: 3900671 - RNA, 23 nt, Human adenovirus A
ugcgaccucagcccagggcaacc

SEQ ID NO: 3900672 - RNA, 15 nt, Human adenovirus A
ugcgagcugccaccg

SEQ ID NO: 3900673 - RNA, 20 nt, Human adenovirus A
ugcgcaagcgcugaaacagg

SEQ ID NO: 3900674 - RNA, 12 nt, Human adenovirus A
ugcgggcagcca

SEQ ID NO: 3900675 - RNA, 19 nt, Human adenovirus A
ugcgguuccagaaggagua

SEQ ID NO: 3900676 - RNA, 17 nt, Human adenovirus A
ugcguaaaucucgcagg

SEQ ID NO: 3900677 - RNA, 15 nt, Human adenovirus A
ugcguuuugugcccg

SEQ ID NO: 3900678 - RNA, 13 nt, Human adenovirus A
ugcuaacagcucu

SEQ ID NO: 3900679 - RNA, 16 nt, Human adenovirus A
ugcuccuuuucuuaca

SEQ ID NO: 3900680 - RNA, 18 nt, Human adenovirus A
ugcucuuggugguucugc

SEQ ID NO: 3900681 - RNA, 16 nt, Human adenovirus A
ugcugaagaaacagaa

SEQ ID NO: 3900682 - RNA, 17 nt, Human adenovirus A
ugcugagguuaaaagga

SEQ ID NO: 3900683 - RNA, 23 nt, Human adenovirus A
ugcuucggcaagguagcauuuua

SEQ ID NO: 3900684 - RNA, 18 nt, Human adenovirus A
ugcuuugcucgagacauc

SEQ ID NO: 3900685 - RNA, 23 nt, Human adenovirus A
uggaacucuccaauuuguggagg

SEQ ID NO: 3900686 - RNA, 16 nt, Human adenovirus A
uggaacugcagacagu

SEQ ID NO: 3900687 - RNA, 14 nt, Human adenovirus A
uggaagaaaaaaac

SEQ ID NO: 3900688 - RNA, 21 nt, Human adenovirus A
uggaauaaaauuucuagaaau

SEQ ID NO: 3900689 - RNA, 14 nt, Human adenovirus A
uggacauggaaaaa

SEQ ID NO: 3900690 - RNA, 21 nt, Human adenovirus A
uggacuuugagcaccugggca

SEQ ID NO: 3900691 - RNA, 22 nt, Human adenovirus A
uggagauaaguuuaaaggcauu

SEQ ID NO: 3900692 - RNA, 19 nt, Human adenovirus A
uggagccacaggaaagcuu

SEQ ID NO: 3900693 - RNA, 13 nt, Human adenovirus A
uggagcuuucaac

SEQ ID NO: 3900694 - RNA, 13 nt, Human adenovirus A
uggaggcagcugg

SEQ ID NO: 3900695 - RNA, 15 nt, Human adenovirus A
uggaguacaagcuug

SEQ ID NO: 3900696 - RNA, 15 nt, Human adenovirus A
uggaguuggaagaag

SEQ ID NO: 3900697 - RNA, 19 nt, Human adenovirus A
uggaugcuuugggagacag

SEQ ID NO: 3900698 - RNA, 15 nt, Human adenovirus A
uggcagccaagcgcu

SEQ ID NO: 3900699 - RNA, 21 nt, Human adenovirus A
uggcauagaaaguuugguaga

SEQ ID NO: 3900700 - RNA, 13 nt, Human adenovirus A
uggcauuugugcc

SEQ ID NO: 3900701 - RNA, 14 nt, Human adenovirus A
uggcccaaugcaau

SEQ ID NO: 3900702 - RNA, 13 nt, Human adenovirus A
uggcgcuuccaua

SEQ ID NO: 3900703 - RNA, 11 nt, Human adenovirus A
uggcuuccaug

SEQ ID NO: 3900704 - RNA, 14 nt, Human adenovirus A
uggcuucgaaugcu

SEQ ID NO: 3900705 - RNA, 14 nt, Human adenovirus A
ugggaaacaaguuu

SEQ ID NO: 3900706 - RNA, 17 nt, Human adenovirus A
ugggaccccgaaaccca

SEQ ID NO: 3900707 - RNA, 13 nt, Human adenovirus A
ugggcacauugca

SEQ ID NO: 3900708 - RNA, 18 nt, Human adenovirus A
ugggcuuuggacuucugc

SEQ ID NO: 3900709 - RNA, 15 nt, Human adenovirus A
ugguacuaugacugu

SEQ ID NO: 3900710 - RNA, 15 nt, Human adenovirus A
uggucccauccaagu

SEQ ID NO: 3900711 - RNA, 22 nt, Human adenovirus A
uggugcaauucgcccgcgccac

SEQ ID NO: 3900712 - RNA, 22 nt, Human adenovirus A
ugguguuaugaaucuuuauuga

SEQ ID NO: 3900713 - RNA, 14 nt, Human adenovirus A
ugguuaaacugccu

SEQ ID NO: 3900714 - RNA, 14 nt, Human adenovirus A
uguaaggaacgagg

SEQ ID NO: 3900715 - RNA, 18 nt, Human adenovirus A
uguaauaaagcuaaaucu

SEQ ID NO: 3900716 - RNA, 18 nt, Human adenovirus A
uguaauugaaguaagcug

SEQ ID NO: 3900717 - RNA, 22 nt, Human adenovirus A
uguacagcaaucuguaaguuug

SEQ ID NO: 3900718 - RNA, 13 nt, Human adenovirus A
uguacaguuucug

SEQ ID NO: 3900719 - RNA, 12 nt, Human adenovirus A
uguaucuggaca

SEQ ID NO: 3900720 - RNA, 21 nt, Human adenovirus A
uguaucuggacauccauguga

SEQ ID NO: 3900721 - RNA, 23 nt, Human adenovirus A
ugucaacuacauaaaccauggaa

SEQ ID NO: 3900722 - RNA, 13 nt, Human adenovirus A
ugucauggagaag

SEQ ID NO: 3900723 - RNA, 18 nt, Human adenovirus A
ugucauuuacugcagccu

SEQ ID NO: 3900724 - RNA, 13 nt, Human adenovirus A
uguccuuccaggg

SEQ ID NO: 3900725 - RNA, 14 nt, Human adenovirus A
ugugcaaaacuuuc

SEQ ID NO: 3900726 - RNA, 18 nt, Human adenovirus A
ugugcuacacgcugccca

SEQ ID NO: 3900727 - RNA, 15 nt, Human adenovirus A
ugugcugcaaacaug

SEQ ID NO: 3900728 - RNA, 16 nt, Human adenovirus A
uguggcccaaugcaau

SEQ ID NO: 3900729 - RNA, 19 nt, Human adenovirus A
uguuaaauuaaagaugccu

SEQ ID NO: 3900730 - RNA, 23 nt, Human adenovirus A
uguucaacaacagcuucuaaaag

SEQ ID NO: 3900731 - RNA, 21 nt, Human adenovirus A
uguugugcauauuuucuugua

SEQ ID NO: 3900732 - RNA, 19 nt, Human adenovirus A
uguuugacaagauugucau

SEQ ID NO: 3900733 - RNA, 13 nt, Human adenovirus A
uguuuuauuaaaa

SEQ ID NO: 3900734 - RNA, 18 nt, Human adenovirus A
uuaaacaacaaaacacug

SEQ ID NO: 3900735 - RNA, 18 nt, Human adenovirus A
uuaaacccuuuagcaguu

SEQ ID NO: 3900736 - RNA, 13 nt, Human adenovirus A
uuaaaguaaauua

SEQ ID NO: 3900737 - RNA, 22 nt, Human adenovirus A
uuaaauugagaugguguuauga

SEQ ID NO: 3900738 - RNA, 23 nt, Human adenovirus A
uuaacuaagugguugggaacaga

SEQ ID NO: 3900739 - RNA, 18 nt, Human adenovirus A
uuaagaaaacgcauuuuu

SEQ ID NO: 3900740 - RNA, 12 nt, Human adenovirus A
uuaagaaaucuu

SEQ ID NO: 3900741 - RNA, 17 nt, Human adenovirus A
uuaauaauaaaaccauu

SEQ ID NO: 3900742 - RNA, 13 nt, Human adenovirus A
aaucggcggcgcg

SEQ ID NO: 3900743 - RNA, 12 nt, Human adenovirus A
aaugaaaacaau

SEQ ID NO: 3900744 - RNA, 20 nt, Human adenovirus A
aaugaaacccgcugugagca

SEQ ID NO: 3900745 - RNA, 18 nt, Human adenovirus A
aaugagcgcagugaugaa

SEQ ID NO: 3900746 - RNA, 19 nt, Human adenovirus A
aaugauuaaacaacaaaac

SEQ ID NO: 3900747 - RNA, 21 nt, Human adenovirus A
aaugccuuaccagaaaaacag

SEQ ID NO: 3900748 - RNA, 23 nt, Human adenovirus A
aaugccuuaccagaaaaacagua

SEQ ID NO: 3900749 - RNA, 13 nt, Human adenovirus A
aaugcucuggaca

SEQ ID NO: 3900750 - RNA, 11 nt, Human adenovirus A
aaugcucuuug

SEQ ID NO: 3900751 - RNA, 20 nt, Human adenovirus A
aauggcuguugaugugauga

SEQ ID NO: 3900752 - RNA, 21 nt, Human adenovirus A
aaugguggcuaggaaaacaaa

SEQ ID NO: 3900753 - RNA, 20 nt, Human adenovirus A
aaugucucgcuggaaaacau

SEQ ID NO: 3900754 - RNA, 17 nt, Human adenovirus A
aauguggagcugagcaa

SEQ ID NO: 3900755 - RNA, 22 nt, Human adenovirus A
aauuaagcgagcccaacccauu

SEQ ID NO: 3900756 - RNA, 16 nt, Human adenovirus A
aauuacaaaggcauua

SEQ ID NO: 3900757 - RNA, 16 nt, Human adenovirus A
aauuacuaaaacagua

SEQ ID NO: 3900758 - RNA, 18 nt, Human adenovirus A
aauuauugcuuuccucuu

SEQ ID NO: 3900759 - RNA, 17 nt, Human adenovirus A
aauucuggaauaacaag

SEQ ID NO: 3900760 - RNA, 19 nt, Human adenovirus A
aauugagaugguguuauga

SEQ ID NO: 3900761 - RNA, 20 nt, Human adenovirus A
aauugggcggcauuuagagg

SEQ ID NO: 3900762 - RNA, 16 nt, Human adenovirus A
aauuugucugaaaauu

SEQ ID NO: 3900763 - RNA, 12 nt, Human adenovirus A
acaaaacacuga

SEQ ID NO: 3900764 - RNA, 16 nt, Human adenovirus A
acaaaauuugucugaa

SEQ ID NO: 3900765 - RNA, 16 nt, Human adenovirus A
acaaacgcccugcucc

SEQ ID NO: 3900766 - RNA, 20 nt, Human adenovirus A
acaaagcacugggcauaguu

SEQ ID NO: 3900767 - RNA, 22 nt, Human adenovirus A
acaaaugcgaccucagcccagg

SEQ ID NO: 3900768 - RNA, 22 nt, Human adenovirus A
acaacaaaacacugagcuccau

SEQ ID NO: 3900769 - RNA, 13 nt, Human adenovirus A
acaacaauuugca

SEQ ID NO: 3900770 - RNA, 16 nt, Human adenovirus A
acaacagcugcuguca

SEQ ID NO: 3900771 - RNA, 16 nt, Human adenovirus A
acaagcugcgcugccg

SEQ ID NO: 3900772 - RNA, 17 nt, Human adenovirus A
acaagguaggcuaaguu

SEQ ID NO: 3900773 - RNA, 21 nt, Human adenovirus A
acaaguuaaaagaccaaaauu

SEQ ID NO: 3900774 - RNA, 13 nt, Human adenovirus A
acaaguuucccuc

SEQ ID NO: 3900775 - RNA, 20 nt, Human adenovirus A
acaauaguuuaauguuuccc

SEQ ID NO: 3900776 - RNA, 22 nt, Human adenovirus A
acaauccaaggaugacaacauu

SEQ ID NO: 3900777 - RNA, 22 nt, Human adenovirus A
acaaugaaaguugcauuuaaug

SEQ ID NO: 3900778 - RNA, 19 nt, Human adenovirus A
acaaugcagcaaacacugc

SEQ ID NO: 3900779 - RNA, 21 nt, Human adenovirus A
acaauuugcaucucaccacug

SEQ ID NO: 3900780 - RNA, 17 nt, Human adenovirus A
acacagcacuaacaugu

SEQ ID NO: 3900781 - RNA, 15 nt, Human adenovirus A
acacagcguuccaga

SEQ ID NO: 3900782 - RNA, 12 nt, Human adenovirus A
acacaguuuaac

SEQ ID NO: 3900783 - RNA, 16 nt, Human adenovirus A
acacaguuucuuuacg

SEQ ID NO: 3900784 - RNA, 19 nt, Human adenovirus A
acaccauugaaaccagcgc

SEQ ID NO: 3900785 - RNA, 23 nt, Human adenovirus A
acacgggcuggggacugggugcc

SEQ ID NO: 3900786 - RNA, 16 nt, Human adenovirus A
acacuaauacuuccau

SEQ ID NO: 3900787 - RNA, 22 nt, Human adenovirus A
acacuauccugacgccuucaua

SEQ ID NO: 3900788 - RNA, 15 nt, Human adenovirus A
acacugaaggcauuu

SEQ ID NO: 3900789 - RNA, 13 nt, Human adenovirus A
acacuggcuggcu

SEQ ID NO: 3900790 - RNA, 13 nt, Human adenovirus A
acacuuaacacaa

SEQ ID NO: 3900791 - RNA, 18 nt, Human adenovirus A
acacuuuaauaaaaacac

SEQ ID NO: 3900792 - RNA, 21 nt, Human adenovirus A
acacuuuaauaaaaacacugu

SEQ ID NO: 3900793 - RNA, 14 nt, Human adenovirus A
acagaaaaaaauug

SEQ ID NO: 3900794 - RNA, 16 nt, Human adenovirus A
acagaccccaaaggac

SEQ ID NO: 3900795 - RNA, 17 nt, Human adenovirus A
acagacuugcaaacagc

SEQ ID NO: 3900796 - RNA, 19 nt, Human adenovirus A
acagacuugcaaacagcaa

SEQ ID NO: 3900797 - RNA, 15 nt, Human adenovirus A
acaguacaaagccag

SEQ ID NO: 3900798 - RNA, 13 nt, Human adenovirus A
acagucugcagga

SEQ ID NO: 3900799 - RNA, 21 nt, Human adenovirus A
acaguuuugaacaauuaaaaa

SEQ ID NO: 3900800 - RNA, 12 nt, Human adenovirus A
acauaccuggca

SEQ ID NO: 3900801 - RNA, 12 nt, Human adenovirus A
acauaggcauug

SEQ ID NO: 3900802 - RNA, 15 nt, Human adenovirus A
acaucaggagcagaa

SEQ ID NO: 3900803 - RNA, 20 nt, Human adenovirus A
acauccuuccauugugccca

SEQ ID NO: 3900804 - RNA, 20 nt, Human adenovirus A
acaucgccggucaggaugcc

SEQ ID NO: 3900805 - RNA, 22 nt, Human adenovirus A
acaucuacagcgacaaagcacu

SEQ ID NO: 3900806 - RNA, 14 nt, Human adenovirus A
acaucuuaaugcca

SEQ ID NO: 3900807 - RNA, 12 nt, Human adenovirus A
acaugaggcggu

SEQ ID NO: 3900808 - RNA, 13 nt, Human adenovirus A
acaugauuuccag

SEQ ID NO: 3900809 - RNA, 22 nt, Human adenovirus A
acaugcgggggaugaaggaagc

SEQ ID NO: 3900810 - RNA, 20 nt, Human adenovirus A
acauggaaaaaaugaaaguu

SEQ ID NO: 3900811 - RNA, 14 nt, Human adenovirus A
acauguuauuuaaa

SEQ ID NO: 3900812 - RNA, 16 nt, Human adenovirus A
acauuacaauuaacug

SEQ ID NO: 3900813 - RNA, 12 nt, Human adenovirus A
acauuagcaguc

SEQ ID NO: 3900814 - RNA, 13 nt, Human adenovirus A
acauuauguaaag

SEQ ID NO: 3900815 - RNA, 17 nt, Human adenovirus A
acauucgcagcgcacug

SEQ ID NO: 3900816 - RNA, 16 nt, Human adenovirus A
acauugacuguuucca

SEQ ID NO: 3900817 - RNA, 12 nt, Human adenovirus A
acauuuaauaau

SEQ ID NO: 3900818 - RNA, 13 nt, Human adenovirus A
acauuugugacug

SEQ ID NO: 3900819 - RNA, 14 nt, Human adenovirus A
accaaacuggccau

SEQ ID NO: 3900820 - RNA, 22 nt, Human adenovirus A
accaaagccauggcgaccagug

SEQ ID NO: 3900821 - RNA, 11 nt, Human adenovirus A
accacaguggu

SEQ ID NO: 3900822 - RNA, 15 nt, Human adenovirus A
accacuguagugcaa

SEQ ID NO: 3900823 - RNA, 17 nt, Human adenovirus A
accaguacgaggacuga

SEQ ID NO: 3900824 - RNA, 14 nt, Human adenovirus A
accauccaauggau

SEQ ID NO: 3900825 - RNA, 14 nt, Human adenovirus A
accauccugcuccu

SEQ ID NO: 3900826 - RNA, 14 nt, Human adenovirus A
accaugaaaacagc

SEQ ID NO: 3900827 - RNA, 15 nt, Human adenovirus A
acccaagggugcagc

SEQ ID NO: 3900828 - RNA, 23 nt, Human adenovirus A
acccaguuuuugcagugccagaa

SEQ ID NO: 3900829 - RNA, 19 nt, Human adenovirus A
accccaagauuaccacgcc

SEQ ID NO: 3900830 - RNA, 12 nt, Human adenovirus A
accccugggcuu

SEQ ID NO: 3900831 - RNA, 23 nt, Human adenovirus A
acccucccucuuggccagcugcc

SEQ ID NO: 3900832 - RNA, 23 nt, Human adenovirus A
acccuucgcuaugaaucuuuacc

SEQ ID NO: 3900833 - RNA, 17 nt, Human adenovirus A
accgaccugcaacagcc

SEQ ID NO: 3900834 - RNA, 20 nt, Human adenovirus A
accgcagucugacagcaauu

SEQ ID NO: 3900835 - RNA, 15 nt, Human adenovirus A
accguagaugggaca

SEQ ID NO: 3900836 - RNA, 15 nt, Human adenovirus A
accgucgcuuucaac

SEQ ID NO: 3900837 - RNA, 21 nt, Human adenovirus A
accgucgcuuucaaccaagcc

SEQ ID NO: 3900838 - RNA, 16 nt, Human adenovirus A
accuaaacgagggaga

SEQ ID NO: 3900839 - RNA, 22 nt, Human adenovirus A
accuaagacuuaccccugggcu

SEQ ID NO: 3900840 - RNA, 22 nt, Human adenovirus A
accuagguuuaaaucuuucugc

SEQ ID NO: 3900841 - RNA, 23 nt, Human adenovirus A
accuagguuuaaaucuuucugcu

SEQ ID NO: 3900842 - RNA, 18 nt, Human adenovirus A
accuauaacaaugaaagu

SEQ ID NO: 3900843 - RNA, 21 nt, Human adenovirus A
accucaaaaucuaagccaugc

SEQ ID NO: 3900844 - RNA, 15 nt, Human adenovirus A
accucacugcuuugc

SEQ ID NO: 3900845 - RNA, 16 nt, Human adenovirus A
accuccauuauuucuu

SEQ ID NO: 3900846 - RNA, 21 nt, Human adenovirus A
accucccgauaccaaaaacac

SEQ ID NO: 3900847 - RNA, 16 nt, Human adenovirus A
accucuaaguucuguu

SEQ ID NO: 3900848 - RNA, 18 nt, Human adenovirus A
accucuagaaacugugcc

SEQ ID NO: 3900849 - RNA, 18 nt, Human adenovirus A
accucuuuaggcauuaaa

SEQ ID NO: 3900850 - RNA, 23 nt, Human adenovirus A
accugagucccggucuggugcaa

SEQ ID NO: 3900851 - RNA, 20 nt, Human adenovirus A
accuucgagaacuaaacaaa

SEQ ID NO: 3900852 - RNA, 17 nt, Human adenovirus A
accuuggucucgcagcu

SEQ ID NO: 3900853 - RNA, 13 nt, Human adenovirus A
accuuuaacggaa

SEQ ID NO: 3900854 - RNA, 19 nt, Human adenovirus A
accuuuaguauagguauug

SEQ ID NO: 3900855 - RNA, 17 nt, Human adenovirus A
accuuugcucaggcgcc

SEQ ID NO: 3900856 - RNA, 12 nt, Human adenovirus A
acgagcaagccg

SEQ ID NO: 3900857 - RNA, 19 nt, Human adenovirus A
acgaggauccagaggagga

SEQ ID NO: 3900858 - RNA, 15 nt, Human adenovirus A
acgauuaagacauau

SEQ ID NO: 3900859 - RNA, 13 nt, Human adenovirus A
caaagcacugggc

SEQ ID NO: 3900860 - RNA, 20 nt, Human adenovirus A
caaagguaaugagcgcagug

SEQ ID NO: 3900861 - RNA, 21 nt, Human adenovirus A
caaauaaacguguacacaaug

SEQ ID NO: 3900862 - RNA, 20 nt, Human adenovirus A
caaauacugcuagaacaagc

SEQ ID NO: 3900863 - RNA, 16 nt, Human adenovirus A
caaauagcucuuaaug

SEQ ID NO: 3900864 - RNA, 23 nt, Human adenovirus A
caaauauaaaagcacaacuccau

SEQ ID NO: 3900865 - RNA, 23 nt, Human adenovirus A
caaauccauuaauauuguguccu

SEQ ID NO: 3900866 - RNA, 18 nt, Human adenovirus A
caaaucucagaaagccaa

SEQ ID NO: 3900867 - RNA, 14 nt, Human adenovirus A
caaaugagcaaaac

SEQ ID NO: 3900868 - RNA, 15 nt, Human adenovirus A
caaaugcgaccucag

SEQ ID NO: 3900869 - RNA, 17 nt, Human adenovirus A
caaaugcgaccucagcc

SEQ ID NO: 3900870 - RNA, 23 nt, Human adenovirus A
caaauggacgaggguuuuguccu

SEQ ID NO: 3900871 - RNA, 15 nt, Human adenovirus A
caaauuacacacuac

SEQ ID NO: 3900872 - RNA, 16 nt, Human adenovirus A
caaauugcggcucuuu

SEQ ID NO: 3900873 - RNA, 12 nt, Human adenovirus A
caacacaaaaaa

SEQ ID NO: 3900874 - RNA, 18 nt, Human adenovirus A
caacacggaguaaugaac

SEQ ID NO: 3900875 - RNA, 23 nt, Human adenovirus A
caacaguuuaagucgagauucau

SEQ ID NO: 3900876 - RNA, 18 nt, Human adenovirus A
caacaucaugaaaacagc

SEQ ID NO: 3900877 - RNA, 22 nt, Human adenovirus A
caacauccuuuuucuacaggca

SEQ ID NO: 3900878 - RNA, 23 nt, Human adenovirus A
caacauuuguauucauacuaaca

SEQ ID NO: 3900879 - RNA, 13 nt, Human adenovirus A
caaccaaaggaga

SEQ ID NO: 3900880 - RNA, 18 nt, Human adenovirus A
caaccaugaaaacagcau

SEQ ID NO: 3900881 - RNA, 23 nt, Human adenovirus A
caaccguuuagagccgcggcccg

SEQ ID NO: 3900882 - RNA, 19 nt, Human adenovirus A
caacgaaggccaaaccauu

SEQ ID NO: 3900883 - RNA, 13 nt, Human adenovirus A
caacgacuaaaac

SEQ ID NO: 3900884 - RNA, 22 nt, Human adenovirus A
caacggaugaaagcuuagccuu

SEQ ID NO: 3900885 - RNA, 15 nt, Human adenovirus A
caacggccagccaag

SEQ ID NO: 3900886 - RNA, 13 nt, Human adenovirus A
caacguuggcagc

SEQ ID NO: 3900887 - RNA, 21 nt, Human adenovirus A
caacucuacuuaaaagcaagc

SEQ ID NO: 3900888 - RNA, 14 nt, Human adenovirus A
caacuuaacaaauu

SEQ ID NO: 3900889 - RNA, 16 nt, Human adenovirus A
caacuuaacaaauuua

SEQ ID NO: 3900890 - RNA, 21 nt, Human adenovirus A
caacuuacagcuaguaauaau

SEQ ID NO: 3900891 - RNA, 23 nt, Human adenovirus A
caacuuuguccaguuuacuaaca

SEQ ID NO: 3900892 - RNA, 14 nt, Human adenovirus A
caagaugaguaaag

SEQ ID NO: 3900893 - RNA, 11 nt, Human adenovirus A
caagauuuaau

SEQ ID NO: 3900894 - RNA, 16 nt, Human adenovirus A
caagcauauaaaacug

SEQ ID NO: 3900895 - RNA, 13 nt, Human adenovirus A
caaggaaaugagg

SEQ ID NO: 3900896 - RNA, 21 nt, Human adenovirus A
caaggcauuggaaagcagcuu

SEQ ID NO: 3900897 - RNA, 20 nt, Human adenovirus A
caagucuucugacauugcuu

SEQ ID NO: 3900898 - RNA, 22 nt, Human adenovirus A
caagugaauggaacaccagcau

SEQ ID NO: 3900899 - RNA, 17 nt, Human adenovirus A
caaguuaaaagaccaaa

SEQ ID NO: 3900900 - RNA, 18 nt, Human adenovirus A
caaguuguggauaccaca

SEQ ID NO: 3900901 - RNA, 20 nt, Human adenovirus A
caauaaaaaaaacaguuucu

SEQ ID NO: 3900902 - RNA, 12 nt, Human adenovirus A
caauaaauacug

SEQ ID NO: 3900903 - RNA, 18 nt, Human adenovirus A
caauaacuacaaacaguu

SEQ ID NO: 3900904 - RNA, 16 nt, Human adenovirus A
caaucaaauagcucuu

SEQ ID NO: 3900905 - RNA, 13 nt, Human adenovirus A
caaucagugucua

SEQ ID NO: 3900906 - RNA, 19 nt, Human adenovirus A
caaucccuacccaccaucu

SEQ ID NO: 3900907 - RNA, 20 nt, Human adenovirus A
caaugcaauaugacuaagga

SEQ ID NO: 3900908 - RNA, 20 nt, Human adenovirus A
caaugcagcaaacacugcuc

SEQ ID NO: 3900909 - RNA, 21 nt, Human adenovirus A
caaugcuuggaagaaaaaaac

SEQ ID NO: 3900910 - RNA, 13 nt, Human adenovirus A
caaugugcaggcu

SEQ ID NO: 3900911 - RNA, 19 nt, Human adenovirus A
caaugugcaggcuaacuua

SEQ ID NO: 3900912 - RNA, 16 nt, Human adenovirus A
caauuaguaacaagaa

SEQ ID NO: 3900913 - RNA, 20 nt, Human adenovirus A
caauuuacauuuuaacugug

SEQ ID NO: 3900914 - RNA, 12 nt, Human adenovirus A
caauuucugcca

SEQ ID NO: 3900915 - RNA, 14 nt, Human adenovirus A
cacaacacagcacu

SEQ ID NO: 3900916 - RNA, 21 nt, Human adenovirus A
cacaacacauacauacacuca

SEQ ID NO: 3900917 - RNA, 18 nt, Human adenovirus A
cacaacggaugaaagcuu

SEQ ID NO: 3900918 - RNA, 10 nt, Human adenovirus A
cacaaggucu

SEQ ID NO: 3900919 - RNA, 21 nt, Human adenovirus A
cacaaucugccgcaagugcgc

SEQ ID NO: 3900920 - RNA, 20 nt, Human adenovirus A
cacaauuuucuggugguggg

SEQ ID NO: 3900921 - RNA, 15 nt, Human adenovirus A
cacacugauuuugca

SEQ ID NO: 3900922 - RNA, 20 nt, Human adenovirus A
cacacuuaacacaagagcgc

SEQ ID NO: 3900923 - RNA, 20 nt, Human adenovirus A
cacacuuuuaagaagguguc

SEQ ID NO: 3900924 - RNA, 21 nt, Human adenovirus A
cacaguuuaacacauacagua

SEQ ID NO: 3900925 - RNA, 15 nt, Human adenovirus A
cacauacaucaccuc

SEQ ID NO: 3900926 - RNA, 21 nt, Human adenovirus A
cacauauucgcgugccaggca

SEQ ID NO: 3900927 - RNA, 22 nt, Human adenovirus A
cacaugauggaucuggagccac

SEQ ID NO: 3900928 - RNA, 19 nt, Human adenovirus A
caccaaacugcagccucau

SEQ ID NO: 3900929 - RNA, 18 nt, Human adenovirus A
caccaaauuuaaggccag

SEQ ID NO: 3900930 - RNA, 12 nt, Human adenovirus A
caccaccaaacu

SEQ ID NO: 3900931 - RNA, 13 nt, Human adenovirus A
caccaccucccuc

SEQ ID NO: 3900932 - RNA, 17 nt, Human adenovirus A
caccaguuggaagaaug

SEQ ID NO: 3900933 - RNA, 19 nt, Human adenovirus A
caccaugguaaaaaggaag

SEQ ID NO: 3900934 - RNA, 19 nt, Human adenovirus A
caccgcgcugcggccauga

SEQ ID NO: 3900935 - RNA, 19 nt, Human adenovirus A
caccugcaguaaauucagu

SEQ ID NO: 3900936 - RNA, 16 nt, Human adenovirus A
cacgcgcucaaaggca

SEQ ID NO: 3900937 - RNA, 15 nt, Human adenovirus A
cacgcuuugaccggu

SEQ ID NO: 3900938 - RNA, 11 nt, Human adenovirus A
cacggagagga

SEQ ID NO: 3900939 - RNA, 16 nt, Human adenovirus A
cacggccucagcagcg

SEQ ID NO: 3900940 - RNA, 17 nt, Human adenovirus A
cacggccucagcagcgg

SEQ ID NO: 3900941 - RNA, 18 nt, Human adenovirus A
cacgguauuggccauucc

SEQ ID NO: 3900942 - RNA, 23 nt, Human adenovirus A
cacguucaauaguggcugcaagg

SEQ ID NO: 3900943 - RNA, 22 nt, Human adenovirus A
cacuagaaucggcaacagcagc

SEQ ID NO: 3900944 - RNA, 22 nt, Human adenovirus A
cacuagaccuuuguuaccacuu

SEQ ID NO: 3900945 - RNA, 16 nt, Human adenovirus A
cacugggccaggagga

SEQ ID NO: 3900946 - RNA, 17 nt, Human adenovirus A
cacugggccaggaggac

SEQ ID NO: 3900947 - RNA, 20 nt, Human adenovirus A
cacuguaaaaccuacacaug

SEQ ID NO: 3900948 - RNA, 13 nt, Human adenovirus A
cacuuagagggag

SEQ ID NO: 3900949 - RNA, 22 nt, Human adenovirus A
cacuuaugcucccacacgcagc

SEQ ID NO: 3900950 - RNA, 19 nt, Human adenovirus A
cacuuuaauaaaaacacug

SEQ ID NO: 3900951 - RNA, 21 nt, Human adenovirus A
cacuuugccuacccggcagua

SEQ ID NO: 3900952 - RNA, 19 nt, Human adenovirus A
cagaaaaaaauugccaacc

SEQ ID NO: 3900953 - RNA, 18 nt, Human adenovirus A
cagaaauacagagcuguc

SEQ ID NO: 3900954 - RNA, 19 nt, Human adenovirus A
cagaacgugcuacacucaa

SEQ ID NO: 3900955 - RNA, 12 nt, Human adenovirus A
cagaagcacugg

SEQ ID NO: 3900956 - RNA, 15 nt, Human adenovirus A
cagaaugaauuguau

SEQ ID NO: 3900957 - RNA, 17 nt, Human adenovirus A
cagacaccgcccaggca

SEQ ID NO: 3900958 - RNA, 21 nt, Human adenovirus A
cagacaguuucaucaccagca

SEQ ID NO: 3900959 - RNA, 17 nt, Human adenovirus A
cagaccuacgguggcag

SEQ ID NO: 3900960 - RNA, 16 nt, Human adenovirus A
cagacgaugacauuuu

SEQ ID NO: 3900961 - RNA, 22 nt, Human adenovirus A
cagagagcuaagcgacaaagag

SEQ ID NO: 3900962 - RNA, 15 nt, Human adenovirus A
cagagcacacuggga

SEQ ID NO: 3900963 - RNA, 21 nt, Human adenovirus A
cagagcacacugggaaaugau

SEQ ID NO: 3900964 - RNA, 16 nt, Human adenovirus A
cagagcaccccuuccc

SEQ ID NO: 3900965 - RNA, 14 nt, Human adenovirus A
cagauccguuaaug

SEQ ID NO: 3900966 - RNA, 21 nt, Human adenovirus A
cagauuaugguucagcuucuc

SEQ ID NO: 3900967 - RNA, 13 nt, Human adenovirus A
cagauucuggaga

SEQ ID NO: 3900968 - RNA, 20 nt, Human adenovirus A
cagauuucagcacgagaggg

SEQ ID NO: 3900969 - RNA, 14 nt, Human adenovirus A
cagauuuugugccu

SEQ ID NO: 3900970 - RNA, 14 nt, Human adenovirus A
cagcaagugccucc

SEQ ID NO: 3900971 - RNA, 19 nt, Human adenovirus A
cagcagcaacacuccauac

SEQ ID NO: 3900972 - RNA, 16 nt, Human adenovirus A
cagcagcgguggcgcu

SEQ ID NO: 3900973 - RNA, 23 nt, Human adenovirus A
cagcauguccccgaaagccgcaa

SEQ ID NO: 3900974 - RNA, 15 nt, Human adenovirus A
cagcauuaguucuuu

SEQ ID NO: 3900975 - RNA, 15 nt, Human adenovirus A
auaaagaauuuuccg

SEQ ID NO: 3900976 - RNA, 20 nt, Human adenovirus A
auaaauucuuaaacaaucug

SEQ ID NO: 3900977 - RNA, 21 nt, Human adenovirus A
auaaguuuaaaggcauuaugu

SEQ ID NO: 3900978 - RNA, 19 nt, Human adenovirus A
auaauaguucccucugguc

SEQ ID NO: 3900979 - RNA, 16 nt, Human adenovirus A
auaaucuccaaauaaa

SEQ ID NO: 3900980 - RNA, 21 nt, Human adenovirus A
auaaugcagcuucagaaaaug

SEQ ID NO: 3900981 - RNA, 18 nt, Human adenovirus A
auaauuggcuucagcauu

SEQ ID NO: 3900982 - RNA, 12 nt, Human adenovirus A
auaauuucccuc

SEQ ID NO: 3900983 - RNA, 22 nt, Human adenovirus A
auacaacggccagccaagcgua

SEQ ID NO: 3900984 - RNA, 19 nt, Human adenovirus A
auacaacucuacaaaucuu

SEQ ID NO: 3900985 - RNA, 21 nt, Human adenovirus A
auacacauaaagagucucaaa

SEQ ID NO: 3900986 - RNA, 18 nt, Human adenovirus A
auaccacucgaguguacu

SEQ ID NO: 3900987 - RNA, 17 nt, Human adenovirus A
auaccaugauggagugg

SEQ ID NO: 3900988 - RNA, 19 nt, Human adenovirus A
auaccuuugcucaggcgcc

SEQ ID NO: 3900989 - RNA, 20 nt, Human adenovirus A
auacgcgugguuaaacugcc

SEQ ID NO: 3900990 - RNA, 22 nt, Human adenovirus A
auacgcuugugcagccuuucuu

SEQ ID NO: 3900991 - RNA, 22 nt, Human adenovirus A
auacuaaagaaacaaacuacau

SEQ ID NO: 3900992 - RNA, 23 nt, Human adenovirus A
auagcaacaacgcugggcauggu

SEQ ID NO: 3900993 - RNA, 13 nt, Human adenovirus A
auagcgaggaacc

SEQ ID NO: 3900994 - RNA, 14 nt, Human adenovirus A
auagggguuaaggg

SEQ ID NO: 3900995 - RNA, 13 nt, Human adenovirus A
auagggugaaaga

SEQ ID NO: 3900996 - RNA, 18 nt, Human adenovirus A
auaucaauguuauccaca

SEQ ID NO: 3900997 - RNA, 15 nt, Human adenovirus A
auauccaaaguacua

SEQ ID NO: 3900998 - RNA, 23 nt, Human adenovirus A
auaucuuuuaacaacaagcuaau

SEQ ID NO: 3900999 - RNA, 14 nt, Human adenovirus A
auaugggcucuuuu

SEQ ID NO: 3901000 - RNA, 16 nt, Human adenovirus A
auauguaucuggacau

SEQ ID NO: 3901001 - RNA, 16 nt, Human adenovirus A
auauguuucuguacug

SEQ ID NO: 3901002 - RNA, 20 nt, Human adenovirus A
auauuagagcguucugggau

SEQ ID NO: 3901003 - RNA, 20 nt, Human adenovirus A
aucagaagccagcagcaaag

SEQ ID NO: 3901004 - RNA, 17 nt, Human adenovirus A
aucagccagagccgcaa

SEQ ID NO: 3901005 - RNA, 16 nt, Human adenovirus A
auccaacugauuuuca

SEQ ID NO: 3901006 - RNA, 22 nt, Human adenovirus A
auccauguugcuaggcaauggg

SEQ ID NO: 3901007 - RNA, 20 nt, Human adenovirus A
auccauuaauauuguguccu

SEQ ID NO: 3901008 - RNA, 14 nt, Human adenovirus A
aucccagcuaacgc

SEQ ID NO: 3901009 - RNA, 15 nt, Human adenovirus A
auccccagacaguuu

SEQ ID NO: 3901010 - RNA, 14 nt, Human adenovirus A
aucccgaguguuua

SEQ ID NO: 3901011 - RNA, 19 nt, Human adenovirus A
cgggcagccugucuacaaa

SEQ ID NO: 3901012 - RNA, 17 nt, Human adenovirus A
cggguggacggagccag

SEQ ID NO: 3901013 - RNA, 16 nt, Human adenovirus A
cggucucgcagcucuu

SEQ ID NO: 3901014 - RNA, 16 nt, Human adenovirus A
cguaacucaaaaacuc

SEQ ID NO: 3901015 - RNA, 22 nt, Human adenovirus A
cguaacuuucaaaaaagcuuua

SEQ ID NO: 3901016 - RNA, 16 nt, Human adenovirus A
cguagccuugcagcgg

SEQ ID NO: 3901017 - RNA, 13 nt, Human adenovirus A
cguccaggcaggg

SEQ ID NO: 3901018 - RNA, 17 nt, Human adenovirus A
cgucgaguuugugcgcu

SEQ ID NO: 3901019 - RNA, 17 nt, Human adenovirus A
cgucggggcuacugcuc

SEQ ID NO: 3901020 - RNA, 22 nt, Human adenovirus A
cgucuccccauucgcagcaugu

SEQ ID NO: 3901021 - RNA, 15 nt, Human adenovirus A
cgucucguacuaacc

SEQ ID NO: 3901022 - RNA, 15 nt, Human adenovirus A
cgucuucguggagaa

SEQ ID NO: 3901023 - RNA, 18 nt, Human adenovirus A
cguggagaagcggagcca

SEQ ID NO: 3901024 - RNA, 16 nt, Human adenovirus A
cguguuagacauggcu

SEQ ID NO: 3901025 - RNA, 13 nt, Human adenovirus A
cguuaccacccua

SEQ ID NO: 3901026 - RNA, 17 nt, Human adenovirus A
cguuccagauuguggaa

SEQ ID NO: 3901027 - RNA, 15 nt, Human adenovirus A
cguugagccauguug

SEQ ID NO: 3901028 - RNA, 12 nt, Human adenovirus A
cguuuggaaacu

SEQ ID NO: 3901029 - RNA, 12 nt, Human adenovirus A
cuaaaaugcaaa

SEQ ID NO: 3901030 - RNA, 16 nt, Human adenovirus A
cuaaaaugcaaaaugg

SEQ ID NO: 3901031 - RNA, 16 nt, Human adenovirus A
cuaaauaucgcagcug

SEQ ID NO: 3901032 - RNA, 22 nt, Human adenovirus A
cuaaauguaacugaggagcuga

SEQ ID NO: 3901033 - RNA, 17 nt, Human adenovirus A
cuaacaacuccagaugu

SEQ ID NO: 3901034 - RNA, 17 nt, Human adenovirus A
cuaacauguuauuuaaa

SEQ ID NO: 3901035 - RNA, 20 nt, Human adenovirus A
cuaacgcuggggcacagcuu

SEQ ID NO: 3901036 - RNA, 12 nt, Human adenovirus A
cuaacuuuaaug

SEQ ID NO: 3901037 - RNA, 20 nt, Human adenovirus A
cuaagaaggcacccucccag

SEQ ID NO: 3901038 - RNA, 23 nt, Human adenovirus A
cuaagacuuaccccugggcuuug

SEQ ID NO: 3901039 - RNA, 14 nt, Human adenovirus A
cuaauagaacugga

SEQ ID NO: 3901040 - RNA, 23 nt, Human adenovirus A
cuaauggagcggcugacagagcg

SEQ ID NO: 3901041 - RNA, 12 nt, Human adenovirus A
cuacacaacaca

SEQ ID NO: 3901042 - RNA, 20 nt, Human adenovirus A
cuacacaugaaggaaugccu

SEQ ID NO: 3901043 - RNA, 16 nt, Human adenovirus A
cuacacucaacacuac

SEQ ID NO: 3901044 - RNA, 14 nt, Human adenovirus A
cuacagacaaacaa

SEQ ID NO: 3901045 - RNA, 20 nt, Human adenovirus A
cuacauaaaccauggaauuu

SEQ ID NO: 3901046 - RNA, 11 nt, Human adenovirus A
cuacaucuuuu

SEQ ID NO: 3901047 - RNA, 14 nt, Human adenovirus A
cuaccugcgcaaau

SEQ ID NO: 3901048 - RNA, 20 nt, Human adenovirus A
cuaccugcgcacgcccuucu

SEQ ID NO: 3901049 - RNA, 16 nt, Human adenovirus A
cuacgagacucccccc

SEQ ID NO: 3901050 - RNA, 18 nt, Human adenovirus A
cuacuaacaacuccagau

SEQ ID NO: 3901051 - RNA, 15 nt, Human adenovirus A
cuacuaauaauguaa

SEQ ID NO: 3901052 - RNA, 22 nt, Human adenovirus A
cuagacgaggauccagaggagg

SEQ ID NO: 3901053 - RNA, 15 nt, Human adenovirus A
cuagaguguguuuaa

SEQ ID NO: 3901054 - RNA, 20 nt, Human adenovirus A
cuagcuuaccacucagaccu

SEQ ID NO: 3901055 - RNA, 13 nt, Human adenovirus A
cuaggaaaacaaa

SEQ ID NO: 3901056 - RNA, 20 nt, Human adenovirus A
cuaggcaacguuggcagcga

SEQ ID NO: 3901057 - RNA, 15 nt, Human adenovirus A
cuaguucuugucaac

SEQ ID NO: 3901058 - RNA, 18 nt, Human adenovirus A
cuaucaucaaacugccug

SEQ ID NO: 3901059 - RNA, 21 nt, Human adenovirus A
cuaugaugcgggcagccaggc

SEQ ID NO: 3901060 - RNA, 13 nt, Human adenovirus A
cuauuacacucag

SEQ ID NO: 3901061 - RNA, 23 nt, Human adenovirus A
cuauuauugagcauuauuugcga

SEQ ID NO: 3901062 - RNA, 12 nt, Human adenovirus A
cuauuguuaaug

SEQ ID NO: 3901063 - RNA, 11 nt, Human adenovirus A
cucaagacuau

SEQ ID NO: 3901064 - RNA, 14 nt, Human adenovirus A
cucaccacugaaac

SEQ ID NO: 3901065 - RNA, 23 nt, Human adenovirus A
cucagcuggaagagcuaucgcaa

SEQ ID NO: 3901066 - RNA, 15 nt, Human adenovirus A
cucaggccauaaaga

SEQ ID NO: 3901067 - RNA, 14 nt, Human adenovirus A
cucaguagccuugc

SEQ ID NO: 3901068 - RNA, 15 nt, Human adenovirus A
cucauccucagcucc

SEQ ID NO: 3901069 - RNA, 16 nt, Human adenovirus A
cucauccucagcuccg

SEQ ID NO: 3901070 - RNA, 20 nt, Human adenovirus A
cucauuugcgcccagacgua

SEQ ID NO: 3901071 - RNA, 20 nt, Human adenovirus A
cuccagacaacuucauuuuc

SEQ ID NO: 3901072 - RNA, 18 nt, Human adenovirus A
cuccccacagcuggcgca

SEQ ID NO: 3901073 - RNA, 21 nt, Human adenovirus A
cuccccuguggagccacugcu

SEQ ID NO: 3901074 - RNA, 16 nt, Human adenovirus A
cucccucuuggccagc

SEQ ID NO: 3901075 - RNA, 16 nt, Human adenovirus A
cuccggaaacaacacg

SEQ ID NO: 3901076 - RNA, 22 nt, Human adenovirus A
cuccuaccacuguacuuuugcc

SEQ ID NO: 3901077 - RNA, 19 nt, Human adenovirus A
cuccugagcgucacccaag

SEQ ID NO: 3901078 - RNA, 14 nt, Human adenovirus A
cucgaccacaggug

SEQ ID NO: 3901079 - RNA, 13 nt, Human adenovirus A
cucgcagcucuua

SEQ ID NO: 3901080 - RNA, 18 nt, Human adenovirus A
cucgcgcuuuggaggcag

SEQ ID NO: 3901081 - RNA, 13 nt, Human adenovirus A
cucuaccucgcgg

SEQ ID NO: 3901082 - RNA, 20 nt, Human adenovirus A
cucucaaacgccgacgcugc

SEQ ID NO: 3901083 - RNA, 21 nt, Human adenovirus A
cucugguccugggacauaauu

SEQ ID NO: 3901084 - RNA, 16 nt, Human adenovirus A
cucuucgcugcaguuu

SEQ ID NO: 3901085 - RNA, 22 nt, Human adenovirus A
cucuuggaauaaaauuucuaga

SEQ ID NO: 3901086 - RNA, 13 nt, Human adenovirus A
cucuuuaacauuc

SEQ ID NO: 3901087 - RNA, 13 nt, Human adenovirus A
cugaaagaaaguu

SEQ ID NO: 3901088 - RNA, 22 nt, Human adenovirus A
cugaagaagaaccuaacuguca

SEQ ID NO: 3901089 - RNA, 19 nt, Human adenovirus A
cugaagugccucaaaguga

SEQ ID NO: 3901090 - RNA, 15 nt, Human adenovirus A
cugacacaaaagcuc

SEQ ID NO: 3901091 - RNA, 15 nt, Human adenovirus A
cugaccauuacuuuu

SEQ ID NO: 3901092 - RNA, 18 nt, Human adenovirus A
cugagacgaagaaauaca

SEQ ID NO: 3901093 - RNA, 13 nt, Human adenovirus A
cugagacuuccca

SEQ ID NO: 3901094 - RNA, 23 nt, Human adenovirus A
cugagcccuauccgucuccagcu

SEQ ID NO: 3901095 - RNA, 12 nt, Human adenovirus A
cugagcggcaag

SEQ ID NO: 3901096 - RNA, 16 nt, Human adenovirus A
cugaucgcucuucaau

SEQ ID NO: 3901097 - RNA, 22 nt, Human adenovirus A
cugaugcuuuucgccagcagcc

SEQ ID NO: 3901098 - RNA, 20 nt, Human adenovirus A
cugauuucgauaaacaaaag

SEQ ID NO: 3901099 - RNA, 13 nt, Human adenovirus A
cugauuuucacau

SEQ ID NO: 3901100 - RNA, 18 nt, Human adenovirus A
cugcaaaaagaaaaugaa

SEQ ID NO: 3901101 - RNA, 19 nt, Human adenovirus A
cugcaaaauugaaaaacug

SEQ ID NO: 3901102 - RNA, 13 nt, Human adenovirus A
cugcaagacagaa

SEQ ID NO: 3901103 - RNA, 22 nt, Human adenovirus A
cugcaaucuuugcaccccccac

SEQ ID NO: 3901104 - RNA, 17 nt, Human adenovirus A
cugcacuaacucugauu

SEQ ID NO: 3901105 - RNA, 16 nt, Human adenovirus A
cugcacucucugggga

SEQ ID NO: 3901106 - RNA, 19 nt, Human adenovirus A
cugccaccucuagaaacug

SEQ ID NO: 3901107 - RNA, 22 nt, Human adenovirus A
cugccauuaauugaucaauuuc

SEQ ID NO: 3901108 - RNA, 21 nt, Human adenovirus A
cugcgacauuuagaccacugu

SEQ ID NO: 3901109 - RNA, 20 nt, Human adenovirus A
cugcggggggaauaucucau

SEQ ID NO: 3901110 - RNA, 18 nt, Human adenovirus A
cugcuaaacucacauugu

SEQ ID NO: 3901111 - RNA, 22 nt, Human adenovirus A
cugcuaaucaccucgcuccaau

SEQ ID NO: 3901112 - RNA, 23 nt, Human adenovirus A
cugcuccgacaacagcugcuguc

SEQ ID NO: 3901113 - RNA, 14 nt, Human adenovirus A
cuggcaaacuggga

SEQ ID NO: 3901114 - RNA, 21 nt, Human adenovirus A
cuggcaggggaagguguugag

SEQ ID NO: 3901115 - RNA, 18 nt, Human adenovirus A
cuggcaguuuagaggcca

SEQ ID NO: 3901116 - RNA, 15 nt, Human adenovirus A
cuggccccgcgacac

SEQ ID NO: 3901117 - RNA, 14 nt, Human adenovirus A
cugggaguaaaguc

SEQ ID NO: 3901118 - RNA, 19 nt, Human adenovirus A
cuggggugccuaauuguau

SEQ ID NO: 3901119 - RNA, 19 nt, Human adenovirus A
cugguucacaccaaacugg

SEQ ID NO: 3901120 - RNA, 14 nt, Human adenovirus A
cuguacgcaaacuc

SEQ ID NO: 3901121 - RNA, 15 nt, Human adenovirus A
cugucacugagcaca

SEQ ID NO: 3901122 - RNA, 20 nt, Human adenovirus A
cugucagugaagcaaaccac

SEQ ID NO: 3901123 - RNA, 20 nt, Human adenovirus A
cugugagcaaaucucagaaa

SEQ ID NO: 3901124 - RNA, 15 nt, Human adenovirus A
cuguuagacagagca

SEQ ID NO: 3901125 - RNA, 20 nt, Human adenovirus A
cuguugaugugaugaaagua

SEQ ID NO: 3901126 - RNA, 19 nt, Human adenovirus A
cuguugcuacugcagaccc

SEQ ID NO: 3901127 - RNA, 13 nt, Human adenovirus A
cuguuuacuucaa

SEQ ID NO: 3901128 - RNA, 22 nt, Human adenovirus A
gcgcacuucuugcugaaaugcg

SEQ ID NO: 3901129 - RNA, 23 nt, Human adenovirus A
gcgccaaguugaguuccacgagc

SEQ ID NO: 3901130 - RNA, 21 nt, Human adenovirus A
gcgccacccuacgugccuccc

SEQ ID NO: 3901131 - RNA, 12 nt, Human adenovirus A
gcgccaccugcc

SEQ ID NO: 3901132 - RNA, 16 nt, Human adenovirus A
gcgccgcggauuuaau

SEQ ID NO: 3901133 - RNA, 18 nt, Human adenovirus A
gcgcgcaauauggagccg

SEQ ID NO: 3901134 - RNA, 20 nt, Human adenovirus A
gcgcgcccggcucccacgcc

SEQ ID NO: 3901135 - RNA, 18 nt, Human adenovirus A
gcgcgucggggcuacugc

SEQ ID NO: 3901136 - RNA, 16 nt, Human adenovirus A
gcgcucaaaggcaggc

SEQ ID NO: 3901137 - RNA, 19 nt, Human adenovirus A
gcgcugcaucguaaacaac

SEQ ID NO: 3901138 - RNA, 17 nt, Human adenovirus A
gcgcugcggucuggggu

SEQ ID NO: 3901139 - RNA, 13 nt, Human adenovirus A
gcggcaagaacaa

SEQ ID NO: 3901140 - RNA, 15 nt, Human adenovirus A
gcggccacggccgga

SEQ ID NO: 3901141 - RNA, 17 nt, Human adenovirus A
gcggccgcaacagcuau

SEQ ID NO: 3901142 - RNA, 17 nt, Human adenovirus A
gcggccguacaugggca

SEQ ID NO: 3901143 - RNA, 19 nt, Human adenovirus A
gcggccuguuuuguuguau

SEQ ID NO: 3901144 - RNA, 18 nt, Human adenovirus A
gcggcgagaaugggagga

SEQ ID NO: 3901145 - RNA, 14 nt, Human adenovirus A
gcggcgucagcaga

SEQ ID NO: 3901146 - RNA, 20 nt, Human adenovirus A
gcguagccgcagcaccugga

SEQ ID NO: 3901147 - RNA, 14 nt, Human adenovirus A
gcgucccaaaagca

SEQ ID NO: 3901148 - RNA, 22 nt, Human adenovirus A
gcgugaaguauuccaugagccc

SEQ ID NO: 3901149 - RNA, 12 nt, Human adenovirus A
gcgugccuggcu

SEQ ID NO: 3901150 - RNA, 16 nt, Human adenovirus A
gcuaacuuuuuuccca

SEQ ID NO: 3901151 - RNA, 20 nt, Human adenovirus A
gcuaauugcccccuuuacca

SEQ ID NO: 3901152 - RNA, 15 nt, Human adenovirus A
gcuacacgcugccca

SEQ ID NO: 3901153 - RNA, 16 nt, Human adenovirus A
gcuacagauccauguu

SEQ ID NO: 3901154 - RNA, 17 nt, Human adenovirus A
gcuacugcgucucccca

SEQ ID NO: 3901155 - RNA, 21 nt, Human adenovirus A
gcuaugaaucuuuaccaggca

SEQ ID NO: 3901156 - RNA, 21 nt, Human adenovirus A
gcuaugaugcgggcagccagg

SEQ ID NO: 3901157 - RNA, 21 nt, Human adenovirus A
gcucaaaggcaggcauuaccu

SEQ ID NO: 3901158 - RNA, 23 nt, Human adenovirus A
gcuccugguugagcgcuggccag

SEQ ID NO: 3901159 - RNA, 21 nt, Human adenovirus A
gcucgcagcgucugacgcugc

SEQ ID NO: 3901160 - RNA, 16 nt, Human adenovirus A
gcucgcccgggacagu

SEQ ID NO: 3901161 - RNA, 14 nt, Human adenovirus A
gcucuagacaugac

SEQ ID NO: 3901162 - RNA, 18 nt, Human adenovirus A
gcucugucaccuaccacc

SEQ ID NO: 3901163 - RNA, 19 nt, Human adenovirus A
gcucuuuugcagcuccaac

SEQ ID NO: 3901164 - RNA, 13 nt, Human adenovirus A
gcugaaacaggua

SEQ ID NO: 3901165 - RNA, 18 nt, Human adenovirus A
gcugacauaauuuuccca

SEQ ID NO: 3901166 - RNA, 20 nt, Human adenovirus A
gcugacgggagcaggaacag

SEQ ID NO: 3901167 - RNA, 14 nt, Human adenovirus A
gcugaggaaaugcg

SEQ ID NO: 3901168 - RNA, 14 nt, Human adenovirus A
gcugcaaacaugcu

SEQ ID NO: 3901169 - RNA, 19 nt, Human adenovirus A
gcugccgacguugcaagag

SEQ ID NO: 3901170 - RNA, 19 nt, Human adenovirus A
gcugccuccuuugccagaa

SEQ ID NO: 3901171 - RNA, 13 nt, Human adenovirus A
gcuggcuguugcu

SEQ ID NO: 3901172 - RNA, 17 nt, Human adenovirus A
gcuguacaguuucugug

SEQ ID NO: 3901173 - RNA, 21 nt, Human adenovirus A
gcugucucuaccucaaaagcg

SEQ ID NO: 3901174 - RNA, 20 nt, Human adenovirus A
gcugugacacgcaccgcagu

SEQ ID NO: 3901175 - RNA, 23 nt, Human adenovirus A
gcuguggaaagcauuuuggauuu

SEQ ID NO: 3901176 - RNA, 12 nt, Human adenovirus A
gcuuaucaugug

SEQ ID NO: 3901177 - RNA, 14 nt, Human adenovirus A
gcuuaugcauagcu

SEQ ID NO: 3901178 - RNA, 20 nt, Human adenovirus A
gcuuccaugccuuuuuccca

SEQ ID NO: 3901179 - RNA, 16 nt, Human adenovirus A
gcuuggccaguucccc

SEQ ID NO: 3901180 - RNA, 20 nt, Human adenovirus A
gcuuguugaauucgcaggcg

SEQ ID NO: 3901181 - RNA, 17 nt, Human adenovirus A
gcuuucaagauggccac

SEQ ID NO: 3901182 - RNA, 23 nt, Human adenovirus A
gcuuuccaaaugcccccauccag

SEQ ID NO: 3901183 - RNA, 19 nt, Human adenovirus A
gcuuugcgcgaacaucgca

SEQ ID NO: 3901184 - RNA, 15 nt, Human adenovirus A
gcuuuggaggcagcu

SEQ ID NO: 3901185 - RNA, 15 nt, Human adenovirus A
ggaaacaacacggag

SEQ ID NO: 3901186 - RNA, 14 nt, Human adenovirus A
ggaaagacagccaa

SEQ ID NO: 3901187 - RNA, 18 nt, Human adenovirus A
ggaaagccgguuguaagc

SEQ ID NO: 3901188 - RNA, 23 nt, Human adenovirus A
ggaaaucagggcguacagccugg

SEQ ID NO: 3901189 - RNA, 11 nt, Human adenovirus A
ggaaaugaggc

SEQ ID NO: 3901190 - RNA, 19 nt, Human adenovirus A
ggaaauuaauuugcaggcu

SEQ ID NO: 3901191 - RNA, 16 nt, Human adenovirus A
ggaacagacaccgccc

SEQ ID NO: 3901192 - RNA, 21 nt, Human adenovirus A
ggaacagacaccgcccaggca

SEQ ID NO: 3901193 - RNA, 19 nt, Human adenovirus A
ggaacucgagugcaugcau

SEQ ID NO: 3901194 - RNA, 14 nt, Human adenovirus A
ggaagaacauccaa

SEQ ID NO: 3901195 - RNA, 17 nt, Human adenovirus A
ggaagaacauccaacug

SEQ ID NO: 3901196 - RNA, 16 nt, Human adenovirus A
ggaagaauggcuguug

SEQ ID NO: 3901197 - RNA, 17 nt, Human adenovirus A
ggaagcaauaaaacaag

SEQ ID NO: 3901198 - RNA, 15 nt, Human adenovirus A
ggaauaauaguuccc

SEQ ID NO: 3901199 - RNA, 17 nt, Human adenovirus A
ggaauaauuggcuucag

SEQ ID NO: 3901200 - RNA, 16 nt, Human adenovirus A
ggaaugauuaaacaac

SEQ ID NO: 3901201 - RNA, 17 nt, Human adenovirus A
ggaauuuacuccaucug

SEQ ID NO: 3901202 - RNA, 16 nt, Human adenovirus A
ggacaaguugcuuucc

SEQ ID NO: 3901203 - RNA, 15 nt, Human adenovirus A
ggacaguagcugcag

SEQ ID NO: 3901204 - RNA, 13 nt, Human adenovirus A
ggaccauugaagg

SEQ ID NO: 3901205 - RNA, 20 nt, Human adenovirus A
ggacgagcucccggaggaag

SEQ ID NO: 3901206 - RNA, 14 nt, Human adenovirus A
ggacuuggaagaau

SEQ ID NO: 3901207 - RNA, 16 nt, Human adenovirus A
ggagaaggcauagccc

SEQ ID NO: 3901208 - RNA, 12 nt, Human adenovirus A
ggagggucagga

SEQ ID NO: 3901209 - RNA, 19 nt, Human adenovirus A
ggaucuggagccacaggaa

SEQ ID NO: 3901210 - RNA, 19 nt, Human adenovirus A
ggaugaaaaacgagcagca

SEQ ID NO: 3901211 - RNA, 18 nt, Human adenovirus A
ggaugaauuucagcgggg

SEQ ID NO: 3901212 - RNA, 21 nt, Human adenovirus A
ggauuacaugaagauuucugc

SEQ ID NO: 3901213 - RNA, 19 nt, Human adenovirus A
ggauuacaugucaaugcag

SEQ ID NO: 3901214 - RNA, 20 nt, Human adenovirus A
ggauuauaaaaggcuggaag

SEQ ID NO: 3901215 - RNA, 16 nt, Human adenovirus A
ggauuuuuuuguaaaa

SEQ ID NO: 3901216 - RNA, 18 nt, Human adenovirus A
ggcagaauuugugcuacc

SEQ ID NO: 3901217 - RNA, 18 nt, Human adenovirus A
ggcagccguuucaggaag

SEQ ID NO: 3901218 - RNA, 15 nt, Human adenovirus A
ggcaggaguugcagg

SEQ ID NO: 3901219 - RNA, 18 nt, Human adenovirus A
ggccaaacagcuguggaa

SEQ ID NO: 3901220 - RNA, 19 nt, Human adenovirus A
ggccaaacagcuguggaaa

SEQ ID NO: 3901221 - RNA, 14 nt, Human adenovirus A
ggcgcccuccaccg

SEQ ID NO: 3901222 - RNA, 15 nt, Human adenovirus A
ggcgccgcagacggc

SEQ ID NO: 3901223 - RNA, 14 nt, Human adenovirus A
ggcgcucagugcga

SEQ ID NO: 3901224 - RNA, 19 nt, Human adenovirus A
ggcgcuuucgggcucuggc

SEQ ID NO: 3901225 - RNA, 17 nt, Human adenovirus A
ggcggccaugcaaagcc

SEQ ID NO: 3901226 - RNA, 20 nt, Human adenovirus A
ggcggcuccgaacaggugua

SEQ ID NO: 3901227 - RNA, 13 nt, Human adenovirus A
ggcggucugccau

SEQ ID NO: 3901228 - RNA, 22 nt, Human adenovirus A
ggcguuccgucaaaaaagcaaa

SEQ ID NO: 3901229 - RNA, 15 nt, Human adenovirus A
ggcuauugcgcagca

SEQ ID NO: 3901230 - RNA, 17 nt, Human adenovirus A
ggcuauugcgcagcaac

SEQ ID NO: 3901231 - RNA, 12 nt, Human adenovirus A
ggcuccacaccu

SEQ ID NO: 3901232 - RNA, 11 nt, Human adenovirus A
ggcucuuuuaa

SEQ ID NO: 3901233 - RNA, 20 nt, Human adenovirus A
gggcauacgcuugugcagcc

SEQ ID NO: 3901234 - RNA, 17 nt, Human adenovirus A
gggcaucuugcaugaaa

SEQ ID NO: 3901235 - RNA, 21 nt, Human adenovirus A
gggccggaguacgucagaaug

SEQ ID NO: 3901236 - RNA, 22 nt, Human adenovirus A
gggcgcugacgggagcaggaac

SEQ ID NO: 3901237 - RNA, 20 nt, Human adenovirus A
gggcucuggcgaacaggaag

SEQ ID NO: 3901238 - RNA, 18 nt, Human adenovirus A
gggggaugaaggaagcga

SEQ ID NO: 3901239 - RNA, 14 nt, Human adenovirus A
gguaaugagcgcag

SEQ ID NO: 3901240 - RNA, 12 nt, Human adenovirus A
gguauucagcug

SEQ ID NO: 3901241 - RNA, 23 nt, Human adenovirus A
ggucccauccaaguucuaaugca

SEQ ID NO: 3901242 - RNA, 21 nt, Human adenovirus A
ggucgaccuguggcaccugca

SEQ ID NO: 3901243 - RNA, 19 nt, Human adenovirus A
ggucuacuguugaugcagu

SEQ ID NO: 3901244 - RNA, 17 nt, Human adenovirus A
gguucgacgggccaggc

SEQ ID NO: 3901245 - RNA, 17 nt, Human adenovirus A
guaaaccuugaaaugcc

SEQ ID NO: 3901246 - RNA, 21 nt, Human adenovirus A
guaaaccuugaaaugccagac

SEQ ID NO: 3901247 - RNA, 21 nt, Human adenovirus A
guaaaugcuuuguuggauagc

SEQ ID NO: 3901248 - RNA, 10 nt, Human adenovirus A
guaaauuaaa

SEQ ID NO: 3901249 - RNA, 15 nt, Human adenovirus A
guaacccuuccccac

SEQ ID NO: 3901250 - RNA, 19 nt, Human adenovirus A
guaauugaaguaagcuguu

SEQ ID NO: 3901251 - RNA, 23 nt, Human adenovirus A
guacaaggcauuggaaagcagcu

SEQ ID NO: 3901252 - RNA, 15 nt, Human adenovirus A
guacauccagggcac

SEQ ID NO: 3901253 - RNA, 18 nt, Human adenovirus A
guaccgccugaagaagaa

SEQ ID NO: 3901254 - RNA, 17 nt, Human adenovirus A
guacgcagacgaugaca

SEQ ID NO: 3901255 - RNA, 18 nt, Human adenovirus A
guacgcauucaccagcca

SEQ ID NO: 3901256 - RNA, 17 nt, Human adenovirus A
guacucaucagagggaa

SEQ ID NO: 3901257 - RNA, 20 nt, Human adenovirus A
guacugcaaacgcugaugcc

SEQ ID NO: 3901258 - RNA, 18 nt, Human adenovirus A
guacuuguaacuguggaa

SEQ ID NO: 3901259 - RNA, 18 nt, Human adenovirus A
guagacauuguuggccug

SEQ ID NO: 3901260 - RNA, 12 nt, Human adenovirus A
guagacgagguc

SEQ ID NO: 3901261 - RNA, 20 nt, Human adenovirus A
guagaggaaaagcugccacc

SEQ ID NO: 3901262 - RNA, 19 nt, Human adenovirus A
guagcugcaguuugucauu

SEQ ID NO: 3901263 - RNA, 18 nt, Human adenovirus A
guaggaacuccgcgcaag

SEQ ID NO: 3901264 - RNA, 21 nt, Human adenovirus A
guaggauagcaccugccgcca

SEQ ID NO: 3901265 - RNA, 18 nt, Human adenovirus A
guaggcaaguuguggaua

SEQ ID NO: 3901266 - RNA, 18 nt, Human adenovirus A
guauaaauucuuaaacaa

SEQ ID NO: 3901267 - RNA, 17 nt, Human adenovirus A
guaucuguuuggcucua

SEQ ID NO: 3901268 - RNA, 14 nt, Human adenovirus A
guaugcucaaacag

SEQ ID NO: 3901269 - RNA, 13 nt, Human adenovirus A
guaugcugaagaa

SEQ ID NO: 3901270 - RNA, 17 nt, Human adenovirus A
guaugcugaagaaacag

SEQ ID NO: 3901271 - RNA, 14 nt, Human adenovirus A
guauggugccaauc

SEQ ID NO: 3901272 - RNA, 14 nt, Human adenovirus A
gucaaaaaagcaaa

SEQ ID NO: 3901273 - RNA, 14 nt, Human adenovirus A
gucaaaauaaucaa

SEQ ID NO: 3901274 - RNA, 22 nt, Human adenovirus A
gucacuacagacaaacaaguuc

SEQ ID NO: 3901275 - RNA, 14 nt, Human adenovirus A
gucagauucuucuu

SEQ ID NO: 3901276 - RNA, 15 nt, Human adenovirus A
gucagcugcaaaccg

SEQ ID NO: 3901277 - RNA, 19 nt, Human adenovirus A
gucagugaagcaaaccaca

SEQ ID NO: 3901278 - RNA, 23 nt, Human adenovirus A
gucauaccuuaaaaacuguucau

SEQ ID NO: 3901279 - RNA, 20 nt, Human adenovirus A
gucaucguaggacaacuuaa

SEQ ID NO: 3901280 - RNA, 19 nt, Human adenovirus A
guccaauuucguuccagac

SEQ ID NO: 3901281 - RNA, 14 nt, Human adenovirus A
guccccgaaagccg

SEQ ID NO: 3901282 - RNA, 19 nt, Human adenovirus A
gucccgacuuacaggagga

SEQ ID NO: 3901283 - RNA, 23 nt, Human adenovirus A
gucccgcccgcguuuggaaacug

SEQ ID NO: 3901284 - RNA, 21 nt, Human adenovirus A
gucccguaaaauacacauaaa

SEQ ID NO: 3901285 - RNA, 19 nt, Human adenovirus A
guccucagguagugggcac

SEQ ID NO: 3901286 - RNA, 19 nt, Human adenovirus A
guccuccucguacaggaau

SEQ ID NO: 3901287 - RNA, 13 nt, Human adenovirus A
guccuccuucugu

SEQ ID NO: 3901288 - RNA, 14 nt, Human adenovirus A
gucgcaugugaggg

SEQ ID NO: 3901289 - RNA, 20 nt, Human adenovirus A
gucgccagcaagugccuccu

SEQ ID NO: 3901290 - RNA, 22 nt, Human adenovirus A
gucgcgcacugggccaggagga

SEQ ID NO: 3901291 - RNA, 14 nt, Human adenovirus A
gucguuacuuuugc

SEQ ID NO: 3901292 - RNA, 21 nt, Human adenovirus A
gucuacaaaucuuucaaucau

SEQ ID NO: 3901293 - RNA, 21 nt, Human adenovirus A
gucuagccaacauccagugcg

SEQ ID NO: 3901294 - RNA, 14 nt, Human adenovirus A
gucuguugccaauc

SEQ ID NO: 3901295 - RNA, 19 nt, Human adenovirus A
gucuucaagaaaaaccacc

SEQ ID NO: 3901296 - RNA, 13 nt, Human adenovirus A
gucuugcauuaac

SEQ ID NO: 3901297 - RNA, 17 nt, Human adenovirus A
gugaaggcgccaggaug

SEQ ID NO: 3901298 - RNA, 15 nt, Human adenovirus A
gugacacgcaccgca

SEQ ID NO: 3901299 - RNA, 16 nt, Human adenovirus A
gugauggcagcggcgc

SEQ ID NO: 3901300 - RNA, 16 nt, Human adenovirus A
gugccacccccagugc

SEQ ID NO: 3901301 - RNA, 21 nt, Human adenovirus A
gugccccccuccccuguggag

SEQ ID NO: 3901302 - RNA, 21 nt, Human adenovirus A
gugccuaugacccuugagcug

SEQ ID NO: 3901303 - RNA, 17 nt, Human adenovirus A
gugcgcguacgcggaca

SEQ ID NO: 3901304 - RNA, 22 nt, Human adenovirus A
gugcgcuuuaaacugaggcggc

SEQ ID NO: 3901305 - RNA, 20 nt, Human adenovirus A
guggaaaagucacaagggua

SEQ ID NO: 3901306 - RNA, 13 nt, Human adenovirus A
guggaggaauuua

SEQ ID NO: 3901307 - RNA, 18 nt, Human adenovirus A
guggaucuccugccacca

SEQ ID NO: 3901308 - RNA, 15 nt, Human adenovirus A
guggcaacguguucu

SEQ ID NO: 3901309 - RNA, 15 nt, Human adenovirus A
guggcacaacacaua

SEQ ID NO: 3901310 - RNA, 13 nt, Human adenovirus A
gugguucaggaac

SEQ ID NO: 3901311 - RNA, 13 nt, Human adenovirus A
gugguuuggugga

SEQ ID NO: 3901312 - RNA, 18 nt, Human adenovirus A
guguacuugguggacaac

SEQ ID NO: 3901313 - RNA, 13 nt, Human adenovirus A
guguaugccaaca

SEQ ID NO: 3901314 - RNA, 17 nt, Human adenovirus A
guguuaucuucaaauca

SEQ ID NO: 3901315 - RNA, 17 nt, Human adenovirus A
guuaaaaauacagucaa

SEQ ID NO: 3901316 - RNA, 23 nt, Human adenovirus A
guuacuucguugauaucaauguu

SEQ ID NO: 3901317 - RNA, 18 nt, Human adenovirus A
guuagucgcgcacugggc

SEQ ID NO: 3901318 - RNA, 15 nt, Human adenovirus A
guuauccacauugcu

SEQ ID NO: 3901319 - RNA, 19 nt, Human adenovirus A
guucaauaaauacugcucc

SEQ ID NO: 3901320 - RNA, 22 nt, Human adenovirus A
guucacaauuuucugguggugg

SEQ ID NO: 3901321 - RNA, 13 nt, Human adenovirus A
guucagcuucucc

SEQ ID NO: 3901322 - RNA, 13 nt, Human adenovirus A
guuccagaaggag

SEQ ID NO: 3901323 - RNA, 17 nt, Human adenovirus A
guuccagauuguggaau

SEQ ID NO: 3901324 - RNA, 14 nt, Human adenovirus A
guuccaguauuuug

SEQ ID NO: 3901325 - RNA, 14 nt, Human adenovirus A
guuccauggcuucg

SEQ ID NO: 3901326 - RNA, 20 nt, Human adenovirus A
guucgcgauacaacggccag

SEQ ID NO: 3901327 - RNA, 19 nt, Human adenovirus A
guucgcuaguagcauuaaa

SEQ ID NO: 3901328 - RNA, 19 nt, Human adenovirus A
guucucacgacacgucaca

SEQ ID NO: 3901329 - RNA, 16 nt, Human adenovirus A
guugaacccggccaag

SEQ ID NO: 3901330 - RNA, 23 nt, Human adenovirus A
guugaccgaccuucauuuuuucu

SEQ ID NO: 3901331 - RNA, 16 nt, Human adenovirus A
guugggauuacaugcu

SEQ ID NO: 3901332 - RNA, 14 nt, Human adenovirus A
guuucaggaaggau

SEQ ID NO: 3901333 - RNA, 14 nt, Human adenovirus A
guuucuguacugca

SEQ ID NO: 3901334 - RNA, 17 nt, Human adenovirus A
guuugcuaacagcucuc

SEQ ID NO: 3901335 - RNA, 16 nt, Human adenovirus A
guuuuaugcucguaaa

SEQ ID NO: 3901336 - RNA, 19 nt, Human adenovirus A
uaaaaacacacacaaaaca

SEQ ID NO: 3901337 - RNA, 21 nt, Human adenovirus A
uaaaaaccaucuuacauacca

SEQ ID NO: 3901338 - RNA, 17 nt, Human adenovirus A
uaaaaaggaagcaggug

SEQ ID NO: 3901339 - RNA, 19 nt, Human adenovirus A
uaaaaaggaagcaggugau

SEQ ID NO: 3901340 - RNA, 16 nt, Human adenovirus A
uaaaaaucacaaaaua

SEQ ID NO: 3901341 - RNA, 20 nt, Human adenovirus A
uaaaagcgugcgcaguguuc

SEQ ID NO: 3901342 - RNA, 13 nt, Human adenovirus A
uaaacugucugua

SEQ ID NO: 3901343 - RNA, 21 nt, Human adenovirus A
uaaagaaaaaacuuaaauuga

SEQ ID NO: 3901344 - RNA, 11 nt, Human adenovirus A
uaaagaaacuc

SEQ ID NO: 3901345 - RNA, 23 nt, Human adenovirus A
uaaagcaaaccacugcaaugcag

SEQ ID NO: 3901346 - RNA, 21 nt, Human adenovirus A
uaaagcgcagaguauccacac

SEQ ID NO: 3901347 - RNA, 19 nt, Human adenovirus A
uaaaggguuagaacuuucu

SEQ ID NO: 3901348 - RNA, 15 nt, Human adenovirus A
uaaauaucgcagcug

SEQ ID NO: 3901349 - RNA, 18 nt, Human adenovirus A
uaacaaaauucgcaggag

SEQ ID NO: 3901350 - RNA, 24 nt, Human adenovirus A
uaacaacagucaguguccaucagc

SEQ ID NO: 3901351 - RNA, 22 nt, Human adenovirus A
uaacaaccucccgauaccaaaa

SEQ ID NO: 3901352 - RNA, 15 nt, Human adenovirus A
uaacaggugaaagug

SEQ ID NO: 3901353 - RNA, 18 nt, Human adenovirus A
uaacaguugaaaaaggaa

SEQ ID NO: 3901354 - RNA, 22 nt, Human adenovirus A
uaacauguuauuuaaaauucca

SEQ ID NO: 3901355 - RNA, 17 nt, Human adenovirus A
uaacauuuguguagagu

SEQ ID NO: 3901356 - RNA, 22 nt, Human adenovirus A
uaaccacgguuccacggugcac

SEQ ID NO: 3901357 - RNA, 18 nt, Human adenovirus A
uaaccagagcaccccuuc

SEQ ID NO: 3901358 - RNA, 16 nt, Human adenovirus A
uaaccagcugggcaga

SEQ ID NO: 3901359 - RNA, 18 nt, Human adenovirus A
uaaccauuguaaaugcuu

SEQ ID NO: 3901360 - RNA, 15 nt, Human adenovirus A
gcugcauugccacua

SEQ ID NO: 3901361 - RNA, 22 nt, Human adenovirus A
gcugccaccucuagaaacugug

SEQ ID NO: 3901362 - RNA, 23 nt, Human adenovirus A
gcugcccugauauaucaggaaaa

SEQ ID NO: 3901363 - RNA, 14 nt, Human adenovirus A
gcugcucagcucca

SEQ ID NO: 3901364 - RNA, 23 nt, Human adenovirus A
gcuggcgcuuccauaccugggau

SEQ ID NO: 3901365 - RNA, 16 nt, Human adenovirus A
gcugggcucgaggacc

SEQ ID NO: 3901366 - RNA, 23 nt, Human adenovirus A
gcuguacgcaaacucagcccaug

SEQ ID NO: 3901367 - RNA, 19 nt, Human adenovirus A
gcugugagcaaaucucaga

SEQ ID NO: 3901368 - RNA, 19 nt, Human adenovirus A
gcuuaauaccuuugcucag

SEQ ID NO: 3901369 - RNA, 17 nt, Human adenovirus A
gcuuaguauuugucucc

SEQ ID NO: 3901370 - RNA, 21 nt, Human adenovirus A
gcuuauguacauaauccagca

SEQ ID NO: 3901371 - RNA, 20 nt, Human adenovirus A
gcuucagguguuaucuucaa

SEQ ID NO: 3901372 - RNA, 18 nt, Human adenovirus A
gcuuccaugccuuuuucc

SEQ ID NO: 3901373 - RNA, 22 nt, Human adenovirus A
gcuucuacaacgagcaagccgu

SEQ ID NO: 3901374 - RNA, 20 nt, Human adenovirus A
gcuucuacaaucacuuggcu

SEQ ID NO: 3901375 - RNA, 12 nt, Human adenovirus A
gcuucuccagac

SEQ ID NO: 3901376 - RNA, 13 nt, Human adenovirus A
gcuucuugcuuua

SEQ ID NO: 3901377 - RNA, 18 nt, Human adenovirus A
gcuugagcgcguggcacg

SEQ ID NO: 3901378 - RNA, 23 nt, Human adenovirus A
gcuuucgagggguucucuuucaa

SEQ ID NO: 3901379 - RNA, 14 nt, Human adenovirus A
gcuuugcucgagac

SEQ ID NO: 3901380 - RNA, 18 nt, Human adenovirus A
ggaaagcauuuuggauuu

SEQ ID NO: 3901381 - RNA, 21 nt, Human adenovirus A
ggaaauuguguacuuuucaaa

SEQ ID NO: 3901382 - RNA, 14 nt, Human adenovirus A
ggaacaacaggugc

SEQ ID NO: 3901383 - RNA, 13 nt, Human adenovirus A
ggaacuauuucuu

SEQ ID NO: 3901384 - RNA, 20 nt, Human adenovirus A
ggagacgggccgcagcugcg

SEQ ID NO: 3901385 - RNA, 14 nt, Human adenovirus A
ggagacguuuuugc

SEQ ID NO: 3901386 - RNA, 20 nt, Human adenovirus A
ggagcgccccccuagcagua

SEQ ID NO: 3901387 - RNA, 23 nt, Human adenovirus A
ggagcggaacccugcgguggugg

SEQ ID NO: 3901388 - RNA, 14 nt, Human adenovirus A
ggagcuaaaacaag

SEQ ID NO: 3901389 - RNA, 17 nt, Human adenovirus A
ggaggaagcugaggaaa

SEQ ID NO: 3901390 - RNA, 23 nt, Human adenovirus A
ggaggacuuugagccagaugaac

SEQ ID NO: 3901391 - RNA, 21 nt, Human adenovirus A
ggaggucuccaugucccgcac

SEQ ID NO: 3901392 - RNA, 13 nt, Human adenovirus A
ggagguggcugga

SEQ ID NO: 3901393 - RNA, 20 nt, Human adenovirus A
ggaguuggaagaaggagaag

SEQ ID NO: 3901394 - RNA, 19 nt, Human adenovirus A
ggauggguguuuggcagca

SEQ ID NO: 3901395 - RNA, 18 nt, Human adenovirus A
ggcaagccaacggcacau

SEQ ID NO: 3901396 - RNA, 13 nt, Human adenovirus A
ggcacgagccagc

SEQ ID NO: 3901397 - RNA, 14 nt, Human adenovirus A
ggcagccaggcggg

SEQ ID NO: 3901398 - RNA, 22 nt, Human adenovirus A
ggcaggaaaucugggaggaaga

SEQ ID NO: 3901399 - RNA, 14 nt, Human adenovirus A
ggcaucuugcauga

SEQ ID NO: 3901400 - RNA, 14 nt, Human adenovirus A
ggcgacuacccggc

SEQ ID NO: 3901401 - RNA, 20 nt, Human adenovirus A
ggcgagaaugggaggaaaga

SEQ ID NO: 3901402 - RNA, 18 nt, Human adenovirus A
ggcgaucaucgcggagag

SEQ ID NO: 3901403 - RNA, 17 nt, Human adenovirus A
ggcgcccuccaccgcca

SEQ ID NO: 3901404 - RNA, 19 nt, Human adenovirus A
ggcgcgcgaguuaagaaaa

SEQ ID NO: 3901405 - RNA, 16 nt, Human adenovirus A
gugaauguguuccagu

SEQ ID NO: 3901406 - RNA, 20 nt, Human adenovirus A
gugacaaugcccgccuggca

SEQ ID NO: 3901407 - RNA, 15 nt, Human adenovirus A
gugcaaaacuuucua

SEQ ID NO: 3901408 - RNA, 17 nt, Human adenovirus A
gugccccucgaccugca

SEQ ID NO: 3901409 - RNA, 17 nt, Human adenovirus A
gugcuuccguagccuug

SEQ ID NO: 3901410 - RNA, 13 nt, Human adenovirus A
guggagccacugc

SEQ ID NO: 3901411 - RNA, 13 nt, Human adenovirus A
gugguauuggaac

SEQ ID NO: 3901412 - RNA, 12 nt, Human adenovirus A
guggucaggaag

SEQ ID NO: 3901413 - RNA, 14 nt, Human adenovirus A
gugguugggaacag

SEQ ID NO: 3901414 - RNA, 17 nt, Human adenovirus A
guguaaacacuaccggc

SEQ ID NO: 3901415 - RNA, 14 nt, Human adenovirus A
guguacacaaugca

SEQ ID NO: 3901416 - RNA, 18 nt, Human adenovirus A
gugucuucucccugugcu

SEQ ID NO: 3901417 - RNA, 13 nt, Human adenovirus A
gugugacugcccc

SEQ ID NO: 3901418 - RNA, 17 nt, Human adenovirus A
guguuaaccauuguaaa

SEQ ID NO: 3901419 - RNA, 15 nt, Human adenovirus A
guuaagcaguagaaa

SEQ ID NO: 3901420 - RNA, 14 nt, Human adenovirus A
guuacgacccugac

SEQ ID NO: 3901421 - RNA, 20 nt, Human adenovirus A
guuagccugaaaaauaaaaa

SEQ ID NO: 3901422 - RNA, 21 nt, Human adenovirus A
guuaucuaguuugguagcaaa

SEQ ID NO: 3901423 - RNA, 15 nt, Human adenovirus A
guuaucuucaaauca

SEQ ID NO: 3901424 - RNA, 17 nt, Human adenovirus A
guuaucuugguaggcaa

SEQ ID NO: 3901425 - RNA, 16 nt, Human adenovirus A
guuauguaugcccagc

SEQ ID NO: 3901426 - RNA, 23 nt, Human adenovirus A
guucaacaacagcuucuaaaaga

SEQ ID NO: 3901427 - RNA, 17 nt, Human adenovirus A
guucaauaguggcugca

SEQ ID NO: 3901428 - RNA, 16 nt, Human adenovirus A
guucacuuacccgcag

SEQ ID NO: 3901429 - RNA, 20 nt, Human adenovirus A
guucacuuacccgcagcugu

SEQ ID NO: 3901430 - RNA, 18 nt, Human adenovirus A
guuccaguauuuuguaaa

SEQ ID NO: 3901431 - RNA, 11 nt, Human adenovirus A
guucccacagu

SEQ ID NO: 3901432 - RNA, 22 nt, Human adenovirus A
guugcuuugaauaguucaucuu

SEQ ID NO: 3901433 - RNA, 23 nt, Human adenovirus A
guugguucgacgggccaggcgca

SEQ ID NO: 3901434 - RNA, 20 nt, Human adenovirus A
guuuaaaucuuucugcuccc

SEQ ID NO: 3901435 - RNA, 18 nt, Human adenovirus A
guuuacaaagcacugggc

SEQ ID NO: 3901436 - RNA, 14 nt, Human adenovirus A
guuuagaaacccca

SEQ ID NO: 3901437 - RNA, 12 nt, Human adenovirus A
guuuccagugcg

SEQ ID NO: 3901438 - RNA, 20 nt, Human adenovirus A
guuuuggcuuaagguggaaa

SEQ ID NO: 3901439 - RNA, 22 nt, Human adenovirus A
uaaaaacuguucauauugugag

SEQ ID NO: 3901440 - RNA, 18 nt, Human adenovirus A
uaaaaccuacacaugaag

SEQ ID NO: 3901441 - RNA, 16 nt, Human adenovirus A
uaaaacuaccugauaa

SEQ ID NO: 3901442 - RNA, 16 nt, Human adenovirus A
uaaaacuuccaacuua

SEQ ID NO: 3901443 - RNA, 19 nt, Human adenovirus A
uaaaagagccacagcucug

SEQ ID NO: 3901444 - RNA, 21 nt, Human adenovirus A
uaaagacuccggaaacaacac

SEQ ID NO: 3901445 - RNA, 23 nt, Human adenovirus A
uaaagcgcagaguauccacacag

SEQ ID NO: 3901446 - RNA, 20 nt, Human adenovirus A
uaaagcuuuugcuaaauugg

SEQ ID NO: 3901447 - RNA, 17 nt, Human adenovirus A
caagccuaccugacacu

SEQ ID NO: 3901448 - RNA, 16 nt, Human adenovirus A
caagcgaacaggagcu

SEQ ID NO: 3901449 - RNA, 21 nt, Human adenovirus A
caagcggcauuccccauccaa

SEQ ID NO: 3901450 - RNA, 16 nt, Human adenovirus A
caagcuacccuucgcu

SEQ ID NO: 3901451 - RNA, 19 nt, Human adenovirus A
caagcuuaccccgccaacu

SEQ ID NO: 3901452 - RNA, 21 nt, Human adenovirus A
caagcuuucauugguccaggc

SEQ ID NO: 3901453 - RNA, 21 nt, Human adenovirus A
caaggauuugaaugcguaaau

SEQ ID NO: 3901454 - RNA, 17 nt, Human adenovirus A
caaggcauuggaaagca

SEQ ID NO: 3901455 - RNA, 16 nt, Human adenovirus A
caaggcguggaacagc

SEQ ID NO: 3901456 - RNA, 17 nt, Human adenovirus A
caaggucaacuuacagc

SEQ ID NO: 3901457 - RNA, 18 nt, Human adenovirus A
caaguaacaacacgggcu

SEQ ID NO: 3901458 - RNA, 16 nt, Human adenovirus A
caaguguaauuuucca

SEQ ID NO: 3901459 - RNA, 13 nt, Human adenovirus A
caaguuaaaagac

SEQ ID NO: 3901460 - RNA, 15 nt, Human adenovirus A
caauaaaaaaaacag

SEQ ID NO: 3901461 - RNA, 12 nt, Human adenovirus A
caauaaaacaag

SEQ ID NO: 3901462 - RNA, 14 nt, Human adenovirus A
caauaaaacaagga

SEQ ID NO: 3901463 - RNA, 19 nt, Human adenovirus A
caauaaaacaaggagccgc

SEQ ID NO: 3901464 - RNA, 15 nt, Human adenovirus A
caauaaauacugcuc

SEQ ID NO: 3901465 - RNA, 20 nt, Human adenovirus A
caauaacuacaaacaguuuc

SEQ ID NO: 3901466 - RNA, 23 nt, Human adenovirus A
caauauugagguuacucacuuug

SEQ ID NO: 3901467 - RNA, 21 nt, Human adenovirus A
caaucagugucuaccaauacu

SEQ ID NO: 3901468 - RNA, 15 nt, Human adenovirus A
caaucuacaaacugg

SEQ ID NO: 3901469 - RNA, 16 nt, Human adenovirus A
caaugacaaugaauaa

SEQ ID NO: 3901470 - RNA, 15 nt, Human adenovirus A
caaugcagcaaacac

SEQ ID NO: 3901471 - RNA, 20 nt, Human adenovirus A
caaugcauuaauaauaaaac

SEQ ID NO: 3901472 - RNA, 11 nt, Human adenovirus A
caaugggagau

SEQ ID NO: 3901473 - RNA, 11 nt, Human adenovirus A
caauguaacuu

SEQ ID NO: 3901474 - RNA, 19 nt, Human adenovirus A
caauguaacuucagccacu

SEQ ID NO: 3901475 - RNA, 14 nt, Human adenovirus A
caauuaguaacaag

SEQ ID NO: 3901476 - RNA, 14 nt, Human adenovirus A
caauuucugccauu

SEQ ID NO: 3901477 - RNA, 19 nt, Human adenovirus A
cacaacacauacauacacu

SEQ ID NO: 3901478 - RNA, 12 nt, Human adenovirus A
cacacaaaacac

SEQ ID NO: 3901479 - RNA, 13 nt, Human adenovirus A
cacacgcagcaac

SEQ ID NO: 3901480 - RNA, 16 nt, Human adenovirus A
cacacuuaacacaaga

SEQ ID NO: 3901481 - RNA, 20 nt, Human adenovirus A
cacagccccuagccguagac

SEQ ID NO: 3901482 - RNA, 21 nt, Human adenovirus A
cacagcuuauucgccagucaa

SEQ ID NO: 3901483 - RNA, 19 nt, Human adenovirus A
cacauauucgcgugccagg

SEQ ID NO: 3901484 - RNA, 17 nt, Human adenovirus A
cacaucgccggucagga

SEQ ID NO: 3901485 - RNA, 22 nt, Human adenovirus A
cacaugcgggggaugaaggaag

SEQ ID NO: 3901486 - RNA, 13 nt, Human adenovirus A
cacaugggaaggg

SEQ ID NO: 3901487 - RNA, 22 nt, Human adenovirus A
cacauugcaacgcaaucagaau

SEQ ID NO: 3901488 - RNA, 20 nt, Human adenovirus A
caccaucuucaucuuuucua

SEQ ID NO: 3901489 - RNA, 18 nt, Human adenovirus A
cacccaaucaaauuacac

SEQ ID NO: 3901490 - RNA, 22 nt, Human adenovirus A
cacccugugcuuaacaaaaaac

SEQ ID NO: 3901491 - RNA, 16 nt, Human adenovirus A
cacccuuaauugcagg

SEQ ID NO: 3901492 - RNA, 18 nt, Human adenovirus A
cacccuuaauugcagggg

SEQ ID NO: 3901493 - RNA, 18 nt, Human adenovirus A
caccgcccaggcaggcgc

SEQ ID NO: 3901494 - RNA, 17 nt, Human adenovirus A
caccgcgcugcggccau

SEQ ID NO: 3901495 - RNA, 20 nt, Human adenovirus A
caccuuuuaccuaaaccaca

SEQ ID NO: 3901496 - RNA, 22 nt, Human adenovirus A
caccuuuuguuaauuaaggcgc

SEQ ID NO: 3901497 - RNA, 19 nt, Human adenovirus A
cacgccgcgccccacuucc

SEQ ID NO: 3901498 - RNA, 18 nt, Human adenovirus A
cacggaguaaugaacaag

SEQ ID NO: 3901499 - RNA, 14 nt, Human adenovirus A
cacggcacgcggcc

SEQ ID NO: 3901500 - RNA, 15 nt, Human adenovirus A
cacggccucagcagc

SEQ ID NO: 3901501 - RNA, 19 nt, Human adenovirus A
cacgggacccugccgcugc

SEQ ID NO: 3901502 - RNA, 21 nt, Human adenovirus A
cacuacccguuccgcaagcac

SEQ ID NO: 3901503 - RNA, 17 nt, Human adenovirus A
cacucagcgacaaaccu

SEQ ID NO: 3901504 - RNA, 18 nt, Human adenovirus A
cacugaaaaaccaacaaa

SEQ ID NO: 3901505 - RNA, 14 nt, Human adenovirus A
cacugcaaugcagc

SEQ ID NO: 3901506 - RNA, 18 nt, Human adenovirus A
cacugcuuugcucgagac

SEQ ID NO: 3901507 - RNA, 17 nt, Human adenovirus A
cacuggcgaugacgaug

SEQ ID NO: 3901508 - RNA, 13 nt, Human adenovirus A
cacugggccagga

SEQ ID NO: 3901509 - RNA, 22 nt, Human adenovirus A
cacugggccaggaggacacugg

SEQ ID NO: 3901510 - RNA, 21 nt, Human adenovirus A
cacugguuaucgcaccucguc

SEQ ID NO: 3901511 - RNA, 18 nt, Human adenovirus A
cacuuaagucuuuacaau

SEQ ID NO: 3901512 - RNA, 18 nt, Human adenovirus A
cacuuacccgcagcuguc

SEQ ID NO: 3901513 - RNA, 16 nt, Human adenovirus A
cacuuaugcucccaca

SEQ ID NO: 3901514 - RNA, 16 nt, Human adenovirus A
cacuucuugcugaaau

SEQ ID NO: 3901515 - RNA, 21 nt, Human adenovirus A
cagaaaaacaguacaaagcca

SEQ ID NO: 3901516 - RNA, 18 nt, Human adenovirus A
cagaacauacaacuugca

SEQ ID NO: 3901517 - RNA, 21 nt, Human adenovirus A
cagaacccaguaugcugaaga

SEQ ID NO: 3901518 - RNA, 15 nt, Human adenovirus A
cagaagccagcagca

SEQ ID NO: 3901519 - RNA, 19 nt, Human adenovirus A
cagaauauaagaacuacaa

SEQ ID NO: 3901520 - RNA, 17 nt, Human adenovirus A
cagaauuugugcuaccc

SEQ ID NO: 3901521 - RNA, 18 nt, Human adenovirus A
cagacgacuuaaaauaca

SEQ ID NO: 3901522 - RNA, 18 nt, Human adenovirus A
cagacgcaugaagggugg

SEQ ID NO: 3901523 - RNA, 16 nt, Human adenovirus A
cagagagaaaagcaug

SEQ ID NO: 3901524 - RNA, 23 nt, Human adenovirus A
cagagcguugguucgacgggcca

SEQ ID NO: 3901525 - RNA, 18 nt, Human adenovirus A
cagaggaggaggaggaag

SEQ ID NO: 3901526 - RNA, 23 nt, Human adenovirus A
cagagggaaagguauucagcuga

SEQ ID NO: 3901527 - RNA, 20 nt, Human adenovirus A
cagagucgaggucaagaaca

SEQ ID NO: 3901528 - RNA, 20 nt, Human adenovirus A
cagaguugcuuuuagauguc

SEQ ID NO: 3901529 - RNA, 18 nt, Human adenovirus A
cagaugacuggacagcgg

SEQ ID NO: 3901530 - RNA, 12 nt, Human adenovirus A
cagauuuugugc

SEQ ID NO: 3901531 - RNA, 14 nt, Human adenovirus A
cagcaagcagcgcc

SEQ ID NO: 3901532 - RNA, 17 nt, Human adenovirus A
caaaguaugcugcacaa

SEQ ID NO: 3901533 - RNA, 15 nt, Human adenovirus A
caaauagagcaaacu

SEQ ID NO: 3901534 - RNA, 18 nt, Human adenovirus A
caaauagagcaaacuaca

SEQ ID NO: 3901535 - RNA, 12 nt, Human adenovirus A
caaauagcucuu

SEQ ID NO: 3901536 - RNA, 19 nt, Human adenovirus A
caaauauuuacuaugauuu

SEQ ID NO: 3901537 - RNA, 16 nt, Human adenovirus A
caaaucagaagccagc

SEQ ID NO: 3901538 - RNA, 15 nt, Human adenovirus A
caaauuuaaggccag

SEQ ID NO: 3901539 - RNA, 17 nt, Human adenovirus A
caaauuuaaggccaggg

SEQ ID NO: 3901540 - RNA, 12 nt, Human adenovirus A
caacaaggaaag

SEQ ID NO: 3901541 - RNA, 21 nt, Human adenovirus A
caacacuacgcgaugaagcac

SEQ ID NO: 3901542 - RNA, 17 nt, Human adenovirus A
caacagaaaguuguaga

SEQ ID NO: 3901543 - RNA, 13 nt, Human adenovirus A
caacagcacagga

SEQ ID NO: 3901544 - RNA, 17 nt, Human adenovirus A
caacagcuauugcaaac

SEQ ID NO: 3901545 - RNA, 21 nt, Human adenovirus A
caacagcuucuaaaagagcca

SEQ ID NO: 3901546 - RNA, 14 nt, Human adenovirus A
caacaguacaggca

SEQ ID NO: 3901547 - RNA, 15 nt, Human adenovirus A
caacagucagugucc

SEQ ID NO: 3901548 - RNA, 18 nt, Human adenovirus A
caacauaacaacucagga

SEQ ID NO: 3901549 - RNA, 15 nt, Human adenovirus A
caaccaaaggagaaa

SEQ ID NO: 3901550 - RNA, 11 nt, Human adenovirus A
caacccuuccc

SEQ ID NO: 3901551 - RNA, 18 nt, Human adenovirus A
caaccucacugcuuugcu

SEQ ID NO: 3901552 - RNA, 15 nt, Human adenovirus A
caacgcuuugcuuga

SEQ ID NO: 3901553 - RNA, 20 nt, Human adenovirus A
caacguuaaaaauacaguca

SEQ ID NO: 3901554 - RNA, 23 nt, Human adenovirus A
caacuaaaaauuguuuuuguucu

SEQ ID NO: 3901555 - RNA, 15 nt, Human adenovirus A
caacugauauuagua

SEQ ID NO: 3901556 - RNA, 16 nt, Human adenovirus A
caacuuaacccucccu

SEQ ID NO: 3901557 - RNA, 14 nt, Human adenovirus A
caacuuacagcuag

SEQ ID NO: 3901558 - RNA, 15 nt, Human adenovirus A
caacuuuauugccuu

SEQ ID NO: 3901559 - RNA, 17 nt, Human adenovirus A
caagacguuccauggcu

SEQ ID NO: 3901560 - RNA, 14 nt, Human adenovirus A
caagaggagaagga

SEQ ID NO: 3901561 - RNA, 18 nt, Human adenovirus B (HAdV-B)
gaaugaaaauaaacuuug

SEQ ID NO: 3901562 - RNA, 22 nt, Human adenovirus B (HAdV-B)
gaauugagaauggcaacaucaa

SEQ ID NO: 3901563 - RNA, 20 nt, Human adenovirus B (HAdV-B)
gaauugcaaggccccagcag

SEQ ID NO: 3901564 - RNA, 14 nt, Human adenovirus B (HAdV-B)
gacaguuuggagga

SEQ ID NO: 3901565 - RNA, 15 nt, Human adenovirus B (HAdV-B)
gaccagaacuuccaa

SEQ ID NO: 3901566 - RNA, 12 nt, Human adenovirus B (HAdV-B)
gacccaggccau

SEQ ID NO: 3901567 - RNA, 10 nt, Human adenovirus B (HAdV-B)
gaccucccca

SEQ ID NO: 3901568 - RNA, 19 nt, Human adenovirus B (HAdV-B)
gacgaggaaaaggagcaga

SEQ ID NO: 3901569 - RNA, 20 nt, Human adenovirus B (HAdV-B)
gacguuaugugccuuuccac

SEQ ID NO: 3901570 - RNA, 15 nt, Human adenovirus B (HAdV-B)
gacucgggccgcaaa

SEQ ID NO: 3901571 - RNA, 14 nt, Human adenovirus B (HAdV-B)
gacuuggaagaggg

SEQ ID NO: 3901572 - RNA, 12 nt, Human adenovirus B (HAdV-B)
gagaauuacuuc

SEQ ID NO: 3901573 - RNA, 21 nt, Human adenovirus B (HAdV-B)
gagacucgggccgcaaaugcu

SEQ ID NO: 3901574 - RNA, 21 nt, Human adenovirus B (HAdV-B)
gagaugcgagcuucccgcuuu

SEQ ID NO: 3901575 - RNA, 15 nt, Human adenovirus B (HAdV-B)
gagcaguaucuggag

SEQ ID NO: 3901576 - RNA, 23 nt, Human adenovirus B (HAdV-B)
gagcuuccuuacauagaagaggc

SEQ ID NO: 3901577 - RNA, 14 nt, Human adenovirus B (HAdV-B)
gaggauuugcaugu

SEQ ID NO: 3901578 - RNA, 21 nt, Human adenovirus B (HAdV-B)
gaggucccaguuucaaacccu

SEQ ID NO: 3901579 - RNA, 14 nt, Human adenovirus B (HAdV-B)
gaguacuuggaaga

SEQ ID NO: 3901580 - RNA, 14 nt, Human adenovirus B (HAdV-B)
gauaugugcagcag

SEQ ID NO: 3901581 - RNA, 19 nt, Human adenovirus B (HAdV-B)
gaucuaccgccagugcugu

SEQ ID NO: 3901582 - RNA, 20 nt, Human adenovirus B (HAdV-B)
gaucucuacagcuaaaagug

SEQ ID NO: 3901583 - RNA, 15 nt, Human adenovirus B (HAdV-B)
gaucuucgagggucu

SEQ ID NO: 3901584 - RNA, 21 nt, Human adenovirus B (HAdV-B)
gaugaaguuucuguauugcag

SEQ ID NO: 3901585 - RNA, 17 nt, Human adenovirus B (HAdV-B)
gaugacuggcagaaccc

SEQ ID NO: 3901586 - RNA, 18 nt, Human adenovirus B (HAdV-B)
gaugagcgaaacccagau

SEQ ID NO: 3901587 - RNA, 17 nt, Human adenovirus B (HAdV-B)
gaugauugggagguggc

SEQ ID NO: 3901588 - RNA, 21 nt, Human adenovirus B (HAdV-B)
gaugcauuauuggacagaacu

SEQ ID NO: 3901589 - RNA, 17 nt, Human adenovirus B (HAdV-B)
gaugccuuuuccagaau

SEQ ID NO: 3901590 - RNA, 23 nt, Human adenovirus B (HAdV-B)
gaugggcguccagcgcugccagg

SEQ ID NO: 3901591 - RNA, 14 nt, Human adenovirus B (HAdV-B)
gcaaaaauaaaaaa

SEQ ID NO: 3901592 - RNA, 16 nt, Human adenovirus B (HAdV-B)
gcaaaacaaugacuuu

SEQ ID NO: 3901593 - RNA, 19 nt, Human adenovirus B (HAdV-B)
gcaaugcugaacgggguca

SEQ ID NO: 3901594 - RNA, 17 nt, Human adenovirus B (HAdV-B)
gcaccgacucucccagg

SEQ ID NO: 3901595 - RNA, 16 nt, Human adenovirus B (HAdV-B)
gcagacaguaaaggaa

SEQ ID NO: 3901596 - RNA, 22 nt, Human adenovirus B (HAdV-B)
gcagcagcuccuuuagccagag

SEQ ID NO: 3901597 - RNA, 18 nt, Human adenovirus B (HAdV-B)
gcagcuccuuuagccaga

SEQ ID NO: 3901598 - RNA, 16 nt, Human adenovirus B (HAdV-B)
gcaggcgccucccagg

SEQ ID NO: 3901599 - RNA, 13 nt, Human adenovirus B (HAdV-B)
gcaguggcagccu

SEQ ID NO: 3901600 - RNA, 16 nt, Human adenovirus B (HAdV-B)
gcaguuuaccaugagu

SEQ ID NO: 3901601 - RNA, 22 nt, Human adenovirus B (HAdV-B)
gcauccgcgaguucaacugaaa

SEQ ID NO: 3901602 - RNA, 19 nt, Human adenovirus B (HAdV-B)
gcauuguggagaacaugga

SEQ ID NO: 3901603 - RNA, 11 nt, Human adenovirus B (HAdV-B)
gccacuugaau

SEQ ID NO: 3901604 - RNA, 17 nt, Human adenovirus B (HAdV-B)
gccagacucgcaguacu

SEQ ID NO: 3901605 - RNA, 12 nt, Human adenovirus B (HAdV-B)
gccagaggguca

SEQ ID NO: 3901606 - RNA, 20 nt, Human adenovirus B (HAdV-B)
gcccaucaguguggaagagc

SEQ ID NO: 3901607 - RNA, 23 nt, Human adenovirus B (HAdV-B)
gccgccaagaucccgucuugggu

SEQ ID NO: 3901608 - RNA, 20 nt, Human adenovirus B (HAdV-B)
gccugacuuuaugagccaga

SEQ ID NO: 3901609 - RNA, 20 nt, Human adenovirus B (HAdV-B)
gccuggacccuccaguggag

SEQ ID NO: 3901610 - RNA, 17 nt, Human adenovirus B (HAdV-B)
gcgacaucggcacgagc

SEQ ID NO: 3901611 - RNA, 21 nt, Human adenovirus B (HAdV-B)
gcgaguuugcuuauggcaagc

SEQ ID NO: 3901612 - RNA, 14 nt, Human adenovirus B (HAdV-B)
gcgcgcgcagucau

SEQ ID NO: 3901613 - RNA, 22 nt, Human adenovirus B (HAdV-B)
gcggcccuggcagaacacacuc

SEQ ID NO: 3901614 - RNA, 11 nt, Human adenovirus B (HAdV-B)
gcucagccgcg

SEQ ID NO: 3901615 - RNA, 23 nt, Human adenovirus B (HAdV-B)
gcucgaaaacugguuagcugcac

SEQ ID NO: 3901616 - RNA, 15 nt, Human adenovirus B (HAdV-B)
gcugcaaaaguucua

SEQ ID NO: 3901617 - RNA, 13 nt, Human adenovirus B (HAdV-B)
gcugcacagcacc

SEQ ID NO: 3901618 - RNA, 19 nt, Human adenovirus B (HAdV-B)
gcugccaccggucaacgug

SEQ ID NO: 3901619 - RNA, 16 nt, Human adenovirus B (HAdV-B)
gcugcugcuguggcuu

SEQ ID NO: 3901620 - RNA, 22 nt, Human adenovirus B (HAdV-B)
gcuggacuacuugcacagagcu

SEQ ID NO: 3901621 - RNA, 16 nt, Human adenovirus B (HAdV-B)
gcugucucaaccccag

SEQ ID NO: 3901622 - RNA, 13 nt, Human adenovirus B (HAdV-B)
gcuuauugcuugu

SEQ ID NO: 3901623 - RNA, 16 nt, Human adenovirus B (HAdV-B)
ggaaucauguccaccu

SEQ ID NO: 3901624 - RNA, 22 nt, Human adenovirus B (HAdV-B)
ggaauuuuugacaugaacaugc

SEQ ID NO: 3901625 - RNA, 17 nt, Human adenovirus B (HAdV-B)
ggacaaagcgugcugca

SEQ ID NO: 3901626 - RNA, 20 nt, Human adenovirus B (HAdV-B)
ggacugccccauggcauggg

SEQ ID NO: 3901627 - RNA, 12 nt, Human adenovirus B (HAdV-B)
ggagugcaugcc

SEQ ID NO: 3901628 - RNA, 12 nt, Human adenovirus B (HAdV-B)
ggauacaaagua

SEQ ID NO: 3901629 - RNA, 17 nt, Human adenovirus B (HAdV-B)
ggauacguuuuggauuu

SEQ ID NO: 3901630 - RNA, 14 nt, Human adenovirus B (HAdV-B)
ggauugccacagcu

SEQ ID NO: 3901631 - RNA, 20 nt, Human adenovirus B (HAdV-B)
ggcaacuccgacugcagcac

SEQ ID NO: 3901632 - RNA, 21 nt, Human adenovirus B (HAdV-B)
ggcaacuccgacugcagcacu

SEQ ID NO: 3901633 - RNA, 18 nt, Human adenovirus B (HAdV-B)
aguuggugcgauuggguu

SEQ ID NO: 3901634 - RNA, 19 nt, Human adenovirus B (HAdV-B)
auaaaaaaaaaaacaagcg

SEQ ID NO: 3901635 - RNA, 17 nt, Human adenovirus B (HAdV-B)
auaaaaauccaucggga

SEQ ID NO: 3901636 - RNA, 16 nt, Human adenovirus B (HAdV-B)
auaguaucacaaucug

SEQ ID NO: 3901637 - RNA, 18 nt, Human adenovirus B (HAdV-B)
auauaaucuguugcacca

SEQ ID NO: 3901638 - RNA, 20 nt, Human adenovirus B (HAdV-B)
auauagcuuccuuggaagag

SEQ ID NO: 3901639 - RNA, 14 nt, Human adenovirus B (HAdV-B)
auaugugcagcaga

SEQ ID NO: 3901640 - RNA, 16 nt, Human adenovirus B (HAdV-B)
auauguggccuggggu

SEQ ID NO: 3901641 - RNA, 17 nt, Human adenovirus B (HAdV-B)
aucaccaacuugggaac

SEQ ID NO: 3901642 - RNA, 23 nt, Human adenovirus B (HAdV-B)
aucauagauaauuacuugaaagu

SEQ ID NO: 3901643 - RNA, 17 nt, Human adenovirus B (HAdV-B)
aucauguccaccugggg

SEQ ID NO: 3901644 - RNA, 13 nt, Human adenovirus B (HAdV-B)
auccccacuggag

SEQ ID NO: 3901645 - RNA, 19 nt, Human adenovirus B (HAdV-B)
aucccggcagucucgacag

SEQ ID NO: 3901646 - RNA, 15 nt, Human adenovirus B (HAdV-B)
auccgguggggccau

SEQ ID NO: 3901647 - RNA, 17 nt, Human adenovirus B (HAdV-B)
aucgaaguugcuggaaa

SEQ ID NO: 3901648 - RNA, 18 nt, Human adenovirus B (HAdV-B)
aucgaaguugcuggaaau

SEQ ID NO: 3901649 - RNA, 18 nt, Human adenovirus B (HAdV-B)
aucuaacguggaacucac

SEQ ID NO: 3901650 - RNA, 18 nt, Human adenovirus B (HAdV-B)
aucuguggaguucuuauu

SEQ ID NO: 3901651 - RNA, 22 nt, Human adenovirus B (HAdV-B)
augacuuuaccccuacggaagc

SEQ ID NO: 3901652 - RNA, 18 nt, Human adenovirus B (HAdV-B)
augcaugcaggugggcgu

SEQ ID NO: 3901653 - RNA, 16 nt, Human adenovirus B (HAdV-B)
augccuggaguguaua

SEQ ID NO: 3901654 - RNA, 17 nt, Human adenovirus B (HAdV-B)
augccuuaccaguguaa

SEQ ID NO: 3901655 - RNA, 16 nt, Human adenovirus B (HAdV-B)
augccuuucaugaggu

SEQ ID NO: 3901656 - RNA, 22 nt, Human adenovirus B (HAdV-B)
augcucaggaucacagagacga

SEQ ID NO: 3901657 - RNA, 16 nt, Human adenovirus B (HAdV-B)
augcuuuuauaugcuu

SEQ ID NO: 3901658 - RNA, 20 nt, Human adenovirus B (HAdV-B)
augugcauauuaacaaucug

SEQ ID NO: 3901659 - RNA, 13 nt, Human adenovirus B (HAdV-B)
auuaccaccccua

SEQ ID NO: 3901660 - RNA, 20 nt, Human adenovirus B (HAdV-B)
auucaaccugagguuaaagu

SEQ ID NO: 3901661 - RNA, 19 nt, Human adenovirus B (HAdV-B)
auugucucugaagaaaugc

SEQ ID NO: 3901662 - RNA, 16 nt, Human adenovirus B (HAdV-B)
auuguuucugaugcaa

SEQ ID NO: 3901663 - RNA, 16 nt, Human adenovirus B (HAdV-B)
auuuccacuucaacaa

SEQ ID NO: 3901664 - RNA, 18 nt, Human adenovirus B (HAdV-B)
auuucugugggacgacgu

SEQ ID NO: 3901665 - RNA, 18 nt, Human adenovirus B (HAdV-B)
auuugccaaaaaaacauu

SEQ ID NO: 3901666 - RNA, 22 nt, Human adenovirus B (HAdV-B)
auuugugggauuugauggaagc

SEQ ID NO: 3901667 - RNA, 14 nt, Human adenovirus B (HAdV-B)
auuuugccuccccc

SEQ ID NO: 3901668 - RNA, 22 nt, Human adenovirus B (HAdV-B)
caaaguaaaaggcacaggagaa

SEQ ID NO: 3901669 - RNA, 19 nt, Human adenovirus B (HAdV-B)
caacgaauuuucucccagc

SEQ ID NO: 3901670 - RNA, 20 nt, Human adenovirus B (HAdV-B)
caacgaauuuucucccagcg

SEQ ID NO: 3901671 - RNA, 17 nt, Human adenovirus B (HAdV-B)
caacuucacauacaaca

SEQ ID NO: 3901672 - RNA, 22 nt, Human adenovirus B (HAdV-B)
caagcggguuaaaaaggacaaa

SEQ ID NO: 3901673 - RNA, 20 nt, Human adenovirus B (HAdV-B)
caagcguaguagaauaacuu

SEQ ID NO: 3901674 - RNA, 22 nt, Human adenovirus B (HAdV-B)
caagcucuuacagaaaucucuu

SEQ ID NO: 3901675 - RNA, 15 nt, Human adenovirus B (HAdV-B)
caaggccccagcagc

SEQ ID NO: 3901676 - RNA, 12 nt, Human adenovirus B (HAdV-B)
caauccccacug

SEQ ID NO: 3901677 - RNA, 15 nt, Human adenovirus B (HAdV-B)
caaucgcgaagaggc

SEQ ID NO: 3901678 - RNA, 22 nt, Human adenovirus B (HAdV-B)
cacacguggcugcagccaaccu

SEQ ID NO: 3901679 - RNA, 20 nt, Human adenovirus B (HAdV-B)
caccaccucuacccuagaag

SEQ ID NO: 3901680 - RNA, 15 nt, Human adenovirus B (HAdV-B)
caccguuucuggggc

SEQ ID NO: 3901681 - RNA, 17 nt, Human adenovirus B (HAdV-B)
caccuuaaucccagaaa

SEQ ID NO: 3901682 - RNA, 23 nt, Human adenovirus B (HAdV-B)
cacggcuuugugcggcaggcaug

SEQ ID NO: 3901683 - RNA, 17 nt, Human adenovirus B (HAdV-B)
cacuagucacugcauuu

SEQ ID NO: 3901684 - RNA, 13 nt, Human adenovirus B (HAdV-B)
cacuugugcuggu

SEQ ID NO: 3901685 - RNA, 22 nt, Human adenovirus B (HAdV-B)
cagaacuugaaagagcuugaca

SEQ ID NO: 3901686 - RNA, 23 nt, Human adenovirus B (HAdV-B)
cagaagacaugcaugacccagau

SEQ ID NO: 3901687 - RNA, 14 nt, Human adenovirus B (HAdV-B)
cagaaguuggagga

SEQ ID NO: 3901688 - RNA, 13 nt, Human adenovirus B (HAdV-B)
cagacaugaugaa

SEQ ID NO: 3901689 - RNA, 15 nt, Human adenovirus B (HAdV-B)
cagagacgagccugg

SEQ ID NO: 3901690 - RNA, 14 nt, Human adenovirus B (HAdV-B)
cagaggcuggucau

SEQ ID NO: 3901691 - RNA, 23 nt, Human adenovirus B (HAdV-B)
cagcagcggcaguuagaaaauac

SEQ ID NO: 3901692 - RNA, 21 nt, Human adenovirus B (HAdV-B)
cagcauucguuauucggaacu

SEQ ID NO: 3901693 - RNA, 13 nt, Human adenovirus B (HAdV-B)
cagccaugcauug

SEQ ID NO: 3901694 - RNA, 16 nt, Human adenovirus B (HAdV-B)
aguuggaggauuggcu

SEQ ID NO: 3901695 - RNA, 13 nt, Human adenovirus B (HAdV-B)
auauguggccugg

SEQ ID NO: 3901696 - RNA, 14 nt, Human adenovirus B (HAdV-B)
auauuagauaaaug

SEQ ID NO: 3901697 - RNA, 22 nt, Human adenovirus B (HAdV-B)
aucaagaaauuacccaagucag

SEQ ID NO: 3901698 - RNA, 18 nt, Human adenovirus B (HAdV-B)
aucaccaagaugcuggaa

SEQ ID NO: 3901699 - RNA, 15 nt, Human adenovirus B (HAdV-B)
aucaugcccacaucc

SEQ ID NO: 3901700 - RNA, 18 nt, Human adenovirus B (HAdV-B)
aucauggggauuacaagu

SEQ ID NO: 3901701 - RNA, 21 nt, Human adenovirus B (HAdV-B)
aucggauucuuaacagugcag

SEQ ID NO: 3901702 - RNA, 17 nt, Human adenovirus B (HAdV-B)
aucuaacguggaacuca

SEQ ID NO: 3901703 - RNA, 20 nt, Human adenovirus B (HAdV-B)
aucuagaccacugccgccgc

SEQ ID NO: 3901704 - RNA, 22 nt, Human adenovirus B (HAdV-B)
aucucuccuaccacucggaugu

SEQ ID NO: 3901705 - RNA, 18 nt, Human adenovirus B (HAdV-B)
aucugcuccuucugaauc

SEQ ID NO: 3901706 - RNA, 14 nt, Human adenovirus B (HAdV-B)
augacuggcagaac

SEQ ID NO: 3901707 - RNA, 17 nt, Human adenovirus B (HAdV-B)
augaucuggacuuggaa

SEQ ID NO: 3901708 - RNA, 21 nt, Human adenovirus B (HAdV-B)
augccagcgguucuggaggag

SEQ ID NO: 3901709 - RNA, 17 nt, Human adenovirus B (HAdV-B)
augucauaaccugguug

SEQ ID NO: 3901710 - RNA, 12 nt, Human adenovirus B (HAdV-B)
augugauuggcu

SEQ ID NO: 3901711 - RNA, 12 nt, Human adenovirus B (HAdV-B)
auguggccuggg

SEQ ID NO: 3901712 - RNA, 21 nt, Human adenovirus B (HAdV-B)
auguugaaaugggcaugaggu

SEQ ID NO: 3901713 - RNA, 12 nt, Human adenovirus B (HAdV-B)
auucacuggaac

SEQ ID NO: 3901714 - RNA, 19 nt, Human adenovirus B (HAdV-B)
auuccacauuccaaacagu

SEQ ID NO: 3901715 - RNA, 21 nt, Human adenovirus B (HAdV-B)
auuccagucuccugccgcgcu

SEQ ID NO: 3901716 - RNA, 17 nt, Human adenovirus B (HAdV-B)
auugccggcugcgggag

SEQ ID NO: 3901717 - RNA, 14 nt, Human adenovirus B (HAdV-B)
auugucaaguuugg

SEQ ID NO: 3901718 - RNA, 19 nt, Human adenovirus B (HAdV-B)
auuguugaucaccugggca

SEQ ID NO: 3901719 - RNA, 17 nt, Human adenovirus B (HAdV-B)
auuuccauuccuucucg

SEQ ID NO: 3901720 - RNA, 23 nt, Human adenovirus B (HAdV-B)
caaagcuauucguccagaugagg

SEQ ID NO: 3901721 - RNA, 22 nt, Human adenovirus B (HAdV-B)
caaaugcucugcaaaagggaga

SEQ ID NO: 3901722 - RNA, 18 nt, Human adenovirus B (HAdV-B)
caacaauaccuguguaga

SEQ ID NO: 3901723 - RNA, 22 nt, Human adenovirus B (HAdV-B)
caaccacaggcggaucucuaca

SEQ ID NO: 3901724 - RNA, 19 nt, Human adenovirus B (HAdV-B)
caacgugacagcaaaugac

SEQ ID NO: 3901725 - RNA, 14 nt, Human adenovirus B (HAdV-B)
caaguguuucuuga

SEQ ID NO: 3901726 - RNA, 15 nt, Human adenovirus B (HAdV-B)
caaucaccacacgau

SEQ ID NO: 3901727 - RNA, 17 nt, Human adenovirus B (HAdV-B)
caauccccacuggaggc

SEQ ID NO: 3901728 - RNA, 16 nt, Human adenovirus B (HAdV-B)
caaucugggaccuggu

SEQ ID NO: 3901729 - RNA, 20 nt, Human adenovirus B (HAdV-B)
caaugaggcuuucagagagg

SEQ ID NO: 3901730 - RNA, 23 nt, Human adenovirus B (HAdV-B)
cacaacccccacuacucccugcu

SEQ ID NO: 3901731 - RNA, 18 nt, Human adenovirus B (HAdV-B)
cacacugguggccaccuc

SEQ ID NO: 3901732 - RNA, 17 nt, Human adenovirus B (HAdV-B)
cacagcuuucuggucag

SEQ ID NO: 3901733 - RNA, 16 nt, Human adenovirus B (HAdV-B)
cacagggucuccagcu

SEQ ID NO: 3901734 - RNA, 21 nt, Human adenovirus B (HAdV-B)
cacccgcaugaauuggcucag

SEQ ID NO: 3901735 - RNA, 16 nt, Human adenovirus B (HAdV-B)
caccgacucucccagg

SEQ ID NO: 3901736 - RNA, 18 nt, Human adenovirus B (HAdV-B)
cacuaugcaacugauggu

SEQ ID NO: 3901737 - RNA, 21 nt, Human adenovirus B (HAdV-B)
cacuuagaagauacugagcag

SEQ ID NO: 3901738 - RNA, 20 nt, Human adenovirus B (HAdV-B)
cacuugaauucgggaaucac

SEQ ID NO: 3901739 - RNA, 16 nt, Human adenovirus B (HAdV-B)
cagaacccuacuagca

SEQ ID NO: 3901740 - RNA, 14 nt, Human adenovirus B (HAdV-B)
cagaaguacuggcu

SEQ ID NO: 3901741 - RNA, 18 nt, Human adenovirus B (HAdV-B)
cagaaguacuggcuaccu

SEQ ID NO: 3901742 - RNA, 18 nt, Human adenovirus B (HAdV-B)
cagaauggagugcuugaa

SEQ ID NO: 3901743 - RNA, 19 nt, Human adenovirus B (HAdV-B)
cagacgguaaaucugagcc

SEQ ID NO: 3901744 - RNA, 23 nt, Human adenovirus B (HAdV-B)
cagagcuuaagcauuccaccgcc

SEQ ID NO: 3901745 - RNA, 21 nt, Human adenovirus B (HAdV-B)
cagaggcauacaugccacaga

SEQ ID NO: 3901746 - RNA, 14 nt, Human adenovirus B (HAdV-B)
cagaggugcaaacc

SEQ ID NO: 3901747 - RNA, 22 nt, Human adenovirus B (HAdV-B)
cagagucggggucaagagcagg

SEQ ID NO: 3901748 - RNA, 14 nt, Human adenovirus B (HAdV-B)
cagauacuggaugu

SEQ ID NO: 3901749 - RNA, 22 nt, Human adenovirus B (HAdV-B)
cagcaccgaaaguuccucgcgg

SEQ ID NO: 3901750 - RNA, 17 nt, Human adenovirus B (HAdV-B)
cagcacuggacaugaca

SEQ ID NO: 3901751 - RNA, 15 nt, Human adenovirus B (HAdV-B)
cagcagacacaucac

SEQ ID NO: 3901752 - RNA, 14 nt, Human adenovirus B (HAdV-B)
cagcagcagcaggc

SEQ ID NO: 3901753 - RNA, 16 nt, Human adenovirus B (HAdV-B)
cagccaacgagccagc

SEQ ID NO: 3901754 - RNA, 17 nt, Human adenovirus B (HAdV-B)
cagcgugaugccaaccu

SEQ ID NO: 3901755 - RNA, 23 nt, Human adenovirus B (HAdV-B)
caggagaaauauucacuggaaca

SEQ ID NO: 3901756 - RNA, 21 nt, Human adenovirus B (HAdV-B)
caggcgacggcggugaugcaa

SEQ ID NO: 3901757 - RNA, 14 nt, Human adenovirus B (HAdV-B)
caggcuguccgugu

SEQ ID NO: 3901758 - RNA, 18 nt, Human adenovirus B (HAdV-B)
caguaacuacccuguggu

SEQ ID NO: 3901759 - RNA, 19 nt, Human adenovirus B (HAdV-B)
caguaacuuuuguaaaugu

SEQ ID NO: 3901760 - RNA, 16 nt, Human adenovirus B (HAdV-B)
caguagaugggacgag

SEQ ID NO: 3901761 - RNA, 12 nt, Human adenovirus B (HAdV-B)
caguggacggcu

SEQ ID NO: 3901762 - RNA, 15 nt, Human adenovirus B (HAdV-B)
cauagugcaggagcg

SEQ ID NO: 3901763 - RNA, 17 nt, Human adenovirus B (HAdV-B)
caucaguuaacgagaaa

SEQ ID NO: 3901764 - RNA, 15 nt, Human adenovirus B (HAdV-B)
caucgccggacagga

SEQ ID NO: 3901765 - RNA, 23 nt, Human adenovirus B (HAdV-B)
caugaacaugcaaaucuggaaga

SEQ ID NO: 3901766 - RNA, 15 nt, Human adenovirus B (HAdV-B)
caugacagacagagg

SEQ ID NO: 3901767 - RNA, 23 nt, Human adenovirus B (HAdV-B)
caugauggauauguggccugggg

SEQ ID NO: 3901768 - RNA, 22 nt, Human adenovirus B (HAdV-B)
cauguugguuggagccugagga

SEQ ID NO: 3901769 - RNA, 16 nt, Human adenovirus B (HAdV-B)
cauuaacuuugaugaa

SEQ ID NO: 3901770 - RNA, 15 nt, Human adenovirus B (HAdV-B)
cauuacccggacgag

SEQ ID NO: 3901771 - RNA, 23 nt, Human adenovirus B (HAdV-B)
cauuagggguguguuggacagag

SEQ ID NO: 3901772 - RNA, 14 nt, Human adenovirus B (HAdV-B)
ccaaacggaguucu

SEQ ID NO: 3901773 - RNA, 19 nt, Human adenovirus B (HAdV-B)
ccaaacuuauauugcaugg

SEQ ID NO: 3901774 - RNA, 15 nt, Human adenovirus B (HAdV-B)
ccacaacccccacua

SEQ ID NO: 3901775 - RNA, 23 nt, Human adenovirus B (HAdV-B)
ccacaacccccacuacucccugc

SEQ ID NO: 3901776 - RNA, 16 nt, Human adenovirus B (HAdV-B)
ccacaacgcacagccu

SEQ ID NO: 3901777 - RNA, 14 nt, Human adenovirus B (HAdV-B)
ccacacgauccaca

SEQ ID NO: 3901778 - RNA, 14 nt, Human adenovirus B (HAdV-B)
ccaccaccucuacc

SEQ ID NO: 3901779 - RNA, 16 nt, Human adenovirus B (HAdV-B)
ccagacgccaccgagc

SEQ ID NO: 3901780 - RNA, 14 nt, Human adenovirus B (HAdV-B)
ccagacgccgcacc

SEQ ID NO: 3901781 - RNA, 20 nt, Human adenovirus B (HAdV-B)
ccagggcacacguggcugca

SEQ ID NO: 3901782 - RNA, 14 nt, Human adenovirus B (HAdV-B)
ccaguuggaggauu

SEQ ID NO: 3901783 - RNA, 19 nt, Human adenovirus B (HAdV-B)
cccaacaacagccccccuc

SEQ ID NO: 3901784 - RNA, 17 nt, Human adenovirus B (HAdV-B)
cccaauuggcuccagca

SEQ ID NO: 3901785 - RNA, 17 nt, Human adenovirus B (HAdV-B)
cccaggacuacuccacc

SEQ ID NO: 3901786 - RNA, 14 nt, Human adenovirus B (HAdV-B)
cccccaaauuuaau

SEQ ID NO: 3901787 - RNA, 22 nt, Human adenovirus B (HAdV-B)
ccccuucuccggaucuccuggg

SEQ ID NO: 3901788 - RNA, 17 nt, Human adenovirus B (HAdV-B)
ccgauccaugcuucugg

SEQ ID NO: 3901789 - RNA, 14 nt, Human adenovirus B (HAdV-B)
ccgcaggaccugcu

SEQ ID NO: 3901790 - RNA, 21 nt, Human adenovirus B (HAdV-B)
ccgcccuaguguaccaggaaa

SEQ ID NO: 3901791 - RNA, 23 nt, Human adenovirus B (HAdV-B)
ccgcguucgggggugugcucccu

SEQ ID NO: 3901792 - RNA, 21 nt, Human adenovirus B (HAdV-B)
ccggauuuuacaaccagaaga

SEQ ID NO: 3901793 - RNA, 21 nt, Human adenovirus B (HAdV-B)
ccggccuggacccuccagugg

SEQ ID NO: 3901794 - RNA, 21 nt, Human adenovirus B (HAdV-B)
ccgguauaucgggcaggaugu

SEQ ID NO: 3901795 - RNA, 18 nt, Human adenovirus B (HAdV-B)
ccggucacuuugcagcaa

SEQ ID NO: 3901796 - RNA, 14 nt, Human adenovirus B (HAdV-B)
uuggaacagcagua

SEQ ID NO: 3901797 - RNA, 18 nt, Human adenovirus B (HAdV-B)
uuggauggaaaagcgugg

SEQ ID NO: 3901798 - RNA, 17 nt, Human adenovirus B (HAdV-B)
uuggcaauauugccgcc

SEQ ID NO: 3901799 - RNA, 13 nt, Human adenovirus B (HAdV-B)
uuggcuccagcaa

SEQ ID NO: 3901800 - RNA, 16 nt, Human adenovirus B (HAdV-B)
uugggacagucaggca

SEQ ID NO: 3901801 - RNA, 20 nt, Human adenovirus B (HAdV-B)
aaaaauuucccaaacaaugg

SEQ ID NO: 3901802 - RNA, 18 nt, Human adenovirus B (HAdV-B)
aaacccaacacacacccc

SEQ ID NO: 3901803 - RNA, 20 nt, Human adenovirus B (HAdV-B)
aaagaauguaucauucccug

SEQ ID NO: 3901804 - RNA, 18 nt, Human adenovirus B (HAdV-B)
aaaggcgcgcguccaggc

SEQ ID NO: 3901805 - RNA, 21 nt, Human adenovirus B (HAdV-B)
aaaugggauuggcggcaggcg

SEQ ID NO: 3901806 - RNA, 21 nt, Human adenovirus B (HAdV-B)
aaauguuuaaccccacuaaca

SEQ ID NO: 3901807 - RNA, 19 nt, Human adenovirus B (HAdV-B)
aacaccguuucuggggcgg

SEQ ID NO: 3901808 - RNA, 22 nt, Human adenovirus B (HAdV-B)
aacaggaauuuuugacaugaac

SEQ ID NO: 3901809 - RNA, 16 nt, Human adenovirus B (HAdV-B)
aaccaggggguccacc

SEQ ID NO: 3901810 - RNA, 22 nt, Human adenovirus B (HAdV-B)
aaccgucuaucggccaucaugg

SEQ ID NO: 3901811 - RNA, 11 nt, Human adenovirus B (HAdV-B)
aaccugacccc

SEQ ID NO: 3901812 - RNA, 19 nt, Human adenovirus B (HAdV-B)
aacugaauuaagacucucc

SEQ ID NO: 3901813 - RNA, 16 nt, Human adenovirus B (HAdV-B)
aacugcuuagccagaa

SEQ ID NO: 3901814 - RNA, 22 nt, Human adenovirus B (HAdV-B)
aacuggauuuccugccaccagu

SEQ ID NO: 3901815 - RNA, 23 nt, Human adenovirus B (HAdV-B)
aacuuauauugcaugguuguagc

SEQ ID NO: 3901816 - RNA, 13 nt, Human adenovirus B (HAdV-B)
aagaggcggauga

SEQ ID NO: 3901817 - RNA, 15 nt, Human adenovirus B (HAdV-B)
aagcaacgaagcuug

SEQ ID NO: 3901818 - RNA, 20 nt, Human adenovirus B (HAdV-B)
aagcucuaaagugacucucc

SEQ ID NO: 3901819 - RNA, 18 nt, Human adenovirus B (HAdV-B)
aaggcgcauugccagacg

SEQ ID NO: 3901820 - RNA, 14 nt, Human adenovirus B (HAdV-B)
aaggcuacaacgua

SEQ ID NO: 3901821 - RNA, 23 nt, Human adenovirus B (HAdV-B)
aagggagaaaauggcauggauga

SEQ ID NO: 3901822 - RNA, 18 nt, Human adenovirus B (HAdV-B)
aaguccuggcgggggcau

SEQ ID NO: 3901823 - RNA, 18 nt, Human adenovirus B (HAdV-B)
aagugccaccacaccacu

SEQ ID NO: 3901824 - RNA, 18 nt, Human adenovirus B (HAdV-B)
aaguuuaaaacugacccc

SEQ ID NO: 3901825 - RNA, 16 nt, Human adenovirus B (HAdV-B)
aauaauucuacaacuu

SEQ ID NO: 3901826 - RNA, 21 nt, Human adenovirus B (HAdV-B)
aauacauacucuuacaaagug

SEQ ID NO: 3901827 - RNA, 17 nt, Human adenovirus B (HAdV-B)
aauccaauccacacauu

SEQ ID NO: 3901828 - RNA, 16 nt, Human adenovirus B (HAdV-B)
ugauuaaacaacagca

SEQ ID NO: 3901829 - RNA, 20 nt, Human adenovirus B (HAdV-B)
ugcaacgaauuuucucccag

SEQ ID NO: 3901830 - RNA, 21 nt, Human adenovirus B (HAdV-B)
ugcaacgaauuuucucccagc

SEQ ID NO: 3901831 - RNA, 17 nt, Human adenovirus B (HAdV-B)
ugcagcagcagcaggcg

SEQ ID NO: 3901832 - RNA, 18 nt, Human adenovirus B (HAdV-B)
ugcagccaugaggccaca

SEQ ID NO: 3901833 - RNA, 19 nt, Human adenovirus B (HAdV-B)
ugcaggagcggagccuggg

SEQ ID NO: 3901834 - RNA, 16 nt, Human adenovirus B (HAdV-B)
ugcaggcacuucagcu

SEQ ID NO: 3901835 - RNA, 14 nt, Human adenovirus B (HAdV-B)
ugcaguggcagccu

SEQ ID NO: 3901836 - RNA, 16 nt, Human adenovirus B (HAdV-B)
ugcauuauuggacaga

SEQ ID NO: 3901837 - RNA, 15 nt, Human adenovirus B (HAdV-B)
ugccaagauagcuuu

SEQ ID NO: 3901838 - RNA, 22 nt, Human adenovirus B (HAdV-B)
ugccagcacggugggaucugca

SEQ ID NO: 3901839 - RNA, 14 nt, Human adenovirus B (HAdV-B)
ugccccccgccgcu

SEQ ID NO: 3901840 - RNA, 16 nt, Human adenovirus B (HAdV-B)
ugccuaugagaacagu

SEQ ID NO: 3901841 - RNA, 19 nt, Human adenovirus B (HAdV-B)
ugccuuaccaguguaacau

SEQ ID NO: 3901842 - RNA, 23 nt, Human adenovirus B (HAdV-B)
ugcgccugcuugggcgcuugcca

SEQ ID NO: 3901843 - RNA, 15 nt, Human adenovirus B (HAdV-B)
ugcuaaagguuucau

SEQ ID NO: 3901844 - RNA, 14 nt, Human adenovirus B (HAdV-B)
ugcuauuccaccau

SEQ ID NO: 3901845 - RNA, 18 nt, Human adenovirus B (HAdV-B)
ugcuuaaccgaagagcaa

SEQ ID NO: 3901846 - RNA, 12 nt, Human adenovirus B (HAdV-B)
ugcuugaaagug

SEQ ID NO: 3901847 - RNA, 20 nt, Human adenovirus B (HAdV-B)
uggaagacugauggcacaac

SEQ ID NO: 3901848 - RNA, 22 nt, Human adenovirus B (HAdV-B)
uggaagucuacccguuucuugu

SEQ ID NO: 3901849 - RNA, 15 nt, Human adenovirus B (HAdV-B)
uggaaugcucccaau

SEQ ID NO: 3901850 - RNA, 17 nt, Human adenovirus B (HAdV-B)
uggaggaggaacagcaa

SEQ ID NO: 3901851 - RNA, 12 nt, Human adenovirus B (HAdV-B)
uggcaaugcuga

SEQ ID NO: 3901852 - RNA, 20 nt, Human adenovirus B (HAdV-B)
uggcagcaauguuuagaaga

SEQ ID NO: 3901853 - RNA, 21 nt, Human adenovirus B (HAdV-B)
uggccauuguguucuccuagg

SEQ ID NO: 3901854 - RNA, 15 nt, Human adenovirus B (HAdV-B)
ugggacaggaagaca

SEQ ID NO: 3901855 - RNA, 21 nt, Human adenovirus B (HAdV-B)
ugggacaggaagacacuggca

SEQ ID NO: 3901856 - RNA, 11 nt, Human adenovirus B (HAdV-B)
ugggaccuggu

SEQ ID NO: 3901857 - RNA, 20 nt, Human adenovirus B (HAdV-B)
ugggauuguuucugaugcaa

SEQ ID NO: 3901858 - RNA, 16 nt, Human adenovirus B (HAdV-B)
ugggucuucuccuggg

SEQ ID NO: 3901859 - RNA, 17 nt, Human adenovirus B (HAdV-B)
ugguguugcacaauauc

SEQ ID NO: 3901860 - RNA, 16 nt, Human adenovirus B (HAdV-B)
uguuacauaucuggaa

SEQ ID NO: 3901861 - RNA, 21 nt, Human adenovirus B (HAdV-B)
uguuggacagaggucccaguu

SEQ ID NO: 3901862 - RNA, 20 nt, Human adenovirus B (HAdV-B)
uuacugugcguaugcauaca

SEQ ID NO: 3901863 - RNA, 19 nt, Human adenovirus B (HAdV-B)
uuauaauggaauaguguuu

SEQ ID NO: 3901864 - RNA, 14 nt, Human adenovirus B (HAdV-B)
uucacucaaaucuu

SEQ ID NO: 3901865 - RNA, 13 nt, Human adenovirus B (HAdV-B)
uucacuuccgcaa

SEQ ID NO: 3901866 - RNA, 22 nt, Human adenovirus B (HAdV-B)
uuccacccuugaagccaugcug

SEQ ID NO: 3901867 - RNA, 19 nt, Human adenovirus B (HAdV-B)
uuccagccuugaauuauuc

SEQ ID NO: 3901868 - RNA, 21 nt, Human adenovirus B (HAdV-B)
uucccgaacccaaccagcgcu

SEQ ID NO: 3901869 - RNA, 16 nt, Human adenovirus B (HAdV-B)
uucgugcaggugagga

SEQ ID NO: 3901870 - RNA, 16 nt, Human adenovirus B (HAdV-B)
uucucuagcagcagug

SEQ ID NO: 3901871 - RNA, 13 nt, Human adenovirus B (HAdV-B)
uugaaacgcuuuc

SEQ ID NO: 3901872 - RNA, 18 nt, Human adenovirus B (HAdV-B)
uugcagcacugaaacacc

SEQ ID NO: 3901873 - RNA, 18 nt, Human adenovirus B (HAdV-B)
uugcuccugugucaccug

SEQ ID NO: 3901874 - RNA, 13 nt, Human adenovirus B (HAdV-B)
uugcuucccuacg

SEQ ID NO: 3901875 - RNA, 11 nt, Human adenovirus B (HAdV-B)
uuggaggagga

SEQ ID NO: 3901876 - RNA, 19 nt, Human adenovirus B (HAdV-B)
uugggcgcuugccagggug

SEQ ID NO: 3901877 - RNA, 18 nt, Human adenovirus B (HAdV-B)
uuugaagcucuuaauuug

SEQ ID NO: 3901878 - RNA, 16 nt, Human adenovirus B (HAdV-B)
uuuggaccgaagacga

SEQ ID NO: 3901879 - RNA, 23 nt, Human adenovirus B (HAdV-B)
uuuggggucuggauuugaccccu

SEQ ID NO: 3901880 - RNA, 14 nt, Human adenovirus B (HAdV-B)
cuagaccacugccg

SEQ ID NO: 3901881 - RNA, 17 nt, Human adenovirus B (HAdV-B)
cuagagagagaggauga

SEQ ID NO: 3901882 - RNA, 16 nt, Human adenovirus B (HAdV-B)
cuaggcggagcggugg

SEQ ID NO: 3901883 - RNA, 14 nt, Human adenovirus B (HAdV-B)
cuagucacugcauu

SEQ ID NO: 3901884 - RNA, 18 nt, Human adenovirus B (HAdV-B)
cuagugaucgcacugcuu

SEQ ID NO: 3901885 - RNA, 21 nt, Human adenovirus B (HAdV-B)
cucaaugcuucuuuugccauc

SEQ ID NO: 3901886 - RNA, 15 nt, Human adenovirus B (HAdV-B)
cuccacagccccuac

SEQ ID NO: 3901887 - RNA, 16 nt, Human adenovirus B (HAdV-B)
cucccaagcagacacc

SEQ ID NO: 3901888 - RNA, 17 nt, Human adenovirus B (HAdV-B)
cucccgacggugcugca

SEQ ID NO: 3901889 - RNA, 15 nt, Human adenovirus B (HAdV-B)
acuacuuucaaaacc

SEQ ID NO: 3901890 - RNA, 17 nt, Human adenovirus B (HAdV-B)
acucaagcgaagcaucg

SEQ ID NO: 3901891 - RNA, 11 nt, Human adenovirus B (HAdV-B)
acugcuggacu

SEQ ID NO: 3901892 - RNA, 14 nt, Human adenovirus B (HAdV-B)
acuuacuugaaauc

SEQ ID NO: 3901893 - RNA, 13 nt, Human adenovirus B (HAdV-B)
acuuauauugcau

SEQ ID NO: 3901894 - RNA, 22 nt, Human adenovirus B (HAdV-B)
acuuuuaagaagguuuccauca

SEQ ID NO: 3901895 - RNA, 18 nt, Human adenovirus B (HAdV-B)
agaaaauggcauggauga

SEQ ID NO: 3901896 - RNA, 16 nt, Human adenovirus B (HAdV-B)
agaacagaacuugaaa

SEQ ID NO: 3901897 - RNA, 15 nt, Human adenovirus B (HAdV-B)
agaacaguaaagcug

SEQ ID NO: 3901898 - RNA, 22 nt, Human adenovirus B (HAdV-B)
agaagaggcggaugaaggcgag

SEQ ID NO: 3901899 - RNA, 14 nt, Human adenovirus B (HAdV-B)
agaauuucuacuga

SEQ ID NO: 3901900 - RNA, 14 nt, Human adenovirus B (HAdV-B)
agacacggcuuugu

SEQ ID NO: 3901901 - RNA, 23 nt, Human adenovirus B (HAdV-B)
agacagucgcucauagucaagga

SEQ ID NO: 3901902 - RNA, 12 nt, Human adenovirus B (HAdV-B)
agacauggaaac

SEQ ID NO: 3901903 - RNA, 19 nt, Human adenovirus B (HAdV-B)
agacgaugggcguccagcg

SEQ ID NO: 3901904 - RNA, 16 nt, Human adenovirus B (HAdV-B)
agauaauuacuugaaa

SEQ ID NO: 3901905 - RNA, 13 nt, Human adenovirus B (HAdV-B)
agaucggacaggg

SEQ ID NO: 3901906 - RNA, 22 nt, Human adenovirus B (HAdV-B)
agcaggggacgcuacagugcag

SEQ ID NO: 3901907 - RNA, 19 nt, Human adenovirus B (HAdV-B)
agccaaucaccacacgauc

SEQ ID NO: 3901908 - RNA, 17 nt, Human adenovirus B (HAdV-B)
agcggagacggcuugcu

SEQ ID NO: 3901909 - RNA, 19 nt, Human adenovirus B (HAdV-B)
agcucauaggagcuggcuu

SEQ ID NO: 3901910 - RNA, 16 nt, Human adenovirus B (HAdV-B)
agcugcugcagaagcu

SEQ ID NO: 3901911 - RNA, 17 nt, Human adenovirus B (HAdV-B)
aggacagucuggaggac

SEQ ID NO: 3901912 - RNA, 21 nt, Human adenovirus B (HAdV-B)
aggacguuuuggagaaaguaa

SEQ ID NO: 3901913 - RNA, 19 nt, Human adenovirus B (HAdV-B)
aggagccgaaaucuugaaa

SEQ ID NO: 3901914 - RNA, 16 nt, Human adenovirus B (HAdV-B)
aggaggacagucugga

SEQ ID NO: 3901915 - RNA, 13 nt, Human adenovirus B (HAdV-B)
aggaggcggagga

SEQ ID NO: 3901916 - RNA, 17 nt, Human adenovirus B (HAdV-B)
aggaggcggaggaggac

SEQ ID NO: 3901917 - RNA, 13 nt, Human adenovirus B (HAdV-B)
aggcagaggaggc

SEQ ID NO: 3901918 - RNA, 19 nt, Human adenovirus B (HAdV-B)
aggccccagcagccaaggc

SEQ ID NO: 3901919 - RNA, 15 nt, Human adenovirus B (HAdV-B)
aggccuuaucaaaug

SEQ ID NO: 3901920 - RNA, 16 nt, Human adenovirus B (HAdV-B)
aggucaauuacaaaga

SEQ ID NO: 3901921 - RNA, 15 nt, Human adenovirus B (HAdV-B)
agguccguugaaauu

SEQ ID NO: 3901922 - RNA, 17 nt, Human adenovirus B (HAdV-B)
aggucucuguugaaauu

SEQ ID NO: 3901923 - RNA, 14 nt, Human adenovirus B (HAdV-B)
aguaacuugcaaca

SEQ ID NO: 3901924 - RNA, 21 nt, Human adenovirus B (HAdV-B)
aguaugcaaacacaugucacc

SEQ ID NO: 3901925 - RNA, 21 nt, Human adenovirus B (HAdV-B)
agucaugacggcggucaugga

SEQ ID NO: 3901926 - RNA, 12 nt, Human adenovirus B (HAdV-B)
agucuggaggaa

SEQ ID NO: 3901927 - RNA, 12 nt, Human adenovirus B (HAdV-B)
agugcaggagcg

SEQ ID NO: 3901928 - RNA, 20 nt, Human adenovirus B (HAdV-B)
agugcuggauauggccagca

SEQ ID NO: 3901929 - RNA, 17 nt, Human adenovirus B (HAdV-B)
agugcuugaaagugaca

SEQ ID NO: 3901930 - RNA, 23 nt, Human adenovirus B (HAdV-B)
aguggucagugaugagcagcuaa

SEQ ID NO: 3901931 - RNA, 21 nt, Human adenovirus B (HAdV-B)
aguugaaggugcagccgccgc

SEQ ID NO: 3901932 - RNA, 16 nt, Human adenovirus B (HAdV-B)
cagccgccgcccccag

SEQ ID NO: 3901933 - RNA, 18 nt, Human adenovirus B (HAdV-B)
cagccgccgcccccagaa

SEQ ID NO: 3901934 - RNA, 17 nt, Human adenovirus B (HAdV-B)
cagcuaacccgauggcu

SEQ ID NO: 3901935 - RNA, 16 nt, Human adenovirus B (HAdV-B)
cagcuccgccagucca

SEQ ID NO: 3901936 - RNA, 14 nt, Human adenovirus B (HAdV-B)
cagcugcugcagaa

SEQ ID NO: 3901937 - RNA, 23 nt, Human adenovirus B (HAdV-B)
caggacuacuccacccgcaugaa

SEQ ID NO: 3901938 - RNA, 19 nt, Human adenovirus B (HAdV-B)
caggccucuucuccagugg

SEQ ID NO: 3901939 - RNA, 14 nt, Human adenovirus B (HAdV-B)
caggcgccucccag

SEQ ID NO: 3901940 - RNA, 16 nt, Human adenovirus B (HAdV-B)
cagggaacugaugcac

SEQ ID NO: 3901941 - RNA, 18 nt, Human adenovirus B (HAdV-B)
cagguuguaucuggugga

SEQ ID NO: 3901942 - RNA, 13 nt, Human adenovirus B (HAdV-B)
caguacaggacag

SEQ ID NO: 3901943 - RNA, 15 nt, Human adenovirus B (HAdV-B)
caguacaggacaggc

SEQ ID NO: 3901944 - RNA, 13 nt, Human adenovirus B (HAdV-B)
cagucaggcagag

SEQ ID NO: 3901945 - RNA, 22 nt, Human adenovirus B (HAdV-B)
cagugguugacuugcaggacag

SEQ ID NO: 3901946 - RNA, 13 nt, Human adenovirus B (HAdV-B)
caguguggaagag

SEQ ID NO: 3901947 - RNA, 22 nt, Human adenovirus B (HAdV-B)
cauaaaggugauccauuacuua

SEQ ID NO: 3901948 - RNA, 17 nt, Human adenovirus B (HAdV-B)
cauaaaugcaugcaucu

SEQ ID NO: 3901949 - RNA, 20 nt, Human adenovirus B (HAdV-B)
cauaggacccccaaucacuu

SEQ ID NO: 3901950 - RNA, 19 nt, Human adenovirus B (HAdV-B)
cauauuuuuugaugcguuu

SEQ ID NO: 3901951 - RNA, 20 nt, Human adenovirus B (HAdV-B)
cauccaaaaaucccgccaag

SEQ ID NO: 3901952 - RNA, 20 nt, Human adenovirus B (HAdV-B)
caucgcgcgguuagcgccag

SEQ ID NO: 3901953 - RNA, 17 nt, Human adenovirus B (HAdV-B)
caucuacuucgaacucc

SEQ ID NO: 3901954 - RNA, 17 nt, Human adenovirus B (HAdV-B)
caucuagaccacugccg

SEQ ID NO: 3901955 - RNA, 14 nt, Human adenovirus B (HAdV-B)
caugaaagccuuug

SEQ ID NO: 3901956 - RNA, 14 nt, Human adenovirus B (HAdV-B)
caugacagacagag

SEQ ID NO: 3901957 - RNA, 19 nt, Human adenovirus B (HAdV-B)
caugccuuucucccaagca

SEQ ID NO: 3901958 - RNA, 14 nt, Human adenovirus B (HAdV-B)
cauguaugcagaaa

SEQ ID NO: 3901959 - RNA, 15 nt, Human adenovirus B (HAdV-B)
cauuauuggacagaa

SEQ ID NO: 3901960 - RNA, 18 nt, Human adenovirus B (HAdV-B)
cauuauuggccgaugugu

SEQ ID NO: 3901961 - RNA, 11 nt, Human adenovirus B (HAdV-B)
cauucagaacc

SEQ ID NO: 3901962 - RNA, 13 nt, Human adenovirus B (HAdV-B)
cauuugugcauuu

SEQ ID NO: 3901963 - RNA, 19 nt, Human adenovirus B (HAdV-B)
ccaacaccgcucccccagc

SEQ ID NO: 3901964 - RNA, 23 nt, Human adenovirus B (HAdV-B)
ccaacucuugcuugacucucugg

SEQ ID NO: 3901965 - RNA, 15 nt, Human adenovirus B (HAdV-B)
ccacaacgcacagcc

SEQ ID NO: 3901966 - RNA, 14 nt, Human adenovirus B (HAdV-B)
ccaccacaccacuc

SEQ ID NO: 3901967 - RNA, 15 nt, Human adenovirus B (HAdV-B)
ccacgagugccauca

SEQ ID NO: 3901968 - RNA, 18 nt, Human adenovirus B (HAdV-B)
ccagaggugcaaaccucu

SEQ ID NO: 3901969 - RNA, 22 nt, Human adenovirus B (HAdV-B)
gcgcgguuagcgccagcaggag

SEQ ID NO: 3901970 - RNA, 11 nt, Human adenovirus B (HAdV-B)
gcgcuccagcc

SEQ ID NO: 3901971 - RNA, 22 nt, Human adenovirus B (HAdV-B)
gcggcaggcgccucccaggacu

SEQ ID NO: 3901972 - RNA, 19 nt, Human adenovirus B (HAdV-B)
gcggucaggcaaaacaaaa

SEQ ID NO: 3901973 - RNA, 13 nt, Human adenovirus B (HAdV-B)
gcguguuggauug

SEQ ID NO: 3901974 - RNA, 17 nt, Human adenovirus B (HAdV-B)
gcuagaucugaguuggc

SEQ ID NO: 3901975 - RNA, 12 nt, Human adenovirus B (HAdV-B)
gcucaccagaag

SEQ ID NO: 3901976 - RNA, 16 nt, Human adenovirus B (HAdV-B)
gcucuauaucucccag

SEQ ID NO: 3901977 - RNA, 22 nt, Human adenovirus B (HAdV-B)
gcugaaauuacaaaagaaggac

SEQ ID NO: 3901978 - RNA, 14 nt, Human adenovirus B (HAdV-B)
gcugcgcacugccc

SEQ ID NO: 3901979 - RNA, 14 nt, Human adenovirus B (HAdV-B)
gcugucucaacccc

SEQ ID NO: 3901980 - RNA, 20 nt, Human adenovirus B (HAdV-B)
gcuguguacucccagcagcu

SEQ ID NO: 3901981 - RNA, 14 nt, Human adenovirus B (HAdV-B)
gcuguuucuggugg

SEQ ID NO: 3901982 - RNA, 15 nt, Human adenovirus B (HAdV-B)
ggaacagcaagagga

SEQ ID NO: 3901983 - RNA, 16 nt, Human adenovirus B (HAdV-B)
ggacaggaagacacug

SEQ ID NO: 3901984 - RNA, 16 nt, Human adenovirus B (HAdV-B)
ggacagucaggcagag

SEQ ID NO: 3901985 - RNA, 18 nt, Human adenovirus B (HAdV-B)
ggacagucuggaggaaga

SEQ ID NO: 3901986 - RNA, 16 nt, Human adenovirus B (HAdV-B)
ggacgauuggacccag

SEQ ID NO: 3901987 - RNA, 15 nt, Human adenovirus B (HAdV-B)
ggaggagaggauccu

SEQ ID NO: 3901988 - RNA, 15 nt, Human adenovirus B (HAdV-B)
ggauuggcggcaggc

SEQ ID NO: 3901989 - RNA, 23 nt, Human adenovirus B (HAdV-B)
ggcaaaguuuaaaacugaccccg

SEQ ID NO: 3901990 - RNA, 20 nt, Human adenovirus B (HAdV-B)
ggcacacguggcugcagcca

SEQ ID NO: 3901991 - RNA, 21 nt, Human adenovirus B (HAdV-B)
ggcauggguguauggcagcaa

SEQ ID NO: 3901992 - RNA, 21 nt, Human adenovirus B (HAdV-B)
ggcauuaacuccucggacgau

SEQ ID NO: 3901993 - RNA, 14 nt, Human adenovirus B (HAdV-B)
ggccccagcagcca

SEQ ID NO: 3901994 - RNA, 18 nt, Human adenovirus B (HAdV-B)
ggcgacggcggugaugca

SEQ ID NO: 3901995 - RNA, 17 nt, Human adenovirus B (HAdV-B)
ggcuugcuggaguguca

SEQ ID NO: 3901996 - RNA, 17 nt, Human adenovirus B (HAdV-B)
ggcuuugugcggcaggc

SEQ ID NO: 3901997 - RNA, 23 nt, Human adenovirus B (HAdV-B)
gggcccauacuagucuugcuugu

SEQ ID NO: 3901998 - RNA, 11 nt, Human adenovirus B (HAdV-B)
ggggagugcau

SEQ ID NO: 3901999 - RNA, 18 nt, Human adenovirus B (HAdV-B)
ggggucaaaaacaaguuu

SEQ ID NO: 3902000 - RNA, 19 nt, Human adenovirus B (HAdV-B)
ggguuuauuuccccaaaug

SEQ ID NO: 3902001 - RNA, 14 nt, Human adenovirus B (HAdV-B)
gguacaacacauua

SEQ ID NO: 3902002 - RNA, 22 nt, Human adenovirus B (HAdV-B)
ggucuccaugaguucguguccu

SEQ ID NO: 3902003 - RNA, 12 nt, Human adenovirus B (HAdV-B)
ggugagugcaga

SEQ ID NO: 3902004 - RNA, 18 nt, Human adenovirus B (HAdV-B)
gguggaacacgaggaaga

SEQ ID NO: 3902005 - RNA, 14 nt, Human adenovirus B (HAdV-B)
gguggcaugagguu

SEQ ID NO: 3902006 - RNA, 15 nt, Human adenovirus B (HAdV-B)
ggugggugcagagcu

SEQ ID NO: 3902007 - RNA, 22 nt, Human adenovirus B (HAdV-B)
guacgagagcgugaugcagcag

SEQ ID NO: 3902008 - RNA, 16 nt, Human adenovirus B (HAdV-B)
guacguagcagcgaag

SEQ ID NO: 3902009 - RNA, 18 nt, Human adenovirus B (HAdV-B)
guacuggugacagaugcg

SEQ ID NO: 3902010 - RNA, 21 nt, Human adenovirus B (HAdV-B)
guagaagaaccugaccccaca

SEQ ID NO: 3902011 - RNA, 13 nt, Human adenovirus B (HAdV-B)
guagagcgagccg

SEQ ID NO: 3902012 - RNA, 20 nt, Human adenovirus B (HAdV-B)
guagucgguauggaagcagu

SEQ ID NO: 3902013 - RNA, 15 nt, Human adenovirus B (HAdV-B)
guaucaaggcucugc

SEQ ID NO: 3902014 - RNA, 18 nt, Human adenovirus B (HAdV-B)
guaucauucccugcagaa

SEQ ID NO: 3902015 - RNA, 20 nt, Human adenovirus B (HAdV-B)
guaucauucccugcagaaau

SEQ ID NO: 3902016 - RNA, 17 nt, Human adenovirus B (HAdV-B)
gucacuuugcagcaagu

SEQ ID NO: 3902017 - RNA, 21 nt, Human adenovirus B (HAdV-B)
gucgcuuccgaccuggcagac

SEQ ID NO: 3902018 - RNA, 13 nt, Human adenovirus B (HAdV-B)
gucuaucuguacc

SEQ ID NO: 3902019 - RNA, 15 nt, Human adenovirus B (HAdV-B)
gucucugaccaugac

SEQ ID NO: 3902020 - RNA, 17 nt, Human adenovirus B (HAdV-B)
gucugcgcgcuccaagc

SEQ ID NO: 3902021 - RNA, 14 nt, Human adenovirus B (HAdV-B)
gugcacgccccacc

SEQ ID NO: 3902022 - RNA, 17 nt, Human adenovirus B (HAdV-B)
gugcaggagcggagccu

SEQ ID NO: 3902023 - RNA, 17 nt, Human adenovirus B (HAdV-B)
gugcgcacccguccccc

SEQ ID NO: 3902024 - RNA, 22 nt, Human adenovirus B (HAdV-B)
gugcuggugggcauuguaauau

SEQ ID NO: 3902025 - RNA, 13 nt, Human adenovirus B (HAdV-B)
guuauuagaugcu

SEQ ID NO: 3902026 - RNA, 19 nt, Human adenovirus B (HAdV-B)
guuccugcucucacagauc

SEQ ID NO: 3902027 - RNA, 18 nt, Human adenovirus B (HAdV-B)
guugaaggugcagccgcc

SEQ ID NO: 3902028 - RNA, 19 nt, Human adenovirus B (HAdV-B)
guugaucaccugggcagcu

SEQ ID NO: 3902029 - RNA, 16 nt, Human adenovirus B (HAdV-B)
guugcuaacgcuggag

SEQ ID NO: 3902030 - RNA, 16 nt, Human adenovirus B (HAdV-B)
guuggauugccacagc

SEQ ID NO: 3902031 - RNA, 14 nt, Human adenovirus B (HAdV-B)
uaacagugcaggca

SEQ ID NO: 3902032 - RNA, 15 nt, Human adenovirus B (HAdV-B)
uaacagugcaggcag

SEQ ID NO: 3902033 - RNA, 19 nt, Human adenovirus B (HAdV-B)
uaaccccacuaacaaccac

SEQ ID NO: 3902034 - RNA, 19 nt, Human adenovirus B (HAdV-B)
uaacgcuggagaggucaga

SEQ ID NO: 3902035 - RNA, 14 nt, Human adenovirus B (HAdV-B)
uaagaaugccauca

SEQ ID NO: 3902036 - RNA, 20 nt, Human adenovirus B (HAdV-B)
uaagauucccacugaaagua

SEQ ID NO: 3902037 - RNA, 14 nt, Human adenovirus B (HAdV-B)
uaagcauuccaccg

SEQ ID NO: 3902038 - RNA, 22 nt, Human adenovirus B (HAdV-B)
uaauaugcuggcuacugugcau

SEQ ID NO: 3902039 - RNA, 12 nt, Human adenovirus B (HAdV-B)
uaaugccagacu

SEQ ID NO: 3902040 - RNA, 21 nt, Human adenovirus B (HAdV-B)
uacaaaagaaggacucccagu

SEQ ID NO: 3902041 - RNA, 22 nt, Human adenovirus B (HAdV-B)
uacaauuauggcgaucccgaaa

SEQ ID NO: 3902042 - RNA, 19 nt, Human adenovirus B (HAdV-B)
uacacacaauaacaaaacc

SEQ ID NO: 3902043 - RNA, 14 nt, Human adenovirus B (HAdV-B)
uacaccgcuuuucc

SEQ ID NO: 3902044 - RNA, 16 nt, Human adenovirus B (HAdV-B)
uacauggguauucugc

SEQ ID NO: 3902045 - RNA, 17 nt, Human adenovirus B (HAdV-B)
uaccugauauagcuucc

SEQ ID NO: 3902046 - RNA, 22 nt, Human adenovirus B (HAdV-B)
uacgcugucucaaccccagcug

SEQ ID NO: 3902047 - RNA, 14 nt, Human adenovirus B (HAdV-B)
uacucccagcagcu

SEQ ID NO: 3902048 - RNA, 16 nt, Human adenovirus B (HAdV-B)
uacuugaaaucagcaa

SEQ ID NO: 3902049 - RNA, 14 nt, Human adenovirus B (HAdV-B)
uacuuuaaaauguu

SEQ ID NO: 3902050 - RNA, 15 nt, Human adenovirus B (HAdV-B)
uagcgccagcaggag

SEQ ID NO: 3902051 - RNA, 16 nt, Human adenovirus B (HAdV-B)
uagcugaaacccacug

SEQ ID NO: 3902052 - RNA, 14 nt, Human adenovirus B (HAdV-B)
uagcuugcaacccc

SEQ ID NO: 3902053 - RNA, 15 nt, Human adenovirus B (HAdV-B)
uagcuuugaggccug

SEQ ID NO: 3902054 - RNA, 15 nt, Human adenovirus B (HAdV-B)
uaggcugauugccac

SEQ ID NO: 3902055 - RNA, 20 nt, Human adenovirus B (HAdV-B)
uagucaccuccccauuuacc

SEQ ID NO: 3902056 - RNA, 13 nt, Human adenovirus B (HAdV-B)
uagugcaggagcg

SEQ ID NO: 3902057 - RNA, 16 nt, Human adenovirus B (HAdV-B)
uagugccuucccgcuc

SEQ ID NO: 3902058 - RNA, 18 nt, Human adenovirus B (HAdV-B)
uauagcuuccuuggaaga

SEQ ID NO: 3902059 - RNA, 21 nt, Human adenovirus B (HAdV-B)
uauagcuuccuuggaagaggu

SEQ ID NO: 3902060 - RNA, 14 nt, Human adenovirus B (HAdV-B)
uauauauacacaag

SEQ ID NO: 3902061 - RNA, 22 nt, Human adenovirus B (HAdV-B)
uaugaagaugaaagcaccuccc

SEQ ID NO: 3902062 - RNA, 14 nt, Human adenovirus B (HAdV-B)
uauggagcccagca

SEQ ID NO: 3902063 - RNA, 12 nt, Human adenovirus B (HAdV-B)
ucaacauccagg

SEQ ID NO: 3902064 - RNA, 15 nt, Human adenovirus B (HAdV-B)
ucaaccccagguaga

SEQ ID NO: 3902065 - RNA, 19 nt, Human adenovirus B (HAdV-B)
ucaacgguggcuuccagca

SEQ ID NO: 3902066 - RNA, 18 nt, Human adenovirus B (HAdV-B)
ucaccccucgucaggcug

SEQ ID NO: 3902067 - RNA, 18 nt, Human adenovirus B (HAdV-B)
ucagaccgucagccaugg

SEQ ID NO: 3902068 - RNA, 23 nt, Human adenovirus B (HAdV-B)
ucagaugucaccugcggagcaga

SEQ ID NO: 3902069 - RNA, 15 nt, Human adenovirus B (HAdV-B)
ucaggguuacuuugc

SEQ ID NO: 3902070 - RNA, 13 nt, Human adenovirus B (HAdV-B)
ucaguguggaaga

SEQ ID NO: 3902071 - RNA, 22 nt, Human adenovirus B (HAdV-B)
ucauagauaauuacuugaaagu

SEQ ID NO: 3902072 - RNA, 19 nt, Human adenovirus B (HAdV-B)
acaaugaggcuuucagaga

SEQ ID NO: 3902073 - RNA, 15 nt, Human adenovirus B (HAdV-B)
acaccuacgacuaca

SEQ ID NO: 3902074 - RNA, 20 nt, Human adenovirus B (HAdV-B)
acaccuugcuucacuuucuu

SEQ ID NO: 3902075 - RNA, 13 nt, Human adenovirus B (HAdV-B)
acagcagagacaa

SEQ ID NO: 3902076 - RNA, 17 nt, Human adenovirus B (HAdV-B)
acagcugcugcagaagc

SEQ ID NO: 3902077 - RNA, 16 nt, Human adenovirus B (HAdV-B)
acaguaaaggaagagc

SEQ ID NO: 3902078 - RNA, 17 nt, Human adenovirus B (HAdV-B)
acaguauggugaacacc

SEQ ID NO: 3902079 - RNA, 19 nt, Human adenovirus B (HAdV-B)
acaguuucacauuccacca

SEQ ID NO: 3902080 - RNA, 14 nt, Human adenovirus B (HAdV-B)
acaguuucacuucc

SEQ ID NO: 3902081 - RNA, 17 nt, Human adenovirus B (HAdV-B)
acaucacuuccaugccu

SEQ ID NO: 3902082 - RNA, 14 nt, Human adenovirus B (HAdV-B)
accacugccaugcg

SEQ ID NO: 3902083 - RNA, 15 nt, Human adenovirus B (HAdV-B)
accagacaaaguaca

SEQ ID NO: 3902084 - RNA, 14 nt, Human adenovirus B (HAdV-B)
accagcgcuuccaa

SEQ ID NO: 3902085 - RNA, 12 nt, Human adenovirus B (HAdV-B)
acccggcggcgu

SEQ ID NO: 3902086 - RNA, 22 nt, Human adenovirus B (HAdV-B)
acccuguaugccaucuuccagc

SEQ ID NO: 3902087 - RNA, 17 nt, Human adenovirus B (HAdV-B)
accucugaccgcccagc

SEQ ID NO: 3902088 - RNA, 18 nt, Human adenovirus B (HAdV-B)
accugcugcgcacugccc

SEQ ID NO: 3902089 - RNA, 19 nt, Human adenovirus B (HAdV-B)
acgagaaaaaacagccaac

SEQ ID NO: 3902090 - RNA, 17 nt, Human adenovirus B (HAdV-B)
acgcauccgccagcagc

SEQ ID NO: 3902091 - RNA, 14 nt, Human adenovirus B (HAdV-B)
acggcuugcuggag

SEQ ID NO: 3902092 - RNA, 12 nt, Human adenovirus B (HAdV-B)
acuacacagcua

SEQ ID NO: 3902093 - RNA, 20 nt, Human adenovirus B (HAdV-B)
acucauguaguguacaaacc

SEQ ID NO: 3902094 - RNA, 23 nt, Human adenovirus B (HAdV-B)
acuccauacguucccauagacaa

SEQ ID NO: 3902095 - RNA, 15 nt, Human adenovirus B (HAdV-B)
acucugaacuucuug

SEQ ID NO: 3902096 - RNA, 16 nt, Human adenovirus B (HAdV-B)
acugcagcacuggaca

SEQ ID NO: 3902097 - RNA, 20 nt, Human adenovirus B (HAdV-B)
acuggcaguuuggaagccac

SEQ ID NO: 3902098 - RNA, 12 nt, Human adenovirus B (HAdV-B)
acuuggaagacu

SEQ ID NO: 3902099 - RNA, 13 nt, Human adenovirus B (HAdV-B)
acuuuaaaauguu

SEQ ID NO: 3902100 - RNA, 23 nt, Human adenovirus B (HAdV-B)
agaaaugcauauuucaaagaugu

SEQ ID NO: 3902101 - RNA, 13 nt, Human adenovirus B (HAdV-B)
agacgagccuggg

SEQ ID NO: 3902102 - RNA, 12 nt, Human adenovirus B (HAdV-B)
agaggaauguuu

SEQ ID NO: 3902103 - RNA, 18 nt, Human adenovirus B (HAdV-B)
agaggaggcggaggagga

SEQ ID NO: 3902104 - RNA, 15 nt, Human adenovirus B (HAdV-B)
agaugccugugauga

SEQ ID NO: 3902105 - RNA, 16 nt, Human adenovirus B (HAdV-B)
agauuacagccaacga

SEQ ID NO: 3902106 - RNA, 22 nt, Human adenovirus B (HAdV-B)
agauucuugaagcuugguuacc

SEQ ID NO: 3902107 - RNA, 21 nt, Human adenovirus B (HAdV-B)
agcaacagcgcuaccaucucc

SEQ ID NO: 3902108 - RNA, 16 nt, Human adenovirus B (HAdV-B)
agcaaccccaggccaa

SEQ ID NO: 3902109 - RNA, 21 nt, Human adenovirus B (HAdV-B)
agcaagauguacggaggcgca

SEQ ID NO: 3902110 - RNA, 14 nt, Human adenovirus B (HAdV-B)
agcaagggggccac

SEQ ID NO: 3902111 - RNA, 16 nt, Human adenovirus B (HAdV-B)
agcagcgugcuggacu

SEQ ID NO: 3902112 - RNA, 19 nt, Human adenovirus B (HAdV-B)
agcaucauauugcuugaaa

SEQ ID NO: 3902113 - RNA, 14 nt, Human adenovirus B (HAdV-B)
agccagcacccaga

SEQ ID NO: 3902114 - RNA, 15 nt, Human adenovirus B (HAdV-B)
agcgaucuucucaau

SEQ ID NO: 3902115 - RNA, 22 nt, Human adenovirus B (HAdV-B)
agcgcauacaacuugggcgcaa

SEQ ID NO: 3902116 - RNA, 14 nt, Human adenovirus B (HAdV-B)
agcgggcuuaaaaa

SEQ ID NO: 3902117 - RNA, 20 nt, Human adenovirus B (HAdV-B)
agcgugaguaagggcaaagg

SEQ ID NO: 3902118 - RNA, 14 nt, Human adenovirus B (HAdV-B)
agcuuaccuuugga

SEQ ID NO: 3902119 - RNA, 16 nt, Human adenovirus B (HAdV-B)
aggaagacaguuugga

SEQ ID NO: 3902120 - RNA, 16 nt, Human adenovirus B (HAdV-B)
aggcagaggaggugga

SEQ ID NO: 3902121 - RNA, 18 nt, Human adenovirus B (HAdV-B)
aggcucaaacugcacacu

SEQ ID NO: 3902122 - RNA, 15 nt, Human adenovirus B (HAdV-B)
agguggcugccauca

SEQ ID NO: 3902123 - RNA, 15 nt, Human adenovirus B (HAdV-B)
aguaacuugcaacau

SEQ ID NO: 3902124 - RNA, 15 nt, Human adenovirus B (HAdV-B)
aguacuggcuaccua

SEQ ID NO: 3902125 - RNA, 14 nt, Human adenovirus B (HAdV-B)
aguagcugacuugu

SEQ ID NO: 3902126 - RNA, 16 nt, Human adenovirus B (HAdV-B)
agucacugcuaccugu

SEQ ID NO: 3902127 - RNA, 12 nt, Human adenovirus B (HAdV-B)
agucgcagggcu

SEQ ID NO: 3902128 - RNA, 15 nt, Human adenovirus B (HAdV-B)
agucuguuccacagu

SEQ ID NO: 3902129 - RNA, 20 nt, Human adenovirus B (HAdV-B)
agugauguguucuauggcau

SEQ ID NO: 3902130 - RNA, 18 nt, Human adenovirus B (HAdV-B)
aguucgacaccaggaacu

SEQ ID NO: 3902131 - RNA, 20 nt, Human adenovirus B (HAdV-B)
aguuuacuuugccagaaggc

SEQ ID NO: 3902132 - RNA, 15 nt, Human adenovirus B (HAdV-B)
auaagcauauuggga

SEQ ID NO: 3902133 - RNA, 21 nt, Human adenovirus B (HAdV-B)
auacuaaggguugcauucacu

SEQ ID NO: 3902134 - RNA, 21 nt, Human adenovirus B (HAdV-B)
auacucauuugugcauuuaau

SEQ ID NO: 3902135 - RNA, 20 nt, Human adenovirus B (HAdV-B)
auagcaauggggccgugggc

SEQ ID NO: 3902136 - RNA, 12 nt, Human adenovirus B (HAdV-B)
auagccacagca

SEQ ID NO: 3902137 - RNA, 20 nt, Human adenovirus B (HAdV-B)
auagccacagcauuguggag

SEQ ID NO: 3902138 - RNA, 15 nt, Human adenovirus B (HAdV-B)
auaucuggaaauggg

SEQ ID NO: 3902139 - RNA, 19 nt, Human adenovirus B (HAdV-B)
auaugcuggcuacugugca

SEQ ID NO: 3902140 - RNA, 12 nt, Human adenovirus B (HAdV-B)
aucaaaacucca

SEQ ID NO: 3902141 - RNA, 14 nt, Human adenovirus B (HAdV-B)
aucaaggcucugca

SEQ ID NO: 3902142 - RNA, 17 nt, Human adenovirus B (HAdV-B)
auccaagaacaaaagaa

SEQ ID NO: 3902143 - RNA, 12 nt, Human adenovirus B (HAdV-B)
aucgcagugcag

SEQ ID NO: 3902144 - RNA, 13 nt, Human adenovirus B (HAdV-B)
aucgcgaagccau

SEQ ID NO: 3902145 - RNA, 13 nt, Human adenovirus B (HAdV-B)
aucuuccagcaga

SEQ ID NO: 3902146 - RNA, 13 nt, Human adenovirus B (HAdV-B)
aucuugaaaucac

SEQ ID NO: 3902147 - RNA, 18 nt, Human adenovirus B (HAdV-B)
augaauuaaaaaaugauu

SEQ ID NO: 3902148 - RNA, 15 nt, Human adenovirus B (HAdV-B)
augacccgcaggcag

SEQ ID NO: 3902149 - RNA, 21 nt, Human adenovirus B (HAdV-B)
augagaacaguaagaaagaac

SEQ ID NO: 3902150 - RNA, 20 nt, Human adenovirus B (HAdV-B)
augagucgcagacguccuga

SEQ ID NO: 3902151 - RNA, 17 nt, Human adenovirus B (HAdV-B)
augcaucccgugcugcg

SEQ ID NO: 3902152 - RNA, 19 nt, Human adenovirus B (HAdV-B)
augcuaacuacacacagaa

SEQ ID NO: 3902153 - RNA, 18 nt, Human adenovirus B (HAdV-B)
auggauauguggccuggg

SEQ ID NO: 3902154 - RNA, 16 nt, Human adenovirus B (HAdV-B)
augggacgagaccgga

SEQ ID NO: 3902155 - RNA, 20 nt, Human adenovirus B (HAdV-B)
auguguugagaccuggaacu

SEQ ID NO: 3902156 - RNA, 21 nt, Human adenovirus B (HAdV-B)
auuaauauccggaaugcuugu

SEQ ID NO: 3902157 - RNA, 20 nt, Human adenovirus B (HAdV-B)
auucauuuuucagaaacuuc

SEQ ID NO: 3902158 - RNA, 16 nt, Human adenovirus B (HAdV-B)
auucugcaugagaauc

SEQ ID NO: 3902159 - RNA, 14 nt, Human adenovirus B (HAdV-B)
auugaauaaaagaa

SEQ ID NO: 3902160 - RNA, 11 nt, Human adenovirus B (HAdV-B)
auugccacagc

SEQ ID NO: 3902161 - RNA, 12 nt, Human adenovirus B (HAdV-B)
auugccacagcu

SEQ ID NO: 3902162 - RNA, 16 nt, Human adenovirus B (HAdV-B)
auuucauagccacagc

SEQ ID NO: 3902163 - RNA, 16 nt, Human adenovirus B (HAdV-B)
auuugaugaacaaugc

SEQ ID NO: 3902164 - RNA, 15 nt, Human adenovirus B (HAdV-B)
auuuuggauuggauu

SEQ ID NO: 3902165 - RNA, 15 nt, Human adenovirus B (HAdV-B)
caaaaaagaagagga

SEQ ID NO: 3902166 - RNA, 19 nt, Human adenovirus B (HAdV-B)
caaaagaaggacucccagu

SEQ ID NO: 3902167 - RNA, 17 nt, Human adenovirus B (HAdV-B)
ggaaaaggagcagagcu

SEQ ID NO: 3902168 - RNA, 16 nt, Human adenovirus B (HAdV-B)
ggacaaugucaaccca

SEQ ID NO: 3902169 - RNA, 12 nt, Human adenovirus B (HAdV-B)
gaugacaccaac

SEQ ID NO: 3902170 - RNA, 19 nt, Human adenovirus B (HAdV-B)
gaugggugcauucggggug

SEQ ID NO: 3902171 - RNA, 15 nt, Human adenovirus B (HAdV-B)
gauguagaugccuau

SEQ ID NO: 3902172 - RNA, 12 nt, Human adenovirus B (HAdV-B)
gauguccaagcg

SEQ ID NO: 3902173 - RNA, 13 nt, Human adenovirus B (HAdV-B)
gaugugagcuucc

SEQ ID NO: 3902174 - RNA, 18 nt, Human adenovirus B (HAdV-B)
gauuacagccaacgagcc

SEQ ID NO: 3902175 - RNA, 19 nt, Human adenovirus B (HAdV-B)
gcaaggguccgccacugcg

SEQ ID NO: 3902176 - RNA, 20 nt, Human adenovirus B (HAdV-B)
gcacagcuagaucaaaagaa

SEQ ID NO: 3902177 - RNA, 20 nt, Human adenovirus B (HAdV-B)
gcacauagucauauaguuca

SEQ ID NO: 3902178 - RNA, 16 nt, Human adenovirus B (HAdV-B)
gcaccgacucucccag

SEQ ID NO: 3902179 - RNA, 13 nt, Human adenovirus B (HAdV-B)
gcacgccccaccg

SEQ ID NO: 3902180 - RNA, 22 nt, Human adenovirus B (HAdV-B)
gcacuucagcuugcccucauaa

SEQ ID NO: 3902181 - RNA, 23 nt, Human adenovirus B (HAdV-B)
gcagcaauguuuagaagaacaga

SEQ ID NO: 3902182 - RNA, 20 nt, Human adenovirus B (HAdV-B)
gcagccgccgcccccagaag

SEQ ID NO: 3902183 - RNA, 22 nt, Human adenovirus B (HAdV-B)
gcaguagccacagcaaccccag

SEQ ID NO: 3902184 - RNA, 22 nt, Human adenovirus B (HAdV-B)
gcauaugcaaaucccaaccaag

SEQ ID NO: 3902185 - RNA, 19 nt, Human adenovirus B (HAdV-B)
gcaugaccaucauaccaaa

SEQ ID NO: 3902186 - RNA, 15 nt, Human adenovirus B (HAdV-B)
gccaaguagcaguuu

SEQ ID NO: 3902187 - RNA, 12 nt, Human adenovirus B (HAdV-B)
gccccagcagcc

SEQ ID NO: 3902188 - RNA, 22 nt, Human adenovirus B (HAdV-B)
gcccuggugcggcaaguguacc

SEQ ID NO: 3902189 - RNA, 20 nt, Human adenovirus B (HAdV-B)
gccgagaagguggcugccau

SEQ ID NO: 3902190 - RNA, 22 nt, Human adenovirus B (HAdV-B)
gccuccgcgauaccuggcaccu

SEQ ID NO: 3902191 - RNA, 22 nt, Human adenovirus B (HAdV-B)
gccuccuugcagauauggcccu

SEQ ID NO: 3902192 - RNA, 14 nt, Human adenovirus B (HAdV-B)
gcgauaccuggcac

SEQ ID NO: 3902193 - RNA, 21 nt, Human adenovirus B (HAdV-B)
gcgcugccaggguucgguccu

SEQ ID NO: 3902194 - RNA, 16 nt, Human adenovirus B (HAdV-B)
gcgcugcgcuccaaca

SEQ ID NO: 3902195 - RNA, 16 nt, Human adenovirus B (HAdV-B)
gcgggcaaacacguuc

SEQ ID NO: 3902196 - RNA, 18 nt, Human adenovirus B (HAdV-B)
gcgucccgauuuggaaga

SEQ ID NO: 3902197 - RNA, 13 nt, Human adenovirus B (HAdV-B)
gcguuaagaggga

SEQ ID NO: 3902198 - RNA, 19 nt, Human adenovirus B (HAdV-B)
gcguucgcucaccagaagu

SEQ ID NO: 3902199 - RNA, 20 nt, Human adenovirus B (HAdV-B)
gcuaugaacucugauuauuu

SEQ ID NO: 3902200 - RNA, 15 nt, Human adenovirus B (HAdV-B)
gcugcugcuguggcu

SEQ ID NO: 3902201 - RNA, 22 nt, Human adenovirus B (HAdV-B)
gcuggacuugggugggagagga

SEQ ID NO: 3902202 - RNA, 15 nt, Human adenovirus B (HAdV-B)
gcuggauauggccag

SEQ ID NO: 3902203 - RNA, 15 nt, Human adenovirus B (HAdV-B)
gcuguuucugguggu

SEQ ID NO: 3902204 - RNA, 18 nt, Human adenovirus B (HAdV-B)
gcuguuucugguggugca

SEQ ID NO: 3902205 - RNA, 22 nt, Human adenovirus B (HAdV-B)
ggaagguucgcaagaugaggac

SEQ ID NO: 3902206 - RNA, 17 nt, Human adenovirus B (HAdV-B)
ggagccggaggagaugc

SEQ ID NO: 3902207 - RNA, 13 nt, Human adenovirus B (HAdV-B)
ggaggaggagagg

SEQ ID NO: 3902208 - RNA, 22 nt, Human adenovirus B (HAdV-B)
ggauccuuagauaugugcagca

SEQ ID NO: 3902209 - RNA, 17 nt, Human adenovirus B (HAdV-B)
ggaugacuggcagaacc

SEQ ID NO: 3902210 - RNA, 18 nt, Human adenovirus B (HAdV-B)
ggauuucauagccacagc

SEQ ID NO: 3902211 - RNA, 22 nt, Human adenovirus B (HAdV-B)
ggcacucccgucucgacccagc

SEQ ID NO: 3902212 - RNA, 17 nt, Human adenovirus B (HAdV-B)
ggcccaauugcaagcca

SEQ ID NO: 3902213 - RNA, 12 nt, Human adenovirus B (HAdV-B)
ggccgguaacgc

SEQ ID NO: 3902214 - RNA, 17 nt, Human adenovirus B (HAdV-B)
ggcggagcgguggugua

SEQ ID NO: 3902215 - RNA, 12 nt, Human adenovirus B (HAdV-B)
ggcggaggagga

SEQ ID NO: 3902216 - RNA, 18 nt, Human adenovirus B (HAdV-B)
ggcggaugacuggcagaa

SEQ ID NO: 3902217 - RNA, 19 nt, Human adenovirus B (HAdV-B)
ggcggccagacgugcagcu

SEQ ID NO: 3902218 - RNA, 18 nt, Human adenovirus B (HAdV-B)
gggagcugacuugcagug

SEQ ID NO: 3902219 - RNA, 15 nt, Human adenovirus B (HAdV-B)
ggguucgcugguggc

SEQ ID NO: 3902220 - RNA, 17 nt, Human adenovirus B (HAdV-B)
gguaaaucugagccaag

SEQ ID NO: 3902221 - RNA, 20 nt, Human adenovirus B (HAdV-B)
gguagaagaaccugacccca

SEQ ID NO: 3902222 - RNA, 18 nt, Human adenovirus B (HAdV-B)
ggugaaauuaugugcauu

SEQ ID NO: 3902223 - RNA, 17 nt, Human adenovirus B (HAdV-B)
ggugagugcagaggcau

SEQ ID NO: 3902224 - RNA, 20 nt, Human adenovirus B (HAdV-B)
ggugcuaccgcggcugagcc

SEQ ID NO: 3902225 - RNA, 22 nt, Human adenovirus B (HAdV-B)
ggugcuaccgcggcugagcccg

SEQ ID NO: 3902226 - RNA, 21 nt, Human adenovirus B (HAdV-B)
gguggugcaacacagcagaga

SEQ ID NO: 3902227 - RNA, 16 nt, Human adenovirus B (HAdV-B)
gguuagcugcacagcc

SEQ ID NO: 3902228 - RNA, 20 nt, Human adenovirus B (HAdV-B)
gguucuauucccuaccugga

SEQ ID NO: 3902229 - RNA, 21 nt, Human adenovirus B (HAdV-B)
gguugcaaucgcagugcaggg

SEQ ID NO: 3902230 - RNA, 16 nt, Human adenovirus B (HAdV-B)
gguuguaucuggugga

SEQ ID NO: 3902231 - RNA, 15 nt, Human adenovirus B (HAdV-B)
guaacuuuuguaaau

SEQ ID NO: 3902232 - RNA, 20 nt, Human adenovirus B (HAdV-B)
guaagaaggaucggcaggga

SEQ ID NO: 3902233 - RNA, 12 nt, Human adenovirus B (HAdV-B)
guaagggcagca

SEQ ID NO: 3902234 - RNA, 13 nt, Human adenovirus B (HAdV-B)
guagccaggucac

SEQ ID NO: 3902235 - RNA, 20 nt, Human adenovirus B (HAdV-B)
guaggcacgguuugaccagu

SEQ ID NO: 3902236 - RNA, 12 nt, Human adenovirus B (HAdV-B)
guauaaugaggc

SEQ ID NO: 3902237 - RNA, 17 nt, Human adenovirus B (HAdV-B)
guauucugcaugagaau

SEQ ID NO: 3902238 - RNA, 13 nt, Human adenovirus B (HAdV-B)
guccuuucaagcc

SEQ ID NO: 3902239 - RNA, 12 nt, Human adenovirus B (HAdV-B)
gucuccaugagu

SEQ ID NO: 3902240 - RNA, 16 nt, Human adenovirus B (HAdV-B)
gugaugcaauccccac

SEQ ID NO: 3902241 - RNA, 19 nt, Human adenovirus B (HAdV-B)
gugcgcgaguuugccccac

SEQ ID NO: 3902242 - RNA, 13 nt, Human adenovirus B (HAdV-B)
guggaagaugaac

SEQ ID NO: 3902243 - RNA, 19 nt, Human adenovirus B (HAdV-B)
gugggucuagcauaaguuc

SEQ ID NO: 3902244 - RNA, 23 nt, Human adenovirus B (HAdV-B)
guuggauugccacagcuggcaga

SEQ ID NO: 3902245 - RNA, 18 nt, Human adenovirus B (HAdV-B)
guuuagauacaugggcau

SEQ ID NO: 3902246 - RNA, 16 nt, Human adenovirus B (HAdV-B)
guuuaguaacaaguuc

SEQ ID NO: 3902247 - RNA, 21 nt, Human adenovirus B (HAdV-B)
guuuuggagaaaguaaaagug

SEQ ID NO: 3902248 - RNA, 19 nt, Human adenovirus B (HAdV-B)
uaacaauuuucgcucuuuc

SEQ ID NO: 3902249 - RNA, 18 nt, Human adenovirus B (HAdV-B)
uaacuuguuuauuugaaa

SEQ ID NO: 3902250 - RNA, 14 nt, Human adenovirus B (HAdV-B)
uaagggaaaugcca

SEQ ID NO: 3902251 - RNA, 20 nt, Human adenovirus B (HAdV-B)
uaauaugcuaacuacacaca

SEQ ID NO: 3902252 - RNA, 13 nt, Human adenovirus B (HAdV-B)
uaauucuacaacu

SEQ ID NO: 3902253 - RNA, 13 nt, Human adenovirus B (HAdV-B)
uacaaggaagaaa

SEQ ID NO: 3902254 - RNA, 18 nt, Human adenovirus B (HAdV-B)
uacacaccuugcuucacu

SEQ ID NO: 3902255 - RNA, 14 nt, Human adenovirus B (HAdV-B)
uacacugucucugu

SEQ ID NO: 3902256 - RNA, 15 nt, Human adenovirus B (HAdV-B)
uacagcugcugcaga

SEQ ID NO: 3902257 - RNA, 19 nt, Human adenovirus B (HAdV-B)
uacaguuucacuuccgcaa

SEQ ID NO: 3902258 - RNA, 17 nt, Human adenovirus B (HAdV-B)
uacauucaauucaaaca

SEQ ID NO: 3902259 - RNA, 20 nt, Human adenovirus B (HAdV-B)
uacccuguggugggugcaga

SEQ ID NO: 3902260 - RNA, 15 nt, Human adenovirus B (HAdV-B)
uaccgauccaugcuu

SEQ ID NO: 3902261 - RNA, 21 nt, Human adenovirus B (HAdV-B)
uacuaagaugaaaccaugcua

SEQ ID NO: 3902262 - RNA, 16 nt, Human adenovirus B (HAdV-B)
uacuaaggguugcauu

SEQ ID NO: 3902263 - RNA, 14 nt, Human adenovirus B (HAdV-B)
uacuauagccagca

SEQ ID NO: 3902264 - RNA, 22 nt, Human adenovirus B (HAdV-B)
uacuuuuggaacagucagcucu

SEQ ID NO: 3902265 - RNA, 17 nt, Human adenovirus B (HAdV-B)
uagacagaauggagugc

SEQ ID NO: 3902266 - RNA, 20 nt, Human adenovirus B (HAdV-B)
uagaccuacagagucucuga

SEQ ID NO: 3902267 - RNA, 16 nt, Human adenovirus B (HAdV-B)
uaggcugauugccaca

SEQ ID NO: 3902268 - RNA, 22 nt, Human adenovirus B (HAdV-B)
uagugcaggagcggagccuggg

SEQ ID NO: 3902269 - RNA, 16 nt, Human adenovirus B (HAdV-B)
uaguuuaaaagagguu

SEQ ID NO: 3902270 - RNA, 12 nt, Human adenovirus B (HAdV-B)
uauaaaacaucc

SEQ ID NO: 3902271 - RNA, 22 nt, Human adenovirus B (HAdV-B)
ggacaggguucgacgagcgcac

SEQ ID NO: 3902272 - RNA, 16 nt, Human adenovirus B (HAdV-B)
ggaccgaagacgagug

SEQ ID NO: 3902273 - RNA, 22 nt, Human adenovirus B (HAdV-B)
ggaggaaaacgaggaggcagag

SEQ ID NO: 3902274 - RNA, 16 nt, Human adenovirus B (HAdV-B)
ggaggagaugcgagcu

SEQ ID NO: 3902275 - RNA, 11 nt, Human adenovirus B (HAdV-B)
ggaggcagagg

SEQ ID NO: 3902276 - RNA, 20 nt, Human adenovirus B (HAdV-B)
ggauucuuaacagugcaggc

SEQ ID NO: 3902277 - RNA, 22 nt, Human adenovirus B (HAdV-B)
ggcaggaugucacuccacagcu

SEQ ID NO: 3902278 - RNA, 17 nt, Human adenovirus B (HAdV-B)
ggcguccagcgcugcca

SEQ ID NO: 3902279 - RNA, 13 nt, Human adenovirus B (HAdV-B)
gggaaucaacccc

SEQ ID NO: 3902280 - RNA, 16 nt, Human adenovirus B (HAdV-B)
ggggccgugggcagcg

SEQ ID NO: 3902281 - RNA, 19 nt, Human adenovirus B (HAdV-B)
ggggucuaccuugaccccc

SEQ ID NO: 3902282 - RNA, 19 nt, Human adenovirus B (HAdV-B)
gggucuugugugggacgau

SEQ ID NO: 3902283 - RNA, 11 nt, Human adenovirus B (HAdV-B)
gggugggagag

SEQ ID NO: 3902284 - RNA, 22 nt, Human adenovirus B (HAdV-B)
gguaaauccaauccacacauua

SEQ ID NO: 3902285 - RNA, 20 nt, Human adenovirus B (HAdV-B)
gguaagaaggaucggcaggg

SEQ ID NO: 3902286 - RNA, 20 nt, Human adenovirus B (HAdV-B)
ggucgaaaacuucugucgcu

SEQ ID NO: 3902287 - RNA, 20 nt, Human adenovirus B (HAdV-B)
ggucuuuacacccggcgagc

SEQ ID NO: 3902288 - RNA, 20 nt, Human adenovirus B (HAdV-B)
ggugacgcgcguagaugaac

SEQ ID NO: 3902289 - RNA, 19 nt, Human adenovirus B (HAdV-B)
ggugcaacacagcagagac

SEQ ID NO: 3902290 - RNA, 15 nt, Human adenovirus B (HAdV-B)
guauaucgggcagga

SEQ ID NO: 3902291 - RNA, 12 nt, Human adenovirus B (HAdV-B)
gucacaggccuc

SEQ ID NO: 3902292 - RNA, 15 nt, Human adenovirus B (HAdV-B)
gucagccaugggcau

SEQ ID NO: 3902293 - RNA, 23 nt, Human adenovirus B (HAdV-B)
gucaugccagcgguucuggagga

SEQ ID NO: 3902294 - RNA, 15 nt, Human adenovirus B (HAdV-B)
gucccuacguguaca

SEQ ID NO: 3902295 - RNA, 19 nt, Human adenovirus B (HAdV-B)
guccguucucgcuggccac

SEQ ID NO: 3902296 - RNA, 22 nt, Human adenovirus B (HAdV-B)
gucgacgcugaguuacuuucaa

SEQ ID NO: 3902297 - RNA, 20 nt, Human adenovirus B (HAdV-B)
gucgccguagacgcacaagc

SEQ ID NO: 3902298 - RNA, 22 nt, Human adenovirus B (HAdV-B)
gucgcgcuuugggacaggaaga

SEQ ID NO: 3902299 - RNA, 13 nt, Human adenovirus B (HAdV-B)
gugcagcagagcg

SEQ ID NO: 3902300 - RNA, 21 nt, Human adenovirus B (HAdV-B)
gugcagccgccgcccccagaa

SEQ ID NO: 3902301 - RNA, 21 nt, Human adenovirus B (HAdV-B)
gugccuccgcgauaccuggca

SEQ ID NO: 3902302 - RNA, 21 nt, Human adenovirus B (HAdV-B)
gugcugcacagcacccugaag

SEQ ID NO: 3902303 - RNA, 15 nt, Human adenovirus B (HAdV-B)
gugggcgcaaaguuc

SEQ ID NO: 3902304 - RNA, 23 nt, Human adenovirus B (HAdV-B)
gugguugacuugcaggacagaaa

SEQ ID NO: 3902305 - RNA, 14 nt, Human adenovirus B (HAdV-B)
gugugacagugcaa

SEQ ID NO: 3902306 - RNA, 14 nt, Human adenovirus B (HAdV-B)
guuacauggcuccg

SEQ ID NO: 3902307 - RNA, 17 nt, Human adenovirus B (HAdV-B)
guuaugaaggaccacca

SEQ ID NO: 3902308 - RNA, 22 nt, Human adenovirus B (HAdV-B)
guugcggaacugauacuugggu

SEQ ID NO: 3902309 - RNA, 17 nt, Human adenovirus B (HAdV-B)
guuggauaaaaguuugg

SEQ ID NO: 3902310 - RNA, 17 nt, Human adenovirus B (HAdV-B)
guuuggacggcuccugg

SEQ ID NO: 3902311 - RNA, 17 nt, Human adenovirus B (HAdV-B)
uaacuuuuguaaauguu

SEQ ID NO: 3902312 - RNA, 16 nt, Human adenovirus B (HAdV-B)
uaagucgcccgaguuu

SEQ ID NO: 3902313 - RNA, 19 nt, Human adenovirus B (HAdV-B)
uaauauugccaugcaggca

SEQ ID NO: 3902314 - RNA, 12 nt, Human adenovirus B (HAdV-B)
uaaucccagaaa

SEQ ID NO: 3902315 - RNA, 16 nt, Human adenovirus B (HAdV-B)
uacaguuucacuuccg

SEQ ID NO: 3902316 - RNA, 17 nt, Human adenovirus B (HAdV-B)
uaccaacacaacaacuc

SEQ ID NO: 3902317 - RNA, 13 nt, Human adenovirus B (HAdV-B)
uaccuuuggaagu

SEQ ID NO: 3902318 - RNA, 14 nt, Human adenovirus B (HAdV-B)
uacggaagccagca

SEQ ID NO: 3902319 - RNA, 19 nt, Human adenovirus B (HAdV-B)
uacuggucgcuuccagaca

SEQ ID NO: 3902320 - RNA, 15 nt, Human adenovirus B (HAdV-B)
uacuuugccagaagg

SEQ ID NO: 3902321 - RNA, 11 nt, Human adenovirus B (HAdV-B)
uagaaacuuuu

SEQ ID NO: 3902322 - RNA, 20 nt, Human adenovirus B (HAdV-B)
uagaagcugcuacagcugcu

SEQ ID NO: 3902323 - RNA, 16 nt, Human adenovirus B (HAdV-B)
uagcgaucuucucaau

SEQ ID NO: 3902324 - RNA, 12 nt, Human adenovirus B (HAdV-B)
uaucaaaugcuc

SEQ ID NO: 3902325 - RNA, 20 nt, Human adenovirus B (HAdV-B)
uauccagcuuuugcugugcc

SEQ ID NO: 3902326 - RNA, 13 nt, Human adenovirus B (HAdV-B)
uaucggaggagga

SEQ ID NO: 3902327 - RNA, 17 nt, Human adenovirus B (HAdV-B)
uaugaagauuuagaagg

SEQ ID NO: 3902328 - RNA, 14 nt, Human adenovirus B (HAdV-B)
uaugagccagagca

SEQ ID NO: 3902329 - RNA, 19 nt, Human adenovirus B (HAdV-B)
uaugcggccuaagagaccu

SEQ ID NO: 3902330 - RNA, 15 nt, Human adenovirus B (HAdV-B)
uauggccuccuagca

SEQ ID NO: 3902331 - RNA, 12 nt, Human adenovirus B (HAdV-B)
uaugugcagcag

SEQ ID NO: 3902332 - RNA, 14 nt, Human adenovirus B (HAdV-B)
uaugugcagcagag

SEQ ID NO: 3902333 - RNA, 20 nt, Human adenovirus B (HAdV-B)
uauugcuugaaagccugcug

SEQ ID NO: 3902334 - RNA, 21 nt, Human adenovirus B (HAdV-B)
uauuguuucccaucaacgcaa

SEQ ID NO: 3902335 - RNA, 20 nt, Human adenovirus B (HAdV-B)
uauuugcaccacacuucugc

SEQ ID NO: 3902336 - RNA, 21 nt, Human adenovirus B (HAdV-B)
ucaaauuuuagcuccucuccu

SEQ ID NO: 3902337 - RNA, 23 nt, Human adenovirus B (HAdV-B)
ucaagagcaggaacugaaaauaa

SEQ ID NO: 3902338 - RNA, 12 nt, Human adenovirus B (HAdV-B)
ucacaccucacu

SEQ ID NO: 3902339 - RNA, 19 nt, Human adenovirus B (HAdV-B)
ucacaucucguccucagcg

SEQ ID NO: 3902340 - RNA, 19 nt, Human adenovirus B (HAdV-B)
ucagcaauaaggucucugu

SEQ ID NO: 3902341 - RNA, 21 nt, Human adenovirus B (HAdV-B)
ucagcugcaaagcuccaagca

SEQ ID NO: 3902342 - RNA, 16 nt, Human adenovirus B (HAdV-B)
ucauccaaauucacca

SEQ ID NO: 3902343 - RNA, 15 nt, Human adenovirus B (HAdV-B)
ucauccuuggcuccg

SEQ ID NO: 3902344 - RNA, 15 nt, Human adenovirus B (HAdV-B)
ucaugccuggagugu

SEQ ID NO: 3902345 - RNA, 19 nt, Human adenovirus B (HAdV-B)
ucaugucuuucuucccaga

SEQ ID NO: 3902346 - RNA, 19 nt, Human adenovirus B (HAdV-B)
ucccaggacuacuccaccc

SEQ ID NO: 3902347 - RNA, 19 nt, Human adenovirus B (HAdV-B)
ucccaguagguuuggaagu

SEQ ID NO: 3902348 - RNA, 20 nt, Human adenovirus B (HAdV-B)
uccccaaauggcuucacaca

SEQ ID NO: 3902349 - RNA, 18 nt, Human adenovirus B (HAdV-B)
uccggaucgcuguccagg

SEQ ID NO: 3902350 - RNA, 22 nt, Human adenovirus B (HAdV-B)
ucgacgcaucucaugacaugca

SEQ ID NO: 3902351 - RNA, 19 nt, Human adenovirus B (HAdV-B)
ucgaggucacacacuucgc

SEQ ID NO: 3902352 - RNA, 11 nt, Human adenovirus B (HAdV-B)
ucgcagcagca

SEQ ID NO: 3902353 - RNA, 15 nt, Human adenovirus B (HAdV-B)
ucuggaagauccuga

SEQ ID NO: 3902354 - RNA, 22 nt, Human adenovirus B (HAdV-B)
ucuucccagagcgucucagggu

SEQ ID NO: 3902355 - RNA, 22 nt, Human adenovirus B (HAdV-B)
ucuucgcugucuugacugaugu

SEQ ID NO: 3902356 - RNA, 14 nt, Human adenovirus B (HAdV-B)
ugaaggaugaaaaa

SEQ ID NO: 3902357 - RNA, 15 nt, Human adenovirus B (HAdV-B)
ugacagaugcgcuug

SEQ ID NO: 3902358 - RNA, 14 nt, Human adenovirus B (HAdV-B)
ugacauuggaaaaa

SEQ ID NO: 3902359 - RNA, 23 nt, Human adenovirus B (HAdV-B)
ugacggauuucugugggacgacg

SEQ ID NO: 3902360 - RNA, 16 nt, Human adenovirus B (HAdV-B)
ugacggcggucaugga

SEQ ID NO: 3902361 - RNA, 22 nt, Human adenovirus B (HAdV-B)
ugacuugucuccugaacugcaa

SEQ ID NO: 3902362 - RNA, 20 nt, Human adenovirus B (HAdV-B)
ugagaaauugguauuugaag

SEQ ID NO: 3902363 - RNA, 21 nt, Human adenovirus B (HAdV-B)
ugagagccgaucgggaagaac

SEQ ID NO: 3902364 - RNA, 22 nt, Human adenovirus B (HAdV-B)
ugagcaauugagauuugccaca

SEQ ID NO: 3902365 - RNA, 17 nt, Human adenovirus B (HAdV-B)
ugagcggagacggcuug

SEQ ID NO: 3902366 - RNA, 23 nt, Human adenovirus B (HAdV-B)
ugaguuacuuucaagauggccac

SEQ ID NO: 3902367 - RNA, 18 nt, Human adenovirus B (HAdV-B)
ugaucuggacuuggaaga

SEQ ID NO: 3902368 - RNA, 18 nt, Human adenovirus B (HAdV-B)
ugaugacgaaguguacca

SEQ ID NO: 3902369 - RNA, 20 nt, Human adenovirus B (HAdV-B)
ugaugcaauccccacuggag

SEQ ID NO: 3902370 - RNA, 22 nt, Human adenovirus B (HAdV-B)
aaucuucaugucuuucuuccca

SEQ ID NO: 3902371 - RNA, 15 nt, Human adenovirus B (HAdV-B)
aaugaaaauaaacuu

SEQ ID NO: 3902372 - RNA, 22 nt, Human adenovirus B (HAdV-B)
aaugagccuaacaggaauuuuu

SEQ ID NO: 3902373 - RNA, 21 nt, Human adenovirus B (HAdV-B)
aauugcaaggccccagcagcc

SEQ ID NO: 3902374 - RNA, 12 nt, Human adenovirus B (HAdV-B)
aauuuggggcgg

SEQ ID NO: 3902375 - RNA, 12 nt, Human adenovirus B (HAdV-B)
acaaaccuggaa

SEQ ID NO: 3902376 - RNA, 19 nt, Human adenovirus B (HAdV-B)
acaacaagugcagcaacag

SEQ ID NO: 3902377 - RNA, 12 nt, Human adenovirus B (HAdV-B)
acaacuuacacu

SEQ ID NO: 3902378 - RNA, 16 nt, Human adenovirus B (HAdV-B)
acaaguacugcgcgcu

SEQ ID NO: 3902379 - RNA, 14 nt, Human adenovirus B (HAdV-B)
acaauauuaacacc

SEQ ID NO: 3902380 - RNA, 18 nt, Human adenovirus B (HAdV-B)
aaaaccugcugcuucucc

SEQ ID NO: 3902381 - RNA, 13 nt, Human adenovirus B (HAdV-B)
aaaauaaacuuug

SEQ ID NO: 3902382 - RNA, 19 nt, Human adenovirus B (HAdV-B)
aaaccucugcuacaacccu

SEQ ID NO: 3902383 - RNA, 22 nt, Human adenovirus B (HAdV-B)
aaaccuggaacagaagacacaa

SEQ ID NO: 3902384 - RNA, 21 nt, Human adenovirus B (HAdV-B)
aaacucgcgccguagaagagg

SEQ ID NO: 3902385 - RNA, 19 nt, Human adenovirus B (HAdV-B)
aaaguggguagacagaaug

SEQ ID NO: 3902386 - RNA, 15 nt, Human adenovirus B (HAdV-B)
aaauauucacuggaa

SEQ ID NO: 3902387 - RNA, 22 nt, Human adenovirus B (HAdV-B)
aacaagugcagcaacaggagga

SEQ ID NO: 3902388 - RNA, 17 nt, Human adenovirus B (HAdV-B)
aacagaaaaccagcagc

SEQ ID NO: 3902389 - RNA, 14 nt, Human adenovirus B (HAdV-B)
aacagcaagcaccg

SEQ ID NO: 3902390 - RNA, 22 nt, Human adenovirus B (HAdV-B)
aacccggcggcgucccagcagu

SEQ ID NO: 3902391 - RNA, 14 nt, Human adenovirus B (HAdV-B)
aacgaagcuuggaa

SEQ ID NO: 3902392 - RNA, 19 nt, Human adenovirus B (HAdV-B)
aacgaggaggcagaggagg

SEQ ID NO: 3902393 - RNA, 23 nt, Human adenovirus B (HAdV-B)
aacgcuaccacguaagaagcuuc

SEQ ID NO: 3902394 - RNA, 13 nt, Human adenovirus B (HAdV-B)
aacuacauuuacg

SEQ ID NO: 3902395 - RNA, 11 nt, Human adenovirus B (HAdV-B)
aacugcacacu

SEQ ID NO: 3902396 - RNA, 19 nt, Human adenovirus B (HAdV-B)
aagacaguuuggaggagga

SEQ ID NO: 3902397 - RNA, 12 nt, Human adenovirus B (HAdV-B)
aagagccaugcu

SEQ ID NO: 3902398 - RNA, 22 nt, Human adenovirus B (HAdV-B)
aagagcuagacgcguggggcga

SEQ ID NO: 3902399 - RNA, 20 nt, Human adenovirus B (HAdV-B)
aagcaccucccaacaccccu

SEQ ID NO: 3902400 - RNA, 13 nt, Human adenovirus B (HAdV-B)
aaggauacaaaga

SEQ ID NO: 3902401 - RNA, 17 nt, Human adenovirus B (HAdV-B)
aaguacgucuagggcgc

SEQ ID NO: 3902402 - RNA, 15 nt, Human adenovirus B (HAdV-B)
aauaaguuuagaaau

SEQ ID NO: 3902403 - RNA, 13 nt, Human adenovirus B (HAdV-B)
aauacaauuucca

SEQ ID NO: 3902404 - RNA, 13 nt, Human adenovirus B (HAdV-B)
aaucaauucacaa

SEQ ID NO: 3902405 - RNA, 16 nt, Human adenovirus B (HAdV-B)
aaucaugcccacaucc

SEQ ID NO: 3902406 - RNA, 17 nt, Human adenovirus B (HAdV-B)
aaucuucccaucaucgu

SEQ ID NO: 3902407 - RNA, 12 nt, Human adenovirus B (HAdV-B)
aaugacagaaug

SEQ ID NO: 3902408 - RNA, 17 nt, Human adenovirus B (HAdV-B)
aauuacaaagacuucaa

SEQ ID NO: 3902409 - RNA, 15 nt, Human adenovirus B (HAdV-B)
aauuacuugaaagug

SEQ ID NO: 3902410 - RNA, 23 nt, Human adenovirus B (HAdV-B)
aauucuaacacuaguuaaaacug

SEQ ID NO: 3902411 - RNA, 18 nt, Human adenovirus B (HAdV-B)
aauugagauuugccacau

SEQ ID NO: 3902412 - RNA, 15 nt, Human adenovirus B (HAdV-B)
aauuggcuccagcaa

SEQ ID NO: 3902413 - RNA, 23 nt, Human adenovirus B (HAdV-B)
acaacagacauggaaacucagcc

SEQ ID NO: 3902414 - RNA, 14 nt, Human adenovirus B (HAdV-B)
acaacuacuuucuc

SEQ ID NO: 3902415 - RNA, 18 nt, Human adenovirus B (HAdV-B)
acaagcucuaaagugacu

SEQ ID NO: 3902416 - RNA, 15 nt, Human adenovirus B (HAdV-B)
acaagcucuuacaga

SEQ ID NO: 3902417 - RNA, 12 nt, Human adenovirus B (HAdV-B)
acaaucuggcaa

SEQ ID NO: 3902418 - RNA, 13 nt, Human adenovirus B (HAdV-B)
acacaucacuucc

SEQ ID NO: 3902419 - RNA, 15 nt, Human adenovirus B (HAdV-B)
acacccuuguguccu

SEQ ID NO: 3902420 - RNA, 15 nt, Human adenovirus B (HAdV-B)
acaccgcuuccaccc

SEQ ID NO: 3902421 - RNA, 23 nt, Human adenovirus B (HAdV-B)
acaccuguuccgacugcagaauc

SEQ ID NO: 3902422 - RNA, 21 nt, Human adenovirus B (HAdV-B)
acagaguucccucgguaacga

SEQ ID NO: 3902423 - RNA, 19 nt, Human adenovirus B (HAdV-B)
acagcaguacaggacaggc

SEQ ID NO: 3902424 - RNA, 18 nt, Human adenovirus B (HAdV-B)
acagcuagaucaaaagaa

SEQ ID NO: 3902425 - RNA, 20 nt, Human adenovirus B (HAdV-B)
accaaaguuuaauauaaauu

SEQ ID NO: 3902426 - RNA, 12 nt, Human adenovirus B (HAdV-B)
acccaaccagcg

SEQ ID NO: 3902427 - RNA, 23 nt, Human adenovirus B (HAdV-B)
acccugauugcccgcgaagaagu

SEQ ID NO: 3902428 - RNA, 22 nt, Human adenovirus B (HAdV-B)
accgcaaugguagugcggaacc

SEQ ID NO: 3902429 - RNA, 17 nt, Human adenovirus B (HAdV-B)
accgucagccaugggca

SEQ ID NO: 3902430 - RNA, 13 nt, Human adenovirus B (HAdV-B)
accuccacugaag

SEQ ID NO: 3902431 - RNA, 15 nt, Human adenovirus B (HAdV-B)
accuuuggaaguuuu

SEQ ID NO: 3902432 - RNA, 18 nt, Human adenovirus B (HAdV-B)
acgcaaaaaauggccugu

SEQ ID NO: 3902433 - RNA, 13 nt, Human adenovirus B (HAdV-B)
acgcucuucuccu

SEQ ID NO: 3902434 - RNA, 15 nt, Human adenovirus B (HAdV-B)
acggagggcagaaac

SEQ ID NO: 3902435 - RNA, 20 nt, Human adenovirus B (HAdV-B)
acguggaacucaccaaccug

SEQ ID NO: 3902436 - RNA, 14 nt, Human adenovirus B (HAdV-B)
cugaagugcccauc

SEQ ID NO: 3902437 - RNA, 15 nt, Human adenovirus B (HAdV-B)
cugagaguuucauga

SEQ ID NO: 3902438 - RNA, 22 nt, Human adenovirus B (HAdV-B)
cugcaacgaauuuucucccagc

SEQ ID NO: 3902439 - RNA, 16 nt, Human adenovirus B (HAdV-B)
cugcacacuuacuuuu

SEQ ID NO: 3902440 - RNA, 12 nt, Human adenovirus B (HAdV-B)
cugccccauggc

SEQ ID NO: 3902441 - RNA, 19 nt, Human adenovirus B (HAdV-B)
cugccugguuauuaauuuu

SEQ ID NO: 3902442 - RNA, 15 nt, Human adenovirus B (HAdV-B)
cugcuacgaagagcu

SEQ ID NO: 3902443 - RNA, 16 nt, Human adenovirus B (HAdV-B)
cugcugcuguggcuuu

SEQ ID NO: 3902444 - RNA, 17 nt, Human adenovirus B (HAdV-B)
cugcugcuucucccagg

SEQ ID NO: 3902445 - RNA, 16 nt, Human adenovirus B (HAdV-B)
cuggacuuggaagagg

SEQ ID NO: 3902446 - RNA, 19 nt, Human adenovirus B (HAdV-B)
cuggaggaagacaguuugg

SEQ ID NO: 3902447 - RNA, 17 nt, Human adenovirus B (HAdV-B)
cuggagugucacugccg

SEQ ID NO: 3902448 - RNA, 12 nt, Human adenovirus B (HAdV-B)
cuggccacaucc

SEQ ID NO: 3902449 - RNA, 18 nt, Human adenovirus B (HAdV-B)
cuggcccaauugcaagcc

SEQ ID NO: 3902450 - RNA, 20 nt, Human adenovirus B (HAdV-B)
cugucaaaucaugaacucca

SEQ ID NO: 3902451 - RNA, 14 nt, Human adenovirus B (HAdV-B)
cugugcgaggauga

SEQ ID NO: 3902452 - RNA, 19 nt, Human adenovirus B (HAdV-B)
cugugcgaggaugagagcc

SEQ ID NO: 3902453 - RNA, 19 nt, Human adenovirus B (HAdV-B)
cuguuaaaaaccugcugcu

SEQ ID NO: 3902454 - RNA, 15 nt, Human adenovirus B (HAdV-B)
cuuacauagaagagg

SEQ ID NO: 3902455 - RNA, 18 nt, Human adenovirus B (HAdV-B)
cuuacauugauuaauguu

SEQ ID NO: 3902456 - RNA, 19 nt, Human adenovirus B (HAdV-B)
cuucaaccccuucuccgga

SEQ ID NO: 3902457 - RNA, 20 nt, Human adenovirus B (HAdV-B)
cuucccagagcgucucaggg

SEQ ID NO: 3902458 - RNA, 23 nt, Human adenovirus B (HAdV-B)
cuucguacgagagcgugaugcag

SEQ ID NO: 3902459 - RNA, 14 nt, Human adenovirus B (HAdV-B)
cuugaaagugggua

SEQ ID NO: 3902460 - RNA, 18 nt, Human adenovirus B (HAdV-B)
cuuugauauaaucugcaa

SEQ ID NO: 3902461 - RNA, 18 nt, Human adenovirus B (HAdV-B)
cuuuuaaaacgcacugug

SEQ ID NO: 3902462 - RNA, 23 nt, Human adenovirus B (HAdV-B)
gaaccucagcugggagaugaaac

SEQ ID NO: 3902463 - RNA, 19 nt, Human adenovirus B (HAdV-B)
gaacugauuaacugccuug

SEQ ID NO: 3902464 - RNA, 23 nt, Human adenovirus B (HAdV-B)
gaagauugggacagucaggcaga

SEQ ID NO: 3902465 - RNA, 17 nt, Human adenovirus B (HAdV-B)
gaagcguugauuacuuu

SEQ ID NO: 3902466 - RNA, 17 nt, Human adenovirus B (HAdV-B)
gaaguugaaggugcagc

SEQ ID NO: 3902467 - RNA, 16 nt, Human adenovirus B (HAdV-B)
gaauaccgcaaccaaa

SEQ ID NO: 3902468 - RNA, 13 nt, Human adenovirus B (HAdV-B)
ucaugcaacccaa

SEQ ID NO: 3902469 - RNA, 16 nt, Human adenovirus B (HAdV-B)
ucauucacacagcagc

SEQ ID NO: 3902470 - RNA, 16 nt, Human adenovirus B (HAdV-B)
uccaaccucuccacaa

SEQ ID NO: 3902471 - RNA, 13 nt, Human adenovirus B (HAdV-B)
uccaucagcagac

SEQ ID NO: 3902472 - RNA, 19 nt, Human adenovirus B (HAdV-B)
uccaugccuuucucccaag

SEQ ID NO: 3902473 - RNA, 16 nt, Human adenovirus B (HAdV-B)
ucccagaguuggaagu

SEQ ID NO: 3902474 - RNA, 18 nt, Human adenovirus B (HAdV-B)
ucccagggauuuggaaga

SEQ ID NO: 3902475 - RNA, 16 nt, Human adenovirus B (HAdV-B)
ucccauagacaaggag

SEQ ID NO: 3902476 - RNA, 18 nt, Human adenovirus B (HAdV-B)
ucccgacgaaaguacggu

SEQ ID NO: 3902477 - RNA, 12 nt, Human adenovirus B (HAdV-B)
ucccuggcuccu

SEQ ID NO: 3902478 - RNA, 23 nt, Human adenovirus B (HAdV-B)
uccuaggcagagaaacaacagac

SEQ ID NO: 3902479 - RNA, 18 nt, Human adenovirus B (HAdV-B)
uccugcaccauucccaga

SEQ ID NO: 3902480 - RNA, 20 nt, Human adenovirus B (HAdV-B)
uccugcccgccaccugcugc

SEQ ID NO: 3902481 - RNA, 17 nt, Human adenovirus B (HAdV-B)
ucgcagcagcagcagca

SEQ ID NO: 3902482 - RNA, 12 nt, Human adenovirus B (HAdV-B)
ucgcugcuuugc

SEQ ID NO: 3902483 - RNA, 14 nt, Human adenovirus B (HAdV-B)
ucgcuuccgaccug

SEQ ID NO: 3902484 - RNA, 23 nt, Human adenovirus B (HAdV-B)
ucgcuuuuggaaccggguucugc

SEQ ID NO: 3902485 - RNA, 15 nt, Human adenovirus B (HAdV-B)
ucgggcgccagcgcc

SEQ ID NO: 3902486 - RNA, 16 nt, Human adenovirus B (HAdV-B)
ucguuauccagccugu

SEQ ID NO: 3902487 - RNA, 17 nt, Human adenovirus B (HAdV-B)
ucuacagauacuggaug

SEQ ID NO: 3902488 - RNA, 15 nt, Human adenovirus B (HAdV-B)
ucuaccacuccagca

SEQ ID NO: 3902489 - RNA, 15 nt, Human adenovirus B (HAdV-B)
ucuaccgccagugcu

SEQ ID NO: 3902490 - RNA, 17 nt, Human adenovirus B (HAdV-B)
ucuccggaucuccuggg

SEQ ID NO: 3902491 - RNA, 20 nt, Human adenovirus B (HAdV-B)
ucucgacagauaaagacagc

SEQ ID NO: 3902492 - RNA, 20 nt, Human adenovirus B (HAdV-B)
ucucugcguucgcucaccag

SEQ ID NO: 3902493 - RNA, 19 nt, Human adenovirus B (HAdV-B)
ucugcaacggcagagaccu

SEQ ID NO: 3902494 - RNA, 20 nt, Human adenovirus B (HAdV-B)
ucuggggucuuguugccauc

SEQ ID NO: 3902495 - RNA, 18 nt, Human adenovirus B (HAdV-B)
ucuugcuugacucucugg

SEQ ID NO: 3902496 - RNA, 14 nt, Human adenovirus B (HAdV-B)
ucuugcuugcuauc

SEQ ID NO: 3902497 - RNA, 21 nt, Human adenovirus B (HAdV-B)
ugaaaccauuugguggcauga

SEQ ID NO: 3902498 - RNA, 11 nt, Human adenovirus B (HAdV-B)
ugaaagagcuu

SEQ ID NO: 3902499 - RNA, 22 nt, Human adenovirus B (HAdV-B)
ugaaagcaccucccaacacccc

SEQ ID NO: 3902500 - RNA, 19 nt, Human adenovirus B (HAdV-B)
ugaacaugcaaaucuggaa

SEQ ID NO: 3902501 - RNA, 16 nt, Human adenovirus B (HAdV-B)
ugaaggugcagccgcc

SEQ ID NO: 3902502 - RNA, 23 nt, Human adenovirus B (HAdV-B)
ugaccugggguccccgcuggggg

SEQ ID NO: 3902503 - RNA, 15 nt, Human adenovirus B (HAdV-B)
ugacuugucuccuga

SEQ ID NO: 3902504 - RNA, 13 nt, Human adenovirus B (HAdV-B)
ugagaauuggaag

SEQ ID NO: 3902505 - RNA, 16 nt, Human adenovirus B (HAdV-B)
ugagaauuggaagaga

SEQ ID NO: 3902506 - RNA, 22 nt, Human adenovirus B (HAdV-B)
ugagaggccuuaucaaaugcuc

SEQ ID NO: 3902507 - RNA, 22 nt, Human adenovirus B (HAdV-B)
ugagcagcuaacccgauggcug

SEQ ID NO: 3902508 - RNA, 17 nt, Human adenovirus B (HAdV-B)
ugaucaugccuggagug

SEQ ID NO: 3902509 - RNA, 22 nt, Human adenovirus B (HAdV-B)
ugaugaaggauccugucacuuu

SEQ ID NO: 3902510 - RNA, 13 nt, Human adenovirus B (HAdV-B)
ugaugcagcagca

SEQ ID NO: 3902511 - RNA, 15 nt, Human adenovirus B (HAdV-B)
ugaugcagcagcagc

SEQ ID NO: 3902512 - RNA, 20 nt, Human adenovirus B (HAdV-B)
ugcaaauuaauucuaacacu

SEQ ID NO: 3902513 - RNA, 18 nt, Human adenovirus B (HAdV-B)
ugcaaggccccagcagcc

SEQ ID NO: 3902514 - RNA, 18 nt, Human adenovirus B (HAdV-B)
ugcacaguuugcaaagag

SEQ ID NO: 3902515 - RNA, 21 nt, Human adenovirus B (HAdV-B)
ugcagaggcauacaugccaca

SEQ ID NO: 3902516 - RNA, 17 nt, Human adenovirus B (HAdV-B)
ugcaguuauugacagug

SEQ ID NO: 3902517 - RNA, 20 nt, Human adenovirus B (HAdV-B)
ugccaucaucuccugcuugc

SEQ ID NO: 3902518 - RNA, 19 nt, Human adenovirus B (HAdV-B)
ugccucccccuucccauuu

SEQ ID NO: 3902519 - RNA, 17 nt, Human adenovirus B (HAdV-B)
ugcgccuaauuggaagg

SEQ ID NO: 3902520 - RNA, 21 nt, Human adenovirus B (HAdV-B)
ugcgccuucacccgagcggca

SEQ ID NO: 3902521 - RNA, 21 nt, Human adenovirus B (HAdV-B)
ugcgggcggcgcugcagagcc

SEQ ID NO: 3902522 - RNA, 16 nt, Human adenovirus B (HAdV-B)
ugcugcuucucccagg

SEQ ID NO: 3902523 - RNA, 22 nt, Human adenovirus B (HAdV-B)
ugcuggacuugggugggagagg

SEQ ID NO: 3902524 - RNA, 16 nt, Human adenovirus B (HAdV-B)
uggacccaggccaugc

SEQ ID NO: 3902525 - RNA, 15 nt, Human adenovirus B (HAdV-B)
ugggaugggugagug

SEQ ID NO: 3902526 - RNA, 23 nt, Human adenovirus B (HAdV-B)
ugggucgcgguguaccccgguuc

SEQ ID NO: 3902527 - RNA, 18 nt, Human adenovirus B (HAdV-B)
ugguuaccgaggaagaaa

SEQ ID NO: 3902528 - RNA, 13 nt, Human adenovirus B (HAdV-B)
ugguuugaugcau

SEQ ID NO: 3902529 - RNA, 17 nt, Human adenovirus B (HAdV-B)
uguaaauguuaaguuua

SEQ ID NO: 3902530 - RNA, 19 nt, Human adenovirus B (HAdV-B)
uguaucgcaaugacagaau

SEQ ID NO: 3902531 - RNA, 12 nt, Human adenovirus B (HAdV-B)
uguaucuggugg

SEQ ID NO: 3902532 - RNA, 19 nt, Human adenovirus B (HAdV-B)
uguaugucggccaaguagc

SEQ ID NO: 3902533 - RNA, 19 nt, Human adenovirus B (HAdV-B)
uguggguuacauggcuccg

SEQ ID NO: 3902534 - RNA, 12 nt, Human adenovirus B (HAdV-B)
uguguagaugcc

SEQ ID NO: 3902535 - RNA, 14 nt, Human adenovirus B (HAdV-B)
uguuaacuguucac

SEQ ID NO: 3902536 - RNA, 18 nt, Human adenovirus B (HAdV-B)
uguugaucaccugggcag

SEQ ID NO: 3902537 - RNA, 12 nt, Human adenovirus B (HAdV-B)
uuacacucucau

SEQ ID NO: 3902538 - RNA, 20 nt, Human adenovirus B (HAdV-B)
uuacaguggaugacaccaac

SEQ ID NO: 3902539 - RNA, 19 nt, Human adenovirus B (HAdV-B)
uuaccccuacggaagccag

SEQ ID NO: 3902540 - RNA, 15 nt, Human adenovirus B (HAdV-B)
uucaaguacaaccac

SEQ ID NO: 3902541 - RNA, 22 nt, Human adenovirus B (HAdV-B)
uuccaacaaccaguuacaaauc

SEQ ID NO: 3902542 - RNA, 11 nt, Human adenovirus B (HAdV-B)
uuccagucucc

SEQ ID NO: 3902543 - RNA, 15 nt, Human adenovirus B (HAdV-B)
uucccagauaauuuu

SEQ ID NO: 3902544 - RNA, 13 nt, Human adenovirus B (HAdV-B)
uuccgagggugga

SEQ ID NO: 3902545 - RNA, 16 nt, Human adenovirus B (HAdV-B)
uucuacagauacugga

SEQ ID NO: 3902546 - RNA, 22 nt, Human adenovirus B (HAdV-B)
uucuaugcguguuggauugcca

SEQ ID NO: 3902547 - RNA, 14 nt, Human adenovirus B (HAdV-B)
uucucccagcagca

SEQ ID NO: 3902548 - RNA, 13 nt, Human adenovirus B (HAdV-B)
uucuggaggagga

SEQ ID NO: 3902549 - RNA, 15 nt, Human adenovirus B (HAdV-B)
uugaaaaucaauuca

SEQ ID NO: 3902550 - RNA, 19 nt, Human adenovirus B (HAdV-B)
uugaaauuuucucccagca

SEQ ID NO: 3902551 - RNA, 23 nt, Human adenovirus B (HAdV-B)
uugaugaaaugacagggaucagu

SEQ ID NO: 3902552 - RNA, 22 nt, Human adenovirus B (HAdV-B)
uugcaagccauccaaaaauccc

SEQ ID NO: 3902553 - RNA, 18 nt, Human adenovirus B (HAdV-B)
uugcuagauggaacagca

SEQ ID NO: 3902554 - RNA, 13 nt, Human adenovirus B (HAdV-B)
uuggaagagaugg

SEQ ID NO: 3902555 - RNA, 16 nt, Human adenovirus B (HAdV-B)
uugggcgcuugccagg

SEQ ID NO: 3902556 - RNA, 17 nt, Human adenovirus B (HAdV-B)
uuguugguagauugccc

SEQ ID NO: 3902557 - RNA, 15 nt, Human adenovirus B (HAdV-B)
uuuaacuuguuuauu

SEQ ID NO: 3902558 - RNA, 14 nt, Human adenovirus B (HAdV-B)
uuucuacacgggcg

SEQ ID NO: 3902559 - RNA, 12 nt, Human adenovirus B (HAdV-B)
uuuucucccagc

SEQ ID NO: 3902560 - RNA, 15 nt, Human adenovirus B (HAdV-B)
uuuuugaucacaaug

SEQ ID NO: 3902561 - RNA, 22 nt, Human adenovirus B (HAdV-B)
caacgagcagauaacuaucacc

SEQ ID NO: 3902562 - RNA, 21 nt, Human adenovirus B (HAdV-B)
caagaaguugaaggugcagcc

SEQ ID NO: 3902563 - RNA, 16 nt, Human adenovirus B (HAdV-B)
caaggucgcagugcau

SEQ ID NO: 3902564 - RNA, 20 nt, Human adenovirus B (HAdV-B)
caagugcagcaacaggagga

SEQ ID NO: 3902565 - RNA, 18 nt, Human adenovirus B (HAdV-B)
caaucacagccuccaaag

SEQ ID NO: 3902566 - RNA, 22 nt, Human adenovirus B (HAdV-B)
caaugcugaacggggucaucuu

SEQ ID NO: 3902567 - RNA, 17 nt, Human adenovirus B (HAdV-B)
cacagcaguagccacag

SEQ ID NO: 3902568 - RNA, 21 nt, Human adenovirus B (HAdV-B)
caccgucgcuuccgaccuggc

SEQ ID NO: 3902569 - RNA, 18 nt, Human adenovirus B (HAdV-B)
caccucagaugucaccug

SEQ ID NO: 3902570 - RNA, 13 nt, Human adenovirus B (HAdV-B)
cacgaggaagagu

SEQ ID NO: 3902571 - RNA, 13 nt, Human adenovirus B (HAdV-B)
cagaagacaugca

SEQ ID NO: 3902572 - RNA, 16 nt, Human adenovirus B (HAdV-B)
cagaagacaugcauga

SEQ ID NO: 3902573 - RNA, 16 nt, Human adenovirus B (HAdV-B)
cagaagauauggagga

SEQ ID NO: 3902574 - RNA, 12 nt, Human adenovirus B (HAdV-B)
cagaagcggcga

SEQ ID NO: 3902575 - RNA, 13 nt, Human adenovirus B (HAdV-B)
cagauucaaugau

SEQ ID NO: 3902576 - RNA, 14 nt, Human adenovirus B (HAdV-B)
cagcacccagacca

SEQ ID NO: 3902577 - RNA, 14 nt, Human adenovirus B (HAdV-B)
cagcacgacugccu

SEQ ID NO: 3902578 - RNA, 18 nt, Human adenovirus B (HAdV-B)
cagcagcaccucacuucc

SEQ ID NO: 3902579 - RNA, 14 nt, Human adenovirus B (HAdV-B)
cagcagcuccuuua

SEQ ID NO: 3902580 - RNA, 21 nt, Human adenovirus B (HAdV-B)
cagcaguacaggacaggcgcu

SEQ ID NO: 3902581 - RNA, 19 nt, Human adenovirus B (HAdV-B)
cagcauuggcaaugcugaa

SEQ ID NO: 3902582 - RNA, 13 nt, Human adenovirus B (HAdV-B)
cagcgaccgcgcu

SEQ ID NO: 3902583 - RNA, 12 nt, Human adenovirus B (HAdV-B)
cagcgcuaccau

SEQ ID NO: 3902584 - RNA, 19 nt, Human adenovirus B (HAdV-B)
cagcgggcacacaaagcac

SEQ ID NO: 3902585 - RNA, 13 nt, Human adenovirus B (HAdV-B)
cagcuguuggggu

SEQ ID NO: 3902586 - RNA, 16 nt, Human adenovirus B (HAdV-B)
caggagcggagccugg

SEQ ID NO: 3902587 - RNA, 20 nt, Human adenovirus B (HAdV-B)
caggcauuaguuuaaaagag

SEQ ID NO: 3902588 - RNA, 21 nt, Human adenovirus B (HAdV-B)
caggcauuaguuuaaaagagg

SEQ ID NO: 3902589 - RNA, 13 nt, Human adenovirus B (HAdV-B)
caggcgacggcgg

SEQ ID NO: 3902590 - RNA, 14 nt, Human adenovirus B (HAdV-B)
cagggcucugagcg

SEQ ID NO: 3902591 - RNA, 14 nt, Human adenovirus B (HAdV-B)
caguauaggcauuu

SEQ ID NO: 3902592 - RNA, 17 nt, Human adenovirus B (HAdV-B)
cagucaggcagaggagg

SEQ ID NO: 3902593 - RNA, 16 nt, Human adenovirus B (HAdV-B)
caguccugccaccacc

SEQ ID NO: 3902594 - RNA, 12 nt, Human adenovirus B (HAdV-B)
caguugaaaacc

SEQ ID NO: 3902595 - RNA, 22 nt, Human adenovirus B (HAdV-B)
caguuugcaaagagcucugacu

SEQ ID NO: 3902596 - RNA, 15 nt, Human adenovirus B (HAdV-B)
cauagauaauuacuu

SEQ ID NO: 3902597 - RNA, 12 nt, Human adenovirus B (HAdV-B)
cauagccacagc

SEQ ID NO: 3902598 - RNA, 23 nt, Human adenovirus B (HAdV-B)
caucauuucccuuacaugcauau

SEQ ID NO: 3902599 - RNA, 19 nt, Human adenovirus B (HAdV-B)
cauccgaguaucaucacuu

SEQ ID NO: 3902600 - RNA, 18 nt, Human adenovirus B (HAdV-B)
caucuacuguggaugcag

SEQ ID NO: 3902601 - RNA, 23 nt, Human adenovirus B (HAdV-B)
cauuacuaccgucaccuccacag

SEQ ID NO: 3902602 - RNA, 13 nt, Human adenovirus B (HAdV-B)
cauugcagccaug

SEQ ID NO: 3902603 - RNA, 17 nt, Human adenovirus B (HAdV-B)
cauugcuucucugaacu

SEQ ID NO: 3902604 - RNA, 15 nt, Human adenovirus B (HAdV-B)
cauuuuaaugaauuu

SEQ ID NO: 3902605 - RNA, 19 nt, Human adenovirus B (HAdV-B)
ccaaaggaucccauccagg

SEQ ID NO: 3902606 - RNA, 12 nt, Human adenovirus B (HAdV-B)
ccaaugccaucu

SEQ ID NO: 3902607 - RNA, 21 nt, Human adenovirus B (HAdV-B)
ccaaugucacucuuccagaaa

SEQ ID NO: 3902608 - RNA, 16 nt, Human adenovirus B (HAdV-B)
ccacacuucugcccca

SEQ ID NO: 3902609 - RNA, 16 nt, Human adenovirus B (HAdV-B)
ccacagggucuccagc

SEQ ID NO: 3902610 - RNA, 13 nt, Human adenovirus B (HAdV-B)
ccaccccucgcgg

SEQ ID NO: 3902611 - RNA, 20 nt, Human adenovirus B (HAdV-B)
ccacguaagaagcuucuugc

SEQ ID NO: 3902612 - RNA, 19 nt, Human adenovirus B (HAdV-B)
ccagaccggcgaggaacuc

SEQ ID NO: 3902613 - RNA, 20 nt, Human adenovirus B (HAdV-B)
ccagcagcaccucacuuccc

SEQ ID NO: 3902614 - RNA, 16 nt, Human adenovirus B (HAdV-B)
ccagcggcgaggaugu

SEQ ID NO: 3902615 - RNA, 20 nt, Human adenovirus B (HAdV-B)
ccaggcauagcuuccguggc

SEQ ID NO: 3902616 - RNA, 17 nt, Human adenovirus B (HAdV-B)
ccaucaguguggaagag

SEQ ID NO: 3902617 - RNA, 14 nt, Human adenovirus B (HAdV-B)
ccaucuuccagcag

SEQ ID NO: 3902618 - RNA, 16 nt, Human adenovirus B (HAdV-B)
ccaugcaugcaggugg

SEQ ID NO: 3902619 - RNA, 19 nt, Human adenovirus B (HAdV-B)
ccaugcgagccgcaagagc

SEQ ID NO: 3902620 - RNA, 16 nt, Human adenovirus B (HAdV-B)
ccaugugaccaaccug

SEQ ID NO: 3902621 - RNA, 13 nt, Human adenovirus B (HAdV-B)
ccauguuaauuuu

SEQ ID NO: 3902622 - RNA, 15 nt, Human adenovirus B (HAdV-B)
ccauuugguggcaug

SEQ ID NO: 3902623 - RNA, 13 nt, Human adenovirus B (HAdV-B)
cccagcagccaag

SEQ ID NO: 3902624 - RNA, 22 nt, Human adenovirus B (HAdV-B)
cccagggaauaggaagcucuug

SEQ ID NO: 3902625 - RNA, 13 nt, Human adenovirus B (HAdV-B)
cccaucgaugcug

SEQ ID NO: 3902626 - RNA, 18 nt, Human adenovirus B (HAdV-B)
ccccagcagccaaggcga

SEQ ID NO: 3902627 - RNA, 17 nt, Human adenovirus B (HAdV-B)
ccccuacuauagccagc

SEQ ID NO: 3902628 - RNA, 15 nt, Human adenovirus B (HAdV-B)
ccccucccccugcug

SEQ ID NO: 3902629 - RNA, 16 nt, Human adenovirus B (HAdV-B)
cccgaacccaaccagc

SEQ ID NO: 3902630 - RNA, 21 nt, Human adenovirus B (HAdV-B)
cccgacgaaaguacgguccag

SEQ ID NO: 3902631 - RNA, 14 nt, Human adenovirus B (HAdV-B)
cccuaugaaaucaa

SEQ ID NO: 3902632 - RNA, 22 nt, Human adenovirus B (HAdV-B)
cccuguggugggugcagagcuu

SEQ ID NO: 3902633 - RNA, 13 nt, Human adenovirus B (HAdV-B)
ccgacugcagaau

SEQ ID NO: 3902634 - RNA, 14 nt, Human adenovirus B (HAdV-B)
ccgcacuggcugcc

SEQ ID NO: 3902635 - RNA, 18 nt, Human adenovirus B (HAdV-B)
ccgcuuucgcagcggcga

SEQ ID NO: 3902636 - RNA, 18 nt, Human adenovirus B (HAdV-B)
ccggagacagggaggauu

SEQ ID NO: 3902637 - RNA, 16 nt, Human adenovirus B (HAdV-B)
ccggccggagccgcgg

SEQ ID NO: 3902638 - RNA, 12 nt, Human adenovirus B (HAdV-B)
ccgucuggccaa

SEQ ID NO: 3902639 - RNA, 17 nt, Human adenovirus B (HAdV-B)
ccguucucgcuggccac

SEQ ID NO: 3902640 - RNA, 22 nt, Human adenovirus B (HAdV-B)
ccuaacaggaauuuuugacaug

SEQ ID NO: 3902641 - RNA, 13 nt, Human adenovirus B (HAdV-B)
ccuaugcacuuuu

SEQ ID NO: 3902642 - RNA, 19 nt, Human adenovirus B (HAdV-B)
ccucaaaaacacacuaccc

SEQ ID NO: 3902643 - RNA, 15 nt, Human adenovirus B (HAdV-B)
ccucaucuucccaga

SEQ ID NO: 3902644 - RNA, 21 nt, Human adenovirus B (HAdV-B)
ccugauuacuucuuucagacu

SEQ ID NO: 3902645 - RNA, 19 nt, Human adenovirus B (HAdV-B)
ccugcagaaaucuucccau

SEQ ID NO: 3902646 - RNA, 17 nt, Human adenovirus B (HAdV-B)
ccugcccgccaccugcu

SEQ ID NO: 3902647 - RNA, 13 nt, Human adenovirus B (HAdV-B)
ccugcugcuucuc

SEQ ID NO: 3902648 - RNA, 20 nt, Human adenovirus B (HAdV-B)
ccuggacccuccaguggagg

SEQ ID NO: 3902649 - RNA, 14 nt, Human adenovirus B (HAdV-B)
ccuucaccccucgu

SEQ ID NO: 3902650 - RNA, 12 nt, Human adenovirus B (HAdV-B)
ccuuggaagagg

SEQ ID NO: 3902651 - RNA, 21 nt, Human adenovirus B (HAdV-B)
ccuuuggguguagcgggaauc

SEQ ID NO: 3902652 - RNA, 19 nt, Human adenovirus B (HAdV-B)
cgaacccgaggggagaugg

SEQ ID NO: 3902653 - RNA, 21 nt, Human adenovirus B (HAdV-B)
cgaagcaucgaggucacacac

SEQ ID NO: 3902654 - RNA, 11 nt, Human adenovirus B (HAdV-B)
cgaagugggua

SEQ ID NO: 3902655 - RNA, 21 nt, Human adenovirus B (HAdV-B)
cgacgcaucucaugacaugca

SEQ ID NO: 3902656 - RNA, 17 nt, Human adenovirus B (HAdV-B)
cgagaaaaaacagccaa

SEQ ID NO: 3902657 - RNA, 16 nt, Human adenovirus B (HAdV-B)
cgagagcgugaugcag

SEQ ID NO: 3902658 - RNA, 18 nt, Human adenovirus B (HAdV-B)
cgagagcgugaugcagca

SEQ ID NO: 3902659 - RNA, 17 nt, Human adenovirus B (HAdV-B)
cgaggaggcagaggagg

SEQ ID NO: 3902660 - RNA, 18 nt, Human adenovirus B (HAdV-B)
cgaggaggcagaggaggu

SEQ ID NO: 3902661 - RNA, 22 nt, Human adenovirus B (HAdV-B)
cgaguuuaaugggcgaagagga

SEQ ID NO: 3902662 - RNA, 19 nt, Human adenovirus B (HAdV-B)
cgaugggucuucuccuggg

SEQ ID NO: 3902663 - RNA, 16 nt, Human adenovirus B (HAdV-B)
cgaugugucugaagga

SEQ ID NO: 3902664 - RNA, 16 nt, Human adenovirus B (HAdV-B)
cgccacgagugccauc

SEQ ID NO: 3902665 - RNA, 22 nt, Human adenovirus B (HAdV-B)
cgcguucgggggugugcucccu

SEQ ID NO: 3902666 - RNA, 15 nt, Human adenovirus B (HAdV-B)
cgcugucaaccugcc

SEQ ID NO: 3902667 - RNA, 19 nt, Human adenovirus B (HAdV-B)
cgcugucaaccugcccccu

SEQ ID NO: 3902668 - RNA, 18 nt, Human adenovirus B (HAdV-B)
cggaggaggacagucugg

SEQ ID NO: 3902669 - RNA, 13 nt, Human adenovirus B (HAdV-B)
cggaugacuggca

SEQ ID NO: 3902670 - RNA, 11 nt, Human adenovirus B (HAdV-B)
cggcaccugcg

SEQ ID NO: 3902671 - RNA, 21 nt, Human adenovirus B (HAdV-B)
cggcgaggauguccaagcgca

SEQ ID NO: 3902672 - RNA, 20 nt, Human adenovirus B (HAdV-B)
cgggccgcaaaugcucugca

SEQ ID NO: 3902673 - RNA, 17 nt, Human adenovirus B (HAdV-B)
cgggcggcgcugcagag

SEQ ID NO: 3902674 - RNA, 18 nt, Human adenovirus B (HAdV-B)
cgguaaaucugagccaag

SEQ ID NO: 3902675 - RNA, 21 nt, Human adenovirus B (HAdV-B)
cggugcgggacagcccgccua

SEQ ID NO: 3902676 - RNA, 13 nt, Human adenovirus B (HAdV-B)
cgguucuggagga

SEQ ID NO: 3902677 - RNA, 19 nt, Human adenovirus B (HAdV-B)
cuagucuuaaaccggucac

SEQ ID NO: 3902678 - RNA, 13 nt, Human adenovirus B (HAdV-B)
cuaugagaacagu

SEQ ID NO: 3902679 - RNA, 20 nt, Human adenovirus B (HAdV-B)
cuaugggggcccuuacagac

SEQ ID NO: 3902680 - RNA, 17 nt, Human adenovirus B (HAdV-B)
cuauuuagagacagaag

SEQ ID NO: 3902681 - RNA, 23 nt, Human adenovirus B (HAdV-B)
cucaacacaagguucccucagga

SEQ ID NO: 3902682 - RNA, 19 nt, Human adenovirus B (HAdV-B)
cucaguacgauaccaccag

SEQ ID NO: 3902683 - RNA, 20 nt, Human adenovirus B (HAdV-B)
cucauaaugacaaaauaucu

SEQ ID NO: 3902684 - RNA, 16 nt, Human adenovirus B (HAdV-B)
cucaugaaagcaucau

SEQ ID NO: 3902685 - RNA, 22 nt, Human adenovirus B (HAdV-B)
cuccacagccccuacuauagcc

SEQ ID NO: 3902686 - RNA, 14 nt, Human adenovirus B (HAdV-B)
cuccauggggcgcc

SEQ ID NO: 3902687 - RNA, 23 nt, Human adenovirus B (HAdV-B)
cuccuacggacugccgcuucuuc

SEQ ID NO: 3902688 - RNA, 19 nt, Human adenovirus B (HAdV-B)
cucgauaaucugcuccuuc

SEQ ID NO: 3902689 - RNA, 17 nt, Human adenovirus B (HAdV-B)
cucgggauucuccuuua

SEQ ID NO: 3902690 - RNA, 19 nt, Human adenovirus B (HAdV-B)
cucugggaugcaaaugcaa

SEQ ID NO: 3902691 - RNA, 16 nt, Human adenovirus B (HAdV-B)
cucuuacagaaaucuc

SEQ ID NO: 3902692 - RNA, 15 nt, Human adenovirus B (HAdV-B)
cugaacgggggcgcc

SEQ ID NO: 3902693 - RNA, 13 nt, Human adenovirus B (HAdV-B)
cugaguuggcuuu

SEQ ID NO: 3902694 - RNA, 21 nt, Human adenovirus B (HAdV-B)
cugcaacgaauuuucucccag

SEQ ID NO: 3902695 - RNA, 22 nt, Human adenovirus B (HAdV-B)
cugccaggguucgguccuucca

SEQ ID NO: 3902696 - RNA, 23 nt, Human adenovirus B (HAdV-B)
cugccaugcgagccgcaagagcu

SEQ ID NO: 3902697 - RNA, 13 nt, Human adenovirus B (HAdV-B)
cugcgcacugccc

SEQ ID NO: 3902698 - RNA, 20 nt, Human adenovirus B (HAdV-B)
cugcuuugcccgggaacuca

SEQ ID NO: 3902699 - RNA, 22 nt, Human adenovirus B (HAdV-B)
cuggaaauggggcugagguggu

SEQ ID NO: 3902700 - RNA, 24 nt, Human adenovirus B (HAdV-B)
cuggaauaggguaugagacgaugg

SEQ ID NO: 3902701 - RNA, 20 nt, Human adenovirus B (HAdV-B)
cuggcggcuccacccuaugu

SEQ ID NO: 3902702 - RNA, 15 nt, Human adenovirus B (HAdV-B)
cuggcuacugugcau

SEQ ID NO: 3902703 - RNA, 14 nt, Human adenovirus B (HAdV-B)
cugggcgacagaac

SEQ ID NO: 3902704 - RNA, 19 nt, Human adenovirus B (HAdV-B)
cugguggugcaacacagca

SEQ ID NO: 3902705 - RNA, 15 nt, Human adenovirus B (HAdV-B)
cugucgcuuggcgcc

SEQ ID NO: 3902706 - RNA, 13 nt, Human adenovirus B (HAdV-B)
cugugccagaagu

SEQ ID NO: 3902707 - RNA, 12 nt, Human adenovirus B (HAdV-B)
cuguggaguucu

SEQ ID NO: 3902708 - RNA, 13 nt, Human adenovirus B (HAdV-B)
cuuagagauggaa

SEQ ID NO: 3902709 - RNA, 20 nt, Human adenovirus B (HAdV-B)
cuucagcgcacucucgagga

SEQ ID NO: 3902710 - RNA, 15 nt, Human adenovirus B (HAdV-B)
cuucagcuugcccuc

SEQ ID NO: 3902711 - RNA, 14 nt, Human adenovirus B (HAdV-B)
cuucucaaagagcu

SEQ ID NO: 3902712 - RNA, 21 nt, Human adenovirus B (HAdV-B)
cuucuccggaucuccugggca

SEQ ID NO: 3902713 - RNA, 16 nt, Human adenovirus B (HAdV-B)
cuucuuuugccauccu

SEQ ID NO: 3902714 - RNA, 21 nt, Human adenovirus B (HAdV-B)
cuugaaagagcuugacaagcu

SEQ ID NO: 3902715 - RNA, 12 nt, Human adenovirus B (HAdV-B)
cuugaaaucaca

SEQ ID NO: 3902716 - RNA, 14 nt, Human adenovirus B (HAdV-B)
gaaaucuucccauc

SEQ ID NO: 3902717 - RNA, 22 nt, Human adenovirus B (HAdV-B)
gaacaaagcuuggaacagcagu

SEQ ID NO: 3902718 - RNA, 17 nt, Human adenovirus B (HAdV-B)
gaagcauuuucccuacu

SEQ ID NO: 3902719 - RNA, 14 nt, Human adenovirus B (HAdV-B)
gaagguucuggggu

SEQ ID NO: 3902720 - RNA, 23 nt, Human adenovirus B (HAdV-B)
gacauggaaacucagccauugcu

SEQ ID NO: 3902721 - RNA, 15 nt, Human adenovirus B (HAdV-B)
gacccuaugcggccu

SEQ ID NO: 3902722 - RNA, 21 nt, Human adenovirus B (HAdV-B)
gaccuccaacagaaaaccagc

SEQ ID NO: 3902723 - RNA, 15 nt, Human adenovirus B (HAdV-B)
gacuccuucaacccu

SEQ ID NO: 3902724 - RNA, 20 nt, Human adenovirus B (HAdV-B)
gagaaaaaacagccaacaua

SEQ ID NO: 3902725 - RNA, 19 nt, Human adenovirus B (HAdV-B)
gagagcccauucgugcagg

SEQ ID NO: 3902726 - RNA, 16 nt, Human adenovirus B (HAdV-B)
gagccugggccuggcc

SEQ ID NO: 3902727 - RNA, 13 nt, Human adenovirus B (HAdV-B)
gagcgugaugcag

SEQ ID NO: 3902728 - RNA, 22 nt, Human adenovirus B (HAdV-B)
gagcuuaagcauuccaccgccc

SEQ ID NO: 3902729 - RNA, 18 nt, Human adenovirus B (HAdV-B)
gagguucagaaagaggga

SEQ ID NO: 3902730 - RNA, 21 nt, Human adenovirus B (HAdV-B)
gauaacuaucaccaagaugcu

SEQ ID NO: 3902731 - RNA, 19 nt, Human adenovirus B (HAdV-B)
gauccagauauucaaccug

SEQ ID NO: 3902732 - RNA, 16 nt, Human adenovirus B (HAdV-B)
gaucugaguuggcuuu

SEQ ID NO: 3902733 - RNA, 19 nt, Human adenovirus B (HAdV-B)
gaugcaauccccacuggag

SEQ ID NO: 3902734 - RNA, 12 nt, Human adenovirus B (HAdV-B)
gaugccugggga

SEQ ID NO: 3902735 - RNA, 11 nt, Human adenovirus B (HAdV-B)
gauucugggga

SEQ ID NO: 3902736 - RNA, 22 nt, Human adenovirus B (HAdV-B)
gcaaagagcucugacuggagcu

SEQ ID NO: 3902737 - RNA, 15 nt, Human adenovirus B (HAdV-B)
gcacgucuucaaccg

SEQ ID NO: 3902738 - RNA, 22 nt, Human adenovirus B (HAdV-B)
gcagagcaggucuacuggucgc

SEQ ID NO: 3902739 - RNA, 19 nt, Human adenovirus B (HAdV-B)
gcagaggaggcggaggagg

SEQ ID NO: 3902740 - RNA, 19 nt, Human adenovirus B (HAdV-B)
gcagccuagucgcagggcu

SEQ ID NO: 3902741 - RNA, 23 nt, Human adenovirus B (HAdV-B)
gcagcgugcuggacuuggguggg

SEQ ID NO: 3902742 - RNA, 13 nt, Human adenovirus B (HAdV-B)
gcaggaggcgcaa

SEQ ID NO: 3902743 - RNA, 14 nt, Human adenovirus B (HAdV-B)
gcaggucaggagcc

SEQ ID NO: 3902744 - RNA, 15 nt, Human adenovirus B (HAdV-B)
gcaguuauugacagu

SEQ ID NO: 3902745 - RNA, 12 nt, Human adenovirus B (HAdV-B)
gcauacuuucuc

SEQ ID NO: 3902746 - RNA, 12 nt, Human adenovirus B (HAdV-B)
gcauauucuguu

SEQ ID NO: 3902747 - RNA, 16 nt, Human adenovirus B (HAdV-B)
gccaacugucaaauca

SEQ ID NO: 3902748 - RNA, 24 nt, Human adenovirus B (HAdV-B)
gccagcacccagaccauuaacuuu

SEQ ID NO: 3902749 - RNA, 20 nt, Human adenovirus B (HAdV-B)
gccaugcgagccgcaagagc

SEQ ID NO: 3902750 - RNA, 22 nt, Human adenovirus B (HAdV-B)
gcccucauaaucauugcagcca

SEQ ID NO: 3902751 - RNA, 17 nt, Human adenovirus B (HAdV-B)
gcccucgcuuggguggu

SEQ ID NO: 3902752 - RNA, 23 nt, Human adenovirus B (HAdV-B)
gccuggggacagguuaguguacg

SEQ ID NO: 3902753 - RNA, 16 nt, Human adenovirus B (HAdV-B)
gccugugaugagggua

SEQ ID NO: 3902754 - RNA, 13 nt, Human adenovirus B (HAdV-B)
gcgcccuccacca

SEQ ID NO: 3902755 - RNA, 16 nt, Human adenovirus B (HAdV-B)
gcgccuucacccgagc

SEQ ID NO: 3902756 - RNA, 13 nt, Human adenovirus B (HAdV-B)
gcggagcagagca

SEQ ID NO: 3902757 - RNA, 16 nt, Human adenovirus B (HAdV-B)
gcggaggaggagagga

SEQ ID NO: 3902758 - RNA, 14 nt, Human adenovirus B (HAdV-B)
gcuccauggggcgc

SEQ ID NO: 3902759 - RNA, 16 nt, Human adenovirus B (HAdV-B)
gcugaaacccacugcu

SEQ ID NO: 3902760 - RNA, 22 nt, Human adenovirus B (HAdV-B)
gcugaguuacuuucaagauggc

SEQ ID NO: 3902761 - RNA, 15 nt, Human adenovirus B (HAdV-B)
gcugauugccacaga

SEQ ID NO: 3902762 - RNA, 16 nt, Human adenovirus B (HAdV-B)
gcugcgcuccaacauu

SEQ ID NO: 3902763 - RNA, 17 nt, Human adenovirus B (HAdV-B)
gcugcuacagcugcugc

SEQ ID NO: 3902764 - RNA, 13 nt, Human adenovirus B (HAdV-B)
gcuggcuggucaa

SEQ ID NO: 3902765 - RNA, 19 nt, Human adenovirus B (HAdV-B)
gcugggcaccgacucuccc

SEQ ID NO: 3902766 - RNA, 15 nt, Human adenovirus B (HAdV-B)
gcugucaaccugccc

SEQ ID NO: 3902767 - RNA, 19 nt, Human adenovirus B (HAdV-B)
ggcacacguggcugcagcc

SEQ ID NO: 3902768 - RNA, 20 nt, Human adenovirus B (HAdV-B)
ggcaggugguugaugagguc

SEQ ID NO: 3902769 - RNA, 19 nt, Human adenovirus B (HAdV-B)
ggcgacggcggugaugcaa

SEQ ID NO: 3902770 - RNA, 20 nt, Human adenovirus B (HAdV-B)
ggcgcccuccaccaccauuc

SEQ ID NO: 3902771 - RNA, 21 nt, Human adenovirus B (HAdV-B)
ggcggaugaaggcgaggagga

SEQ ID NO: 3902772 - RNA, 15 nt, Human adenovirus B (HAdV-B)
ggcggcgaccuccaa

SEQ ID NO: 3902773 - RNA, 16 nt, Human adenovirus B (HAdV-B)
ggcggcgcugcagagc

SEQ ID NO: 3902774 - RNA, 14 nt, Human adenovirus B (HAdV-B)
gggaacugaugcac

SEQ ID NO: 3902775 - RNA, 21 nt, Human adenovirus B (HAdV-B)
gggauaggggcguuaagaggg

SEQ ID NO: 3902776 - RNA, 19 nt, Human adenovirus B (HAdV-B)
gggcacccaauuaggcuug

SEQ ID NO: 3902777 - RNA, 21 nt, Human adenovirus B (HAdV-B)
ggggcaacuccgacugcagca

SEQ ID NO: 3902778 - RNA, 12 nt, Human adenovirus B (HAdV-B)
ggucagcugcaa

SEQ ID NO: 3902779 - RNA, 17 nt, Human adenovirus B (HAdV-B)
ggucauuucuugcuugc

SEQ ID NO: 3902780 - RNA, 15 nt, Human adenovirus B (HAdV-B)
ggucgcagugcaugg

SEQ ID NO: 3902781 - RNA, 12 nt, Human adenovirus B (HAdV-B)
ggugacaaguac

SEQ ID NO: 3902782 - RNA, 13 nt, Human adenovirus B (HAdV-B)
ggugaccagcaug

SEQ ID NO: 3902783 - RNA, 23 nt, Human adenovirus B (HAdV-B)
ggugcaacacagcagagacaaug

SEQ ID NO: 3902784 - RNA, 15 nt, Human adenovirus B (HAdV-B)
gguggacaacaaguc

SEQ ID NO: 3902785 - RNA, 16 nt, Human adenovirus B (HAdV-B)
gguggacgagcagacc

SEQ ID NO: 3902786 - RNA, 17 nt, Human adenovirus B (HAdV-B)
gguucuuugcucuuccu

SEQ ID NO: 3902787 - RNA, 20 nt, Human adenovirus B (HAdV-B)
guaaaaauugaauaaaagaa

SEQ ID NO: 3902788 - RNA, 17 nt, Human adenovirus B (HAdV-B)
guaugagacgaugggcg

SEQ ID NO: 3902789 - RNA, 16 nt, Human adenovirus B (HAdV-B)
guauugcaggagaaau

SEQ ID NO: 3902790 - RNA, 18 nt, Human adenovirus B (HAdV-B)
gucaauugucucugaaga

SEQ ID NO: 3902791 - RNA, 12 nt, Human adenovirus B (HAdV-B)
gucaccucccca

SEQ ID NO: 3902792 - RNA, 17 nt, Human adenovirus B (HAdV-B)
gucauggaccaguuacu

SEQ ID NO: 3902793 - RNA, 23 nt, Human adenovirus B (HAdV-B)
gucucaguguucgagucaggguu

SEQ ID NO: 3902794 - RNA, 14 nt, Human adenovirus B (HAdV-B)
gucucugaagaaau

SEQ ID NO: 3902795 - RNA, 12 nt, Human adenovirus B (HAdV-B)
gugaacaccaau

SEQ ID NO: 3902796 - RNA, 15 nt, Human adenovirus B (HAdV-B)
gugauagaaguucuu

SEQ ID NO: 3902797 - RNA, 14 nt, Human adenovirus B (HAdV-B)
gugcggcaggcaug

SEQ ID NO: 3902798 - RNA, 14 nt, Human adenovirus B (HAdV-B)
gugucaccuguagc

SEQ ID NO: 3902799 - RNA, 16 nt, Human adenovirus B (HAdV-B)
guucgcucaccagaag

SEQ ID NO: 3902800 - RNA, 19 nt, Human adenovirus B (HAdV-B)
guucggcggugacaaguac

SEQ ID NO: 3902801 - RNA, 12 nt, Human adenovirus B (HAdV-B)
guuggggauacu

SEQ ID NO: 3902802 - RNA, 16 nt, Human adenovirus B (HAdV-B)
uaaaaccugucaucau

SEQ ID NO: 3902803 - RNA, 18 nt, Human adenovirus B (HAdV-B)
uaaacacacccucauaau

SEQ ID NO: 3902804 - RNA, 17 nt, Human adenovirus B (HAdV-B)
uaaauccaauccacaca

SEQ ID NO: 3902805 - RNA, 17 nt, Human adenovirus B (HAdV-B)
uaaccccacuaacaacc

SEQ ID NO: 3902806 - RNA, 22 nt, Human adenovirus B (HAdV-B)
uaacgagaaaaaacagccaaca

SEQ ID NO: 3902807 - RNA, 18 nt, Human adenovirus B (HAdV-B)
uaagguucuguggacagg

SEQ ID NO: 3902808 - RNA, 15 nt, Human adenovirus B (HAdV-B)
uacaaagacuucaag

SEQ ID NO: 3902809 - RNA, 22 nt, Human adenovirus B (HAdV-B)
uacaacaauuuccacuucaaca

SEQ ID NO: 3902810 - RNA, 19 nt, Human adenovirus B (HAdV-B)
uacaccggauugcagcacu

SEQ ID NO: 3902811 - RNA, 12 nt, Human adenovirus B (HAdV-B)
uacauggcuccg

SEQ ID NO: 3902812 - RNA, 18 nt, Human adenovirus B (HAdV-B)
uaccagacaaaguacagc

SEQ ID NO: 3902813 - RNA, 17 nt, Human adenovirus B (HAdV-B)
uaccuguguagaugccu

SEQ ID NO: 3902814 - RNA, 20 nt, Human adenovirus B (HAdV-B)
uaccuguuccgucuggccaa

SEQ ID NO: 3902815 - RNA, 15 nt, Human adenovirus B (HAdV-B)
uaccuuuuacuacau

SEQ ID NO: 3902816 - RNA, 19 nt, Human adenovirus B (HAdV-B)
uacgagagcgugaugcagc

SEQ ID NO: 3902817 - RNA, 19 nt, Human adenovirus B (HAdV-B)
uacgauugaugucugguga

SEQ ID NO: 3902818 - RNA, 14 nt, Human adenovirus B (HAdV-B)
uacuaagaugaaac

SEQ ID NO: 3902819 - RNA, 15 nt, Human adenovirus B (HAdV-B)
uacugacgccagacg

SEQ ID NO: 3902820 - RNA, 20 nt, Human adenovirus B (HAdV-B)
uacuuuuauauuagauaaau

SEQ ID NO: 3902821 - RNA, 13 nt, Human adenovirus B (HAdV-B)
uagcccuuaacau

SEQ ID NO: 3902822 - RNA, 21 nt, Human adenovirus B (HAdV-B)
uagcucauaggagcuggcuuu

SEQ ID NO: 3902823 - RNA, 17 nt, Human adenovirus B (HAdV-B)
uaggagccggauuggga

SEQ ID NO: 3902824 - RNA, 23 nt, Human adenovirus B (HAdV-B)
uaguugccagcgacucuacaagg

SEQ ID NO: 3902825 - RNA, 13 nt, Human adenovirus B (HAdV-B)
uauagcaaagcca

SEQ ID NO: 3902826 - RNA, 16 nt, Human adenovirus B (HAdV-B)
uaucaccaaacugcuu

SEQ ID NO: 3902827 - RNA, 14 nt, Human adenovirus B (HAdV-B)
uauccggaaugcuu

SEQ ID NO: 3902828 - RNA, 14 nt, Human adenovirus B (HAdV-B)
uaugcucaggauca

SEQ ID NO: 3902829 - RNA, 21 nt, Human adenovirus B (HAdV-B)
uaugcucaggaucacagagac

SEQ ID NO: 3902830 - RNA, 12 nt, Human adenovirus B (HAdV-B)
uauggagcccag

SEQ ID NO: 3902831 - RNA, 19 nt, Human adenovirus B (HAdV-B)
ucaaaaacacacuacccac

SEQ ID NO: 3902832 - RNA, 20 nt, Human adenovirus B (HAdV-B)
ucaacccggauuuuacaacc

SEQ ID NO: 3902833 - RNA, 22 nt, Human adenovirus B (HAdV-B)
ucaacccggauuuuacaaccag

SEQ ID NO: 3902834 - RNA, 14 nt, Human adenovirus B (HAdV-B)
ucaacgacuacacc

SEQ ID NO: 3902835 - RNA, 13 nt, Human adenovirus B (HAdV-B)
ucaauaaacauca

SEQ ID NO: 3902836 - RNA, 15 nt, Human adenovirus B (HAdV-B)
ucaaugauugcaauu

SEQ ID NO: 3902837 - RNA, 18 nt, Human adenovirus B (HAdV-B)
ucaccaaacugcuuagcc

SEQ ID NO: 3902838 - RNA, 20 nt, Human adenovirus B (HAdV-B)
ucaccagggaaaaguacagu

SEQ ID NO: 3902839 - RNA, 17 nt, Human adenovirus B (HAdV-B)
ucaccuccacagccccu

SEQ ID NO: 3902840 - RNA, 20 nt, Human adenovirus B (HAdV-B)
ucaccugcggagcagagcag

SEQ ID NO: 3902841 - RNA, 12 nt, Human adenovirus B (HAdV-B)
ucaccugggcag

SEQ ID NO: 3902842 - RNA, 15 nt, Human adenovirus B (HAdV-B)
ucacgcuugccagca

SEQ ID NO: 3902843 - RNA, 13 nt, Human adenovirus B (HAdV-B)
ucauagccacagc

SEQ ID NO: 3902844 - RNA, 16 nt, Human adenovirus B (HAdV-B)
ucaucuucccagagcg

SEQ ID NO: 3902845 - RNA, 19 nt, Human adenovirus B (HAdV-B)
uccaacagaaaaccagcag

SEQ ID NO: 3902846 - RNA, 20 nt, Human adenovirus B (HAdV-B)
uccaacagaaaaccagcagc

SEQ ID NO: 3902847 - RNA, 21 nt, Human adenovirus B (HAdV-B)
uccagaagcauuuucccuacu

SEQ ID NO: 3902848 - RNA, 14 nt, Human adenovirus B (HAdV-B)
ucccggcagucucg

SEQ ID NO: 3902849 - RNA, 11 nt, Human adenovirus B (HAdV-B)
uccgaccuggc

SEQ ID NO: 3902850 - RNA, 19 nt, Human adenovirus B (HAdV-B)
uccgcauuaguaacaacac

SEQ ID NO: 3902851 - RNA, 18 nt, Human adenovirus B (HAdV-B)
uccgcgauaccuggcacc

SEQ ID NO: 3902852 - RNA, 19 nt, Human adenovirus B (HAdV-B)
uccuagcaaggacaacauc

SEQ ID NO: 3902853 - RNA, 17 nt, Human adenovirus B (HAdV-B)
ucgcagaaaacaaacuu

SEQ ID NO: 3902854 - RNA, 16 nt, Human adenovirus B (HAdV-B)
ucgcagcagcagcagc

SEQ ID NO: 3902855 - RNA, 23 nt, Human adenovirus B (HAdV-B)
ucggucucaaaagaucccuccuc

SEQ ID NO: 3902856 - RNA, 14 nt, Human adenovirus B (HAdV-B)
ucuacuucaacccc

SEQ ID NO: 3902857 - RNA, 15 nt, Human adenovirus B (HAdV-B)
ucuagcaagacaguc

SEQ ID NO: 3902858 - RNA, 17 nt, Human adenovirus B (HAdV-B)
ucuauugcuucccuacg

SEQ ID NO: 3902859 - RNA, 23 nt, Human adenovirus B (HAdV-B)
ucucuguugaaauuuucucccag

SEQ ID NO: 3902860 - RNA, 18 nt, Human adenovirus B (HAdV-B)
ucucuuaagguucugugg

SEQ ID NO: 3902861 - RNA, 13 nt, Human adenovirus B (HAdV-B)
ucugagacagaca

SEQ ID NO: 3902862 - RNA, 22 nt, Human adenovirus B (HAdV-B)
ucuggcccaauugcaagccauc

SEQ ID NO: 3902863 - RNA, 20 nt, Human adenovirus B (HAdV-B)
ugaaaguguuguuggaacca

SEQ ID NO: 3902864 - RNA, 21 nt, Human adenovirus B (HAdV-B)
ugaacaccaaucaugguaccu

SEQ ID NO: 3902865 - RNA, 15 nt, Human adenovirus B (HAdV-B)
ugaauuggcucagcg

SEQ ID NO: 3902866 - RNA, 14 nt, Human adenovirus B (HAdV-B)
ugaccacagcaacu

SEQ ID NO: 3902867 - RNA, 18 nt, Human adenovirus B (HAdV-B)
ugacgccgccggucccac

SEQ ID NO: 3902868 - RNA, 22 nt, Human adenovirus B (HAdV-B)
ugacuuuaugagccagagcaug

SEQ ID NO: 3902869 - RNA, 16 nt, Human adenovirus B (HAdV-B)
ugagaacaguaagaaa

SEQ ID NO: 3902870 - RNA, 19 nt, Human adenovirus B (HAdV-B)
ugagacccauuaagcaggu

SEQ ID NO: 3902871 - RNA, 19 nt, Human adenovirus B (HAdV-B)
aaaacaagcgucauaucau

SEQ ID NO: 3902872 - RNA, 14 nt, Human adenovirus B (HAdV-B)
aaaagaaaaauuug

SEQ ID NO: 3902873 - RNA, 14 nt, Human adenovirus B (HAdV-B)
aaaaugccaaauau

SEQ ID NO: 3902874 - RNA, 13 nt, Human adenovirus B (HAdV-B)
aaaauguugaaau

SEQ ID NO: 3902875 - RNA, 12 nt, Human adenovirus B (HAdV-B)
aaacaacauuug

SEQ ID NO: 3902876 - RNA, 21 nt, Human adenovirus B (HAdV-B)
aaaccauuugguggcaugagg

SEQ ID NO: 3902877 - RNA, 20 nt, Human adenovirus B (HAdV-B)
aaacccaggguuuauuuccc

SEQ ID NO: 3902878 - RNA, 11 nt, Human adenovirus B (HAdV-B)
aaaccuucuca

SEQ ID NO: 3902879 - RNA, 21 nt, Human adenovirus B (HAdV-B)
aaacuuaaagaccagaacuuc

SEQ ID NO: 3902880 - RNA, 16 nt, Human adenovirus B (HAdV-B)
aaaguuaacuggaugc

SEQ ID NO: 3902881 - RNA, 18 nt, Human adenovirus B (HAdV-B)
aaaugacgagacaucaua

SEQ ID NO: 3902882 - RNA, 18 nt, Human adenovirus B (HAdV-B)
aaauuuaccugcauggug

SEQ ID NO: 3902883 - RNA, 16 nt, Human adenovirus B (HAdV-B)
aaauuucuucuucacc

SEQ ID NO: 3902884 - RNA, 15 nt, Human adenovirus B (HAdV-B)
aaauuuucucccagc

SEQ ID NO: 3902885 - RNA, 18 nt, Human adenovirus B (HAdV-B)
aaauuuucucccagcagc

SEQ ID NO: 3902886 - RNA, 14 nt, Human adenovirus B (HAdV-B)
aacaaagcuuggaa

SEQ ID NO: 3902887 - RNA, 16 nt, Human adenovirus B (HAdV-B)
aacaaccaguuacaaa

SEQ ID NO: 3902888 - RNA, 15 nt, Human adenovirus B (HAdV-B)
aacaaggucgcagug

SEQ ID NO: 3902889 - RNA, 17 nt, Human adenovirus B (HAdV-B)
aacaccguuucuggggc

SEQ ID NO: 3902890 - RNA, 15 nt, Human adenovirus B (HAdV-B)
aacaucauugaagag

SEQ ID NO: 3902891 - RNA, 22 nt, Human adenovirus B (HAdV-B)
aacauguugguuggagccugag

SEQ ID NO: 3902892 - RNA, 15 nt, Human adenovirus B (HAdV-B)
aacauucuacagagu

SEQ ID NO: 3902893 - RNA, 19 nt, Human adenovirus B (HAdV-B)
aaccaguggucagugauga

SEQ ID NO: 3902894 - RNA, 20 nt, Human adenovirus B (HAdV-B)
aaccucccgacggugcugca

SEQ ID NO: 3902895 - RNA, 21 nt, Human adenovirus B (HAdV-B)
aacgaauuuucucccagcggc

SEQ ID NO: 3902896 - RNA, 19 nt, Human adenovirus B (HAdV-B)
aacgcaaaaaauggccugu

SEQ ID NO: 3902897 - RNA, 16 nt, Human adenovirus B (HAdV-B)
aacuuauauugcaugg

SEQ ID NO: 3902898 - RNA, 23 nt, Human adenovirus B (HAdV-B)
aacuucuugaccacgguggugca

SEQ ID NO: 3902899 - RNA, 15 nt, Human adenovirus B (HAdV-B)
aagacaaacauaaag

SEQ ID NO: 3902900 - RNA, 16 nt, Human adenovirus B (HAdV-B)
aagagacggaagaacc

SEQ ID NO: 3902901 - RNA, 17 nt, Human adenovirus B (HAdV-B)
aagaugaaagcaccucc

SEQ ID NO: 3902902 - RNA, 20 nt, Human adenovirus B (HAdV-B)
aagcuaauuugggacaacaa

SEQ ID NO: 3902903 - RNA, 16 nt, Human adenovirus B (HAdV-B)
aagcucuugcagaaca

SEQ ID NO: 3902904 - RNA, 16 nt, Human adenovirus B (HAdV-B)
aagcugaaauuacaaa

SEQ ID NO: 3902905 - RNA, 20 nt, Human adenovirus B (HAdV-B)
aagcugcuacagcugcugca

SEQ ID NO: 3902906 - RNA, 19 nt, Human adenovirus B (HAdV-B)
aaggacaaaaaagaagagg

SEQ ID NO: 3902907 - RNA, 23 nt, Human adenovirus B (HAdV-B)
aaggcgaugggucuucuccuggg

SEQ ID NO: 3902908 - RNA, 18 nt, Human adenovirus B (HAdV-B)
aagguucccucaggaugu

SEQ ID NO: 3902909 - RNA, 19 nt, Human adenovirus B (HAdV-B)
aagugcagcaacaggagga

SEQ ID NO: 3902910 - RNA, 12 nt, Human adenovirus B (HAdV-B)
aauaugcuggcu

SEQ ID NO: 3902911 - RNA, 18 nt, Human adenovirus B (HAdV-B)
aaucaaguucuaugagga

SEQ ID NO: 3902912 - RNA, 18 nt, Human adenovirus B (HAdV-B)
aaucuauggcgaaguuuc

SEQ ID NO: 3902913 - RNA, 12 nt, Human adenovirus B (HAdV-B)
aaucugcaacaa

SEQ ID NO: 3902914 - RNA, 14 nt, Human adenovirus B (HAdV-B)
aaugccaucaucuc

SEQ ID NO: 3902915 - RNA, 18 nt, Human adenovirus B (HAdV-B)
aauggagugcuugaaagu

SEQ ID NO: 3902916 - RNA, 15 nt, Human adenovirus B (HAdV-B)
aauggggcugaggug

SEQ ID NO: 3902917 - RNA, 16 nt, Human adenovirus B (HAdV-B)
aauuaucgcugcugca

SEQ ID NO: 3902918 - RNA, 14 nt, Human adenovirus B (HAdV-B)
aauuucuuuuuaua

SEQ ID NO: 3902919 - RNA, 14 nt, Human adenovirus B (HAdV-B)
acaacaauuuccac

SEQ ID NO: 3902920 - RNA, 13 nt, Human adenovirus B (HAdV-B)
acaacaguagcaa

SEQ ID NO: 3902921 - RNA, 20 nt, Human adenovirus B (HAdV-B)
acaagugagaucggacaggg

SEQ ID NO: 3902922 - RNA, 15 nt, Human adenovirus B (HAdV-B)
acaaguuuuccgcca

SEQ ID NO: 3902923 - RNA, 21 nt, Human adenovirus B (HAdV-B)
acacaucauaguuauguuccu

SEQ ID NO: 3902924 - RNA, 17 nt, Human adenovirus B (HAdV-B)
acacccugcugaagacc

SEQ ID NO: 3902925 - RNA, 15 nt, Human adenovirus B (HAdV-B)
acacguuccgugggu

SEQ ID NO: 3902926 - RNA, 15 nt, Human adenovirus B (HAdV-B)
acacucaccaccucc

SEQ ID NO: 3902927 - RNA, 15 nt, Human adenovirus B (HAdV-B)
acacugguggccacc

SEQ ID NO: 3902928 - RNA, 14 nt, Human adenovirus B (HAdV-B)
acacuucugcccca

SEQ ID NO: 3902929 - RNA, 18 nt, Human adenovirus B (HAdV-B)
acagaacuuucuuaccaa

SEQ ID NO: 3902930 - RNA, 14 nt, Human adenovirus B (HAdV-B)
acagcaacuucuug

SEQ ID NO: 3902931 - RNA, 17 nt, Human adenovirus B (HAdV-B)
acaguaaagcuggcaga

SEQ ID NO: 3902932 - RNA, 14 nt, Human adenovirus B (HAdV-B)
acaguaaaggaaga

SEQ ID NO: 3902933 - RNA, 15 nt, Human adenovirus B (HAdV-B)
acaguuuggaggagg

SEQ ID NO: 3902934 - RNA, 17 nt, Human adenovirus B (HAdV-B)
acauaauuacacucuca

SEQ ID NO: 3902935 - RNA, 17 nt, Human adenovirus B (HAdV-B)
acauacaacaauuucca

SEQ ID NO: 3902936 - RNA, 21 nt, Human adenovirus B (HAdV-B)
acauagccuuuggguauaauu

SEQ ID NO: 3902937 - RNA, 16 nt, Human adenovirus B (HAdV-B)
acaucgccggacagga

SEQ ID NO: 3902938 - RNA, 21 nt, Human adenovirus B (HAdV-B)
acaucuagcaagacagucgcu

SEQ ID NO: 3902939 - RNA, 12 nt, Human adenovirus B (HAdV-B)
acaugccacaga

SEQ ID NO: 3902940 - RNA, 13 nt, Human adenovirus B (HAdV-B)
acccaacacacac

SEQ ID NO: 3902941 - RNA, 13 nt, Human adenovirus B (HAdV-B)
acccagggggcaa

SEQ ID NO: 3902942 - RNA, 19 nt, Human adenovirus B (HAdV-B)
accccuacggaagccagca

SEQ ID NO: 3902943 - RNA, 16 nt, Human adenovirus B (HAdV-B)
acccugucuaccccua

SEQ ID NO: 3902944 - RNA, 18 nt, Human adenovirus B (HAdV-B)
accgcuuuccugagaacc

SEQ ID NO: 3902945 - RNA, 17 nt, Human adenovirus B (HAdV-B)
accucccaacaccccuu

SEQ ID NO: 3902946 - RNA, 16 nt, Human adenovirus B (HAdV-B)
accuugacccccagac

SEQ ID NO: 3902947 - RNA, 17 nt, Human adenovirus B (HAdV-B)
accuugcuucacuuucu

SEQ ID NO: 3902948 - RNA, 20 nt, Human adenovirus B (HAdV-B)
acgcgcaugcgaaugcggag

SEQ ID NO: 3902949 - RNA, 18 nt, Human adenovirus B (HAdV-B)
acgcggcccuggcagaac

SEQ ID NO: 3902950 - RNA, 16 nt, Human adenovirus B (HAdV-B)
acgucuagggcgcagu

SEQ ID NO: 3902951 - RNA, 17 nt, Human adenovirus B (HAdV-B)
acguggaaaaaggaagg

SEQ ID NO: 3902952 - RNA, 17 nt, Human adenovirus B (HAdV-B)
acuacaccgcuuuucca

SEQ ID NO: 3902953 - RNA, 12 nt, Human adenovirus B (HAdV-B)
acucacaaacua

SEQ ID NO: 3902954 - RNA, 11 nt, Human adenovirus B (HAdV-B)
acuccacagcu

SEQ ID NO: 3902955 - RNA, 16 nt, Human adenovirus B (HAdV-B)
acucuugcuugacucu

SEQ ID NO: 3902956 - RNA, 13 nt, Human adenovirus B (HAdV-B)
acugguggccacc

SEQ ID NO: 3902957 - RNA, 12 nt, Human adenovirus B (HAdV-B)
acuuggaagagg

SEQ ID NO: 3902958 - RNA, 15 nt, Human adenovirus B (HAdV-B)
agaaaagacaaacau

SEQ ID NO: 3902959 - RNA, 21 nt, Human adenovirus B (HAdV-B)
agaaaucucuuaagguucugu

SEQ ID NO: 3902960 - RNA, 12 nt, Human adenovirus B (HAdV-B)
agaaauuacuug

SEQ ID NO: 3902961 - RNA, 18 nt, Human adenovirus B (HAdV-B)
agaacaccgacuaccuca

SEQ ID NO: 3902962 - RNA, 16 nt, Human adenovirus B (HAdV-B)
agaacgaaacuuuucc

SEQ ID NO: 3902963 - RNA, 18 nt, Human adenovirus B (HAdV-B)
agaauaaaaaauauaauu

SEQ ID NO: 3902964 - RNA, 14 nt, Human adenovirus B (HAdV-B)
agaaucgccuagga

SEQ ID NO: 3902965 - RNA, 19 nt, Human adenovirus B (HAdV-B)
agaaugacccgcaggcagu

SEQ ID NO: 3902966 - RNA, 15 nt, Human adenovirus B (HAdV-B)
agacccgggcuaugu

SEQ ID NO: 3902967 - RNA, 18 nt, Human adenovirus B (HAdV-B)
agacuagcagacagggcu

SEQ ID NO: 3902968 - RNA, 13 nt, Human adenovirus B (HAdV-B)
agagagaggauga

SEQ ID NO: 3902969 - RNA, 14 nt, Human adenovirus B (HAdV-B)
agagccggccugga

SEQ ID NO: 3902970 - RNA, 16 nt, Human adenovirus B (HAdV-B)
agagcgucgcaagcuu

SEQ ID NO: 3902971 - RNA, 19 nt, Human adenovirus B (HAdV-B)
agagcgugaugcagcagca

SEQ ID NO: 3902972 - RNA, 23 nt, Human adenovirus B (HAdV-B)
agaggggucuugugugggacgau

SEQ ID NO: 3902973 - RNA, 16 nt, Human adenovirus B (HAdV-B)
agauacuggauguuuu

SEQ ID NO: 3902974 - RNA, 13 nt, Human adenovirus B (HAdV-B)
agcaacaggagga

SEQ ID NO: 3902975 - RNA, 21 nt, Human adenovirus B (HAdV-B)
agcaccucacuucccucuucc

SEQ ID NO: 3902976 - RNA, 18 nt, Human adenovirus B (HAdV-B)
agcaucauauugcuugaa

SEQ ID NO: 3902977 - RNA, 14 nt, Human adenovirus B (HAdV-B)
agcccgagucugca

SEQ ID NO: 3902978 - RNA, 12 nt, Human adenovirus B (HAdV-B)
agccggccugga

SEQ ID NO: 3902979 - RNA, 13 nt, Human adenovirus B (HAdV-B)
agcggguuaaaaa

SEQ ID NO: 3902980 - RNA, 16 nt, Human adenovirus B (HAdV-B)
agcucugacuggagcu

SEQ ID NO: 3902981 - RNA, 18 nt, Human adenovirus B (HAdV-B)
aggacgccgaggcucucu

SEQ ID NO: 3902982 - RNA, 16 nt, Human adenovirus B (HAdV-B)
aggaggcggaggagga

SEQ ID NO: 3902983 - RNA, 13 nt, Human adenovirus B (HAdV-B)
aggagucaacccc

SEQ ID NO: 3902984 - RNA, 21 nt, Human adenovirus B (HAdV-B)
aggccaugcaacguaucaugg

SEQ ID NO: 3902985 - RNA, 22 nt, Human adenovirus B (HAdV-B)
agggaucaguccugccagggca

SEQ ID NO: 3902986 - RNA, 24 nt, Human adenovirus B (HAdV-B)
aggguuuauuuccccaaauggcuu

SEQ ID NO: 3902987 - RNA, 20 nt, Human adenovirus B (HAdV-B)
aguacagcgggcacacaaag

SEQ ID NO: 3902988 - RNA, 17 nt, Human adenovirus B (HAdV-B)
aguacaggacaggcgcu

SEQ ID NO: 3902989 - RNA, 24 nt, Human adenovirus B (HAdV-B)
aguaccucagagcgaaguguauca

SEQ ID NO: 3902990 - RNA, 19 nt, Human adenovirus B (HAdV-B)
aguccugccaccaccucua

SEQ ID NO: 3902991 - RNA, 23 nt, Human adenovirus B (HAdV-B)
agugcaauguaauaaaaauaugu

SEQ ID NO: 3902992 - RNA, 22 nt, Human adenovirus B (HAdV-B)
agugcuguuuguaacugguccc

SEQ ID NO: 3902993 - RNA, 13 nt, Human adenovirus B (HAdV-B)
agugucacugccg

SEQ ID NO: 3902994 - RNA, 14 nt, Human adenovirus B (HAdV-B)
aguuaacuggaugc

SEQ ID NO: 3902995 - RNA, 12 nt, Human adenovirus B (HAdV-B)
auaaaacauccc

SEQ ID NO: 3902996 - RNA, 15 nt, Human adenovirus B (HAdV-B)
auauaaucugcaaca

SEQ ID NO: 3902997 - RNA, 22 nt, Human adenovirus B (HAdV-B)
aucagagaagacgacugacaaa

SEQ ID NO: 3902998 - RNA, 20 nt, Human adenovirus B (HAdV-B)
auccuacgagaucaccgcua

SEQ ID NO: 3902999 - RNA, 12 nt, Human adenovirus B (HAdV-B)
auccuucucaac

SEQ ID NO: 3903000 - RNA, 20 nt, Human adenovirus B (HAdV-B)
aucguugucaaccagggggu

SEQ ID NO: 3903001 - RNA, 18 nt, Human adenovirus B (HAdV-B)
aucuacguccacuggacg

SEQ ID NO: 3903002 - RNA, 16 nt, Human adenovirus B (HAdV-B)
aucuagaccacugccg

SEQ ID NO: 3903003 - RNA, 17 nt, Human adenovirus B (HAdV-B)
augaauuaaaaaaugau

SEQ ID NO: 3903004 - RNA, 17 nt, Human adenovirus B (HAdV-B)
augauauucuugagcag

SEQ ID NO: 3903005 - RNA, 16 nt, Human adenovirus B (HAdV-B)
augaugggcuggcgga

SEQ ID NO: 3903006 - RNA, 21 nt, Human adenovirus B (HAdV-B)
augauuaauaaaaaaucacuu

SEQ ID NO: 3903007 - RNA, 20 nt, Human adenovirus B (HAdV-B)
augauuugcggugcuuccga

SEQ ID NO: 3903008 - RNA, 17 nt, Human adenovirus B (HAdV-B)
augcacaugaucaucca

SEQ ID NO: 3903009 - RNA, 22 nt, Human adenovirus B (HAdV-B)
augcaucugcgccgcaggaggc

SEQ ID NO: 3903010 - RNA, 18 nt, Human adenovirus B (HAdV-B)
augccagcgguucuggag

SEQ ID NO: 3903011 - RNA, 20 nt, Human adenovirus B (HAdV-B)
auggcuuaccagacaaagua

SEQ ID NO: 3903012 - RNA, 13 nt, Human adenovirus B (HAdV-B)
augugucugaagg

SEQ ID NO: 3903013 - RNA, 12 nt, Human adenovirus B (HAdV-B)
auuacagccaac

SEQ ID NO: 3903014 - RNA, 22 nt, Human adenovirus B (HAdV-B)
auuacuucuuucagacuagcag

SEQ ID NO: 3903015 - RNA, 13 nt, Human adenovirus B (HAdV-B)
auuaugugcauuu

SEQ ID NO: 3903016 - RNA, 14 nt, Human adenovirus B (HAdV-B)
auucaaacaacauu

SEQ ID NO: 3903017 - RNA, 14 nt, Human adenovirus B (HAdV-B)
auucccacugaaag

SEQ ID NO: 3903018 - RNA, 19 nt, Human adenovirus B (HAdV-B)
auucuacugguaauuuacu

SEQ ID NO: 3903019 - RNA, 19 nt, Human adenovirus B (HAdV-B)
auuuuugauauacccccua

SEQ ID NO: 3903020 - RNA, 19 nt, Human adenovirus B (HAdV-B)
caaaccucugcuacaaccc

SEQ ID NO: 3903021 - RNA, 15 nt, Human adenovirus B (HAdV-B)
caaacgucagccaaa

SEQ ID NO: 3903022 - RNA, 21 nt, Human adenovirus B (HAdV-B)
caaacugcuggacuacuugca

SEQ ID NO: 3903023 - RNA, 20 nt, Human adenovirus B (HAdV-B)
caaagcgugcugcacagcac

SEQ ID NO: 3903024 - RNA, 23 nt, Human adenovirus B (HAdV-B)
caaaguuuacagcgguuacuauu

SEQ ID NO: 3903025 - RNA, 21 nt, Human adenovirus B (HAdV-B)
caaaugacaaaggcuucuauu

SEQ ID NO: 3903026 - RNA, 17 nt, Human adenovirus B (HAdV-B)
caaauucaccaaugcaa

SEQ ID NO: 3903027 - RNA, 19 nt, Human adenovirus B (HAdV-B)
caaccguugaaggaugaaa

SEQ ID NO: 3903028 - RNA, 16 nt, Human adenovirus B (HAdV-B)
caacucccuggcuccu

SEQ ID NO: 3903029 - RNA, 21 nt, Human adenovirus B (HAdV-B)
caagaacaaaagaauaccaaa

SEQ ID NO: 3903030 - RNA, 23 nt, Human adenovirus B (HAdV-B)
caagcgcaaauacaaggaagaaa

SEQ ID NO: 3903031 - RNA, 22 nt, Human adenovirus B (HAdV-B)
caagugcagcaacaggaggauu

SEQ ID NO: 3903032 - RNA, 12 nt, Human adenovirus B (HAdV-B)
caauaaacauca

SEQ ID NO: 3903033 - RNA, 14 nt, Human adenovirus B (HAdV-B)
caaucacaaaaggc

SEQ ID NO: 3903034 - RNA, 15 nt, Human adenovirus B (HAdV-B)
caauuggcuccagca

SEQ ID NO: 3903035 - RNA, 21 nt, Human adenovirus B (HAdV-B)
cacaugggagccaggaguucc

SEQ ID NO: 3903036 - RNA, 13 nt, Human adenovirus B (HAdV-B)
caccaaacugcuu

SEQ ID NO: 3903037 - RNA, 18 nt, Human adenovirus B (HAdV-B)
caccacacgauccacacu

SEQ ID NO: 3903038 - RNA, 17 nt, Human adenovirus B (HAdV-B)
caccuuuccuacucaca

SEQ ID NO: 3903039 - RNA, 23 nt, Human adenovirus B (HAdV-B)
cacucggaugugaucgaggaugu

SEQ ID NO: 3903040 - RNA, 17 nt, Human adenovirus B (HAdV-B)
cacuggacaugacagcg

SEQ ID NO: 3903041 - RNA, 20 nt, Human adenovirus B (HAdV-B)
cagaaccaagagucaauugu

SEQ ID NO: 3903042 - RNA, 23 nt, Human adenovirus B (HAdV-B)
cagaaccuauuuagagacagaag

SEQ ID NO: 3903043 - RNA, 21 nt, Human adenovirus B (HAdV-B)
cagaagacaugcaugacccag

SEQ ID NO: 3903044 - RNA, 20 nt, Human adenovirus B (HAdV-B)
cagaagcggcgaggagccgg

SEQ ID NO: 3903045 - RNA, 20 nt, Human adenovirus B (HAdV-B)
cagaccucaucuucccagag

SEQ ID NO: 3903046 - RNA, 16 nt, Human adenovirus B (HAdV-B)
cagacuugggacagaa

SEQ ID NO: 3903047 - RNA, 19 nt, Human adenovirus B (HAdV-B)
cagcaaccccaggccaacc

SEQ ID NO: 3903048 - RNA, 16 nt, Human adenovirus B (HAdV-B)
cagcacugaaacacca

SEQ ID NO: 3903049 - RNA, 13 nt, Human adenovirus B (HAdV-B)
cagcagcaggcga

SEQ ID NO: 3903050 - RNA, 17 nt, Human adenovirus B (HAdV-B)
cagccaugaggccacaa

SEQ ID NO: 3903051 - RNA, 12 nt, Human adenovirus B (HAdV-B)
cagcgugcugga

SEQ ID NO: 3903052 - RNA, 19 nt, Human adenovirus B (HAdV-B)
cagcucuuaccaccacgcc

SEQ ID NO: 3903053 - RNA, 13 nt, Human adenovirus B (HAdV-B)
caggcagaggagg

SEQ ID NO: 3903054 - RNA, 22 nt, Human adenovirus B (HAdV-B)
caggccucuucuccaguggagu

SEQ ID NO: 3903055 - RNA, 15 nt, Human adenovirus B (HAdV-B)
caggcgccucccagg

SEQ ID NO: 3903056 - RNA, 14 nt, Human adenovirus B (HAdV-B)
caguacaggacagg

SEQ ID NO: 3903057 - RNA, 12 nt, Human adenovirus B (HAdV-B)
caguaucaucuu

SEQ ID NO: 3903058 - RNA, 21 nt, Human adenovirus B (HAdV-B)
caguccgguccugauuacuuc

SEQ ID NO: 3903059 - RNA, 18 nt, Human adenovirus B (HAdV-B)
cagucuccgauguugugu

SEQ ID NO: 3903060 - RNA, 23 nt, Human adenovirus B (HAdV-B)
caguuuggaagccacucugaacu

SEQ ID NO: 3903061 - RNA, 21 nt, Human adenovirus B (HAdV-B)
cauaauauugccaugcaggca

SEQ ID NO: 3903062 - RNA, 23 nt, Human adenovirus B (HAdV-B)
cauacuuuaaaggggaugucaaa

SEQ ID NO: 3903063 - RNA, 16 nt, Human adenovirus B (HAdV-B)
cauagauaauuacuug

SEQ ID NO: 3903064 - RNA, 16 nt, Human adenovirus B (HAdV-B)
caucacuuccaugccu

SEQ ID NO: 3903065 - RNA, 21 nt, Human adenovirus B (HAdV-B)
caucaucuccugcuugcauga

SEQ ID NO: 3903066 - RNA, 14 nt, Human adenovirus B (HAdV-B)
cauccuuggcuccg

SEQ ID NO: 3903067 - RNA, 22 nt, Human adenovirus B (HAdV-B)
caucggcuaucagggcuucuac

SEQ ID NO: 3903068 - RNA, 18 nt, Human adenovirus B (HAdV-B)
caugcuucuggguaacgg

SEQ ID NO: 3903069 - RNA, 19 nt, Human adenovirus B (HAdV-B)
cauugcuuauugcuugugc

SEQ ID NO: 3903070 - RNA, 17 nt, Human adenovirus B (HAdV-B)
cauuuucccuacuaaua

SEQ ID NO: 3903071 - RNA, 12 nt, Human adenovirus B (HAdV-B)
ccaaaucagaaa

SEQ ID NO: 3903072 - RNA, 14 nt, Human adenovirus B (HAdV-B)
ccaaccucuccaca

SEQ ID NO: 3903073 - RNA, 23 nt, Human adenovirus B (HAdV-B)
ccaagauagcuuugaggccugau

SEQ ID NO: 3903074 - RNA, 13 nt, Human adenovirus B (HAdV-B)
ccaauccaaccuu

SEQ ID NO: 3903075 - RNA, 20 nt, Human adenovirus B (HAdV-B)
ccaaugaauuaaaaaaugau

SEQ ID NO: 3903076 - RNA, 17 nt, Human adenovirus B (HAdV-B)
ccaauuaucgcugcugc

SEQ ID NO: 3903077 - RNA, 17 nt, Human adenovirus B (HAdV-B)
ccacagggucuccagcu

SEQ ID NO: 3903078 - RNA, 18 nt, Human adenovirus B (HAdV-B)
ccagaaguuggaggacgu

SEQ ID NO: 3903079 - RNA, 11 nt, Human adenovirus B (HAdV-B)
ccagaaugagc

SEQ ID NO: 3903080 - RNA, 16 nt, Human adenovirus B (HAdV-B)
ccaggaacgucagcug

SEQ ID NO: 3903081 - RNA, 15 nt, Human adenovirus B (HAdV-B)
ccaguccugccacca

SEQ ID NO: 3903082 - RNA, 17 nt, Human adenovirus B (HAdV-B)
ccagugaaucuaaugau

SEQ ID NO: 3903083 - RNA, 17 nt, Human adenovirus B (HAdV-B)
ccaguguaacaugaauc

SEQ ID NO: 3903084 - RNA, 22 nt, Human adenovirus B (HAdV-B)
ccauaauuaaaagcgcuccagc

SEQ ID NO: 3903085 - RNA, 18 nt, Human adenovirus B (HAdV-B)
ccauaguuaucacccagc

SEQ ID NO: 3903086 - RNA, 21 nt, Human adenovirus B (HAdV-B)
ccaucagcagacacaucacuu

SEQ ID NO: 3903087 - RNA, 23 nt, Human adenovirus B (HAdV-B)
ccaugccuuucucccaagcagac

SEQ ID NO: 3903088 - RNA, 15 nt, Human adenovirus B (HAdV-B)
ccaugcuuagggcgg

SEQ ID NO: 3903089 - RNA, 16 nt, Human adenovirus B (HAdV-B)
cccaauuggcuccagc

SEQ ID NO: 3903090 - RNA, 16 nt, Human adenovirus B (HAdV-B)
cccagaaauuggcccg

SEQ ID NO: 3903091 - RNA, 23 nt, Human adenovirus B (HAdV-B)
cccagggggcaauucuggcccaa

SEQ ID NO: 3903092 - RNA, 21 nt, Human adenovirus B (HAdV-B)
cccgcacuggcugcccccacc

SEQ ID NO: 3903093 - RNA, 12 nt, Human adenovirus B (HAdV-B)
ccgaccuggcag

SEQ ID NO: 3903094 - RNA, 22 nt, Human adenovirus B (HAdV-B)
ccgaccuggcagaccucaucuu

SEQ ID NO: 3903095 - RNA, 12 nt, Human adenovirus B (HAdV-B)
ccgacucuccca

SEQ ID NO: 3903096 - RNA, 20 nt, Human adenovirus B (HAdV-B)
ccgacuuugugccucucacc

SEQ ID NO: 3903097 - RNA, 23 nt, Human adenovirus B (HAdV-B)
ccgauguugugucccagcggcga

SEQ ID NO: 3903098 - RNA, 13 nt, Human adenovirus B (HAdV-B)
ccgccggucccac

SEQ ID NO: 3903099 - RNA, 14 nt, Human adenovirus B (HAdV-B)
ccgcgagugccccc

SEQ ID NO: 3903100 - RNA, 16 nt, Human adenovirus B (HAdV-B)
ccgcuuuuccagaagc

SEQ ID NO: 3903101 - RNA, 13 nt, Human adenovirus B (HAdV-B)
ccggcaggucccg

SEQ ID NO: 3903102 - RNA, 12 nt, Human adenovirus B (HAdV-B)
ccuacuccuggu

SEQ ID NO: 3903103 - RNA, 17 nt, Human adenovirus B (HAdV-B)
ccuauccuuucaaugau

SEQ ID NO: 3903104 - RNA, 20 nt, Human adenovirus B (HAdV-B)
ccucagcgacgaggaaaagg

SEQ ID NO: 3903105 - RNA, 13 nt, Human adenovirus B (HAdV-B)
ccucggugcuccu

SEQ ID NO: 3903106 - RNA, 19 nt, Human adenovirus B (HAdV-B)
ccucuucuccaguggagug

SEQ ID NO: 3903107 - RNA, 18 nt, Human adenovirus B (HAdV-B)
ccuggcagaacacacucu

SEQ ID NO: 3903108 - RNA, 16 nt, Human adenovirus B (HAdV-B)
ccuguacauucccaau

SEQ ID NO: 3903109 - RNA, 18 nt, Human adenovirus B (HAdV-B)
ccuuaccaguguaacaug

SEQ ID NO: 3903110 - RNA, 13 nt, Human adenovirus B (HAdV-B)
ccuuaucaaaugc

SEQ ID NO: 3903111 - RNA, 17 nt, Human adenovirus B (HAdV-B)
ccuucgcggcuggccau

SEQ ID NO: 3903112 - RNA, 14 nt, Human adenovirus B (HAdV-B)
ccuugacccccaga

SEQ ID NO: 3903113 - RNA, 12 nt, Human adenovirus B (HAdV-B)
ccuuucucccaa

SEQ ID NO: 3903114 - RNA, 18 nt, Human adenovirus B (HAdV-B)
cgaagagcaauaaaugac

SEQ ID NO: 3903115 - RNA, 22 nt, Human adenovirus B (HAdV-B)
cgaagccauagggcaaagucag

SEQ ID NO: 3903116 - RNA, 16 nt, Human adenovirus B (HAdV-B)
cgacaugaguaaagaa

SEQ ID NO: 3903117 - RNA, 15 nt, Human adenovirus B (HAdV-B)
cgagggucugggcaa

SEQ ID NO: 3903118 - RNA, 14 nt, Human adenovirus B (HAdV-B)
cgccagcaggaggc

SEQ ID NO: 3903119 - RNA, 17 nt, Human adenovirus B (HAdV-B)
cgcgccguagaagaggg

SEQ ID NO: 3903120 - RNA, 20 nt, Human adenovirus B (HAdV-B)
cgcucgauuguugaucaccu

SEQ ID NO: 3903121 - RNA, 16 nt, Human adenovirus B (HAdV-B)
cggaucuccugggcau

SEQ ID NO: 3903122 - RNA, 22 nt, Human adenovirus B (HAdV-B)
cggauucuuaacagugcaggca

SEQ ID NO: 3903123 - RNA, 13 nt, Human adenovirus B (HAdV-B)
cggcgucccagca

SEQ ID NO: 3903124 - RNA, 15 nt, Human adenovirus B (HAdV-B)
cgguccuuccagggu

SEQ ID NO: 3903125 - RNA, 14 nt, Human adenovirus B (HAdV-B)
cguaguugagcgcc

SEQ ID NO: 3903126 - RNA, 14 nt, Human adenovirus B (HAdV-B)
cguucgcucaccag

SEQ ID NO: 3903127 - RNA, 19 nt, Human adenovirus B (HAdV-B)
cuaaccaggcugugcagaa

SEQ ID NO: 3903128 - RNA, 23 nt, Human adenovirus B (HAdV-B)
cuacacacagaaauauaaauuuu

SEQ ID NO: 3903129 - RNA, 23 nt, Human adenovirus B (HAdV-B)
ugagcaucacagcguucuggugg

SEQ ID NO: 3903130 - RNA, 18 nt, Human adenovirus B (HAdV-B)
ugagcugcgucacgguuu

SEQ ID NO: 3903131 - RNA, 18 nt, Human adenovirus B (HAdV-B)
ugaggaccaaucacagcc

SEQ ID NO: 3903132 - RNA, 23 nt, Human adenovirus B (HAdV-B)
ugaugaagcauacaauccagaca

SEQ ID NO: 3903133 - RNA, 16 nt, Human adenovirus B (HAdV-B)
ugaugcagcagcagca

SEQ ID NO: 3903134 - RNA, 22 nt, Human adenovirus B (HAdV-B)
ugauggauauguggccuggggu

SEQ ID NO: 3903135 - RNA, 19 nt, Human adenovirus B (HAdV-B)
ugauuaacugccuuguaag

SEQ ID NO: 3903136 - RNA, 18 nt, Human adenovirus B (HAdV-B)
ugauuucacucaaaucuu

SEQ ID NO: 3903137 - RNA, 16 nt, Human adenovirus B (HAdV-B)
ugcaaggccccagcag

SEQ ID NO: 3903138 - RNA, 12 nt, Human adenovirus B (HAdV-B)
ugcacgccccac

SEQ ID NO: 3903139 - RNA, 23 nt, Human adenovirus B (HAdV-B)
ugcaucgcuguccggggucaugg

SEQ ID NO: 3903140 - RNA, 18 nt, Human adenovirus B (HAdV-B)
ugccacauccgguggggc

SEQ ID NO: 3903141 - RNA, 16 nt, Human adenovirus B (HAdV-B)
ugccaucuuccagcag

SEQ ID NO: 3903142 - RNA, 22 nt, Human adenovirus B (HAdV-B)
ugcgcccccaacaacagccccc

SEQ ID NO: 3903143 - RNA, 16 nt, Human adenovirus B (HAdV-B)
ugcggaggaggagagg

SEQ ID NO: 3903144 - RNA, 17 nt, Human adenovirus B (HAdV-B)
ugcggaggaggagagga

SEQ ID NO: 3903145 - RNA, 15 nt, Human adenovirus B (HAdV-B)
ugcggcaggcaugca

SEQ ID NO: 3903146 - RNA, 15 nt, Human adenovirus B (HAdV-B)
ugcgggacagcccgc

SEQ ID NO: 3903147 - RNA, 16 nt, Human adenovirus B (HAdV-B)
ugcguucgcucaccag

SEQ ID NO: 3903148 - RNA, 23 nt, Human adenovirus B (HAdV-B)
ugcuaccuguuccgucuggccaa

SEQ ID NO: 3903149 - RNA, 19 nt, Human adenovirus B (HAdV-B)
ugcuuagggcggccagacg

SEQ ID NO: 3903150 - RNA, 18 nt, Human adenovirus B (HAdV-B)
uggaaaagcguggaaaaa

SEQ ID NO: 3903151 - RNA, 20 nt, Human adenovirus B (HAdV-B)
uggcacgucuaggugcgccu

SEQ ID NO: 3903152 - RNA, 23 nt, Human adenovirus B (HAdV-B)
uggcaugagguucagaaagaggg

SEQ ID NO: 3903153 - RNA, 23 nt, Human adenovirus B (HAdV-B)
uggcugggcaccgacucucccag

SEQ ID NO: 3903154 - RNA, 16 nt, Human adenovirus B (HAdV-B)
ugggacagucaggcag

SEQ ID NO: 3903155 - RNA, 20 nt, Human adenovirus B (HAdV-B)
ugggcauuacccggacgagu

SEQ ID NO: 3903156 - RNA, 14 nt, Human adenovirus B (HAdV-B)
uggguagacagaau

SEQ ID NO: 3903157 - RNA, 13 nt, Human adenovirus B (HAdV-B)
uguaagggcagca

SEQ ID NO: 3903158 - RNA, 17 nt, Human adenovirus B (HAdV-B)
ugugcgaauugccuacc

SEQ ID NO: 3903159 - RNA, 20 nt, Human adenovirus B (HAdV-B)
ugugggagggguagcgaucg

SEQ ID NO: 3903160 - RNA, 13 nt, Human adenovirus B (HAdV-B)
ugugugacagaac

SEQ ID NO: 3903161 - RNA, 14 nt, Human adenovirus B (HAdV-B)
uuaaacacacccuc

SEQ ID NO: 3903162 - RNA, 16 nt, Human adenovirus B (HAdV-B)
uuaaaccggucacuuu

SEQ ID NO: 3903163 - RNA, 15 nt, Human adenovirus B (HAdV-B)
uuaauaaaaacugaa

SEQ ID NO: 3903164 - RNA, 13 nt, Human adenovirus B (HAdV-B)
uuacaucucucau

SEQ ID NO: 3903165 - RNA, 23 nt, Human adenovirus B (HAdV-B)
uuacuagucucgcaacucugacu

SEQ ID NO: 3903166 - RNA, 23 nt, Human adenovirus B (HAdV-B)
uuacuuugcgaaacggauugccu

SEQ ID NO: 3903167 - RNA, 23 nt, Human adenovirus B (HAdV-B)
uuagacagcaaccccaggccaac

SEQ ID NO: 3903168 - RNA, 20 nt, Human adenovirus B (HAdV-B)
uuauaaacccaggguuuauu

SEQ ID NO: 3903169 - RNA, 12 nt, Human adenovirus B (HAdV-B)
uucacagcagua

SEQ ID NO: 3903170 - RNA, 17 nt, Human adenovirus B (HAdV-B)
uuccaacccuguaugcc

SEQ ID NO: 3903171 - RNA, 17 nt, Human adenovirus B (HAdV-B)
uuccaucgagugcaccu

SEQ ID NO: 3903172 - RNA, 23 nt, Human adenovirus B (HAdV-B)
uuccccuacaaaacaugcaacau

SEQ ID NO: 3903173 - RNA, 21 nt, Human adenovirus B (HAdV-B)
uuccuagaacagaaaggggga

SEQ ID NO: 3903174 - RNA, 17 nt, Human adenovirus B (HAdV-B)
uucggccugcgucauca

SEQ ID NO: 3903175 - RNA, 17 nt, Human adenovirus B (HAdV-B)
uucuaacuccucaauca

SEQ ID NO: 3903176 - RNA, 15 nt, Human adenovirus B (HAdV-B)
uucuuguagugagga

SEQ ID NO: 3903177 - RNA, 18 nt, Human adenovirus B (HAdV-B)
uuggaauaucuauucuug

SEQ ID NO: 3903178 - RNA, 15 nt, Human adenovirus B (HAdV-B)
uugggugggagagga

SEQ ID NO: 3903179 - RNA, 21 nt, Human adenovirus B (HAdV-B)
uuguagugcuaggaauucuug

SEQ ID NO: 3903180 - RNA, 16 nt, Human adenovirus B (HAdV-B)
uugugauuauucuuug

SEQ ID NO: 3903181 - RNA, 14 nt, Human adenovirus B (HAdV-B)
uuucagaagacaug

SEQ ID NO: 3903182 - RNA, 12 nt, Human adenovirus B (HAdV-B)
uuuccauuccuu

SEQ ID NO: 3903183 - RNA, 12 nt, Human adenovirus B (HAdV-B)
uuucuguucugu

SEQ ID NO: 3903184 - RNA, 17 nt, Human adenovirus B (HAdV-B)
ccguagaagagggaugu

SEQ ID NO: 3903185 - RNA, 13 nt, Human adenovirus B (HAdV-B)
ccuaacaggaauu

SEQ ID NO: 3903186 - RNA, 21 nt, Human adenovirus B (HAdV-B)
ccuccccaauuggcuccagca

SEQ ID NO: 3903187 - RNA, 22 nt, Human adenovirus B (HAdV-B)
ccugcaacgaauuuucucccag

SEQ ID NO: 3903188 - RNA, 9 nt, Human adenovirus B (HAdV-B)
ccugcugcu

SEQ ID NO: 3903189 - RNA, 21 nt, Human adenovirus B (HAdV-B)
ccuggcaccuacggagggcag

SEQ ID NO: 3903190 - RNA, 14 nt, Human adenovirus B (HAdV-B)
ccugguccugugac

SEQ ID NO: 3903191 - RNA, 14 nt, Human adenovirus B (HAdV-B)
ccuguaugccaucu

SEQ ID NO: 3903192 - RNA, 19 nt, Human adenovirus B (HAdV-B)
ccuguaugccaucuuccag

SEQ ID NO: 3903193 - RNA, 18 nt, Human adenovirus B (HAdV-B)
ccuuaucaaaugcucacu

SEQ ID NO: 3903194 - RNA, 16 nt, Human adenovirus B (HAdV-B)
ccuucuccggaucucc

SEQ ID NO: 3903195 - RNA, 19 nt, Human adenovirus B (HAdV-B)
cgaagccuuuagacagcaa

SEQ ID NO: 3903196 - RNA, 21 nt, Human adenovirus B (HAdV-B)
cgaggaaaaggagcagagcuu

SEQ ID NO: 3903197 - RNA, 14 nt, Human adenovirus B (HAdV-B)
cgaggaggaagagg

SEQ ID NO: 3903198 - RNA, 15 nt, Human adenovirus B (HAdV-B)
cgaggaggaagaggg

SEQ ID NO: 3903199 - RNA, 21 nt, Human adenovirus B (HAdV-B)
cgaguuaaugauauacgcgcc

SEQ ID NO: 3903200 - RNA, 20 nt, Human adenovirus B (HAdV-B)
cgaucucgcaguacuucaaa

SEQ ID NO: 3903201 - RNA, 14 nt, Human adenovirus B (HAdV-B)
cgauggcugggcac

SEQ ID NO: 3903202 - RNA, 16 nt, Human adenovirus B (HAdV-B)
cgcaaaaaauggccug

SEQ ID NO: 3903203 - RNA, 21 nt, Human adenovirus B (HAdV-B)
cgcaucucaugacaugcagaa

SEQ ID NO: 3903204 - RNA, 16 nt, Human adenovirus B (HAdV-B)
cgccaaacccaacaca

SEQ ID NO: 3903205 - RNA, 19 nt, Human adenovirus B (HAdV-B)
cgcccucaagggccgcacu

SEQ ID NO: 3903206 - RNA, 20 nt, Human adenovirus B (HAdV-B)
cgcgguuagcgccagcagga

SEQ ID NO: 3903207 - RNA, 19 nt, Human adenovirus B (HAdV-B)
cgcuuccgaccuggcagac

SEQ ID NO: 3903208 - RNA, 13 nt, Human adenovirus B (HAdV-B)
cggcucugggcau

SEQ ID NO: 3903209 - RNA, 23 nt, Human adenovirus B (HAdV-B)
cgggacccugccguugcgcagca

SEQ ID NO: 3903210 - RNA, 16 nt, Human adenovirus B (HAdV-B)
cgggguugggcaaagc

SEQ ID NO: 3903211 - RNA, 23 nt, Human adenovirus B (HAdV-B)
cggugcuuccgaugagaggccuu

SEQ ID NO: 3903212 - RNA, 21 nt, Human adenovirus B (HAdV-B)
cgguugagaugccuuucauga

SEQ ID NO: 3903213 - RNA, 19 nt, Human adenovirus B (HAdV-B)
cguccuuucaagccgcacu

SEQ ID NO: 3903214 - RNA, 13 nt, Human adenovirus B (HAdV-B)
cgugaugcagcag

SEQ ID NO: 3903215 - RNA, 18 nt, Human adenovirus B (HAdV-B)
cguuaaccccacagccaa

SEQ ID NO: 3903216 - RNA, 21 nt, Human adenovirus B (HAdV-B)
cguuccugcucucacagauca

SEQ ID NO: 3903217 - RNA, 20 nt, Human adenovirus B (HAdV-B)
cuaaggccauuugccauucu

SEQ ID NO: 3903218 - RNA, 14 nt, Human adenovirus B (HAdV-B)
cuaaugauugcaaa

SEQ ID NO: 3903219 - RNA, 14 nt, Human adenovirus B (HAdV-B)
cuacaaaacaugca

SEQ ID NO: 3903220 - RNA, 18 nt, Human adenovirus B (HAdV-B)
cuacagcugcugcagaag

SEQ ID NO: 3903221 - RNA, 21 nt, Human adenovirus B (HAdV-B)
cuagcuuguuaacuccgaacu

SEQ ID NO: 3903222 - RNA, 19 nt, Human adenovirus B (HAdV-B)
cuauaggcucaaacugcac

SEQ ID NO: 3903223 - RNA, 15 nt, Human adenovirus B (HAdV-B)
cuauccgcaagcaau

SEQ ID NO: 3903224 - RNA, 20 nt, Human adenovirus B (HAdV-B)
cuauggagucacugcuaccu

SEQ ID NO: 3903225 - RNA, 18 nt, Human adenovirus B (HAdV-B)
cuauucaaccuguagaaa

SEQ ID NO: 3903226 - RNA, 14 nt, Human adenovirus B (HAdV-B)
cuauuuagagacag

SEQ ID NO: 3903227 - RNA, 12 nt, Human adenovirus B (HAdV-B)
cucaaaacucca

SEQ ID NO: 3903228 - RNA, 16 nt, Human adenovirus B (HAdV-B)
cucacuauucaaccug

SEQ ID NO: 3903229 - RNA, 22 nt, Human adenovirus B (HAdV-B)
cucacuucccucuucccaacuc

SEQ ID NO: 3903230 - RNA, 15 nt, Human adenovirus B (HAdV-B)
cucacuugccacccu

SEQ ID NO: 3903231 - RNA, 18 nt, Human adenovirus B (HAdV-B)
cucaguggauugcagaag

SEQ ID NO: 3903232 - RNA, 19 nt, Human adenovirus B (HAdV-B)
cuccaacauuguuaguuuu

SEQ ID NO: 3903233 - RNA, 17 nt, Human adenovirus B (HAdV-B)
cuccaucagcagacaca

SEQ ID NO: 3903234 - RNA, 23 nt, Human adenovirus B (HAdV-B)
cuccgguauccugcccgccaccu

SEQ ID NO: 3903235 - RNA, 20 nt, Human adenovirus B (HAdV-B)
cucgcaacucugacuucugc

SEQ ID NO: 3903236 - RNA, 17 nt, Human adenovirus B (HAdV-B)
cucuucgggggcagagg

SEQ ID NO: 3903237 - RNA, 14 nt, Human adenovirus B (HAdV-B)
cucuucuccagugg

SEQ ID NO: 3903238 - RNA, 12 nt, Human adenovirus B (HAdV-B)
cucuucucuuuc

SEQ ID NO: 3903239 - RNA, 21 nt, Human adenovirus B (HAdV-B)
cugaagugcccaucagugugg

SEQ ID NO: 3903240 - RNA, 16 nt, Human adenovirus B (HAdV-B)
cugacacuccuggucc

SEQ ID NO: 3903241 - RNA, 17 nt, Human adenovirus B (HAdV-B)
cugaugggagugggguc

SEQ ID NO: 3903242 - RNA, 15 nt, Human adenovirus B (HAdV-B)
cugcaacuacugcaa

SEQ ID NO: 3903243 - RNA, 21 nt, Human adenovirus B (HAdV-B)
cugcaaucaugcccacaucca

SEQ ID NO: 3903244 - RNA, 18 nt, Human adenovirus B (HAdV-B)
cugccaaugcaaccaaua

SEQ ID NO: 3903245 - RNA, 19 nt, Human adenovirus B (HAdV-B)
cugccguugcgcagcagua

SEQ ID NO: 3903246 - RNA, 20 nt, Human adenovirus B (HAdV-B)
cuggaggacagucuggagga

SEQ ID NO: 3903247 - RNA, 22 nt, Human adenovirus B (HAdV-B)
cuggcacgauucucacuugcca

SEQ ID NO: 3903248 - RNA, 18 nt, Human adenovirus B (HAdV-B)
cuggcuuucauccaugga

SEQ ID NO: 3903249 - RNA, 19 nt, Human adenovirus B (HAdV-B)
cugggaccugguucacgcu

SEQ ID NO: 3903250 - RNA, 19 nt, Human adenovirus B (HAdV-B)
cugggaugggaucccgaaa

SEQ ID NO: 3903251 - RNA, 17 nt, Human adenovirus B (HAdV-B)
cuguauaggagcauuug

SEQ ID NO: 3903252 - RNA, 20 nt, Human adenovirus B (HAdV-B)
cuguggacaguuaugauccu

SEQ ID NO: 3903253 - RNA, 18 nt, Human adenovirus B (HAdV-B)
cuguguagaugccugggg

SEQ ID NO: 3903254 - RNA, 17 nt, Human adenovirus B (HAdV-B)
cuuacauucaauucaaa

SEQ ID NO: 3903255 - RNA, 14 nt, Human adenovirus B (HAdV-B)
cuuagaaaaugcaa

SEQ ID NO: 3903256 - RNA, 20 nt, Human adenovirus B (HAdV-B)
cuuaucaacauucuacagag

SEQ ID NO: 3903257 - RNA, 16 nt, Human adenovirus B (HAdV-B)
cuuccagaaaacaaaa

SEQ ID NO: 3903258 - RNA, 19 nt, Human adenovirus B (HAdV-B)
cuucuccggaucuccuggg

SEQ ID NO: 3903259 - RNA, 13 nt, Human adenovirus B (HAdV-B)
cuucuccugggca

SEQ ID NO: 3903260 - RNA, 14 nt, Human adenovirus B (HAdV-B)
cuucuccugggcaa

SEQ ID NO: 3903261 - RNA, 22 nt, Human adenovirus B (HAdV-B)
cuucuuagacucaucuaaaacc

SEQ ID NO: 3903262 - RNA, 20 nt, Human adenovirus B (HAdV-B)
cuugagaaugaaaaauaucu

SEQ ID NO: 3903263 - RNA, 21 nt, Human adenovirus B (HAdV-B)
cuugcuggagugucacugccg

SEQ ID NO: 3903264 - RNA, 15 nt, Human adenovirus B (HAdV-B)
cuugugacuagugaa

SEQ ID NO: 3903265 - RNA, 13 nt, Human adenovirus B (HAdV-B)
gaacgaaacuuuu

SEQ ID NO: 3903266 - RNA, 17 nt, Human adenovirus B (HAdV-B)
gaagacaguuuggagga

SEQ ID NO: 3903267 - RNA, 17 nt, Human adenovirus B (HAdV-B)
gaagaugaacuucccaa

SEQ ID NO: 3903268 - RNA, 21 nt, Human adenovirus B (HAdV-B)
gaagauugggacagucaggca

SEQ ID NO: 3903269 - RNA, 17 nt, Human adenovirus B (HAdV-B)
gaaucaccaacuuggga

SEQ ID NO: 3903270 - RNA, 21 nt, Human adenovirus B (HAdV-B)
gaaugacccgcaggcagugau

SEQ ID NO: 3903271 - RNA, 19 nt, Human adenovirus B (HAdV-B)
gacaauucucuagaaacuu

SEQ ID NO: 3903272 - RNA, 14 nt, Human adenovirus B (HAdV-B)
gacagaauggagug

SEQ ID NO: 3903273 - RNA, 23 nt, Human adenovirus B (HAdV-B)
gacgaaaguacgguccagcaagu

SEQ ID NO: 3903274 - RNA, 13 nt, Human adenovirus B (HAdV-B)
gacuauaaaagua

SEQ ID NO: 3903275 - RNA, 17 nt, Human adenovirus B (HAdV-B)
gacuugucuccugaacu

SEQ ID NO: 3903276 - RNA, 14 nt, Human adenovirus B (HAdV-B)
gagacgagccuggg

SEQ ID NO: 3903277 - RNA, 15 nt, Human adenovirus B (HAdV-B)
gagacgcccaggccg

SEQ ID NO: 3903278 - RNA, 15 nt, Human adenovirus B (HAdV-B)
gagaugcgagcuucc

SEQ ID NO: 3903279 - RNA, 14 nt, Human adenovirus B (HAdV-B)
gagccugggaucau

SEQ ID NO: 3903280 - RNA, 15 nt, Human adenovirus B (HAdV-B)
gagcucagccgcgcc

SEQ ID NO: 3903281 - RNA, 17 nt, Human adenovirus B (HAdV-B)
gaggcagucuaccugcg

SEQ ID NO: 3903282 - RNA, 14 nt, Human adenovirus B (HAdV-B)
gagugcgggggcaa

SEQ ID NO: 3903283 - RNA, 14 nt, Human adenovirus B (HAdV-B)
gagugcuugaaagu

SEQ ID NO: 3903284 - RNA, 15 nt, Human adenovirus B (HAdV-B)
gagugcuugaaagug

SEQ ID NO: 3903285 - RNA, 16 nt, Human adenovirus B (HAdV-B)
gaguucauaccgaacu

SEQ ID NO: 3903286 - RNA, 23 nt, Human adenovirus B (HAdV-B)
gauccauggaugcccaugccuau

SEQ ID NO: 3903287 - RNA, 13 nt, Human adenovirus B (HAdV-B)
cucccuggcuccu

SEQ ID NO: 3903288 - RNA, 14 nt, Human adenovirus B (HAdV-B)
cuccuaggcagaga

SEQ ID NO: 3903289 - RNA, 18 nt, Human adenovirus B (HAdV-B)
cucgaaaacugguuagcu

SEQ ID NO: 3903290 - RNA, 16 nt, Human adenovirus B (HAdV-B)
cucuaccccauuccug

SEQ ID NO: 3903291 - RNA, 16 nt, Human adenovirus B (HAdV-B)
cucugacacuccuggu

SEQ ID NO: 3903292 - RNA, 23 nt, Human adenovirus B (HAdV-B)
cucugagcgccgcgacggcagga

SEQ ID NO: 3903293 - RNA, 23 nt, Human adenovirus B (HAdV-B)
cugagcaauugagauuugccaca

SEQ ID NO: 3903294 - RNA, 19 nt, Human adenovirus B (HAdV-B)
cugcaaccauggccugcgg

SEQ ID NO: 3903295 - RNA, 14 nt, Human adenovirus B (HAdV-B)
cugcaaucaugccc

SEQ ID NO: 3903296 - RNA, 13 nt, Human adenovirus B (HAdV-B)
cugcagaaucauu

SEQ ID NO: 3903297 - RNA, 13 nt, Human adenovirus B (HAdV-B)
cugcagagccagc

SEQ ID NO: 3903298 - RNA, 17 nt, Human adenovirus B (HAdV-B)
cugcgguccgaccugga

SEQ ID NO: 3903299 - RNA, 21 nt, Human adenovirus B (HAdV-B)
cugcguucgcucaccagaagu

SEQ ID NO: 3903300 - RNA, 23 nt, Human adenovirus B (HAdV-B)
cugcuugggcgcuugccagggug

SEQ ID NO: 3903301 - RNA, 19 nt, Human adenovirus B (HAdV-B)
cuggacuacuugcacagag

SEQ ID NO: 3903302 - RNA, 13 nt, Human adenovirus B (HAdV-B)
cugguggccaccu

SEQ ID NO: 3903303 - RNA, 17 nt, Human adenovirus B (HAdV-B)
cugguuuuuauugcuuu

SEQ ID NO: 3903304 - RNA, 16 nt, Human adenovirus B (HAdV-B)
cuguauaggagcauuu

SEQ ID NO: 3903305 - RNA, 15 nt, Human adenovirus B (HAdV-B)
cuuaacauuuaauuu

SEQ ID NO: 3903306 - RNA, 17 nt, Human adenovirus B (HAdV-B)
cuuaccggcucugggca

SEQ ID NO: 3903307 - RNA, 12 nt, Human adenovirus B (HAdV-B)
cuuaccuuuggu

SEQ ID NO: 3903308 - RNA, 22 nt, Human adenovirus B (HAdV-B)
cuuagauuugauauuuaauuug

SEQ ID NO: 3903309 - RNA, 15 nt, Human adenovirus B (HAdV-B)
cuucaacauccagga

SEQ ID NO: 3903310 - RNA, 21 nt, Human adenovirus B (HAdV-B)
cuucgacccagaaaacugcac

SEQ ID NO: 3903311 - RNA, 14 nt, Human adenovirus B (HAdV-B)
cuucucauaauuuu

SEQ ID NO: 3903312 - RNA, 19 nt, Human adenovirus B (HAdV-B)
cuugaauucgggaaucacc

SEQ ID NO: 3903313 - RNA, 18 nt, Human adenovirus B (HAdV-B)
cuugaccacgguggugca

SEQ ID NO: 3903314 - RNA, 14 nt, Human adenovirus B (HAdV-B)
cuugcaggacagaa

SEQ ID NO: 3903315 - RNA, 15 nt, Human adenovirus B (HAdV-B)
cuugcaggucugccu

SEQ ID NO: 3903316 - RNA, 23 nt, Human adenovirus B (HAdV-B)
cuugccagggugcgcuucagacu

SEQ ID NO: 3903317 - RNA, 20 nt, Human adenovirus B (HAdV-B)
cuugcuggagugucacugcc

SEQ ID NO: 3903318 - RNA, 13 nt, Human adenovirus B (HAdV-B)
cuugggacagaau

SEQ ID NO: 3903319 - RNA, 14 nt, Human adenovirus B (HAdV-B)
cuuggguugccacu

SEQ ID NO: 3903320 - RNA, 15 nt, Human adenovirus B (HAdV-B)
cuugguuugaugcau

SEQ ID NO: 3903321 - RNA, 21 nt, Human adenovirus B (HAdV-B)
cuuguagugaggaaaaguuuu

SEQ ID NO: 3903322 - RNA, 11 nt, Human adenovirus B (HAdV-B)
cuuuaaguuua

SEQ ID NO: 3903323 - RNA, 14 nt, Human adenovirus B (HAdV-B)
cuuuaugagccaga

SEQ ID NO: 3903324 - RNA, 20 nt, Human adenovirus B (HAdV-B)
cuuugugccucucaccuacc

SEQ ID NO: 3903325 - RNA, 15 nt, Human adenovirus B (HAdV-B)
gaacagcaguacagg

SEQ ID NO: 3903326 - RNA, 14 nt, Human adenovirus B (HAdV-B)
gaagauauggagga

SEQ ID NO: 3903327 - RNA, 15 nt, Human adenovirus B (HAdV-B)
gaagccguacauggg

SEQ ID NO: 3903328 - RNA, 14 nt, Human adenovirus B (HAdV-B)
gaaggacucccagu

SEQ ID NO: 3903329 - RNA, 20 nt, Human adenovirus B (HAdV-B)
gaaggcgauaaugccagacu

SEQ ID NO: 3903330 - RNA, 22 nt, Human adenovirus B (HAdV-B)
gaaggggugugcgccugcuugg

SEQ ID NO: 3903331 - RNA, 12 nt, Human adenovirus B (HAdV-B)
gaauacaccaau

SEQ ID NO: 3903332 - RNA, 19 nt, Human adenovirus B (HAdV-B)
gaaucauaauauugccaug

SEQ ID NO: 3903333 - RNA, 21 nt, Human adenovirus B (HAdV-B)
gaaugaaggcgaagcaagggu

SEQ ID NO: 3903334 - RNA, 18 nt, Human adenovirus B (HAdV-B)
gaauggcagggaagugag

SEQ ID NO: 3903335 - RNA, 23 nt, Human adenovirus B (HAdV-B)
gacacggcuuugugcggcaggca

SEQ ID NO: 3903336 - RNA, 15 nt, Human adenovirus B (HAdV-B)
gacacuccugguccu

SEQ ID NO: 3903337 - RNA, 18 nt, Human adenovirus B (HAdV-B)
gacagacaucgagcaaga

SEQ ID NO: 3903338 - RNA, 16 nt, Human adenovirus B (HAdV-B)
gacagucaggcagagg

SEQ ID NO: 3903339 - RNA, 21 nt, Human adenovirus B (HAdV-B)
gacaugcaugacccagaugcc

SEQ ID NO: 3903340 - RNA, 13 nt, Human adenovirus B (HAdV-B)
gacgaaguguacc

SEQ ID NO: 3903341 - RNA, 16 nt, Human adenovirus B (HAdV-B)
gacuccguagccugga

SEQ ID NO: 3903342 - RNA, 21 nt, Human adenovirus B (HAdV-B)
gacugccgcuucuucaacccg

SEQ ID NO: 3903343 - RNA, 20 nt, Human adenovirus B (HAdV-B)
gacuuuaugagccagagcau

SEQ ID NO: 3903344 - RNA, 12 nt, Human adenovirus B (HAdV-B)
gagaauaaaaaa

SEQ ID NO: 3903345 - RNA, 14 nt, Human adenovirus B (HAdV-B)
gagacaagcaacag

SEQ ID NO: 3903346 - RNA, 15 nt, Human adenovirus B (HAdV-B)
gagacgagccuggga

SEQ ID NO: 3903347 - RNA, 14 nt, Human adenovirus B (HAdV-B)
gagacgcuggugac

SEQ ID NO: 3903348 - RNA, 12 nt, Human adenovirus B (HAdV-B)
gagcagacagua

SEQ ID NO: 3903349 - RNA, 21 nt, Human adenovirus B (HAdV-B)
gagccagcgcaaacccgagag

SEQ ID NO: 3903350 - RNA, 17 nt, Human adenovirus B (HAdV-B)
gagcugacuugcagugg

SEQ ID NO: 3903351 - RNA, 16 nt, Human adenovirus B (HAdV-B)
gagcuuaagcauucca

SEQ ID NO: 3903352 - RNA, 19 nt, Human adenovirus B (HAdV-B)
gaggaaaaggagcagagcu

SEQ ID NO: 3903353 - RNA, 15 nt, Human adenovirus B (HAdV-B)
gagggucugcaucca

SEQ ID NO: 3903354 - RNA, 19 nt, Human adenovirus B (HAdV-B)
gaguucuuacuuuaaaaug

SEQ ID NO: 3903355 - RNA, 20 nt, Human adenovirus B (HAdV-B)
gauacucaagacaaggcagu

SEQ ID NO: 3903356 - RNA, 18 nt, Human adenovirus B (HAdV-B)
gauagccccaauggccac

SEQ ID NO: 3903357 - RNA, 16 nt, Human adenovirus B (HAdV-B)
gaucaccugggcagcu

SEQ ID NO: 3903358 - RNA, 14 nt, Human adenovirus B (HAdV-B)
gaucaugccuggag

SEQ ID NO: 3903359 - RNA, 11 nt, Human adenovirus B (HAdV-B)
gaucuccuggg

SEQ ID NO: 3903360 - RNA, 12 nt, Human adenovirus B (HAdV-B)
gaugagcaucac

SEQ ID NO: 3903361 - RNA, 14 nt, Human adenovirus B (HAdV-B)
gauggaacagcaag

SEQ ID NO: 3903362 - RNA, 18 nt, Human adenovirus B (HAdV-B)
gaugucucacgcuugcca

SEQ ID NO: 3903363 - RNA, 14 nt, Human adenovirus B (HAdV-B)
gauugcccaggacu

SEQ ID NO: 3903364 - RNA, 14 nt, Human adenovirus B (HAdV-B)
gcaaaucuggaaga

SEQ ID NO: 3903365 - RNA, 14 nt, Human adenovirus B (HAdV-B)
gcaaggccccagca

SEQ ID NO: 3903366 - RNA, 17 nt, Human adenovirus B (HAdV-B)
gcaaggccccagcagcc

SEQ ID NO: 3903367 - RNA, 20 nt, Human adenovirus B (HAdV-B)
gcacacguggcugcagccaa

SEQ ID NO: 3903368 - RNA, 21 nt, Human adenovirus B (HAdV-B)
gcacauccaagaacaaaagaa

SEQ ID NO: 3903369 - RNA, 18 nt, Human adenovirus B (HAdV-B)
gcacccaauuaggcuugu

SEQ ID NO: 3903370 - RNA, 19 nt, Human adenovirus B (HAdV-B)
gcacgguuugaccagugag

SEQ ID NO: 3903371 - RNA, 13 nt, Human adenovirus B (HAdV-B)
gcagaauaaaaaa

SEQ ID NO: 3903372 - RNA, 16 nt, Human adenovirus B (HAdV-B)
gcagagacaaugaggc

SEQ ID NO: 3903373 - RNA, 19 nt, Human adenovirus B (HAdV-B)
gcagcaauguuuagaagaa

SEQ ID NO: 3903374 - RNA, 16 nt, Human adenovirus B (HAdV-B)
gcagcacuggacauga

SEQ ID NO: 3903375 - RNA, 14 nt, Human adenovirus B (HAdV-B)
gcagcagcagcaau

SEQ ID NO: 3903376 - RNA, 21 nt, Human adenovirus B (HAdV-B)
gcaggaacugaaaauaaaaaa

SEQ ID NO: 3903377 - RNA, 14 nt, Human adenovirus B (HAdV-B)
gcaggcaagcagcc

SEQ ID NO: 3903378 - RNA, 20 nt, Human adenovirus B (HAdV-B)
gcaggcacuucagcuugccc

SEQ ID NO: 3903379 - RNA, 18 nt, Human adenovirus B (HAdV-B)
gcaguagaugggacgaga

SEQ ID NO: 3903380 - RNA, 16 nt, Human adenovirus B (HAdV-B)
gcauacaugccacaga

SEQ ID NO: 3903381 - RNA, 16 nt, Human adenovirus B (HAdV-B)
gccaaagagcucagag

SEQ ID NO: 3903382 - RNA, 19 nt, Human adenovirus B (HAdV-B)
gcccgucuucucaaagagc

SEQ ID NO: 3903383 - RNA, 23 nt, Human adenovirus B (HAdV-B)
gccugcaacgaauuuucucccag

SEQ ID NO: 3903384 - RNA, 16 nt, Human adenovirus B (HAdV-B)
gccugcgucaucaccc

SEQ ID NO: 3903385 - RNA, 17 nt, Human adenovirus B (HAdV-B)
gcgaagcaucgagguca

SEQ ID NO: 3903386 - RNA, 17 nt, Human adenovirus B (HAdV-B)
gcgccaaggucaacccu

SEQ ID NO: 3903387 - RNA, 18 nt, Human adenovirus B (HAdV-B)
gcgccaugacagacagag

SEQ ID NO: 3903388 - RNA, 22 nt, Human adenovirus B (HAdV-B)
gcgccugcuugggcgcuugcca

SEQ ID NO: 3903389 - RNA, 19 nt, Human adenovirus B (HAdV-B)
gcgcgauaccaggcauagc

SEQ ID NO: 3903390 - RNA, 22 nt, Human adenovirus B (HAdV-B)
aaaaaguucuugugugacagaa

SEQ ID NO: 3903391 - RNA, 22 nt, Human adenovirus B (HAdV-B)
aaaacacacuacccacauacau

SEQ ID NO: 3903392 - RNA, 19 nt, Human adenovirus B (HAdV-B)
ccagcgguucuggaggagg

SEQ ID NO: 3903393 - RNA, 15 nt, Human adenovirus B (HAdV-B)
ccagguggucucugg

SEQ ID NO: 3903394 - RNA, 19 nt, Human adenovirus B (HAdV-B)
ccagguuguaucuggugga

SEQ ID NO: 3903395 - RNA, 13 nt, Human adenovirus B (HAdV-B)
ccaguggaggagg

SEQ ID NO: 3903396 - RNA, 17 nt, Human adenovirus B (HAdV-B)
ccaucagcgacggaugu

SEQ ID NO: 3903397 - RNA, 22 nt, Human adenovirus B (HAdV-B)
ccaucgugaacgcguuggugga

SEQ ID NO: 3903398 - RNA, 15 nt, Human adenovirus B (HAdV-B)
ccaucuuccagcaga

SEQ ID NO: 3903399 - RNA, 16 nt, Human adenovirus B (HAdV-B)
ccaucuuccagcagag

SEQ ID NO: 3903400 - RNA, 16 nt, Human adenovirus B (HAdV-B)
ccaugccuuucuccca

SEQ ID NO: 3903401 - RNA, 18 nt, Human adenovirus B (HAdV-B)
cccagggauuuggaagag

SEQ ID NO: 3903402 - RNA, 19 nt, Human adenovirus B (HAdV-B)
ccccuacuauagccagcaa

SEQ ID NO: 3903403 - RNA, 18 nt, Human adenovirus B (HAdV-B)
cccgucuucucaaagagc

SEQ ID NO: 3903404 - RNA, 20 nt, Human adenovirus B (HAdV-B)
cccuccgacuuugugccucu

SEQ ID NO: 3903405 - RNA, 17 nt, Human adenovirus B (HAdV-B)
cccuugaagccaugcug

SEQ ID NO: 3903406 - RNA, 14 nt, Human adenovirus B (HAdV-B)
ccgacucucccagg

SEQ ID NO: 3903407 - RNA, 13 nt, Human adenovirus B (HAdV-B)
ccgauccaugcuu

SEQ ID NO: 3903408 - RNA, 17 nt, Human adenovirus B (HAdV-B)
ccgccgcccccagaaga

SEQ ID NO: 3903409 - RNA, 21 nt, Human adenovirus B (HAdV-B)
ccggcaucauucacacagcag

SEQ ID NO: 3903410 - RNA, 19 nt, Human adenovirus B (HAdV-B)
ccguagacgcacaagcaaa

SEQ ID NO: 3903411 - RNA, 13 nt, Human adenovirus B (HAdV-B)
ccgucaccuccac

SEQ ID NO: 3903412 - RNA, 23 nt, Human adenovirus B (HAdV-B)
ccuacauggguauucugcaugag

SEQ ID NO: 3903413 - RNA, 13 nt, Human adenovirus B (HAdV-B)
ccuaucacaucuu

SEQ ID NO: 3903414 - RNA, 22 nt, Human adenovirus B (HAdV-B)
ccucggcugcguggccuuuggc

SEQ ID NO: 3903415 - RNA, 14 nt, Human adenovirus B (HAdV-B)
ccugcugcuacugc

SEQ ID NO: 3903416 - RNA, 18 nt, Human adenovirus B (HAdV-B)
ccugcugcuucucccagg

SEQ ID NO: 3903417 - RNA, 16 nt, Human adenovirus B (HAdV-B)
ccuggcaccuacggag

SEQ ID NO: 3903418 - RNA, 13 nt, Human adenovirus B (HAdV-B)
ccuuaaucccaga

SEQ ID NO: 3903419 - RNA, 16 nt, Human adenovirus B (HAdV-B)
cgagaagguggcugcc

SEQ ID NO: 3903420 - RNA, 22 nt, Human adenovirus B (HAdV-B)
cgagucaguggacggcuacgau

SEQ ID NO: 3903421 - RNA, 15 nt, Human adenovirus B (HAdV-B)
cgagucgaggaaccc

SEQ ID NO: 3903422 - RNA, 18 nt, Human adenovirus B (HAdV-B)
cgauccagcagaccuccu

SEQ ID NO: 3903423 - RNA, 21 nt, Human adenovirus B (HAdV-B)
cgcgcuaaucgcacccgcgcc

SEQ ID NO: 3903424 - RNA, 18 nt, Human adenovirus B (HAdV-B)
cggcaggcgccucccagg

SEQ ID NO: 3903425 - RNA, 18 nt, Human adenovirus B (HAdV-B)
cggcgcccuggugcggca

SEQ ID NO: 3903426 - RNA, 19 nt, Human adenovirus B (HAdV-B)
cggggucaucuugcagguc

SEQ ID NO: 3903427 - RNA, 20 nt, Human adenovirus B (HAdV-B)
cgguaugcccuagaccaccg

SEQ ID NO: 3903428 - RNA, 19 nt, Human adenovirus B (HAdV-B)
cguacgagagcgugaugca

SEQ ID NO: 3903429 - RNA, 14 nt, Human adenovirus B (HAdV-B)
cguagccuggagga

SEQ ID NO: 3903430 - RNA, 19 nt, Human adenovirus B (HAdV-B)
cguguuggauugccacagc

SEQ ID NO: 3903431 - RNA, 19 nt, Human adenovirus B (HAdV-B)
cguuccuaugaugaggugu

SEQ ID NO: 3903432 - RNA, 17 nt, Human adenovirus B (HAdV-B)
cuaaaauugucauguau

SEQ ID NO: 3903433 - RNA, 19 nt, Human adenovirus B (HAdV-B)
cuaagaugaaaccaugcua

SEQ ID NO: 3903434 - RNA, 18 nt, Human adenovirus B (HAdV-B)
cuaccgcgagugcccccc

SEQ ID NO: 3903435 - RNA, 18 nt, Human adenovirus B (HAdV-B)
cuaccgucaccuccacag

SEQ ID NO: 3903436 - RNA, 16 nt, Human adenovirus B (HAdV-B)
cuaccuugacccccag

SEQ ID NO: 3903437 - RNA, 15 nt, Human adenovirus B (HAdV-B)
cuacggaagccagca

SEQ ID NO: 3903438 - RNA, 22 nt, Human adenovirus B (HAdV-B)
cuagucuguuccacaguucagu

SEQ ID NO: 3903439 - RNA, 14 nt, Human adenovirus B (HAdV-B)
cuauaucucccaga

SEQ ID NO: 3903440 - RNA, 20 nt, Human adenovirus B (HAdV-B)
cuauugauuugaugaacaau

SEQ ID NO: 3903441 - RNA, 22 nt, Human adenovirus B (HAdV-B)
cucacagaucacgggacccugc

SEQ ID NO: 3903442 - RNA, 16 nt, Human adenovirus B (HAdV-B)
cucacuugccacccuc

SEQ ID NO: 3903443 - RNA, 20 nt, Human adenovirus B (HAdV-B)
cucaggauuuagaaacauau

SEQ ID NO: 3903444 - RNA, 21 nt, Human adenovirus B (HAdV-B)
cuccaacagaaaaccagcagc

SEQ ID NO: 3903445 - RNA, 11 nt, Human adenovirus B (HAdV-B)
cuccaagcaag

SEQ ID NO: 3903446 - RNA, 22 nt, Human adenovirus B (HAdV-B)
cuccacagcuuucuggucagcu

SEQ ID NO: 3903447 - RNA, 18 nt, Human adenovirus B (HAdV-B)
cuccagacacucauguag

SEQ ID NO: 3903448 - RNA, 20 nt, Human adenovirus B (HAdV-B)
cucccagacucguacaaaua

SEQ ID NO: 3903449 - RNA, 14 nt, Human adenovirus B (HAdV-B)
cuccgacugcagca

SEQ ID NO: 3903450 - RNA, 14 nt, Human adenovirus B (HAdV-B)
cuccuuaaacaucu

SEQ ID NO: 3903451 - RNA, 12 nt, Human adenovirus B (HAdV-B)
cucgacccagcc

SEQ ID NO: 3903452 - RNA, 17 nt, Human adenovirus B (HAdV-B)
cucgagcugccagugcg

SEQ ID NO: 3903453 - RNA, 13 nt, Human adenovirus B (HAdV-B)
cucgcccccacug

SEQ ID NO: 3903454 - RNA, 14 nt, Human adenovirus B (HAdV-B)
cucgcuggccacau

SEQ ID NO: 3903455 - RNA, 13 nt, Human adenovirus B (HAdV-B)
cucggcugcggag

SEQ ID NO: 3903456 - RNA, 17 nt, Human adenovirus B (HAdV-B)
cucgguauaaaacaucc

SEQ ID NO: 3903457 - RNA, 16 nt, Human adenovirus B (HAdV-B)
cucuauaucucccaga

SEQ ID NO: 3903458 - RNA, 22 nt, Human adenovirus B (HAdV-B)
cucuccaaccucuccacaauau

SEQ ID NO: 3903459 - RNA, 13 nt, Human adenovirus B (HAdV-B)
aaagcacaagcuc

SEQ ID NO: 3903460 - RNA, 21 nt, Human adenovirus B (HAdV-B)
aacaagauuggaauaagcaua

SEQ ID NO: 3903461 - RNA, 23 nt, Human adenovirus B (HAdV-B)
aacagccccccucgcagcagcag

SEQ ID NO: 3903462 - RNA, 10 nt, Human adenovirus B (HAdV-B)
aaccccacua

SEQ ID NO: 3903463 - RNA, 23 nt, Human adenovirus B (HAdV-B)
aaccgguauaucgggcaggaugu

SEQ ID NO: 3903464 - RNA, 20 nt, Human adenovirus B (HAdV-B)
aacugguuagcugcacagcc

SEQ ID NO: 3903465 - RNA, 22 nt, Human adenovirus B (HAdV-B)
aagacgcgcuccuuaaacaucu

SEQ ID NO: 3903466 - RNA, 19 nt, Human adenovirus B (HAdV-B)
aagaucccgacgaaaguac

SEQ ID NO: 3903467 - RNA, 18 nt, Human adenovirus B (HAdV-B)
aagauguaaccugggcau

SEQ ID NO: 3903468 - RNA, 20 nt, Human adenovirus B (HAdV-B)
aagauucccacugaaaguau

SEQ ID NO: 3903469 - RNA, 15 nt, Human adenovirus B (HAdV-B)
aagauucuugaagcu

SEQ ID NO: 3903470 - RNA, 12 nt, Human adenovirus B (HAdV-B)
aaggcuacaacg

SEQ ID NO: 3903471 - RNA, 15 nt, Human adenovirus B (HAdV-B)
aagguccggcccacg

SEQ ID NO: 3903472 - RNA, 21 nt, Human adenovirus B (HAdV-B)
aaguuucagaugaagaaagua

SEQ ID NO: 3903473 - RNA, 23 nt, Human adenovirus B (HAdV-B)
aauaucuauaguggcacaacaua

SEQ ID NO: 3903474 - RNA, 18 nt, Human adenovirus B (HAdV-B)
aauaugcaugcuuuuaua

SEQ ID NO: 3903475 - RNA, 18 nt, Human adenovirus B (HAdV-B)
aaugcgggcggcgcugca

SEQ ID NO: 3903476 - RNA, 21 nt, Human adenovirus B (HAdV-B)
aauggagugcuugaaagugac

SEQ ID NO: 3903477 - RNA, 11 nt, Human adenovirus B (HAdV-B)
aauuaaaugac

SEQ ID NO: 3903478 - RNA, 17 nt, Human adenovirus B (HAdV-B)
aauucaccaaugcaaaa

SEQ ID NO: 3903479 - RNA, 19 nt, Human adenovirus B (HAdV-B)
aauucuucgcuguuaaaaa

SEQ ID NO: 3903480 - RNA, 16 nt, Human adenovirus B (HAdV-B)
aauugcaaggccccag

SEQ ID NO: 3903481 - RNA, 12 nt, Human adenovirus B (HAdV-B)
acaacacuuuca

SEQ ID NO: 3903482 - RNA, 13 nt, Human adenovirus B (HAdV-B)
acaagcgcagacc

SEQ ID NO: 3903483 - RNA, 21 nt, Human adenovirus B (HAdV-B)
acagagacgagccugggauca

SEQ ID NO: 3903484 - RNA, 19 nt, Human adenovirus B (HAdV-B)
acagagucucugacaaagu

SEQ ID NO: 3903485 - RNA, 18 nt, Human adenovirus B (HAdV-B)
acagauaagcccuuggug

SEQ ID NO: 3903486 - RNA, 15 nt, Human adenovirus B (HAdV-B)
acagcuggcagaacc

SEQ ID NO: 3903487 - RNA, 17 nt, Human adenovirus B (HAdV-B)
acagcuuuaaacauuug

SEQ ID NO: 3903488 - RNA, 15 nt, Human adenovirus B (HAdV-B)
acagucaggcagagg

SEQ ID NO: 3903489 - RNA, 14 nt, Human adenovirus B (HAdV-B)
acagugcaggcagc

SEQ ID NO: 3903490 - RNA, 20 nt, Human adenovirus B (HAdV-B)
acagugcaggcagcagcucc

SEQ ID NO: 3903491 - RNA, 21 nt, Human adenovirus B (HAdV-B)
acauauccuucacgcggcgcu

SEQ ID NO: 3903492 - RNA, 16 nt, Human adenovirus B (HAdV-B)
acaugaaucaugugaa

SEQ ID NO: 3903493 - RNA, 22 nt, Human adenovirus B (HAdV-B)
accaaaauaucgcggcacuucu

SEQ ID NO: 3903494 - RNA, 14 nt, Human adenovirus B (HAdV-B)
accaaucacagccu

SEQ ID NO: 3903495 - RNA, 23 nt, Human adenovirus B (HAdV-B)
accaccauucuuaaacacacccu

SEQ ID NO: 3903496 - RNA, 23 nt, Human adenovirus B (HAdV-B)
accacgguggugcaaaacaauga

SEQ ID NO: 3903497 - RNA, 20 nt, Human adenovirus B (HAdV-B)
accagacggaaucuuucaga

SEQ ID NO: 3903498 - RNA, 16 nt, Human adenovirus B (HAdV-B)
accagggaaaaguaca

SEQ ID NO: 3903499 - RNA, 17 nt, Human adenovirus B (HAdV-B)
accaguguaacaugaau

SEQ ID NO: 3903500 - RNA, 16 nt, Human adenovirus B (HAdV-B)
acccgucaccuuggau

SEQ ID NO: 3903501 - RNA, 17 nt, Human adenovirus B (HAdV-B)
acccuccaguggaggag

SEQ ID NO: 3903502 - RNA, 16 nt, Human adenovirus B (HAdV-B)
accggggugaugaaac

SEQ ID NO: 3903503 - RNA, 19 nt, Human adenovirus B (HAdV-B)
accguugauguuguguccu

SEQ ID NO: 3903504 - RNA, 16 nt, Human adenovirus B (HAdV-B)
accucaucuucccaga

SEQ ID NO: 3903505 - RNA, 21 nt, Human adenovirus B (HAdV-B)
accuguagcgaauugagaaug

SEQ ID NO: 3903506 - RNA, 17 nt, Human adenovirus B (HAdV-B)
accuuaaucccagaaau

SEQ ID NO: 3903507 - RNA, 22 nt, Human adenovirus B (HAdV-B)
acgagccugggaucauggggau

SEQ ID NO: 3903508 - RNA, 18 nt, Human adenovirus B (HAdV-B)
acgaucgcgguggggcgg

SEQ ID NO: 3903509 - RNA, 15 nt, Human adenovirus B (HAdV-B)
acgcacaagcaaacc

SEQ ID NO: 3903510 - RNA, 17 nt, Human adenovirus B (HAdV-B)
acgccuuacauguggag

SEQ ID NO: 3903511 - RNA, 12 nt, Human adenovirus B (HAdV-B)
acggcaggaugu

SEQ ID NO: 3903512 - RNA, 17 nt, Human adenovirus B (HAdV-B)
acguguacccgugcgca

SEQ ID NO: 3903513 - RNA, 15 nt, Human adenovirus B (HAdV-B)
acuccguagccugga

SEQ ID NO: 3903514 - RNA, 18 nt, Human adenovirus B (HAdV-B)
acuggauuuccugccacc

SEQ ID NO: 3903515 - RNA, 19 nt, Human adenovirus B (HAdV-B)
acuggauuuccugccacca

SEQ ID NO: 3903516 - RNA, 14 nt, Human adenovirus B (HAdV-B)
acuggccagugcag

SEQ ID NO: 3903517 - RNA, 15 nt, Human adenovirus B (HAdV-B)
acuucccucuuccca

SEQ ID NO: 3903518 - RNA, 18 nt, Human adenovirus B (HAdV-B)
acuuuuggcaaugcuccu

SEQ ID NO: 3903519 - RNA, 13 nt, Human adenovirus B (HAdV-B)
acuuuuuucccca

SEQ ID NO: 3903520 - RNA, 13 nt, Human adenovirus B (HAdV-B)
agaaauauaaauu

SEQ ID NO: 3903521 - RNA, 19 nt, Human adenovirus B (HAdV-B)
agacucucgccugcaacga

SEQ ID NO: 3903522 - RNA, 23 nt, Human adenovirus B (HAdV-B)
agagccauuguccaagaccuggg

SEQ ID NO: 3903523 - RNA, 13 nt, Human adenovirus B (HAdV-B)
agauauggaggaa

SEQ ID NO: 3903524 - RNA, 13 nt, Human adenovirus B (HAdV-B)
agauccugaggua

SEQ ID NO: 3903525 - RNA, 16 nt, Human adenovirus B (HAdV-B)
agaucugaguuggcuu

SEQ ID NO: 3903526 - RNA, 22 nt, Human adenovirus B (HAdV-B)
agaugcaucccgugcugcgaca

SEQ ID NO: 3903527 - RNA, 13 nt, Human adenovirus B (HAdV-B)
agaugccugggga

SEQ ID NO: 3903528 - RNA, 18 nt, Human adenovirus B (HAdV-B)
agauugggacagucaggc

SEQ ID NO: 3903529 - RNA, 22 nt, Human adenovirus B (HAdV-B)
agcaaaacgcggcccuggcaga

SEQ ID NO: 3903530 - RNA, 22 nt, Human adenovirus B (HAdV-B)
agcaauggggccgugggcagcg

SEQ ID NO: 3903531 - RNA, 19 nt, Human adenovirus B (HAdV-B)
agcaggauauuuugaaaua

SEQ ID NO: 3903532 - RNA, 16 nt, Human adenovirus B (HAdV-B)
agccggcgaaggcgca

SEQ ID NO: 3903533 - RNA, 22 nt, Human adenovirus B (HAdV-B)
agccguuaaccccacagccaau

SEQ ID NO: 3903534 - RNA, 15 nt, Human adenovirus B (HAdV-B)
agccugggaucaugg

SEQ ID NO: 3903535 - RNA, 18 nt, Human adenovirus B (HAdV-B)
agcuagacgcguggggcg

SEQ ID NO: 3903536 - RNA, 20 nt, Human adenovirus B (HAdV-B)
agcucugacuggagcuggaa

SEQ ID NO: 3903537 - RNA, 21 nt, Human adenovirus B (HAdV-B)
agcuguguacucccagcagcu

SEQ ID NO: 3903538 - RNA, 17 nt, Human adenovirus B (HAdV-B)
agcuugcccucauaauc

SEQ ID NO: 3903539 - RNA, 19 nt, Human adenovirus B (HAdV-B)
aggacaaagcgugcugcac

SEQ ID NO: 3903540 - RNA, 19 nt, Human adenovirus B (HAdV-B)
aggacaggcgcuuagaaau

SEQ ID NO: 3903541 - RNA, 16 nt, Human adenovirus B (HAdV-B)
aggacagucuggagga

SEQ ID NO: 3903542 - RNA, 22 nt, Human adenovirus B (HAdV-B)
aggaugcuucggaguaccugag

SEQ ID NO: 3903543 - RNA, 21 nt, Human adenovirus B (HAdV-B)
aggaugugagcggagacggcu

SEQ ID NO: 3903544 - RNA, 15 nt, Human adenovirus B (HAdV-B)
aggcgcugcugaaca

SEQ ID NO: 3903545 - RNA, 17 nt, Human adenovirus B (HAdV-B)
aggcugauugccacaga

SEQ ID NO: 3903546 - RNA, 21 nt, Human adenovirus B (HAdV-B)
agggcugcgguccgaccugga

SEQ ID NO: 3903547 - RNA, 19 nt, Human adenovirus B (HAdV-B)
agggcuugacggggaagac

SEQ ID NO: 3903548 - RNA, 20 nt, Human adenovirus B (HAdV-B)
aggggacugccccauggcau

SEQ ID NO: 3903549 - RNA, 12 nt, Human adenovirus B (HAdV-B)
aggugucucuga

SEQ ID NO: 3903550 - RNA, 17 nt, Human adenovirus B (HAdV-B)
agguucccucaggaugu

SEQ ID NO: 3903551 - RNA, 19 nt, Human adenovirus B (HAdV-B)
agguuguaucugguggaca

SEQ ID NO: 3903552 - RNA, 15 nt, Human adenovirus B (HAdV-B)
aguacucagccugcu

SEQ ID NO: 3903553 - RNA, 15 nt, Human adenovirus B (HAdV-B)
agucuggaggaagac

SEQ ID NO: 3903554 - RNA, 16 nt, Human adenovirus B (HAdV-B)
agugcaaacggaucca

SEQ ID NO: 3903555 - RNA, 11 nt, Human adenovirus B (HAdV-B)
agugcagcaac

SEQ ID NO: 3903556 - RNA, 12 nt, Human adenovirus B (HAdV-B)
aguggaggaggc

SEQ ID NO: 3903557 - RNA, 22 nt, Human adenovirus B (HAdV-B)
aguucaaguacaaccacacucu

SEQ ID NO: 3903558 - RNA, 19 nt, Human adenovirus B (HAdV-B)
uaugaagaugaaagcaccu

SEQ ID NO: 3903559 - RNA, 17 nt, Human adenovirus B (HAdV-B)
uaugccaucuuccagca

SEQ ID NO: 3903560 - RNA, 21 nt, Human adenovirus B (HAdV-B)
uauuauggaaccgacuauaaa

SEQ ID NO: 3903561 - RNA, 18 nt, Human adenovirus B (HAdV-B)
uauuuccccaaauggcuu

SEQ ID NO: 3903562 - RNA, 16 nt, Human adenovirus B (HAdV-B)
ucaaaaccucugggau

SEQ ID NO: 3903563 - RNA, 19 nt, Human adenovirus B (HAdV-B)
ucaaaugcucacuugugcu

SEQ ID NO: 3903564 - RNA, 18 nt, Human adenovirus B (HAdV-B)
ucaaccccuucuccggau

SEQ ID NO: 3903565 - RNA, 14 nt, Human adenovirus B (HAdV-B)
ucaaguacaaccac

SEQ ID NO: 3903566 - RNA, 13 nt, Human adenovirus B (HAdV-B)
ucacacagcagcg

SEQ ID NO: 3903567 - RNA, 21 nt, Human adenovirus B (HAdV-B)
ucacaucucguccucagcgac

SEQ ID NO: 3903568 - RNA, 21 nt, Human adenovirus B (HAdV-B)
ucaccaagaugcuggaaauag

SEQ ID NO: 3903569 - RNA, 15 nt, Human adenovirus B (HAdV-B)
ucaccaaggccaugg

SEQ ID NO: 3903570 - RNA, 16 nt, Human adenovirus B (HAdV-B)
ucaccuccacagcccc

SEQ ID NO: 3903571 - RNA, 19 nt, Human adenovirus B (HAdV-B)
ucacgcuugccagcacggu

SEQ ID NO: 3903572 - RNA, 21 nt, Human adenovirus B (HAdV-B)
ucagagcgagccaaucugggg

SEQ ID NO: 3903573 - RNA, 13 nt, Human adenovirus B (HAdV-B)
ucagguggacgag

SEQ ID NO: 3903574 - RNA, 21 nt, Human adenovirus B (HAdV-B)
ucagugacuccuucaacccug

SEQ ID NO: 3903575 - RNA, 22 nt, Human adenovirus B (HAdV-B)
ucauagaagcucggguuucauu

SEQ ID NO: 3903576 - RNA, 20 nt, Human adenovirus B (HAdV-B)
ucauccuggaacgcuccggu

SEQ ID NO: 3903577 - RNA, 13 nt, Human adenovirus B (HAdV-B)
ucaucuucccaga

SEQ ID NO: 3903578 - RNA, 17 nt, Human adenovirus B (HAdV-B)
uccaaggaugagacagu

SEQ ID NO: 3903579 - RNA, 17 nt, Human adenovirus B (HAdV-B)
uccaaggucuuccuaca

SEQ ID NO: 3903580 - RNA, 14 nt, Human adenovirus B (HAdV-B)
uccaccagaacacc

SEQ ID NO: 3903581 - RNA, 15 nt, Human adenovirus B (HAdV-B)
uccagcgcugccagg

SEQ ID NO: 3903582 - RNA, 19 nt, Human adenovirus B (HAdV-B)
uccaugcacucauccauga

SEQ ID NO: 3903583 - RNA, 23 nt, Human adenovirus B (HAdV-B)
ucccgacgaaaguacgguccagc

SEQ ID NO: 3903584 - RNA, 15 nt, Human adenovirus B (HAdV-B)
ucccgacggugcugc

SEQ ID NO: 3903585 - RNA, 20 nt, Human adenovirus B (HAdV-B)
ucccggcgcccuggugcggc

SEQ ID NO: 3903586 - RNA, 16 nt, Human adenovirus B (HAdV-B)
uccgaacucccgccua

SEQ ID NO: 3903587 - RNA, 18 nt, Human adenovirus B (HAdV-B)
uccgaccuggcagaccuc

SEQ ID NO: 3903588 - RNA, 18 nt, Human adenovirus B (HAdV-B)
uccggaagauuaccaccc

SEQ ID NO: 3903589 - RNA, 13 nt, Human adenovirus B (HAdV-B)
uccguagccugga

SEQ ID NO: 3903590 - RNA, 18 nt, Human adenovirus B (HAdV-B)
uccguucucgcuggccac

SEQ ID NO: 3903591 - RNA, 15 nt, Human adenovirus B (HAdV-B)
uccuaggcagagaaa

SEQ ID NO: 3903592 - RNA, 20 nt, Human adenovirus B (HAdV-B)
uccuaugcacuuuuugcuuu

SEQ ID NO: 3903593 - RNA, 15 nt, Human adenovirus B (HAdV-B)
uccugcaccauuccc

SEQ ID NO: 3903594 - RNA, 16 nt, Human adenovirus B (HAdV-B)
uccugcccgccaccug

SEQ ID NO: 3903595 - RNA, 18 nt, Human adenovirus B (HAdV-B)
uccuucgcggcuggccau

SEQ ID NO: 3903596 - RNA, 15 nt, Human adenovirus B (HAdV-B)
ucgccaacuacaaca

SEQ ID NO: 3903597 - RNA, 12 nt, Human adenovirus B (HAdV-B)
ucgcuggccaca

SEQ ID NO: 3903598 - RNA, 22 nt, Human adenovirus B (HAdV-B)
ucuagcggaaacccgucuuugu

SEQ ID NO: 3903599 - RNA, 14 nt, Human adenovirus B (HAdV-B)
ucucacuugccacc

SEQ ID NO: 3903600 - RNA, 14 nt, Human adenovirus B (HAdV-B)
ucuccgcuccgagu

SEQ ID NO: 3903601 - RNA, 19 nt, Human adenovirus B (HAdV-B)
ucugacgagaaucagaaug

SEQ ID NO: 3903602 - RNA, 17 nt, Human adenovirus B (HAdV-B)
ucuggggguacaaacug

SEQ ID NO: 3903603 - RNA, 11 nt, Human adenovirus B (HAdV-B)
ucugugggguc

SEQ ID NO: 3903604 - RNA, 19 nt, Human adenovirus B (HAdV-B)
ucuuaaacccgcacuggcu

SEQ ID NO: 3903605 - RNA, 17 nt, Human adenovirus B (HAdV-B)
ugaaagcaccucccaac

SEQ ID NO: 3903606 - RNA, 20 nt, Human adenovirus B (HAdV-B)
ugaaagcaucauauugcuug

SEQ ID NO: 3903607 - RNA, 20 nt, Human adenovirus B (HAdV-B)
ugaaggcgaggaggaagagg

SEQ ID NO: 3903608 - RNA, 21 nt, Human adenovirus B (HAdV-B)
ugaaguuucuguauugcagga

SEQ ID NO: 3903609 - RNA, 16 nt, Human adenovirus B (HAdV-B)
ugacaugaacaugcaa

SEQ ID NO: 3903610 - RNA, 19 nt, Human adenovirus B (HAdV-B)
ugagaagguccuggccauc

SEQ ID NO: 3903611 - RNA, 20 nt, Human adenovirus B (HAdV-B)
ugaggccacaacgcacagcc

SEQ ID NO: 3903612 - RNA, 19 nt, Human adenovirus B (HAdV-B)
ugauauucuugagcaggcg

SEQ ID NO: 3903613 - RNA, 16 nt, Human adenovirus B (HAdV-B)
ugaucacaagcaggau

SEQ ID NO: 3903614 - RNA, 18 nt, Human adenovirus B (HAdV-B)
ugaugaacaaugccauca

SEQ ID NO: 3903615 - RNA, 20 nt, Human adenovirus B (HAdV-B)
ugaugauagcaaauuucuga

SEQ ID NO: 3903616 - RNA, 15 nt, Human adenovirus B (HAdV-B)
ugauuaauugugaug

SEQ ID NO: 3903617 - RNA, 15 nt, Human adenovirus B (HAdV-B)
ugcaacacagcagag

SEQ ID NO: 3903618 - RNA, 17 nt, Human adenovirus B (HAdV-B)
ugcaaggccccagcagc

SEQ ID NO: 3903619 - RNA, 23 nt, Human adenovirus B (HAdV-B)
ugcacaugaucauccacaagacc

SEQ ID NO: 3903620 - RNA, 13 nt, Human adenovirus B (HAdV-B)
ugcagaacaguaa

SEQ ID NO: 3903621 - RNA, 11 nt, Human adenovirus B (HAdV-B)
ugcagcacuga

SEQ ID NO: 3903622 - RNA, 13 nt, Human adenovirus B (HAdV-B)
ugcaggcagcagc

SEQ ID NO: 3903623 - RNA, 14 nt, Human adenovirus B (HAdV-B)
ugcaggcagcagcu

SEQ ID NO: 3903624 - RNA, 16 nt, Human adenovirus B (HAdV-B)
ugccauccuucucaac

SEQ ID NO: 3903625 - RNA, 12 nt, Human adenovirus B (HAdV-B)
ugcgggacgagg

SEQ ID NO: 3903626 - RNA, 16 nt, Human adenovirus B (HAdV-B)
ugcgucaucacccagg

SEQ ID NO: 3903627 - RNA, 13 nt, Human adenovirus B (HAdV-B)
ugcuauuccacca

SEQ ID NO: 3903628 - RNA, 15 nt, Human adenovirus B (HAdV-B)
ugcugcuucucccag

SEQ ID NO: 3903629 - RNA, 18 nt, Human adenovirus B (HAdV-B)
uggaacaauaccuuaucc

SEQ ID NO: 3903630 - RNA, 11 nt, Human adenovirus B (HAdV-B)
uggaagagcuc

SEQ ID NO: 3903631 - RNA, 15 nt, Human adenovirus B (HAdV-B)
uggaaguuuucuugc

SEQ ID NO: 3903632 - RNA, 23 nt, Human adenovirus B (HAdV-B)
uggagcaguaucuggagcgggcu

SEQ ID NO: 3903633 - RNA, 22 nt, Human adenovirus B (HAdV-B)
uggcaauauugccgccaagauc

SEQ ID NO: 3903634 - RNA, 22 nt, Human adenovirus B (HAdV-B)
uggcaccuacggagggcagaaa

SEQ ID NO: 3903635 - RNA, 15 nt, Human adenovirus B (HAdV-B)
uggcaguuuggaagc

SEQ ID NO: 3903636 - RNA, 19 nt, Human adenovirus B (HAdV-B)
uggcgugagaauuggaaga

SEQ ID NO: 3903637 - RNA, 21 nt, Human adenovirus B (HAdV-B)
uggcucgcuacaacaguagca

SEQ ID NO: 3903638 - RNA, 19 nt, Human adenovirus B (HAdV-B)
uggcucuauaucucccaga

SEQ ID NO: 3903639 - RNA, 13 nt, Human adenovirus B (HAdV-B)
uggcuuccagcaa

SEQ ID NO: 3903640 - RNA, 22 nt, Human adenovirus B (HAdV-B)
ugguaaagauucccggaaguaa

SEQ ID NO: 3903641 - RNA, 16 nt, Human adenovirus B (HAdV-B)
ugguggaauuggaagg

SEQ ID NO: 3903642 - RNA, 20 nt, Human adenovirus B (HAdV-B)
ugguuuuagauuccacauuc

SEQ ID NO: 3903643 - RNA, 19 nt, Human adenovirus B (HAdV-B)
ugucucugaagaaaugcau

SEQ ID NO: 3903644 - RNA, 14 nt, Human adenovirus B (HAdV-B)
ugugcucccugugg

SEQ ID NO: 3903645 - RNA, 15 nt, Human adenovirus B (HAdV-B)
uguugaaaugggcau

SEQ ID NO: 3903646 - RNA, 19 nt, Human adenovirus B (HAdV-B)
uuaaaauguuuaaccccac

SEQ ID NO: 3903647 - RNA, 22 nt, Human adenovirus B (HAdV-B)
uuacaaaagaaggacucccagu

SEQ ID NO: 3903648 - RNA, 15 nt, Human adenovirus B (HAdV-B)
uuaccccuacggaag

SEQ ID NO: 3903649 - RNA, 13 nt, Human adenovirus B (HAdV-B)
uuacucccucugu

SEQ ID NO: 3903650 - RNA, 17 nt, Human adenovirus B (HAdV-B)
uuaugcucaggaucaca

SEQ ID NO: 3903651 - RNA, 13 nt, Human adenovirus B (HAdV-B)
uucaauucaaaca

SEQ ID NO: 3903652 - RNA, 13 nt, Human adenovirus B (HAdV-B)
uucacucaaaucu

SEQ ID NO: 3903653 - RNA, 15 nt, Human adenovirus B (HAdV-B)
uucagaaacuuccag

SEQ ID NO: 3903654 - RNA, 17 nt, Human adenovirus B (HAdV-B)
uuccgaugagaggccuu

SEQ ID NO: 3903655 - RNA, 14 nt, Human adenovirus B (HAdV-B)
uuccuucaccccuc

SEQ ID NO: 3903656 - RNA, 12 nt, Human adenovirus B (HAdV-B)
uucgcugcuuug

SEQ ID NO: 3903657 - RNA, 17 nt, Human adenovirus B (HAdV-B)
uugacugaugucuugca

SEQ ID NO: 3903658 - RNA, 22 nt, Human adenovirus B (HAdV-B)
uugcaaggccccagcagccaag

SEQ ID NO: 3903659 - RNA, 21 nt, Human adenovirus B (HAdV-B)
uugcaguagguacaacacauu

SEQ ID NO: 3903660 - RNA, 18 nt, Human adenovirus B (HAdV-B)
uugcaugguuguagcuuu

SEQ ID NO: 3903661 - RNA, 20 nt, Human adenovirus B [HAdV-B]
caccuguuccgacugcagaa

SEQ ID NO: 3903662 - RNA, 20 nt, Human adenovirus B [HAdV-B]
caccuuggauuugcccccuc

SEQ ID NO: 3903663 - RNA, 22 nt, Human adenovirus B [HAdV-B]
cacgguuuggaccgaagacgag

SEQ ID NO: 3903664 - RNA, 15 nt, Human adenovirus B [HAdV-B]
cacguggcugcagcc

SEQ ID NO: 3903665 - RNA, 14 nt, Human adenovirus B [HAdV-B]
cacucaccaccucc

SEQ ID NO: 3903666 - RNA, 18 nt, Human adenovirus B [HAdV-B]
cacugaaacaccaucagc

SEQ ID NO: 3903667 - RNA, 14 nt, Human adenovirus B [HAdV-B]
cacugaagugcaaa

SEQ ID NO: 3903668 - RNA, 11 nt, Human adenovirus B [HAdV-B]
cacuggcugcc

SEQ ID NO: 3903669 - RNA, 14 nt, Human adenovirus B [HAdV-B]
cucgcucacaccuc

SEQ ID NO: 3903670 - RNA, 14 nt, Human adenovirus B [HAdV-B]
cucguccucagcga

SEQ ID NO: 3903671 - RNA, 19 nt, Human adenovirus B [HAdV-B]
cugaagggggaagcccgcc

SEQ ID NO: 3903672 - RNA, 21 nt, Human adenovirus B [HAdV-B]
cugaaucauaauauugccaug

SEQ ID NO: 3903673 - RNA, 17 nt, Human adenovirus B [HAdV-B]
cugaccccgggacugug

SEQ ID NO: 3903674 - RNA, 22 nt, Human adenovirus B [HAdV-B]
cugacgccgccggucccacucg

SEQ ID NO: 3903675 - RNA, 16 nt, Human adenovirus B [HAdV-B]
cugauuucacucaaau

SEQ ID NO: 3903676 - RNA, 22 nt, Human adenovirus B [HAdV-B]
cugcaaagcuccaagcagguca

SEQ ID NO: 3903677 - RNA, 20 nt, Human adenovirus B [HAdV-B]
cugcaacgggugcuuacugg

SEQ ID NO: 3903678 - RNA, 11 nt, Human adenovirus B [HAdV-B]
cugcacagcac

SEQ ID NO: 3903679 - RNA, 17 nt, Human adenovirus B [HAdV-B]
cugcagaaaucuuccca

SEQ ID NO: 3903680 - RNA, 13 nt, Human adenovirus B [HAdV-B]
cugccgcugcaau

SEQ ID NO: 3903681 - RNA, 21 nt, Human adenovirus B [HAdV-B]
cugccuacccauggcgggcac

SEQ ID NO: 3903682 - RNA, 15 nt, Human adenovirus B [HAdV-B]
cugccuggcugcgga

SEQ ID NO: 3903683 - RNA, 16 nt, Human adenovirus B [HAdV-B]
cugcguucgcucacca

SEQ ID NO: 3903684 - RNA, 15 nt, Human adenovirus B [HAdV-B]
cugcuccuucugaau

SEQ ID NO: 3903685 - RNA, 18 nt, Human adenovirus B [HAdV-B]
cugcucgcucacaccuca

SEQ ID NO: 3903686 - RNA, 21 nt, Human adenovirus B [HAdV-B]
cugcucucacagaucacggga

SEQ ID NO: 3903687 - RNA, 15 nt, Human adenovirus B [HAdV-B]
cugcugcagaagcua

SEQ ID NO: 3903688 - RNA, 13 nt, Human adenovirus B [HAdV-B]
cugcuugcaugag

SEQ ID NO: 3903689 - RNA, 15 nt, Human adenovirus B [HAdV-B]
cuggaggacagucug

SEQ ID NO: 3903690 - RNA, 13 nt, Human adenovirus B [HAdV-B]
cuggaggaggaac

SEQ ID NO: 3903691 - RNA, 15 nt, Human adenovirus B [HAdV-B]
cuggcagaacacacu

SEQ ID NO: 3903692 - RNA, 22 nt, Human adenovirus B [HAdV-B]
cuggcagaccucaucuucccag

SEQ ID NO: 3903693 - RNA, 14 nt, Human adenovirus B [HAdV-B]
cuggcuaccuauca

SEQ ID NO: 3903694 - RNA, 12 nt, Human adenovirus B [HAdV-B]
cugggaccuggu

SEQ ID NO: 3903695 - RNA, 22 nt, Human adenovirus B [HAdV-B]
cugggaugggaucccgaaacca

SEQ ID NO: 3903696 - RNA, 15 nt, Human adenovirus B [HAdV-B]
cuggucagcugcaaa

SEQ ID NO: 3903697 - RNA, 18 nt, Human adenovirus B [HAdV-B]
cugguucuauucccuacc

SEQ ID NO: 3903698 - RNA, 16 nt, Human adenovirus B [HAdV-B]
cuguauaggagcauuu

SEQ ID NO: 3903699 - RNA, 17 nt, Human adenovirus B [HAdV-B]
cuguauaggagcauuug

SEQ ID NO: 3903700 - RNA, 19 nt, Human adenovirus B [HAdV-B]
cuguguacucccagcagcu

SEQ ID NO: 3903701 - RNA, 21 nt, Human adenovirus B [HAdV-B]
cuuaagcauuccaccgcccag

SEQ ID NO: 3903702 - RNA, 18 nt, Human adenovirus B [HAdV-B]
cuuaagguucuguggaca

SEQ ID NO: 3903703 - RNA, 15 nt, Human adenovirus B [HAdV-B]
cuuaaucccagaaau

SEQ ID NO: 3903704 - RNA, 18 nt, Human adenovirus B [HAdV-B]
cuuaccggcucugggcau

SEQ ID NO: 3903705 - RNA, 17 nt, Human adenovirus B [HAdV-B]
cuuacgagcagacagua

SEQ ID NO: 3903706 - RNA, 18 nt, Human adenovirus B [HAdV-B]
cuuacuuuaaaauguuua

SEQ ID NO: 3903707 - RNA, 12 nt, Human adenovirus B [HAdV-B]
cuucacacaaag

SEQ ID NO: 3903708 - RNA, 19 nt, Human adenovirus B [HAdV-B]
cuuccgcaaucccaacagg

SEQ ID NO: 3903709 - RNA, 15 nt, Human adenovirus B [HAdV-B]
cuuccuaugcacuuu

SEQ ID NO: 3903710 - RNA, 15 nt, Human adenovirus B [HAdV-B]
cuucgcggcuggcca

SEQ ID NO: 3903711 - RNA, 22 nt, Human adenovirus B [HAdV-B]
cuucuccggaucuccugggcau

SEQ ID NO: 3903712 - RNA, 13 nt, Human adenovirus B [HAdV-B]
cuucuccugggca

SEQ ID NO: 3903713 - RNA, 22 nt, Human adenovirus B [HAdV-B]
cuucuuucagacuagcagacag

SEQ ID NO: 3903714 - RNA, 18 nt, Human adenovirus B [HAdV-B]
cuugaccacgguggugca

SEQ ID NO: 3903715 - RNA, 16 nt, Human adenovirus B [HAdV-B]
cuugcaacauacaaaa

SEQ ID NO: 3903716 - RNA, 21 nt, Human adenovirus B [HAdV-B]
cuugcuggagugucacugccg

SEQ ID NO: 3903717 - RNA, 14 nt, Human adenovirus B [HAdV-B]
cuuggaagagguuc

SEQ ID NO: 3903718 - RNA, 13 nt, Human adenovirus B [HAdV-B]
cuuggcuucuuuu

SEQ ID NO: 3903719 - RNA, 18 nt, Human adenovirus B [HAdV-B]
cuugggugggagaggaag

SEQ ID NO: 3903720 - RNA, 16 nt, Human adenovirus B [HAdV-B]
cuuucaagauggccac

SEQ ID NO: 3903721 - RNA, 18 nt, Human adenovirus B [HAdV-B]
cuuucagagaggcgcugc

SEQ ID NO: 3903722 - RNA, 11 nt, Human adenovirus B [HAdV-B]
gaaaaagcaca

SEQ ID NO: 3903723 - RNA, 22 nt, Human adenovirus B [HAdV-B]
gaaaacugcacacuuacuuuug

SEQ ID NO: 3903724 - RNA, 21 nt, Human adenovirus B [HAdV-B]
gaaacccagauaauaggcacc

SEQ ID NO: 3903725 - RNA, 15 nt, Human adenovirus B [HAdV-B]
gaaauuuucucccag

SEQ ID NO: 3903726 - RNA, 14 nt, Human adenovirus B [HAdV-B]
gaacaaaagaauac

SEQ ID NO: 3903727 - RNA, 19 nt, Human adenovirus B [HAdV-B]
gaacacgaggaagaguuga

SEQ ID NO: 3903728 - RNA, 12 nt, Human adenovirus B [HAdV-B]
gaacaguaagaa

SEQ ID NO: 3903729 - RNA, 22 nt, Human adenovirus B [HAdV-B]
gaacuugaaagagcuugacaag

SEQ ID NO: 3903730 - RNA, 16 nt, Human adenovirus B [HAdV-B]
gaagaaaguaaaccga

SEQ ID NO: 3903731 - RNA, 11 nt, Human adenovirus B [HAdV-B]
gaagaaaugca

SEQ ID NO: 3903732 - RNA, 20 nt, Human adenovirus B [HAdV-B]
gaagaccacgaacacaacuu

SEQ ID NO: 3903733 - RNA, 15 nt, Human adenovirus B [HAdV-B]
gaagauuaccacccc

SEQ ID NO: 3903734 - RNA, 20 nt, Human adenovirus B [HAdV-B]
gaagccuuuagacagcaacc

SEQ ID NO: 3903735 - RNA, 13 nt, Human adenovirus B [HAdV-B]
gaagguucugggg

SEQ ID NO: 3903736 - RNA, 19 nt, Human adenovirus B [HAdV-B]
gaaucauaauauugccaug

SEQ ID NO: 3903737 - RNA, 17 nt, Human adenovirus B [HAdV-B]
gaaugagccuaacagga

SEQ ID NO: 3903738 - RNA, 18 nt, Human adenovirus B [HAdV-B]
gaauuuucucccagcggc

SEQ ID NO: 3903739 - RNA, 18 nt, Human adenovirus B [HAdV-B]
gacaaaaaagaagaggaa

SEQ ID NO: 3903740 - RNA, 14 nt, Human adenovirus B [HAdV-B]
gacaaagcgugcug

SEQ ID NO: 3903741 - RNA, 21 nt, Human adenovirus B [HAdV-B]
gacaaugaggcuuucagagag

SEQ ID NO: 3903742 - RNA, 14 nt, Human adenovirus B [HAdV-B]
gacagaaacacaga

SEQ ID NO: 3903743 - RNA, 12 nt, Human adenovirus B [HAdV-B]
gacagauaaaga

SEQ ID NO: 3903744 - RNA, 19 nt, Human adenovirus B [HAdV-B]
gacagcaaccccaggccaa

SEQ ID NO: 3903745 - RNA, 17 nt, Human adenovirus B [HAdV-B]
gacagcccgccuaugau

SEQ ID NO: 3903746 - RNA, 19 nt, Human adenovirus B [HAdV-B]
gacaggaagacacuggcag

SEQ ID NO: 3903747 - RNA, 16 nt, Human adenovirus B [HAdV-B]
gacaggcgcuuagaaa

SEQ ID NO: 3903748 - RNA, 12 nt, Human adenovirus B [HAdV-B]
gacccaggccau

SEQ ID NO: 3903749 - RNA, 13 nt, Human adenovirus B [HAdV-B]
gacccgcaggcag

SEQ ID NO: 3903750 - RNA, 21 nt, Human adenovirus B [HAdV-B]
gaccgcgcuuauucaaaaaag

SEQ ID NO: 3903751 - RNA, 16 nt, Human adenovirus B [HAdV-B]
gaccggacgcuucccg

SEQ ID NO: 3903752 - RNA, 19 nt, Human adenovirus B [HAdV-B]
gaccggcgaggaacucaac

SEQ ID NO: 3903753 - RNA, 16 nt, Human adenovirus B [HAdV-B]
gacgcuacagugcagu

SEQ ID NO: 3903754 - RNA, 16 nt, Human adenovirus B [HAdV-B]
gacggcggucauggac

SEQ ID NO: 3903755 - RNA, 21 nt, Human adenovirus B [HAdV-B]
gagaaacaacagacauggaaa

SEQ ID NO: 3903756 - RNA, 14 nt, Human adenovirus B [HAdV-B]
gagagagaggauga

SEQ ID NO: 3903757 - RNA, 20 nt, Human adenovirus B [HAdV-B]
gagaguuucaugaccagcau

SEQ ID NO: 3903758 - RNA, 15 nt, Human adenovirus B [HAdV-B]
gagcaauaaaugacg

SEQ ID NO: 3903759 - RNA, 23 nt, Human adenovirus B [HAdV-B]
gagcaucaaccucuaugcuacuu

SEQ ID NO: 3903760 - RNA, 23 nt, Human adenovirus B [HAdV-B]
gagcuuaagcauuccaccgccca

SEQ ID NO: 3903761 - RNA, 22 nt, Human adenovirus B [HAdV-B]
gagcuuccuuacauagaagagg

SEQ ID NO: 3903762 - RNA, 22 nt, Human adenovirus B [HAdV-B]
gagcuucuacaacgaacaagcu

SEQ ID NO: 3903763 - RNA, 13 nt, Human adenovirus B [HAdV-B]
gaggccggacugg

SEQ ID NO: 3903764 - RNA, 20 nt, Human adenovirus B [HAdV-B]
gaggccuuaucaaaugcuca

SEQ ID NO: 3903765 - RNA, 15 nt, Human adenovirus B [HAdV-B]
gagugcguuccugga

SEQ ID NO: 3903766 - RNA, 15 nt, Human adenovirus B [HAdV-B]
gauacuggauguuuu

SEQ ID NO: 3903767 - RNA, 20 nt, Human adenovirus B [HAdV-B]
gaucccauggaugagcccac

SEQ ID NO: 3903768 - RNA, 22 nt, Human adenovirus B [HAdV-B]
gaucgaggguacgcgcaugcga

SEQ ID NO: 3903769 - RNA, 18 nt, Human adenovirus B [HAdV-B]
gaucgcgguggggcgguc

SEQ ID NO: 3903770 - RNA, 19 nt, Human adenovirus B [HAdV-B]
gaucuaccgccagugcugu

SEQ ID NO: 3903771 - RNA, 20 nt, Human adenovirus B [HAdV-B]
gaucucgucgaaaccguuga

SEQ ID NO: 3903772 - RNA, 16 nt, Human adenovirus B [HAdV-B]
caggcaaaacaaaaaa

SEQ ID NO: 3903773 - RNA, 14 nt, Human adenovirus B [HAdV-B]
caggucaggagccg

SEQ ID NO: 3903774 - RNA, 16 nt, Human adenovirus B [HAdV-B]
caggugaaaacauguu

SEQ ID NO: 3903775 - RNA, 20 nt, Human adenovirus B [HAdV-B]
caguaagaaagaacaaaaag

SEQ ID NO: 3903776 - RNA, 21 nt, Human adenovirus B [HAdV-B]
caguagucaaguguuucuuga

SEQ ID NO: 3903777 - RNA, 21 nt, Human adenovirus B [HAdV-B]
caguccugccagggcacacgu

SEQ ID NO: 3903778 - RNA, 14 nt, Human adenovirus B [HAdV-B]
cagucuggaggaag

SEQ ID NO: 3903779 - RNA, 18 nt, Human adenovirus B [HAdV-B]
caguguccugaagcauga

SEQ ID NO: 3903780 - RNA, 18 nt, Human adenovirus B [HAdV-B]
cagugucgcuaacaauac

SEQ ID NO: 3903781 - RNA, 21 nt, Human adenovirus B [HAdV-B]
caguuguaaucaaaacuccau

SEQ ID NO: 3903782 - RNA, 22 nt, Human adenovirus B [HAdV-B]
cauaauuaaaagcgcuccagcc

SEQ ID NO: 3903783 - RNA, 22 nt, Human adenovirus B [HAdV-B]
cauaggacccccaaucacuuca

SEQ ID NO: 3903784 - RNA, 13 nt, Human adenovirus B [HAdV-B]
cauaguugccagc

SEQ ID NO: 3903785 - RNA, 12 nt, Human adenovirus B [HAdV-B]
caucagccaugg

SEQ ID NO: 3903786 - RNA, 22 nt, Human adenovirus B [HAdV-B]
cauccauggagguuugggccau

SEQ ID NO: 3903787 - RNA, 16 nt, Human adenovirus B [HAdV-B]
caucgcagaaaacaaa

SEQ ID NO: 3903788 - RNA, 17 nt, Human adenovirus B [HAdV-B]
caucuagaccacugccg

SEQ ID NO: 3903789 - RNA, 19 nt, Human adenovirus B [HAdV-B]
caucuauuauuccuacucc

SEQ ID NO: 3903790 - RNA, 20 nt, Human adenovirus B [HAdV-B]
caugaaaggaacuaguuguu

SEQ ID NO: 3903791 - RNA, 13 nt, Human adenovirus B [HAdV-B]
caugaacaugcaa

SEQ ID NO: 3903792 - RNA, 21 nt, Human adenovirus B [HAdV-B]
caugagcaaacaguauucucu

SEQ ID NO: 3903793 - RNA, 18 nt, Human adenovirus B [HAdV-B]
cauguggaaucaggcugu

SEQ ID NO: 3903794 - RNA, 19 nt, Human adenovirus B [HAdV-B]
cauuaagauucccacugaa

SEQ ID NO: 3903795 - RNA, 21 nt, Human adenovirus B [HAdV-B]
cauuaagcagguagcgccugg

SEQ ID NO: 3903796 - RNA, 14 nt, Human adenovirus B [HAdV-B]
cauucacacagcag

SEQ ID NO: 3903797 - RNA, 17 nt, Human adenovirus B [HAdV-B]
cauucucgagcugccag

SEQ ID NO: 3903798 - RNA, 12 nt, Human adenovirus B [HAdV-B]
cauugcuucucu

SEQ ID NO: 3903799 - RNA, 18 nt, Human adenovirus B [HAdV-B]
cauugguccaacagagcc

SEQ ID NO: 3903800 - RNA, 13 nt, Human adenovirus B [HAdV-B]
ccaaauggagaca

SEQ ID NO: 3903801 - RNA, 14 nt, Human adenovirus B [HAdV-B]
ccaacgacgagaaa

SEQ ID NO: 3903802 - RNA, 14 nt, Human adenovirus B [HAdV-B]
ccaagcaaugcaac

SEQ ID NO: 3903803 - RNA, 22 nt, Human adenovirus B [HAdV-B]
ccacaauauauauauacacaag

SEQ ID NO: 3903804 - RNA, 18 nt, Human adenovirus B [HAdV-B]
ccacaucguaggucagga

SEQ ID NO: 3903805 - RNA, 15 nt, Human adenovirus B [HAdV-B]
ccacuaccacauucc

SEQ ID NO: 3903806 - RNA, 22 nt, Human adenovirus B [HAdV-B]
ccagaacaccuuagaaaaugca

SEQ ID NO: 3903807 - RNA, 19 nt, Human adenovirus B [HAdV-B]
ccagaacuuccaacaaaaa

SEQ ID NO: 3903808 - RNA, 15 nt, Human adenovirus B [HAdV-B]
ccagcacgacugccu

SEQ ID NO: 3903809 - RNA, 19 nt, Human adenovirus B [HAdV-B]
ccagcgccaugacagacag

SEQ ID NO: 3903810 - RNA, 15 nt, Human adenovirus B [HAdV-B]
ccagggcacacgugg

SEQ ID NO: 3903811 - RNA, 14 nt, Human adenovirus B [HAdV-B]
ccaggggguccacc

SEQ ID NO: 3903812 - RNA, 22 nt, Human adenovirus B [HAdV-B]
ccaguagguuuggaaguuucag

SEQ ID NO: 3903813 - RNA, 18 nt, Human adenovirus B [HAdV-B]
ccauacucauuugugcau

SEQ ID NO: 3903814 - RNA, 14 nt, Human adenovirus B [HAdV-B]
ccaucaucuccugc

SEQ ID NO: 3903815 - RNA, 16 nt, Human adenovirus B [HAdV-B]
ccaugagcaggcaggu

SEQ ID NO: 3903816 - RNA, 21 nt, Human adenovirus B [HAdV-B]
ccaugccuuucucccaagcag

SEQ ID NO: 3903817 - RNA, 13 nt, Human adenovirus B [HAdV-B]
ccauuguguucuc

SEQ ID NO: 3903818 - RNA, 23 nt, Human adenovirus B [HAdV-B]
cccacugaaaguauggaagugca

SEQ ID NO: 3903819 - RNA, 14 nt, Human adenovirus B [HAdV-B]
cccagcuguuucug

SEQ ID NO: 3903820 - RNA, 14 nt, Human adenovirus B [HAdV-B]
ccccucgcagcagc

SEQ ID NO: 3903821 - RNA, 17 nt, Human adenovirus B [HAdV-B]
cccgcaggaccugcucg

SEQ ID NO: 3903822 - RNA, 13 nt, Human adenovirus B [HAdV-B]
cccgccaccugcu

SEQ ID NO: 3903823 - RNA, 17 nt, Human adenovirus B [HAdV-B]
cccuacggaagccagca

SEQ ID NO: 3903824 - RNA, 15 nt, Human adenovirus B [HAdV-B]
cccuaguguaccagg

SEQ ID NO: 3903825 - RNA, 15 nt, Human adenovirus B [HAdV-B]
cccuccaguggagga

SEQ ID NO: 3903826 - RNA, 13 nt, Human adenovirus B [HAdV-B]
ccgacugcagcac

SEQ ID NO: 3903827 - RNA, 17 nt, Human adenovirus B [HAdV-B]
ccgacugcagcacugga

SEQ ID NO: 3903828 - RNA, 18 nt, Human adenovirus B [HAdV-B]
ccgagcuaccacugccau

SEQ ID NO: 3903829 - RNA, 21 nt, Human adenovirus B [HAdV-B]
ccgcaaugcgggcggcgcugc

SEQ ID NO: 3903830 - RNA, 23 nt, Human adenovirus B [HAdV-B]
ccgccuaugaucuggacuuggaa

SEQ ID NO: 3903831 - RNA, 14 nt, Human adenovirus B [HAdV-B]
ccgcugucaaccug

SEQ ID NO: 3903832 - RNA, 16 nt, Human adenovirus B [HAdV-B]
ccggauugcagcacug

SEQ ID NO: 3903833 - RNA, 21 nt, Human adenovirus B [HAdV-B]
ccggcgaaggcgcauugccag

SEQ ID NO: 3903834 - RNA, 22 nt, Human adenovirus B [HAdV-B]
ccgggccuucuaugauuucucg

SEQ ID NO: 3903835 - RNA, 17 nt, Human adenovirus B [HAdV-B]
ccgucuuugucugcacg

SEQ ID NO: 3903836 - RNA, 17 nt, Human adenovirus B [HAdV-B]
ccuacaaaacaugcaac

SEQ ID NO: 3903837 - RNA, 18 nt, Human adenovirus B [HAdV-B]
ccuacuacgccugcugcu

SEQ ID NO: 3903838 - RNA, 13 nt, Human adenovirus B [HAdV-B]
ccuaugcacuuuu

SEQ ID NO: 3903839 - RNA, 21 nt, Human adenovirus B [HAdV-B]
ccucagagcgaaguguaucag

SEQ ID NO: 3903840 - RNA, 21 nt, Human adenovirus B [HAdV-B]
ccucaguacgauaccaccagg

SEQ ID NO: 3903841 - RNA, 18 nt, Human adenovirus B [HAdV-B]
ccuccacugaagugcaaa

SEQ ID NO: 3903842 - RNA, 16 nt, Human adenovirus B [HAdV-B]
ccuccgcgauaccugg

SEQ ID NO: 3903843 - RNA, 16 nt, Human adenovirus B [HAdV-B]
ccucugggaugcaaau

SEQ ID NO: 3903844 - RNA, 20 nt, Human adenovirus B [HAdV-B]
ccugacgaacagauggauaa

SEQ ID NO: 3903845 - RNA, 16 nt, Human adenovirus B [HAdV-B]
ccugccaccaccucua

SEQ ID NO: 3903846 - RNA, 21 nt, Human adenovirus B [HAdV-B]
ccugcugcuucucccaggcuc

SEQ ID NO: 3903847 - RNA, 17 nt, Human adenovirus B [HAdV-B]
ccugcuuguaaccacuc

SEQ ID NO: 3903848 - RNA, 17 nt, Human adenovirus B [HAdV-B]
ccuggcagaacacacuc

SEQ ID NO: 3903849 - RNA, 19 nt, Human adenovirus B [HAdV-B]
ccuguagaaaaagauagua

SEQ ID NO: 3903850 - RNA, 21 nt, Human adenovirus B [HAdV-B]
ccugucacuuuccgcuccacu

SEQ ID NO: 3903851 - RNA, 16 nt, Human adenovirus B [HAdV-B]
ccugucaucaugauua

SEQ ID NO: 3903852 - RNA, 22 nt, Human adenovirus B [HAdV-B]
ccuucuccggaucuccugggca

SEQ ID NO: 3903853 - RNA, 18 nt, Human adenovirus B [HAdV-B]
ccuuguaagggcagcagc

SEQ ID NO: 3903854 - RNA, 15 nt, Human adenovirus B [HAdV-B]
ccuuguguccuccaa

SEQ ID NO: 3903855 - RNA, 15 nt, Human adenovirus B [HAdV-B]
cgacguggacagcga

SEQ ID NO: 3903856 - RNA, 13 nt, Human adenovirus B [HAdV-B]
cgacugcagcacu

SEQ ID NO: 3903857 - RNA, 19 nt, Human adenovirus B [HAdV-B]
cgagcuaccacugccaugc

SEQ ID NO: 3903858 - RNA, 15 nt, Human adenovirus B [HAdV-B]
cgaggaaaaggagca

SEQ ID NO: 3903859 - RNA, 13 nt, Human adenovirus B [HAdV-B]
cgaggaggcagag

SEQ ID NO: 3903860 - RNA, 15 nt, Human adenovirus B [HAdV-B]
cgaggcucucuucaa

SEQ ID NO: 3903861 - RNA, 22 nt, Human adenovirus B [HAdV-B]
cgaggguggaaucauguccacc

SEQ ID NO: 3903862 - RNA, 16 nt, Human adenovirus B [HAdV-B]
cgaguaucaucacuua

SEQ ID NO: 3903863 - RNA, 20 nt, Human adenovirus B [HAdV-B]
cgaguuuacuuugccagaag

SEQ ID NO: 3903864 - RNA, 23 nt, Human adenovirus B [HAdV-B]
cgaugcccuacucaaucugggac

SEQ ID NO: 3903865 - RNA, 17 nt, Human adenovirus B [HAdV-B]
cgauuggacccaggcca

SEQ ID NO: 3903866 - RNA, 21 nt, Human adenovirus B [HAdV-B]
cgcaaaaaauggccuguuuuu

SEQ ID NO: 3903867 - RNA, 17 nt, Human adenovirus B [HAdV-B]
cgcaaguccccuuucag

SEQ ID NO: 3903868 - RNA, 20 nt, Human adenovirus B [HAdV-B]
cgccuucaauuggagcagua

SEQ ID NO: 3903869 - RNA, 22 nt, Human adenovirus B [HAdV-B]
cgcggcgugccucugacgugag

SEQ ID NO: 3903870 - RNA, 14 nt, Human adenovirus B [HAdV-B]
cgcuaccaucuccg

SEQ ID NO: 3903871 - RNA, 18 nt, Human adenovirus B [HAdV-B]
cgcuauggagucacugcu

SEQ ID NO: 3903872 - RNA, 16 nt, Human adenovirus B [HAdV-B]
cgcugcaaucugugca

SEQ ID NO: 3903873 - RNA, 13 nt, Human adenovirus B [HAdV-B]
cgcugcagagcca

SEQ ID NO: 3903874 - RNA, 21 nt, Human adenovirus B [HAdV-B]
gccuuguaagggcagcagccc

SEQ ID NO: 3903875 - RNA, 20 nt, Human adenovirus B [HAdV-B]
gcgaaauauggagcccagca

SEQ ID NO: 3903876 - RNA, 24 nt, Human adenovirus B [HAdV-B]
gcgacucgacuccguagccuggag

SEQ ID NO: 3903877 - RNA, 12 nt, Human adenovirus B [HAdV-B]
gcgccaacaccu

SEQ ID NO: 3903878 - RNA, 21 nt, Human adenovirus B [HAdV-B]
gcgugcaauggcgugggcgca

SEQ ID NO: 3903879 - RNA, 14 nt, Human adenovirus B [HAdV-B]
gcgugccaggcacu

SEQ ID NO: 3903880 - RNA, 18 nt, Human adenovirus B [HAdV-B]
gcguuccuggacauugcu

SEQ ID NO: 3903881 - RNA, 15 nt, Human adenovirus B [HAdV-B]
gcuacagcugcugca

SEQ ID NO: 3903882 - RNA, 14 nt, Human adenovirus B [HAdV-B]
gcuacgaagagcua

SEQ ID NO: 3903883 - RNA, 11 nt, Human adenovirus B [HAdV-B]
gcuagcagccc

SEQ ID NO: 3903884 - RNA, 21 nt, Human adenovirus B [HAdV-B]
gcuaggcggagcgguggugua

SEQ ID NO: 3903885 - RNA, 19 nt, Human adenovirus B [HAdV-B]
gcuagugaucgcacugcuu

SEQ ID NO: 3903886 - RNA, 22 nt, Human adenovirus B [HAdV-B]
gcucaucaaagguuaggucugu

SEQ ID NO: 3903887 - RNA, 16 nt, Human adenovirus B [HAdV-B]
gcucauggacaaacag

SEQ ID NO: 3903888 - RNA, 20 nt, Human adenovirus B [HAdV-B]
gcuccaaauacaucucagug

SEQ ID NO: 3903889 - RNA, 19 nt, Human adenovirus B [HAdV-B]
gcuccgccaguccaccucg

SEQ ID NO: 3903890 - RNA, 18 nt, Human adenovirus B [HAdV-B]
gcuccgguauccugcccg

SEQ ID NO: 3903891 - RNA, 14 nt, Human adenovirus B [HAdV-B]
gcucuaugccaacu

SEQ ID NO: 3903892 - RNA, 19 nt, Human adenovirus B [HAdV-B]
gcuggacuacuugcacaga

SEQ ID NO: 3903893 - RNA, 16 nt, Human adenovirus B [HAdV-B]
gcugucaaccugcccc

SEQ ID NO: 3903894 - RNA, 18 nt, Human adenovirus B [HAdV-B]
gcuuaacugauuuccuuc

SEQ ID NO: 3903895 - RNA, 18 nt, Human adenovirus B [HAdV-B]
gcuuacaacucccuggcu

SEQ ID NO: 3903896 - RNA, 14 nt, Human adenovirus B [HAdV-B]
gcuuaccuuuggaa

SEQ ID NO: 3903897 - RNA, 18 nt, Human adenovirus B [HAdV-B]
gcuucacacaaagcccaa

SEQ ID NO: 3903898 - RNA, 18 nt, Human adenovirus B [HAdV-B]
gcuugggcgcuugccagg

SEQ ID NO: 3903899 - RNA, 15 nt, Human adenovirus B [HAdV-B]
gcuuuugcugugcca

SEQ ID NO: 3903900 - RNA, 16 nt, Human adenovirus B [HAdV-B]
ggaacaaagcuuggaa

SEQ ID NO: 3903901 - RNA, 20 nt, Human adenovirus B [HAdV-B]
ggaagagucuuucugugcga

SEQ ID NO: 3903902 - RNA, 11 nt, Human adenovirus B [HAdV-B]
ggacaggguuc

SEQ ID NO: 3903903 - RNA, 18 nt, Human adenovirus B [HAdV-B]
ggagccgaaaucuugaaa

SEQ ID NO: 3903904 - RNA, 13 nt, Human adenovirus B [HAdV-B]
ggagcgguggugu

SEQ ID NO: 3903905 - RNA, 19 nt, Human adenovirus B [HAdV-B]
ggagcuuaccuuuggaagu

SEQ ID NO: 3903906 - RNA, 20 nt, Human adenovirus B [HAdV-B]
ggaggacagucuggaggaca

SEQ ID NO: 3903907 - RNA, 12 nt, Human adenovirus B [HAdV-B]
ggaggcagagga

SEQ ID NO: 3903908 - RNA, 12 nt, Human adenovirus B [HAdV-B]
ggagucacugcu

SEQ ID NO: 3903909 - RNA, 23 nt, Human adenovirus B [HAdV-B]
ggauagcuuccggcaucaaugga

SEQ ID NO: 3903910 - RNA, 15 nt, Human adenovirus B [HAdV-B]
ggaucacccucaagg

SEQ ID NO: 3903911 - RNA, 11 nt, Human adenovirus B [HAdV-B]
ggaucuccugg

SEQ ID NO: 3903912 - RNA, 21 nt, Human adenovirus B [HAdV-B]
ggauguagaugccuaugagaa

SEQ ID NO: 3903913 - RNA, 16 nt, Human adenovirus B [HAdV-B]
ggauuuccugccacca

SEQ ID NO: 3903914 - RNA, 11 nt, Human adenovirus B [HAdV-B]
ggcagaggugg

SEQ ID NO: 3903915 - RNA, 13 nt, Human adenovirus B [HAdV-B]
ggcagcagcuccu

SEQ ID NO: 3903916 - RNA, 15 nt, Human adenovirus B [HAdV-B]
ggcaggaugugagcu

SEQ ID NO: 3903917 - RNA, 15 nt, Human adenovirus B [HAdV-B]
ggcaggcaugcaaga

SEQ ID NO: 3903918 - RNA, 17 nt, Human adenovirus B [HAdV-B]
ggcaguuuggaagccac

SEQ ID NO: 3903919 - RNA, 20 nt, Human adenovirus B [HAdV-B]
ggcauggguguauggcagca

SEQ ID NO: 3903920 - RNA, 18 nt, Human adenovirus B [HAdV-B]
ggccaccucguucaucau

SEQ ID NO: 3903921 - RNA, 15 nt, Human adenovirus B [HAdV-B]
ggccauuuuggaaga

SEQ ID NO: 3903922 - RNA, 17 nt, Human adenovirus B [HAdV-B]
ggccgcaaaugcucugc

SEQ ID NO: 3903923 - RNA, 18 nt, Human adenovirus B [HAdV-B]
ggccuaagagaccugcua

SEQ ID NO: 3903924 - RNA, 15 nt, Human adenovirus B [HAdV-B]
ggccuccuagcaagg

SEQ ID NO: 3903925 - RNA, 18 nt, Human adenovirus B [HAdV-B]
ggccugcgucaucaccca

SEQ ID NO: 3903926 - RNA, 18 nt, Human adenovirus B [HAdV-B]
ggcgacggcggugaugca

SEQ ID NO: 3903927 - RNA, 18 nt, Human adenovirus B [HAdV-B]
ggcgcaguagucaagugu

SEQ ID NO: 3903928 - RNA, 20 nt, Human adenovirus B [HAdV-B]
ggcgccuucaauuggagcag

SEQ ID NO: 3903929 - RNA, 22 nt, Human adenovirus B [HAdV-B]
ggcgcuacuugcuauuccacca

SEQ ID NO: 3903930 - RNA, 18 nt, Human adenovirus B [HAdV-B]
ggcgcugcagagccagcc

SEQ ID NO: 3903931 - RNA, 16 nt, Human adenovirus B [HAdV-B]
ggcgcuugccagggug

SEQ ID NO: 3903932 - RNA, 13 nt, Human adenovirus B [HAdV-B]
ggcggcuccaccc

SEQ ID NO: 3903933 - RNA, 23 nt, Human adenovirus B [HAdV-B]
ggcguccagcgcugccaggguuc

SEQ ID NO: 3903934 - RNA, 17 nt, Human adenovirus B [HAdV-B]
ggcucagcgccgggccu

SEQ ID NO: 3903935 - RNA, 17 nt, Human adenovirus B [HAdV-B]
ggcucucuucaacaagu

SEQ ID NO: 3903936 - RNA, 19 nt, Human adenovirus B [HAdV-B]
ggcugcgguccgaccugga

SEQ ID NO: 3903937 - RNA, 14 nt, Human adenovirus B [HAdV-B]
gggacagucaggca

SEQ ID NO: 3903938 - RNA, 14 nt, Human adenovirus B [HAdV-B]
gggauguaguuucu

SEQ ID NO: 3903939 - RNA, 15 nt, Human adenovirus B [HAdV-B]
gggauuuggaagagc

SEQ ID NO: 3903940 - RNA, 23 nt, Human adenovirus B [HAdV-B]
gggcaaaguuuaaaacugacccc

SEQ ID NO: 3903941 - RNA, 18 nt, Human adenovirus B [HAdV-B]
gggcaacuccgacugcag

SEQ ID NO: 3903942 - RNA, 15 nt, Human adenovirus B [HAdV-B]
gggcggcgcugcaga

SEQ ID NO: 3903943 - RNA, 17 nt, Human adenovirus B [HAdV-B]
gggggcaauucuggccc

SEQ ID NO: 3903944 - RNA, 11 nt, Human adenovirus B [HAdV-B]
gggggcagagg

SEQ ID NO: 3903945 - RNA, 17 nt, Human adenovirus B [HAdV-B]
ggggugcuggcugguca

SEQ ID NO: 3903946 - RNA, 15 nt, Human adenovirus B [HAdV-B]
gggguguguuggaca

SEQ ID NO: 3903947 - RNA, 14 nt, Human adenovirus B [HAdV-B]
gggucuucuccugg

SEQ ID NO: 3903948 - RNA, 22 nt, Human adenovirus B [HAdV-B]
gggucuugugugggacgaugag

SEQ ID NO: 3903949 - RNA, 14 nt, Human adenovirus B [HAdV-B]
gguagaacugcugc

SEQ ID NO: 3903950 - RNA, 14 nt, Human adenovirus B [HAdV-B]
gguagacagaaugg

SEQ ID NO: 3903951 - RNA, 21 nt, Human adenovirus B [HAdV-B]
gguagcugaaacccacugcua

SEQ ID NO: 3903952 - RNA, 13 nt, Human adenovirus B [HAdV-B]
gguaggagaaaga

SEQ ID NO: 3903953 - RNA, 18 nt, Human adenovirus B [HAdV-B]
gguagucgguauggaagc

SEQ ID NO: 3903954 - RNA, 18 nt, Human adenovirus B [HAdV-B]
ggucagugaugagcagcu

SEQ ID NO: 3903955 - RNA, 20 nt, Human adenovirus B [HAdV-B]
ggucaucuugcaggucugcc

SEQ ID NO: 3903956 - RNA, 20 nt, Human adenovirus B [HAdV-B]
ggugcaacacagcagagaca

SEQ ID NO: 3903957 - RNA, 14 nt, Human adenovirus B [HAdV-B]
ggugccaggugguc

SEQ ID NO: 3903958 - RNA, 22 nt, Human adenovirus B [HAdV-B]
gguggugcaacacagcagagac

SEQ ID NO: 3903959 - RNA, 19 nt, Human adenovirus B [HAdV-B]
gguguaucgcaaugacaga

SEQ ID NO: 3903960 - RNA, 17 nt, Human adenovirus B [HAdV-B]
gguugcauucacugcuc

SEQ ID NO: 3903961 - RNA, 19 nt, Human adenovirus B [HAdV-B]
guacaugggcaccuggagc

SEQ ID NO: 3903962 - RNA, 14 nt, Human adenovirus B [HAdV-B]
guaccaugcaugca

SEQ ID NO: 3903963 - RNA, 16 nt, Human adenovirus B [HAdV-B]
guacgauaccaccagg

SEQ ID NO: 3903964 - RNA, 16 nt, Human adenovirus B [HAdV-B]
guauaauuaugcuuaa

SEQ ID NO: 3903965 - RNA, 15 nt, Human adenovirus B [HAdV-B]
guaucacaagagcga

SEQ ID NO: 3903966 - RNA, 14 nt, Human adenovirus B [HAdV-B]
guaucgcaaugaca

SEQ ID NO: 3903967 - RNA, 15 nt, Human adenovirus B [HAdV-B]
gucaaguguuucuug

SEQ ID NO: 3903968 - RNA, 21 nt, Human adenovirus B [HAdV-B]
gucaucuuuagcgaucuucuc

SEQ ID NO: 3903969 - RNA, 22 nt, Human adenovirus B [HAdV-B]
gucaucuuuagcgaucuucuca

SEQ ID NO: 3903970 - RNA, 15 nt, Human adenovirus B [HAdV-B]
gucccgauuuggaag

SEQ ID NO: 3903971 - RNA, 17 nt, Human adenovirus B [HAdV-B]
guccugccaccaccucu

SEQ ID NO: 3903972 - RNA, 16 nt, Human adenovirus B [HAdV-B]
guccugccagggcaca

SEQ ID NO: 3903973 - RNA, 21 nt, Human adenovirus B [HAdV-B]
gucggcggacauugcuucucu

SEQ ID NO: 3903974 - RNA, 20 nt, Human adenovirus B [HAdV-B]
gucuaucuguaccugugcca

SEQ ID NO: 3903975 - RNA, 13 nt, Human adenovirus B [HAdV-B]
gucucaaccccag

SEQ ID NO: 3903976 - RNA, 14 nt, Human adenovirus B [HAdV-B]
gucucacgcuugcc

SEQ ID NO: 3903977 - RNA, 20 nt, Human adenovirus B [HAdV-B]
agacgccaccgagcuaccac

SEQ ID NO: 3903978 - RNA, 14 nt, Human adenovirus B [HAdV-B]
agagcgagccguag

SEQ ID NO: 3903979 - RNA, 20 nt, Human adenovirus B [HAdV-B]
agagcgugaugcagcagcag

SEQ ID NO: 3903980 - RNA, 16 nt, Human adenovirus B [HAdV-B]
agagcucugacuggag

SEQ ID NO: 3903981 - RNA, 20 nt, Human adenovirus B [HAdV-B]
agagcucugacuggagcugg

SEQ ID NO: 3903982 - RNA, 17 nt, Human adenovirus B [HAdV-B]
agaggugggauugaaug

SEQ ID NO: 3903983 - RNA, 17 nt, Human adenovirus B [HAdV-B]
agaguaucauagugcag

SEQ ID NO: 3903984 - RNA, 18 nt, Human adenovirus B [HAdV-B]
agagucucugacaaagug

SEQ ID NO: 3903985 - RNA, 16 nt, Human adenovirus B [HAdV-B]
agauaacuaucaccaa

SEQ ID NO: 3903986 - RNA, 15 nt, Human adenovirus B [HAdV-B]
agauguaaccugggc

SEQ ID NO: 3903987 - RNA, 22 nt, Human adenovirus B [HAdV-B]
agauguacgcgaagccgugucu

SEQ ID NO: 3903988 - RNA, 22 nt, Human adenovirus B [HAdV-B]
agcaacgcauucugauuucacu

SEQ ID NO: 3903989 - RNA, 19 nt, Human adenovirus B [HAdV-B]
agcaauggggccgugggca

SEQ ID NO: 3903990 - RNA, 14 nt, Human adenovirus B [HAdV-B]
agcagagcaggucu

SEQ ID NO: 3903991 - RNA, 16 nt, Human adenovirus B [HAdV-B]
agcagcaggcgacggc

SEQ ID NO: 3903992 - RNA, 16 nt, Human adenovirus B [HAdV-B]
agcaguaucuggagcg

SEQ ID NO: 3903993 - RNA, 23 nt, Human adenovirus B [HAdV-B]
agccagguuaaauccgguucauu

SEQ ID NO: 3903994 - RNA, 21 nt, Human adenovirus B [HAdV-B]
agcccauucgugcaggugagg

SEQ ID NO: 3903995 - RNA, 19 nt, Human adenovirus B [HAdV-B]
agccccccgggaacaagag

SEQ ID NO: 3903996 - RNA, 14 nt, Human adenovirus B [HAdV-B]
agccuacugccacc

SEQ ID NO: 3903997 - RNA, 18 nt, Human adenovirus B [HAdV-B]
agccuggaggaacgugaa

SEQ ID NO: 3903998 - RNA, 16 nt, Human adenovirus B [HAdV-B]
agcgccagcaggaggc

SEQ ID NO: 3903999 - RNA, 16 nt, Human adenovirus B [HAdV-B]
agcgcuaccaucuccg

SEQ ID NO: 3904000 - RNA, 14 nt, Human adenovirus B [HAdV-B]
agcgcuuucacagu

SEQ ID NO: 3904001 - RNA, 21 nt, Human adenovirus B [HAdV-B]
agcucagagaugucauccaaa

SEQ ID NO: 3904002 - RNA, 15 nt, Human adenovirus B [HAdV-B]
agcucagagccauug

SEQ ID NO: 3904003 - RNA, 18 nt, Human adenovirus B [HAdV-B]
agcucgccugugccauug

SEQ ID NO: 3904004 - RNA, 13 nt, Human adenovirus B [HAdV-B]
agcugacuugcag

SEQ ID NO: 3904005 - RNA, 16 nt, Human adenovirus B [HAdV-B]
agcugcuacagcugcu

SEQ ID NO: 3904006 - RNA, 21 nt, Human adenovirus B [HAdV-B]
aggaaccugaaguaaauggaa

SEQ ID NO: 3904007 - RNA, 16 nt, Human adenovirus B [HAdV-B]
aggaccagugcuuuga

SEQ ID NO: 3904008 - RNA, 16 nt, Human adenovirus B [HAdV-B]
aggagcggagccuggg

SEQ ID NO: 3904009 - RNA, 22 nt, Human adenovirus B [HAdV-B]
aggaggaaaacgaggaggcaga

SEQ ID NO: 3904010 - RNA, 13 nt, Human adenovirus B [HAdV-B]
aggaggacagucu

SEQ ID NO: 3904011 - RNA, 19 nt, Human adenovirus B [HAdV-B]
aggaggcggaggaggacag

SEQ ID NO: 3904012 - RNA, 20 nt, Human adenovirus B [HAdV-B]
aggauauuuugaaauaugag

SEQ ID NO: 3904013 - RNA, 13 nt, Human adenovirus B [HAdV-B]
aggaucacagaga

SEQ ID NO: 3904014 - RNA, 22 nt, Human adenovirus B [HAdV-B]
aggcgaugggucuucuccuggg

SEQ ID NO: 3904015 - RNA, 15 nt, Human adenovirus B [HAdV-B]
aggcggagcgguggu

SEQ ID NO: 3904016 - RNA, 18 nt, Human adenovirus B [HAdV-B]
aggggcguuaagagggag

SEQ ID NO: 3904017 - RNA, 18 nt, Human adenovirus B [HAdV-B]
aggguugcauucacugcu

SEQ ID NO: 3904018 - RNA, 15 nt, Human adenovirus B [HAdV-B]
aggucaucugggcca

SEQ ID NO: 3904019 - RNA, 14 nt, Human adenovirus B [HAdV-B]
aggucgcagugcau

SEQ ID NO: 3904020 - RNA, 21 nt, Human adenovirus B [HAdV-B]
aggugaagauuuguaucccac

SEQ ID NO: 3904021 - RNA, 18 nt, Human adenovirus B [HAdV-B]
agguggacgagcagaccu

SEQ ID NO: 3904022 - RNA, 15 nt, Human adenovirus B [HAdV-B]
agguggucucuggau

SEQ ID NO: 3904023 - RNA, 19 nt, Human adenovirus B [HAdV-B]
agguuacuggccagugcag

SEQ ID NO: 3904024 - RNA, 17 nt, Human adenovirus B [HAdV-B]
aguaacuuuuguaaaug

SEQ ID NO: 3904025 - RNA, 17 nt, Human adenovirus B [HAdV-B]
aguacuccaccagaaca

SEQ ID NO: 3904026 - RNA, 18 nt, Human adenovirus B [HAdV-B]
agucaaguguuucuugaa

SEQ ID NO: 3904027 - RNA, 17 nt, Human adenovirus B [HAdV-B]
agucggcggacauugcu

SEQ ID NO: 3904028 - RNA, 16 nt, Human adenovirus B [HAdV-B]
agucugagacagacau

SEQ ID NO: 3904029 - RNA, 22 nt, Human adenovirus B [HAdV-B]
agucuguuccacaguucaguga

SEQ ID NO: 3904030 - RNA, 16 nt, Human adenovirus B [HAdV-B]
agucuguugaugccca

SEQ ID NO: 3904031 - RNA, 19 nt, Human adenovirus B [HAdV-B]
agugaaccacaacccccac

SEQ ID NO: 3904032 - RNA, 15 nt, Human adenovirus B [HAdV-B]
agugagaucggacag

SEQ ID NO: 3904033 - RNA, 21 nt, Human adenovirus B [HAdV-B]
agugcccaucaguguggaaga

SEQ ID NO: 3904034 - RNA, 23 nt, Human adenovirus B [HAdV-B]
agugcccaucaguguggaagagc

SEQ ID NO: 3904035 - RNA, 23 nt, Human adenovirus B [HAdV-B]
agugcggaaccuuugacacugcc

SEQ ID NO: 3904036 - RNA, 13 nt, Human adenovirus B [HAdV-B]
aguucaaguacaa

SEQ ID NO: 3904037 - RNA, 21 nt, Human adenovirus B [HAdV-B]
aguucuugugguaaauccaau

SEQ ID NO: 3904038 - RNA, 19 nt, Human adenovirus B [HAdV-B]
aguugagcgccucggcugc

SEQ ID NO: 3904039 - RNA, 17 nt, Human adenovirus B [HAdV-B]
aguugcgccucuucucu

SEQ ID NO: 3904040 - RNA, 22 nt, Human adenovirus B [HAdV-B]
auaaaucagucuuuccaucaca

SEQ ID NO: 3904041 - RNA, 13 nt, Human adenovirus B [HAdV-B]
auaagaaugccau

SEQ ID NO: 3904042 - RNA, 13 nt, Human adenovirus B [HAdV-B]
auacaauggacuc

SEQ ID NO: 3904043 - RNA, 18 nt, Human adenovirus B [HAdV-B]
auaccgcaaccaaaauau

SEQ ID NO: 3904044 - RNA, 15 nt, Human adenovirus B [HAdV-B]
auacugacgaaaaug

SEQ ID NO: 3904045 - RNA, 13 nt, Human adenovirus B [HAdV-B]
auacuuuuggaac

SEQ ID NO: 3904046 - RNA, 16 nt, Human adenovirus B [HAdV-B]
auagcuuugaggccug

SEQ ID NO: 3904047 - RNA, 22 nt, Human adenovirus B [HAdV-B]
auagggcuugacggggaagacg

SEQ ID NO: 3904048 - RNA, 16 nt, Human adenovirus B [HAdV-B]
auaguuauguuccuga

SEQ ID NO: 3904049 - RNA, 13 nt, Human adenovirus B [HAdV-B]
aucaaaugcucac

SEQ ID NO: 3904050 - RNA, 21 nt, Human adenovirus B [HAdV-B]
aucacaauuaggaccagugcu

SEQ ID NO: 3904051 - RNA, 12 nt, Human adenovirus B [HAdV-B]
aucacccagcaa

SEQ ID NO: 3904052 - RNA, 22 nt, Human adenovirus B [HAdV-B]
aucagccauggcuuaccagaca

SEQ ID NO: 3904053 - RNA, 18 nt, Human adenovirus B [HAdV-B]
auccacaagacccagagg

SEQ ID NO: 3904054 - RNA, 20 nt, Human adenovirus B [HAdV-B]
aucccgccaaacccaacaca

SEQ ID NO: 3904055 - RNA, 22 nt, Human adenovirus B [HAdV-B]
aucccgccaaacccaacacaca

SEQ ID NO: 3904056 - RNA, 21 nt, Human adenovirus B [HAdV-B]
auccugcccgccaccugcugc

SEQ ID NO: 3904057 - RNA, 21 nt, Human adenovirus B [HAdV-B]
auccugucugauuccuggaua

SEQ ID NO: 3904058 - RNA, 21 nt, Human adenovirus B [HAdV-B]
aucggcacgagccaacugaac

SEQ ID NO: 3904059 - RNA, 19 nt, Human adenovirus B [HAdV-B]
aucuggacuuggaagaggg

SEQ ID NO: 3904060 - RNA, 13 nt, Human adenovirus B [HAdV-B]
augaacaaugcca

SEQ ID NO: 3904061 - RNA, 14 nt, Human adenovirus B [HAdV-B]
augaacaaugccau

SEQ ID NO: 3904062 - RNA, 13 nt, Human adenovirus B [HAdV-B]
augaauguuccuu

SEQ ID NO: 3904063 - RNA, 11 nt, Human adenovirus B [HAdV-B]
augaauuaaaa

SEQ ID NO: 3904064 - RNA, 22 nt, Human adenovirus B [HAdV-B]
augacccagaugccugugauga

SEQ ID NO: 3904065 - RNA, 19 nt, Human adenovirus B [HAdV-B]
augagaacaguaagaaaga

SEQ ID NO: 3904066 - RNA, 12 nt, Human adenovirus B [HAdV-B]
augagacagugu

SEQ ID NO: 3904067 - RNA, 12 nt, Human adenovirus B [HAdV-B]
augaggccacaa

SEQ ID NO: 3904068 - RNA, 19 nt, Human adenovirus B [HAdV-B]
augaggcuuucagagaggc

SEQ ID NO: 3904069 - RNA, 14 nt, Human adenovirus B [HAdV-B]
augauaacagaugu

SEQ ID NO: 3904070 - RNA, 20 nt, Human adenovirus B [HAdV-B]
augaugaaggauccugucac

SEQ ID NO: 3904071 - RNA, 21 nt, Human adenovirus B [HAdV-B]
augauuaauaaaaaaucacuu

SEQ ID NO: 3904072 - RNA, 19 nt, Human adenovirus B [HAdV-B]
augcaguuauugacagugu

SEQ ID NO: 3904073 - RNA, 20 nt, Human adenovirus B [HAdV-B]
augccauggacaaugucaac

SEQ ID NO: 3904074 - RNA, 18 nt, Human adenovirus B [HAdV-B]
augcgggcggcgcugcag

SEQ ID NO: 3904075 - RNA, 21 nt, Human adenovirus B [HAdV-B]
augcuggcuacugugcauauu

SEQ ID NO: 3904076 - RNA, 21 nt, Human adenovirus B [HAdV-B]
auggacaggagucaaccccac

SEQ ID NO: 3904077 - RNA, 20 nt, Human adenovirus B [HAdV-B]
auggcgaucccgaaaaagga

SEQ ID NO: 3904078 - RNA, 13 nt, Human adenovirus B [HAdV-B]
auggcgcuagcag

SEQ ID NO: 3904079 - RNA, 18 nt, Human adenovirus B [HAdV-B]
gcuauggagucacugcua

SEQ ID NO: 3904080 - RNA, 20 nt, Human adenovirus B [HAdV-B]
gcuauggagucacugcuacc

SEQ ID NO: 3904081 - RNA, 15 nt, Human adenovirus B [HAdV-B]
gcucaccauuaccaa

SEQ ID NO: 3904082 - RNA, 17 nt, Human adenovirus B [HAdV-B]
gcuccgccaguccaccu

SEQ ID NO: 3904083 - RNA, 18 nt, Human adenovirus B [HAdV-B]
gcuccgggguaguguugu

SEQ ID NO: 3904084 - RNA, 17 nt, Human adenovirus B [HAdV-B]
gcucgggauucuccuuu

SEQ ID NO: 3904085 - RNA, 21 nt, Human adenovirus B [HAdV-B]
gcucuuaccaccacgccccgc

SEQ ID NO: 3904086 - RNA, 22 nt, Human adenovirus B [HAdV-B]
gcucuuacugcggaggaggaga

SEQ ID NO: 3904087 - RNA, 13 nt, Human adenovirus B [HAdV-B]
gcugauugccaca

SEQ ID NO: 3904088 - RNA, 20 nt, Human adenovirus B [HAdV-B]
gcugcaaagcuccaagcagg

SEQ ID NO: 3904089 - RNA, 13 nt, Human adenovirus B [HAdV-B]
gcugcacagcacc

SEQ ID NO: 3904090 - RNA, 15 nt, Human adenovirus B [HAdV-B]
gcugcagagccagcc

SEQ ID NO: 3904091 - RNA, 12 nt, Human adenovirus B [HAdV-B]
gcugccagugcg

SEQ ID NO: 3904092 - RNA, 11 nt, Human adenovirus B [HAdV-B]
gcugcuacagc

SEQ ID NO: 3904093 - RNA, 22 nt, Human adenovirus B [HAdV-B]
gcugcuacagcugcugcagaag

SEQ ID NO: 3904094 - RNA, 13 nt, Human adenovirus B [HAdV-B]
gcugguuuccgaa

SEQ ID NO: 3904095 - RNA, 13 nt, Human adenovirus B [HAdV-B]
gcuuauggcaagc

SEQ ID NO: 3904096 - RNA, 13 nt, Human adenovirus B [HAdV-B]
gcuucacuuucuu

SEQ ID NO: 3904097 - RNA, 19 nt, Human adenovirus B [HAdV-B]
gcuuccagacaugaugaag

SEQ ID NO: 3904098 - RNA, 22 nt, Human adenovirus B [HAdV-B]
gcuuccagacaugaugaaggau

SEQ ID NO: 3904099 - RNA, 18 nt, Human adenovirus B [HAdV-B]
gcuuccgaccuggcagac

SEQ ID NO: 3904100 - RNA, 14 nt, Human adenovirus B [HAdV-B]
gcuugacucucugg

SEQ ID NO: 3904101 - RNA, 15 nt, Human adenovirus B [HAdV-B]
gcuuggaaugcccac

SEQ ID NO: 3904102 - RNA, 17 nt, Human adenovirus B [HAdV-B]
gcuugggcgcuugccag

SEQ ID NO: 3904103 - RNA, 19 nt, Human adenovirus B [HAdV-B]
ggaaaacggauucugggga

SEQ ID NO: 3904104 - RNA, 11 nt, Human adenovirus B [HAdV-B]
ggaacuggcac

SEQ ID NO: 3904105 - RNA, 15 nt, Human adenovirus B [HAdV-B]
ggaagacgcgcuccu

SEQ ID NO: 3904106 - RNA, 23 nt, Human adenovirus B [HAdV-B]
ggaagcaacgaagcuuggaaugc

SEQ ID NO: 3904107 - RNA, 17 nt, Human adenovirus B [HAdV-B]
ggaagugaguccuauuu

SEQ ID NO: 3904108 - RNA, 19 nt, Human adenovirus B [HAdV-B]
ggaaguuucagaugaagaa

SEQ ID NO: 3904109 - RNA, 14 nt, Human adenovirus B [HAdV-B]
ggaaucaaccccau

SEQ ID NO: 3904110 - RNA, 21 nt, Human adenovirus B [HAdV-B]
ggaaucaccaacuugggaacc

SEQ ID NO: 3904111 - RNA, 20 nt, Human adenovirus B [HAdV-B]
ggaaucaggcuguggacagu

SEQ ID NO: 3904112 - RNA, 18 nt, Human adenovirus B [HAdV-B]
ggaaugcgacgcuacagg

SEQ ID NO: 3904113 - RNA, 13 nt, Human adenovirus B [HAdV-B]
gacagaacugaag

SEQ ID NO: 3904114 - RNA, 14 nt, Human adenovirus B [HAdV-B]
gacagcaaaugaca

SEQ ID NO: 3904115 - RNA, 19 nt, Human adenovirus B [HAdV-B]
gacaggguucgacgagcgc

SEQ ID NO: 3904116 - RNA, 15 nt, Human adenovirus B [HAdV-B]
gacauggaaacucag

SEQ ID NO: 3904117 - RNA, 15 nt, Human adenovirus B [HAdV-B]
gacauggcuucucuu

SEQ ID NO: 3904118 - RNA, 14 nt, Human adenovirus B [HAdV-B]
gaccacgguggugc

SEQ ID NO: 3904119 - RNA, 20 nt, Human adenovirus B [HAdV-B]
gaccucaucuucccagagcg

SEQ ID NO: 3904120 - RNA, 14 nt, Human adenovirus B [HAdV-B]
gacgagaaaacaag

SEQ ID NO: 3904121 - RNA, 20 nt, Human adenovirus B [HAdV-B]
gacgccagcgccaugacaga

SEQ ID NO: 3904122 - RNA, 23 nt, Human adenovirus B [HAdV-B]
gacggaugucucacgcuugccag

SEQ ID NO: 3904123 - RNA, 16 nt, Human adenovirus B [HAdV-B]
gacggcggugaugcaa

SEQ ID NO: 3904124 - RNA, 14 nt, Human adenovirus B [HAdV-B]
gacuagcagacagg

SEQ ID NO: 3904125 - RNA, 18 nt, Human adenovirus B [HAdV-B]
gacucugacacuccuggu

SEQ ID NO: 3904126 - RNA, 21 nt, Human adenovirus B [HAdV-B]
gacugcagcacuggacaugac

SEQ ID NO: 3904127 - RNA, 13 nt, Human adenovirus B [HAdV-B]
gacuuaugcucag

SEQ ID NO: 3904128 - RNA, 14 nt, Human adenovirus B [HAdV-B]
gacuugggacagaa

SEQ ID NO: 3904129 - RNA, 15 nt, Human adenovirus B [HAdV-B]
gagagccggccugga

SEQ ID NO: 3904130 - RNA, 13 nt, Human adenovirus B [HAdV-B]
gagagcgugaugc

SEQ ID NO: 3904131 - RNA, 21 nt, Human adenovirus B [HAdV-B]
gagcaguaucuggagcgggcu

SEQ ID NO: 3904132 - RNA, 13 nt, Human adenovirus B [HAdV-B]
gagcccagcaugu

SEQ ID NO: 3904133 - RNA, 13 nt, Human adenovirus B [HAdV-B]
gagcggagccugg

SEQ ID NO: 3904134 - RNA, 16 nt, Human adenovirus B [HAdV-B]
gaggaaaaggagcaga

SEQ ID NO: 3904135 - RNA, 20 nt, Human adenovirus B [HAdV-B]
gaggaagauggcgaugaugg

SEQ ID NO: 3904136 - RNA, 15 nt, Human adenovirus B [HAdV-B]
gaggaugugagcgga

SEQ ID NO: 3904137 - RNA, 19 nt, Human adenovirus B [HAdV-B]
gaggcagucuaccugcgua

SEQ ID NO: 3904138 - RNA, 20 nt, Human adenovirus B [HAdV-B]
gaggcggaugaaggcgagga

SEQ ID NO: 3904139 - RNA, 12 nt, Human adenovirus B [HAdV-B]
gagggcgaagga

SEQ ID NO: 3904140 - RNA, 19 nt, Human adenovirus B [HAdV-B]
gaggguaaaccagugguca

SEQ ID NO: 3904141 - RNA, 15 nt, Human adenovirus B [HAdV-B]
gagucggugagcucu

SEQ ID NO: 3904142 - RNA, 13 nt, Human adenovirus B [HAdV-B]
gagugucacugcc

SEQ ID NO: 3904143 - RNA, 12 nt, Human adenovirus B [HAdV-B]
aaaaauggccug

SEQ ID NO: 3904144 - RNA, 14 nt, Human adenovirus B [HAdV-B]
aaaacaugcaacau

SEQ ID NO: 3904145 - RNA, 21 nt, Human adenovirus B [HAdV-B]
aaaacugguuagcugcacagc

SEQ ID NO: 3904146 - RNA, 18 nt, Human adenovirus B [HAdV-B]
aaaauguugaaaugggca

SEQ ID NO: 3904147 - RNA, 19 nt, Human adenovirus B [HAdV-B]
aaaauuugccaaaaaaaca

SEQ ID NO: 3904148 - RNA, 19 nt, Human adenovirus B [HAdV-B]
aaacuuuuauccagcuuuu

SEQ ID NO: 3904149 - RNA, 12 nt, Human adenovirus B [HAdV-B]
aaagccaaaaua

SEQ ID NO: 3904150 - RNA, 12 nt, Human adenovirus B [HAdV-B]
aaagccugcugg

SEQ ID NO: 3904151 - RNA, 17 nt, Human adenovirus B [HAdV-B]
aaagcgugcugcacagc

SEQ ID NO: 3904152 - RNA, 17 nt, Human adenovirus B [HAdV-B]
aaagugacauugguguu

SEQ ID NO: 3904153 - RNA, 14 nt, Human adenovirus B [HAdV-B]
aaaguuugguggau

SEQ ID NO: 3904154 - RNA, 15 nt, Human adenovirus B [HAdV-B]
aaauuacccaaguca

SEQ ID NO: 3904155 - RNA, 16 nt, Human adenovirus B [HAdV-B]
aacaaagaaaaaaugc

SEQ ID NO: 3904156 - RNA, 17 nt, Human adenovirus B [HAdV-B]
aacaauuuucgcucuuu

SEQ ID NO: 3904157 - RNA, 20 nt, Human adenovirus B [HAdV-B]
aacaccuuagaaaaugcaaa

SEQ ID NO: 3904158 - RNA, 23 nt, Human adenovirus B [HAdV-B]
aacacguuccgugggucugacac

SEQ ID NO: 3904159 - RNA, 20 nt, Human adenovirus B [HAdV-B]
aacaggaggauuaaagauua

SEQ ID NO: 3904160 - RNA, 14 nt, Human adenovirus B [HAdV-B]
aacagugcaggcag

SEQ ID NO: 3904161 - RNA, 23 nt, Human adenovirus B [HAdV-B]
aacagugcaggcagcagcuccuu

SEQ ID NO: 3904162 - RNA, 22 nt, Human adenovirus B [HAdV-B]
aacauagacauaaaugcaugca

SEQ ID NO: 3904163 - RNA, 18 nt, Human adenovirus B [HAdV-B]
aacaucaauugacaugcc

SEQ ID NO: 3904164 - RNA, 21 nt, Human adenovirus B [HAdV-B]
aacauuauuguacugccaucu

SEQ ID NO: 3904165 - RNA, 16 nt, Human adenovirus B [HAdV-B]
aacauucuacagagua

SEQ ID NO: 3904166 - RNA, 11 nt, Human adenovirus B [HAdV-B]
aaccacaaccc

SEQ ID NO: 3904167 - RNA, 16 nt, Human adenovirus B [HAdV-B]
aacccccacuacuccc

SEQ ID NO: 3904168 - RNA, 17 nt, Human adenovirus B [HAdV-B]
aaccuuugacacugccg

SEQ ID NO: 3904169 - RNA, 21 nt, Human adenovirus B [HAdV-B]
aacgaauuuucucccagcggc

SEQ ID NO: 3904170 - RNA, 21 nt, Human adenovirus B [HAdV-B]
aacgagcagauaacuaucacc

SEQ ID NO: 3904171 - RNA, 16 nt, Human adenovirus B [HAdV-B]
aacgaggaggcagagg

SEQ ID NO: 3904172 - RNA, 22 nt, Human adenovirus B [HAdV-B]
aacucugaccacucugauacaa

SEQ ID NO: 3904173 - RNA, 19 nt, Human adenovirus B [HAdV-B]
aagaacaaaaagccaaaau

SEQ ID NO: 3904174 - RNA, 20 nt, Human adenovirus B [HAdV-B]
aagagcuugacaagcucuua

SEQ ID NO: 3904175 - RNA, 19 nt, Human adenovirus B [HAdV-B]
aagcaaggguccgccacug

SEQ ID NO: 3904176 - RNA, 20 nt, Human adenovirus B [HAdV-B]
aagcaaggguccgccacugc

SEQ ID NO: 3904177 - RNA, 16 nt, Human adenovirus B [HAdV-B]
aagcauacaauccaga

SEQ ID NO: 3904178 - RNA, 19 nt, Human adenovirus B [HAdV-B]
aagcaugauuuuaauagcc

SEQ ID NO: 3904179 - RNA, 19 nt, Human adenovirus B [HAdV-B]
aagccauagggcaaaguca

SEQ ID NO: 3904180 - RNA, 16 nt, Human adenovirus B [HAdV-B]
aagcuaaggcaaacau

SEQ ID NO: 3904181 - RNA, 13 nt, Human adenovirus B [HAdV-B]
aaguauggaggca

SEQ ID NO: 3904182 - RNA, 21 nt, Human adenovirus B [HAdV-B]
aauaguaacuugcaacauaca

SEQ ID NO: 3904183 - RNA, 17 nt, Human adenovirus B [HAdV-B]
aauaguuccaaauggag

SEQ ID NO: 3904184 - RNA, 23 nt, Human adenovirus B [HAdV-B]
aauaucaucgaaguugcuggaaa

SEQ ID NO: 3904185 - RNA, 22 nt, Human adenovirus B [HAdV-B]
aaucagaaugacccgcaggcag

SEQ ID NO: 3904186 - RNA, 14 nt, Human adenovirus B [HAdV-B]
aaucauaauccgaa

SEQ ID NO: 3904187 - RNA, 12 nt, Human adenovirus B [HAdV-B]
aaucaugugaaa

SEQ ID NO: 3904188 - RNA, 15 nt, Human adenovirus B [HAdV-B]
aaucugcacuacacu

SEQ ID NO: 3904189 - RNA, 20 nt, Human adenovirus B [HAdV-B]
aaucuuagguuacuggccag

SEQ ID NO: 3904190 - RNA, 24 nt, Human adenovirus B [HAdV-B]
aaugacggauuucugugggacgac

SEQ ID NO: 3904191 - RNA, 14 nt, Human adenovirus B [HAdV-B]
ucaaacugcacacu

SEQ ID NO: 3904192 - RNA, 13 nt, Human adenovirus B [HAdV-B]
ucaaaugcucacu

SEQ ID NO: 3904193 - RNA, 17 nt, Human adenovirus B [HAdV-B]
ucaaccccagcugccua

SEQ ID NO: 3904194 - RNA, 16 nt, Human adenovirus B [HAdV-B]
ucaauaguuccaaaug

SEQ ID NO: 3904195 - RNA, 16 nt, Human adenovirus B [HAdV-B]
ucaauucaaacaacau

SEQ ID NO: 3904196 - RNA, 17 nt, Human adenovirus B [HAdV-B]
ucacaagacaagccaca

SEQ ID NO: 3904197 - RNA, 18 nt, Human adenovirus B [HAdV-B]
ucacagagacgagccugg

SEQ ID NO: 3904198 - RNA, 14 nt, Human adenovirus B [HAdV-B]
ucacagauuugcau

SEQ ID NO: 3904199 - RNA, 20 nt, Human adenovirus B [HAdV-B]
ucacaggcucccuguuccca

SEQ ID NO: 3904200 - RNA, 23 nt, Human adenovirus B [HAdV-B]
ucagcagacacaucacuuccaug

SEQ ID NO: 3904201 - RNA, 12 nt, Human adenovirus B [HAdV-B]
ucagcugcaaag

SEQ ID NO: 3904202 - RNA, 17 nt, Human adenovirus B [HAdV-B]
ucagcuguugggguagg

SEQ ID NO: 3904203 - RNA, 14 nt, Human adenovirus B [HAdV-B]
ucaguccugccagg

SEQ ID NO: 3904204 - RNA, 18 nt, Human adenovirus B [HAdV-B]
ucagugaaaacguuccug

SEQ ID NO: 3904205 - RNA, 22 nt, Human adenovirus B [HAdV-B]
ucaguguggaagagcucagccg

SEQ ID NO: 3904206 - RNA, 13 nt, Human adenovirus B [HAdV-B]
ucauagccacagc

SEQ ID NO: 3904207 - RNA, 15 nt, Human adenovirus B [HAdV-B]
ucauccuuggcuccg

SEQ ID NO: 3904208 - RNA, 14 nt, Human adenovirus B [HAdV-B]
ucaucuaaaaccau

SEQ ID NO: 3904209 - RNA, 18 nt, Human adenovirus B [HAdV-B]
ucaucugggccaaacugg

SEQ ID NO: 3904210 - RNA, 22 nt, Human adenovirus B [HAdV-B]
uccaacaaccguggucauuucu

SEQ ID NO: 3904211 - RNA, 18 nt, Human adenovirus B [HAdV-B]
uccaacagagccuaccuc

SEQ ID NO: 3904212 - RNA, 18 nt, Human adenovirus B [HAdV-B]
uccagguguaaguuucca

SEQ ID NO: 3904213 - RNA, 23 nt, Human adenovirus B [HAdV-B]
uccaguggaggaggcggaguagc

SEQ ID NO: 3904214 - RNA, 15 nt, Human adenovirus B [HAdV-B]
ucccagcagcaccuc

SEQ ID NO: 3904215 - RNA, 19 nt, Human adenovirus B [HAdV-B]
uccccccaaacgucagcca

SEQ ID NO: 3904216 - RNA, 14 nt, Human adenovirus B [HAdV-B]
uccccgcugggggg

SEQ ID NO: 3904217 - RNA, 18 nt, Human adenovirus B [HAdV-B]
ucccgacgaaaguacggu

SEQ ID NO: 3904218 - RNA, 15 nt, Human adenovirus B [HAdV-B]
uccgacugcagaauc

SEQ ID NO: 3904219 - RNA, 19 nt, Human adenovirus B [HAdV-B]
uccgagucgaggaacccgg

SEQ ID NO: 3904220 - RNA, 17 nt, Human adenovirus B [HAdV-B]
uccgguauccugcccgc

SEQ ID NO: 3904221 - RNA, 20 nt, Human adenovirus B [HAdV-B]
uccugcccgccaccugcugc

SEQ ID NO: 3904222 - RNA, 17 nt, Human adenovirus B [HAdV-B]
ucgaaaccguugauguu

SEQ ID NO: 3904223 - RNA, 17 nt, Human adenovirus B [HAdV-B]
ucgacuccguagccugg

SEQ ID NO: 3904224 - RNA, 22 nt, Human adenovirus B [HAdV-B]
ucgcaacugggcggcuuucaga

SEQ ID NO: 3904225 - RNA, 20 nt, Human adenovirus B [HAdV-B]
ucgcauaucccgcugucaac

SEQ ID NO: 3904226 - RNA, 22 nt, Human adenovirus B [HAdV-B]
ucgcauguauucauuuuucaga

SEQ ID NO: 3904227 - RNA, 19 nt, Human adenovirus B [HAdV-B]
ucgccacgagugccaucac

SEQ ID NO: 3904228 - RNA, 15 nt, Human adenovirus B [HAdV-B]
ucgcgauccuuccag

SEQ ID NO: 3904229 - RNA, 15 nt, Human adenovirus B [HAdV-B]
ucggcugcggagaca

SEQ ID NO: 3904230 - RNA, 18 nt, Human adenovirus B [HAdV-B]
ucggcuuacgagcagaca

SEQ ID NO: 3904231 - RNA, 21 nt, Human adenovirus B [HAdV-B]
ucguacgagagcgugaugcag

SEQ ID NO: 3904232 - RNA, 16 nt, Human adenovirus B [HAdV-B]
ucguucaucauuuccc

SEQ ID NO: 3904233 - RNA, 13 nt, Human adenovirus B [HAdV-B]
ucuacauuccaga

SEQ ID NO: 3904234 - RNA, 12 nt, Human adenovirus B [HAdV-B]
ucuaccuugacc

SEQ ID NO: 3904235 - RNA, 16 nt, Human adenovirus B [HAdV-B]
ucuagcaagacagucg

SEQ ID NO: 3904236 - RNA, 20 nt, Human adenovirus B [HAdV-B]
ucuccaaccucuccacaaua

SEQ ID NO: 3904237 - RNA, 14 nt, Human adenovirus B [HAdV-B]
ucuccuccuaguga

SEQ ID NO: 3904238 - RNA, 17 nt, Human adenovirus B [HAdV-B]
ucugcaaucaugcccac

SEQ ID NO: 3904239 - RNA, 18 nt, Human adenovirus B [HAdV-B]
ucuggcacgauucucacu

SEQ ID NO: 3904240 - RNA, 13 nt, Human adenovirus B [HAdV-B]
ucuuaaagaguag

SEQ ID NO: 3904241 - RNA, 18 nt, Human adenovirus B [HAdV-B]
ucuuaaguuggucaaaag

SEQ ID NO: 3904242 - RNA, 20 nt, Human adenovirus B [HAdV-B]
ucuucaaccgcuuuccugag

SEQ ID NO: 3904243 - RNA, 14 nt, Human adenovirus B [HAdV-B]
ucuuccagaaaaca

SEQ ID NO: 3904244 - RNA, 13 nt, Human adenovirus B [HAdV-B]
ucuucccagagcg

SEQ ID NO: 3904245 - RNA, 12 nt, Human adenovirus B [HAdV-B]
ucuucuccuggg

SEQ ID NO: 3904246 - RNA, 21 nt, Human adenovirus B [HAdV-B]
ucuuuagcgaucuucucaaug

SEQ ID NO: 3904247 - RNA, 21 nt, Human adenovirus B [HAdV-B]
ucuuuugccauccuucucaac

SEQ ID NO: 3904248 - RNA, 18 nt, Human adenovirus B [HAdV-B]
ugaaaauaaacuuuguau

SEQ ID NO: 3904249 - RNA, 19 nt, Human adenovirus B [HAdV-B]
ugaaacgcuuucuagagag

SEQ ID NO: 3904250 - RNA, 17 nt, Human adenovirus B [HAdV-B]
ugaaacucacuauucaa

SEQ ID NO: 3904251 - RNA, 20 nt, Human adenovirus B [HAdV-B]
ugaaaguauggaagugcaaa

SEQ ID NO: 3904252 - RNA, 19 nt, Human adenovirus B [HAdV-B]
ugaaccacaacccccacua

SEQ ID NO: 3904253 - RNA, 16 nt, Human adenovirus B [HAdV-B]
ugaacuaucagaauga

SEQ ID NO: 3904254 - RNA, 16 nt, Human adenovirus B [HAdV-B]
ugaagaaaugcauauu

SEQ ID NO: 3904255 - RNA, 21 nt, Human adenovirus B [HAdV-B]
ugaauaauucuacaacuucac

SEQ ID NO: 3904256 - RNA, 21 nt, Human adenovirus B [HAdV-B]
ugacauucucguauuuuguau

SEQ ID NO: 3904257 - RNA, 21 nt, Human adenovirus B [HAdV-B]
ugacgaaaaugccggccaauu

SEQ ID NO: 3904258 - RNA, 18 nt, Human adenovirus B [HAdV-B]
ugacucuccaaccucucc

SEQ ID NO: 3904259 - RNA, 16 nt, Human adenovirus B [HAdV-B]
ugacugaaacacucac

SEQ ID NO: 3904260 - RNA, 14 nt, Human adenovirus B [HAdV-B]
ugagcugcgucacg

SEQ ID NO: 3904261 - RNA, 17 nt, Human adenovirus B [HAdV-B]
ugagcugggaugggugc

SEQ ID NO: 3904262 - RNA, 15 nt, Human adenovirus B [HAdV-B]
ugaucaccugggcag

SEQ ID NO: 3904263 - RNA, 12 nt, Human adenovirus B [HAdV-B]
ugcaaacugaac

SEQ ID NO: 3904264 - RNA, 16 nt, Human adenovirus B [HAdV-B]
ugcaaagagcucugac

SEQ ID NO: 3904265 - RNA, 19 nt, Human adenovirus B [HAdV-B]
ugcaacaaaacaaaaccaa

SEQ ID NO: 3904266 - RNA, 21 nt, Human adenovirus B [HAdV-B]
ugcaaguccuuuuccuagucu

SEQ ID NO: 3904267 - RNA, 12 nt, Human adenovirus B [HAdV-B]
ugcagaaaucuu

SEQ ID NO: 3904268 - RNA, 21 nt, Human adenovirus B [HAdV-B]
ugcagcacuggacaugacagc

SEQ ID NO: 3904269 - RNA, 18 nt, Human adenovirus B [HAdV-B]
ugcagccgccgcccccag

SEQ ID NO: 3904270 - RNA, 21 nt, Human adenovirus B [HAdV-B]
ugcagccgccgcccccagaag

SEQ ID NO: 3904271 - RNA, 22 nt, Human adenovirus B [HAdV-B]
ugcagccgccgcccccagaaga

SEQ ID NO: 3904272 - RNA, 19 nt, Human adenovirus B [HAdV-B]
ugcagcuucgggcgccagc

SEQ ID NO: 3904273 - RNA, 17 nt, Human adenovirus B [HAdV-B]
ugcaggcagcagcuccu

SEQ ID NO: 3904274 - RNA, 13 nt, Human adenovirus B [HAdV-B]
ugcaugauggaua

SEQ ID NO: 3904275 - RNA, 20 nt, Human adenovirus B [HAdV-B]
ugccagcgguucuggaggag

SEQ ID NO: 3904276 - RNA, 22 nt, Human adenovirus B [HAdV-B]
ugccaggguucgguccuuccag

SEQ ID NO: 3904277 - RNA, 15 nt, Human adenovirus B [HAdV-B]
ugccaucgaucccac

SEQ ID NO: 3904278 - RNA, 15 nt, Human adenovirus B [HAdV-B]
ugccaugcgagccgc

SEQ ID NO: 3904279 - RNA, 18 nt, Human adenovirus B [HAdV-B]
ugcccacauccagaucuu

SEQ ID NO: 3904280 - RNA, 17 nt, Human adenovirus B [HAdV-B]
ugcccaggacuuuuuga

SEQ ID NO: 3904281 - RNA, 15 nt, Human adenovirus B [HAdV-B]
ugccgcugccuccuu

SEQ ID NO: 3904282 - RNA, 12 nt, Human adenovirus B [HAdV-B]
ugccuggagugu

SEQ ID NO: 3904283 - RNA, 21 nt, Human adenovirus B [HAdV-B]
ugccuuucucccaagcagaca

SEQ ID NO: 3904284 - RNA, 23 nt, Human adenovirus B [HAdV-B]
ugcgacaucuagaccacugccgc

SEQ ID NO: 3904285 - RNA, 13 nt, Human adenovirus B [HAdV-B]
ugcgggggcaaca

SEQ ID NO: 3904286 - RNA, 19 nt, Human adenovirus B [HAdV-B]
ugcucagugucuugugacu

SEQ ID NO: 3904287 - RNA, 18 nt, Human adenovirus B [HAdV-B]
ugcucuaccccauuccug

SEQ ID NO: 3904288 - RNA, 15 nt, Human adenovirus B [HAdV-B]
ugcugcgcacugccc

SEQ ID NO: 3904289 - RNA, 20 nt, Human adenovirus B [HAdV-B]
ugcuggagugucacugccgc

SEQ ID NO: 3904290 - RNA, 21 nt, Human adenovirus B [HAdV-B]
uggaaaucccaccccuagucu

SEQ ID NO: 3904291 - RNA, 12 nt, Human adenovirus B [HAdV-B]
uggaacucacca

SEQ ID NO: 3904292 - RNA, 20 nt, Human adenovirus B [HAdV-B]
uggaagacugauggcacaac

SEQ ID NO: 3904293 - RNA, 18 nt, Human adenovirus B [HAdV-B]
uggacucugacacuccug

SEQ ID NO: 3904294 - RNA, 15 nt, Human adenovirus B [HAdV-B]
uggacuuggaagagg

SEQ ID NO: 3904295 - RNA, 21 nt, Human adenovirus B [HAdV-B]
uggaggaagauugggacaguc

SEQ ID NO: 3904296 - RNA, 17 nt, Human adenovirus B [HAdV-B]
uggcaguuuggaagcca

SEQ ID NO: 3904297 - RNA, 16 nt, Human adenovirus B [HAdV-B]
uggcaugggaugggug

SEQ ID NO: 3904298 - RNA, 21 nt, Human adenovirus B [HAdV-B]
uggccgaugugucugaaggaa

SEQ ID NO: 3904299 - RNA, 12 nt, Human adenovirus B [HAdV-B]
uggcugcagcca

SEQ ID NO: 3904300 - RNA, 22 nt, Human adenovirus B [HAdV-B]
uggcuuccagcaaagccuccac

SEQ ID NO: 3904301 - RNA, 13 nt, Human adenovirus B [HAdV-B]
ugggccauuuugg

SEQ ID NO: 3904302 - RNA, 17 nt, Human adenovirus B [HAdV-B]
uggggccgugggcagcg

SEQ ID NO: 3904303 - RNA, 17 nt, Human adenovirus B [HAdV-B]
uggguagacagaaugga

SEQ ID NO: 3904304 - RNA, 18 nt, Human adenovirus B [HAdV-B]
uggucauuucuugcuugc

SEQ ID NO: 3904305 - RNA, 15 nt, Human adenovirus B [HAdV-B]
uguacguagcagcga

SEQ ID NO: 3904306 - RNA, 14 nt, Human adenovirus B [HAdV-B]
uguacucccagcag

SEQ ID NO: 3904307 - RNA, 20 nt, Human adenovirus B [HAdV-B]
uguagaugccuaugagaaca

SEQ ID NO: 3904308 - RNA, 21 nt, Human adenovirus B [HAdV-B]
uguauaggagcauuugcuucc

SEQ ID NO: 3904309 - RNA, 18 nt, Human adenovirus B [HAdV-B]
ugucacccucuucaacau

SEQ ID NO: 3904310 - RNA, 17 nt, Human adenovirus B [HAdV-B]
ugucacuccacagcuuu

SEQ ID NO: 3904311 - RNA, 20 nt, Human adenovirus B [HAdV-B]
ugucagcauugucacugccg

SEQ ID NO: 3904312 - RNA, 21 nt, Human adenovirus B [HAdV-B]
ugucauaauggaguugcuucc

SEQ ID NO: 3904313 - RNA, 20 nt, Human adenovirus B [HAdV-B]
ugucgguagaagaaccugac

SEQ ID NO: 3904314 - RNA, 16 nt, Human adenovirus B [HAdV-B]
ugugggagggguagcg

SEQ ID NO: 3904315 - RNA, 18 nt, Human adenovirus B [HAdV-B]
uguucccagaguuggaag

SEQ ID NO: 3904316 - RNA, 23 nt, Human adenovirus B [HAdV-B]
uguugcacaauaucuuuuagaag

SEQ ID NO: 3904317 - RNA, 22 nt, Human adenovirus B [HAdV-B]
uguuggauugccacagcuggca

SEQ ID NO: 3904318 - RNA, 14 nt, Human adenovirus B [HAdV-B]
uguuucugaugcaa

SEQ ID NO: 3904319 - RNA, 16 nt, Human adenovirus B [HAdV-B]
uguuuggucuuccuug

SEQ ID NO: 3904320 - RNA, 13 nt, Human adenovirus B [HAdV-B]
uuaagagggagag

SEQ ID NO: 3904321 - RNA, 12 nt, Human adenovirus B [HAdV-B]
uuacaaaaccau

SEQ ID NO: 3904322 - RNA, 13 nt, Human adenovirus B [HAdV-B]
uuacagaaaucuc

SEQ ID NO: 3904323 - RNA, 17 nt, Human adenovirus B [HAdV-B]
uuacuaccgucaccucc

SEQ ID NO: 3904324 - RNA, 14 nt, Human adenovirus B [HAdV-B]
uuagcuauuugcac

SEQ ID NO: 3904325 - RNA, 13 nt, Human adenovirus B [HAdV-B]
uuaggaccagugc

SEQ ID NO: 3904326 - RNA, 23 nt, Human adenovirus B [HAdV-B]
uuaugcuuaaucguaaguauagc

SEQ ID NO: 3904327 - RNA, 11 nt, Human adenovirus B [HAdV-B]
uuauuuacagu

SEQ ID NO: 3904328 - RNA, 19 nt, Human adenovirus B [HAdV-B]
uucagaagacaugcaugac

SEQ ID NO: 3904329 - RNA, 14 nt, Human adenovirus B [HAdV-B]
uucagcauuggcaa

SEQ ID NO: 3904330 - RNA, 18 nt, Human adenovirus B [HAdV-B]
uucuccggaucuccuggg

SEQ ID NO: 3904331 - RNA, 14 nt, Human adenovirus B [HAdV-B]
uucucgagcugcca

SEQ ID NO: 3904332 - RNA, 15 nt, Human adenovirus B [HAdV-B]
uucugaggaaaucau

SEQ ID NO: 3904333 - RNA, 11 nt, Human adenovirus B [HAdV-B]
uucuggggagu

SEQ ID NO: 3904334 - RNA, 16 nt, Human adenovirus B [HAdV-B]
uugacaagcucuuaca

SEQ ID NO: 3904335 - RNA, 16 nt, Human adenovirus B [HAdV-B]
uugacaugaacaugca

SEQ ID NO: 3904336 - RNA, 15 nt, Human adenovirus B [HAdV-B]
uugaguacucagccu

SEQ ID NO: 3904337 - RNA, 17 nt, Human adenovirus B [HAdV-B]
uugcaaggccccagcag

SEQ ID NO: 3904338 - RNA, 22 nt, Human adenovirus B [HAdV-B]
uugcccucauaaucauugcagc

SEQ ID NO: 3904339 - RNA, 19 nt, Human adenovirus B [HAdV-B]
uugcuggagugucacugcc

SEQ ID NO: 3904340 - RNA, 13 nt, Human adenovirus B [HAdV-B]
uugggccauuuug

SEQ ID NO: 3904341 - RNA, 17 nt, Human adenovirus B [HAdV-B]
uuuccaucacaagacaa

SEQ ID NO: 3904342 - RNA, 22 nt, Human adenovirus B [HAdV-B]
uuucuuaccuuuggucuccaug

SEQ ID NO: 3904343 - RNA, 17 nt, Human adenovirus B [HAdV-B]
uuucuuuucccacaguu

SEQ ID NO: 3904344 - RNA, 16 nt, Human adenovirus B [HAdV-B]
uuugaaaaauguugaa

SEQ ID NO: 3904345 - RNA, 17 nt, Human adenovirus B [HAdV-B]
uuugacaugaacaugca

SEQ ID NO: 3904346 - RNA, 21 nt, Human adenovirus B [HAdV-B]
uuugagaaauugguauuugaa

SEQ ID NO: 3904347 - RNA, 19 nt, Human adenovirus B [HAdV-B]
uuugaggccugauaaacag

SEQ ID NO: 3904348 - RNA, 18 nt, Human adenovirus B [HAdV-B]
uuugccauccuucucaac

SEQ ID NO: 3904349 - RNA, 19 nt, Human adenovirus B [HAdV-B]
uuugcugugccagaaguac

SEQ ID NO: 3904350 - RNA, 20 nt, Human adenovirus B [HAdV-B]
uuuuaauagcccuuaacauc

SEQ ID NO: 3904351 - RNA, 14 nt, Human adenovirus B [HAdV-B]
agacauaaaugcau

SEQ ID NO: 3904352 - RNA, 18 nt, Human adenovirus B [HAdV-B]
agacaugcaugacccaga

SEQ ID NO: 3904353 - RNA, 13 nt, Human adenovirus B [HAdV-B]
agacgagccuggg

SEQ ID NO: 3904354 - RNA, 13 nt, Human adenovirus B [HAdV-B]
agacgcuggugac

SEQ ID NO: 3904355 - RNA, 12 nt, Human adenovirus B [HAdV-B]
agagcucagccg

SEQ ID NO: 3904356 - RNA, 23 nt, Human adenovirus B [HAdV-B]
agagucguuugagcaaccuucuu

SEQ ID NO: 3904357 - RNA, 22 nt, Human adenovirus B [HAdV-B]
agauaauuacuugaaagugggu

SEQ ID NO: 3904358 - RNA, 13 nt, Human adenovirus B [HAdV-B]
agauacaugggca

SEQ ID NO: 3904359 - RNA, 15 nt, Human adenovirus B [HAdV-B]
agauaguuguuaauu

SEQ ID NO: 3904360 - RNA, 15 nt, Human adenovirus B [HAdV-B]
agaugccuuucauga

SEQ ID NO: 3904361 - RNA, 22 nt, Human adenovirus B [HAdV-B]
agauuacagccaacgagccagc

SEQ ID NO: 3904362 - RNA, 15 nt, Human adenovirus B [HAdV-B]
agauucccacugaaa

SEQ ID NO: 3904363 - RNA, 18 nt, Human adenovirus B [HAdV-B]
agcagcagaggaaaaaag

SEQ ID NO: 3904364 - RNA, 13 nt, Human adenovirus B [HAdV-B]
agcagcagcaggc

SEQ ID NO: 3904365 - RNA, 21 nt, Human adenovirus B [HAdV-B]
agcagcuaacccgauggcugg

SEQ ID NO: 3904366 - RNA, 17 nt, Human adenovirus B [HAdV-B]
agccacagcaaccccag

SEQ ID NO: 3904367 - RNA, 15 nt, Human adenovirus B [HAdV-B]
agccccaauggccac

SEQ ID NO: 3904368 - RNA, 14 nt, Human adenovirus B [HAdV-B]
agccggccuggacc

SEQ ID NO: 3904369 - RNA, 20 nt, Human adenovirus B [HAdV-B]
agccguagacgccagcgcca

SEQ ID NO: 3904370 - RNA, 17 nt, Human adenovirus B [HAdV-B]
agccguuaaccccacag

SEQ ID NO: 3904371 - RNA, 15 nt, Human adenovirus B [HAdV-B]
agcgccggcaggucc

SEQ ID NO: 3904372 - RNA, 13 nt, Human adenovirus B [HAdV-B]
agcggugguguau

SEQ ID NO: 3904373 - RNA, 16 nt, Human adenovirus B [HAdV-B]
agcuagaucaaaagaa

SEQ ID NO: 3904374 - RNA, 20 nt, Human adenovirus B [HAdV-B]
agcucaacgacuacaccgcu

SEQ ID NO: 3904375 - RNA, 20 nt, Human adenovirus B [HAdV-B]
agcucuuacagaaaucucuu

SEQ ID NO: 3904376 - RNA, 13 nt, Human adenovirus B [HAdV-B]
agcugggaugggu

SEQ ID NO: 3904377 - RNA, 15 nt, Human adenovirus B [HAdV-B]
agcuguguacuccca

SEQ ID NO: 3904378 - RNA, 20 nt, Human adenovirus B [HAdV-B]
agcuguguacucccagcagc

SEQ ID NO: 3904379 - RNA, 15 nt, Human adenovirus B [HAdV-B]
agcuuaagcauucca

SEQ ID NO: 3904380 - RNA, 19 nt, Human adenovirus B [HAdV-B]
aggacaaaaaagaagagga

SEQ ID NO: 3904381 - RNA, 18 nt, Human adenovirus B [HAdV-B]
aggacagucuggaggaag

SEQ ID NO: 3904382 - RNA, 14 nt, Human adenovirus B [HAdV-B]
aggaguaucuaaac

SEQ ID NO: 3904383 - RNA, 21 nt, Human adenovirus B [HAdV-B]
aggauccuuagauaugugcag

SEQ ID NO: 3904384 - RNA, 16 nt, Human adenovirus B [HAdV-B]
aggaugaaaaaaaacc

SEQ ID NO: 3904385 - RNA, 12 nt, Human adenovirus B [HAdV-B]
aggauuugcaug

SEQ ID NO: 3904386 - RNA, 15 nt, Human adenovirus B [HAdV-B]
aggcacuucagcuug

SEQ ID NO: 3904387 - RNA, 21 nt, Human adenovirus B [HAdV-B]
aggcagagaaacaacagacau

SEQ ID NO: 3904388 - RNA, 20 nt, Human adenovirus B [HAdV-B]
aggcagaguuucuuguaaaa

SEQ ID NO: 3904389 - RNA, 16 nt, Human adenovirus B [HAdV-B]
agggugagaauuacuu

SEQ ID NO: 3904390 - RNA, 17 nt, Human adenovirus B [HAdV-B]
aggguugcauucacugc

SEQ ID NO: 3904391 - RNA, 17 nt, Human adenovirus B [HAdV-B]
aggucgacgcaucucau

SEQ ID NO: 3904392 - RNA, 15 nt, Human adenovirus B [HAdV-B]
agguggacgagcaga

SEQ ID NO: 3904393 - RNA, 18 nt, Human adenovirus B [HAdV-B]
aguaaauggaacaaguga

SEQ ID NO: 3904394 - RNA, 15 nt, Human adenovirus B [HAdV-B]
agucugcaaaaauaa

SEQ ID NO: 3904395 - RNA, 13 nt, Human adenovirus B [HAdV-B]
agugaugagcagc

SEQ ID NO: 3904396 - RNA, 14 nt, Human adenovirus B [HAdV-B]
agugcaaacugaac

SEQ ID NO: 3904397 - RNA, 14 nt, Human adenovirus B [HAdV-B]
agugcaauguaaua

SEQ ID NO: 3904398 - RNA, 17 nt, Human adenovirus B [HAdV-B]
agugccaucacaucucg

SEQ ID NO: 3904399 - RNA, 11 nt, Human adenovirus B [HAdV-B]
agugucacugc

SEQ ID NO: 3904400 - RNA, 20 nt, Human adenovirus B [HAdV-B]
aguuauuagaugcugcauga

SEQ ID NO: 3904401 - RNA, 21 nt, Human adenovirus B [HAdV-B]
aguugaaaaccacgaaaaugc

SEQ ID NO: 3904402 - RNA, 21 nt, Human adenovirus B [HAdV-B]
aguuucauccuaaaaaacaag

SEQ ID NO: 3904403 - RNA, 11 nt, Human adenovirus B [HAdV-B]
auaaaagaaaa

SEQ ID NO: 3904404 - RNA, 15 nt, Human adenovirus B [HAdV-B]
auacaauccagacau

SEQ ID NO: 3904405 - RNA, 15 nt, Human adenovirus B [HAdV-B]
auaccuguguagaug

SEQ ID NO: 3904406 - RNA, 23 nt, Human adenovirus B [HAdV-B]
auacugggugcgugacgcugcca

SEQ ID NO: 3904407 - RNA, 23 nt, Human adenovirus B [HAdV-B]
auagcaauggggccgugggcagc

SEQ ID NO: 3904408 - RNA, 16 nt, Human adenovirus B [HAdV-B]
auagcuuccuuggaag

SEQ ID NO: 3904409 - RNA, 17 nt, Human adenovirus B [HAdV-B]
auaguaacuugcaacau

SEQ ID NO: 3904410 - RNA, 23 nt, Human adenovirus B [HAdV-B]
auagugcaggagcggagccuggg

SEQ ID NO: 3904411 - RNA, 12 nt, Human adenovirus B [HAdV-B]
auauaauuauuu

SEQ ID NO: 3904412 - RNA, 21 nt, Human adenovirus B [HAdV-B]
auauuaucaccaaacugcuua

SEQ ID NO: 3904413 - RNA, 20 nt, Human adenovirus B [HAdV-B]
auauucacuggaacagguga

SEQ ID NO: 3904414 - RNA, 18 nt, Human adenovirus B [HAdV-B]
aucaaaaaauuccagucu

SEQ ID NO: 3904415 - RNA, 12 nt, Human adenovirus B [HAdV-B]
aucaaaagaaau

SEQ ID NO: 3904416 - RNA, 21 nt, Human adenovirus B [HAdV-B]
aucaagcggguuaaaaaggac

SEQ ID NO: 3904417 - RNA, 16 nt, Human adenovirus B [HAdV-B]
aucaccugggcagcua

SEQ ID NO: 3904418 - RNA, 21 nt, Human adenovirus B [HAdV-B]
aucauucccugcagaaaucuu

SEQ ID NO: 3904419 - RNA, 16 nt, Human adenovirus B [HAdV-B]
auccagaucuucagca

SEQ ID NO: 3904420 - RNA, 20 nt, Human adenovirus B [HAdV-B]
auccagcuuuugcugugcca

SEQ ID NO: 3904421 - RNA, 15 nt, Human adenovirus B [HAdV-B]
auccauggaugccca

SEQ ID NO: 3904422 - RNA, 21 nt, Human adenovirus B [HAdV-B]
aucccgugcugcgacagaugc

SEQ ID NO: 3904423 - RNA, 23 nt, Human adenovirus B [HAdV-B]
augaaaacugcccaaaacaacga

SEQ ID NO: 3904424 - RNA, 18 nt, Human adenovirus B [HAdV-B]
augaacgaucgcgguggg

SEQ ID NO: 3904425 - RNA, 21 nt, Human adenovirus B [HAdV-B]
augaaggcgaggaggaagagg

SEQ ID NO: 3904426 - RNA, 20 nt, Human adenovirus B [HAdV-B]
augacugaaacacucaccac

SEQ ID NO: 3904427 - RNA, 18 nt, Human adenovirus B [HAdV-B]
augaggaccaaucacagc

SEQ ID NO: 3904428 - RNA, 13 nt, Human adenovirus B [HAdV-B]
augaggcuuucag

SEQ ID NO: 3904429 - RNA, 21 nt, Human adenovirus B [HAdV-B]
augcaaacacaugucacccuc

SEQ ID NO: 3904430 - RNA, 22 nt, Human adenovirus B [HAdV-B]
augccaucauagauaauuacuu

SEQ ID NO: 3904431 - RNA, 22 nt, Human adenovirus B [HAdV-B]
augcguguuggauugccacagc

SEQ ID NO: 3904432 - RNA, 16 nt, Human adenovirus B [HAdV-B]
auggaagugcaaacug

SEQ ID NO: 3904433 - RNA, 22 nt, Human adenovirus B [HAdV-B]
auggaauagaaaguuuggugga

SEQ ID NO: 3904434 - RNA, 13 nt, Human adenovirus B [HAdV-B]
auggacaggaguc

SEQ ID NO: 3904435 - RNA, 13 nt, Human adenovirus B [HAdV-B]
auggagucacugc

SEQ ID NO: 3904436 - RNA, 12 nt, Human adenovirus B [HAdV-B]
auggcugggcac

SEQ ID NO: 3904437 - RNA, 16 nt, Human adenovirus B [HAdV-B]
auggcuuaccagacaa

SEQ ID NO: 3904438 - RNA, 21 nt, Human adenovirus B [HAdV-B]
augguacccaaacgccagaag

SEQ ID NO: 3904439 - RNA, 13 nt, Human adenovirus B [HAdV-B]
auggugggucuuu

SEQ ID NO: 3904440 - RNA, 21 nt, Human adenovirus B [HAdV-B]
augguuguagcuuuuuugguu

SEQ ID NO: 3904441 - RNA, 17 nt, Human adenovirus B [HAdV-B]
augucaccugcggagca

SEQ ID NO: 3904442 - RNA, 23 nt, Human adenovirus B [HAdV-B]
augugagcggagacggcuugcug

SEQ ID NO: 3904443 - RNA, 14 nt, Human adenovirus B [HAdV-B]
auuacaaagacuuc

SEQ ID NO: 3904444 - RNA, 13 nt, Human adenovirus B [HAdV-B]
auuacaacugacg

SEQ ID NO: 3904445 - RNA, 19 nt, Human adenovirus B [HAdV-B]
auuaguuuaaaagagguuc

SEQ ID NO: 3904446 - RNA, 18 nt, Human adenovirus B [HAdV-B]
auuauacuccuacugcgc

SEQ ID NO: 3904447 - RNA, 12 nt, Human adenovirus B [HAdV-B]
auucacugcucc

SEQ ID NO: 3904448 - RNA, 13 nt, Human adenovirus B [HAdV-B]
auucccggaagua

SEQ ID NO: 3904449 - RNA, 20 nt, Human adenovirus B [HAdV-B]
auugcaaggccccagcagcc

SEQ ID NO: 3904450 - RNA, 16 nt, Human adenovirus B [HAdV-B]
auugccacagcuggca

SEQ ID NO: 3904451 - RNA, 22 nt, Human adenovirus B [HAdV-B]
auuguguucuccuaggcagaga

SEQ ID NO: 3904452 - RNA, 24 nt, Human adenovirus B [HAdV-B]
auuucuaucgaaggcaaaauagac

SEQ ID NO: 3904453 - RNA, 23 nt, Human adenovirus B [HAdV-B]
auuugccauucucgagcugccag

SEQ ID NO: 3904454 - RNA, 19 nt, Human adenovirus B [HAdV-B]
auuuggcuaaccaggcugu

SEQ ID NO: 3904455 - RNA, 22 nt, Human adenovirus B [HAdV-B]
auuuuggagagaguuugcugca

SEQ ID NO: 3904456 - RNA, 15 nt, Human adenovirus B [HAdV-B]
caaaacaacgagcag

SEQ ID NO: 3904457 - RNA, 20 nt, Human adenovirus B [HAdV-B]
caaaacgcggcccuggcaga

SEQ ID NO: 3904458 - RNA, 21 nt, Human adenovirus B [HAdV-B]
caaacggcaccugcgagccaa

SEQ ID NO: 3904459 - RNA, 17 nt, Human adenovirus B [HAdV-B]
caaacugcuuagccaga

SEQ ID NO: 3904460 - RNA, 16 nt, Human adenovirus B [HAdV-B]
caaagccuacugccac

SEQ ID NO: 3904461 - RNA, 22 nt, Human adenovirus B [HAdV-B]
caaagcuauucguccagaugag

SEQ ID NO: 3904462 - RNA, 15 nt, Human adenovirus B [HAdV-B]
caaaggugucucuga

SEQ ID NO: 3904463 - RNA, 22 nt, Human adenovirus B [HAdV-B]
caaaguaaaaggcacaggagaa

SEQ ID NO: 3904464 - RNA, 20 nt, Human adenovirus B [HAdV-B]
caacccggauuuuacaacca

SEQ ID NO: 3904465 - RNA, 21 nt, Human adenovirus B [HAdV-B]
caaccuggguucgcugguggc

SEQ ID NO: 3904466 - RNA, 14 nt, Human adenovirus B [HAdV-B]
caacucugacuucu

SEQ ID NO: 3904467 - RNA, 14 nt, Human adenovirus B [HAdV-B]
caacuucacauaca

SEQ ID NO: 3904468 - RNA, 22 nt, Human adenovirus B [HAdV-B]
caagagcucugcuacgaagagc

SEQ ID NO: 3904469 - RNA, 14 nt, Human adenovirus B [HAdV-B]
caagaugaggacaa

SEQ ID NO: 3904470 - RNA, 16 nt, Human adenovirus B [HAdV-B]
caagcagacaccaggg

SEQ ID NO: 3904471 - RNA, 17 nt, Human adenovirus B [HAdV-B]
caagcucuuacagaaau

SEQ ID NO: 3904472 - RNA, 18 nt, Human adenovirus B [HAdV-B]
caagcuguguacucccag

SEQ ID NO: 3904473 - RNA, 21 nt, Human adenovirus B [HAdV-B]
caaguuugcuccggaagauua

SEQ ID NO: 3904474 - RNA, 16 nt, Human adenovirus B [HAdV-B]
caaucaucauauuaca

SEQ ID NO: 3904475 - RNA, 23 nt, Human adenovirus B [HAdV-B]
cacaacaccgcuuccacccuuga

SEQ ID NO: 3904476 - RNA, 13 nt, Human adenovirus B [HAdV-B]
cacaacccccacu

SEQ ID NO: 3904477 - RNA, 15 nt, Human adenovirus B [HAdV-B]
cacaacgcacagccu

SEQ ID NO: 3904478 - RNA, 23 nt, Human adenovirus B [HAdV-B]
cacaagguucccucaggaugucc

SEQ ID NO: 3904479 - RNA, 19 nt, Human adenovirus B [HAdV-B]
cacacccgacgaaaaaaac

SEQ ID NO: 3904480 - RNA, 18 nt, Human adenovirus B [HAdV-B]
cacacuucugccccagcg

SEQ ID NO: 3904481 - RNA, 22 nt, Human adenovirus B [HAdV-B]
cacagcuagugaucgcacugcu

SEQ ID NO: 3904482 - RNA, 19 nt, Human adenovirus B [HAdV-B]
cacauacaacaauuuccac

SEQ ID NO: 3904483 - RNA, 17 nt, Human adenovirus B [HAdV-B]
cacauccagaucuucag

SEQ ID NO: 3904484 - RNA, 17 nt, Human adenovirus B [HAdV-B]
caccaagaugcuggaaa

SEQ ID NO: 3904485 - RNA, 22 nt, Human adenovirus B [HAdV-B]
caccaaggccauggcgacgagc

SEQ ID NO: 3904486 - RNA, 15 nt, Human adenovirus B [HAdV-B]
caccauaauuucauu

SEQ ID NO: 3904487 - RNA, 15 nt, Human adenovirus B [HAdV-B]
caccccgcacaacua

SEQ ID NO: 3904488 - RNA, 17 nt, Human adenovirus B [HAdV-B]
caccucuuucugaucau

SEQ ID NO: 3904489 - RNA, 22 nt, Human adenovirus B [HAdV-B]
cacucuuccagaaaacaaaaac

SEQ ID NO: 3904490 - RNA, 23 nt, Human adenovirus B [HAdV-B]
cacugaaaguauggaagugcaaa

SEQ ID NO: 3904491 - RNA, 17 nt, Human adenovirus B [HAdV-B]
cacugccaacaccgcuc

SEQ ID NO: 3904492 - RNA, 18 nt, Human adenovirus B [HAdV-B]
cacugguggccaccucgc

SEQ ID NO: 3904493 - RNA, 18 nt, Human adenovirus B [HAdV-B]
cagaaguaccucagagcg

SEQ ID NO: 3904494 - RNA, 20 nt, Human adenovirus B [HAdV-B]
cagaauaaaaaagcgaaaga

SEQ ID NO: 3904495 - RNA, 14 nt, Human adenovirus B [HAdV-B]
cagacaugaugaag

SEQ ID NO: 3904496 - RNA, 20 nt, Human adenovirus B [HAdV-B]
cagacgguaaaucugagcca

SEQ ID NO: 3904497 - RNA, 21 nt, Human adenovirus B [HAdV-B]
cagagcgugggauuguuucug

SEQ ID NO: 3904498 - RNA, 12 nt, Human adenovirus B [HAdV-B]
cagagcugccgc

SEQ ID NO: 3904499 - RNA, 21 nt, Human adenovirus B [HAdV-B]
cagaggagguggaagaaguaa

SEQ ID NO: 3904500 - RNA, 22 nt, Human adenovirus B [HAdV-B]
cagaguaucauagugcaggagc

SEQ ID NO: 3904501 - RNA, 15 nt, Human adenovirus B [HAdV-B]
cagcaccucacuucc

SEQ ID NO: 3904502 - RNA, 13 nt, Human adenovirus B [HAdV-B]
cagcacugaaaca

SEQ ID NO: 3904503 - RNA, 21 nt, Human adenovirus B [HAdV-B]
cagcacugaaacaccaucagc

SEQ ID NO: 3904504 - RNA, 22 nt, Human adenovirus B [HAdV-B]
cagccagaaccucagcugggag

SEQ ID NO: 3904505 - RNA, 21 nt, Human adenovirus B [HAdV-B]
cagccccccucgcagcagcag

SEQ ID NO: 3904506 - RNA, 17 nt, Human adenovirus B [HAdV-B]
cagccgaaacaguaccu

SEQ ID NO: 3904507 - RNA, 15 nt, Human adenovirus B [HAdV-B]
cagcgacggaugucu

SEQ ID NO: 3904508 - RNA, 22 nt, Human adenovirus B [HAdV-B]
cagcgcgaaauauggagcccag

SEQ ID NO: 3904509 - RNA, 16 nt, Human adenovirus B [HAdV-B]
cagcgcugccaggguu

SEQ ID NO: 3904510 - RNA, 15 nt, Human adenovirus B [HAdV-B]
cagcugcugcagaag

SEQ ID NO: 3904511 - RNA, 20 nt, Human adenovirus B [HAdV-B]
cagcuuuugcugugccagaa

SEQ ID NO: 3904512 - RNA, 18 nt, Human adenovirus B [HAdV-B]
caggaaagucccgcuccc

SEQ ID NO: 3904513 - RNA, 15 nt, Human adenovirus B [HAdV-B]
caggcugugcagaaa

SEQ ID NO: 3904514 - RNA, 20 nt, Human adenovirus B [HAdV-B]
cagggggcaauucuggccca

SEQ ID NO: 3904515 - RNA, 17 nt, Human adenovirus B [HAdV-B]
cagguagaacugcugcu

SEQ ID NO: 3904516 - RNA, 18 nt, Human adenovirus B [HAdV-B]
caggucccgcaggcaagc

SEQ ID NO: 3904517 - RNA, 19 nt, Human adenovirus B [HAdV-B]
cagguuaucgcaccugaag

SEQ ID NO: 3904518 - RNA, 15 nt, Human adenovirus B [HAdV-B]
caguagccacagcaa

SEQ ID NO: 3904519 - RNA, 12 nt, Human adenovirus B [HAdV-B]
cagucaggcaga

SEQ ID NO: 3904520 - RNA, 24 nt, Human adenovirus B [HAdV-B]
cagucuuuccaucacaagacaagc

SEQ ID NO: 3904521 - RNA, 19 nt, Human adenovirus B [HAdV-B]
cagugucgcuaacaauaca

SEQ ID NO: 3904522 - RNA, 14 nt, Human adenovirus B [HAdV-B]
caguguggaagagc

SEQ ID NO: 3904523 - RNA, 15 nt, Human adenovirus B [HAdV-B]
caguuuggaagccac

SEQ ID NO: 3904524 - RNA, 14 nt, Human adenovirus B [HAdV-B]
cauaagauucuuga

SEQ ID NO: 3904525 - RNA, 16 nt, Human adenovirus B [HAdV-B]
cauagauaauuacuug

SEQ ID NO: 3904526 - RNA, 18 nt, Human adenovirus B [HAdV-B]
cauaucauaguagccuga

SEQ ID NO: 3904527 - RNA, 17 nt, Human adenovirus B [HAdV-B]
cauauuucaaagaugua

SEQ ID NO: 3904528 - RNA, 18 nt, Human adenovirus B [HAdV-B]
caucccucaaaacuccac

SEQ ID NO: 3904529 - RNA, 16 nt, Human adenovirus B [HAdV-B]
cauccuaaaaaacaag

SEQ ID NO: 3904530 - RNA, 18 nt, Human adenovirus B [HAdV-B]
caucgccggacaggaugc

SEQ ID NO: 3904531 - RNA, 20 nt, Human adenovirus B [HAdV-B]
caucuagugguacugaugcu

SEQ ID NO: 3904532 - RNA, 12 nt, Human adenovirus B [HAdV-B]
caugaacuccag

SEQ ID NO: 3904533 - RNA, 15 nt, Human adenovirus B [HAdV-B]
caugacagacagagg

SEQ ID NO: 3904534 - RNA, 16 nt, Human adenovirus B [HAdV-B]
cauggaaacucagcca

SEQ ID NO: 3904535 - RNA, 16 nt, Human adenovirus B [HAdV-B]
cauucaauucaaacaa

SEQ ID NO: 3904536 - RNA, 17 nt, Human adenovirus B [HAdV-B]
cauuccugcaccauucc

SEQ ID NO: 3904537 - RNA, 14 nt, Human adenovirus B [HAdV-B]
cauugcagccauga

SEQ ID NO: 3904538 - RNA, 14 nt, Human adenovirus B [HAdV-B]
cauuuccauuccuu

SEQ ID NO: 3904539 - RNA, 19 nt, Human adenovirus B [HAdV-B]
cauuuggucagaaaacaca

SEQ ID NO: 3904540 - RNA, 21 nt, Human adenovirus B [HAdV-B]
ccaaaauaucgcggcacuucu

SEQ ID NO: 3904541 - RNA, 20 nt, Human adenovirus B [HAdV-B]
ccaacaccgcucccccagcc

SEQ ID NO: 3904542 - RNA, 16 nt, Human adenovirus B [HAdV-B]
ccaacgacgagaaaac

SEQ ID NO: 3904543 - RNA, 13 nt, Human adenovirus B [HAdV-B]
ccaacuaucucuc

SEQ ID NO: 3904544 - RNA, 17 nt, Human adenovirus B [HAdV-B]
ccaaggaugagacagug

SEQ ID NO: 3904545 - RNA, 15 nt, Human adenovirus B [HAdV-B]
ccacaacgcacagcc

SEQ ID NO: 3904546 - RNA, 16 nt, Human adenovirus B [HAdV-B]
ccacacgauccacacu

SEQ ID NO: 3904547 - RNA, 17 nt, Human adenovirus B [HAdV-B]
ccacagcaacuucuuga

SEQ ID NO: 3904548 - RNA, 18 nt, Human adenovirus B [HAdV-B]
ccacagcauuguggagaa

SEQ ID NO: 3904549 - RNA, 16 nt, Human adenovirus B [HAdV-B]
ccaccgagcuaccacu

SEQ ID NO: 3904550 - RNA, 16 nt, Human adenovirus B [HAdV-B]
ccaccugcugcgcacu

SEQ ID NO: 3904551 - RNA, 18 nt, Human adenovirus B [HAdV-B]
ccacgguagcauaugcaa

SEQ ID NO: 3904552 - RNA, 15 nt, Human adenovirus B [HAdV-B]
ccacugaagugcaaa

SEQ ID NO: 3904553 - RNA, 18 nt, Human adenovirus B [HAdV-B]
ccagaacuuccaacaaaa

SEQ ID NO: 3904554 - RNA, 19 nt, Human adenovirus B [HAdV-B]
ccagaagauauggaggaag

SEQ ID NO: 3904555 - RNA, 16 nt, Human adenovirus B [HAdV-B]
ccagacgugcagcuuc

SEQ ID NO: 3904556 - RNA, 19 nt, Human adenovirus B [HAdV-B]
ccagaucuucagcauuggc

SEQ ID NO: 3904557 - RNA, 12 nt, Human adenovirus B [HAdV-B]
ccagaugccuuu

SEQ ID NO: 3904558 - RNA, 21 nt, Human adenovirus B [HAdV-B]
ccagccuguacuucuccauca

SEQ ID NO: 3904559 - RNA, 18 nt, Human adenovirus B [HAdV-B]
ccagcgccaugacagaca

SEQ ID NO: 3904560 - RNA, 23 nt, Human adenovirus B [HAdV-B]
ccagcuguuucugguggugcaac

SEQ ID NO: 3904561 - RNA, 18 nt, Human adenovirus B [HAdV-B]
ccagcuuuugcugugcca

SEQ ID NO: 3904562 - RNA, 17 nt, Human adenovirus B [HAdV-B]
ccaggacuacuccaccc

SEQ ID NO: 3904563 - RNA, 14 nt, Human adenovirus B [HAdV-B]
ccaguccugccacc

SEQ ID NO: 3904564 - RNA, 16 nt, Human adenovirus B [HAdV-B]
ccaguguaacaugaau

SEQ ID NO: 3904565 - RNA, 15 nt, Human adenovirus B [HAdV-B]
ccaguugaaaaccac

SEQ ID NO: 3904566 - RNA, 21 nt, Human adenovirus B [HAdV-B]
ccauccgaguaucaucacuua

SEQ ID NO: 3904567 - RNA, 23 nt, Human adenovirus B [HAdV-B]
ccaucuauuauuccuacuccugg

SEQ ID NO: 3904568 - RNA, 16 nt, Human adenovirus B [HAdV-B]
ccaugcacucauccau

SEQ ID NO: 3904569 - RNA, 21 nt, Human adenovirus B [HAdV-B]
ccaugcuuagggcggccagac

SEQ ID NO: 3904570 - RNA, 20 nt, Human adenovirus B [HAdV-B]
ccauggaugagcccacccug

SEQ ID NO: 3904571 - RNA, 13 nt, Human adenovirus B [HAdV-B]
cccacccugcuuu

SEQ ID NO: 3904572 - RNA, 20 nt, Human adenovirus B [HAdV-B]
cccagagcgucucaggguua

SEQ ID NO: 3904573 - RNA, 18 nt, Human adenovirus B [HAdV-B]
cccagaugccugugauga

SEQ ID NO: 3904574 - RNA, 21 nt, Human adenovirus B [HAdV-B]
ccccacggcgacgcgugcaau

SEQ ID NO: 3904575 - RNA, 17 nt, Human adenovirus B [HAdV-B]
ccccucccccugcugcu

SEQ ID NO: 3904576 - RNA, 14 nt, Human adenovirus B [HAdV-B]
cccgcaggcaagca

SEQ ID NO: 3904577 - RNA, 12 nt, Human adenovirus B [HAdV-B]
cccgcaggcagu

SEQ ID NO: 3904578 - RNA, 14 nt, Human adenovirus B [HAdV-B]
cccgccgccagcaa

SEQ ID NO: 3904579 - RNA, 23 nt, Human adenovirus B [HAdV-B]
cccguaacuccgcgaacaggugu

SEQ ID NO: 3904580 - RNA, 18 nt, Human adenovirus B [HAdV-B]
cccuacggaagccagcac

SEQ ID NO: 3904581 - RNA, 17 nt, Human adenovirus B [HAdV-B]
cccucaaaaacacacua

SEQ ID NO: 3904582 - RNA, 21 nt, Human adenovirus B [HAdV-B]
cccugcaacuacugcaacugc

SEQ ID NO: 3904583 - RNA, 18 nt, Human adenovirus B [HAdV-B]
ccgaagagcaauaaauga

SEQ ID NO: 3904584 - RNA, 13 nt, Human adenovirus B [HAdV-B]
ccgacugcagaau

SEQ ID NO: 3904585 - RNA, 19 nt, Human adenovirus B [HAdV-B]
ccgagucgaggaacccggc

SEQ ID NO: 3904586 - RNA, 14 nt, Human adenovirus B [HAdV-B]
ccgcacuggcugcc

SEQ ID NO: 3904587 - RNA, 16 nt, Human adenovirus B [HAdV-B]
ccgcaggcaagcagcc

SEQ ID NO: 3904588 - RNA, 21 nt, Human adenovirus B [HAdV-B]
ccgcaggcaagcagccgcuuu

SEQ ID NO: 3904589 - RNA, 22 nt, Human adenovirus B [HAdV-B]
ccggccggagccgcggcuaacg

SEQ ID NO: 3904590 - RNA, 22 nt, Human adenovirus B [HAdV-B]
ccgggacuguggaccuccgccu

SEQ ID NO: 3904591 - RNA, 18 nt, Human adenovirus B [HAdV-B]
ccuacauggguauucugc

SEQ ID NO: 3904592 - RNA, 14 nt, Human adenovirus B [HAdV-B]
ccuaccaacacaac

SEQ ID NO: 3904593 - RNA, 17 nt, Human adenovirus B [HAdV-B]
ccuacggaagccagcac

SEQ ID NO: 3904594 - RNA, 18 nt, Human adenovirus B [HAdV-B]
ccuacggaagccagcacc

SEQ ID NO: 3904595 - RNA, 18 nt, Human adenovirus B [HAdV-B]
ccuaguguaccaggaaag

SEQ ID NO: 3904596 - RNA, 14 nt, Human adenovirus B [HAdV-B]
ccucaaaacuccac

SEQ ID NO: 3904597 - RNA, 14 nt, Human adenovirus B [HAdV-B]
ccuccaguggagga

SEQ ID NO: 3904598 - RNA, 15 nt, Human adenovirus B [HAdV-B]
ccucccaacaccccu

SEQ ID NO: 3904599 - RNA, 17 nt, Human adenovirus B [HAdV-B]
ccucccgacggugcugc

SEQ ID NO: 3904600 - RNA, 23 nt, Human adenovirus B [HAdV-B]
ccucgcggugaccagcaugaaua

SEQ ID NO: 3904601 - RNA, 20 nt, Human adenovirus B [HAdV-B]
ccucguuuacguacugguga

SEQ ID NO: 3904602 - RNA, 19 nt, Human adenovirus B [HAdV-B]
ccugcagaaaucuucccau

SEQ ID NO: 3904603 - RNA, 14 nt, Human adenovirus B [HAdV-B]
ccugccaaugcaac

SEQ ID NO: 3904604 - RNA, 19 nt, Human adenovirus B [HAdV-B]
ccugcgagccaaauccucg

SEQ ID NO: 3904605 - RNA, 15 nt, Human adenovirus B [HAdV-B]
ccuggcagaacacac

SEQ ID NO: 3904606 - RNA, 23 nt, Human adenovirus B [HAdV-B]
ccuggcagaccucaucuucccag

SEQ ID NO: 3904607 - RNA, 12 nt, Human adenovirus B [HAdV-B]
ccugggccuggc

SEQ ID NO: 3904608 - RNA, 20 nt, Human adenovirus B [HAdV-B]
ccuggggacagguuagugua

SEQ ID NO: 3904609 - RNA, 18 nt, Human adenovirus B [HAdV-B]
ccuucaauuggagcagua

SEQ ID NO: 3904610 - RNA, 16 nt, Human adenovirus B [HAdV-B]
ccuucuuacugcuuua

SEQ ID NO: 3904611 - RNA, 17 nt, Human adenovirus B [HAdV-B]
ccuugaagccaugcugc

SEQ ID NO: 3904612 - RNA, 21 nt, Human adenovirus B [HAdV-B]
ccuuggcuccgcgacacggca

SEQ ID NO: 3904613 - RNA, 22 nt, Human adenovirus B [HAdV-B]
ccuuguagugcuaggaauucuu

SEQ ID NO: 3904614 - RNA, 12 nt, Human adenovirus B [HAdV-B]
ccuuugcugucu

SEQ ID NO: 3904615 - RNA, 22 nt, Human adenovirus B [HAdV-B]
cgaagccguacaugggcaccug

SEQ ID NO: 3904616 - RNA, 18 nt, Human adenovirus B [HAdV-B]
cgaaggcgcauugccaga

SEQ ID NO: 3904617 - RNA, 14 nt, Human adenovirus B [HAdV-B]
cgacauguguugag

SEQ ID NO: 3904618 - RNA, 23 nt, Human adenovirus B [HAdV-B]
cgacgaggaaaaggagcagagcu

SEQ ID NO: 3904619 - RNA, 14 nt, Human adenovirus B [HAdV-B]
cgagacgcucuucu

SEQ ID NO: 3904620 - RNA, 18 nt, Human adenovirus B [HAdV-B]
cgagagccggccuggacc

SEQ ID NO: 3904621 - RNA, 14 nt, Human adenovirus B [HAdV-B]
cgagcugccagugc

SEQ ID NO: 3904622 - RNA, 15 nt, Human adenovirus B [HAdV-B]
cgaggaggcagagga

SEQ ID NO: 3904623 - RNA, 20 nt, Human adenovirus B [HAdV-B]
cgagucggugagcucuccgc

SEQ ID NO: 3904624 - RNA, 12 nt, Human adenovirus B [HAdV-B]
cgaucugagaaa

SEQ ID NO: 3904625 - RNA, 19 nt, Human adenovirus B [HAdV-B]
cgaugggucuucuccuggg

SEQ ID NO: 3904626 - RNA, 21 nt, Human adenovirus B [HAdV-B]
cgauguugugucccagcggcg

SEQ ID NO: 3904627 - RNA, 11 nt, Human adenovirus B [HAdV-B]
cgauuuggaag

SEQ ID NO: 3904628 - RNA, 15 nt, Human adenovirus B [HAdV-B]
cgcaagagcucugcu

SEQ ID NO: 3904629 - RNA, 23 nt, Human adenovirus B [HAdV-B]
cgcaggaggcgcaaacaguuuca

SEQ ID NO: 3904630 - RNA, 14 nt, Human adenovirus B [HAdV-B]
cgcagggcucugag

SEQ ID NO: 3904631 - RNA, 12 nt, Human adenovirus B [HAdV-B]
cgccagcagcag

SEQ ID NO: 3904632 - RNA, 15 nt, Human adenovirus B [HAdV-B]
cgcccaguccugcca

SEQ ID NO: 3904633 - RNA, 15 nt, Human adenovirus B [HAdV-B]
cgccgucacagcagc

SEQ ID NO: 3904634 - RNA, 14 nt, Human adenovirus B [HAdV-B]
cgcgaagaggcaau

SEQ ID NO: 3904635 - RNA, 17 nt, Human adenovirus B [HAdV-B]
cgcgaguuaagcgacag

SEQ ID NO: 3904636 - RNA, 20 nt, Human adenovirus B [HAdV-B]
cgcgcgguuagcgccagcag

SEQ ID NO: 3904637 - RNA, 23 nt, Human adenovirus B [HAdV-B]
cgcguggggcgaagagccaugcu

SEQ ID NO: 3904638 - RNA, 21 nt, Human adenovirus B [HAdV-B]
cgcuaacaauacaauuuccaa

SEQ ID NO: 3904639 - RNA, 14 nt, Human adenovirus B [HAdV-B]
cgcucgggauucuc

SEQ ID NO: 3904640 - RNA, 13 nt, Human adenovirus B [HAdV-B]
cgcuuccacccuu

SEQ ID NO: 3904641 - RNA, 12 nt, Human adenovirus B [HAdV-B]
cgcuugccuucu

SEQ ID NO: 3904642 - RNA, 23 nt, Human adenovirus B [HAdV-B]
cggaagccagcacccagaccauu

SEQ ID NO: 3904643 - RNA, 11 nt, Human adenovirus B [HAdV-B]
cggaggaggac

SEQ ID NO: 3904644 - RNA, 18 nt, Human adenovirus B [HAdV-B]
cggaucgcuguccaggaa

SEQ ID NO: 3904645 - RNA, 13 nt, Human adenovirus B [HAdV-B]
cggaucuccuggg

SEQ ID NO: 3904646 - RNA, 19 nt, Human adenovirus B [HAdV-B]
cggcgaggagccggaggag

SEQ ID NO: 3904647 - RNA, 23 nt, Human adenovirus B [HAdV-B]
cgggccccggagcauaguucccc

SEQ ID NO: 3904648 - RNA, 22 nt, Human adenovirus B [HAdV-B]
cgguacaccggauugcagcacu

SEQ ID NO: 3904649 - RNA, 14 nt, Human adenovirus B [HAdV-B]
cgguccuuccaggg

SEQ ID NO: 3904650 - RNA, 23 nt, Human adenovirus B [HAdV-B]
cguacgagagcgugaugcagcag

SEQ ID NO: 3904651 - RNA, 15 nt, Human adenovirus B [HAdV-B]
cgugacgcugccacc

SEQ ID NO: 3904652 - RNA, 21 nt, Human adenovirus B [HAdV-B]
cgugcagcuucgggcgccagc

SEQ ID NO: 3904653 - RNA, 16 nt, Human adenovirus B [HAdV-B]
cguuauccagccugua

SEQ ID NO: 3904654 - RNA, 13 nt, Human adenovirus B [HAdV-B]
cuaaauacacaua

SEQ ID NO: 3904655 - RNA, 14 nt, Human adenovirus B [HAdV-B]
cuaacgcuggagag

SEQ ID NO: 3904656 - RNA, 23 nt, Human adenovirus B [HAdV-B]
cuaauaauaauaugcaugcuuuu

SEQ ID NO: 3904657 - RNA, 15 nt, Human adenovirus B [HAdV-B]
cuacagagucucuga

SEQ ID NO: 3904658 - RNA, 16 nt, Human adenovirus B [HAdV-B]
cuacagagucucugac

SEQ ID NO: 3904659 - RNA, 15 nt, Human adenovirus B [HAdV-B]
cuacccuagaagaua

SEQ ID NO: 3904660 - RNA, 20 nt, Human adenovirus B [HAdV-B]
cuaccuguuccgucuggcca

SEQ ID NO: 3904661 - RNA, 15 nt, Human adenovirus B [HAdV-B]
cuacggaagccagca

SEQ ID NO: 3904662 - RNA, 18 nt, Human adenovirus B [HAdV-B]
cuacuauagccagcaaau

SEQ ID NO: 3904663 - RNA, 11 nt, Human adenovirus B [HAdV-B]
cuacuccuggu

SEQ ID NO: 3904664 - RNA, 12 nt, Human adenovirus B [HAdV-B]
cuacuccugguu

SEQ ID NO: 3904665 - RNA, 20 nt, Human adenovirus B [HAdV-B]
cuagagagagaggaugaaaa

SEQ ID NO: 3904666 - RNA, 11 nt, Human adenovirus B [HAdV-B]
cuagcuugcaa

SEQ ID NO: 3904667 - RNA, 22 nt, Human adenovirus B [HAdV-B]
cuagugaaaguuaacuggaugc

SEQ ID NO: 3904668 - RNA, 17 nt, Human adenovirus B [HAdV-B]
cuauaggcucaaacugc

SEQ ID NO: 3904669 - RNA, 18 nt, Human adenovirus B [HAdV-B]
cucaaacugcacacuaaa

SEQ ID NO: 3904670 - RNA, 13 nt, Human adenovirus B [HAdV-B]
cucacgcuugcca

SEQ ID NO: 3904671 - RNA, 18 nt, Human adenovirus B [HAdV-B]
cucacgcuugccagcacg

SEQ ID NO: 3904672 - RNA, 18 nt, Human adenovirus B [HAdV-B]
cucacuauucaaccugua

SEQ ID NO: 3904673 - RNA, 16 nt, Human adenovirus B [HAdV-B]
cucagccauugcuguc

SEQ ID NO: 3904674 - RNA, 18 nt, Human adenovirus B [HAdV-B]
cucauauuugucagcauu

SEQ ID NO: 3904675 - RNA, 16 nt, Human adenovirus B [HAdV-B]
cucauggacaaacagu

SEQ ID NO: 3904676 - RNA, 19 nt, Human adenovirus B [HAdV-B]
cuccaacagaaaaccagca

SEQ ID NO: 3904677 - RNA, 18 nt, Human adenovirus B [HAdV-B]
cuccaagauuuuccaugc

SEQ ID NO: 3904678 - RNA, 12 nt, Human adenovirus B [HAdV-B]
cuccauacuuua

SEQ ID NO: 3904679 - RNA, 12 nt, Human adenovirus B [HAdV-B]
cucccaagcaga

SEQ ID NO: 3904680 - RNA, 13 nt, Human adenovirus B [HAdV-B]
cucccagcagcac

SEQ ID NO: 3904681 - RNA, 18 nt, Human adenovirus B [HAdV-B]
cuccggaucuccugggca

SEQ ID NO: 3904682 - RNA, 19 nt, Human adenovirus B [HAdV-B]
cuccguagccuggaggaac

SEQ ID NO: 3904683 - RNA, 23 nt, Human adenovirus B [HAdV-B]
cuccguuccggagacagggagga

SEQ ID NO: 3904684 - RNA, 21 nt, Human adenovirus B [HAdV-B]
cuccuaaaggcgcuccaaaua

SEQ ID NO: 3904685 - RNA, 19 nt, Human adenovirus B [HAdV-B]
cuccucaauaugcucuuac

SEQ ID NO: 3904686 - RNA, 15 nt, Human adenovirus B [HAdV-B]
cuccucguccaaaug

SEQ ID NO: 3904687 - RNA, 22 nt, Human adenovirus B [HAdV-B]
cucgaaaacugguuagcugcac

SEQ ID NO: 3904688 - RNA, 15 nt, Human adenovirus B [HAdV-B]
cucgcagcagcagca

SEQ ID NO: 3904689 - RNA, 16 nt, Human adenovirus B [HAdV-B]
cucgcggugaccagca

SEQ ID NO: 3904690 - RNA, 20 nt, Human adenovirus B [HAdV-B]
cucgcgugccaggcacuucc

SEQ ID NO: 3904691 - RNA, 22 nt, Human adenovirus B [HAdV-B]
cucggacgauuggacccaggcc

SEQ ID NO: 3904692 - RNA, 20 nt, Human adenovirus B [HAdV-B]
cucggcugcggagacaagca

SEQ ID NO: 3904693 - RNA, 16 nt, Human adenovirus B [HAdV-B]
cucguucaucauuucc

SEQ ID NO: 3904694 - RNA, 13 nt, Human adenovirus B [HAdV-B]
cucucgaggacgc

SEQ ID NO: 3904695 - RNA, 14 nt, Human adenovirus B [HAdV-B]
cucugaacuucuug

SEQ ID NO: 3904696 - RNA, 16 nt, Human adenovirus B [HAdV-B]
cucugacuggagcugg

SEQ ID NO: 3904697 - RNA, 14 nt, Human adenovirus B [HAdV-B]
cucuuucuucuucg

SEQ ID NO: 3904698 - RNA, 19 nt, Human adenovirus B [HAdV-B]
cucuuucuucuucgcuguc

SEQ ID NO: 3904699 - RNA, 12 nt, Human adenovirus B [HAdV-B]
cugacaaauaaa

SEQ ID NO: 3904700 - RNA, 20 nt, Human adenovirus B [HAdV-B]
cugacacuccugguccugug

SEQ ID NO: 3904701 - RNA, 19 nt, Human adenovirus B [HAdV-B]
cugacgccagacgccgcac

SEQ ID NO: 3904702 - RNA, 20 nt, Human adenovirus B [HAdV-B]
cugacuuuaugagccagagc

SEQ ID NO: 3904703 - RNA, 18 nt, Human adenovirus B [HAdV-B]
cugagacagacaucgagc

SEQ ID NO: 3904704 - RNA, 21 nt, Human adenovirus B [HAdV-B]
cugagguuaaagugagaccca

SEQ ID NO: 3904705 - RNA, 14 nt, Human adenovirus B [HAdV-B]
cugauugccacaga

SEQ ID NO: 3904706 - RNA, 13 nt, Human adenovirus B [HAdV-B]
cugcaaaaauaaa

SEQ ID NO: 3904707 - RNA, 14 nt, Human adenovirus B [HAdV-B]
cugcaaucugugca

SEQ ID NO: 3904708 - RNA, 22 nt, Human adenovirus B [HAdV-B]
cugccaccaccucuacccuaga

SEQ ID NO: 3904709 - RNA, 16 nt, Human adenovirus B [HAdV-B]
cugccaccuccacuga

SEQ ID NO: 3904710 - RNA, 16 nt, Human adenovirus B [HAdV-B]
cugcccgccaccugcu

SEQ ID NO: 3904711 - RNA, 19 nt, Human adenovirus B [HAdV-B]
cugccguugcgcagcagua

SEQ ID NO: 3904712 - RNA, 17 nt, Human adenovirus B [HAdV-B]
cugccuccuugcagaua

SEQ ID NO: 3904713 - RNA, 18 nt, Human adenovirus B [HAdV-B]
cugcgcacugcccuccga

SEQ ID NO: 3904714 - RNA, 17 nt, Human adenovirus B [HAdV-B]
cugcguggccuuuggcg

SEQ ID NO: 3904715 - RNA, 19 nt, Human adenovirus B [HAdV-B]
cugcuacaaguugcgccuc

SEQ ID NO: 3904716 - RNA, 17 nt, Human adenovirus B [HAdV-B]
cugcuacagcugcugca

SEQ ID NO: 3904717 - RNA, 17 nt, Human adenovirus B [HAdV-B]
cuggagugucacugccg

SEQ ID NO: 3904718 - RNA, 18 nt, Human adenovirus B [HAdV-B]
cuggauguuuuauuuuga

SEQ ID NO: 3904719 - RNA, 17 nt, Human adenovirus B [HAdV-B]
cuggcagaccucaucuu

SEQ ID NO: 3904720 - RNA, 16 nt, Human adenovirus B [HAdV-B]
cuggccaucgugaacg

SEQ ID NO: 3904721 - RNA, 17 nt, Human adenovirus B [HAdV-B]
cugggaugcaaaugcaa

SEQ ID NO: 3904722 - RNA, 15 nt, Human adenovirus B [HAdV-B]
cugucgguagaagaa

SEQ ID NO: 3904723 - RNA, 19 nt, Human adenovirus B [HAdV-B]
cugugccagaaguacuggc

SEQ ID NO: 3904724 - RNA, 16 nt, Human adenovirus B [HAdV-B]
cuguuccgucuggcca

SEQ ID NO: 3904725 - RNA, 18 nt, Human adenovirus B [HAdV-B]
cuguucugacuuuggaaa

SEQ ID NO: 3904726 - RNA, 17 nt, Human adenovirus B [HAdV-B]
cuuaaacccgcacuggc

SEQ ID NO: 3904727 - RNA, 16 nt, Human adenovirus B [HAdV-B]
cuuaaccgaagagcaa

SEQ ID NO: 3904728 - RNA, 18 nt, Human adenovirus B [HAdV-B]
cuuaugcccgucuucuca

SEQ ID NO: 3904729 - RNA, 14 nt, Human adenovirus B [HAdV-B]
cuucaauuggagca

SEQ ID NO: 3904730 - RNA, 19 nt, Human adenovirus B [HAdV-B]
cuuccgaccuggcagaccu

SEQ ID NO: 3904731 - RNA, 18 nt, Human adenovirus B [HAdV-B]
cuucgacaugggagcuga

SEQ ID NO: 3904732 - RNA, 18 nt, Human adenovirus B [HAdV-B]
cuucgagggucugggcaa

SEQ ID NO: 3904733 - RNA, 19 nt, Human adenovirus B [HAdV-B]
cuucgcauaucccgcuguc

SEQ ID NO: 3904734 - RNA, 15 nt, Human adenovirus B [HAdV-B]
cuucgggggcagagg

SEQ ID NO: 3904735 - RNA, 23 nt, Human adenovirus B [HAdV-B]
cuugaaaguggguagacagaaug

SEQ ID NO: 3904736 - RNA, 17 nt, Human adenovirus B [HAdV-B]
cuugacaagcucuuaca

SEQ ID NO: 3904737 - RNA, 23 nt, Human adenovirus B [HAdV-B]
cuugcgcaaguuugcuccggaag

SEQ ID NO: 3904738 - RNA, 23 nt, Human adenovirus B [HAdV-B]
cuuuaaaauguuuaaccccacua

SEQ ID NO: 3904739 - RNA, 18 nt, Human adenovirus B [HAdV-B]
cuuucagacuagcagaca

SEQ ID NO: 3904740 - RNA, 16 nt, Human adenovirus B [HAdV-B]
cuuucuccauacuuua

SEQ ID NO: 3904741 - RNA, 18 nt, Human adenovirus B [HAdV-B]
cuuucucccaagcagaca

SEQ ID NO: 3904742 - RNA, 16 nt, Human adenovirus B [HAdV-B]
cuuucucuagcagcag

SEQ ID NO: 3904743 - RNA, 23 nt, Human adenovirus B [HAdV-B]
cuuuuccaaaguaugcaaacaca

SEQ ID NO: 3904744 - RNA, 18 nt, Human adenovirus B [HAdV-B]
gaaaccauuugguggcau

SEQ ID NO: 3904745 - RNA, 18 nt, Human adenovirus B [HAdV-B]
gaaagagucugagacaga

SEQ ID NO: 3904746 - RNA, 19 nt, Human adenovirus B [HAdV-B]
gaaaguauggaagugcaaa

SEQ ID NO: 3904747 - RNA, 17 nt, Human adenovirus B [HAdV-B]
gaacagaacuugaaaga

SEQ ID NO: 3904748 - RNA, 18 nt, Human adenovirus B [HAdV-B]
gaacccuacuagcaaacc

SEQ ID NO: 3904749 - RNA, 14 nt, Human adenovirus B [HAdV-B]
gaacgaaacuuuuc

SEQ ID NO: 3904750 - RNA, 16 nt, Human adenovirus B [HAdV-B]
gaacucaccaaccugg

SEQ ID NO: 3904751 - RNA, 22 nt, Human adenovirus B [HAdV-B]
gaagacaguuuggaggaggaaa

SEQ ID NO: 3904752 - RNA, 15 nt, Human adenovirus B [HAdV-B]
gaagauacugagcag

SEQ ID NO: 3904753 - RNA, 15 nt, Human adenovirus B [HAdV-B]
gaagaugaaagcacc

SEQ ID NO: 3904754 - RNA, 16 nt, Human adenovirus B [HAdV-B]
gaagcuauaauguguu

SEQ ID NO: 3904755 - RNA, 21 nt, Human adenovirus B [HAdV-B]
gaagcucuuaauuugggccau

SEQ ID NO: 3904756 - RNA, 18 nt, Human adenovirus B [HAdV-B]
gaagcuuggaaugcccac

SEQ ID NO: 3904757 - RNA, 20 nt, Human adenovirus B [HAdV-B]
gaaucagaaugacccgcagg

SEQ ID NO: 3904758 - RNA, 19 nt, Human adenovirus B [HAdV-B]
gaaucauguccaccugggg

SEQ ID NO: 3904759 - RNA, 20 nt, Human adenovirus B [HAdV-B]
gaaucauguccaccuggggg

SEQ ID NO: 3904760 - RNA, 13 nt, Human adenovirus B [HAdV-B]
gacaaaguacagc

SEQ ID NO: 3904761 - RNA, 17 nt, Human adenovirus B [HAdV-B]
gacaauuggaauaucua

SEQ ID NO: 3904762 - RNA, 15 nt, Human adenovirus B [HAdV-B]
gacagcaaccccagg

SEQ ID NO: 3904763 - RNA, 17 nt, Human adenovirus B [HAdV-B]
gacaguaaaggaagagc

SEQ ID NO: 3904764 - RNA, 16 nt, Human adenovirus B [HAdV-B]
gacagucaggcagagg

SEQ ID NO: 3904765 - RNA, 15 nt, Human adenovirus B [HAdV-B]
gaccacgguggugca

SEQ ID NO: 3904766 - RNA, 20 nt, Human adenovirus B [HAdV-B]
ggcaaaauagacucucgccu

SEQ ID NO: 3904767 - RNA, 16 nt, Human adenovirus B [HAdV-B]
ggcaccgacucuccca

SEQ ID NO: 3904768 - RNA, 14 nt, Human adenovirus B [HAdV-B]
ggcaccugcgagcc

SEQ ID NO: 3904769 - RNA, 22 nt, Human adenovirus B [HAdV-B]
ggcacgauucucacuugccacc

SEQ ID NO: 3904770 - RNA, 19 nt, Human adenovirus B [HAdV-B]
ggcagaccucaucuuccca

SEQ ID NO: 3904771 - RNA, 22 nt, Human adenovirus B [HAdV-B]
ggcagcaauguuuagaagaaca

SEQ ID NO: 3904772 - RNA, 15 nt, Human adenovirus B [HAdV-B]
ggcagucucgacaga

SEQ ID NO: 3904773 - RNA, 19 nt, Human adenovirus B [HAdV-B]
ggcaguuauuagaugcugc

SEQ ID NO: 3904774 - RNA, 17 nt, Human adenovirus B [HAdV-B]
ggcauggaugagcauca

SEQ ID NO: 3904775 - RNA, 21 nt, Human adenovirus B [HAdV-B]
ggccaacuaucucuccuacca

SEQ ID NO: 3904776 - RNA, 22 nt, Human adenovirus B [HAdV-B]
ggcccaauugcaagccauccaa

SEQ ID NO: 3904777 - RNA, 23 nt, Human adenovirus B [HAdV-B]
ggcccuuacagacuugggacaga

SEQ ID NO: 3904778 - RNA, 18 nt, Human adenovirus B [HAdV-B]
ggccgagaagguggcugc

SEQ ID NO: 3904779 - RNA, 16 nt, Human adenovirus B [HAdV-B]
ggcgaagagccaugcu

SEQ ID NO: 3904780 - RNA, 14 nt, Human adenovirus B [HAdV-B]
ggcgaccuccaaca

SEQ ID NO: 3904781 - RNA, 17 nt, Human adenovirus B [HAdV-B]
ggcggagcgguggugua

SEQ ID NO: 3904782 - RNA, 18 nt, Human adenovirus B [HAdV-B]
ggcggaugaaggcgagga

SEQ ID NO: 3904783 - RNA, 17 nt, Human adenovirus B [HAdV-B]
ggcggaugacuggcaga

SEQ ID NO: 3904784 - RNA, 18 nt, Human adenovirus B [HAdV-B]
ggcggcgcugcagagcca

SEQ ID NO: 3904785 - RNA, 15 nt, Human adenovirus B [HAdV-B]
ggcucucaugaaagc

SEQ ID NO: 3904786 - RNA, 14 nt, Human adenovirus B [HAdV-B]
ggcugcagccaacc

SEQ ID NO: 3904787 - RNA, 16 nt, Human adenovirus B [HAdV-B]
gggacagucaggcaga

SEQ ID NO: 3904788 - RNA, 22 nt, Human adenovirus B [HAdV-B]
gggugcuaccgcggcugagccc

SEQ ID NO: 3904789 - RNA, 15 nt, Human adenovirus B [HAdV-B]
gguacuuccgcucga

SEQ ID NO: 3904790 - RNA, 22 nt, Human adenovirus B [HAdV-B]
ggucaagagcaggaacugaaaa

SEQ ID NO: 3904791 - RNA, 22 nt, Human adenovirus B [HAdV-B]
ggucccuagcuugcaaccccca

SEQ ID NO: 3904792 - RNA, 16 nt, Human adenovirus B [HAdV-B]
ggucuugugugggacg

SEQ ID NO: 3904793 - RNA, 18 nt, Human adenovirus B [HAdV-B]
ggugacgcggcugagcua

SEQ ID NO: 3904794 - RNA, 20 nt, Human adenovirus B [HAdV-B]
gguggaacacgaggaagagu

SEQ ID NO: 3904795 - RNA, 16 nt, Human adenovirus B [HAdV-B]
gguguguuggacagag

SEQ ID NO: 3904796 - RNA, 15 nt, Human adenovirus B [HAdV-B]
gguucuguggacagg

SEQ ID NO: 3904797 - RNA, 13 nt, Human adenovirus B [HAdV-B]
guaauuaaaucca

SEQ ID NO: 3904798 - RNA, 18 nt, Human adenovirus B [HAdV-B]
guaccgcaaugguagugc

SEQ ID NO: 3904799 - RNA, 12 nt, Human adenovirus B [HAdV-B]
guagaagaggga

SEQ ID NO: 3904800 - RNA, 14 nt, Human adenovirus B [HAdV-B]
guagguuuggaagu

SEQ ID NO: 3904801 - RNA, 17 nt, Human adenovirus B [HAdV-B]
guaucauagugcaggag

SEQ ID NO: 3904802 - RNA, 11 nt, Human adenovirus B [HAdV-B]
guaugaagauu

SEQ ID NO: 3904803 - RNA, 21 nt, Human adenovirus B [HAdV-B]
gucaccagggaaaaguacagu

SEQ ID NO: 3904804 - RNA, 12 nt, Human adenovirus B [HAdV-B]
gucaccugcgga

SEQ ID NO: 3904805 - RNA, 14 nt, Human adenovirus B [HAdV-B]
gucaggcuguucug

SEQ ID NO: 3904806 - RNA, 16 nt, Human adenovirus B [HAdV-B]
guccagcgcugccagg

SEQ ID NO: 3904807 - RNA, 17 nt, Human adenovirus B [HAdV-B]
gucccgauuuggaagag

SEQ ID NO: 3904808 - RNA, 15 nt, Human adenovirus B [HAdV-B]
guccggcccacggag

SEQ ID NO: 3904809 - RNA, 14 nt, Human adenovirus B [HAdV-B]
guccuuugccaaac

SEQ ID NO: 3904810 - RNA, 13 nt, Human adenovirus B [HAdV-B]
gucgcuacaaaaa

SEQ ID NO: 3904811 - RNA, 19 nt, Human adenovirus B [HAdV-B]
gucucacgcuugccagcac

SEQ ID NO: 3904812 - RNA, 16 nt, Human adenovirus B [HAdV-B]
gucucuguugaaauuu

SEQ ID NO: 3904813 - RNA, 22 nt, Human adenovirus B [HAdV-B]
gucuugacugaugucuugcaug

SEQ ID NO: 3904814 - RNA, 14 nt, Human adenovirus B [HAdV-B]
gucuuguugccauc

SEQ ID NO: 3904815 - RNA, 22 nt, Human adenovirus B [HAdV-B]
gugaaaacauguugguuggagc

SEQ ID NO: 3904816 - RNA, 19 nt, Human adenovirus B [HAdV-B]
gugaaaguguuguuggaac

SEQ ID NO: 3904817 - RNA, 14 nt, Human adenovirus B [HAdV-B]
gugacgcugccacc

SEQ ID NO: 3904818 - RNA, 15 nt, Human adenovirus B [HAdV-B]
gugacgcugccaccg

SEQ ID NO: 3904819 - RNA, 14 nt, Human adenovirus B [HAdV-B]
gugcuuugagacug

SEQ ID NO: 3904820 - RNA, 16 nt, Human adenovirus B [HAdV-B]
guggcgguucaggccu

SEQ ID NO: 3904821 - RNA, 15 nt, Human adenovirus B [HAdV-B]
guguggaagagcuca

SEQ ID NO: 3904822 - RNA, 13 nt, Human adenovirus B [HAdV-B]
guguuggacagag

SEQ ID NO: 3904823 - RNA, 12 nt, Human adenovirus B [HAdV-B]
guuaauucaucu

SEQ ID NO: 3904824 - RNA, 14 nt, Human adenovirus B [HAdV-B]
guuagcugcacagc

SEQ ID NO: 3904825 - RNA, 15 nt, Human adenovirus B [HAdV-B]
guuaggucugugggg

SEQ ID NO: 3904826 - RNA, 20 nt, Human adenovirus B [HAdV-B]
guucagcggcauacuuucuc

SEQ ID NO: 3904827 - RNA, 19 nt, Human adenovirus B [HAdV-B]
guucugacgagaaucagaa

SEQ ID NO: 3904828 - RNA, 17 nt, Human adenovirus B [HAdV-B]
guucugaggaaaucauc

SEQ ID NO: 3904829 - RNA, 20 nt, Human adenovirus B [HAdV-B]
guucuggaggaggaacagca

SEQ ID NO: 3904830 - RNA, 15 nt, Human adenovirus B [HAdV-B]
guugaaggugcagcc

SEQ ID NO: 3904831 - RNA, 23 nt, Human adenovirus B [HAdV-B]
guugagcgccucggcugcguggc

SEQ ID NO: 3904832 - RNA, 18 nt, Human adenovirus B [HAdV-B]
guugaucaugccuggagu

SEQ ID NO: 3904833 - RNA, 12 nt, Human adenovirus B [HAdV-B]
guugaugcccaa

SEQ ID NO: 3904834 - RNA, 18 nt, Human adenovirus B [HAdV-B]
guuguuggaaccagaugc

SEQ ID NO: 3904835 - RNA, 22 nt, Human adenovirus B [HAdV-B]
guuucucuucgggggcagaggu

SEQ ID NO: 3904836 - RNA, 16 nt, Human adenovirus B [HAdV-B]
guuucugaugcaagag

SEQ ID NO: 3904837 - RNA, 20 nt, Human adenovirus B [HAdV-B]
guuugcgcuacuuucacagc

SEQ ID NO: 3904838 - RNA, 12 nt, Human adenovirus B [HAdV-B]
guuuggaggagg

SEQ ID NO: 3904839 - RNA, 13 nt, Human adenovirus B [HAdV-B]
guuugguggauaa

SEQ ID NO: 3904840 - RNA, 18 nt, Human adenovirus B [HAdV-B]
uaaaaaauauaauuauuu

SEQ ID NO: 3904841 - RNA, 15 nt, Human adenovirus B [HAdV-B]
uaaaacuggagcacu

SEQ ID NO: 3904842 - RNA, 15 nt, Human adenovirus B [HAdV-B]
uaagcauuccaccgc

SEQ ID NO: 3904843 - RNA, 16 nt, Human adenovirus B [HAdV-B]
uaagggggucuaccuu

SEQ ID NO: 3904844 - RNA, 15 nt, Human adenovirus B [HAdV-B]
uaaucauaaaucagg

SEQ ID NO: 3904845 - RNA, 18 nt, Human adenovirus B [HAdV-B]
uacaacucccuggcuccu

SEQ ID NO: 3904846 - RNA, 21 nt, Human adenovirus B [HAdV-B]
uacaagcgcagaccuccccaa

SEQ ID NO: 3904847 - RNA, 12 nt, Human adenovirus B [HAdV-B]
uacauggcuccg

SEQ ID NO: 3904848 - RNA, 16 nt, Human adenovirus B [HAdV-B]
uacauuccagaaggau

SEQ ID NO: 3904849 - RNA, 14 nt, Human adenovirus B [HAdV-B]
uaccaggaaagucc

SEQ ID NO: 3904850 - RNA, 14 nt, Human adenovirus B [HAdV-B]
uacgagcagacagu

SEQ ID NO: 3904851 - RNA, 12 nt, Human adenovirus B [HAdV-B]
uacuuucucuag

SEQ ID NO: 3904852 - RNA, 14 nt, Human adenovirus B [HAdV-B]
uacuuugccagaag

SEQ ID NO: 3904853 - RNA, 18 nt, Human adenovirus B [HAdV-B]
uagaaaaugcaaauucca

SEQ ID NO: 3904854 - RNA, 19 nt, Human adenovirus B [HAdV-B]
uagaagcugcuacagcugc

SEQ ID NO: 3904855 - RNA, 21 nt, Human adenovirus B [HAdV-B]
uagacacggcuuugugcggca

SEQ ID NO: 3904856 - RNA, 19 nt, Human adenovirus B [HAdV-B]
uagacagcaaccccaggcc

SEQ ID NO: 3904857 - RNA, 23 nt, Human adenovirus B [HAdV-B]
uagagcgagccguagacgccagc

SEQ ID NO: 3904858 - RNA, 23 nt, Human adenovirus B [HAdV-B]
uagaugggauccucaaagaugcc

SEQ ID NO: 3904859 - RNA, 23 nt, Human adenovirus B [HAdV-B]
uagcugaugggaguggggucauc

SEQ ID NO: 3904860 - RNA, 19 nt, Human adenovirus B [HAdV-B]
uagucuacccuuuucucua

SEQ ID NO: 3904861 - RNA, 17 nt, Human adenovirus B [HAdV-B]
uagucuguuccacaguu

SEQ ID NO: 3904862 - RNA, 14 nt, Human adenovirus B [HAdV-B]
uagugauagaaguu

SEQ ID NO: 3904863 - RNA, 14 nt, Human adenovirus B [HAdV-B]
uaguuauguuccug

SEQ ID NO: 3904864 - RNA, 16 nt, Human adenovirus B [HAdV-B]
uaguuauuuugccucc

SEQ ID NO: 3904865 - RNA, 13 nt, Human adenovirus B [HAdV-B]
uaucauugagaac

SEQ ID NO: 3904866 - RNA, 11 nt, Human adenovirus B [HAdV-B]
uaugaaaucaa

SEQ ID NO: 3904867 - RNA, 18 nt, Human adenovirus B [HAdV-B]
uauggaagugcaaacuga

SEQ ID NO: 3904868 - RNA, 14 nt, Human adenovirus B [HAdV-B]
uauucuuugcuacc

SEQ ID NO: 3904869 - RNA, 23 nt, Human adenovirus B [HAdV-B]
uauuuugauuaagggaaaugcca

SEQ ID NO: 3904870 - RNA, 16 nt, Human adenovirus B [HAdV-B]
aaugauugcuggaaua

SEQ ID NO: 3904871 - RNA, 19 nt, Human adenovirus B [HAdV-B]
aaugggaguaaaguguaaa

SEQ ID NO: 3904872 - RNA, 15 nt, Human adenovirus B [HAdV-B]
aaugugaaaggcggu

SEQ ID NO: 3904873 - RNA, 15 nt, Human adenovirus B [HAdV-B]
aauuaagacucuccu

SEQ ID NO: 3904874 - RNA, 20 nt, Human adenovirus B [HAdV-B]
aauugcaaggccccagcagc

SEQ ID NO: 3904875 - RNA, 17 nt, Human adenovirus B [HAdV-B]
aauugcgagugaugcga

SEQ ID NO: 3904876 - RNA, 17 nt, Human adenovirus B [HAdV-B]
aauugugaugauagcaa

SEQ ID NO: 3904877 - RNA, 21 nt, Human adenovirus B [HAdV-B]
aauuugccaaaaaaacauuca

SEQ ID NO: 3904878 - RNA, 12 nt, Human adenovirus B [HAdV-B]
aauuuuggcuca

SEQ ID NO: 3904879 - RNA, 22 nt, Human adenovirus B [HAdV-B]
acaaugaagaacccaauucucu

SEQ ID NO: 3904880 - RNA, 15 nt, Human adenovirus B [HAdV-B]
acaaugaggcuuuca

SEQ ID NO: 3904881 - RNA, 12 nt, Human adenovirus B [HAdV-B]
acaauucucuag

SEQ ID NO: 3904882 - RNA, 14 nt, Human adenovirus B [HAdV-B]
acacacagaaauau

SEQ ID NO: 3904883 - RNA, 18 nt, Human adenovirus B [HAdV-B]
acaccgcucccccagcca

SEQ ID NO: 3904884 - RNA, 14 nt, Human adenovirus B [HAdV-B]
acaccuaugugaac

SEQ ID NO: 3904885 - RNA, 17 nt, Human adenovirus B [HAdV-B]
acagggcguuggauaaa

SEQ ID NO: 3904886 - RNA, 16 nt, Human adenovirus B [HAdV-B]
acagugcaggcagcag

SEQ ID NO: 3904887 - RNA, 14 nt, Human adenovirus B [HAdV-B]
acauccaauagcgc

SEQ ID NO: 3904888 - RNA, 18 nt, Human adenovirus B [HAdV-B]
acaugcagaauaaaaaag

SEQ ID NO: 3904889 - RNA, 16 nt, Human adenovirus B [HAdV-B]
acaugggagcugacuu

SEQ ID NO: 3904890 - RNA, 15 nt, Human adenovirus B [HAdV-B]
acaugggcaccugga

SEQ ID NO: 3904891 - RNA, 20 nt, Human adenovirus B [HAdV-B]
acauugucuuacugccuggc

SEQ ID NO: 3904892 - RNA, 23 nt, Human adenovirus B [HAdV-B]
accaagagucaauugucucugaa

SEQ ID NO: 3904893 - RNA, 18 nt, Human adenovirus B [HAdV-B]
accaauauuuuugcuucu

SEQ ID NO: 3904894 - RNA, 11 nt, Human adenovirus B [HAdV-B]
accaaugccau

SEQ ID NO: 3904895 - RNA, 18 nt, Human adenovirus B [HAdV-B]
accaaugccaucuuaaac

SEQ ID NO: 3904896 - RNA, 12 nt, Human adenovirus B [HAdV-B]
accacacucuua

SEQ ID NO: 3904897 - RNA, 12 nt, Human adenovirus B [HAdV-B]
accacacugcca

SEQ ID NO: 3904898 - RNA, 20 nt, Human adenovirus B [HAdV-B]
accaggaacuucaagcuggg

SEQ ID NO: 3904899 - RNA, 16 nt, Human adenovirus B [HAdV-B]
acccaacauccugucc

SEQ ID NO: 3904900 - RNA, 14 nt, Human adenovirus B [HAdV-B]
acccacaagcagcc

SEQ ID NO: 3904901 - RNA, 19 nt, Human adenovirus B [HAdV-B]
acccagaggaacacauucc

SEQ ID NO: 3904902 - RNA, 12 nt, Human adenovirus B [HAdV-B]
accccaggccaa

SEQ ID NO: 3904903 - RNA, 17 nt, Human adenovirus B [HAdV-B]
acccggcggcgucccag

SEQ ID NO: 3904904 - RNA, 18 nt, Human adenovirus B [HAdV-B]
acccuaugucgucacagg

SEQ ID NO: 3904905 - RNA, 22 nt, Human adenovirus B [HAdV-B]
accgaaaaguauggaggcaggg

SEQ ID NO: 3904906 - RNA, 17 nt, Human adenovirus B [HAdV-B]
accggauugcagcacug

SEQ ID NO: 3904907 - RNA, 21 nt, Human adenovirus B [HAdV-B]
accugcugcuucucccaggcu

SEQ ID NO: 3904908 - RNA, 18 nt, Human adenovirus B [HAdV-B]
accuguaucgcgaagcca

SEQ ID NO: 3904909 - RNA, 18 nt, Human adenovirus B [HAdV-B]
acgaggaaaaggagcaga

SEQ ID NO: 3904910 - RNA, 12 nt, Human adenovirus B [HAdV-B]
acgcacagccug

SEQ ID NO: 3904911 - RNA, 14 nt, Human adenovirus B [HAdV-B]
acgcacagccugua

SEQ ID NO: 3904912 - RNA, 14 nt, Human adenovirus B [HAdV-B]
acggagggcagaaa

SEQ ID NO: 3904913 - RNA, 19 nt, Human adenovirus B [HAdV-B]
acggaguucuuacuuuaaa

SEQ ID NO: 3904914 - RNA, 19 nt, Human adenovirus B [HAdV-B]
acgguuuuuugaaagaaaa

SEQ ID NO: 3904915 - RNA, 15 nt, Human adenovirus B [HAdV-B]
acguggcaaaccggc

SEQ ID NO: 3904916 - RNA, 13 nt, Human adenovirus B [HAdV-B]
acguuuuggauuu

SEQ ID NO: 3904917 - RNA, 12 nt, Human adenovirus B [HAdV-B]
acuaaugugaaa

SEQ ID NO: 3904918 - RNA, 17 nt, Human adenovirus B [HAdV-B]
acuacuugcacagagcu

SEQ ID NO: 3904919 - RNA, 23 nt, Human adenovirus B [HAdV-B]
acuaucuccuaacgaauuugaaa

SEQ ID NO: 3904920 - RNA, 16 nt, Human adenovirus B [HAdV-B]
acucaucuaaaaccau

SEQ ID NO: 3904921 - RNA, 22 nt, Human adenovirus B [HAdV-B]
acuccagugaaucuaaugauug

SEQ ID NO: 3904922 - RNA, 15 nt, Human adenovirus B [HAdV-B]
acucugaacuucuug

SEQ ID NO: 3904923 - RNA, 22 nt, Human adenovirus B [HAdV-B]
acugcccaaaacaacgagcaga

SEQ ID NO: 3904924 - RNA, 22 nt, Human adenovirus B [HAdV-B]
acugccgcugcaaucugugcac

SEQ ID NO: 3904925 - RNA, 12 nt, Human adenovirus B [HAdV-B]
acugcuggacua

SEQ ID NO: 3904926 - RNA, 14 nt, Human adenovirus B [HAdV-B]
acugcuuuucccau

SEQ ID NO: 3904927 - RNA, 14 nt, Human adenovirus B [HAdV-B]
acuuccagcccaug

SEQ ID NO: 3904928 - RNA, 14 nt, Human adenovirus B [HAdV-B]
acuugcaguggcag

SEQ ID NO: 3904929 - RNA, 11 nt, Human adenovirus B [HAdV-B]
agaaaaaaaca

SEQ ID NO: 3904930 - RNA, 19 nt, Human adenovirus B [HAdV-B]
agaaaaaaauuucccaaac

SEQ ID NO: 3904931 - RNA, 12 nt, Human adenovirus B [HAdV-B]
agaaagagggaa

SEQ ID NO: 3904932 - RNA, 23 nt, Human adenovirus B [HAdV-B]
agaacgcuucggacggagucucc

SEQ ID NO: 3904933 - RNA, 16 nt, Human adenovirus B [HAdV-B]
agaagguccuggccau

SEQ ID NO: 3904934 - RNA, 13 nt, Human adenovirus B [HAdV-B]
agaauacaccaau

SEQ ID NO: 3904935 - RNA, 16 nt, Human adenovirus B [HAdV-B]
agaccggcgaggaacu

SEQ ID NO: 3904936 - RNA, 15 nt, Human adenovirus B [HAdV-B]
agaccugcuaccaau

SEQ ID NO: 3904937 - RNA, 21 nt, Human adenovirus B [HAdV-B]
agacgcgcuccuuaaacaucu

SEQ ID NO: 3904938 - RNA, 20 nt, Human adenovirus B [HAdV-B]
agacggauuaauauccggaa

SEQ ID NO: 3904939 - RNA, 14 nt, Human adenovirus B [HAdV-B]
agacuagcagacag

SEQ ID NO: 3904940 - RNA, 23 nt, Human adenovirus B [HAdV-B]
agacuguauaggagcauuugcuu

SEQ ID NO: 3904941 - RNA, 14 nt, Human adenovirus B [HAdV-B]
agagcgugaugcag

SEQ ID NO: 3904942 - RNA, 14 nt, Human adenovirus B [HAdV-B]
agagcgugggauug

SEQ ID NO: 3904943 - RNA, 14 nt, Human adenovirus B [HAdV-B]
agagcuucuacaac

SEQ ID NO: 3904944 - RNA, 22 nt, Human adenovirus B [HAdV-B]
agaggcaauguauacugggugc

SEQ ID NO: 3904945 - RNA, 14 nt, Human adenovirus B [HAdV-B]
agaggucagaggag

SEQ ID NO: 3904946 - RNA, 11 nt, Human adenovirus B [HAdV-B]
agaguuucaug

SEQ ID NO: 3904947 - RNA, 12 nt, Human adenovirus B [HAdV-B]
agaguuucauga

SEQ ID NO: 3904948 - RNA, 20 nt, Human adenovirus B [HAdV-B]
agaugccuggggacagguua

SEQ ID NO: 3904949 - RNA, 14 nt, Human adenovirus B [HAdV-B]
agauguacggaggc

SEQ ID NO: 3904950 - RNA, 13 nt, Human adenovirus B [HAdV-B]
agauuacagccaa

SEQ ID NO: 3904951 - RNA, 18 nt, Human adenovirus B [HAdV-B]
agauugggacagucaggc

SEQ ID NO: 3904952 - RNA, 15 nt, Human adenovirus B [HAdV-B]
agauuuuucugcaac

SEQ ID NO: 3904953 - RNA, 23 nt, Human adenovirus B [HAdV-B]
agcaagcaccggaucccgcaaug

SEQ ID NO: 3904954 - RNA, 16 nt, Human adenovirus B [HAdV-B]
agcaagggggccaccu

SEQ ID NO: 3904955 - RNA, 19 nt, Human adenovirus B [HAdV-B]
agcaauugagauuugccac

SEQ ID NO: 3904956 - RNA, 18 nt, Human adenovirus B [HAdV-B]
agcagacagggcuugcag

SEQ ID NO: 3904957 - RNA, 14 nt, Human adenovirus B [HAdV-B]
agcagagcguggga

SEQ ID NO: 3904958 - RNA, 14 nt, Human adenovirus B [HAdV-B]
agcaggaacugaaa

SEQ ID NO: 3904959 - RNA, 18 nt, Human adenovirus B [HAdV-B]
agccgcuuucgcagcggc

SEQ ID NO: 3904960 - RNA, 15 nt, Human adenovirus B [HAdV-B]
agccggccggagccg

SEQ ID NO: 3904961 - RNA, 18 nt, Human adenovirus B [HAdV-B]
agccguuaaccccacagc

SEQ ID NO: 3904962 - RNA, 12 nt, Human adenovirus B [HAdV-B]
agccuacugcca

SEQ ID NO: 3904963 - RNA, 22 nt, Human adenovirus B [HAdV-B]
agcgccggcaggucccgcaggc

SEQ ID NO: 3904964 - RNA, 16 nt, Human adenovirus B [HAdV-B]
agcgugaugcagcagc

SEQ ID NO: 3904965 - RNA, 16 nt, Human adenovirus B [HAdV-B]
agcucaugcucuggac

SEQ ID NO: 3904966 - RNA, 14 nt, Human adenovirus B [HAdV-B]
agcuccgccagucc

SEQ ID NO: 3904967 - RNA, 19 nt, Human adenovirus B [HAdV-B]
agcucuuaauuugggccau

SEQ ID NO: 3904968 - RNA, 20 nt, Human adenovirus B [HAdV-B]
agcugccuauaguacuccac

SEQ ID NO: 3904969 - RNA, 22 nt, Human adenovirus B [HAdV-B]
agcuguagugccuucccgcucu

SEQ ID NO: 3904970 - RNA, 17 nt, Human adenovirus B [HAdV-B]
aggacccccaaucacuu

SEQ ID NO: 3904971 - RNA, 11 nt, Human adenovirus B [HAdV-B]
aggagcuggcu

SEQ ID NO: 3904972 - RNA, 23 nt, Human adenovirus B [HAdV-B]
aggauccuauagaggugggauug

SEQ ID NO: 3904973 - RNA, 23 nt, Human adenovirus B [HAdV-B]
aggaugauugggagguggccauu

SEQ ID NO: 3904974 - RNA, 19 nt, Human adenovirus B [HAdV-B]
aggaugucacuccacagcu

SEQ ID NO: 3904975 - RNA, 22 nt, Human adenovirus B [HAdV-B]
aggauucggccgaugauagcag

SEQ ID NO: 3904976 - RNA, 16 nt, Human adenovirus B [HAdV-B]
aggcagaggaggugga

SEQ ID NO: 3904977 - RNA, 15 nt, Human adenovirus B [HAdV-B]
aggcauuaguuuaaa

SEQ ID NO: 3904978 - RNA, 15 nt, Human adenovirus B [HAdV-B]
aggcgacggcgguga

SEQ ID NO: 3904979 - RNA, 15 nt, Human adenovirus B [HAdV-B]
aggcugucccugcaa

SEQ ID NO: 3904980 - RNA, 15 nt, Human adenovirus B [HAdV-B]
agggcgaaggacugg

SEQ ID NO: 3904981 - RNA, 14 nt, Human adenovirus B [HAdV-B]
aggucaggagccga

SEQ ID NO: 3904982 - RNA, 22 nt, Human adenovirus B [HAdV-B]
aggucccgcaggcaagcagccg

SEQ ID NO: 3904983 - RNA, 20 nt, Human adenovirus B [HAdV-B]
aguaagaaagaacaaaaagc

SEQ ID NO: 3904984 - RNA, 19 nt, Human adenovirus B [HAdV-B]
aguagacaccuaugugaac

SEQ ID NO: 3904985 - RNA, 16 nt, Human adenovirus B [HAdV-B]
agucgaggaacccggc

SEQ ID NO: 3904986 - RNA, 19 nt, Human adenovirus B [HAdV-B]
agugcaccuacacccugcu

SEQ ID NO: 3904987 - RNA, 18 nt, Human adenovirus B [HAdV-B]
agugccaucacaucucgu

SEQ ID NO: 3904988 - RNA, 21 nt, Human adenovirus B [HAdV-B]
agugguugacuugcaggacag

SEQ ID NO: 3904989 - RNA, 15 nt, Human adenovirus B [HAdV-B]
aguguuucuugaaug

SEQ ID NO: 3904990 - RNA, 22 nt, Human adenovirus B [HAdV-B]
aguuacccuugguuugaugcau

SEQ ID NO: 3904991 - RNA, 13 nt, Human adenovirus B [HAdV-B]
aguuauguuccug

SEQ ID NO: 3904992 - RNA, 14 nt, Human adenovirus B [HAdV-B]
aguucaucgggagg

SEQ ID NO: 3904993 - RNA, 17 nt, Human adenovirus B [HAdV-B]
aguucguuauccagccu

SEQ ID NO: 3904994 - RNA, 19 nt, Human adenovirus B [HAdV-B]
aguucuuguagugaggaaa

SEQ ID NO: 3904995 - RNA, 20 nt, Human adenovirus B [HAdV-B]
aguuuacuuugccagaaggc

SEQ ID NO: 3904996 - RNA, 17 nt, Human adenovirus B [HAdV-B]
aguuucagaugaagaaa

SEQ ID NO: 3904997 - RNA, 22 nt, Human adenovirus B [HAdV-B]
aguuucuaugcguguuggauug

SEQ ID NO: 3904998 - RNA, 14 nt, Human adenovirus B [HAdV-B]
aguuuggcaaugga

SEQ ID NO: 3904999 - RNA, 20 nt, Human adenovirus B [HAdV-B]
auaacaaaaccuggaacaau

SEQ ID NO: 3905000 - RNA, 21 nt, Human adenovirus B [HAdV-B]
auacaaagccucaucagccau

SEQ ID NO: 3905001 - RNA, 16 nt, Human adenovirus B [HAdV-B]
auacaacaauuuccac

SEQ ID NO: 3905002 - RNA, 13 nt, Human adenovirus B [HAdV-B]
auacaauuuccaa

SEQ ID NO: 3905003 - RNA, 22 nt, Human adenovirus B [HAdV-B]
auacuaacaugccaaacgugaa

SEQ ID NO: 3905004 - RNA, 13 nt, Human adenovirus B [HAdV-B]
auauuuucccgca

SEQ ID NO: 3905005 - RNA, 12 nt, Human adenovirus B [HAdV-B]
auauuuuugcuu

SEQ ID NO: 3905006 - RNA, 13 nt, Human adenovirus B [HAdV-B]
aucaccugggcag

SEQ ID NO: 3905007 - RNA, 20 nt, Human adenovirus B [HAdV-B]
aucacugguuaccgaggaag

SEQ ID NO: 3905008 - RNA, 23 nt, Human adenovirus B [HAdV-B]
aucccgacgaaaguacgguccag

SEQ ID NO: 3905009 - RNA, 18 nt, Human adenovirus B [HAdV-B]
aucccgcugucaaccugc

SEQ ID NO: 3905010 - RNA, 22 nt, Human adenovirus B [HAdV-B]
aucucuuaagguucuguggaca

SEQ ID NO: 3905011 - RNA, 17 nt, Human adenovirus B [HAdV-B]
aucugcaacaaaacaaa

SEQ ID NO: 3905012 - RNA, 20 nt, Human adenovirus B [HAdV-B]
aucugggaccugguucacgc

SEQ ID NO: 3905013 - RNA, 14 nt, Human adenovirus B [HAdV-B]
aucuguggaguucu

SEQ ID NO: 3905014 - RNA, 11 nt, Human adenovirus B [HAdV-B]
aucuguugcac

SEQ ID NO: 3905015 - RNA, 11 nt, Human adenovirus B [HAdV-B]
augaacaaugc

SEQ ID NO: 3905016 - RNA, 18 nt, Human adenovirus B [HAdV-B]
augacagaaugcaucgcg

SEQ ID NO: 3905017 - RNA, 20 nt, Human adenovirus B [HAdV-B]
augagaaucgccuaggacaa

SEQ ID NO: 3905018 - RNA, 13 nt, Human adenovirus B [HAdV-B]
augaucacaagca

SEQ ID NO: 3905019 - RNA, 17 nt, Human adenovirus B [HAdV-B]
augaucuugggguguau

SEQ ID NO: 3905020 - RNA, 22 nt, Human adenovirus B [HAdV-B]
augcccaugccuauuacaacug

SEQ ID NO: 3905021 - RNA, 16 nt, Human adenovirus B [HAdV-B]
augcuggcuacugugc

SEQ ID NO: 3905022 - RNA, 20 nt, Human adenovirus B [HAdV-B]
auggaagacuuaugcucagg

SEQ ID NO: 3905023 - RNA, 18 nt, Human adenovirus B [HAdV-B]
auggcgaugaugggcugg

SEQ ID NO: 3905024 - RNA, 23 nt, Human adenovirus B [HAdV-B]
augggcguccagcgcugccaggg

SEQ ID NO: 3905025 - RNA, 14 nt, Human adenovirus B [HAdV-B]
augugccccaacag

SEQ ID NO: 3905026 - RNA, 18 nt, Human adenovirus B [HAdV-B]
auguuagcaaaguuuaca

SEQ ID NO: 3905027 - RNA, 23 nt, Human adenovirus B [HAdV-B]
auguugacgagacgcucuucucc

SEQ ID NO: 3905028 - RNA, 20 nt, Human adenovirus B [HAdV-B]
auuaaaugacguucccucaa

SEQ ID NO: 3905029 - RNA, 19 nt, Human adenovirus B [HAdV-B]
auuaacaaacugcuggacu

SEQ ID NO: 3905030 - RNA, 21 nt, Human adenovirus B [HAdV-B]
auuacagccaacgagccagcg

SEQ ID NO: 3905031 - RNA, 15 nt, Human adenovirus B [HAdV-B]
auucacacagcagcg

SEQ ID NO: 3905032 - RNA, 20 nt, Human adenovirus B [HAdV-B]
auucauuuuucagaaacuuc

SEQ ID NO: 3905033 - RNA, 14 nt, Human adenovirus B [HAdV-B]
auuccaccagccag

SEQ ID NO: 3905034 - RNA, 18 nt, Human adenovirus B [HAdV-B]
auuccagucuccugccgc

SEQ ID NO: 3905035 - RNA, 14 nt, Human adenovirus B [HAdV-B]
auuccuugcucaga

SEQ ID NO: 3905036 - RNA, 19 nt, Human adenovirus B [HAdV-B]
auucuagagaaaaagaaaa

SEQ ID NO: 3905037 - RNA, 15 nt, Human adenovirus B [HAdV-B]
auucuuaaacacacc

SEQ ID NO: 3905038 - RNA, 16 nt, Human adenovirus B [HAdV-B]
auuguguuucaagcag

SEQ ID NO: 3905039 - RNA, 16 nt, Human adenovirus B [HAdV-B]
auuucaccaaugccau

SEQ ID NO: 3905040 - RNA, 17 nt, Human adenovirus B [HAdV-B]
auuucauagccacagca

SEQ ID NO: 3905041 - RNA, 22 nt, Human adenovirus B [HAdV-B]
auuuccacuucaacaaucagca

SEQ ID NO: 3905042 - RNA, 13 nt, Human adenovirus B [HAdV-B]
auuuccauuccuu

SEQ ID NO: 3905043 - RNA, 19 nt, Human adenovirus B [HAdV-B]
auuuccccaaauggcuuca

SEQ ID NO: 3905044 - RNA, 18 nt, Human adenovirus B [HAdV-B]
auuugugugacagugcaa

SEQ ID NO: 3905045 - RNA, 15 nt, Human adenovirus B [HAdV-B]
auuuuuaacuccuca

SEQ ID NO: 3905046 - RNA, 22 nt, Human adenovirus B [HAdV-B]
caaaaauaaaaaaaaaaacaag

SEQ ID NO: 3905047 - RNA, 11 nt, Human adenovirus B [HAdV-B]
caaaacaaaaa

SEQ ID NO: 3905048 - RNA, 14 nt, Human adenovirus B [HAdV-B]
caaaacaaaaccaa

SEQ ID NO: 3905049 - RNA, 14 nt, Human adenovirus B [HAdV-B]
caaacccacaagca

SEQ ID NO: 3905050 - RNA, 20 nt, Human adenovirus B [HAdV-B]
caaagcgcgugugauggugu

SEQ ID NO: 3905051 - RNA, 14 nt, Human adenovirus B [HAdV-B]
caaagcgugcugca

SEQ ID NO: 3905052 - RNA, 18 nt, Human adenovirus B [HAdV-B]
caaaucccaaccaagcaa

SEQ ID NO: 3905053 - RNA, 12 nt, Human adenovirus B [HAdV-B]
caaaucuggaag

SEQ ID NO: 3905054 - RNA, 14 nt, Human adenovirus B [HAdV-B]
caacaagugcagca

SEQ ID NO: 3905055 - RNA, 18 nt, Human adenovirus B [HAdV-B]
caacaccuuaaucccaga

SEQ ID NO: 3905056 - RNA, 19 nt, Human adenovirus B [HAdV-B]
caacucagcucaugcucug

SEQ ID NO: 3905057 - RNA, 11 nt, Human adenovirus B [HAdV-B]
caacuggugag

SEQ ID NO: 3905058 - RNA, 14 nt, Human adenovirus B [HAdV-B]
caagagcaggggac

SEQ ID NO: 3905059 - RNA, 11 nt, Human adenovirus B [HAdV-B]
caagaggacaa

SEQ ID NO: 3905060 - RNA, 13 nt, Human adenovirus B [HAdV-B]
caagauagcuuug

SEQ ID NO: 3905061 - RNA, 16 nt, Human adenovirus B [HAdV-B]
caagcaaaccgacucc

SEQ ID NO: 3905062 - RNA, 16 nt, Human adenovirus B [HAdV-B]
caaggccccagcagcc

SEQ ID NO: 3905063 - RNA, 17 nt, Human adenovirus B [HAdV-B]
caaggucaacccuaucc

SEQ ID NO: 3905064 - RNA, 14 nt, Human adenovirus B [HAdV-B]
caagguucccucag

SEQ ID NO: 3905065 - RNA, 14 nt, Human adenovirus B [HAdV-B]
caauaaacaucacu

SEQ ID NO: 3905066 - RNA, 20 nt, Human adenovirus B [HAdV-B]
caauggaugguuuacaaaac

SEQ ID NO: 3905067 - RNA, 22 nt, Human adenovirus B [HAdV-B]
cacaacgugguaacugggcucu

SEQ ID NO: 3905068 - RNA, 16 nt, Human adenovirus B [HAdV-B]
cacaagacaagccaca

SEQ ID NO: 3905069 - RNA, 13 nt, Human adenovirus B [HAdV-B]
cacacaaagcaca

SEQ ID NO: 3905070 - RNA, 12 nt, Human adenovirus B [HAdV-B]
cacagagcugcc

SEQ ID NO: 3905071 - RNA, 20 nt, Human adenovirus B [HAdV-B]
cacagcacccugaaggggga

SEQ ID NO: 3905072 - RNA, 14 nt, Human adenovirus B [HAdV-B]
cacagcagagacaa

SEQ ID NO: 3905073 - RNA, 14 nt, Human adenovirus B [HAdV-B]
cacaggagaauaaa

SEQ ID NO: 3905074 - RNA, 11 nt, Human adenovirus B [HAdV-B]
caccaaugcca

SEQ ID NO: 3905075 - RNA, 21 nt, Human adenovirus B [HAdV-B]
caccagguuguaucuggugga

SEQ ID NO: 3905076 - RNA, 20 nt, Human adenovirus B [HAdV-B]
caccauucuuaaacacaccc

SEQ ID NO: 3905077 - RNA, 16 nt, Human adenovirus B [HAdV-B]
caccccggauugcaug

SEQ ID NO: 3905078 - RNA, 23 nt, Human adenovirus B [HAdV-B]
caccgagcuaccacugccaugcg

SEQ ID NO: 3905079 - RNA, 18 nt, Human adenovirus B [HAdV-B]
agccaacgagccagcgca

SEQ ID NO: 3905080 - RNA, 15 nt, Human adenovirus B [HAdV-B]
agccauugcugucaa

SEQ ID NO: 3905081 - RNA, 21 nt, Human adenovirus B [HAdV-B]
agcgcuccagccaaaacucau

SEQ ID NO: 3905082 - RNA, 15 nt, Human adenovirus B [HAdV-B]
agcgugcugcacagc

SEQ ID NO: 3905083 - RNA, 23 nt, Human adenovirus B [HAdV-B]
agcucauaggagcuggcuuucau

SEQ ID NO: 3905084 - RNA, 21 nt, Human adenovirus B [HAdV-B]
agcucaugcucuggacaugac

SEQ ID NO: 3905085 - RNA, 20 nt, Human adenovirus B [HAdV-B]
agcugaaauuacaaaagaag

SEQ ID NO: 3905086 - RNA, 19 nt, Human adenovirus B [HAdV-B]
agcugacuugucuccugaa

SEQ ID NO: 3905087 - RNA, 16 nt, Human adenovirus B [HAdV-B]
agcuguguacucccag

SEQ ID NO: 3905088 - RNA, 15 nt, Human adenovirus B [HAdV-B]
agcuugguuaccagu

SEQ ID NO: 3905089 - RNA, 16 nt, Human adenovirus B [HAdV-B]
agcuuuugcugugcca

SEQ ID NO: 3905090 - RNA, 16 nt, Human adenovirus B [HAdV-B]
aggaaaaggagcagag

SEQ ID NO: 3905091 - RNA, 21 nt, Human adenovirus B [HAdV-B]
aggaccagugcuuugagcgcg

SEQ ID NO: 3905092 - RNA, 22 nt, Human adenovirus B [HAdV-B]
aggagaaagagcaaccgugucu

SEQ ID NO: 3905093 - RNA, 13 nt, Human adenovirus B [HAdV-B]
caauccccacugg

SEQ ID NO: 3905094 - RNA, 23 nt, Human adenovirus B [HAdV-B]
caaugaauaaauaaacaagcuug

SEQ ID NO: 3905095 - RNA, 19 nt, Human adenovirus B [HAdV-B]
caaugaggcuuucagagag

SEQ ID NO: 3905096 - RNA, 22 nt, Human adenovirus B [HAdV-B]
caauggacucugacacuccugg

SEQ ID NO: 3905097 - RNA, 23 nt, Human adenovirus B [HAdV-B]
caauggaugguuuacaaaaccau

SEQ ID NO: 3905098 - RNA, 20 nt, Human adenovirus B [HAdV-B]
caaugucacucuuccagaaa

SEQ ID NO: 3905099 - RNA, 12 nt, Human adenovirus B [HAdV-B]
caauuguugcag

SEQ ID NO: 3905100 - RNA, 22 nt, Human adenovirus B [HAdV-B]
cacaaagcccaaacggaguucu

SEQ ID NO: 3905101 - RNA, 16 nt, Human adenovirus B [HAdV-B]
cacaacuuacacuaug

SEQ ID NO: 3905102 - RNA, 20 nt, Human adenovirus B [HAdV-B]
cacacaaagcacaagcucua

SEQ ID NO: 3905103 - RNA, 12 nt, Human adenovirus B [HAdV-B]
cacacagcagcg

SEQ ID NO: 3905104 - RNA, 21 nt, Human adenovirus B [HAdV-B]
cacacauuacaaacagguccc

SEQ ID NO: 3905105 - RNA, 14 nt, Human adenovirus B [HAdV-B]
cacauacaaagccu

SEQ ID NO: 3905106 - RNA, 14 nt, Human adenovirus B [HAdV-B]
cacauccaagaaca

SEQ ID NO: 3905107 - RNA, 15 nt, Human adenovirus B [HAdV-B]
cacauuccaccagcc

SEQ ID NO: 3905108 - RNA, 13 nt, Human adenovirus B [HAdV-B]
caccacaccacuc

SEQ ID NO: 3905109 - RNA, 17 nt, Human adenovirus B [HAdV-B]
caccauucuuaaacaca

SEQ ID NO: 3905110 - RNA, 22 nt, Human adenovirus B [HAdV-B]
caccauucuuaaacacacccuc

SEQ ID NO: 3905111 - RNA, 17 nt, Human adenovirus B [HAdV-B]
ccaaccaagcaaugcaa

SEQ ID NO: 3905112 - RNA, 16 nt, Human adenovirus B [HAdV-B]
ccaagaugcuggaaau

SEQ ID NO: 3905113 - RNA, 16 nt, Human adenovirus B [HAdV-B]
ccaaguagcaguuuac

SEQ ID NO: 3905114 - RNA, 17 nt, Human adenovirus B [HAdV-B]
ccaauuaucgcugcugc

SEQ ID NO: 3905115 - RNA, 17 nt, Human adenovirus B [HAdV-B]
ccacagggucuccagcu

SEQ ID NO: 3905116 - RNA, 14 nt, Human adenovirus B [HAdV-B]
ccaccacaccacuc

SEQ ID NO: 3905117 - RNA, 21 nt, Human adenovirus B [HAdV-B]
ccacccuaugucgucacaggc

SEQ ID NO: 3905118 - RNA, 21 nt, Human adenovirus B [HAdV-B]
ccagcgccaugacagacagag

SEQ ID NO: 3905119 - RNA, 15 nt, Human adenovirus B [HAdV-B]
ccagggucucagugu

SEQ ID NO: 3905120 - RNA, 15 nt, Human adenovirus B [HAdV-B]
ccagucgccguagcc

SEQ ID NO: 3905121 - RNA, 23 nt, Human adenovirus B [HAdV-B]
ccauaaccuacuacgccugcugc

SEQ ID NO: 3905122 - RNA, 20 nt, Human adenovirus B [HAdV-B]
ccaucuauuauuccuacucc

SEQ ID NO: 3905123 - RNA, 14 nt, Human adenovirus B [HAdV-B]
ccaugacagacaga

SEQ ID NO: 3905124 - RNA, 21 nt, Human adenovirus B [HAdV-B]
ccauguucaugagcaaacagu

SEQ ID NO: 3905125 - RNA, 18 nt, Human adenovirus B [HAdV-B]
ccauuagauauagacaug

SEQ ID NO: 3905126 - RNA, 14 nt, Human adenovirus B [HAdV-B]
ccauuaggaggcgc

SEQ ID NO: 3905127 - RNA, 23 nt, Human adenovirus B [HAdV-B]
ccauucucgagcugccagugcgc

SEQ ID NO: 3905128 - RNA, 17 nt, Human adenovirus B [HAdV-B]
ccauucuuaaacacacc

SEQ ID NO: 3905129 - RNA, 16 nt, Human adenovirus B [HAdV-B]
ccauuguguucuccua

SEQ ID NO: 3905130 - RNA, 16 nt, Human adenovirus B [HAdV-B]
cccaaugcaacaugac

SEQ ID NO: 3905131 - RNA, 16 nt, Human adenovirus B [HAdV-B]
cccagcagcaccucac

SEQ ID NO: 3905132 - RNA, 21 nt, Human adenovirus B [HAdV-B]
cccauggaugagcccacccug

SEQ ID NO: 3905133 - RNA, 15 nt, Human adenovirus B [HAdV-B]
ccccagcagccaagg

SEQ ID NO: 3905134 - RNA, 17 nt, Human adenovirus B [HAdV-B]
agaauuucuacugaaaa

SEQ ID NO: 3905135 - RNA, 20 nt, Human adenovirus B [HAdV-B]
aaaaauuucccaaacaaugg

SEQ ID NO: 3905136 - RNA, 12 nt, Human adenovirus B [HAdV-B]
aaaacaggacua

SEQ ID NO: 3905137 - RNA, 14 nt, Human adenovirus B [HAdV-B]
aaaaucaauucaca

SEQ ID NO: 3905138 - RNA, 19 nt, Human adenovirus B [HAdV-B]
aaacaccguuucuggggcg

SEQ ID NO: 3905139 - RNA, 13 nt, Human adenovirus B [HAdV-B]
aaaccugcugcuu

SEQ ID NO: 3905140 - RNA, 20 nt, Human adenovirus B [HAdV-B]
cacuggcugcccccaccugg

SEQ ID NO: 3905141 - RNA, 22 nt, Human adenovirus B [HAdV-B]
cacugguuuuuauugcuuuuug

SEQ ID NO: 3905142 - RNA, 20 nt, Human adenovirus B [HAdV-B]
cacuguauuacuuccucgag

SEQ ID NO: 3905143 - RNA, 19 nt, Human adenovirus B [HAdV-B]
cacuuagaagauacugagc

SEQ ID NO: 3905144 - RNA, 17 nt, Human adenovirus B [HAdV-B]
cagaacaaggaagacca

SEQ ID NO: 3905145 - RNA, 20 nt, Human adenovirus B [HAdV-B]
cagaaccuauuuagagacag

SEQ ID NO: 3905146 - RNA, 14 nt, Human adenovirus B [HAdV-B]
cagaacuugaaaga

SEQ ID NO: 3905147 - RNA, 18 nt, Human adenovirus B [HAdV-B]
cagaaugacccgcaggca

SEQ ID NO: 3905148 - RNA, 13 nt, Human adenovirus B [HAdV-B]
cagacacaucacu

SEQ ID NO: 3905149 - RNA, 23 nt, Human adenovirus B [HAdV-B]
cagaccauuaacuuugaugaacg

SEQ ID NO: 3905150 - RNA, 14 nt, Human adenovirus B [HAdV-B]
cagaggaacacauu

SEQ ID NO: 3905151 - RNA, 11 nt, Human adenovirus B [HAdV-B]
cagaggcuggu

SEQ ID NO: 3905152 - RNA, 16 nt, Human adenovirus B [HAdV-B]
cagauguacgcgaagc

SEQ ID NO: 3905153 - RNA, 14 nt, Human adenovirus B [HAdV-B]
cagcagcaccucac

SEQ ID NO: 3905154 - RNA, 19 nt, Human adenovirus B [HAdV-B]
cagcagcaggcgacggcgg

SEQ ID NO: 3905155 - RNA, 20 nt, Human adenovirus B [HAdV-B]
cagcaguacaggacaggcgc

SEQ ID NO: 3905156 - RNA, 22 nt, Human adenovirus B [HAdV-B]
cagcauuaucgcugcagugaca

SEQ ID NO: 3905157 - RNA, 12 nt, Human adenovirus B [HAdV-B]
cagccaacgagc

SEQ ID NO: 3905158 - RNA, 20 nt, Human adenovirus B [HAdV-B]
cagccauggcuuaccagaca

SEQ ID NO: 3905159 - RNA, 19 nt, Human adenovirus B [HAdV-B]
cagccccccucgcagcagc

SEQ ID NO: 3905160 - RNA, 15 nt, Human adenovirus B [HAdV-B]
cagccuguacuucuc

SEQ ID NO: 3905161 - RNA, 22 nt, Human adenovirus B [HAdV-B]
cagccuguacuucuccaucagc

SEQ ID NO: 3905162 - RNA, 23 nt, Human adenovirus B [HAdV-B]
cagcgccaugacagacagagggg

SEQ ID NO: 3905163 - RNA, 14 nt, Human adenovirus B [HAdV-B]
cagcugcugcagaa

SEQ ID NO: 3905164 - RNA, 12 nt, Human adenovirus B [HAdV-B]
caggaacugaaa

SEQ ID NO: 3905165 - RNA, 13 nt, Human adenovirus B [HAdV-B]
caggaacugaaaa

SEQ ID NO: 3905166 - RNA, 15 nt, Human adenovirus B [HAdV-B]
caggacagaaacaca

SEQ ID NO: 3905167 - RNA, 22 nt, Human adenovirus B [HAdV-B]
caggacaggcgcuuagaaauaa

SEQ ID NO: 3905168 - RNA, 16 nt, Human adenovirus B [HAdV-B]
caggacuacuccaccc

SEQ ID NO: 3905169 - RNA, 20 nt, Human adenovirus B [HAdV-B]
caggagaaauauucacugga

SEQ ID NO: 3905170 - RNA, 15 nt, Human adenovirus B [HAdV-B]
caggaucacagagac

SEQ ID NO: 3905171 - RNA, 15 nt, Human adenovirus B [HAdV-B]
caggcagcagcuccu

SEQ ID NO: 3905172 - RNA, 14 nt, Human adenovirus B [HAdV-B]
caggcggcugaccg

SEQ ID NO: 3905173 - RNA, 19 nt, Human adenovirus B [HAdV-B]
cagggcacacguggcugca

SEQ ID NO: 3905174 - RNA, 21 nt, Human adenovirus B [HAdV-B]
caggguuguuuccgucacagu

SEQ ID NO: 3905175 - RNA, 15 nt, Human adenovirus B [HAdV-B]
cagguggacgagcag

SEQ ID NO: 3905176 - RNA, 15 nt, Human adenovirus B [HAdV-B]
cagguuaucgcaccu

SEQ ID NO: 3905177 - RNA, 17 nt, Human adenovirus B [HAdV-B]
cagguuaucgcaccuga

SEQ ID NO: 3905178 - RNA, 18 nt, Human adenovirus B [HAdV-B]
caguacugguaacauggg

SEQ ID NO: 3905179 - RNA, 22 nt, Human adenovirus B [HAdV-B]
caguagaugggacgagaccgga

SEQ ID NO: 3905180 - RNA, 13 nt, Human adenovirus B [HAdV-B]
cagucaggcagag

SEQ ID NO: 3905181 - RNA, 16 nt, Human adenovirus B [HAdV-B]
cagucaggcagaggag

SEQ ID NO: 3905182 - RNA, 17 nt, Human adenovirus B [HAdV-B]
caguccugccaccaccu

SEQ ID NO: 3905183 - RNA, 11 nt, Human adenovirus B [HAdV-B]
cagucuccugc

SEQ ID NO: 3905184 - RNA, 13 nt, Human adenovirus B [HAdV-B]
cagucuggaggac

SEQ ID NO: 3905185 - RNA, 13 nt, Human adenovirus B [HAdV-B]
cagugcaggcagc

SEQ ID NO: 3905186 - RNA, 17 nt, Human adenovirus B [HAdV-B]
cagugcaggcagcagcu

SEQ ID NO: 3905187 - RNA, 21 nt, Human adenovirus B [HAdV-B]
caguggucagugaugagcagc

SEQ ID NO: 3905188 - RNA, 13 nt, Human adenovirus B [HAdV-B]
caguguaacauga

SEQ ID NO: 3905189 - RNA, 22 nt, Human adenovirus B [HAdV-B]
caguuagcuggcggcuccaccc

SEQ ID NO: 3905190 - RNA, 14 nt, Human adenovirus B [HAdV-B]
caguuucacauucc

SEQ ID NO: 3905191 - RNA, 19 nt, Human adenovirus B [HAdV-B]
cauaaucauugcagccaug

SEQ ID NO: 3905192 - RNA, 17 nt, Human adenovirus B [HAdV-B]
cauaggagcuggcuuuc

SEQ ID NO: 3905193 - RNA, 17 nt, Human adenovirus B [HAdV-B]
cauaguuauguuccuga

SEQ ID NO: 3905194 - RNA, 15 nt, Human adenovirus B [HAdV-B]
cauaucagccagaac

SEQ ID NO: 3905195 - RNA, 21 nt, Human adenovirus B [HAdV-B]
caucaaccucuaugcuacuuu

SEQ ID NO: 3905196 - RNA, 21 nt, Human adenovirus B [HAdV-B]
caucaccgaacccgaggggag

SEQ ID NO: 3905197 - RNA, 19 nt, Human adenovirus B [HAdV-B]
cauccaccggucaugccag

SEQ ID NO: 3905198 - RNA, 20 nt, Human adenovirus B [HAdV-B]
caucccgaauaccgcaacca

SEQ ID NO: 3905199 - RNA, 19 nt, Human adenovirus B [HAdV-B]
caucuagugguacugaugc

SEQ ID NO: 3905200 - RNA, 12 nt, Human adenovirus B [HAdV-B]
caucuuccagca

SEQ ID NO: 3905201 - RNA, 20 nt, Human adenovirus B [HAdV-B]
caucuuuuuuaaaaaucaaa

SEQ ID NO: 3905202 - RNA, 14 nt, Human adenovirus B [HAdV-B]
caugaaagccuuug

SEQ ID NO: 3905203 - RNA, 19 nt, Human adenovirus B [HAdV-B]
caugaaagccuuugcuguc

SEQ ID NO: 3905204 - RNA, 18 nt, Human adenovirus B [HAdV-B]
caugaauuggcucagcgc

SEQ ID NO: 3905205 - RNA, 16 nt, Human adenovirus B [HAdV-B]
caugcaugacccagau

SEQ ID NO: 3905206 - RNA, 16 nt, Human adenovirus B [HAdV-B]
cauggaaaucccaccc

SEQ ID NO: 3905207 - RNA, 13 nt, Human adenovirus B [HAdV-B]
caugggcaccugg

SEQ ID NO: 3905208 - RNA, 19 nt, Human adenovirus B [HAdV-B]
cauggguauucugcaugag

SEQ ID NO: 3905209 - RNA, 14 nt, Human adenovirus B [HAdV-B]
cauguaugcagaaa

SEQ ID NO: 3905210 - RNA, 22 nt, Human adenovirus B [HAdV-B]
cauuagggguguguuggacaga

SEQ ID NO: 3905211 - RNA, 17 nt, Human adenovirus B [HAdV-B]
cauugcuuauugcuugu

SEQ ID NO: 3905212 - RNA, 15 nt, Human adenovirus B [HAdV-B]
cauugucuuacugcc

SEQ ID NO: 3905213 - RNA, 18 nt, Human adenovirus B [HAdV-B]
cauuguggagaacaugga

SEQ ID NO: 3905214 - RNA, 18 nt, Human adenovirus B [HAdV-B]
cauuuucgcgcuccaugg

SEQ ID NO: 3905215 - RNA, 22 nt, Human adenovirus B [HAdV-B]
ccaaaacaacgagcagauaacu

SEQ ID NO: 3905216 - RNA, 14 nt, Human adenovirus B [HAdV-B]
ccaaacgccagaag

SEQ ID NO: 3905217 - RNA, 16 nt, Human adenovirus B [HAdV-B]
ccaaacggcaccugcg

SEQ ID NO: 3905218 - RNA, 11 nt, Human adenovirus B [HAdV-B]
ccaacaccugu

SEQ ID NO: 3905219 - RNA, 22 nt, Human adenovirus B [HAdV-B]
ccaacaccuuaaucccagaaau

SEQ ID NO: 3905220 - RNA, 23 nt, Human adenovirus B [HAdV-B]
ccaacgguuuuuugaaagaaaac

SEQ ID NO: 3905221 - RNA, 17 nt, Human adenovirus B [HAdV-B]
ccaauauuuuugcuucu

SEQ ID NO: 3905222 - RNA, 16 nt, Human adenovirus B [HAdV-B]
ccaccagguuguaucu

SEQ ID NO: 3905223 - RNA, 21 nt, Human adenovirus B [HAdV-B]
ccacccucgauuaugcaaggu

SEQ ID NO: 3905224 - RNA, 15 nt, Human adenovirus B [HAdV-B]
ccaccuccacugaag

SEQ ID NO: 3905225 - RNA, 19 nt, Human adenovirus B [HAdV-B]
ccacgccuuacauguggag

SEQ ID NO: 3905226 - RNA, 18 nt, Human adenovirus B [HAdV-B]
ccacuagacaagucagua

SEQ ID NO: 3905227 - RNA, 13 nt, Human adenovirus B [HAdV-B]
ccagaaaacaaaa

SEQ ID NO: 3905228 - RNA, 14 nt, Human adenovirus B [HAdV-B]
ccagaaaacaaaaa

SEQ ID NO: 3905229 - RNA, 16 nt, Human adenovirus B [HAdV-B]
ccagacaaaguacagc

SEQ ID NO: 3905230 - RNA, 19 nt, Human adenovirus B [HAdV-B]
ccagaccauuaacuuugau

SEQ ID NO: 3905231 - RNA, 17 nt, Human adenovirus B [HAdV-B]
ccagacucgcaguacuc

SEQ ID NO: 3905232 - RNA, 12 nt, Human adenovirus B [HAdV-B]
ccagcagcggca

SEQ ID NO: 3905233 - RNA, 20 nt, Human adenovirus B [HAdV-B]
ccagcgugaugccaaccugg

SEQ ID NO: 3905234 - RNA, 13 nt, Human adenovirus B [HAdV-B]
ccagggucucagu

SEQ ID NO: 3905235 - RNA, 15 nt, Human adenovirus B [HAdV-B]
ccagguggucucugg

SEQ ID NO: 3905236 - RNA, 15 nt, Human adenovirus B [HAdV-B]
gaugaaaacugccca

SEQ ID NO: 3905237 - RNA, 22 nt, Human adenovirus B [HAdV-B]
gaugaaaccuucucaguugcau

SEQ ID NO: 3905238 - RNA, 14 nt, Human adenovirus B [HAdV-B]
gaugaaaugacagg

SEQ ID NO: 3905239 - RNA, 14 nt, Human adenovirus B [HAdV-B]
gaugagacaguguc

SEQ ID NO: 3905240 - RNA, 13 nt, Human adenovirus B [HAdV-B]
gaugagaggccuu

SEQ ID NO: 3905241 - RNA, 19 nt, Human adenovirus B [HAdV-B]
gaugcaauccccacuggag

SEQ ID NO: 3905242 - RNA, 23 nt, Human adenovirus B [HAdV-B]
gaugcggcaucgcagaaaacaaa

SEQ ID NO: 3905243 - RNA, 15 nt, Human adenovirus B [HAdV-B]
gauggccguggugcu

SEQ ID NO: 3905244 - RNA, 20 nt, Human adenovirus B [HAdV-B]
gaugucucacgcuugccagc

SEQ ID NO: 3905245 - RNA, 14 nt, Human adenovirus B [HAdV-B]
gauucucacuugcc

SEQ ID NO: 3905246 - RNA, 18 nt, Human adenovirus B [HAdV-B]
gauucuuaacagugcagg

SEQ ID NO: 3905247 - RNA, 12 nt, Human adenovirus B [HAdV-B]
gauugcuggaau

SEQ ID NO: 3905248 - RNA, 16 nt, Human adenovirus B [HAdV-B]
gauuuuggcuggaaug

SEQ ID NO: 3905249 - RNA, 18 nt, Human adenovirus B [HAdV-B]
gcaaacucgaagagaauc

SEQ ID NO: 3905250 - RNA, 18 nt, Human adenovirus B [HAdV-B]
gcaaagccuacugccacc

SEQ ID NO: 3905251 - RNA, 14 nt, Human adenovirus B [HAdV-B]
gcaacauacaaaau

SEQ ID NO: 3905252 - RNA, 21 nt, Human adenovirus B [HAdV-B]
gcaacuccgacugcagcacug

SEQ ID NO: 3905253 - RNA, 14 nt, Human adenovirus B [HAdV-B]
gcaagggggccacc

SEQ ID NO: 3905254 - RNA, 13 nt, Human adenovirus B [HAdV-B]
gcaaguggaggaa

SEQ ID NO: 3905255 - RNA, 14 nt, Human adenovirus B [HAdV-B]
gcaaugacagaaug

SEQ ID NO: 3905256 - RNA, 16 nt, Human adenovirus B [HAdV-B]
gcacaacuacuuucuc

SEQ ID NO: 3905257 - RNA, 14 nt, Human adenovirus B [HAdV-B]
gcacccgucccccu

SEQ ID NO: 3905258 - RNA, 22 nt, Human adenovirus B [HAdV-B]
gcaccgucgcuuccgaccuggc

SEQ ID NO: 3905259 - RNA, 15 nt, Human adenovirus B [HAdV-B]
gcacuggacaugaca

SEQ ID NO: 3905260 - RNA, 22 nt, Human adenovirus B [HAdV-B]
gcacuuagaagauacugagcag

SEQ ID NO: 3905261 - RNA, 18 nt, Human adenovirus B [HAdV-B]
gcagaccucaucuuccca

SEQ ID NO: 3905262 - RNA, 22 nt, Human adenovirus B [HAdV-B]
gcagagucggggucaagagcag

SEQ ID NO: 3905263 - RNA, 17 nt, Human adenovirus B [HAdV-B]
gcagcacuggacaugac

SEQ ID NO: 3905264 - RNA, 15 nt, Human adenovirus B [HAdV-B]
gcagcagcaaucaca

SEQ ID NO: 3905265 - RNA, 12 nt, Human adenovirus B [HAdV-B]
gcagccaaggcg

SEQ ID NO: 3905266 - RNA, 20 nt, Human adenovirus B [HAdV-B]
gcagcuccuuuagccagagg

SEQ ID NO: 3905267 - RNA, 18 nt, Human adenovirus B [HAdV-B]
gcaggacagaaacacaga

SEQ ID NO: 3905268 - RNA, 12 nt, Human adenovirus B [HAdV-B]
gcaggcagcagc

SEQ ID NO: 3905269 - RNA, 18 nt, Human adenovirus B [HAdV-B]
gcaggcgccucccaggac

SEQ ID NO: 3905270 - RNA, 22 nt, Human adenovirus B [HAdV-B]
gcaggggacgcuacagugcagu

SEQ ID NO: 3905271 - RNA, 20 nt, Human adenovirus B [HAdV-B]
gcaguacaagcgcagaccuc

SEQ ID NO: 3905272 - RNA, 15 nt, Human adenovirus B [HAdV-B]
gcaguaucuggagcg

SEQ ID NO: 3905273 - RNA, 18 nt, Human adenovirus B [HAdV-B]
gcaguuauugacagugua

SEQ ID NO: 3905274 - RNA, 21 nt, Human adenovirus B [HAdV-B]
gcaguuggggauacuuaugau

SEQ ID NO: 3905275 - RNA, 15 nt, Human adenovirus B [HAdV-B]
gcaucucaugacaug

SEQ ID NO: 3905276 - RNA, 18 nt, Human adenovirus B [HAdV-B]
gcaucucaugacaugcag

SEQ ID NO: 3905277 - RNA, 20 nt, Human adenovirus B [HAdV-B]
gcauuaucgcugcagugaca

SEQ ID NO: 3905278 - RNA, 15 nt, Human adenovirus B [HAdV-B]
gcauuauuggacaga

SEQ ID NO: 3905279 - RNA, 20 nt, Human adenovirus B [HAdV-B]
gccaccuccacugaagugca

SEQ ID NO: 3905280 - RNA, 22 nt, Human adenovirus B [HAdV-B]
gccaccucguucaucauuuccc

SEQ ID NO: 3905281 - RNA, 21 nt, Human adenovirus B [HAdV-B]
gccagacucgcaguacucaag

SEQ ID NO: 3905282 - RNA, 17 nt, Human adenovirus B [HAdV-B]
gccagcacccagaccau

SEQ ID NO: 3905283 - RNA, 21 nt, Human adenovirus B [HAdV-B]
gccagggcacacguggcugca

SEQ ID NO: 3905284 - RNA, 20 nt, Human adenovirus B [HAdV-B]
gccaucaucuccugcuugca

SEQ ID NO: 3905285 - RNA, 19 nt, Human adenovirus B [HAdV-B]
gccaucuuccagcagaguc

SEQ ID NO: 3905286 - RNA, 20 nt, Human adenovirus B [HAdV-B]
gccauucucgagcugccagu

SEQ ID NO: 3905287 - RNA, 13 nt, Human adenovirus B [HAdV-B]
gccauuugccauu

SEQ ID NO: 3905288 - RNA, 21 nt, Human adenovirus B [HAdV-B]
gcccaaucgcgaagaggcaau

SEQ ID NO: 3905289 - RNA, 18 nt, Human adenovirus B [HAdV-B]
gcccaucaguguggaaga

SEQ ID NO: 3905290 - RNA, 20 nt, Human adenovirus B [HAdV-B]
gccccuacuauagccagcaa

SEQ ID NO: 3905291 - RNA, 16 nt, Human adenovirus B [HAdV-B]
gcccucaagggccgca

SEQ ID NO: 3905292 - RNA, 11 nt, Human adenovirus B [HAdV-B]
gccggacagga

SEQ ID NO: 3905293 - RNA, 17 nt, Human adenovirus B [HAdV-B]
gccguagacgccagcgc

SEQ ID NO: 3905294 - RNA, 16 nt, Human adenovirus B [HAdV-B]
gccuacugccaccucc

SEQ ID NO: 3905295 - RNA, 23 nt, Human adenovirus B [HAdV-B]
gccuggacccuccaguggaggag

SEQ ID NO: 3905296 - RNA, 20 nt, Human adenovirus B [HAdV-B]
gcgacagggaacugaugcac

SEQ ID NO: 3905297 - RNA, 17 nt, Human adenovirus B [HAdV-B]
gcgccgcgacggcagga

SEQ ID NO: 3905298 - RNA, 19 nt, Human adenovirus B [HAdV-B]
gcgcgguuagcgccagcag

SEQ ID NO: 3905299 - RNA, 22 nt, Human adenovirus B [HAdV-B]
gcgcgguuagcgccagcaggag

SEQ ID NO: 3905300 - RNA, 20 nt, Human adenovirus B [HAdV-B]
gcgcuuugggacaggaagac

SEQ ID NO: 3905301 - RNA, 17 nt, Human adenovirus B [HAdV-B]
gcggaguagcugacuug

SEQ ID NO: 3905302 - RNA, 18 nt, Human adenovirus B [HAdV-B]
gcggaugacuggcagaac

SEQ ID NO: 3905303 - RNA, 14 nt, Human adenovirus B [HAdV-B]
gcggcgauagaaug

SEQ ID NO: 3905304 - RNA, 14 nt, Human adenovirus B [HAdV-B]
gcgggucgugagcu

SEQ ID NO: 3905305 - RNA, 17 nt, Human adenovirus B [HAdV-B]
gcguccagcgcugccag

SEQ ID NO: 3905306 - RNA, 21 nt, Human adenovirus B [HAdV-B]
gcuaacccgauggcugggcac

SEQ ID NO: 3905307 - RNA, 12 nt, Human adenovirus B [HAdV-B]
gcuacugcugua

SEQ ID NO: 3905308 - RNA, 14 nt, Human adenovirus B [HAdV-B]
gcuauacuaccaau

SEQ ID NO: 3905309 - RNA, 13 nt, Human adenovirus B [HAdV-B]
gcucaccaccuca

SEQ ID NO: 3905310 - RNA, 17 nt, Human adenovirus B [HAdV-B]
gcuccagcaaaaacaag

SEQ ID NO: 3905311 - RNA, 19 nt, Human adenovirus B [HAdV-B]
gcucccuuugugccuccgc

SEQ ID NO: 3905312 - RNA, 20 nt, Human adenovirus B [HAdV-B]
gcuccgguauccugcccgcc

SEQ ID NO: 3905313 - RNA, 18 nt, Human adenovirus B [HAdV-B]
gcuccuucugaaucauaa

SEQ ID NO: 3905314 - RNA, 22 nt, Human adenovirus B [HAdV-B]
gcucuaccccauuccugccaau

SEQ ID NO: 3905315 - RNA, 17 nt, Human adenovirus B [HAdV-B]
gcugccccgaaaccagu

SEQ ID NO: 3905316 - RNA, 15 nt, Human adenovirus B [HAdV-B]
gcugcgcacugcccu

SEQ ID NO: 3905317 - RNA, 22 nt, Human adenovirus B [HAdV-B]
gcuggaaccgagggugagaauu

SEQ ID NO: 3905318 - RNA, 15 nt, Human adenovirus B [HAdV-B]
gcuggcggcuccacc

SEQ ID NO: 3905319 - RNA, 18 nt, Human adenovirus B [HAdV-B]
gcuguuucugguggugca

SEQ ID NO: 3905320 - RNA, 14 nt, Human adenovirus B [HAdV-B]
gcuuacaacucccu

SEQ ID NO: 3905321 - RNA, 15 nt, Human adenovirus B [HAdV-B]
gcuucgugcccguug

SEQ ID NO: 3905322 - RNA, 19 nt, Human adenovirus B [HAdV-B]
gcuugggcgcuugccaggg

SEQ ID NO: 3905323 - RNA, 20 nt, Human adenovirus B [HAdV-B]
ggaaaacgaggaggcagagg

SEQ ID NO: 3905324 - RNA, 12 nt, Human adenovirus B [HAdV-B]
ggaaauggggcu

SEQ ID NO: 3905325 - RNA, 20 nt, Human adenovirus B [HAdV-B]
ggaacaaagcuuggaacagc

SEQ ID NO: 3905326 - RNA, 15 nt, Human adenovirus B [HAdV-B]
ggaacacgaggaaga

SEQ ID NO: 3905327 - RNA, 14 nt, Human adenovirus B [HAdV-B]
ggaagacugauggc

SEQ ID NO: 3905328 - RNA, 22 nt, Human adenovirus B [HAdV-B]
ggaauguuuaugccuuaccagu

SEQ ID NO: 3905329 - RNA, 21 nt, Human adenovirus B [HAdV-B]
ggacagaggucccaguuucaa

SEQ ID NO: 3905330 - RNA, 18 nt, Human adenovirus B [HAdV-B]
ggacauugcuucucugaa

SEQ ID NO: 3905331 - RNA, 14 nt, Human adenovirus B [HAdV-B]
ggacuacuccaccc

SEQ ID NO: 3905332 - RNA, 20 nt, Human adenovirus B [HAdV-B]
ggaggcagaggagguggaag

SEQ ID NO: 3905333 - RNA, 23 nt, Human adenovirus B [HAdV-B]
ggaggcagggcucucaaacccga

SEQ ID NO: 3905334 - RNA, 15 nt, Human adenovirus B [HAdV-B]
ggaggcuauguggga

SEQ ID NO: 3905335 - RNA, 12 nt, Human adenovirus B [HAdV-B]
ggagggcagaaa

SEQ ID NO: 3905336 - RNA, 22 nt, Human adenovirus B [HAdV-B]
ggaugggugagugcagaggcau

SEQ ID NO: 3905337 - RNA, 12 nt, Human adenovirus B [HAdV-B]
ggauuuggaaga

SEQ ID NO: 3905338 - RNA, 15 nt, Human adenovirus B [HAdV-B]
cggaggaggacaguc

SEQ ID NO: 3905339 - RNA, 17 nt, Human adenovirus B [HAdV-B]
cggaggguccuccuccu

SEQ ID NO: 3905340 - RNA, 18 nt, Human adenovirus B [HAdV-B]
cggcaacugccgucuucu

SEQ ID NO: 3905341 - RNA, 15 nt, Human adenovirus B [HAdV-B]
cggccagacgugcag

SEQ ID NO: 3905342 - RNA, 14 nt, Human adenovirus B [HAdV-B]
cggcgcugcagagc

SEQ ID NO: 3905343 - RNA, 15 nt, Human adenovirus B [HAdV-B]
cgggcggcgcugcag

SEQ ID NO: 3905344 - RNA, 21 nt, Human adenovirus B [HAdV-B]
cggguuaaaaaggacaaaaaa

SEQ ID NO: 3905345 - RNA, 18 nt, Human adenovirus B [HAdV-B]
cgguucaggccucgcaac

SEQ ID NO: 3905346 - RNA, 18 nt, Human adenovirus B [HAdV-B]
cguagaggaauguuuaug

SEQ ID NO: 3905347 - RNA, 22 nt, Human adenovirus B [HAdV-B]
cgucagugaaaacguuccugcu

SEQ ID NO: 3905348 - RNA, 22 nt, Human adenovirus B [HAdV-B]
cgucgccguagacgcacaagca

SEQ ID NO: 3905349 - RNA, 12 nt, Human adenovirus B [HAdV-B]
cgucgcugcuuu

SEQ ID NO: 3905350 - RNA, 15 nt, Human adenovirus B [HAdV-B]
cgugaugcagcagca

SEQ ID NO: 3905351 - RNA, 14 nt, Human adenovirus B [HAdV-B]
cgugcugcacagca

SEQ ID NO: 3905352 - RNA, 18 nt, Human adenovirus B [HAdV-B]
cguguuacccaguugaaa

SEQ ID NO: 3905353 - RNA, 15 nt, Human adenovirus B [HAdV-B]
cguguugcucaggca

SEQ ID NO: 3905354 - RNA, 20 nt, Human adenovirus B [HAdV-B]
cuaaaggcgcuccaaauaca

SEQ ID NO: 3905355 - RNA, 23 nt, Human adenovirus B [HAdV-B]
cuaacaaccacaggcggaucucu

SEQ ID NO: 3905356 - RNA, 15 nt, Human adenovirus B [HAdV-B]
cuaaugauugcaaau

SEQ ID NO: 3905357 - RNA, 18 nt, Human adenovirus B [HAdV-B]
cuacacaguguacguagc

SEQ ID NO: 3905358 - RNA, 18 nt, Human adenovirus B [HAdV-B]
cuacaucuacuguggaug

SEQ ID NO: 3905359 - RNA, 13 nt, Human adenovirus B [HAdV-B]
cuaccgccagugc

SEQ ID NO: 3905360 - RNA, 19 nt, Human adenovirus B [HAdV-B]
cuacggaagccagcaccca

SEQ ID NO: 3905361 - RNA, 16 nt, Human adenovirus B [HAdV-B]
cuacuggucgcuucca

SEQ ID NO: 3905362 - RNA, 17 nt, Human adenovirus B [HAdV-B]
cuagaucgugggccaug

SEQ ID NO: 3905363 - RNA, 21 nt, Human adenovirus B [HAdV-B]
cuaggacaaagcgugcugcac

SEQ ID NO: 3905364 - RNA, 14 nt, Human adenovirus B [HAdV-B]
cuaggcaacuguua

SEQ ID NO: 3905365 - RNA, 11 nt, Human adenovirus B [HAdV-B]
cuaggcagaga

SEQ ID NO: 3905366 - RNA, 19 nt, Human adenovirus B [HAdV-B]
cuaucagaaugaccacagc

SEQ ID NO: 3905367 - RNA, 18 nt, Human adenovirus B [HAdV-B]
cuaucuguaccugugcca

SEQ ID NO: 3905368 - RNA, 23 nt, Human adenovirus B [HAdV-B]
cuaugacuauugauuugaugaac

SEQ ID NO: 3905369 - RNA, 21 nt, Human adenovirus B [HAdV-B]
cuauggagucacugcuaccug

SEQ ID NO: 3905370 - RNA, 14 nt, Human adenovirus B [HAdV-B]
cuauuuagagacag

SEQ ID NO: 3905371 - RNA, 22 nt, Human adenovirus B [HAdV-B]
cucaacacaagguucccucagg

SEQ ID NO: 3905372 - RNA, 15 nt, Human adenovirus B [HAdV-B]
cucaaugcuucuuuu

SEQ ID NO: 3905373 - RNA, 21 nt, Human adenovirus B [HAdV-B]
cucacuauucaaccuguagaa

SEQ ID NO: 3905374 - RNA, 20 nt, Human adenovirus B [HAdV-B]
cucauauuugucagcauugu

SEQ ID NO: 3905375 - RNA, 16 nt, Human adenovirus B [HAdV-B]
cuccagcaaaaacaag

SEQ ID NO: 3905376 - RNA, 22 nt, Human adenovirus B [HAdV-B]
cucccagcagcaccucacuucc

SEQ ID NO: 3905377 - RNA, 13 nt, Human adenovirus B [HAdV-B]
cucccaggacuac

SEQ ID NO: 3905378 - RNA, 14 nt, Human adenovirus B [HAdV-B]
cucccccugcugcu

SEQ ID NO: 3905379 - RNA, 13 nt, Human adenovirus B [HAdV-B]
cuccuaggcagag

SEQ ID NO: 3905380 - RNA, 23 nt, Human adenovirus B [HAdV-B]
cucgagcaacuucaugucuaugg

SEQ ID NO: 3905381 - RNA, 21 nt, Human adenovirus B [HAdV-B]
cucgcacuuagaagauacuga

SEQ ID NO: 3905382 - RNA, 15 nt, Human adenovirus B [HAdV-B]
cucuagcagcagugu

SEQ ID NO: 3905383 - RNA, 20 nt, Human adenovirus B [HAdV-B]
cucucccagggauuuggaag

SEQ ID NO: 3905384 - RNA, 19 nt, Human adenovirus B [HAdV-B]
cucugacuggagcuggaac

SEQ ID NO: 3905385 - RNA, 15 nt, Human adenovirus B [HAdV-B]
cucugggaugcaaau

SEQ ID NO: 3905386 - RNA, 17 nt, Human adenovirus B [HAdV-B]
cucuuccagaaaacaaa

SEQ ID NO: 3905387 - RNA, 14 nt, Human adenovirus B [HAdV-B]
cucuuccucacugu

SEQ ID NO: 3905388 - RNA, 11 nt, Human adenovirus B [HAdV-B]
cucuuucugau

SEQ ID NO: 3905389 - RNA, 15 nt, Human adenovirus B [HAdV-B]
cugacacuccugguc

SEQ ID NO: 3905390 - RNA, 15 nt, Human adenovirus B [HAdV-B]
cugacuugcaguggc

SEQ ID NO: 3905391 - RNA, 13 nt, Human adenovirus B [HAdV-B]
cugacuugucucc

SEQ ID NO: 3905392 - RNA, 19 nt, Human adenovirus B [HAdV-B]
cugacuuuaugagccagag

SEQ ID NO: 3905393 - RNA, 21 nt, Human adenovirus B [HAdV-B]
cugauuauuucaccaaugcca

SEQ ID NO: 3905394 - RNA, 21 nt, Human adenovirus B [HAdV-B]
cugcaacgaauuuucucccag

SEQ ID NO: 3905395 - RNA, 15 nt, Human adenovirus B [HAdV-B]
cugcaaucugugcac

SEQ ID NO: 3905396 - RNA, 13 nt, Human adenovirus B [HAdV-B]
cugcacagcaccc

SEQ ID NO: 3905397 - RNA, 23 nt, Human adenovirus B [HAdV-B]
cugcacagccggcaucauucaca

SEQ ID NO: 3905398 - RNA, 18 nt, Human adenovirus B [HAdV-B]
cugccaugcgagccgcaa

SEQ ID NO: 3905399 - RNA, 18 nt, Human adenovirus B [HAdV-B]
cugcccaaaacaacgagc

SEQ ID NO: 3905400 - RNA, 18 nt, Human adenovirus B [HAdV-B]
cugcccgccaccugcugc

SEQ ID NO: 3905401 - RNA, 19 nt, Human adenovirus B [HAdV-B]
cugcggagcagagcagguc

SEQ ID NO: 3905402 - RNA, 18 nt, Human adenovirus B [HAdV-B]
cugcguauguagcauagu

SEQ ID NO: 3905403 - RNA, 22 nt, Human adenovirus B [HAdV-B]
cuggaacagaagacacaaguuc

SEQ ID NO: 3905404 - RNA, 20 nt, Human adenovirus B [HAdV-B]
cuggacuacuugcacagagc

SEQ ID NO: 3905405 - RNA, 22 nt, Human adenovirus B [HAdV-B]
cuggaggacagucuggaggaag

SEQ ID NO: 3905406 - RNA, 21 nt, Human adenovirus B [HAdV-B]
cuggaugguaccuucuaccug

SEQ ID NO: 3905407 - RNA, 15 nt, Human adenovirus B [HAdV-B]
cuggauuuccugcca

SEQ ID NO: 3905408 - RNA, 22 nt, Human adenovirus B [HAdV-B]
cuggcagaacaaggaagaccac

SEQ ID NO: 3905409 - RNA, 21 nt, Human adenovirus B [HAdV-B]
cuggccgagaagguggcugcc

SEQ ID NO: 3905410 - RNA, 21 nt, Human adenovirus B [HAdV-B]
cuguacuucuccaucagcaga

SEQ ID NO: 3905411 - RNA, 23 nt, Human adenovirus B [HAdV-B]
cuguacuucuccaucagcagaca

SEQ ID NO: 3905412 - RNA, 11 nt, Human adenovirus B [HAdV-B]
cuguggcuuuu

SEQ ID NO: 3905413 - RNA, 19 nt, Human adenovirus B [HAdV-B]
cuguuaaaaaccugcugcu

SEQ ID NO: 3905414 - RNA, 22 nt, Human adenovirus B [HAdV-B]
cuguuucugguggugcaacaca

SEQ ID NO: 3905415 - RNA, 21 nt, Human adenovirus B [HAdV-B]
cuuaaagaguaggcagcgacc

SEQ ID NO: 3905416 - RNA, 20 nt, Human adenovirus B [HAdV-B]
cuuaacagugcaggcagcag

SEQ ID NO: 3905417 - RNA, 14 nt, Human adenovirus B [HAdV-B]
cuuacgagcagaca

SEQ ID NO: 3905418 - RNA, 18 nt, Human adenovirus B [HAdV-B]
cuuacuugaaaucagcaa

SEQ ID NO: 3905419 - RNA, 16 nt, Human adenovirus B [HAdV-B]
cuucaacauccaggaa

SEQ ID NO: 3905420 - RNA, 21 nt, Human adenovirus B [HAdV-B]
cuuccaaggaugagacagugu

SEQ ID NO: 3905421 - RNA, 21 nt, Human adenovirus B [HAdV-B]
cuucccauuuaacagaauaca

SEQ ID NO: 3905422 - RNA, 18 nt, Human adenovirus B [HAdV-B]
cuucuccaucagcagaca

SEQ ID NO: 3905423 - RNA, 14 nt, Human adenovirus B [HAdV-B]
cuucuccugggcaa

SEQ ID NO: 3905424 - RNA, 22 nt, Human adenovirus B [HAdV-B]
cuucucgcaacugggcggcuuu

SEQ ID NO: 3905425 - RNA, 12 nt, Human adenovirus B [HAdV-B]
cuucuugcuuac

SEQ ID NO: 3905426 - RNA, 19 nt, Human adenovirus B [HAdV-B]
cuuucagaagacaugcaug

SEQ ID NO: 3905427 - RNA, 13 nt, Human adenovirus B [HAdV-B]
cuuucuaaaaaaa

SEQ ID NO: 3905428 - RNA, 18 nt, Human adenovirus B [HAdV-B]
cuuuuaaaacgcacugug

SEQ ID NO: 3905429 - RNA, 14 nt, Human adenovirus B [HAdV-B]
cuuuugcugugcca

SEQ ID NO: 3905430 - RNA, 14 nt, Human adenovirus B [HAdV-B]
gaaacgcuuucuag

SEQ ID NO: 3905431 - RNA, 22 nt, Human adenovirus B [HAdV-B]
gaaagcaucauauugcuugaaa

SEQ ID NO: 3905432 - RNA, 20 nt, Human adenovirus B [HAdV-B]
gaaagguuccagcgugaugc

SEQ ID NO: 3905433 - RNA, 15 nt, Human adenovirus B [HAdV-B]
gaaaguggguagaca

SEQ ID NO: 3905434 - RNA, 16 nt, Human adenovirus B [HAdV-B]
gaaaucuugaaaucac

SEQ ID NO: 3905435 - RNA, 23 nt, Human adenovirus B [HAdV-B]
gaacaauaccuuauccaccacau

SEQ ID NO: 3905436 - RNA, 15 nt, Human adenovirus B [HAdV-B]
gaacagcaagaggac

SEQ ID NO: 3905437 - RNA, 21 nt, Human adenovirus B [HAdV-B]
gaaccacacugccaacaccgc

SEQ ID NO: 3905438 - RNA, 16 nt, Human adenovirus B [HAdV-B]
gaacugaagugcccau

SEQ ID NO: 3905439 - RNA, 14 nt, Human adenovirus B [HAdV-B]
gaacugaugcacag

SEQ ID NO: 3905440 - RNA, 20 nt, Human adenovirus B [HAdV-B]
ugacagugccgguugagaug

SEQ ID NO: 3905441 - RNA, 21 nt, Human adenovirus B [HAdV-B]
ugacauaucugucaugcuuaa

SEQ ID NO: 3905442 - RNA, 19 nt, Human adenovirus B [HAdV-B]
ugaccaugacuuugagaaa

SEQ ID NO: 3905443 - RNA, 23 nt, Human adenovirus B [HAdV-B]
ugacguucccucaaaaacacacu

SEQ ID NO: 3905444 - RNA, 20 nt, Human adenovirus B [HAdV-B]
ugagcgccgcgacggcagga

SEQ ID NO: 3905445 - RNA, 16 nt, Human adenovirus B [HAdV-B]
ugagcugggaugggug

SEQ ID NO: 3905446 - RNA, 23 nt, Human adenovirus B [HAdV-B]
ugaggccugauaaacaguauaag

SEQ ID NO: 3905447 - RNA, 18 nt, Human adenovirus B [HAdV-B]
ugaguuuaauggcuagau

SEQ ID NO: 3905448 - RNA, 16 nt, Human adenovirus B [HAdV-B]
ugaucacaaugugaug

SEQ ID NO: 3905449 - RNA, 22 nt, Human adenovirus B [HAdV-B]
ugaugcaauccccacuggaggc

SEQ ID NO: 3905450 - RNA, 13 nt, Human adenovirus B [HAdV-B]
ugauugccacaga

SEQ ID NO: 3905451 - RNA, 17 nt, Human adenovirus B [HAdV-B]
ugauuugcggugcuucc

SEQ ID NO: 3905452 - RNA, 13 nt, Human adenovirus B [HAdV-B]
ugcaaaacaauga

SEQ ID NO: 3905453 - RNA, 21 nt, Human adenovirus B [HAdV-B]
ugcaacuggauuguguuucaa

SEQ ID NO: 3905454 - RNA, 12 nt, Human adenovirus B [HAdV-B]
ugcaagauaucu

SEQ ID NO: 3905455 - RNA, 18 nt, Human adenovirus B [HAdV-B]
ugcaccuacacccugcug

SEQ ID NO: 3905456 - RNA, 16 nt, Human adenovirus B [HAdV-B]
ugcagaaaucuuccca

SEQ ID NO: 3905457 - RNA, 19 nt, Human adenovirus B [HAdV-B]
ugcagacgguaaaucugag

SEQ ID NO: 3905458 - RNA, 23 nt, Human adenovirus B [HAdV-B]
ugcagaggcauacaugccacaga

SEQ ID NO: 3905459 - RNA, 20 nt, Human adenovirus B [HAdV-B]
ugcagcacuggacaugacag

SEQ ID NO: 3905460 - RNA, 16 nt, Human adenovirus B [HAdV-B]
ugcagcuaacaugcuc

SEQ ID NO: 3905461 - RNA, 16 nt, Human adenovirus B [HAdV-B]
ugcaggagcggagccu

SEQ ID NO: 3905462 - RNA, 20 nt, Human adenovirus B [HAdV-B]
ugccaccuccacugaagugc

SEQ ID NO: 3905463 - RNA, 23 nt, Human adenovirus B [HAdV-B]
ugccaccuccacugaagugcaaa

SEQ ID NO: 3905464 - RNA, 20 nt, Human adenovirus B [HAdV-B]
ugccagcacggugggaucug

SEQ ID NO: 3905465 - RNA, 15 nt, Human adenovirus B [HAdV-B]
ugccaucaauuacuc

SEQ ID NO: 3905466 - RNA, 17 nt, Human adenovirus B [HAdV-B]
ugccaucuuccagcaga

SEQ ID NO: 3905467 - RNA, 18 nt, Human adenovirus B [HAdV-B]
ugccaucuuccagcagag

SEQ ID NO: 3905468 - RNA, 16 nt, Human adenovirus B [HAdV-B]
ugccaugcaggcacuu

SEQ ID NO: 3905469 - RNA, 23 nt, Human adenovirus B [HAdV-B]
ugcccuacucaaucugggaccug

SEQ ID NO: 3905470 - RNA, 17 nt, Human adenovirus B [HAdV-B]
ugcuacagcugcugcag

SEQ ID NO: 3905471 - RNA, 18 nt, Human adenovirus B [HAdV-B]
ugcuauuaguuacuucaa

SEQ ID NO: 3905472 - RNA, 16 nt, Human adenovirus B [HAdV-B]
ugcucacuugugcugg

SEQ ID NO: 3905473 - RNA, 21 nt, Human adenovirus B [HAdV-B]
ugcuuaacaauuuucgcucuu

SEQ ID NO: 3905474 - RNA, 14 nt, Human adenovirus B [HAdV-B]
uggaaacucagcca

SEQ ID NO: 3905475 - RNA, 16 nt, Human adenovirus B [HAdV-B]
uggaagccacucugaa

SEQ ID NO: 3905476 - RNA, 16 nt, Human adenovirus B [HAdV-B]
uggacauugcucacca

SEQ ID NO: 3905477 - RNA, 13 nt, Human adenovirus B [HAdV-B]
uggauaaaucagu

SEQ ID NO: 3905478 - RNA, 17 nt, Human adenovirus B [HAdV-B]
uggauccagauauucaa

SEQ ID NO: 3905479 - RNA, 13 nt, Human adenovirus B [HAdV-B]
uggaugccaugga

SEQ ID NO: 3905480 - RNA, 19 nt, Human adenovirus B [HAdV-B]
uggauguagaugccuauga

SEQ ID NO: 3905481 - RNA, 13 nt, Human adenovirus B [HAdV-B]
uggauuuccugcc

SEQ ID NO: 3905482 - RNA, 14 nt, Human adenovirus B [HAdV-B]
uggcagaacacacu

SEQ ID NO: 3905483 - RNA, 17 nt, Human adenovirus B [HAdV-B]
uggcuccgaccaugcgc

SEQ ID NO: 3905484 - RNA, 19 nt, Human adenovirus B [HAdV-B]
ugggagcugacuugcagug

SEQ ID NO: 3905485 - RNA, 16 nt, Human adenovirus B [HAdV-B]
ugggcgcuugccaggg

SEQ ID NO: 3905486 - RNA, 16 nt, Human adenovirus B [HAdV-B]
uggggccgugggcagc

SEQ ID NO: 3905487 - RNA, 14 nt, Human adenovirus B [HAdV-B]
uggggcgaagagcc

SEQ ID NO: 3905488 - RNA, 14 nt, Human adenovirus B [HAdV-B]
uggguauaauuaug

SEQ ID NO: 3905489 - RNA, 19 nt, Human adenovirus B [HAdV-B]
uggucagugaugagcagcu

SEQ ID NO: 3905490 - RNA, 15 nt, Human adenovirus B [HAdV-B]
uggucuccaugaguu

SEQ ID NO: 3905491 - RNA, 20 nt, Human adenovirus B [HAdV-B]
uggucuggggguacaaacug

SEQ ID NO: 3905492 - RNA, 13 nt, Human adenovirus B [HAdV-B]
uggugaacaccaa

SEQ ID NO: 3905493 - RNA, 13 nt, Human adenovirus B [HAdV-B]
uguagaaaaagau

SEQ ID NO: 3905494 - RNA, 14 nt, Human adenovirus B [HAdV-B]
ugucaaccaggggg

SEQ ID NO: 3905495 - RNA, 22 nt, Human adenovirus B [HAdV-B]
ugucauagacguagaugggauc

SEQ ID NO: 3905496 - RNA, 20 nt, Human adenovirus B [HAdV-B]
ugugacagugcaauguaaua

SEQ ID NO: 3905497 - RNA, 23 nt, Human adenovirus B [HAdV-B]
uguguccuccaagauuuuccaug

SEQ ID NO: 3905498 - RNA, 14 nt, Human adenovirus B [HAdV-B]
ugugucugaaggaa

SEQ ID NO: 3905499 - RNA, 14 nt, Human adenovirus B [HAdV-B]
uguuaauucaucug

SEQ ID NO: 3905500 - RNA, 17 nt, Human adenovirus B [HAdV-B]
uguuagcaucaguuaac

SEQ ID NO: 3905501 - RNA, 18 nt, Human adenovirus B [HAdV-B]
uguucaauaaacaucacu

SEQ ID NO: 3905502 - RNA, 13 nt, Human adenovirus B [HAdV-B]
uguucccagaguu

SEQ ID NO: 3905503 - RNA, 22 nt, Human adenovirus B [HAdV-B]
uguucccagaguuggaagucua

SEQ ID NO: 3905504 - RNA, 22 nt, Human adenovirus B [HAdV-B]
uguucuccuaggcagagaaaca

SEQ ID NO: 3905505 - RNA, 14 nt, Human adenovirus B [HAdV-B]
uguuucaagcagga

SEQ ID NO: 3905506 - RNA, 17 nt, Human adenovirus B [HAdV-B]
uguuuccgucacaguga

SEQ ID NO: 3905507 - RNA, 23 nt, Human adenovirus B [HAdV-B]
uguuuucuuagagauggaagaca

SEQ ID NO: 3905508 - RNA, 16 nt, Human adenovirus B [HAdV-B]
uuaagauucccacuga

SEQ ID NO: 3905509 - RNA, 18 nt, Human adenovirus B [HAdV-B]
uuaagauucccacugaaa

SEQ ID NO: 3905510 - RNA, 18 nt, Human adenovirus B [HAdV-B]
uuaccagacaaaguacag

SEQ ID NO: 3905511 - RNA, 16 nt, Human adenovirus B [HAdV-B]
uuaccaguguaacaug

SEQ ID NO: 3905512 - RNA, 15 nt, Human adenovirus B [HAdV-B]
uuacuuugccagaag

SEQ ID NO: 3905513 - RNA, 23 nt, Human adenovirus B [HAdV-B]
uuagacagcaaccccaggccaac

SEQ ID NO: 3905514 - RNA, 20 nt, Human adenovirus B [HAdV-B]
uuaggccgucuuuggggugg

SEQ ID NO: 3905515 - RNA, 14 nt, Human adenovirus B [HAdV-B]
uuaucaaaugcuca

SEQ ID NO: 3905516 - RNA, 13 nt, Human adenovirus B [HAdV-B]
uucccucuuccca

SEQ ID NO: 3905517 - RNA, 19 nt, Human adenovirus B [HAdV-B]
uuccucgagacgcccaggc

SEQ ID NO: 3905518 - RNA, 15 nt, Human adenovirus B [HAdV-B]
uucgcugucuugacu

SEQ ID NO: 3905519 - RNA, 13 nt, Human adenovirus B [HAdV-B]
uucggaacuggca

SEQ ID NO: 3905520 - RNA, 23 nt, Human adenovirus B [HAdV-B]
uucggacggagucuccgguuuuu

SEQ ID NO: 3905521 - RNA, 19 nt, Human adenovirus B [HAdV-B]
uucuaacuccucaaucauc

SEQ ID NO: 3905522 - RNA, 22 nt, Human adenovirus B [HAdV-B]
uucugaucaucgcacguggaaa

SEQ ID NO: 3905523 - RNA, 18 nt, Human adenovirus B [HAdV-B]
uucuucgcugucuugacu

SEQ ID NO: 3905524 - RNA, 20 nt, Human adenovirus B [HAdV-B]
uucuuuugccauccuucuca

SEQ ID NO: 3905525 - RNA, 21 nt, Human adenovirus B [HAdV-B]
uugagcgccucggcugcgugg

SEQ ID NO: 3905526 - RNA, 19 nt, Human adenovirus B [HAdV-B]
uugaugaacaaugccauca

SEQ ID NO: 3905527 - RNA, 23 nt, Human adenovirus B [HAdV-B]
uugcagacgguaaaucugagcca

SEQ ID NO: 3905528 - RNA, 21 nt, Human adenovirus B [HAdV-B]
uugcaugguuguagcuuuuuu

SEQ ID NO: 3905529 - RNA, 21 nt, Human adenovirus B [HAdV-B]
uuuaugccuuaccaguguaac

SEQ ID NO: 3905530 - RNA, 12 nt, Human adenovirus B [HAdV-B]
uuucagaagaca

SEQ ID NO: 3905531 - RNA, 14 nt, Human adenovirus B [HAdV-B]
uuucuaacuccuca

SEQ ID NO: 3905532 - RNA, 15 nt, Human adenovirus B [HAdV-B]
uuugauuaagggaaa

SEQ ID NO: 3905533 - RNA, 21 nt, Human adenovirus B [HAdV-B]
uuugcaguagguacaacacau

SEQ ID NO: 3905534 - RNA, 14 nt, Human adenovirus B [HAdV-B]
uuuuccaacuuaua

SEQ ID NO: 3905535 - RNA, 23 nt, Human adenovirus B [HAdV-B]
uuuugcugguuuccgaauggcag

SEQ ID NO: 3905536 - RNA, 13 nt, Human adenovirus B [HAdV-B]
uuuugcugugcca

SEQ ID NO: 3905537 - RNA, 16 nt, Human adenovirus B [HAdV-B]
guucgcgguugagaag

SEQ ID NO: 3905538 - RNA, 13 nt, Human adenovirus B [HAdV-B]
guucucgcuggcc

SEQ ID NO: 3905539 - RNA, 17 nt, Human adenovirus B [HAdV-B]
guucucgcuggccacau

SEQ ID NO: 3905540 - RNA, 16 nt, Human adenovirus B [HAdV-B]
guucugacuuuggaaa

SEQ ID NO: 3905541 - RNA, 17 nt, Human adenovirus B [HAdV-B]
guugacuugcaggacag

SEQ ID NO: 3905542 - RNA, 14 nt, Human adenovirus B [HAdV-B]
guugagaccuggaa

SEQ ID NO: 3905543 - RNA, 16 nt, Human adenovirus B [HAdV-B]
guugauuuaaaaucaa

SEQ ID NO: 3905544 - RNA, 23 nt, Human adenovirus B [HAdV-B]
guuucacauuccaccagccaggu

SEQ ID NO: 3905545 - RNA, 18 nt, Human adenovirus B [HAdV-B]
guuuugagcuugggaaaa

SEQ ID NO: 3905546 - RNA, 19 nt, Human adenovirus B [HAdV-B]
uaaccuacuacgccugcug

SEQ ID NO: 3905547 - RNA, 15 nt, Human adenovirus B [HAdV-B]
uaagguauauuauug

SEQ ID NO: 3905548 - RNA, 12 nt, Human adenovirus B [HAdV-B]
uaaugacaaaau

SEQ ID NO: 3905549 - RNA, 18 nt, Human adenovirus B [HAdV-B]
uaauggaauaguguuuau

SEQ ID NO: 3905550 - RNA, 14 nt, Human adenovirus B [HAdV-B]
uacaaaagaaggac

SEQ ID NO: 3905551 - RNA, 16 nt, Human adenovirus B [HAdV-B]
uacacggcucucauga

SEQ ID NO: 3905552 - RNA, 19 nt, Human adenovirus B [HAdV-B]
uacagccaacgagccagcg

SEQ ID NO: 3905553 - RNA, 21 nt, Human adenovirus B [HAdV-B]
uacccucgguauaaaacaucc

SEQ ID NO: 3905554 - RNA, 18 nt, Human adenovirus B [HAdV-B]
uaccgucaccuccacagc

SEQ ID NO: 3905555 - RNA, 22 nt, Human adenovirus B [HAdV-B]
uacguccacuggacgggauagg

SEQ ID NO: 3905556 - RNA, 12 nt, Human adenovirus B [HAdV-B]
uacuaauacuac

SEQ ID NO: 3905557 - RNA, 16 nt, Human adenovirus B [HAdV-B]
uacugagcucaucaaa

SEQ ID NO: 3905558 - RNA, 16 nt, Human adenovirus B [HAdV-B]
uacuuagauuugauau

SEQ ID NO: 3905559 - RNA, 21 nt, Human adenovirus B [HAdV-B]
uagaauaagucgcccgaguuu

SEQ ID NO: 3905560 - RNA, 18 nt, Human adenovirus B [HAdV-B]
uagcagcgugcuggacuu

SEQ ID NO: 3905561 - RNA, 20 nt, Human adenovirus B [HAdV-B]
uagcaucgccccccucugau

SEQ ID NO: 3905562 - RNA, 13 nt, Human adenovirus B [HAdV-B]
uagcugcacagcc

SEQ ID NO: 3905563 - RNA, 15 nt, Human adenovirus B [HAdV-B]
uagguuggauagcau

SEQ ID NO: 3905564 - RNA, 19 nt, Human adenovirus B [HAdV-B]
uagucauauaguucaugug

SEQ ID NO: 3905565 - RNA, 14 nt, Human adenovirus B [HAdV-B]
uaguggcacaacau

SEQ ID NO: 3905566 - RNA, 17 nt, Human adenovirus B [HAdV-B]
uauaauggaauaguguu

SEQ ID NO: 3905567 - RNA, 18 nt, Human adenovirus B [HAdV-B]
uauagcuuccuuggaaga

SEQ ID NO: 3905568 - RNA, 16 nt, Human adenovirus B [HAdV-B]
uaucaacgugacagca

SEQ ID NO: 3905569 - RNA, 17 nt, Human adenovirus B [HAdV-B]
uaucggaggaggaggac

SEQ ID NO: 3905570 - RNA, 16 nt, Human adenovirus B [HAdV-B]
uaugaagaugaaagca

SEQ ID NO: 3905571 - RNA, 14 nt, Human adenovirus B [HAdV-B]
uaugagccagagca

SEQ ID NO: 3905572 - RNA, 20 nt, Human adenovirus B [HAdV-B]
uauggaagcaguaacuuuug

SEQ ID NO: 3905573 - RNA, 22 nt, Human adenovirus B [HAdV-B]
uauggccaauaccaaacuuaua

SEQ ID NO: 3905574 - RNA, 21 nt, Human adenovirus B [HAdV-B]
uauguuccugaguuaaaucau

SEQ ID NO: 3905575 - RNA, 22 nt, Human adenovirus B [HAdV-B]
aaucucuuaagguucuguggac

SEQ ID NO: 3905576 - RNA, 15 nt, Human adenovirus B [HAdV-B]
aaucugcaacaaaac

SEQ ID NO: 3905577 - RNA, 14 nt, Human adenovirus B [HAdV-B]
aaugaaagcguuca

SEQ ID NO: 3905578 - RNA, 13 nt, Human adenovirus B [HAdV-B]
aaugacaaaauau

SEQ ID NO: 3905579 - RNA, 23 nt, Human adenovirus B [HAdV-B]
aaugcuuguuacauaucuggaaa

SEQ ID NO: 3905580 - RNA, 13 nt, Human adenovirus B [HAdV-B]
aauguuagcaaag

SEQ ID NO: 3905581 - RNA, 17 nt, Human adenovirus B [HAdV-B]
aauucgggaaucaccaa

SEQ ID NO: 3905582 - RNA, 21 nt, Human adenovirus B [HAdV-B]
aauugacaugcccuuggcucu

SEQ ID NO: 3905583 - RNA, 23 nt, Human adenovirus B [HAdV-B]
aauugcaaggccccagcagccaa

SEQ ID NO: 3905584 - RNA, 22 nt, Human adenovirus B [HAdV-B]
cguuuggacccgccgccagcaa

SEQ ID NO: 3905585 - RNA, 20 nt, Human adenovirus B [HAdV-B]
cuaacccgauggcugggcac

SEQ ID NO: 3905586 - RNA, 16 nt, Human adenovirus B [HAdV-B]
cuaccacugccaugcg

SEQ ID NO: 3905587 - RNA, 17 nt, Human adenovirus B [HAdV-B]
cuagaagauaaggaggu

SEQ ID NO: 3905588 - RNA, 20 nt, Human adenovirus B [HAdV-B]
cuagaucugaguuggcuuua

SEQ ID NO: 3905589 - RNA, 23 nt, Human adenovirus B [HAdV-B]
cuaggacaaagcgugcugcacag

SEQ ID NO: 3905590 - RNA, 14 nt, Human adenovirus B [HAdV-B]
cuaggcagagaaac

SEQ ID NO: 3905591 - RNA, 23 nt, Human adenovirus B [HAdV-B]
cuagucucgcaacucugacuucu

SEQ ID NO: 3905592 - RNA, 20 nt, Human adenovirus B [HAdV-B]
cuaguuguuugccaaaggau

SEQ ID NO: 3905593 - RNA, 21 nt, Human adenovirus B [HAdV-B]
cuaugaggaccaaucacagcc

SEQ ID NO: 3905594 - RNA, 15 nt, Human adenovirus B [HAdV-B]
cuauuuagagacaga

SEQ ID NO: 3905595 - RNA, 14 nt, Human adenovirus B [HAdV-B]
cucaaaaacacacu

SEQ ID NO: 3905596 - RNA, 17 nt, Human adenovirus B [HAdV-B]
cucaaccccagcugccu

SEQ ID NO: 3905597 - RNA, 23 nt, Human adenovirus B [HAdV-B]
cucaccauuaccaacugacuguc

SEQ ID NO: 3905598 - RNA, 17 nt, Human adenovirus B [HAdV-B]
cucagccauugcuguca

SEQ ID NO: 3905599 - RNA, 19 nt, Human adenovirus B [HAdV-B]
cucagccauugcugucaac

SEQ ID NO: 3905600 - RNA, 18 nt, Human adenovirus B [HAdV-B]
cucaggaucacagagacg

SEQ ID NO: 3905601 - RNA, 21 nt, Human adenovirus B [HAdV-B]
cucaggaucacagagacgagc

SEQ ID NO: 3905602 - RNA, 17 nt, Human adenovirus B [HAdV-B]
cucagguugucaguuuc

SEQ ID NO: 3905603 - RNA, 16 nt, Human adenovirus B [HAdV-B]
cuccaagcaagaugua

SEQ ID NO: 3905604 - RNA, 19 nt, Human adenovirus B [HAdV-B]
cuccacuagacaagucagu

SEQ ID NO: 3905605 - RNA, 14 nt, Human adenovirus B [HAdV-B]
cuccaguggaggag

SEQ ID NO: 3905606 - RNA, 22 nt, Human adenovirus B [HAdV-B]
cucccgacggugcugcaguugg

SEQ ID NO: 3905607 - RNA, 16 nt, Human adenovirus B [HAdV-B]
cuccuaggcagagaaa

SEQ ID NO: 3905608 - RNA, 18 nt, Human adenovirus B [HAdV-B]
cuccuccuucguacgaga

SEQ ID NO: 3905609 - RNA, 16 nt, Human adenovirus B [HAdV-B]
cuccuuuagccagagg

SEQ ID NO: 3905610 - RNA, 13 nt, Human adenovirus B [HAdV-B]
cuccuuuccuaga

SEQ ID NO: 3905611 - RNA, 14 nt, Human adenovirus B [HAdV-B]
cucgaagagaaucu

SEQ ID NO: 3905612 - RNA, 17 nt, Human adenovirus B [HAdV-B]
cucgaagggguucauug

SEQ ID NO: 3905613 - RNA, 23 nt, Human adenovirus B [HAdV-B]
cucgguauaaaacaucccgcagg

SEQ ID NO: 3905614 - RNA, 13 nt, Human adenovirus B [HAdV-B]
cucucaccuaccg

SEQ ID NO: 3905615 - RNA, 17 nt, Human adenovirus B [HAdV-B]
cucucauaggaccccca

SEQ ID NO: 3905616 - RNA, 22 nt, Human adenovirus B [HAdV-B]
cucugcguucgcucaccagaag

SEQ ID NO: 3905617 - RNA, 18 nt, Human adenovirus B [HAdV-B]
cucuucgggggcagaggu

SEQ ID NO: 3905618 - RNA, 16 nt, Human adenovirus B [HAdV-B]
cucuuucauccuggaa

SEQ ID NO: 3905619 - RNA, 21 nt, Human adenovirus B [HAdV-B]
cugaaaguauggaagugcaaa

SEQ ID NO: 3905620 - RNA, 21 nt, Human adenovirus B [HAdV-B]
cugaacggggucaucuugcag

SEQ ID NO: 3905621 - RNA, 17 nt, Human adenovirus B [HAdV-B]
cugaagcugaaauuaca

SEQ ID NO: 3905622 - RNA, 14 nt, Human adenovirus B [HAdV-B]
cugaccgcccagcu

SEQ ID NO: 3905623 - RNA, 22 nt, Human adenovirus B [HAdV-B]
cugagcagucuccgauguugug

SEQ ID NO: 3905624 - RNA, 21 nt, Human adenovirus B [HAdV-B]
cugagcuaucucggcugcgac

SEQ ID NO: 3905625 - RNA, 22 nt, Human adenovirus B [HAdV-B]
cugagcuaucucggcugcgaca

SEQ ID NO: 3905626 - RNA, 14 nt, Human adenovirus B [HAdV-B]
cugauuacuucuuu

SEQ ID NO: 3905627 - RNA, 22 nt, Human adenovirus B [HAdV-B]
cugauuauuucaccaaugccau

SEQ ID NO: 3905628 - RNA, 14 nt, Human adenovirus B [HAdV-B]
cugcagagccagcc

SEQ ID NO: 3905629 - RNA, 19 nt, Human adenovirus B [HAdV-B]
cugccuuguaagggcagca

SEQ ID NO: 3905630 - RNA, 14 nt, Human adenovirus B [HAdV-B]
cugcggaggaggag

SEQ ID NO: 3905631 - RNA, 16 nt, Human adenovirus B [HAdV-B]
cugcuacgaagagcua

SEQ ID NO: 3905632 - RNA, 16 nt, Human adenovirus B [HAdV-B]
cuggaacacaggagau

SEQ ID NO: 3905633 - RNA, 23 nt, Human adenovirus B [HAdV-B]
cuggaaggcggaugacuggcaga

SEQ ID NO: 3905634 - RNA, 20 nt, Human adenovirus B [HAdV-B]
cuggacauugcucaccaccu

SEQ ID NO: 3905635 - RNA, 23 nt, Human adenovirus B [HAdV-B]
cuggagcuggaaccgagggugag

SEQ ID NO: 3905636 - RNA, 15 nt, Human adenovirus B [HAdV-B]
cuggagugucacugc

SEQ ID NO: 3905637 - RNA, 18 nt, Human adenovirus B [HAdV-B]
cuggccaacuaucucucc

SEQ ID NO: 3905638 - RNA, 23 nt, Human adenovirus B [HAdV-B]
cuggccaacuaucucuccuacca

SEQ ID NO: 3905639 - RNA, 15 nt, Human adenovirus B [HAdV-B]
cuggcggcuccaccc

SEQ ID NO: 3905640 - RNA, 15 nt, Human adenovirus B [HAdV-B]
cugggcagcuaggac

SEQ ID NO: 3905641 - RNA, 13 nt, Human adenovirus B [HAdV-B]
cugggcauucuga

SEQ ID NO: 3905642 - RNA, 22 nt, Human adenovirus B [HAdV-B]
cuggucuggggguacaaacugu

SEQ ID NO: 3905643 - RNA, 22 nt, Human adenovirus B [HAdV-B]
cugguuagcugcacagccggca

SEQ ID NO: 3905644 - RNA, 14 nt, Human adenovirus B [HAdV-B]
cuguaccugugcca

SEQ ID NO: 3905645 - RNA, 16 nt, Human adenovirus B [HAdV-B]
cuguagacgaucuggc

SEQ ID NO: 3905646 - RNA, 22 nt, Human adenovirus B [HAdV-B]
cuguagugccuucccgcucuaa

SEQ ID NO: 3905647 - RNA, 16 nt, Human adenovirus B [HAdV-B]
cugucaacaucgccac

SEQ ID NO: 3905648 - RNA, 14 nt, Human adenovirus B [HAdV-B]
cugucucaacccca

SEQ ID NO: 3905649 - RNA, 16 nt, Human adenovirus B [HAdV-B]
cuucaacaaguacugc

SEQ ID NO: 3905650 - RNA, 18 nt, Human adenovirus B [HAdV-B]
cuucagcuugcccucaua

SEQ ID NO: 3905651 - RNA, 14 nt, Human adenovirus B [HAdV-B]
cuuccaacaaaaag

SEQ ID NO: 3905652 - RNA, 14 nt, Human adenovirus B [HAdV-B]
cuucccucuuccca

SEQ ID NO: 3905653 - RNA, 13 nt, Human adenovirus B [HAdV-B]
cuucuccaucagc

SEQ ID NO: 3905654 - RNA, 19 nt, Human adenovirus B [HAdV-B]
cuucuccggaucuccuggg

SEQ ID NO: 3905655 - RNA, 12 nt, Human adenovirus B [HAdV-B]
cuugaauuauuc

SEQ ID NO: 3905656 - RNA, 18 nt, Human adenovirus B [HAdV-B]
cuugagcagcuuuucgua

SEQ ID NO: 3905657 - RNA, 20 nt, Human adenovirus B [HAdV-B]
cuugcuggagugucacugcc

SEQ ID NO: 3905658 - RNA, 15 nt, Human adenovirus B [HAdV-B]
cuuggaagacugaug

SEQ ID NO: 3905659 - RNA, 21 nt, Human adenovirus B [HAdV-B]
cuuucagaagacaugcaugac

SEQ ID NO: 3905660 - RNA, 14 nt, Human adenovirus B [HAdV-B]
cuuuccagccuuga

SEQ ID NO: 3905661 - RNA, 15 nt, Human adenovirus B [HAdV-B]
cuuuccugagaacca

SEQ ID NO: 3905662 - RNA, 15 nt, Human adenovirus B [HAdV-B]
cuuucuguuuacaga

SEQ ID NO: 3905663 - RNA, 14 nt, Human adenovirus B [HAdV-B]
cuuugagacugaug

SEQ ID NO: 3905664 - RNA, 17 nt, Human adenovirus B [HAdV-B]
cuuuggguauaauuaug

SEQ ID NO: 3905665 - RNA, 19 nt, Human adenovirus B [HAdV-B]
gaaaaugaaagcguucagc

SEQ ID NO: 3905666 - RNA, 23 nt, Human adenovirus B [HAdV-B]
gaaaaugccggccaauugccauu

SEQ ID NO: 3905667 - RNA, 19 nt, Human adenovirus B [HAdV-B]
gaaaauguaaauuuggaaa

SEQ ID NO: 3905668 - RNA, 22 nt, Human adenovirus B [HAdV-B]
gaaaccuugcgcaaacucgaag

SEQ ID NO: 3905669 - RNA, 20 nt, Human adenovirus B [HAdV-B]
gaaacuuuuacaucucccac

SEQ ID NO: 3905670 - RNA, 21 nt, Human adenovirus B [HAdV-B]
gaaauaugagugguucgaguu

SEQ ID NO: 3905671 - RNA, 20 nt, Human adenovirus B [HAdV-B]
gaaauauggagcccagcaug

SEQ ID NO: 3905672 - RNA, 14 nt, Human adenovirus B [HAdV-B]
gaacaacugccgua

SEQ ID NO: 3905673 - RNA, 23 nt, Human adenovirus B [HAdV-B]
gaacacaggagaugccccagagg

SEQ ID NO: 3905674 - RNA, 14 nt, Human adenovirus B [HAdV-B]
gaacauuggugcca

SEQ ID NO: 3905675 - RNA, 14 nt, Human adenovirus B [HAdV-B]
gaagacacuggcag

SEQ ID NO: 3905676 - RNA, 23 nt, Human adenovirus B [HAdV-B]
gaagagcguaacuuccaaaaguc

SEQ ID NO: 3905677 - RNA, 17 nt, Human adenovirus B [HAdV-B]
gaagauauggaggaaga

SEQ ID NO: 3905678 - RNA, 19 nt, Human adenovirus B [HAdV-B]
gaauaauuaauauaaucug

SEQ ID NO: 3905679 - RNA, 22 nt, Human adenovirus B [HAdV-B]
gaaucagaaugacccgcaggca

SEQ ID NO: 3905680 - RNA, 21 nt, Human adenovirus B [HAdV-B]
gaaucauaauauugccaugca

SEQ ID NO: 3905681 - RNA, 19 nt, Human adenovirus B [HAdV-B]
gaaugccaucaucuccugc

SEQ ID NO: 3905682 - RNA, 14 nt, Human adenovirus B [HAdV-B]
gaauuaaaaaauga

SEQ ID NO: 3905683 - RNA, 21 nt, Human adenovirus B [HAdV-B]
gaauugcaaggccccagcagc

SEQ ID NO: 3905684 - RNA, 22 nt, Human adenovirus B [HAdV-B]
gacaauggaugguuuacaaaac

SEQ ID NO: 3905685 - RNA, 15 nt, Human adenovirus B [HAdV-B]
gauauguggccuggg

SEQ ID NO: 3905686 - RNA, 12 nt, Human adenovirus B [HAdV-B]
gaucaccugggc

SEQ ID NO: 3905687 - RNA, 23 nt, Human adenovirus B [HAdV-B]
gaucugcaaucaugcccacaucc

SEQ ID NO: 3905688 - RNA, 21 nt, Human adenovirus B [HAdV-B]
gaugauauucuugagcaggcg

SEQ ID NO: 3905689 - RNA, 11 nt, Human adenovirus B [HAdV-B]
gaugcuggaaa

SEQ ID NO: 3905690 - RNA, 14 nt, Human adenovirus B [HAdV-B]
gauggcgccagcau

SEQ ID NO: 3905691 - RNA, 14 nt, Human adenovirus B [HAdV-B]
gaugugaacauggu

SEQ ID NO: 3905692 - RNA, 18 nt, Human adenovirus B [HAdV-B]
gauuaagggaaaugccag

SEQ ID NO: 3905693 - RNA, 20 nt, Human adenovirus B [HAdV-B]
gauuacuuugauauaaucug

SEQ ID NO: 3905694 - RNA, 13 nt, Human adenovirus B [HAdV-B]
gauugccacagcu

SEQ ID NO: 3905695 - RNA, 13 nt, Human adenovirus B [HAdV-B]
gauugcuggaaua

SEQ ID NO: 3905696 - RNA, 18 nt, Human adenovirus B [HAdV-B]
gauuucauagccacagca

SEQ ID NO: 3905697 - RNA, 11 nt, Human adenovirus B [HAdV-B]
gauuuggaaga

SEQ ID NO: 3905698 - RNA, 15 nt, Human adenovirus B [HAdV-B]
gauuuuggcuggaau

SEQ ID NO: 3905699 - RNA, 18 nt, Human adenovirus B [HAdV-B]
gcaacgaauuuucuccca

SEQ ID NO: 3905700 - RNA, 19 nt, Human adenovirus B [HAdV-B]
gcaacgaauuuucucccag

SEQ ID NO: 3905701 - RNA, 16 nt, Human adenovirus B [HAdV-B]
gcaacgggugcuuacu

SEQ ID NO: 3905702 - RNA, 13 nt, Human adenovirus B [HAdV-B]
gcaaggacaacau

SEQ ID NO: 3905703 - RNA, 19 nt, Human adenovirus B [HAdV-B]
gcaauauugccgccaagau

SEQ ID NO: 3905704 - RNA, 21 nt, Human adenovirus B [HAdV-B]
gcaaucaugcccacauccaga

SEQ ID NO: 3905705 - RNA, 14 nt, Human adenovirus B [HAdV-B]
gcacacaaagcaca

SEQ ID NO: 3905706 - RNA, 21 nt, Human adenovirus B [HAdV-B]
gcaccgucgcuuccgaccugg

SEQ ID NO: 3905707 - RNA, 21 nt, Human adenovirus B [HAdV-B]
gcaccuuugaauugcaaggcc

SEQ ID NO: 3905708 - RNA, 23 nt, Human adenovirus B [HAdV-B]
gcacgucuucaaccgcuuuccug

SEQ ID NO: 3905709 - RNA, 13 nt, Human adenovirus B [HAdV-B]
gcagcacugaaac

SEQ ID NO: 3905710 - RNA, 22 nt, Human adenovirus B [HAdV-B]
gcagcagcuccuuuagccagag

SEQ ID NO: 3905711 - RNA, 12 nt, Human adenovirus B [HAdV-B]
gcagcgaagugg

SEQ ID NO: 3905712 - RNA, 17 nt, Human adenovirus B [HAdV-B]
gcaggaggcgcaaacag

SEQ ID NO: 3905713 - RNA, 15 nt, Human adenovirus B [HAdV-B]
gcaggauauuuugaa

SEQ ID NO: 3905714 - RNA, 15 nt, Human adenovirus B [HAdV-B]
gcaggcgccucccag

SEQ ID NO: 3905715 - RNA, 22 nt, Human adenovirus B [HAdV-B]
gcagucucgacagauaaagaca

SEQ ID NO: 3905716 - RNA, 17 nt, Human adenovirus B [HAdV-B]
gcauaugcaaaucccaa

SEQ ID NO: 3905717 - RNA, 21 nt, Human adenovirus B [HAdV-B]
gcaucaaaaacgccaauaaca

SEQ ID NO: 3905718 - RNA, 17 nt, Human adenovirus B [HAdV-B]
gcaugaccucugcacuc

SEQ ID NO: 3905719 - RNA, 16 nt, Human adenovirus B [HAdV-B]
gcaugcgaaugcggag

SEQ ID NO: 3905720 - RNA, 13 nt, Human adenovirus B [HAdV-B]
gcaugggaugggu

SEQ ID NO: 3905721 - RNA, 19 nt, Human adenovirus B [HAdV-B]
gcauuguggagaacaugga

SEQ ID NO: 3905722 - RNA, 17 nt, Human adenovirus B [HAdV-B]
gccaaacccaacacaca

SEQ ID NO: 3905723 - RNA, 20 nt, Human adenovirus B [HAdV-B]
gccaccaucccgaauaccgc

SEQ ID NO: 3905724 - RNA, 19 nt, Human adenovirus B [HAdV-B]
gccagcgguucuggaggag

SEQ ID NO: 3905725 - RNA, 21 nt, Human adenovirus B [HAdV-B]
gccaggguucgguccuuccag

SEQ ID NO: 3905726 - RNA, 22 nt, Human adenovirus B [HAdV-B]
gccaugcgagccgcaagagcuc

SEQ ID NO: 3905727 - RNA, 21 nt, Human adenovirus B [HAdV-B]
gccaugcuuagggcggccaga

SEQ ID NO: 3905728 - RNA, 17 nt, Human adenovirus B [HAdV-B]
gcccaguccugccacca

SEQ ID NO: 3905729 - RNA, 14 nt, Human adenovirus B [HAdV-B]
gccccaauggccac

SEQ ID NO: 3905730 - RNA, 22 nt, Human adenovirus B [HAdV-B]
gcccccagaagauauggaggaa

SEQ ID NO: 3905731 - RNA, 20 nt, Human adenovirus B [HAdV-B]
gcccccucccccugcugcua

SEQ ID NO: 3905732 - RNA, 13 nt, Human adenovirus B [HAdV-B]
gccccgccaacac

SEQ ID NO: 3905733 - RNA, 14 nt, Human adenovirus B [HAdV-B]
gccgcaggaggcgc

SEQ ID NO: 3905734 - RNA, 15 nt, Human adenovirus B [HAdV-B]
gccgccggucccacu

SEQ ID NO: 3905735 - RNA, 23 nt, Human adenovirus B [HAdV-B]
gccuacaucuacuguggaugcag

SEQ ID NO: 3905736 - RNA, 22 nt, Human adenovirus B [HAdV-B]
gccuaggacaaagcgugcugca

SEQ ID NO: 3905737 - RNA, 17 nt, Human adenovirus B [HAdV-B]
gcgauaaugccagacuc

SEQ ID NO: 3905738 - RNA, 16 nt, Human adenovirus B [HAdV-B]
gcgcaaguuugcuccg

SEQ ID NO: 3905739 - RNA, 17 nt, Human adenovirus B [HAdV-B]
gcgcaguagucaagugu

SEQ ID NO: 3905740 - RNA, 17 nt, Human adenovirus B [HAdV-B]
gcgccaugacagacaga

SEQ ID NO: 3905741 - RNA, 14 nt, Human adenovirus B [HAdV-B]
gcgcgggcaaacac

SEQ ID NO: 3905742 - RNA, 14 nt, Human adenovirus B [HAdV-B]
gcggagacaagcaa

SEQ ID NO: 3905743 - RNA, 10 nt, Human adenovirus B [HAdV-B]
gcggaggagg

SEQ ID NO: 3905744 - RNA, 19 nt, Human adenovirus B [HAdV-B]
gcggccuaagagaccugcu

SEQ ID NO: 3905745 - RNA, 14 nt, Human adenovirus B [HAdV-B]
gcggcgcugcagag

SEQ ID NO: 3905746 - RNA, 14 nt, Human adenovirus B [HAdV-B]
gcggcucauguugc

SEQ ID NO: 3905747 - RNA, 19 nt, Human adenovirus B [HAdV-B]
gcgggacgaggauuucgaa

SEQ ID NO: 3905748 - RNA, 13 nt, Human adenovirus B [HAdV-B]
gcgggucgugagc

SEQ ID NO: 3905749 - RNA, 18 nt, Human adenovirus B [HAdV-B]
gcguccagcgcugccagg

SEQ ID NO: 3905750 - RNA, 14 nt, Human adenovirus B [HAdV-B]
gcgugaugcagcag

SEQ ID NO: 3905751 - RNA, 16 nt, Human adenovirus B [HAdV-B]
gcguggggcgaagagc

SEQ ID NO: 3905752 - RNA, 14 nt, Human adenovirus B [HAdV-B]
gcuacagcugcugc

SEQ ID NO: 3905753 - RNA, 18 nt, Human adenovirus B [HAdV-B]
gcuaccaucuccgcuccg

SEQ ID NO: 3905754 - RNA, 22 nt, Human adenovirus B [HAdV-B]
gcuauaauguguuggaagacaa

SEQ ID NO: 3905755 - RNA, 12 nt, Human adenovirus B [HAdV-B]
ggaauuggaagg

SEQ ID NO: 3905756 - RNA, 20 nt, Human adenovirus B [HAdV-B]
ggacauaauuacacucucau

SEQ ID NO: 3905757 - RNA, 18 nt, Human adenovirus B [HAdV-B]
ggacucuguuaacuucac

SEQ ID NO: 3905758 - RNA, 14 nt, Human adenovirus B [HAdV-B]
ggacuuggaagagg

SEQ ID NO: 3905759 - RNA, 11 nt, Human adenovirus B [HAdV-B]
ggagcagagcu

SEQ ID NO: 3905760 - RNA, 15 nt, Human adenovirus B [HAdV-B]
ggagcugacuugcag

SEQ ID NO: 3905761 - RNA, 12 nt, Human adenovirus B [HAdV-B]
ggaggaggaaca

SEQ ID NO: 3905762 - RNA, 13 nt, Human adenovirus B [HAdV-B]
ggagggcagaaac

SEQ ID NO: 3905763 - RNA, 14 nt, Human adenovirus B [HAdV-B]
ggaggugaagauag

SEQ ID NO: 3905764 - RNA, 11 nt, Human adenovirus B [HAdV-B]
ggagucacugc

SEQ ID NO: 3905765 - RNA, 21 nt, Human adenovirus B [HAdV-B]
ggaucacagagacgagccugg

SEQ ID NO: 3905766 - RNA, 17 nt, Human adenovirus B [HAdV-B]
ggaucaguccugccagg

SEQ ID NO: 3905767 - RNA, 21 nt, Human adenovirus B [HAdV-B]
ggauucuuaacagugcaggca

SEQ ID NO: 3905768 - RNA, 17 nt, Human adenovirus B [HAdV-B]
ggcacacguggcugcag

SEQ ID NO: 3905769 - RNA, 16 nt, Human adenovirus B [HAdV-B]
ggcacuucagcuugcc

SEQ ID NO: 3905770 - RNA, 19 nt, Human adenovirus B [HAdV-B]
ggcaggaugugagcuuccu

SEQ ID NO: 3905771 - RNA, 21 nt, Human adenovirus B [HAdV-B]
ggcaucucgauccagcagacc

SEQ ID NO: 3905772 - RNA, 17 nt, Human adenovirus B [HAdV-B]
ggccgaacuuucggccu

SEQ ID NO: 3905773 - RNA, 16 nt, Human adenovirus B [HAdV-B]
ggccgagaagguggcu

SEQ ID NO: 3905774 - RNA, 20 nt, Human adenovirus B [HAdV-B]
ggccugcgucaucacccagg

SEQ ID NO: 3905775 - RNA, 20 nt, Human adenovirus B [HAdV-B]
ggcgagucgugcuaggcgga

SEQ ID NO: 3905776 - RNA, 23 nt, Human adenovirus B [HAdV-B]
ggcggaugaaggcgaggaggaag

SEQ ID NO: 3905777 - RNA, 21 nt, Human adenovirus B [HAdV-B]
gggacaacaaucuaugcccaa

SEQ ID NO: 3905778 - RNA, 17 nt, Human adenovirus B [HAdV-B]
ggggaguccaacgugug

SEQ ID NO: 3905779 - RNA, 22 nt, Human adenovirus B [HAdV-B]
ggguccaccuuuuccaaaguau

SEQ ID NO: 3905780 - RNA, 19 nt, Human adenovirus B [HAdV-B]
gggucuaccuugaccccca

SEQ ID NO: 3905781 - RNA, 22 nt, Human adenovirus B [HAdV-B]
ggucaaaagaaugcuggcuuca

SEQ ID NO: 3905782 - RNA, 15 nt, Human adenovirus B [HAdV-B]
gguccgccacugcgc

SEQ ID NO: 3905783 - RNA, 19 nt, Human adenovirus B [HAdV-B]
ggugcaacacagcagagac

SEQ ID NO: 3905784 - RNA, 13 nt, Human adenovirus B [HAdV-B]
gguggcuuccagc

SEQ ID NO: 3905785 - RNA, 16 nt, Human adenovirus B [HAdV-B]
ggugggcauuguaaua

SEQ ID NO: 3905786 - RNA, 14 nt, Human adenovirus B [HAdV-B]
gguguccagaaaac

SEQ ID NO: 3905787 - RNA, 20 nt, Human adenovirus B [HAdV-B]
gguuaccguagaacuagagu

SEQ ID NO: 3905788 - RNA, 23 nt, Human adenovirus B [HAdV-B]
guaaaacaagccaagauauccua

SEQ ID NO: 3905789 - RNA, 12 nt, Human adenovirus B [HAdV-B]
guaccugugcca

SEQ ID NO: 3905790 - RNA, 14 nt, Human adenovirus B [HAdV-B]
guacgagagcguga

SEQ ID NO: 3905791 - RNA, 15 nt, Human adenovirus B [HAdV-B]
guacggggaugauga

SEQ ID NO: 3905792 - RNA, 13 nt, Human adenovirus B [HAdV-B]
guacugaugcuag

SEQ ID NO: 3905793 - RNA, 21 nt, Human adenovirus B [HAdV-B]
guaucagaaaaaaacagccau

SEQ ID NO: 3905794 - RNA, 13 nt, Human adenovirus B [HAdV-B]
guaucggaggagg

SEQ ID NO: 3905795 - RNA, 23 nt, Human adenovirus B [HAdV-B]
guaugccaucuuccagcagaguc

SEQ ID NO: 3905796 - RNA, 14 nt, Human adenovirus B [HAdV-B]
guccguugaaauua

SEQ ID NO: 3905797 - RNA, 13 nt, Human adenovirus B [HAdV-B]
guccucagcgacg

SEQ ID NO: 3905798 - RNA, 12 nt, Human adenovirus B [HAdV-B]
guccuuccaggg

SEQ ID NO: 3905799 - RNA, 18 nt, Human adenovirus B [HAdV-B]
gucuacuggucgcuucca

SEQ ID NO: 3905800 - RNA, 18 nt, Human adenovirus B [HAdV-B]
gucuaucuguaccugugc

SEQ ID NO: 3905801 - RNA, 21 nt, Human adenovirus B [HAdV-B]
gucucaguguucgagucaggg

SEQ ID NO: 3905802 - RNA, 18 nt, Human adenovirus B [HAdV-B]
gucuccgguuuuuggaga

SEQ ID NO: 3905803 - RNA, 16 nt, Human adenovirus B [HAdV-B]
gucucugacaaagugg

SEQ ID NO: 3905804 - RNA, 21 nt, Human adenovirus B [HAdV-B]
gucuuacugccuggcugcgga

SEQ ID NO: 3905805 - RNA, 20 nt, Human adenovirus B [HAdV-B]
gucuucucaaagagcuucua

SEQ ID NO: 3905806 - RNA, 21 nt, Human adenovirus B [HAdV-B]
gugaugaggguaaaccagugg

SEQ ID NO: 3905807 - RNA, 20 nt, Human adenovirus B [HAdV-B]
gugaugcaauccccacugga

SEQ ID NO: 3905808 - RNA, 20 nt, Human adenovirus B [HAdV-B]
gugcaggagcggagccuggg

SEQ ID NO: 3905809 - RNA, 12 nt, Human adenovirus B [HAdV-B]
gugccaccacac

SEQ ID NO: 3905810 - RNA, 12 nt, Human adenovirus B [HAdV-B]
gugcugcacagc

SEQ ID NO: 3905811 - RNA, 20 nt, Human adenovirus B [HAdV-B]
guggacaggguucgacgagc

SEQ ID NO: 3905812 - RNA, 21 nt, Human adenovirus B [HAdV-B]
guggcagccuagucgcagggc

SEQ ID NO: 3905813 - RNA, 12 nt, Human adenovirus B [HAdV-B]
guguuggacaga

SEQ ID NO: 3905814 - RNA, 18 nt, Human adenovirus B [HAdV-B]
guuaaaaaccugcugcuu

SEQ ID NO: 3905815 - RNA, 16 nt, Human adenovirus B [HAdV-B]
guuaagacuggucacu

SEQ ID NO: 3905816 - RNA, 20 nt, Human adenovirus B [HAdV-B]
guuaccuacuaaaccuguau

SEQ ID NO: 3905817 - RNA, 16 nt, Human adenovirus B [HAdV-B]
guuagcgccagcagga

SEQ ID NO: 3905818 - RNA, 16 nt, Human adenovirus B [HAdV-B]
guucaugagcaaacag

SEQ ID NO: 3905819 - RNA, 13 nt, Human adenovirus B [HAdV-B]
guuccugcucuca

SEQ ID NO: 3905820 - RNA, 16 nt, Human adenovirus B [HAdV-B]
guucgagucaggguug

SEQ ID NO: 3905821 - RNA, 16 nt, Human adenovirus B [HAdV-B]
caccccguccaauguc

SEQ ID NO: 3905822 - RNA, 18 nt, Human adenovirus B [HAdV-B]
caccggauugcagcacug

SEQ ID NO: 3905823 - RNA, 21 nt, Human adenovirus B [HAdV-B]
caccgguggaacacgaggaag

SEQ ID NO: 3905824 - RNA, 15 nt, Human adenovirus B [HAdV-B]
caccgucgaugaugu

SEQ ID NO: 3905825 - RNA, 13 nt, Human adenovirus B [HAdV-B]
caccuccacugaa

SEQ ID NO: 3905826 - RNA, 19 nt, Human adenovirus B [HAdV-B]
caccugcugcgcacugccc

SEQ ID NO: 3905827 - RNA, 17 nt, Human adenovirus B [HAdV-B]
cacgagccaacugaacg

SEQ ID NO: 3905828 - RNA, 20 nt, Human adenovirus B [HAdV-B]
cacgagugccaucacaucuc

SEQ ID NO: 3905829 - RNA, 18 nt, Human adenovirus B [HAdV-B]
cacgccccgccaacaccu

SEQ ID NO: 3905830 - RNA, 20 nt, Human adenovirus B [HAdV-B]
cacuauucaaccuguagaaa

SEQ ID NO: 3905831 - RNA, 12 nt, Human adenovirus B [HAdV-B]
cacuccacagcu

SEQ ID NO: 3905832 - RNA, 14 nt, Human adenovirus B [HAdV-B]
cacuugccacccuc

SEQ ID NO: 3905833 - RNA, 13 nt, Human adenovirus B [HAdV-B]
cagaacacacucu

SEQ ID NO: 3905834 - RNA, 22 nt, Human adenovirus B [HAdV-B]
cagaacugaagugcccaucagu

SEQ ID NO: 3905835 - RNA, 20 nt, Human adenovirus B [HAdV-B]
cagaagguguaaaaaauaca

SEQ ID NO: 3905836 - RNA, 20 nt, Human adenovirus B [HAdV-B]
cagacauggaaacucagcca

SEQ ID NO: 3905837 - RNA, 14 nt, Human adenovirus B [HAdV-B]
cagacuagcagaca

SEQ ID NO: 3905838 - RNA, 15 nt, Human adenovirus B [HAdV-B]
cagagaggcgcugcu

SEQ ID NO: 3905839 - RNA, 20 nt, Human adenovirus B [HAdV-B]
cagaugcaucccgugcugcg

SEQ ID NO: 3905840 - RNA, 23 nt, Human adenovirus B [HAdV-B]
cagaugcgcccccaacaacagcc

SEQ ID NO: 3905841 - RNA, 21 nt, Human adenovirus B [HAdV-B]
cagauucaaugauugcaauug

SEQ ID NO: 3905842 - RNA, 23 nt, Human adenovirus B [HAdV-B]
cagauuugcauuucccaagcuuu

SEQ ID NO: 3905843 - RNA, 16 nt, Human adenovirus B [HAdV-B]
cagcaaccccaggcca

SEQ ID NO: 3905844 - RNA, 20 nt, Human adenovirus B [HAdV-B]
cagcacuggacaugacagcg

SEQ ID NO: 3905845 - RNA, 16 nt, Human adenovirus B [HAdV-B]
cagcagcagcagcagc

SEQ ID NO: 3905846 - RNA, 12 nt, Human adenovirus B [HAdV-B]
cagcaguacagg

SEQ ID NO: 3905847 - RNA, 23 nt, Human adenovirus B [HAdV-B]
cagcauuguggagaacauggaag

SEQ ID NO: 3905848 - RNA, 19 nt, Human adenovirus B [HAdV-B]
cagcccaugagcaggcagg

SEQ ID NO: 3905849 - RNA, 20 nt, Human adenovirus B [HAdV-B]
cagcccaugagcaggcaggu

SEQ ID NO: 3905850 - RNA, 17 nt, Human adenovirus B [HAdV-B]
cagccgccgcccccaga

SEQ ID NO: 3905851 - RNA, 19 nt, Human adenovirus B [HAdV-B]
cagccgccgcccccagaag

SEQ ID NO: 3905852 - RNA, 21 nt, Human adenovirus B [HAdV-B]
cagcgccaugacagacagagg

SEQ ID NO: 3905853 - RNA, 15 nt, Human adenovirus B [HAdV-B]
cagcgcugccagggu

SEQ ID NO: 3905854 - RNA, 19 nt, Human adenovirus B [HAdV-B]
cagcgcuuccaagaccggu

SEQ ID NO: 3905855 - RNA, 21 nt, Human adenovirus B [HAdV-B]
cagcggcggcgaccuccaaca

SEQ ID NO: 3905856 - RNA, 15 nt, Human adenovirus B [HAdV-B]
cagcuaaagaccauc

SEQ ID NO: 3905857 - RNA, 23 nt, Human adenovirus B [HAdV-B]
cagcugccuauaguacuccacca

SEQ ID NO: 3905858 - RNA, 21 nt, Human adenovirus B [HAdV-B]
cagcuuuugcugugccagaag

SEQ ID NO: 3905859 - RNA, 14 nt, Human adenovirus B [HAdV-B]
caggagcggagccu

SEQ ID NO: 3905860 - RNA, 19 nt, Human adenovirus B [HAdV-B]
caggauccuauagaggugg

SEQ ID NO: 3905861 - RNA, 23 nt, Human adenovirus B [HAdV-B]
caggaugucccaacgacgagaaa

SEQ ID NO: 3905862 - RNA, 13 nt, Human adenovirus B [HAdV-B]
caggcaaaacaaa

SEQ ID NO: 3905863 - RNA, 12 nt, Human adenovirus B [HAdV-B]
caggccagcaca

SEQ ID NO: 3905864 - RNA, 14 nt, Human adenovirus B [HAdV-B]
caggucuacugguc

SEQ ID NO: 3905865 - RNA, 15 nt, Human adenovirus B [HAdV-B]
caguacaagcgcaga

SEQ ID NO: 3905866 - RNA, 15 nt, Human adenovirus B [HAdV-B]
caguagguuuggaag

SEQ ID NO: 3905867 - RNA, 14 nt, Human adenovirus B [HAdV-B]
caguccugccacca

SEQ ID NO: 3905868 - RNA, 22 nt, Human adenovirus B [HAdV-B]
cagucuuuccaucacaagacaa

SEQ ID NO: 3905869 - RNA, 24 nt, Human adenovirus B [HAdV-B]
cagugagcuggccuggaaaugaca

SEQ ID NO: 3905870 - RNA, 23 nt, Human adenovirus B [HAdV-B]
cagugaugagcagcuaacccgau

SEQ ID NO: 3905871 - RNA, 14 nt, Human adenovirus B [HAdV-B]
cagugcaggcagca

SEQ ID NO: 3905872 - RNA, 16 nt, Human adenovirus B [HAdV-B]
caguggauugcagaag

SEQ ID NO: 3905873 - RNA, 20 nt, Human adenovirus B [HAdV-B]
caguggcagccuagucgcag

SEQ ID NO: 3905874 - RNA, 21 nt, Human adenovirus B [HAdV-B]
caguguggaagagcucagccg

SEQ ID NO: 3905875 - RNA, 13 nt, Human adenovirus B [HAdV-B]
caguuacuaugac

SEQ ID NO: 3905876 - RNA, 15 nt, Human adenovirus B [HAdV-B]
cauacaauccagaca

SEQ ID NO: 3905877 - RNA, 15 nt, Human adenovirus B [HAdV-B]
cauacaugccacaga

SEQ ID NO: 3905878 - RNA, 18 nt, Human adenovirus B [HAdV-B]
cauacucgcgugccaggc

SEQ ID NO: 3905879 - RNA, 23 nt, Human adenovirus B [HAdV-B]
cauauucuguuugguaaaacaag

SEQ ID NO: 3905880 - RNA, 12 nt, Human adenovirus B [HAdV-B]
caucaguuucac

SEQ ID NO: 3905881 - RNA, 15 nt, Human adenovirus B [HAdV-B]
cauccucgacaugag

SEQ ID NO: 3905882 - RNA, 13 nt, Human adenovirus B [HAdV-B]
caucgugcucagu

SEQ ID NO: 3905883 - RNA, 12 nt, Human adenovirus B [HAdV-B]
caucuacugugg

SEQ ID NO: 3905884 - RNA, 19 nt, Human adenovirus B [HAdV-B]
caucucccaccacacccga

SEQ ID NO: 3905885 - RNA, 14 nt, Human adenovirus B [HAdV-B]
caucuuccagcaga

SEQ ID NO: 3905886 - RNA, 14 nt, Human adenovirus B [HAdV-B]
caucuucccagagc

SEQ ID NO: 3905887 - RNA, 15 nt, Human adenovirus B [HAdV-B]
caugaaucaugugaa

SEQ ID NO: 3905888 - RNA, 19 nt, Human adenovirus B [HAdV-B]
caugcauacuaacaugcca

SEQ ID NO: 3905889 - RNA, 17 nt, Human adenovirus B [HAdV-B]
caugccaaacgugaacg

SEQ ID NO: 3905890 - RNA, 15 nt, Human adenovirus B [HAdV-B]
cauggaaacucagcc

SEQ ID NO: 3905891 - RNA, 20 nt, Human adenovirus B [HAdV-B]
cauggaagcuguagugccuu

SEQ ID NO: 3905892 - RNA, 20 nt, Human adenovirus B [HAdV-B]
cauggaugagcaucacagcg

SEQ ID NO: 3905893 - RNA, 13 nt, Human adenovirus B [HAdV-B]
caugggcauuuug

SEQ ID NO: 3905894 - RNA, 12 nt, Human adenovirus B [HAdV-B]
cauguccaccug

SEQ ID NO: 3905895 - RNA, 21 nt, Human adenovirus B [HAdV-B]
caugugauggcgcuagcagcc

SEQ ID NO: 3905896 - RNA, 17 nt, Human adenovirus B [HAdV-B]
cauuaacuuugaugaac

SEQ ID NO: 3905897 - RNA, 15 nt, Human adenovirus B [HAdV-B]
cauuccuuaugcuua

SEQ ID NO: 3905898 - RNA, 14 nt, Human adenovirus B [HAdV-B]
cauugaugcucuau

SEQ ID NO: 3905899 - RNA, 14 nt, Human adenovirus B [HAdV-B]
cauugcuucucuga

SEQ ID NO: 3905900 - RNA, 16 nt, Human adenovirus B [HAdV-B]
ccaaagacugguucuu

SEQ ID NO: 3905901 - RNA, 12 nt, Human adenovirus B [HAdV-B]
ccaacagaaaac

SEQ ID NO: 3905902 - RNA, 16 nt, Human adenovirus B [HAdV-B]
ccccaucgaugcugcc

SEQ ID NO: 3905903 - RNA, 16 nt, Human adenovirus B [HAdV-B]
ccccggacccaaguug

SEQ ID NO: 3905904 - RNA, 20 nt, Human adenovirus B [HAdV-B]
cccgaagccuuuagacagca

SEQ ID NO: 3905905 - RNA, 22 nt, Human adenovirus B [HAdV-B]
cccgcaaugcgggcggcgcugc

SEQ ID NO: 3905906 - RNA, 13 nt, Human adenovirus B [HAdV-B]
cccgcaggcagug

SEQ ID NO: 3905907 - RNA, 15 nt, Human adenovirus B [HAdV-B]
cccgggacuguggac

SEQ ID NO: 3905908 - RNA, 13 nt, Human adenovirus B [HAdV-B]
cccuacgcugucu

SEQ ID NO: 3905909 - RNA, 14 nt, Human adenovirus B [HAdV-B]
ccgacggugcugca

SEQ ID NO: 3905910 - RNA, 12 nt, Human adenovirus B [HAdV-B]
ccgcaagagcuc

SEQ ID NO: 3905911 - RNA, 18 nt, Human adenovirus B [HAdV-B]
ccgccaaacccaacacac

SEQ ID NO: 3905912 - RNA, 20 nt, Human adenovirus B [HAdV-B]
ccgcguucgggggugugcuc

SEQ ID NO: 3905913 - RNA, 22 nt, Human adenovirus B [HAdV-B]
ccggcauggguguauggcagca

SEQ ID NO: 3905914 - RNA, 22 nt, Human adenovirus B [HAdV-B]
ccggcgaaggcgcauugccaga

SEQ ID NO: 3905915 - RNA, 16 nt, Human adenovirus B [HAdV-B]
ccggucccacucgaag

SEQ ID NO: 3905916 - RNA, 18 nt, Human adenovirus B [HAdV-B]
ccgucgccauacccuacc

SEQ ID NO: 3905917 - RNA, 16 nt, Human adenovirus B [HAdV-B]
ccguucucgcuggcca

SEQ ID NO: 3905918 - RNA, 21 nt, Human adenovirus B [HAdV-B]
ccuacuugcgcaaguuugcuc

SEQ ID NO: 3905919 - RNA, 13 nt, Human adenovirus B [HAdV-B]
ccuagaaauuucu

SEQ ID NO: 3905920 - RNA, 21 nt, Human adenovirus B [HAdV-B]
ccuagucuacccuuuucucua

SEQ ID NO: 3905921 - RNA, 15 nt, Human adenovirus B [HAdV-B]
ccucaaaacuccacu

SEQ ID NO: 3905922 - RNA, 15 nt, Human adenovirus B [HAdV-B]
ccucaagggccgcac

SEQ ID NO: 3905923 - RNA, 16 nt, Human adenovirus B [HAdV-B]
ccuccaguggaggagg

SEQ ID NO: 3905924 - RNA, 22 nt, Human adenovirus B [HAdV-B]
ccuccccaauuggcuccagcaa

SEQ ID NO: 3905925 - RNA, 13 nt, Human adenovirus B [HAdV-B]
ccuccgccagaaa

SEQ ID NO: 3905926 - RNA, 13 nt, Human adenovirus B [HAdV-B]
ccucgcagcagca

SEQ ID NO: 3905927 - RNA, 15 nt, Human adenovirus B [HAdV-B]
ccucucaccuaccgc

SEQ ID NO: 3905928 - RNA, 16 nt, Human adenovirus B [HAdV-B]
ccugauuacuucuuuc

SEQ ID NO: 3905929 - RNA, 20 nt, Human adenovirus B [HAdV-B]
ccugcauggugggaaucaac

SEQ ID NO: 3905930 - RNA, 15 nt, Human adenovirus B [HAdV-B]
ccugcugcgcacugc

SEQ ID NO: 3905931 - RNA, 13 nt, Human adenovirus B [HAdV-B]
ccuggaaggcgga

SEQ ID NO: 3905932 - RNA, 21 nt, Human adenovirus B [HAdV-B]
ccuggaaggcggaugacuggc

SEQ ID NO: 3905933 - RNA, 18 nt, Human adenovirus B [HAdV-B]
ccuggagcgacaucggca

SEQ ID NO: 3905934 - RNA, 18 nt, Human adenovirus B [HAdV-B]
ccugucugauuccuggau

SEQ ID NO: 3905935 - RNA, 17 nt, Human adenovirus B [HAdV-B]
ccuguuccgucuggcca

SEQ ID NO: 3905936 - RNA, 16 nt, Human adenovirus B [HAdV-B]
ccuuagaaaaugcaaa

SEQ ID NO: 3905937 - RNA, 17 nt, Human adenovirus B [HAdV-B]
ccuuccaguacucuucu

SEQ ID NO: 3905938 - RNA, 13 nt, Human adenovirus B [HAdV-B]
ccuuuagacagca

SEQ ID NO: 3905939 - RNA, 14 nt, Human adenovirus B [HAdV-B]
ccuuugacacugcc

SEQ ID NO: 3905940 - RNA, 16 nt, Human adenovirus B [HAdV-B]
cgaagagaaucugcac

SEQ ID NO: 3905941 - RNA, 14 nt, Human adenovirus B [HAdV-B]
cgaaguugaugaaa

SEQ ID NO: 3905942 - RNA, 14 nt, Human adenovirus B [HAdV-B]
cgagacgcccaggc

SEQ ID NO: 3905943 - RNA, 16 nt, Human adenovirus B [HAdV-B]
cgagcaagacccgggc

SEQ ID NO: 3905944 - RNA, 16 nt, Human adenovirus B [HAdV-B]
cgaggcagucuaccug

SEQ ID NO: 3905945 - RNA, 13 nt, Human adenovirus B [HAdV-B]
cgaguacuuggaa

SEQ ID NO: 3905946 - RNA, 15 nt, Human adenovirus B [HAdV-B]
cgauccaugcuucug

SEQ ID NO: 3905947 - RNA, 17 nt, Human adenovirus B [HAdV-B]
cgaugggucuucuccug

SEQ ID NO: 3905948 - RNA, 18 nt, Human adenovirus B [HAdV-B]
cgaugggucuucuccugg

SEQ ID NO: 3905949 - RNA, 19 nt, Human adenovirus B [HAdV-B]
cgcaaaguucgacaugugu

SEQ ID NO: 3905950 - RNA, 14 nt, Human adenovirus B [HAdV-B]
cgcauugccagacg

SEQ ID NO: 3905951 - RNA, 13 nt, Human adenovirus B [HAdV-B]
cgccaccugcugc

SEQ ID NO: 3905952 - RNA, 17 nt, Human adenovirus B [HAdV-B]
cgccagacgccgcaccu

SEQ ID NO: 3905953 - RNA, 16 nt, Human adenovirus B [HAdV-B]
cgccaugacagacaga

SEQ ID NO: 3905954 - RNA, 22 nt, Human adenovirus B [HAdV-B]
cgcccguaauuauacuccuacu

SEQ ID NO: 3905955 - RNA, 14 nt, Human adenovirus B [HAdV-B]
cgccucccaggacu

SEQ ID NO: 3905956 - RNA, 10 nt, Human adenovirus B [HAdV-B]
cgcgaacagg

SEQ ID NO: 3905957 - RNA, 14 nt, Human adenovirus B [HAdV-B]
cgcucacaccucac

SEQ ID NO: 3905958 - RNA, 11 nt, Human adenovirus B [HAdV-B]
cgcuuucacag

SEQ ID NO: 3905959 - RNA, 15 nt, Human adenovirus B [HAdV-B]
cggaagccagcaccc

SEQ ID NO: 3905960 - RNA, 17 nt, Human adenovirus B [HAdV-B]
cggagacaagcaacagc

SEQ ID NO: 3905961 - RNA, 14 nt, Human adenovirus B [HAdV-B]
cggagggcagaaac

SEQ ID NO: 3905962 - RNA, 14 nt, Human adenovirus B [HAdV-B]
cggcaggaugugag

SEQ ID NO: 3905963 - RNA, 17 nt, Human adenovirus B [HAdV-B]
cggcaggcgccucccag

SEQ ID NO: 3905964 - RNA, 17 nt, Human adenovirus B [HAdV-B]
cggcaggucccgcaggc

SEQ ID NO: 3905965 - RNA, 23 nt, Human adenovirus B [HAdV-B]
cggcgcuacuugcuauuccacca

SEQ ID NO: 3905966 - RNA, 16 nt, Human adenovirus B [HAdV-B]
cgggcaugaccucugc

SEQ ID NO: 3905967 - RNA, 16 nt, Human adenovirus B [HAdV-B]
cgggcggaaucgggac

SEQ ID NO: 3905968 - RNA, 16 nt, Human adenovirus B [HAdV-B]
cgggucgugagcugcg

SEQ ID NO: 3905969 - RNA, 18 nt, Human adenovirus B [HAdV-B]
cgguacaccggauugcag

SEQ ID NO: 3905970 - RNA, 19 nt, Human adenovirus B [HAdV-B]
cggucacuuugcagcaagu

SEQ ID NO: 3905971 - RNA, 13 nt, Human adenovirus B [HAdV-B]
cgguccagcaagu

SEQ ID NO: 3905972 - RNA, 22 nt, Human adenovirus B [HAdV-B]
cgguucauuggggucaaaaaca

SEQ ID NO: 3905973 - RNA, 20 nt, Human adenovirus B [HAdV-B]
cguacgagagcgugaugcag

SEQ ID NO: 3905974 - RNA, 20 nt, Human adenovirus B [HAdV-B]
cguagacugauuuuacaggc

SEQ ID NO: 3905975 - RNA, 16 nt, Human adenovirus B [HAdV-B]
cguagcccaaugcaac

SEQ ID NO: 3905976 - RNA, 15 nt, Human adenovirus B [HAdV-B]
cgucaucacccaggg

SEQ ID NO: 3905977 - RNA, 19 nt, Human adenovirus B [HAdV-B]
cguccagcgcugccagggu

SEQ ID NO: 3905978 - RNA, 20 nt, Human adenovirus B [HAdV-B]
cguggucauuucuugcuugc

SEQ ID NO: 3905979 - RNA, 19 nt, Human adenovirus B [HAdV-B]
uauuuugccucccccuucc

SEQ ID NO: 3905980 - RNA, 13 nt, Human adenovirus B [HAdV-B]
uauuuuugcuucu

SEQ ID NO: 3905981 - RNA, 20 nt, Human adenovirus B [HAdV-B]
ucaacaauaccuguguagau

SEQ ID NO: 3905982 - RNA, 13 nt, Human adenovirus B [HAdV-B]
ucaagauggccac

SEQ ID NO: 3905983 - RNA, 13 nt, Human adenovirus B [HAdV-B]
ucacagagacgag

SEQ ID NO: 3905984 - RNA, 20 nt, Human adenovirus B [HAdV-B]
ucacaucucguccucagcga

SEQ ID NO: 3905985 - RNA, 21 nt, Human adenovirus B [HAdV-B]
ucaccaaacugcuuagccaga

SEQ ID NO: 3905986 - RNA, 15 nt, Human adenovirus B [HAdV-B]
ucaccaaggccaugg

SEQ ID NO: 3905987 - RNA, 14 nt, Human adenovirus B [HAdV-B]
ucaccugggcagcu

SEQ ID NO: 3905988 - RNA, 14 nt, Human adenovirus B [HAdV-B]
ucacuucccucuuc

SEQ ID NO: 3905989 - RNA, 19 nt, Human adenovirus B [HAdV-B]
ucagauaaggcguaguguu

SEQ ID NO: 3905990 - RNA, 19 nt, Human adenovirus B [HAdV-B]
ucagcaauaaggucucugu

SEQ ID NO: 3905991 - RNA, 17 nt, Human adenovirus B [HAdV-B]
ucagccagaaccucagc

SEQ ID NO: 3905992 - RNA, 15 nt, Human adenovirus B [HAdV-B]
ucauccaaauucacc

SEQ ID NO: 3905993 - RNA, 23 nt, Human adenovirus B [HAdV-B]
ucauccauggagguuugggccau

SEQ ID NO: 3905994 - RNA, 17 nt, Human adenovirus B [HAdV-B]
ucaugaccagcaugaaa

SEQ ID NO: 3905995 - RNA, 11 nt, Human adenovirus B [HAdV-B]
ucaugccugga

SEQ ID NO: 3905996 - RNA, 21 nt, Human adenovirus B [HAdV-B]
ucaugguaccuagaaauuucu

SEQ ID NO: 3905997 - RNA, 20 nt, Human adenovirus B [HAdV-B]
uccaacagaaaaccagcagc

SEQ ID NO: 3905998 - RNA, 16 nt, Human adenovirus B [HAdV-B]
uccagcgcugccaggg

SEQ ID NO: 3905999 - RNA, 13 nt, Human adenovirus B [HAdV-B]
uccagucuccugc

SEQ ID NO: 3906000 - RNA, 16 nt, Human adenovirus B [HAdV-B]
uccagucuccugccgc

SEQ ID NO: 3906001 - RNA, 21 nt, Human adenovirus B [HAdV-B]
uccaucacaagacaagccaca

SEQ ID NO: 3906002 - RNA, 22 nt, Human adenovirus B [HAdV-B]
uccaucagcagacacaucacuu

SEQ ID NO: 3906003 - RNA, 16 nt, Human adenovirus B [HAdV-B]
ucccagggauuuggaa

SEQ ID NO: 3906004 - RNA, 20 nt, Human adenovirus B [HAdV-B]
ucccgagugguacacugucu

SEQ ID NO: 3906005 - RNA, 16 nt, Human adenovirus B [HAdV-B]
ucccgcagacucauuu

SEQ ID NO: 3906006 - RNA, 22 nt, Human adenovirus B [HAdV-B]
ucccgccaagaauuucuacuga

SEQ ID NO: 3906007 - RNA, 19 nt, Human adenovirus B [HAdV-B]
ucccgcugucaaccugccc

SEQ ID NO: 3906008 - RNA, 16 nt, Human adenovirus B [HAdV-B]
uccgaccuggcagacc

SEQ ID NO: 3906009 - RNA, 12 nt, Human adenovirus B [HAdV-B]
uccgacugcagc

SEQ ID NO: 3906010 - RNA, 20 nt, Human adenovirus B [HAdV-B]
uccgcgauaccuggcaccua

SEQ ID NO: 3906011 - RNA, 15 nt, Human adenovirus B [HAdV-B]
uccgguauccugccc

SEQ ID NO: 3906012 - RNA, 19 nt, Human adenovirus B [HAdV-B]
ucgagccggccggagccgc

SEQ ID NO: 3906013 - RNA, 16 nt, Human adenovirus B [HAdV-B]
ucgagggucugggcaa

SEQ ID NO: 3906014 - RNA, 13 nt, Human adenovirus B [HAdV-B]
ucgcgugccaggc

SEQ ID NO: 3906015 - RNA, 15 nt, Human adenovirus B [HAdV-B]
ucgcucaccagaagu

SEQ ID NO: 3906016 - RNA, 16 nt, Human adenovirus B [HAdV-B]
ucggaacuggcaccuc

SEQ ID NO: 3906017 - RNA, 13 nt, Human adenovirus B [HAdV-B]
ucgggggcagagg

SEQ ID NO: 3906018 - RNA, 22 nt, Human adenovirus B [HAdV-B]
ucgguccuuccagggucucagu

SEQ ID NO: 3906019 - RNA, 19 nt, Human adenovirus B [HAdV-B]
ucuaaggccauuugccauu

SEQ ID NO: 3906020 - RNA, 16 nt, Human adenovirus B [HAdV-B]
ucuagaccacugccgc

SEQ ID NO: 3906021 - RNA, 13 nt, Human adenovirus B [HAdV-B]
ucuaugaggacca

SEQ ID NO: 3906022 - RNA, 20 nt, Human adenovirus B [HAdV-B]
ucugcacucagguugucagu

SEQ ID NO: 3906023 - RNA, 17 nt, Human adenovirus B [HAdV-B]
ucuguauugcaggagaa

SEQ ID NO: 3906024 - RNA, 22 nt, Human adenovirus B [HAdV-B]
ucuuaaaccggucacuuugcag

SEQ ID NO: 3906025 - RNA, 17 nt, Human adenovirus B [HAdV-B]
ucuucgggggcagaggu

SEQ ID NO: 3906026 - RNA, 15 nt, Human adenovirus B [HAdV-B]
ugaaacccacugcua

SEQ ID NO: 3906027 - RNA, 11 nt, Human adenovirus B [HAdV-B]
ugaacucugau

SEQ ID NO: 3906028 - RNA, 14 nt, Human adenovirus B [HAdV-B]
ugaagccaugcugc

SEQ ID NO: 3906029 - RNA, 18 nt, Human adenovirus B [HAdV-B]
ugaaggaugaaaaaaaac

SEQ ID NO: 3906030 - RNA, 11 nt, Human adenovirus B [HAdV-B]
ugaagugcaaa

SEQ ID NO: 3906031 - RNA, 17 nt, Human adenovirus B [HAdV-B]
ugaauuagucugcaaaa

SEQ ID NO: 3906032 - RNA, 12 nt, Human adenovirus B [HAdV-B]
ugaccacagcaa

SEQ ID NO: 3906033 - RNA, 19 nt, Human adenovirus B [HAdV-B]
ugagaagguccuggccauc

SEQ ID NO: 3906034 - RNA, 13 nt, Human adenovirus B [HAdV-B]
ugagcugggaugg

SEQ ID NO: 3906035 - RNA, 17 nt, Human adenovirus B [HAdV-B]
ugaggaccaaucacagc

SEQ ID NO: 3906036 - RNA, 20 nt, Human adenovirus B [HAdV-B]
ugaggccacaacgcacagcc

SEQ ID NO: 3906037 - RNA, 14 nt, Human adenovirus B [HAdV-B]
ugaucgcacugcuu

SEQ ID NO: 3906038 - RNA, 12 nt, Human adenovirus B [HAdV-B]
ugaucuggacuu

SEQ ID NO: 3906039 - RNA, 18 nt, Human adenovirus B [HAdV-B]
ugaucuggacuuggaaga

SEQ ID NO: 3906040 - RNA, 14 nt, Human adenovirus B [HAdV-B]
ugaugaaaugacag

SEQ ID NO: 3906041 - RNA, 14 nt, Human adenovirus B [HAdV-B]
ugaugcguuucuua

SEQ ID NO: 3906042 - RNA, 22 nt, Human adenovirus B [HAdV-B]
ugcaaaucuggaagauccugag

SEQ ID NO: 3906043 - RNA, 13 nt, Human adenovirus B [HAdV-B]
ugcaacccccagu

SEQ ID NO: 3906044 - RNA, 20 nt, Human adenovirus B [HAdV-B]
aggagaaauauucacuggaa

SEQ ID NO: 3906045 - RNA, 21 nt, Human adenovirus B [HAdV-B]
aggaggauuaaagauuacagc

SEQ ID NO: 3906046 - RNA, 20 nt, Human adenovirus B [HAdV-B]
aggaggcggaguagcugacu

SEQ ID NO: 3906047 - RNA, 15 nt, Human adenovirus B [HAdV-B]
aggagucaaccccac

SEQ ID NO: 3906048 - RNA, 19 nt, Human adenovirus B [HAdV-B]
aggaugcauuauuggacag

SEQ ID NO: 3906049 - RNA, 13 nt, Human adenovirus B [HAdV-B]
aggauguccaagc

SEQ ID NO: 3906050 - RNA, 12 nt, Human adenovirus B [HAdV-B]
aggcaaaacaaa

SEQ ID NO: 3906051 - RNA, 18 nt, Human adenovirus B [HAdV-B]
aggcaauguauacugggu

SEQ ID NO: 3906052 - RNA, 19 nt, Human adenovirus B [HAdV-B]
aggcagaggaggcggagga

SEQ ID NO: 3906053 - RNA, 15 nt, Human adenovirus B [HAdV-B]
aggcgcugcugaaca

SEQ ID NO: 3906054 - RNA, 23 nt, Human adenovirus B [HAdV-B]
aggcuacaacguagcccaaugca

SEQ ID NO: 3906055 - RNA, 18 nt, Human adenovirus B [HAdV-B]
aggcuguucugacuuugg

SEQ ID NO: 3906056 - RNA, 14 nt, Human adenovirus B [HAdV-B]
agggaaaaguacag

SEQ ID NO: 3906057 - RNA, 16 nt, Human adenovirus B [HAdV-B]
agggauuuggaagagc

SEQ ID NO: 3906058 - RNA, 20 nt, Human adenovirus B [HAdV-B]
aggggacugccccauggcau

SEQ ID NO: 3906059 - RNA, 22 nt, Human adenovirus B [HAdV-B]
aggguaauuuguuugccaugga

SEQ ID NO: 3906060 - RNA, 17 nt, Human adenovirus B [HAdV-B]
agguguauuucacguga

SEQ ID NO: 3906061 - RNA, 13 nt, Human adenovirus B [HAdV-B]
agguucuguggac

SEQ ID NO: 3906062 - RNA, 20 nt, Human adenovirus B [HAdV-B]
aguacuggcuaccuaucaca

SEQ ID NO: 3906063 - RNA, 16 nt, Human adenovirus B [HAdV-B]
aguaguuauuuugccu

SEQ ID NO: 3906064 - RNA, 19 nt, Human adenovirus B [HAdV-B]
aguccugccagggcacacg

SEQ ID NO: 3906065 - RNA, 17 nt, Human adenovirus B [HAdV-B]
agucuguugaugcccaa

SEQ ID NO: 3906066 - RNA, 17 nt, Human adenovirus B [HAdV-B]
agugaaucuaaugauug

SEQ ID NO: 3906067 - RNA, 19 nt, Human adenovirus B [HAdV-B]
agugcgguacacccuggcc

SEQ ID NO: 3906068 - RNA, 15 nt, Human adenovirus B [HAdV-B]
agugcuuugagacug

SEQ ID NO: 3906069 - RNA, 14 nt, Human adenovirus B [HAdV-B]
aguuccaaauggag

SEQ ID NO: 3906070 - RNA, 12 nt, Human adenovirus B [HAdV-B]
auaaaacaggac

SEQ ID NO: 3906071 - RNA, 21 nt, Human adenovirus B [HAdV-B]
auaaacaagcuuguuguugau

SEQ ID NO: 3906072 - RNA, 19 nt, Human adenovirus B [HAdV-B]
auaauauugccaugcaggc

SEQ ID NO: 3906073 - RNA, 23 nt, Human adenovirus B [HAdV-B]
auacaccccguccaaugucacuc

SEQ ID NO: 3906074 - RNA, 22 nt, Human adenovirus B [HAdV-B]
auacacggcucucaugaaagca

SEQ ID NO: 3906075 - RNA, 22 nt, Human adenovirus B [HAdV-B]
auacuagucuugcuuguuuuac

SEQ ID NO: 3906076 - RNA, 19 nt, Human adenovirus B [HAdV-B]
auagcuuccuuggaagagg

SEQ ID NO: 3906077 - RNA, 17 nt, Human adenovirus B [HAdV-B]
auauaaucugcaacaaa

SEQ ID NO: 3906078 - RNA, 21 nt, Human adenovirus B [HAdV-B]
aucaacgugacagcaaaugac

SEQ ID NO: 3906079 - RNA, 19 nt, Human adenovirus B [HAdV-B]
aucacaaucuggcaacagc

SEQ ID NO: 3906080 - RNA, 15 nt, Human adenovirus B [HAdV-B]
aucacuuccaugccu

SEQ ID NO: 3906081 - RNA, 16 nt, Human adenovirus B [HAdV-B]
aucauagugcaggagc

SEQ ID NO: 3906082 - RNA, 19 nt, Human adenovirus B [HAdV-B]
aucauauugcuugaaagcc

SEQ ID NO: 3906083 - RNA, 15 nt, Human adenovirus B [HAdV-B]
aucaugguguggaag

SEQ ID NO: 3906084 - RNA, 19 nt, Human adenovirus B [HAdV-B]
auccauggaugcccaugcc

SEQ ID NO: 3906085 - RNA, 20 nt, Human adenovirus B [HAdV-B]
aucccacuaugcaacugaug

SEQ ID NO: 3906086 - RNA, 17 nt, Human adenovirus B [HAdV-B]
auccucggcugcggaga

SEQ ID NO: 3906087 - RNA, 20 nt, Human adenovirus B [HAdV-B]
aucuaaggccauuugccauu

SEQ ID NO: 3906088 - RNA, 18 nt, Human adenovirus B [HAdV-B]
aucuacuucgaacucccc

SEQ ID NO: 3906089 - RNA, 14 nt, Human adenovirus B [HAdV-B]
aucucccaccacac

SEQ ID NO: 3906090 - RNA, 16 nt, Human adenovirus B [HAdV-B]
aucuguaccugugcca

SEQ ID NO: 3906091 - RNA, 23 nt, Human adenovirus B [HAdV-B]
aucuugcaggucugccuacccau

SEQ ID NO: 3906092 - RNA, 12 nt, Human adenovirus B [HAdV-B]
augaaaaacacc

SEQ ID NO: 3906093 - RNA, 17 nt, Human adenovirus B [HAdV-B]
augaacaaugccaucau

SEQ ID NO: 3906094 - RNA, 14 nt, Human adenovirus B [HAdV-B]
augacagaaugcau

SEQ ID NO: 3906095 - RNA, 22 nt, Human adenovirus B [HAdV-B]
augaccagcaugaaaggaacua

SEQ ID NO: 3906096 - RNA, 17 nt, Human adenovirus B [HAdV-B]
augacccagaugccugu

SEQ ID NO: 3906097 - RNA, 20 nt, Human adenovirus B [HAdV-B]
augaguggaacuuuaggaag

SEQ ID NO: 3906098 - RNA, 22 nt, Human adenovirus B [HAdV-B]
augauauucuugagcaggcggc

SEQ ID NO: 3906099 - RNA, 23 nt, Human adenovirus B [HAdV-B]
augccaucaucuccugcuugcau

SEQ ID NO: 3906100 - RNA, 12 nt, Human adenovirus B [HAdV-B]
augcccagcacg

SEQ ID NO: 3906101 - RNA, 20 nt, Human adenovirus B [HAdV-B]
augcuuagggcggccagacg

SEQ ID NO: 3906102 - RNA, 13 nt, Human adenovirus B [HAdV-B]
auggaaaucccac

SEQ ID NO: 3906103 - RNA, 14 nt, Human adenovirus B [HAdV-B]
auggcagggaagug

SEQ ID NO: 3906104 - RNA, 16 nt, Human adenovirus B [HAdV-B]
augggcaccuggagcg

SEQ ID NO: 3906105 - RNA, 15 nt, Human adenovirus B [HAdV-B]
augggcgaagaggag

SEQ ID NO: 3906106 - RNA, 21 nt, Human adenovirus B [HAdV-B]
auggugggucuuugaaaaaug

SEQ ID NO: 3906107 - RNA, 14 nt, Human adenovirus B [HAdV-B]
auguuuaaccccac

SEQ ID NO: 3906108 - RNA, 12 nt, Human adenovirus B [HAdV-B]
auucccugcaga

SEQ ID NO: 3906109 - RNA, 20 nt, Human adenovirus B [HAdV-B]
auucuguuugguaaaacaag

SEQ ID NO: 3906110 - RNA, 16 nt, Human adenovirus B [HAdV-B]
auucuuaacagugcag

SEQ ID NO: 3906111 - RNA, 22 nt, Human adenovirus B [HAdV-B]
auugaugacaauauuaacaccu

SEQ ID NO: 3906112 - RNA, 12 nt, Human adenovirus B [HAdV-B]
auugccacagcu

SEQ ID NO: 3906113 - RNA, 19 nt, Human adenovirus B [HAdV-B]
auuguguucuccuaggcag

SEQ ID NO: 3906114 - RNA, 14 nt, Human adenovirus B [HAdV-B]
auuguguuucaagc

SEQ ID NO: 3906115 - RNA, 20 nt, Human adenovirus B [HAdV-B]
auuuacuaacuagacucuca

SEQ ID NO: 3906116 - RNA, 20 nt, Human adenovirus B [HAdV-B]
auuuuacaggccucuucucc

SEQ ID NO: 3906117 - RNA, 23 nt, Human adenovirus B [HAdV-B]
auuuuggagagaguuugcugcaa

SEQ ID NO: 3906118 - RNA, 23 nt, Human adenovirus B [HAdV-B]
caaaaauaaaaaaaaaaacaagc

SEQ ID NO: 3906119 - RNA, 17 nt, Human adenovirus B [HAdV-B]
caaaauagaagcugcua

SEQ ID NO: 3906120 - RNA, 13 nt, Human adenovirus B [HAdV-B]
caaacgccagaag

SEQ ID NO: 3906121 - RNA, 14 nt, Human adenovirus B [HAdV-B]
caaagaaacucccu

SEQ ID NO: 3906122 - RNA, 13 nt, Human adenovirus B [HAdV-B]
caacaaaacaaaa

SEQ ID NO: 3906123 - RNA, 12 nt, Human adenovirus B [HAdV-B]
caaccacacucu

SEQ ID NO: 3906124 - RNA, 18 nt, Human adenovirus B [HAdV-B]
caagaauuucuacugaaa

SEQ ID NO: 3906125 - RNA, 14 nt, Human adenovirus B [HAdV-B]
caagauuggaauaa

SEQ ID NO: 3906126 - RNA, 12 nt, Human adenovirus B [HAdV-B]
caagcaggagag

SEQ ID NO: 3906127 - RNA, 21 nt, Human adenovirus B [HAdV-B]
caagccacagggucuccagcu

SEQ ID NO: 3906128 - RNA, 19 nt, Human adenovirus B [HAdV-B]
caaguugaucaugccugga

SEQ ID NO: 3906129 - RNA, 12 nt, Human adenovirus B [HAdV-B]
caauaacaaaac

SEQ ID NO: 3906130 - RNA, 15 nt, Human adenovirus B [HAdV-B]
gcgaaggugaagauu

SEQ ID NO: 3906131 - RNA, 15 nt, Human adenovirus B [HAdV-B]
gcgaccuccaacaga

SEQ ID NO: 3906132 - RNA, 14 nt, Human adenovirus B [HAdV-B]
gcgaggagccggag

SEQ ID NO: 3906133 - RNA, 15 nt, Human adenovirus B [HAdV-B]
gcgauaaugccagac

SEQ ID NO: 3906134 - RNA, 12 nt, Human adenovirus B [HAdV-B]
gcgccagcagga

SEQ ID NO: 3906135 - RNA, 19 nt, Human adenovirus B [HAdV-B]
gcgccagcaucaguuucac

SEQ ID NO: 3906136 - RNA, 19 nt, Human adenovirus B [HAdV-B]
gcgccgcgacggcaggaug

SEQ ID NO: 3906137 - RNA, 22 nt, Human adenovirus B [HAdV-B]
gcgccucccaggacuacuccac

SEQ ID NO: 3906138 - RNA, 14 nt, Human adenovirus B [HAdV-B]
gcgcugcagagcca

SEQ ID NO: 3906139 - RNA, 15 nt, Human adenovirus B [HAdV-B]
gcgcugcagagccag

SEQ ID NO: 3906140 - RNA, 20 nt, Human adenovirus B [HAdV-B]
gcggacauugcuucucugaa

SEQ ID NO: 3906141 - RNA, 21 nt, Human adenovirus B [HAdV-B]
gcggcgaggagccggaggaga

SEQ ID NO: 3906142 - RNA, 15 nt, Human adenovirus B [HAdV-B]
gcgggacagcccgcc

SEQ ID NO: 3906143 - RNA, 16 nt, Human adenovirus B [HAdV-B]
gcguggcucgcuacaa

SEQ ID NO: 3906144 - RNA, 22 nt, Human adenovirus B [HAdV-B]
gcguugguggagaacaaagcua

SEQ ID NO: 3906145 - RNA, 18 nt, Human adenovirus B [HAdV-B]
gcuauuugcaccacacuu

SEQ ID NO: 3906146 - RNA, 15 nt, Human adenovirus B [HAdV-B]
gcucuuacugcggag

SEQ ID NO: 3906147 - RNA, 14 nt, Human adenovirus B [HAdV-B]
gcucuuccucacug

SEQ ID NO: 3906148 - RNA, 20 nt, Human adenovirus B [HAdV-B]
gcugacuugucuccugaacu

SEQ ID NO: 3906149 - RNA, 18 nt, Human adenovirus B [HAdV-B]
gcuggauauggccagcac

SEQ ID NO: 3906150 - RNA, 20 nt, Human adenovirus B [HAdV-B]
gcuuaacuugccuaucugug

SEQ ID NO: 3906151 - RNA, 16 nt, Human adenovirus B [HAdV-B]
gcuuccuuggaagagg

SEQ ID NO: 3906152 - RNA, 22 nt, Human adenovirus B [HAdV-B]
gcuucucugaacuaucagaaug

SEQ ID NO: 3906153 - RNA, 13 nt, Human adenovirus B [HAdV-B]
gcuucuugcaaau

SEQ ID NO: 3906154 - RNA, 22 nt, Human adenovirus B [HAdV-B]
ggaacagcaguacaggacaggc

SEQ ID NO: 3906155 - RNA, 22 nt, Human adenovirus B [HAdV-B]
ggaaccagaugccuuuuccaga

SEQ ID NO: 3906156 - RNA, 20 nt, Human adenovirus B [HAdV-B]
ggaagagcucagccgcgccu

SEQ ID NO: 3906157 - RNA, 24 nt, Human adenovirus B [HAdV-B]
ggaagauccugagguaugaugaua

SEQ ID NO: 3906158 - RNA, 17 nt, Human adenovirus B [HAdV-B]
ggaaggcggaugacugg

SEQ ID NO: 3906159 - RNA, 11 nt, Human adenovirus B [HAdV-B]
ggaaguuucag

SEQ ID NO: 3906160 - RNA, 15 nt, Human adenovirus B [HAdV-B]
ggaauccugaggcau

SEQ ID NO: 3906161 - RNA, 19 nt, Human adenovirus B [HAdV-B]
ggacccuccaguggaggag

SEQ ID NO: 3906162 - RNA, 23 nt, Human adenovirus B [HAdV-B]
ggaccguucaauuuguggaggag

SEQ ID NO: 3906163 - RNA, 18 nt, Human adenovirus B [HAdV-B]
ggagacggcuugcuggag

SEQ ID NO: 3906164 - RNA, 17 nt, Human adenovirus B [HAdV-B]
ggagcagccaaaucaga

SEQ ID NO: 3906165 - RNA, 13 nt, Human adenovirus B [HAdV-B]
ggcaaaguuuaaa

SEQ ID NO: 3906166 - RNA, 14 nt, Human adenovirus B [HAdV-B]
ggcaauucuggccc

SEQ ID NO: 3906167 - RNA, 15 nt, Human adenovirus B [HAdV-B]
ggcaauucuggccca

SEQ ID NO: 3906168 - RNA, 13 nt, Human adenovirus B [HAdV-B]
ggcaccuggagcg

SEQ ID NO: 3906169 - RNA, 13 nt, Human adenovirus B [HAdV-B]
ggcacgagccaac

SEQ ID NO: 3906170 - RNA, 19 nt, Human adenovirus B [HAdV-B]
ggcaggaugucacuccaca

SEQ ID NO: 3906171 - RNA, 14 nt, Human adenovirus B [HAdV-B]
ggcaggaugugagc

SEQ ID NO: 3906172 - RNA, 14 nt, Human adenovirus B [HAdV-B]
ggcaguuuggaagc

SEQ ID NO: 3906173 - RNA, 20 nt, Human adenovirus B [HAdV-B]
ggccaucauggaagcuguag

SEQ ID NO: 3906174 - RNA, 22 nt, Human adenovirus B [HAdV-B]
ggcccuggcagaacacacucuu

SEQ ID NO: 3906175 - RNA, 17 nt, Human adenovirus B [HAdV-B]
ggcgacggcggugaugc

SEQ ID NO: 3906176 - RNA, 16 nt, Human adenovirus B [HAdV-B]
ggcgaggaggaagagg

SEQ ID NO: 3906177 - RNA, 18 nt, Human adenovirus B [HAdV-B]
ggcgcuccucguccaaau

SEQ ID NO: 3906178 - RNA, 17 nt, Human adenovirus B [HAdV-B]
ggcgcugcagagccagc

SEQ ID NO: 3906179 - RNA, 13 nt, Human adenovirus B [HAdV-B]
ggcgggcacccaa

SEQ ID NO: 3906180 - RNA, 14 nt, Human adenovirus B [HAdV-B]
ggcggguggugccg

SEQ ID NO: 3906181 - RNA, 21 nt, Human adenovirus B [HAdV-B]
ggcuccagcaaaaacaagauu

SEQ ID NO: 3906182 - RNA, 22 nt, Human adenovirus B [HAdV-B]
ggcuccuaaaggcgcuccaaau

SEQ ID NO: 3906183 - RNA, 13 nt, Human adenovirus B [HAdV-B]
ggcuguggacagu

SEQ ID NO: 3906184 - RNA, 17 nt, Human adenovirus B [HAdV-B]
ggcuugacggggaagac

SEQ ID NO: 3906185 - RNA, 18 nt, Human adenovirus B [HAdV-B]
gggaacucauugaguuca

SEQ ID NO: 3906186 - RNA, 19 nt, Human adenovirus B [HAdV-B]
gggacagucaggcagagga

SEQ ID NO: 3906187 - RNA, 22 nt, Human adenovirus B [HAdV-B]
gggacgaggauuucgaaguuga

SEQ ID NO: 3906188 - RNA, 14 nt, Human adenovirus B [HAdV-B]
gggaugaaguuucu

SEQ ID NO: 3906189 - RNA, 23 nt, Human adenovirus B [HAdV-B]
gggcggcuuucagaggcugguca

SEQ ID NO: 3906190 - RNA, 13 nt, Human adenovirus B [HAdV-B]
gggcggguggugc

SEQ ID NO: 3906191 - RNA, 17 nt, Human adenovirus B [HAdV-B]
gggcggucagcuaaaga

SEQ ID NO: 3906192 - RNA, 15 nt, Human adenovirus B [HAdV-B]
gggugggagaggaag

SEQ ID NO: 3906193 - RNA, 15 nt, Human adenovirus B [HAdV-B]
gguccgaccuggaag

SEQ ID NO: 3906194 - RNA, 14 nt, Human adenovirus B [HAdV-B]
ggucugcauccaug

SEQ ID NO: 3906195 - RNA, 20 nt, Human adenovirus B [HAdV-B]
ggugcucaacgguggcuucc

SEQ ID NO: 3906196 - RNA, 22 nt, Human adenovirus B [HAdV-B]
gguggauaaaaugaguagaugg

SEQ ID NO: 3906197 - RNA, 16 nt, Human adenovirus B [HAdV-B]
gguggggcggucagcu

SEQ ID NO: 3906198 - RNA, 15 nt, Human adenovirus B [HAdV-B]
guaacagaagaggaa

SEQ ID NO: 3906199 - RNA, 18 nt, Human adenovirus B [HAdV-B]
guaaugggaguaaagugu

SEQ ID NO: 3906200 - RNA, 16 nt, Human adenovirus B [HAdV-B]
guacaaacuguagaca

SEQ ID NO: 3906201 - RNA, 16 nt, Human adenovirus B [HAdV-B]
guacaaccacacucuu

SEQ ID NO: 3906202 - RNA, 18 nt, Human adenovirus B [HAdV-B]
guacagcgggcacacaaa

SEQ ID NO: 3906203 - RNA, 23 nt, Human adenovirus B [HAdV-B]
guagacgccagcgccaugacaga

SEQ ID NO: 3906204 - RNA, 12 nt, Human adenovirus B [HAdV-B]
guagaggaaugu

SEQ ID NO: 3906205 - RNA, 17 nt, Human adenovirus B [HAdV-B]
guagauggcgccagcau

SEQ ID NO: 3906206 - RNA, 19 nt, Human adenovirus B [HAdV-B]
guagucaauauagaaauua

SEQ ID NO: 3906207 - RNA, 16 nt, Human adenovirus B [HAdV-B]
guaguguuguaaauca

SEQ ID NO: 3906208 - RNA, 16 nt, Human adenovirus B [HAdV-B]
guaucaaggcucugca

SEQ ID NO: 3906209 - RNA, 19 nt, Human adenovirus B [HAdV-B]
guauccugcccgccaccug

SEQ ID NO: 3906210 - RNA, 15 nt, Human adenovirus B [HAdV-B]
guaucgcgaagccau

SEQ ID NO: 3906211 - RNA, 12 nt, Human adenovirus B [HAdV-B]
guaugcaaacac

SEQ ID NO: 3906212 - RNA, 15 nt, Human adenovirus B [HAdV-B]
guauggaagugcaaa

SEQ ID NO: 3906213 - RNA, 19 nt, Human adenovirus B [HAdV-B]
guauugguuuaaaaaaugg

SEQ ID NO: 3906214 - RNA, 20 nt, Human adenovirus B [HAdV-B]
gucaaauuuuagcuccucuc

SEQ ID NO: 3906215 - RNA, 13 nt, Human adenovirus B [HAdV-B]
gucaauugucucu

SEQ ID NO: 3906216 - RNA, 15 nt, Human adenovirus B [HAdV-B]
gucagcauugucacu

SEQ ID NO: 3906217 - RNA, 21 nt, Human adenovirus B [HAdV-B]
gucaugggugcuaccgcggcu

SEQ ID NO: 3906218 - RNA, 14 nt, Human adenovirus B [HAdV-B]
guccaaaugcgcac

SEQ ID NO: 3906219 - RNA, 17 nt, Human adenovirus B [HAdV-B]
guccuggcgggggcaua

SEQ ID NO: 3906220 - RNA, 19 nt, Human adenovirus B [HAdV-B]
gucggggucaagagcagga

SEQ ID NO: 3906221 - RNA, 20 nt, Human adenovirus B [HAdV-B]
gucggggucaagagcaggaa

SEQ ID NO: 3906222 - RNA, 16 nt, Human adenovirus B [HAdV-B]
gucuacccguuucuug

SEQ ID NO: 3906223 - RNA, 15 nt, Human adenovirus B [HAdV-B]
gucuuacugccuggc

SEQ ID NO: 3906224 - RNA, 22 nt, Human adenovirus B [HAdV-B]
gucuuccggaucgcuguccagg

SEQ ID NO: 3906225 - RNA, 15 nt, Human adenovirus B [HAdV-B]
gucuuccuuggcuuc

SEQ ID NO: 3906226 - RNA, 16 nt, Human adenovirus B [HAdV-B]
gucuuuccaucacaag

SEQ ID NO: 3906227 - RNA, 15 nt, Human adenovirus B [HAdV-B]
gugaaaguguuguug

SEQ ID NO: 3906228 - RNA, 15 nt, Human adenovirus B [HAdV-B]
gugagaauuggaaga

SEQ ID NO: 3906229 - RNA, 15 nt, Human adenovirus B [HAdV-B]
gugaggcgcgcgcag

SEQ ID NO: 3906230 - RNA, 18 nt, Human adenovirus B [HAdV-B]
gugccaggcacuuccauu

SEQ ID NO: 3906231 - RNA, 18 nt, Human adenovirus B [HAdV-B]
gugccagguggucucugg

SEQ ID NO: 3906232 - RNA, 19 nt, Human adenovirus B [HAdV-B]
gugcccaucaguguggaag

SEQ ID NO: 3906233 - RNA, 12 nt, Human adenovirus B [HAdV-B]
gugcgggggcaa

SEQ ID NO: 3906234 - RNA, 19 nt, Human adenovirus B [HAdV-B]
gugcucaacgguggcuucc

SEQ ID NO: 3906235 - RNA, 17 nt, Human adenovirus B [HAdV-B]
guggauuuuuuccagga

SEQ ID NO: 3906236 - RNA, 18 nt, Human adenovirus B [HAdV-B]
guggcgguucaggccucg

SEQ ID NO: 3906237 - RNA, 16 nt, Human adenovirus B [HAdV-B]
gugggauuguuucuga

SEQ ID NO: 3906238 - RNA, 20 nt, Human adenovirus B [HAdV-B]
guggucagugaugagcagcu

SEQ ID NO: 3906239 - RNA, 14 nt, Human adenovirus B [HAdV-B]
guguauggcagcaa

SEQ ID NO: 3906240 - RNA, 15 nt, Human adenovirus B [HAdV-B]
guguugcucaggcau

SEQ ID NO: 3906241 - RNA, 22 nt, Human adenovirus B [HAdV-B]
guuagcuggcggcuccacccua

SEQ ID NO: 3906242 - RNA, 19 nt, Human adenovirus B [HAdV-B]
guucaauuuguggaggagu

SEQ ID NO: 3906243 - RNA, 19 nt, Human adenovirus B [HAdV-B]
guuccggagacagggagga

SEQ ID NO: 3906244 - RNA, 16 nt, Human adenovirus B [HAdV-B]
guuccuggacauugcu

SEQ ID NO: 3906245 - RNA, 23 nt, Human adenovirus B [HAdV-B]
guucgaaccaccgucgaugaugu

SEQ ID NO: 3906246 - RNA, 18 nt, Human adenovirus B [HAdV-B]
guucgcaagaugaggaca

SEQ ID NO: 3906247 - RNA, 13 nt, Human adenovirus B [HAdV-B]
guucuggaggagg

SEQ ID NO: 3906248 - RNA, 17 nt, Human adenovirus B [HAdV-B]
guucuggaggaggaaca

SEQ ID NO: 3906249 - RNA, 14 nt, Human adenovirus B [HAdV-B]
guugguuaaucaug

SEQ ID NO: 3906250 - RNA, 18 nt, Human adenovirus B [HAdV-B]
guuguaucugguggacaa

SEQ ID NO: 3906251 - RNA, 15 nt, Human adenovirus B [HAdV-B]
guuuacuuaagguga

SEQ ID NO: 3906252 - RNA, 22 nt, Human adenovirus B [HAdV-B]
guuucacauuccaccagccagg

SEQ ID NO: 3906253 - RNA, 20 nt, Human adenovirus B [HAdV-B]
guuucauuuuccucacaacg

SEQ ID NO: 3906254 - RNA, 14 nt, Human adenovirus B [HAdV-B]
guuucugguggugc

SEQ ID NO: 3906255 - RNA, 23 nt, Human adenovirus B [HAdV-B]
uaacaggaauuuuugacaugaac

SEQ ID NO: 3906256 - RNA, 21 nt, Human adenovirus B [HAdV-B]
uaacuguucacugguuuuuau

SEQ ID NO: 3906257 - RNA, 18 nt, Human adenovirus B [HAdV-B]
uaacuuuuguaaauguua

SEQ ID NO: 3906258 - RNA, 23 nt, Human adenovirus B [HAdV-B]
uaagcagguagcgccuggucugg

SEQ ID NO: 3906259 - RNA, 19 nt, Human adenovirus B [HAdV-B]
uaagugcuuugagacugau

SEQ ID NO: 3906260 - RNA, 11 nt, Human adenovirus B [HAdV-B]
uaauuggaagg

SEQ ID NO: 3906261 - RNA, 11 nt, Human adenovirus B [HAdV-B]
uacaaaaccau

SEQ ID NO: 3906262 - RNA, 22 nt, Human adenovirus B [HAdV-B]
uacacaccuugcuucacuuucu

SEQ ID NO: 3906263 - RNA, 14 nt, Human adenovirus B [HAdV-B]
uacacugucucugu

SEQ ID NO: 3906264 - RNA, 19 nt, Human adenovirus B [HAdV-B]
uacaugggcaccuggagcg

SEQ ID NO: 3906265 - RNA, 16 nt, Human adenovirus B [HAdV-B]
uaccgcggcugagccc

SEQ ID NO: 3906266 - RNA, 23 nt, Human adenovirus B [HAdV-B]
uacgaccagacggaaucuuucag

SEQ ID NO: 3906267 - RNA, 23 nt, Human adenovirus B [HAdV-B]
uacggaagccagcacccagacca

SEQ ID NO: 3906268 - RNA, 20 nt, Human adenovirus B [HAdV-B]
uacggagggcagaaacagca

SEQ ID NO: 3906269 - RNA, 16 nt, Human adenovirus B [HAdV-B]
uacguucguucuucuu

SEQ ID NO: 3906270 - RNA, 20 nt, Human adenovirus B [HAdV-B]
uacuaccaauauuuuugcuu

SEQ ID NO: 3906271 - RNA, 14 nt, Human adenovirus B [HAdV-B]
uacucacaaacuag

SEQ ID NO: 3906272 - RNA, 23 nt, Human adenovirus B [HAdV-B]
uacucgcgugccaggcacuucca

SEQ ID NO: 3906273 - RNA, 14 nt, Human adenovirus B [HAdV-B]
uacuugaaaucagc

SEQ ID NO: 3906274 - RNA, 17 nt, Human adenovirus B [HAdV-B]
uagaaugcauucuucug

SEQ ID NO: 3906275 - RNA, 13 nt, Human adenovirus B [HAdV-B]
uagagacagaagc

SEQ ID NO: 3906276 - RNA, 18 nt, Human adenovirus B [HAdV-B]
uagaucaaaagaaaugcg

SEQ ID NO: 3906277 - RNA, 16 nt, Human adenovirus B [HAdV-B]
uagccccaauggccac

SEQ ID NO: 3906278 - RNA, 18 nt, Human adenovirus B [HAdV-B]
uaguuauguuccugaguu

SEQ ID NO: 3906279 - RNA, 12 nt, Human adenovirus B [HAdV-B]
uauaaauuaaau

SEQ ID NO: 3906280 - RNA, 18 nt, Human adenovirus B [HAdV-B]
uauaaauuuuacugcaga

SEQ ID NO: 3906281 - RNA, 19 nt, Human adenovirus B [HAdV-B]
uaucagaaaaaaacagcca

SEQ ID NO: 3906282 - RNA, 20 nt, Human adenovirus B [HAdV-B]
uauccugcccgccaccugcu

SEQ ID NO: 3906283 - RNA, 14 nt, Human adenovirus B [HAdV-B]
uaucggaggaggag

SEQ ID NO: 3906284 - RNA, 19 nt, Human adenovirus B [HAdV-B]
uaucuaacguggaacucac

SEQ ID NO: 3906285 - RNA, 11 nt, Human adenovirus B [HAdV-B]
uaucuggagcg

SEQ ID NO: 3906286 - RNA, 22 nt, Human adenovirus B [HAdV-B]
uaugcaucugcgccgcaggagg

SEQ ID NO: 3906287 - RNA, 18 nt, Human adenovirus B [HAdV-B]
uaugcccgucuucucaaa

SEQ ID NO: 3906288 - RNA, 22 nt, Human adenovirus B [HAdV-B]
uauggaagcaguaacuuuugua

SEQ ID NO: 3906289 - RNA, 12 nt, Human adenovirus B [HAdV-B]
uauggccagcac

SEQ ID NO: 3906290 - RNA, 16 nt, Human adenovirus B [HAdV-B]
uauuccaauguggcuc

SEQ ID NO: 3906291 - RNA, 17 nt, Human adenovirus B [HAdV-B]
uauuguucguguugcuc

SEQ ID NO: 3906292 - RNA, 13 nt, Human adenovirus B [HAdV-B]
ucaauucacaaaa

SEQ ID NO: 3906293 - RNA, 23 nt, Human adenovirus B [HAdV-B]
ucacaaaaggcugucccugcaac

SEQ ID NO: 3906294 - RNA, 14 nt, Human adenovirus B [HAdV-B]
ucacaagacaagcc

SEQ ID NO: 3906295 - RNA, 14 nt, Human adenovirus B [HAdV-B]
ucacaaucuggcaa

SEQ ID NO: 3906296 - RNA, 17 nt, Human adenovirus B [HAdV-B]
ucacaucucguccucag

SEQ ID NO: 3906297 - RNA, 12 nt, Human adenovirus B [HAdV-B]
ucacuccacagc

SEQ ID NO: 3906298 - RNA, 12 nt, Human adenovirus B [HAdV-B]
ucagaaauuccc

SEQ ID NO: 3906299 - RNA, 17 nt, Human adenovirus B [HAdV-B]
ucagacuagcagacagg

SEQ ID NO: 3906300 - RNA, 19 nt, Human adenovirus B [HAdV-B]
ucagacucauccugcuggu

SEQ ID NO: 3906301 - RNA, 20 nt, Human adenovirus B [HAdV-B]
ucagagaggcgcugcugaac

SEQ ID NO: 3906302 - RNA, 23 nt, Human adenovirus B [HAdV-B]
ucagaugcaucccgugcugcgac

SEQ ID NO: 3906303 - RNA, 21 nt, Human adenovirus B [HAdV-B]
ucagcauuggcaaugcugaac

SEQ ID NO: 3906304 - RNA, 15 nt, Human adenovirus B [HAdV-B]
ucaggaucacagaga

SEQ ID NO: 3906305 - RNA, 22 nt, Human adenovirus B [HAdV-B]
ucagucgcgcuuugggacagga

SEQ ID NO: 3906306 - RNA, 20 nt, Human adenovirus B [HAdV-B]
ucauaggagcuggcuuucau

SEQ ID NO: 3906307 - RNA, 20 nt, Human adenovirus B [HAdV-B]
ucaugcuccgggguaguguu

SEQ ID NO: 3906308 - RNA, 17 nt, Human adenovirus B [HAdV-B]
uccaaggaugagacagu

SEQ ID NO: 3906309 - RNA, 17 nt, Human adenovirus B [HAdV-B]
uccacauuccaaacagu

SEQ ID NO: 3906310 - RNA, 13 nt, Human adenovirus B [HAdV-B]
uccaccuuuucca

SEQ ID NO: 3906311 - RNA, 19 nt, Human adenovirus B [HAdV-B]
uccagcuuuugcugugcca

SEQ ID NO: 3906312 - RNA, 15 nt, Human adenovirus B [HAdV-B]
uccagucuccugccg

SEQ ID NO: 3906313 - RNA, 22 nt, Human adenovirus B [HAdV-B]
uccauggagguuugggccauuu

SEQ ID NO: 3906314 - RNA, 23 nt, Human adenovirus B [HAdV-B]
ucccacucaugagaagguccugg

SEQ ID NO: 3906315 - RNA, 12 nt, Human adenovirus B [HAdV-B]
ucccaucacugg

SEQ ID NO: 3906316 - RNA, 12 nt, Human adenovirus B [HAdV-B]
ucccaucaucgu

SEQ ID NO: 3906317 - RNA, 15 nt, Human adenovirus B [HAdV-B]
ucccucuaaauacac

SEQ ID NO: 3906318 - RNA, 18 nt, Human adenovirus B [HAdV-B]
ucccugcagaaaucuucc

SEQ ID NO: 3906319 - RNA, 21 nt, Human adenovirus B [HAdV-B]
uccgaccuggaaggcggauga

SEQ ID NO: 3906320 - RNA, 14 nt, Human adenovirus B [HAdV-B]
uccgaccuggcaga

SEQ ID NO: 3906321 - RNA, 21 nt, Human adenovirus B [HAdV-B]
uccgcgauugugucuaucugu

SEQ ID NO: 3906322 - RNA, 14 nt, Human adenovirus B [HAdV-B]
uccugaaaccauuu

SEQ ID NO: 3906323 - RNA, 16 nt, Human adenovirus B [HAdV-B]
ucgaaggcgggcauga

SEQ ID NO: 3906324 - RNA, 19 nt, Human adenovirus B [HAdV-B]
ucgacagauaaagacagcg

SEQ ID NO: 3906325 - RNA, 16 nt, Human adenovirus B [HAdV-B]
ucgacgcaucucauga

SEQ ID NO: 3906326 - RNA, 12 nt, Human adenovirus B [HAdV-B]
ucgauuguugau

SEQ ID NO: 3906327 - RNA, 17 nt, Human adenovirus B [HAdV-B]
ucgcaaugacagaaugc

SEQ ID NO: 3906328 - RNA, 22 nt, Human adenovirus B [HAdV-B]
ucgcccccggucccucuaaaua

SEQ ID NO: 3906329 - RNA, 19 nt, Human adenovirus B [HAdV-B]
ucgcgcgguuagcgccagc

SEQ ID NO: 3906330 - RNA, 20 nt, Human adenovirus B [HAdV-B]
ucggcuuacgagcagacagu

SEQ ID NO: 3906331 - RNA, 18 nt, Human adenovirus B [HAdV-B]
ucggggaagauaguuguu

SEQ ID NO: 3906332 - RNA, 13 nt, Human adenovirus B [HAdV-B]
ucguucuucuuua

SEQ ID NO: 3906333 - RNA, 19 nt, Human adenovirus B [HAdV-B]
ucuaaauacacauacaaag

SEQ ID NO: 3906334 - RNA, 14 nt, Human adenovirus B [HAdV-B]
ccaucaucgugcuc

SEQ ID NO: 3906335 - RNA, 17 nt, Human adenovirus B [HAdV-B]
ccaucaucgugcucagu

SEQ ID NO: 3906336 - RNA, 19 nt, Human adenovirus B [HAdV-B]
ccaucaucgugcucagugu

SEQ ID NO: 3906337 - RNA, 13 nt, Human adenovirus B [HAdV-B]
ccaucuaccacuc

SEQ ID NO: 3906338 - RNA, 15 nt, Human adenovirus B [HAdV-B]
ugcaaggccccagca

SEQ ID NO: 3906339 - RNA, 22 nt, Human adenovirus B [HAdV-B]
ugcacagccggcaucauucaca

SEQ ID NO: 3906340 - RNA, 15 nt, Human adenovirus B [HAdV-B]
ugcacucauccauga

SEQ ID NO: 3906341 - RNA, 14 nt, Human adenovirus B [HAdV-B]
ugcacuuuuugcuu

SEQ ID NO: 3906342 - RNA, 16 nt, Human adenovirus B [HAdV-B]
ugcagcaacaggagga

SEQ ID NO: 3906343 - RNA, 11 nt, Human adenovirus B [HAdV-B]
ugcagcagcag

SEQ ID NO: 3906344 - RNA, 13 nt, Human adenovirus B [HAdV-B]
ugcaggucugccu

SEQ ID NO: 3906345 - RNA, 15 nt, Human adenovirus B [HAdV-B]
ugcaggugguaguuu

SEQ ID NO: 3906346 - RNA, 20 nt, Human adenovirus B [HAdV-B]
ugcaugaaagccuuugcugu

SEQ ID NO: 3906347 - RNA, 14 nt, Human adenovirus B [HAdV-B]
ugcauucacugcuc

SEQ ID NO: 3906348 - RNA, 20 nt, Human adenovirus B [HAdV-B]
ugccaaacguggcaaaccgg

SEQ ID NO: 3906349 - RNA, 19 nt, Human adenovirus B [HAdV-B]
ugccagguggucucuggau

SEQ ID NO: 3906350 - RNA, 21 nt, Human adenovirus B [HAdV-B]
ugccgccaucucuaguagaca

SEQ ID NO: 3906351 - RNA, 19 nt, Human adenovirus B [HAdV-B]
ugccuuguaagggcagcag

SEQ ID NO: 3906352 - RNA, 16 nt, Human adenovirus B [HAdV-B]
ugcgaaaaggcugugg

SEQ ID NO: 3906353 - RNA, 20 nt, Human adenovirus B [HAdV-B]
ugcgcacgggcggguagcug

SEQ ID NO: 3906354 - RNA, 22 nt, Human adenovirus B [HAdV-B]
ugcgucaucacccagggggcaa

SEQ ID NO: 3906355 - RNA, 20 nt, Human adenovirus B [HAdV-B]
ugcuaucgagaaaaaucaga

SEQ ID NO: 3906356 - RNA, 23 nt, Human adenovirus B [HAdV-B]
ugcugaacggggucaucuugcag

SEQ ID NO: 3906357 - RNA, 18 nt, Human adenovirus B [HAdV-B]
uggaacacgaggaagagu

SEQ ID NO: 3906358 - RNA, 14 nt, Human adenovirus B [HAdV-B]
uggaacagaagaca

SEQ ID NO: 3906359 - RNA, 16 nt, Human adenovirus B [HAdV-B]
uggaacaggugaaaac

SEQ ID NO: 3906360 - RNA, 16 nt, Human adenovirus B [HAdV-B]
uggaagagcucagccg

SEQ ID NO: 3906361 - RNA, 19 nt, Human adenovirus B [HAdV-B]
uggaagccacucugaacuu

SEQ ID NO: 3906362 - RNA, 14 nt, Human adenovirus B [HAdV-B]
uggacccaggccau

SEQ ID NO: 3906363 - RNA, 14 nt, Human adenovirus B [HAdV-B]
uggauugccacagc

SEQ ID NO: 3906364 - RNA, 20 nt, Human adenovirus B [HAdV-B]
uggcagaccucaucuuccca

SEQ ID NO: 3906365 - RNA, 15 nt, Human adenovirus B [HAdV-B]
uggcuucucuuacau

SEQ ID NO: 3906366 - RNA, 20 nt, Human adenovirus B [HAdV-B]
ugggagggggacuuacagug

SEQ ID NO: 3906367 - RNA, 16 nt, Human adenovirus B [HAdV-B]
ugggaugggugcauuc

SEQ ID NO: 3906368 - RNA, 18 nt, Human adenovirus B [HAdV-B]
uggggcgaagagccaugc

SEQ ID NO: 3906369 - RNA, 22 nt, Human adenovirus B [HAdV-B]
uggggggguauaaaagggggcg

SEQ ID NO: 3906370 - RNA, 23 nt, Human adenovirus B [HAdV-B]
ugguuagcucauaggagcuggcu

SEQ ID NO: 3906371 - RNA, 17 nt, Human adenovirus B [HAdV-B]
ugguuuuagauuccaca

SEQ ID NO: 3906372 - RNA, 19 nt, Human adenovirus B [HAdV-B]
uguaccgcaaugguagugc

SEQ ID NO: 3906373 - RNA, 18 nt, Human adenovirus B [HAdV-B]
uguagcgggaauccugag

SEQ ID NO: 3906374 - RNA, 14 nt, Human adenovirus B [HAdV-B]
uguauacugggugc

SEQ ID NO: 3906375 - RNA, 19 nt, Human adenovirus B [HAdV-B]
uguauaggagcauuugcuu

SEQ ID NO: 3906376 - RNA, 16 nt, Human adenovirus B [HAdV-B]
uguaucgcaaugacag

SEQ ID NO: 3906377 - RNA, 23 nt, Human adenovirus B [HAdV-B]
uguaucggcuuacgagcagacag

SEQ ID NO: 3906378 - RNA, 20 nt, Human adenovirus B [HAdV-B]
uguccguucucgcuggccac

SEQ ID NO: 3906379 - RNA, 20 nt, Human adenovirus B [HAdV-B]
ugucggccaaguagcaguuu

SEQ ID NO: 3906380 - RNA, 19 nt, Human adenovirus B [HAdV-B]
ugucgucacaggccucggc

SEQ ID NO: 3906381 - RNA, 15 nt, Human adenovirus B [HAdV-B]
ugucucacgcuugcc

SEQ ID NO: 3906382 - RNA, 18 nt, Human adenovirus B [HAdV-B]
ugucucugaagaaaugca

SEQ ID NO: 3906383 - RNA, 18 nt, Human adenovirus B [HAdV-B]
ugucucugaccaugacuu

SEQ ID NO: 3906384 - RNA, 14 nt, Human adenovirus B [HAdV-B]
ugucuuucuuccca

SEQ ID NO: 3906385 - RNA, 18 nt, Human adenovirus B [HAdV-B]
ugugccucucaccuaccg

SEQ ID NO: 3906386 - RNA, 16 nt, Human adenovirus B [HAdV-B]
ugugccuuuccacaua

SEQ ID NO: 3906387 - RNA, 12 nt, Human adenovirus B [HAdV-B]
uguuaacuguuc

SEQ ID NO: 3906388 - RNA, 16 nt, Human adenovirus B [HAdV-B]
uguuaauucaucuggc

SEQ ID NO: 3906389 - RNA, 18 nt, Human adenovirus B [HAdV-B]
uguuccacaguucaguga

SEQ ID NO: 3906390 - RNA, 17 nt, Human adenovirus B [HAdV-B]
uguuggauugccacagc

SEQ ID NO: 3906391 - RNA, 17 nt, Human adenovirus B [HAdV-B]
uguugggacgcggaaug

SEQ ID NO: 3906392 - RNA, 13 nt, Human adenovirus B [HAdV-B]
uguuuagaagaac

SEQ ID NO: 3906393 - RNA, 18 nt, Human adenovirus B [HAdV-B]
uuacacacaauaacaaaa

SEQ ID NO: 3906394 - RNA, 19 nt, Human adenovirus B [HAdV-B]
uuaccagacaaaguacagc

SEQ ID NO: 3906395 - RNA, 18 nt, Human adenovirus B [HAdV-B]
uuaccccuacggaagcca

SEQ ID NO: 3906396 - RNA, 16 nt, Human adenovirus B [HAdV-B]
uuacugacgccagacg

SEQ ID NO: 3906397 - RNA, 22 nt, Human adenovirus B [HAdV-B]
uuacuugaaaguggguagacag

SEQ ID NO: 3906398 - RNA, 17 nt, Human adenovirus B [HAdV-B]
uuagaagauacugagca

SEQ ID NO: 3906399 - RNA, 15 nt, Human adenovirus B [HAdV-B]
uuagcgaucuucuca

SEQ ID NO: 3906400 - RNA, 19 nt, Human adenovirus B [HAdV-B]
uucagacucauccugcugg

SEQ ID NO: 3906401 - RNA, 22 nt, Human adenovirus B [HAdV-B]
uuccacaguucagugauguguu

SEQ ID NO: 3906402 - RNA, 18 nt, Human adenovirus B [HAdV-B]
uuccuggauacacggcuc

SEQ ID NO: 3906403 - RNA, 17 nt, Human adenovirus B [HAdV-B]
uucuggcccaauugcaa

SEQ ID NO: 3906404 - RNA, 19 nt, Human adenovirus B [HAdV-B]
uucuggcccaauugcaagc

SEQ ID NO: 3906405 - RNA, 19 nt, Human adenovirus B [HAdV-B]
uucuggggucuuguugcca

SEQ ID NO: 3906406 - RNA, 18 nt, Human adenovirus B [HAdV-B]
uucuuagagauggaagac

SEQ ID NO: 3906407 - RNA, 17 nt, Human adenovirus B [HAdV-B]
uugaauucgggaaucac

SEQ ID NO: 3906408 - RNA, 19 nt, Human adenovirus B [HAdV-B]
uugacugaugucuugcaug

SEQ ID NO: 3906409 - RNA, 23 nt, Human adenovirus B [HAdV-B]
uugauuaauguuagcaaaguuua

SEQ ID NO: 3906410 - RNA, 15 nt, Human adenovirus B [HAdV-B]
uugauuugaugaaca

SEQ ID NO: 3906411 - RNA, 23 nt, Human adenovirus B [HAdV-B]
uugcaacauacaaaaucuuacau

SEQ ID NO: 3906412 - RNA, 18 nt, Human adenovirus B [HAdV-B]
uugcaaggccccagcagc

SEQ ID NO: 3906413 - RNA, 17 nt, Human adenovirus B [HAdV-B]
uugccauccuucucaac

SEQ ID NO: 3906414 - RNA, 21 nt, Human adenovirus B [HAdV-B]
uugccaugcaggcacuucagc

SEQ ID NO: 3906415 - RNA, 16 nt, Human adenovirus B [HAdV-B]
uugcugugccagaagu

SEQ ID NO: 3906416 - RNA, 15 nt, Human adenovirus B [HAdV-B]
uuggacggcuccugg

SEQ ID NO: 3906417 - RNA, 21 nt, Human adenovirus B [HAdV-B]
uuggauaaaaguuuggcaaug

SEQ ID NO: 3906418 - RNA, 14 nt, Human adenovirus B [HAdV-B]
uuguucguguugcu

SEQ ID NO: 3906419 - RNA, 11 nt, Human adenovirus B [HAdV-B]
uuguugccauc

SEQ ID NO: 3906420 - RNA, 12 nt, Human adenovirus B [HAdV-B]
uuuaacuccuca

SEQ ID NO: 3906421 - RNA, 18 nt, Human adenovirus B [HAdV-B]
uuuagcgaucuucucaau

SEQ ID NO: 3906422 - RNA, 18 nt, Human adenovirus B [HAdV-B]
uuuauuugaaaaucaauu

SEQ ID NO: 3906423 - RNA, 15 nt, Human adenovirus B [HAdV-B]
uuucauagccacagc

SEQ ID NO: 3906424 - RNA, 19 nt, Human adenovirus B [HAdV-B]
uuuccaucauguuugacuc

SEQ ID NO: 3906425 - RNA, 17 nt, Human adenovirus B [HAdV-B]
uuucccaagcuuucagu

SEQ ID NO: 3906426 - RNA, 16 nt, Human adenovirus B [HAdV-B]
uuugcaguagguacaa

SEQ ID NO: 3906427 - RNA, 10 nt, Human adenovirus B [HAdV-B]
uuugccaaaa

SEQ ID NO: 3906428 - RNA, 20 nt, Human adenovirus B [HAdV-B]
uuuggagagaguuugcugca

SEQ ID NO: 3906429 - RNA, 13 nt, Human adenovirus B [HAdV-B]
uuuggaggaggaa

SEQ ID NO: 3906430 - RNA, 16 nt, Human adenovirus B [HAdV-B]
uuuuaggauaaaacag

SEQ ID NO: 3906431 - RNA, 15 nt, Human adenovirus B [HAdV-B]
uuuuccgccauauuu

SEQ ID NO: 3906432 - RNA, 20 nt, Human adenovirus B [HAdV-B]
uuuugaucacaaugugauga

SEQ ID NO: 3906433 - RNA, 12 nt, Human adenovirus B [HAdV-B]
aaaaaacagcca

SEQ ID NO: 3906434 - RNA, 18 nt, Human adenovirus B [HAdV-B]
aaaacggauucuggggag

SEQ ID NO: 3906435 - RNA, 14 nt, Human adenovirus B [HAdV-B]
aaaagaagaggaag

SEQ ID NO: 3906436 - RNA, 20 nt, Human adenovirus B [HAdV-B]
aaaaugaguagauggaagac

SEQ ID NO: 3906437 - RNA, 23 nt, Human adenovirus B [HAdV-B]
aaaaugauuaauaaaaaaucacu

SEQ ID NO: 3906438 - RNA, 22 nt, Human adenovirus B [HAdV-B]
aaaaugccggccaauugccauu

SEQ ID NO: 3906439 - RNA, 17 nt, Human adenovirus B [HAdV-B]
aaaccaguggucaguga

SEQ ID NO: 3906440 - RNA, 12 nt, Human adenovirus B [HAdV-B]
aaacccacugcu

SEQ ID NO: 3906441 - RNA, 14 nt, Human adenovirus B [HAdV-B]
aaacggcaccugcg

SEQ ID NO: 3906442 - RNA, 17 nt, Human adenovirus B [HAdV-B]
aaagcacaagcucuaaa

SEQ ID NO: 3906443 - RNA, 12 nt, Human adenovirus B [HAdV-B]
aaagcuccaagc

SEQ ID NO: 3906444 - RNA, 18 nt, Human adenovirus B [HAdV-B]
aaauacacauacaaagcc

SEQ ID NO: 3906445 - RNA, 14 nt, Human adenovirus B [HAdV-B]
aaaucaacacagcc

SEQ ID NO: 3906446 - RNA, 21 nt, Human adenovirus B [HAdV-B]
aaaugccggccaauugccauu

SEQ ID NO: 3906447 - RNA, 13 nt, Human adenovirus B [HAdV-B]
aaaugcucugcaa

SEQ ID NO: 3906448 - RNA, 18 nt, Human adenovirus B [HAdV-B]
aaauuuucucccagcagc

SEQ ID NO: 3906449 - RNA, 19 nt, Human adenovirus B [HAdV-B]
aaauuuuggcucaaccaua

SEQ ID NO: 3906450 - RNA, 20 nt, Human adenovirus B [HAdV-B]
aacacacaccccgaaacugc

SEQ ID NO: 3906451 - RNA, 15 nt, Human adenovirus B [HAdV-B]
aacagccaacauagc

SEQ ID NO: 3906452 - RNA, 14 nt, Human adenovirus B [HAdV-B]
aacagucagcucuu

SEQ ID NO: 3906453 - RNA, 19 nt, Human adenovirus B [HAdV-B]
aacagugcaggcagcagcu

SEQ ID NO: 3906454 - RNA, 14 nt, Human adenovirus B [HAdV-B]
aaccagcagcggca

SEQ ID NO: 3906455 - RNA, 13 nt, Human adenovirus B [HAdV-B]
aaccgaucucugc

SEQ ID NO: 3906456 - RNA, 14 nt, Human adenovirus B [HAdV-B]
aaccuugucauaau

SEQ ID NO: 3906457 - RNA, 13 nt, Human adenovirus B [HAdV-B]
aacgagccagcgc

SEQ ID NO: 3906458 - RNA, 18 nt, Human adenovirus B [HAdV-B]
aacgaugggaaucauaau

SEQ ID NO: 3906459 - RNA, 17 nt, Human adenovirus B [HAdV-B]
aacgcgggucgugagcu

SEQ ID NO: 3906460 - RNA, 19 nt, Human adenovirus B [HAdV-B]
aacuaucucuccuaccacu

SEQ ID NO: 3906461 - RNA, 21 nt, Human adenovirus B [HAdV-B]
aacucagcucaugcucuggac

SEQ ID NO: 3906462 - RNA, 20 nt, Human adenovirus B [HAdV-B]
aacugacgccgccgguccca

SEQ ID NO: 3906463 - RNA, 24 nt, Human adenovirus B [HAdV-B]
aacuuggacugaccuugauggaaa

SEQ ID NO: 3906464 - RNA, 22 nt, Human adenovirus B [HAdV-B]
aagaaaucggaucuuuccaacc

SEQ ID NO: 3906465 - RNA, 20 nt, Human adenovirus B [HAdV-B]
aagaacaaaagaauaccaaa

SEQ ID NO: 3906466 - RNA, 19 nt, Human adenovirus B [HAdV-B]
aagagcucugacuggagcu

SEQ ID NO: 3906467 - RNA, 18 nt, Human adenovirus B [HAdV-B]
aagauuuuguaugaagau

SEQ ID NO: 3906468 - RNA, 18 nt, Human adenovirus B [HAdV-B]
aagccaaaauagaagcug

SEQ ID NO: 3906469 - RNA, 19 nt, Human adenovirus B [HAdV-B]
aagcggcgaggagccggag

SEQ ID NO: 3906470 - RNA, 17 nt, Human adenovirus B [HAdV-B]
aagcuaaggcaaacaua

SEQ ID NO: 3906471 - RNA, 22 nt, Human adenovirus B [HAdV-B]
aaggaccaccaagacgguguau

SEQ ID NO: 3906472 - RNA, 12 nt, Human adenovirus B [HAdV-B]
aaggaugugaac

SEQ ID NO: 3906473 - RNA, 16 nt, Human adenovirus B [HAdV-B]
aaggcgauaaugccag

SEQ ID NO: 3906474 - RNA, 17 nt, Human adenovirus B [HAdV-B]
aagggagaaaauggcau

SEQ ID NO: 3906475 - RNA, 14 nt, Human adenovirus B [HAdV-B]
aaguaaauggaaca

SEQ ID NO: 3906476 - RNA, 17 nt, Human adenovirus B [HAdV-B]
aaguagcaguuuaccau

SEQ ID NO: 3906477 - RNA, 23 nt, Human adenovirus B [HAdV-B]
aagucagucgcgcuuugggacag

SEQ ID NO: 3906478 - RNA, 20 nt, Human adenovirus B [HAdV-B]
aaucaugcaacccaauauaa

SEQ ID NO: 3906479 - RNA, 15 nt, Human adenovirus B [HAdV-B]
aaucuaaugauugca

SEQ ID NO: 3906480 - RNA, 16 nt, Human adenovirus B [HAdV-B]
aauuggcgcgauacca

SEQ ID NO: 3906481 - RNA, 17 nt, Human adenovirus B [HAdV-B]
aauuuuagcuccucucc

SEQ ID NO: 3906482 - RNA, 16 nt, Human adenovirus B [HAdV-B]
acaacugacgccgccg

SEQ ID NO: 3906483 - RNA, 14 nt, Human adenovirus B [HAdV-B]
acaagaauuugaaa

SEQ ID NO: 3906484 - RNA, 15 nt, Human adenovirus B [HAdV-B]
acaauacaauuucca

SEQ ID NO: 3906485 - RNA, 15 nt, Human adenovirus B [HAdV-B]
acaaugucaacccau

SEQ ID NO: 3906486 - RNA, 18 nt, Human adenovirus B [HAdV-B]
acacaagguucccucagg

SEQ ID NO: 3906487 - RNA, 12 nt, Human adenovirus B [HAdV-B]
acacagaacuuu

SEQ ID NO: 3906488 - RNA, 23 nt, Human adenovirus B [HAdV-B]
acaccaaucucuccccacgcaca

SEQ ID NO: 3906489 - RNA, 13 nt, Human adenovirus B [HAdV-B]
acacggcacgaag

SEQ ID NO: 3906490 - RNA, 23 nt, Human adenovirus B [HAdV-B]
acacucaccaccuccaauuccgc

SEQ ID NO: 3906491 - RNA, 15 nt, Human adenovirus B [HAdV-B]
acagacauggcuucu

SEQ ID NO: 3906492 - RNA, 21 nt, Human adenovirus B [HAdV-B]
acagauaagcccuugguguag

SEQ ID NO: 3906493 - RNA, 17 nt, Human adenovirus B [HAdV-B]
acagcaaccccaggcca

SEQ ID NO: 3906494 - RNA, 22 nt, Human adenovirus B [HAdV-B]
acagcggcggcgaccuccaaca

SEQ ID NO: 3906495 - RNA, 16 nt, Human adenovirus B [HAdV-B]
acagcugcugcagaag

SEQ ID NO: 3906496 - RNA, 17 nt, Human adenovirus B [HAdV-B]
acagggaacugaugcac

SEQ ID NO: 3906497 - RNA, 15 nt, Human adenovirus B [HAdV-B]
acagugcaguacaag

SEQ ID NO: 3906498 - RNA, 22 nt, Human adenovirus B [HAdV-B]
acaugaacaugcaaaucuggaa

SEQ ID NO: 3906499 - RNA, 18 nt, Human adenovirus B [HAdV-B]
acauuggugccagguggu

SEQ ID NO: 3906500 - RNA, 17 nt, Human adenovirus B [HAdV-B]
accaaucggucucaaaa

SEQ ID NO: 3906501 - RNA, 17 nt, Human adenovirus B [HAdV-B]
accacguaagaagcuuc

SEQ ID NO: 3906502 - RNA, 20 nt, Human adenovirus B [HAdV-B]
accagcgcuuccaagaccgg

SEQ ID NO: 3906503 - RNA, 18 nt, Human adenovirus B [HAdV-B]
accagggaaaaguacagu

SEQ ID NO: 3906504 - RNA, 17 nt, Human adenovirus B [HAdV-B]
acccaauauaaccuucc

SEQ ID NO: 3906505 - RNA, 21 nt, Human adenovirus B [HAdV-B]
accccuacggaagccagcacc

SEQ ID NO: 3906506 - RNA, 13 nt, Human adenovirus B [HAdV-B]
accguuucugggg

SEQ ID NO: 3906507 - RNA, 16 nt, Human adenovirus B [HAdV-B]
accuacuaaugugaaa

SEQ ID NO: 3906508 - RNA, 12 nt, Human adenovirus B [HAdV-B]
accucacuuccc

SEQ ID NO: 3906509 - RNA, 20 nt, Human adenovirus B [HAdV-B]
accugaagucuacggccaac

SEQ ID NO: 3906510 - RNA, 23 nt, Human adenovirus B [HAdV-B]
acgaggaaaaggagcagagcuua

SEQ ID NO: 3906511 - RNA, 14 nt, Human adenovirus B [HAdV-B]
acgaggaggcagag

SEQ ID NO: 3906512 - RNA, 22 nt, Human adenovirus B [HAdV-B]
acgcacagccuguacauuccca

SEQ ID NO: 3906513 - RNA, 17 nt, Human adenovirus B [HAdV-B]
acgcauccgccagcagc

SEQ ID NO: 3906514 - RNA, 18 nt, Human adenovirus B [HAdV-B]
acgccuuacauguggagu

SEQ ID NO: 3906515 - RNA, 21 nt, Human adenovirus B [HAdV-B]
acgcuggagaggucagaggag

SEQ ID NO: 3906516 - RNA, 15 nt, Human adenovirus B [HAdV-B]
acguggaacucacca

SEQ ID NO: 3906517 - RNA, 22 nt, Human adenovirus B [HAdV-B]
acuaacuuuuuaagugcuuuga

SEQ ID NO: 3906518 - RNA, 13 nt, Human adenovirus B [HAdV-B]
acuacacuuuuag

SEQ ID NO: 3906519 - RNA, 16 nt, Human adenovirus B [HAdV-B]
acuaccgucaccucca

SEQ ID NO: 3906520 - RNA, 23 nt, Human adenovirus B [HAdV-B]
acuagugaaaguuaacuggaugc

SEQ ID NO: 3906521 - RNA, 19 nt, Human adenovirus B [HAdV-B]
acuauaaaaguaguuuaga

SEQ ID NO: 3906522 - RNA, 21 nt, Human adenovirus B [HAdV-B]
acuauaaacaagaauuugaaa

SEQ ID NO: 3906523 - RNA, 12 nt, Human adenovirus B [HAdV-B]
acuaucgcagcc

SEQ ID NO: 3906524 - RNA, 15 nt, Human adenovirus B [HAdV-B]
acuccguagccugga

SEQ ID NO: 3906525 - RNA, 20 nt, Human adenovirus B [HAdV-B]
acucgacuccguagccugga

SEQ ID NO: 3906526 - RNA, 22 nt, Human adenovirus B [HAdV-B]
acucucccagggauuuggaaga

SEQ ID NO: 3906527 - RNA, 18 nt, Human adenovirus B [HAdV-B]
acugcacacuaaaaggac

SEQ ID NO: 3906528 - RNA, 18 nt, Human adenovirus B [HAdV-B]
acugccuauccuuucaau

SEQ ID NO: 3906529 - RNA, 20 nt, Human adenovirus B [HAdV-B]
acugcuacaaguugcgccuc

SEQ ID NO: 3906530 - RNA, 15 nt, Human adenovirus B [HAdV-B]
acuggaggcucccuu

SEQ ID NO: 3906531 - RNA, 19 nt, Human adenovirus B [HAdV-B]
acuggaucuacguccacug

SEQ ID NO: 3906532 - RNA, 24 nt, Human adenovirus B [HAdV-B]
acugugcguaugcauacaccugcu

SEQ ID NO: 3906533 - RNA, 20 nt, Human adenovirus B [HAdV-B]
acuguugguagcuccuuuca

SEQ ID NO: 3906534 - RNA, 16 nt, Human adenovirus B [HAdV-B]
acuucagcgcacucuc

SEQ ID NO: 3906535 - RNA, 14 nt, Human adenovirus B [HAdV-B]
acuucgaacucccc

SEQ ID NO: 3906536 - RNA, 18 nt, Human adenovirus B [HAdV-B]
acuucgaacuccccaagg

SEQ ID NO: 3906537 - RNA, 20 nt, Human adenovirus B [HAdV-B]
acuuggaagacugauggcac

SEQ ID NO: 3906538 - RNA, 20 nt, Human adenovirus B [HAdV-B]
acuuuaggaaggaugugaac

SEQ ID NO: 3906539 - RNA, 15 nt, Human adenovirus B [HAdV-B]
acuuuaugagccaga

SEQ ID NO: 3906540 - RNA, 20 nt, Human adenovirus B [HAdV-B]
acuuugauauaaucugcaac

SEQ ID NO: 3906541 - RNA, 16 nt, Human adenovirus B [HAdV-B]
agaacucgguggauuu

SEQ ID NO: 3906542 - RNA, 20 nt, Human adenovirus B [HAdV-B]
agaaguaggcugauugccac

SEQ ID NO: 3906543 - RNA, 22 nt, Human adenovirus B [HAdV-B]
agaaucuuaccggcucugggca

SEQ ID NO: 3906544 - RNA, 21 nt, Human adenovirus B [HAdV-B]
agaauguaucauucccugcag

SEQ ID NO: 3906545 - RNA, 18 nt, Human adenovirus B [HAdV-B]
agacaaggcaguuauuag

SEQ ID NO: 3906546 - RNA, 20 nt, Human adenovirus B [HAdV-B]
agacaauuuugcgccaacac

SEQ ID NO: 3906547 - RNA, 20 nt, Human adenovirus B [HAdV-B]
agacauggaaacucagccau

SEQ ID NO: 3906548 - RNA, 17 nt, Human adenovirus B [HAdV-B]
agacgacugacaaauaa

SEQ ID NO: 3906549 - RNA, 14 nt, Human adenovirus B [HAdV-B]
agagaggaugaaaa

SEQ ID NO: 3906550 - RNA, 22 nt, Human adenovirus B [HAdV-B]
agagcccauucgugcaggugag

SEQ ID NO: 3906551 - RNA, 19 nt, Human adenovirus B [HAdV-B]
agagcgugaugcagcagca

SEQ ID NO: 3906552 - RNA, 23 nt, Human adenovirus B [HAdV-B]
agaggauccuuagauaugugcag

SEQ ID NO: 3906553 - RNA, 17 nt, Human adenovirus B [HAdV-B]
agaggucaucugggcca

SEQ ID NO: 3906554 - RNA, 18 nt, Human adenovirus B [HAdV-B]
agagguuccaaagaucuu

SEQ ID NO: 3906555 - RNA, 23 nt, Human adenovirus B [HAdV-B]
agagucaauugucucugaagaaa

SEQ ID NO: 3906556 - RNA, 18 nt, Human adenovirus B [HAdV-B]
agauaugugcagcagagc

SEQ ID NO: 3906557 - RNA, 21 nt, Human adenovirus B [HAdV-B]
agauuacagccaacgagccag

SEQ ID NO: 3906558 - RNA, 15 nt, Human adenovirus B [HAdV-B]
agauugcccaggacu

SEQ ID NO: 3906559 - RNA, 23 nt, Human adenovirus B [HAdV-B]
agauugggguaugaauguuccuu

SEQ ID NO: 3906560 - RNA, 23 nt, Human adenovirus B [HAdV-B]
agauuuguaucccacuaugcaac

SEQ ID NO: 3906561 - RNA, 15 nt, Human adenovirus B [HAdV-B]
agcaaaguuuacagc

SEQ ID NO: 3906562 - RNA, 21 nt, Human adenovirus B [HAdV-B]
agcagauaacuaucaccaaga

SEQ ID NO: 3906563 - RNA, 13 nt, Human adenovirus B [HAdV-B]
agcagcagcaauc

SEQ ID NO: 3906564 - RNA, 23 nt, Human adenovirus B [HAdV-B]
agcaggaacgcgcggccaaagag

SEQ ID NO: 3906565 - RNA, 23 nt, Human adenovirus B [HAdV-B]
agcaggggacgcuacagugcagu

SEQ ID NO: 3906566 - RNA, 18 nt, Human adenovirus B [HAdV-B]
agcauaugcaaaucccaa

SEQ ID NO: 3906567 - RNA, 12 nt, Human adenovirus B [HAdV-B]
agcauguggaau

SEQ ID NO: 3906568 - RNA, 20 nt, Human adenovirus B [HAdV-B]
agcauguggaaucaggcugu

SEQ ID NO: 3906569 - RNA, 20 nt, Human adenovirus B [HAdV-B]
aaaaaauacaauggacucug

SEQ ID NO: 3906570 - RNA, 21 nt, Human adenovirus B [HAdV-B]
aaaaagcacagcuagaucaaa

SEQ ID NO: 3906571 - RNA, 17 nt, Human adenovirus B [HAdV-B]
aaaacaacggagcagcc

SEQ ID NO: 3906572 - RNA, 22 nt, Human adenovirus B [HAdV-B]
aaaacugguuagcugcacagcc

SEQ ID NO: 3906573 - RNA, 18 nt, Human adenovirus B [HAdV-B]
aaaauaaaaaaaaaaaca

SEQ ID NO: 3906574 - RNA, 21 nt, Human adenovirus B [HAdV-B]
aaaaugccaaauauggcaaag

SEQ ID NO: 3906575 - RNA, 23 nt, Human adenovirus B [HAdV-B]
aaacaucccgcaggaccugcucg

SEQ ID NO: 3906576 - RNA, 21 nt, Human adenovirus B [HAdV-B]
aaacuccagacacucauguag

SEQ ID NO: 3906577 - RNA, 12 nt, Human adenovirus B [HAdV-B]
aaacucgcgccg

SEQ ID NO: 3906578 - RNA, 23 nt, Human adenovirus B [HAdV-B]
aaaucaaguguuuuuauuucauu

SEQ ID NO: 3906579 - RNA, 14 nt, Human adenovirus B [HAdV-B]
aaauccgguucauu

SEQ ID NO: 3906580 - RNA, 11 nt, Human adenovirus B [HAdV-B]
aaaugcuuucu

SEQ ID NO: 3906581 - RNA, 23 nt, Human adenovirus B [HAdV-B]
aaauguaaauuuggaaacuccag

SEQ ID NO: 3906582 - RNA, 14 nt, Human adenovirus B [HAdV-B]
aaauugucauguau

SEQ ID NO: 3906583 - RNA, 21 nt, Human adenovirus B [HAdV-B]
aacacaacaacucuggcuuug

SEQ ID NO: 3906584 - RNA, 16 nt, Human adenovirus B [HAdV-B]
aacacacccucauaau

SEQ ID NO: 3906585 - RNA, 12 nt, Human adenovirus B [HAdV-B]
aacacgaggaag

SEQ ID NO: 3906586 - RNA, 17 nt, Human adenovirus B [HAdV-B]
aacagaaaaccagcagc

SEQ ID NO: 3906587 - RNA, 13 nt, Human adenovirus B [HAdV-B]
aaccaagcaaugc

SEQ ID NO: 3906588 - RNA, 14 nt, Human adenovirus B [HAdV-B]
aacccaaccagcgc

SEQ ID NO: 3906589 - RNA, 17 nt, Human adenovirus B [HAdV-B]
aaccccacuaacaacca

SEQ ID NO: 3906590 - RNA, 18 nt, Human adenovirus B [HAdV-B]
aaccccagguagaacugc

SEQ ID NO: 3906591 - RNA, 22 nt, Human adenovirus B [HAdV-B]
aaccgguauaucgggcaggaug

SEQ ID NO: 3906592 - RNA, 19 nt, Human adenovirus B [HAdV-B]
aacguugguuaaucaugca

SEQ ID NO: 3906593 - RNA, 23 nt, Human adenovirus B [HAdV-B]
aacucuugcuugacucucugggc

SEQ ID NO: 3906594 - RNA, 16 nt, Human adenovirus B [HAdV-B]
aacugcccaaaacaac

SEQ ID NO: 3906595 - RNA, 22 nt, Human adenovirus B [HAdV-B]
aacugcccaaaacaacgagcag

SEQ ID NO: 3906596 - RNA, 14 nt, Human adenovirus B [HAdV-B]
aacuggugaggaac

SEQ ID NO: 3906597 - RNA, 20 nt, Human adenovirus B [HAdV-B]
aacuuaaagaccagaacuuc

SEQ ID NO: 3906598 - RNA, 16 nt, Human adenovirus B [HAdV-B]
aacuuuuacaucuccc

SEQ ID NO: 3906599 - RNA, 18 nt, Human adenovirus B [HAdV-B]
aagaucaacuucagcgca

SEQ ID NO: 3906600 - RNA, 15 nt, Human adenovirus B [HAdV-B]
aagauuuuccaugca

SEQ ID NO: 3906601 - RNA, 22 nt, Human adenovirus B [HAdV-B]
aagcuguguacucccagcagcu

SEQ ID NO: 3906602 - RNA, 18 nt, Human adenovirus B [HAdV-B]
aagucagguggacgagca

SEQ ID NO: 3906603 - RNA, 18 nt, Human adenovirus B [HAdV-B]
aaguccccuuucagaaga

SEQ ID NO: 3906604 - RNA, 18 nt, Human adenovirus B [HAdV-B]
aauacaauggacucugac

SEQ ID NO: 3906605 - RNA, 11 nt, Human adenovirus B [HAdV-B]
aauaugagugg

SEQ ID NO: 3906606 - RNA, 20 nt, Human adenovirus B [HAdV-B]
aauccacacauuacaaacag

SEQ ID NO: 3906607 - RNA, 17 nt, Human adenovirus B [HAdV-B]
aaucuggggucagugau

SEQ ID NO: 3906608 - RNA, 14 nt, Human adenovirus B [HAdV-B]
aaugcacaugauca

SEQ ID NO: 3906609 - RNA, 12 nt, Human adenovirus B [HAdV-B]
aauuccagucuc

SEQ ID NO: 3906610 - RNA, 10 nt, Human adenovirus B [HAdV-B]
aauuggcucc

SEQ ID NO: 3906611 - RNA, 15 nt, Human adenovirus B [HAdV-B]
aauuuccaauccaac

SEQ ID NO: 3906612 - RNA, 20 nt, Human adenovirus B [HAdV-B]
aauuuuucauccuuggcucc

SEQ ID NO: 3906613 - RNA, 21 nt, Human adenovirus B [HAdV-B]
acaaagcccaaacggaguucu

SEQ ID NO: 3906614 - RNA, 23 nt, Human adenovirus B [HAdV-B]
acaacaauuuccacuucaacaau

SEQ ID NO: 3906615 - RNA, 18 nt, Human adenovirus B [HAdV-B]
acaagauuggaauaagca

SEQ ID NO: 3906616 - RNA, 20 nt, Human adenovirus B [HAdV-B]
acaagucggcggacauugcu

SEQ ID NO: 3906617 - RNA, 12 nt, Human adenovirus B [HAdV-B]
acaauccagaca

SEQ ID NO: 3906618 - RNA, 21 nt, Human adenovirus B [HAdV-B]
acacacucuucuucgccuucu

SEQ ID NO: 3906619 - RNA, 23 nt, Human adenovirus B [HAdV-B]
acaccaggaacuucaagcuggga

SEQ ID NO: 3906620 - RNA, 17 nt, Human adenovirus B [HAdV-B]
acagaaaaccagcagcg

SEQ ID NO: 3906621 - RNA, 21 nt, Human adenovirus B [HAdV-B]
acagagccuaccuccuuuccu

SEQ ID NO: 3906622 - RNA, 16 nt, Human adenovirus B [HAdV-B]
acagauggauaaauca

SEQ ID NO: 3906623 - RNA, 17 nt, Human adenovirus B [HAdV-B]
acagauuugcauuuccc

SEQ ID NO: 3906624 - RNA, 14 nt, Human adenovirus B [HAdV-B]
acagcaacuucuug

SEQ ID NO: 3906625 - RNA, 21 nt, Human adenovirus B [HAdV-B]
acagcuuucuggucagcugca

SEQ ID NO: 3906626 - RNA, 15 nt, Human adenovirus B [HAdV-B]
acagucaggcagagg

SEQ ID NO: 3906627 - RNA, 13 nt, Human adenovirus B [HAdV-B]
acagugcaggcag

SEQ ID NO: 3906628 - RNA, 17 nt, Human adenovirus B [HAdV-B]
acauacaacaauuucca

SEQ ID NO: 3906629 - RNA, 18 nt, Human adenovirus B [HAdV-B]
acaucuagaccacugccg

SEQ ID NO: 3906630 - RNA, 21 nt, Human adenovirus B [HAdV-B]
acaugcucuaccccauuccug

SEQ ID NO: 3906631 - RNA, 20 nt, Human adenovirus B [HAdV-B]
acaugggagccaggaguucc

SEQ ID NO: 3906632 - RNA, 17 nt, Human adenovirus B [HAdV-B]
accagacaaaguacagc

SEQ ID NO: 3906633 - RNA, 20 nt, Human adenovirus B [HAdV-B]
accagacugaaaaccaaaga

SEQ ID NO: 3906634 - RNA, 17 nt, Human adenovirus B [HAdV-B]
acccaguugaaaaccac

SEQ ID NO: 3906635 - RNA, 20 nt, Human adenovirus B [HAdV-B]
accccacuaacaaccacagg

SEQ ID NO: 3906636 - RNA, 21 nt, Human adenovirus B [HAdV-B]
accccagguagaacugcugcu

SEQ ID NO: 3906637 - RNA, 23 nt, Human adenovirus B [HAdV-B]
accccguucagcggcauacuuuc

SEQ ID NO: 3906638 - RNA, 20 nt, Human adenovirus B [HAdV-B]
acccuguggugggugcagag

SEQ ID NO: 3906639 - RNA, 15 nt, Human adenovirus B [HAdV-B]
accggcucugggcau

SEQ ID NO: 3906640 - RNA, 20 nt, Human adenovirus B [HAdV-B]
accgucgcuuccgaccuggc

SEQ ID NO: 3906641 - RNA, 22 nt, Human adenovirus B [HAdV-B]
accuuccggaaccacacugcca

SEQ ID NO: 3906642 - RNA, 20 nt, Human adenovirus B [HAdV-B]
accuugacccccagaccggc

SEQ ID NO: 3906643 - RNA, 15 nt, Human adenovirus B [HAdV-B]
acgaggaaaaggagc

SEQ ID NO: 3906644 - RNA, 18 nt, Human adenovirus B [HAdV-B]
acgauuggacccaggcca

SEQ ID NO: 3906645 - RNA, 17 nt, Human adenovirus B [HAdV-B]
acggcaggaugugagcu

SEQ ID NO: 3906646 - RNA, 19 nt, Human adenovirus B [HAdV-B]
acgggaacaaagcuuggaa

SEQ ID NO: 3906647 - RNA, 15 nt, Human adenovirus B [HAdV-B]
acgguagcauaugca

SEQ ID NO: 3906648 - RNA, 13 nt, Human adenovirus B [HAdV-B]
acgugaccugggg

SEQ ID NO: 3906649 - RNA, 22 nt, Human adenovirus B [HAdV-B]
acguggaacucaccaaccuggu

SEQ ID NO: 3906650 - RNA, 20 nt, Human adenovirus B [HAdV-B]
acuacuguuuuccacuggac

SEQ ID NO: 3906651 - RNA, 17 nt, Human adenovirus B [HAdV-B]
acugaccaucgccucuc

SEQ ID NO: 3906652 - RNA, 23 nt, Human adenovirus B [HAdV-B]
acugcccuccgacuuugugccuc

SEQ ID NO: 3906653 - RNA, 16 nt, Human adenovirus B [HAdV-B]
acuggaacaggugaaa

SEQ ID NO: 3906654 - RNA, 18 nt, Human adenovirus B [HAdV-B]
acuuacuugaaaucagca

SEQ ID NO: 3906655 - RNA, 20 nt, Human adenovirus B [HAdV-B]
acuuacuugaaaucagcaau

SEQ ID NO: 3906656 - RNA, 19 nt, Human adenovirus B [HAdV-B]
acuuagaagauacugagca

SEQ ID NO: 3906657 - RNA, 18 nt, Human adenovirus B [HAdV-B]
acuucaacaaucagcauu

SEQ ID NO: 3906658 - RNA, 20 nt, Human adenovirus B [HAdV-B]
acuuccgcaaucccaacagg

SEQ ID NO: 3906659 - RNA, 15 nt, Human adenovirus B [HAdV-B]
acuugggugggagag

SEQ ID NO: 3906660 - RNA, 22 nt, Human adenovirus B [HAdV-B]
acuugucgccuucgcguuccca

SEQ ID NO: 3906661 - RNA, 19 nt, Human adenovirus B [HAdV-B]
agaaacauaucccagggaa

SEQ ID NO: 3906662 - RNA, 16 nt, Human adenovirus B [HAdV-B]
agaagauacugagcag

SEQ ID NO: 3906663 - RNA, 16 nt, Human adenovirus B [HAdV-B]
agaagcagaccugugu

SEQ ID NO: 3906664 - RNA, 18 nt, Human adenovirus B [HAdV-B]
agaaguaccucagagcga

SEQ ID NO: 3906665 - RNA, 20 nt, Human adenovirus B [HAdV-B]
agacgagccugggaucaugg

SEQ ID NO: 3906666 - RNA, 20 nt, Human adenovirus B [HAdV-B]
aaacgaggaggcagaggagg

SEQ ID NO: 3906667 - RNA, 14 nt, Human adenovirus B [HAdV-B]
aaagauaguaagaa

SEQ ID NO: 3906668 - RNA, 20 nt, Human adenovirus B [HAdV-B]
aaagcuauucguccagauga

SEQ ID NO: 3906669 - RNA, 20 nt, Human adenovirus B [HAdV-B]
aaauggcuucacacaaagcc

SEQ ID NO: 3906670 - RNA, 18 nt, Human adenovirus B [HAdV-B]
aaauuuaccugcauggug

SEQ ID NO: 3906671 - RNA, 22 nt, Human adenovirus B [HAdV-B]
aacauguugguuggagccugag

SEQ ID NO: 3906672 - RNA, 18 nt, Human adenovirus B [HAdV-B]
aaccacgaaaaugccaaa

SEQ ID NO: 3906673 - RNA, 15 nt, Human adenovirus B [HAdV-B]
aaccccacagccaau

SEQ ID NO: 3906674 - RNA, 22 nt, Human adenovirus B [HAdV-B]
aacccggcggcgucccagcagu

SEQ ID NO: 3906675 - RNA, 21 nt, Human adenovirus B [HAdV-B]
aaccggucacuuugcagcaag

SEQ ID NO: 3906676 - RNA, 11 nt, Human adenovirus B [HAdV-B]
aaccugcugcu

SEQ ID NO: 3906677 - RNA, 13 nt, Human adenovirus B [HAdV-B]
aacucaacacaag

SEQ ID NO: 3906678 - RNA, 13 nt, Human adenovirus B [HAdV-B]
aagaaaugcauau

SEQ ID NO: 3906679 - RNA, 16 nt, Human adenovirus B [HAdV-B]
aagacuaggcaacugu

SEQ ID NO: 3906680 - RNA, 22 nt, Human adenovirus B [HAdV-B]
aagagcucugacuggagcugga

SEQ ID NO: 3906681 - RNA, 23 nt, Human adenovirus B [HAdV-B]
aagagggcgaguacuuggaagac

SEQ ID NO: 3906682 - RNA, 21 nt, Human adenovirus B [HAdV-B]
aagauagcuuugaggccugau

SEQ ID NO: 3906683 - RNA, 16 nt, Human adenovirus B [HAdV-B]
aagauugggacaguca

SEQ ID NO: 3906684 - RNA, 13 nt, Human adenovirus B [HAdV-B]
aagccaugcugcg

SEQ ID NO: 3906685 - RNA, 16 nt, Human adenovirus B [HAdV-B]
aagcgcgugugauggu

SEQ ID NO: 3906686 - RNA, 23 nt, Human adenovirus B [HAdV-B]
aagcuguguacucccagcagcuc

SEQ ID NO: 3906687 - RNA, 22 nt, Human adenovirus B [HAdV-B]
aaggacuuacauucaauucaaa

SEQ ID NO: 3906688 - RNA, 12 nt, Human adenovirus B [HAdV-B]
aagggaaaugcc

SEQ ID NO: 3906689 - RNA, 21 nt, Human adenovirus B [HAdV-B]
aaggucgcagugcaugguguu

SEQ ID NO: 3906690 - RNA, 17 nt, Human adenovirus B [HAdV-B]
aagucuacccguuucuu

SEQ ID NO: 3906691 - RNA, 17 nt, Human adenovirus B [HAdV-B]
aaguucuaguuguaaaa

SEQ ID NO: 3906692 - RNA, 13 nt, Human adenovirus B [HAdV-B]
aaguuuggcaaug

SEQ ID NO: 3906693 - RNA, 19 nt, Human adenovirus B [HAdV-B]
aaguuugguggcaaaugau

SEQ ID NO: 3906694 - RNA, 13 nt, Human adenovirus B [HAdV-B]
aaguuuucuugca

SEQ ID NO: 3906695 - RNA, 18 nt, Human adenovirus B [HAdV-B]
aauaaaaaaaaaaacaag

SEQ ID NO: 3906696 - RNA, 13 nt, Human adenovirus B [HAdV-B]
aaugaggcuuuca

SEQ ID NO: 3906697 - RNA, 20 nt, Human adenovirus B [HAdV-B]
aaugagucgcagacguccug

SEQ ID NO: 3906698 - RNA, 20 nt, Human adenovirus B [HAdV-B]
aaugccuuaaccucuuucug

SEQ ID NO: 3906699 - RNA, 22 nt, Human adenovirus B [HAdV-B]
aauggagugguagauuuggcua

SEQ ID NO: 3906700 - RNA, 16 nt, Human adenovirus B [HAdV-B]
aauuauggcgaucccg

SEQ ID NO: 3906701 - RNA, 16 nt, Human adenovirus B [HAdV-B]
aauuccagucuccugc

SEQ ID NO: 3906702 - RNA, 15 nt, Human adenovirus B [HAdV-B]
acaaaacaaaaccaa

SEQ ID NO: 3906703 - RNA, 20 nt, Human adenovirus B [HAdV-B]
acaacugacgccgccggucc

SEQ ID NO: 3906704 - RNA, 18 nt, Human adenovirus B [HAdV-B]
acaagaauuugaaaaguu

SEQ ID NO: 3906705 - RNA, 16 nt, Human adenovirus B [HAdV-B]
acaagagcgaagauca

SEQ ID NO: 3906706 - RNA, 11 nt, Human adenovirus B [HAdV-B]
acacagcagcg

SEQ ID NO: 3906707 - RNA, 17 nt, Human adenovirus B [HAdV-B]
acagcaguagccacagc

SEQ ID NO: 3906708 - RNA, 17 nt, Human adenovirus B [HAdV-B]
acagcauuguggagaac

SEQ ID NO: 3906709 - RNA, 23 nt, Human adenovirus B [HAdV-B]
acagcauuguggagaacauggaa

SEQ ID NO: 3906710 - RNA, 22 nt, Human adenovirus B [HAdV-B]
acagccccccucgcagcagcag

SEQ ID NO: 3906711 - RNA, 14 nt, Human adenovirus B [HAdV-B]
acagucaggcagag

SEQ ID NO: 3906712 - RNA, 16 nt, Human adenovirus B [HAdV-B]
acagucaggcagagga

SEQ ID NO: 3906713 - RNA, 18 nt, Human adenovirus B [HAdV-B]
acagucaggcagaggagg

SEQ ID NO: 3906714 - RNA, 19 nt, Human adenovirus B [HAdV-B]
acauaucagccagaaccuc

SEQ ID NO: 3906715 - RNA, 20 nt, Human adenovirus B [HAdV-B]
acauaucuggaaauggggcu

SEQ ID NO: 3906716 - RNA, 16 nt, Human adenovirus B [HAdV-B]
acaugaaucaugugaa

SEQ ID NO: 3906717 - RNA, 17 nt, Human adenovirus B [HAdV-B]
acaugaaucaugugaaa

SEQ ID NO: 3906718 - RNA, 18 nt, Human adenovirus B [HAdV-B]
acaugaccaaagacuggu

SEQ ID NO: 3906719 - RNA, 20 nt, Human adenovirus B [HAdV-B]
acaugggggugcuggcuggu

SEQ ID NO: 3906720 - RNA, 17 nt, Human adenovirus B [HAdV-B]
acauugcuucucugaac

SEQ ID NO: 3906721 - RNA, 16 nt, Human adenovirus B [HAdV-B]
acccacaaucuucaug

SEQ ID NO: 3906722 - RNA, 14 nt, Human adenovirus B [HAdV-B]
acccacgaugugac

SEQ ID NO: 3906723 - RNA, 19 nt, Human adenovirus B [HAdV-B]
accguucaauuuguggagg

SEQ ID NO: 3906724 - RNA, 22 nt, Human adenovirus B [HAdV-B]
accuauacacaccuugcuucac

SEQ ID NO: 3906725 - RNA, 12 nt, Human adenovirus B [HAdV-B]
accuaugugaac

SEQ ID NO: 3906726 - RNA, 16 nt, Human adenovirus B [HAdV-B]
accucuuucuguuuac

SEQ ID NO: 3906727 - RNA, 17 nt, Human adenovirus B [HAdV-B]
accugaaguaaauggaa

SEQ ID NO: 3906728 - RNA, 18 nt, Human adenovirus B [HAdV-B]
accugaaguaaauggaac

SEQ ID NO: 3906729 - RNA, 21 nt, Human adenovirus B [HAdV-B]
accugaagucuacggccaacc

SEQ ID NO: 3906730 - RNA, 19 nt, Human adenovirus B [HAdV-B]
accugcgagccaaauccuc

SEQ ID NO: 3906731 - RNA, 13 nt, Human adenovirus B [HAdV-B]
accugcggagcag

SEQ ID NO: 3906732 - RNA, 18 nt, Human adenovirus B [HAdV-B]
accugcugcgcacugccc

SEQ ID NO: 3906733 - RNA, 21 nt, Human adenovirus B [HAdV-B]
accuuccggaaccacacugcc

SEQ ID NO: 3906734 - RNA, 20 nt, Human adenovirus B [HAdV-B]
acgaaguguaccaugcaugc

SEQ ID NO: 3906735 - RNA, 22 nt, Human adenovirus B [HAdV-B]
acgaccagacggaaucuuucag

SEQ ID NO: 3906736 - RNA, 16 nt, Human adenovirus B [HAdV-B]
acgagccaacugaacg

SEQ ID NO: 3906737 - RNA, 12 nt, Human adenovirus B [HAdV-B]
acgaggaggcag

SEQ ID NO: 3906738 - RNA, 22 nt, Human adenovirus B [HAdV-B]
acgccagacgccgcaccugucc

SEQ ID NO: 3906739 - RNA, 12 nt, Human adenovirus B [HAdV-B]
acgcccaggccg

SEQ ID NO: 3906740 - RNA, 13 nt, Human adenovirus B [HAdV-B]
acggauucugggg

SEQ ID NO: 3906741 - RNA, 18 nt, Human adenovirus B [HAdV-B]
acggcgacgcgugcaaug

SEQ ID NO: 3906742 - RNA, 16 nt, Human adenovirus B [HAdV-B]
acgggugcuuacugga

SEQ ID NO: 3906743 - RNA, 17 nt, Human adenovirus B [HAdV-B]
acgguaaaucugagcca

SEQ ID NO: 3906744 - RNA, 15 nt, Human adenovirus B [HAdV-B]
acggugcugcaguug

SEQ ID NO: 3906745 - RNA, 17 nt, Human adenovirus B [HAdV-B]
acuaucagaaugaccac

SEQ ID NO: 3906746 - RNA, 24 nt, Human adenovirus B [HAdV-B]
acuauguuuucuuagagauggaag

SEQ ID NO: 3906747 - RNA, 14 nt, Human adenovirus B [HAdV-B]
acucccagcagcuc

SEQ ID NO: 3906748 - RNA, 22 nt, Human adenovirus B [HAdV-B]
acuccccccaaacgucagccaa

SEQ ID NO: 3906749 - RNA, 22 nt, Human adenovirus B [HAdV-B]
acucgguggauuuuuuccagga

SEQ ID NO: 3906750 - RNA, 18 nt, Human adenovirus B [HAdV-B]
acucuuccagaaaacaaa

SEQ ID NO: 3906751 - RNA, 18 nt, Human adenovirus B [HAdV-B]
acugaagugcccaucagu

SEQ ID NO: 3906752 - RNA, 13 nt, Human adenovirus B [HAdV-B]
acugacgccagac

SEQ ID NO: 3906753 - RNA, 17 nt, Human adenovirus B [HAdV-B]
acugcagcacuggacau

SEQ ID NO: 3906754 - RNA, 18 nt, Human adenovirus B [HAdV-B]
acugcccuccgacuuugu

SEQ ID NO: 3906755 - RNA, 15 nt, Human adenovirus B [HAdV-B]
acuggcuaccuauca

SEQ ID NO: 3906756 - RNA, 17 nt, Human adenovirus B [HAdV-B]
acuucuccaucagcaga

SEQ ID NO: 3906757 - RNA, 17 nt, Human adenovirus B [HAdV-B]
acuuuaaagaaaaaguu

SEQ ID NO: 3906758 - RNA, 23 nt, Human adenovirus B [HAdV-B]
agaacaaaagaauaccaaaagaa

SEQ ID NO: 3906759 - RNA, 16 nt, Human adenovirus B [HAdV-B]
agaacagaacuugaaa

SEQ ID NO: 3906760 - RNA, 13 nt, Human adenovirus B [HAdV-B]
agaaccugacccc

SEQ ID NO: 3906761 - RNA, 20 nt, Human adenovirus B [HAdV-B]
agaacuggauuuccugccac

SEQ ID NO: 3906762 - RNA, 11 nt, Human adenovirus B [HAdV-B]
agaagaggaag

SEQ ID NO: 3906763 - RNA, 17 nt, Human adenovirus B [HAdV-B]
agaagaggcggaugaag

SEQ ID NO: 3906764 - RNA, 19 nt, Human adenovirus B [HAdV-B]
agaagguuuccaucauguu

SEQ ID NO: 3906765 - RNA, 16 nt, Human adenovirus B [HAdV-B]
agaaugacccgcaggc

SEQ ID NO: 3906766 - RNA, 19 nt, Human adenovirus B [HAdV-B]
agaaugagccuaacaggaa

SEQ ID NO: 3906767 - RNA, 24 nt, Human adenovirus B [HAdV-B]
agaauuacuucgacaugggagcug

SEQ ID NO: 3906768 - RNA, 19 nt, Human adenovirus B [HAdV-B]
ccaugauaauagcaauggg

SEQ ID NO: 3906769 - RNA, 23 nt, Human adenovirus B [HAdV-B]
ccaugccuauuacaacugacgcc

SEQ ID NO: 3906770 - RNA, 21 nt, Human adenovirus B [HAdV-B]
ccauugaagggauucaugcuc

SEQ ID NO: 3906771 - RNA, 17 nt, Human adenovirus B [HAdV-B]
ccauuugccauucucga

SEQ ID NO: 3906772 - RNA, 16 nt, Human adenovirus B [HAdV-B]
cccaaucgcgaagagg

SEQ ID NO: 3906773 - RNA, 17 nt, Human adenovirus B [HAdV-B]
cccaauuggcuccagca

SEQ ID NO: 3906774 - RNA, 18 nt, Human adenovirus B [HAdV-B]
cccagaagauauggagga

SEQ ID NO: 3906775 - RNA, 16 nt, Human adenovirus B [HAdV-B]
cccagagcgucucagg

SEQ ID NO: 3906776 - RNA, 11 nt, Human adenovirus B [HAdV-B]
cccagcagcuc

SEQ ID NO: 3906777 - RNA, 22 nt, Human adenovirus B [HAdV-B]
cccaggccaugcaacguaucau

SEQ ID NO: 3906778 - RNA, 13 nt, Human adenovirus B [HAdV-B]
cccaguccugcca

SEQ ID NO: 3906779 - RNA, 19 nt, Human adenovirus B [HAdV-B]
cccaguccugccaccaccu

SEQ ID NO: 3906780 - RNA, 21 nt, Human adenovirus B [HAdV-B]
cccgccaaacccaacacacac

SEQ ID NO: 3906781 - RNA, 20 nt, Human adenovirus B [HAdV-B]
cccggcggcgucccagcagu

SEQ ID NO: 3906782 - RNA, 19 nt, Human adenovirus B [HAdV-B]
cccuaguguaccaggaaag

SEQ ID NO: 3906783 - RNA, 18 nt, Human adenovirus B [HAdV-B]
cccugccguugcgcagca

SEQ ID NO: 3906784 - RNA, 11 nt, Human adenovirus B [HAdV-B]
cccugcugcua

SEQ ID NO: 3906785 - RNA, 23 nt, Human adenovirus B [HAdV-B]
cccuguaugccaucuuccagcag

SEQ ID NO: 3906786 - RNA, 24 nt, Human adenovirus B [HAdV-B]
ccgacugcagcacuggacaugaca

SEQ ID NO: 3906787 - RNA, 21 nt, Human adenovirus B [HAdV-B]
ccgacuuugugccucucaccu

SEQ ID NO: 3906788 - RNA, 20 nt, Human adenovirus B [HAdV-B]
ccgagaagguggcugccauc

SEQ ID NO: 3906789 - RNA, 15 nt, Human adenovirus B [HAdV-B]
ccgcaagacaccugc

SEQ ID NO: 3906790 - RNA, 17 nt, Human adenovirus B [HAdV-B]
ccgcuuucgcagcggcg

SEQ ID NO: 3906791 - RNA, 21 nt, Human adenovirus B [HAdV-B]
ccgguauccugcccgccaccu

SEQ ID NO: 3906792 - RNA, 20 nt, Human adenovirus B [HAdV-B]
ccgucgcuuccgaccuggca

SEQ ID NO: 3906793 - RNA, 17 nt, Human adenovirus B [HAdV-B]
ccuacauggguauucug

SEQ ID NO: 3906794 - RNA, 20 nt, Human adenovirus B [HAdV-B]
ccuagucgcagggcucugag

SEQ ID NO: 3906795 - RNA, 14 nt, Human adenovirus B [HAdV-B]
ccucaaaaacacac

SEQ ID NO: 3906796 - RNA, 19 nt, Human adenovirus B [HAdV-B]
ccucccgacggugcugcag

SEQ ID NO: 3906797 - RNA, 20 nt, Human adenovirus B [HAdV-B]
ccucccgacggugcugcagu

SEQ ID NO: 3906798 - RNA, 14 nt, Human adenovirus B [HAdV-B]
ccucggcugcggag

SEQ ID NO: 3906799 - RNA, 15 nt, Human adenovirus B [HAdV-B]
ccucugcacucaggu

SEQ ID NO: 3906800 - RNA, 15 nt, Human adenovirus B [HAdV-B]
ccucuuuucaccucg

SEQ ID NO: 3906801 - RNA, 18 nt, Human adenovirus B [HAdV-B]
ccugauauagcuuccuug

SEQ ID NO: 3906802 - RNA, 17 nt, Human adenovirus B [HAdV-B]
ccugcaacgaauuuucu

SEQ ID NO: 3906803 - RNA, 21 nt, Human adenovirus B [HAdV-B]
ccugcagaaaucuucccauca

SEQ ID NO: 3906804 - RNA, 16 nt, Human adenovirus B [HAdV-B]
ccugcggagcagagca

SEQ ID NO: 3906805 - RNA, 22 nt, Human adenovirus B [HAdV-B]
ccugcuugggcgcuugccaggg

SEQ ID NO: 3906806 - RNA, 15 nt, Human adenovirus B [HAdV-B]
ccuguggugggugca

SEQ ID NO: 3906807 - RNA, 21 nt, Human adenovirus B [HAdV-B]
ccuuccagggucucaguguuc

SEQ ID NO: 3906808 - RNA, 13 nt, Human adenovirus B [HAdV-B]
ccuuccaguacuc

SEQ ID NO: 3906809 - RNA, 16 nt, Human adenovirus B [HAdV-B]
ccuucgcggcuggcca

SEQ ID NO: 3906810 - RNA, 20 nt, Human adenovirus B [HAdV-B]
ccuuggaagagguuccaaag

SEQ ID NO: 3906811 - RNA, 16 nt, Human adenovirus B [HAdV-B]
ccuuuauuccaaugug

SEQ ID NO: 3906812 - RNA, 14 nt, Human adenovirus B [HAdV-B]
cgaagccauagggc

SEQ ID NO: 3906813 - RNA, 18 nt, Human adenovirus B [HAdV-B]
cgaagcuaauuugggaca

SEQ ID NO: 3906814 - RNA, 17 nt, Human adenovirus B [HAdV-B]
cgagaaaaaacagccaa

SEQ ID NO: 3906815 - RNA, 22 nt, Human adenovirus B [HAdV-B]
cgagagcgugaugcagcagcag

SEQ ID NO: 3906816 - RNA, 11 nt, Human adenovirus B [HAdV-B]
cgaggaggaag

SEQ ID NO: 3906817 - RNA, 16 nt, Human adenovirus B [HAdV-B]
cgaggaggaagagggc

SEQ ID NO: 3906818 - RNA, 13 nt, Human adenovirus B [HAdV-B]
cgaucuucucaau

SEQ ID NO: 3906819 - RNA, 15 nt, Human adenovirus B [HAdV-B]
cgaugacaauucucu

SEQ ID NO: 3906820 - RNA, 15 nt, Human adenovirus B [HAdV-B]
cgaugucgucacagg

SEQ ID NO: 3906821 - RNA, 20 nt, Human adenovirus B [HAdV-B]
cgauuagcgagucaguggac

SEQ ID NO: 3906822 - RNA, 21 nt, Human adenovirus B [HAdV-B]
cgauucucacuugccacccuc

SEQ ID NO: 3906823 - RNA, 15 nt, Human adenovirus B [HAdV-B]
cgcaguacuucaaau

SEQ ID NO: 3906824 - RNA, 21 nt, Human adenovirus B [HAdV-B]
cgcaugaauuggcucagcgcc

SEQ ID NO: 3906825 - RNA, 17 nt, Human adenovirus B [HAdV-B]
cgccaccugcugcgcac

SEQ ID NO: 3906826 - RNA, 21 nt, Human adenovirus B [HAdV-B]
cgcccagcuguuucugguggu

SEQ ID NO: 3906827 - RNA, 19 nt, Human adenovirus B [HAdV-B]
cgcgcagauggcaucucuc

SEQ ID NO: 3906828 - RNA, 17 nt, Human adenovirus B [HAdV-B]
cgcguggggcgaagagc

SEQ ID NO: 3906829 - RNA, 14 nt, Human adenovirus B [HAdV-B]
cgcucuaaucccac

SEQ ID NO: 3906830 - RNA, 14 nt, Human adenovirus B [HAdV-B]
cgcuugccagcacg

SEQ ID NO: 3906831 - RNA, 13 nt, Human adenovirus B [HAdV-B]
cgcuugccagggu

SEQ ID NO: 3906832 - RNA, 22 nt, Human adenovirus B [HAdV-B]
cggauucuuaacagugcaggca

SEQ ID NO: 3906833 - RNA, 21 nt, Human adenovirus B [HAdV-B]
cggcccuggcagaacacacuc

SEQ ID NO: 3906834 - RNA, 21 nt, Human adenovirus B [HAdV-B]
cggcgcugcagagccagccgu

SEQ ID NO: 3906835 - RNA, 14 nt, Human adenovirus B [HAdV-B]
cggcgucccagcag

SEQ ID NO: 3906836 - RNA, 15 nt, Human adenovirus B [HAdV-B]
cggcgugccucugac

SEQ ID NO: 3906837 - RNA, 14 nt, Human adenovirus B [HAdV-B]
cgggcaggauguca

SEQ ID NO: 3906838 - RNA, 13 nt, Human adenovirus B [HAdV-B]
cggggucaagagc

SEQ ID NO: 3906839 - RNA, 23 nt, Human adenovirus B [HAdV-B]
cggugaugcaauccccacuggag

SEQ ID NO: 3906840 - RNA, 17 nt, Human adenovirus B [HAdV-B]
cgguucuuugcucuucc

SEQ ID NO: 3906841 - RNA, 19 nt, Human adenovirus B [HAdV-B]
cguguacaaggcacugggc

SEQ ID NO: 3906842 - RNA, 13 nt, Human adenovirus B [HAdV-B]
cguguugcucagg

SEQ ID NO: 3906843 - RNA, 18 nt, Human adenovirus B [HAdV-B]
cguuaaccccacagccaa

SEQ ID NO: 3906844 - RNA, 22 nt, Human adenovirus B [HAdV-B]
cguuguccguucucgcuggcca

SEQ ID NO: 3906845 - RNA, 18 nt, Human adenovirus B [HAdV-B]
cuaacgaauuugaaauaa

SEQ ID NO: 3906846 - RNA, 17 nt, Human adenovirus B [HAdV-B]
cuacccaacauccuguc

SEQ ID NO: 3906847 - RNA, 15 nt, Human adenovirus B [HAdV-B]
cuaccuauacacacc

SEQ ID NO: 3906848 - RNA, 17 nt, Human adenovirus B [HAdV-B]
cuaccuugacccccaga

SEQ ID NO: 3906849 - RNA, 12 nt, Human adenovirus B [HAdV-B]
cuacuuucacag

SEQ ID NO: 3906850 - RNA, 17 nt, Human adenovirus B [HAdV-B]
cuagcauaaguucaucg

SEQ ID NO: 3906851 - RNA, 20 nt, Human adenovirus B [HAdV-B]
cuaggacaaagcgugcugca

SEQ ID NO: 3906852 - RNA, 14 nt, Human adenovirus B [HAdV-B]
cuaguagacaccua

SEQ ID NO: 3906853 - RNA, 14 nt, Human adenovirus B [HAdV-B]
cuagucuugcuugu

SEQ ID NO: 3906854 - RNA, 17 nt, Human adenovirus B [HAdV-B]
cuaucucuccuaccacu

SEQ ID NO: 3906855 - RNA, 19 nt, Human adenovirus B [HAdV-B]
cucaagguccggcccacgg

SEQ ID NO: 3906856 - RNA, 23 nt, Human adenovirus B [HAdV-B]
cucagcgacgaggaaaaggagca

SEQ ID NO: 3906857 - RNA, 17 nt, Human adenovirus B [HAdV-B]
cucagcucaugcucugg

SEQ ID NO: 3906858 - RNA, 15 nt, Human adenovirus B [HAdV-B]
cucagguugucaguu

SEQ ID NO: 3906859 - RNA, 15 nt, Human adenovirus B [HAdV-B]
cucauuugugcauuu

SEQ ID NO: 3906860 - RNA, 12 nt, Human adenovirus B [HAdV-B]
cucccagcagca

SEQ ID NO: 3906861 - RNA, 21 nt, Human adenovirus B [HAdV-B]
cuccccaaggaucacccucaa

SEQ ID NO: 3906862 - RNA, 15 nt, Human adenovirus B [HAdV-B]
cucccccagccaugc

SEQ ID NO: 3906863 - RNA, 16 nt, Human adenovirus B [HAdV-B]
cucccccagccaugca

SEQ ID NO: 3906864 - RNA, 15 nt, Human adenovirus B [HAdV-B]
cucccgacggugcug

SEQ ID NO: 3906865 - RNA, 18 nt, Human adenovirus B [HAdV-B]
cuccgacugcagcacugg

SEQ ID NO: 3906866 - RNA, 15 nt, Human adenovirus B [HAdV-B]
cuccggaucuccugg

SEQ ID NO: 3906867 - RNA, 22 nt, Human adenovirus B [HAdV-B]
cuccucguuuacguacugguga

SEQ ID NO: 3906868 - RNA, 13 nt, Human adenovirus B [HAdV-B]
cucgaagcaaggg

SEQ ID NO: 3906869 - RNA, 20 nt, Human adenovirus B [HAdV-B]
cucgaagggguucauugguc

SEQ ID NO: 3906870 - RNA, 17 nt, Human adenovirus B [HAdV-B]
cucgauaaucugcuccu

SEQ ID NO: 3906871 - RNA, 22 nt, Human adenovirus B [HAdV-B]
ugaagcucuuaauuugggccau

SEQ ID NO: 3906872 - RNA, 14 nt, Human adenovirus B [HAdV-B]
ugaaggggugugcg

SEQ ID NO: 3906873 - RNA, 10 nt, Human adenovirus B [HAdV-B]
ugaauuauuc

SEQ ID NO: 3906874 - RNA, 14 nt, Human adenovirus B [HAdV-B]
ugaccccgggacug

SEQ ID NO: 3906875 - RNA, 17 nt, Human adenovirus B [HAdV-B]
ugacguuucgcucacca

SEQ ID NO: 3906876 - RNA, 18 nt, Human adenovirus B [HAdV-B]
ugacugucgguagaagaa

SEQ ID NO: 3906877 - RNA, 21 nt, Human adenovirus B [HAdV-B]
ugaugacaauauuaacaccuu

SEQ ID NO: 3906878 - RNA, 19 nt, Human adenovirus B [HAdV-B]
ugaugcagcagcagcaggc

SEQ ID NO: 3906879 - RNA, 15 nt, Human adenovirus B [HAdV-B]
ugauuacuuugauau

SEQ ID NO: 3906880 - RNA, 17 nt, Human adenovirus B [HAdV-B]
ugauuauucuuugcuac

SEQ ID NO: 3906881 - RNA, 18 nt, Human adenovirus B [HAdV-B]
ugauuuaaaaucaagugu

SEQ ID NO: 3906882 - RNA, 18 nt, Human adenovirus B [HAdV-B]
ugcaaaccucugcuacaa

SEQ ID NO: 3906883 - RNA, 12 nt, Human adenovirus B [HAdV-B]
ugcaacccccag

SEQ ID NO: 3906884 - RNA, 16 nt, Human adenovirus B [HAdV-B]
ugcaaggccccagcag

SEQ ID NO: 3906885 - RNA, 15 nt, Human adenovirus B [HAdV-B]
ugcaccacacuucug

SEQ ID NO: 3906886 - RNA, 17 nt, Human adenovirus B [HAdV-B]
ugcagcaacaggaggau

SEQ ID NO: 3906887 - RNA, 18 nt, Human adenovirus B [HAdV-B]
ugcaggugaggauuugca

SEQ ID NO: 3906888 - RNA, 19 nt, Human adenovirus B [HAdV-B]
ugcaguagguacaacacau

SEQ ID NO: 3906889 - RNA, 14 nt, Human adenovirus B [HAdV-B]
ugccaaaaaaacau

SEQ ID NO: 3906890 - RNA, 20 nt, Human adenovirus B [HAdV-B]
ugccauucucgagcugccag

SEQ ID NO: 3906891 - RNA, 23 nt, Human adenovirus B [HAdV-B]
ugccccacggcgacgcgugcaau

SEQ ID NO: 3906892 - RNA, 16 nt, Human adenovirus B [HAdV-B]
ugcccgccaccugcug

SEQ ID NO: 3906893 - RNA, 23 nt, Human adenovirus B [HAdV-B]
ugccugacuuuaugagccagagc

SEQ ID NO: 3906894 - RNA, 20 nt, Human adenovirus B [HAdV-B]
ugcgaucuggccauguucau

SEQ ID NO: 3906895 - RNA, 21 nt, Human adenovirus B [HAdV-B]
ugcgauuuucaaggugcucaa

SEQ ID NO: 3906896 - RNA, 19 nt, Human adenovirus B [HAdV-B]
ugcggcaucgcagaaaaca

SEQ ID NO: 3906897 - RNA, 20 nt, Human adenovirus B [HAdV-B]
ugcuacagcugcugcagaag

SEQ ID NO: 3906898 - RNA, 14 nt, Human adenovirus B [HAdV-B]
ugcuacgaagagcu

SEQ ID NO: 3906899 - RNA, 15 nt, Human adenovirus B [HAdV-B]
ugcuagauggaacag

SEQ ID NO: 3906900 - RNA, 12 nt, Human adenovirus B [HAdV-B]
ugcucugcaaaa

SEQ ID NO: 3906901 - RNA, 18 nt, Human adenovirus B [HAdV-B]
uggaagagaugguggguc

SEQ ID NO: 3906902 - RNA, 20 nt, Human adenovirus B [HAdV-B]
uggacccuccaguggaggag

SEQ ID NO: 3906903 - RNA, 23 nt, Human adenovirus B [HAdV-B]
uggaggaggaaaacgaggaggca

SEQ ID NO: 3906904 - RNA, 14 nt, Human adenovirus B [HAdV-B]
uggagucacugcua

SEQ ID NO: 3906905 - RNA, 13 nt, Human adenovirus B [HAdV-B]
uggaucccaugga

SEQ ID NO: 3906906 - RNA, 23 nt, Human adenovirus B [HAdV-B]
uggcacucccgucucgacccagc

SEQ ID NO: 3906907 - RNA, 13 nt, Human adenovirus B [HAdV-B]
uggcaugggaugg

SEQ ID NO: 3906908 - RNA, 18 nt, Human adenovirus B [HAdV-B]
uggcgcgauaccaggcau

SEQ ID NO: 3906909 - RNA, 23 nt, Human adenovirus B [HAdV-B]
uggcuacugugcauauuguuucc

SEQ ID NO: 3906910 - RNA, 23 nt, Human adenovirus B [HAdV-B]
uggcuuaccagacaaaguacagc

SEQ ID NO: 3906911 - RNA, 18 nt, Human adenovirus B [HAdV-B]
ugggacagucaggcagag

SEQ ID NO: 3906912 - RNA, 18 nt, Human adenovirus B [HAdV-B]
ugggcaccgacucuccca

SEQ ID NO: 3906913 - RNA, 21 nt, Human adenovirus B [HAdV-B]
ugggcauucugaaugaaggcg

SEQ ID NO: 3906914 - RNA, 14 nt, Human adenovirus B [HAdV-B]
ugggggugcuggcu

SEQ ID NO: 3906915 - RNA, 17 nt, Human adenovirus B [HAdV-B]
ugggucugacacaucau

SEQ ID NO: 3906916 - RNA, 17 nt, Human adenovirus B [HAdV-B]
uguaucccacuaugcaa

SEQ ID NO: 3906917 - RNA, 21 nt, Human adenovirus B [HAdV-B]
uguauccggaggguccuccuc

SEQ ID NO: 3906918 - RNA, 13 nt, Human adenovirus B [HAdV-B]
uguccaagcgcaa

SEQ ID NO: 3906919 - RNA, 15 nt, Human adenovirus B [HAdV-B]
uguccuccaagauuu

SEQ ID NO: 3906920 - RNA, 17 nt, Human adenovirus B [HAdV-B]
ugugauggcgcuagcag

SEQ ID NO: 3906921 - RNA, 13 nt, Human adenovirus B [HAdV-B]
ugugcagcagagc

SEQ ID NO: 3906922 - RNA, 20 nt, Human adenovirus B [HAdV-B]
uguuugccaaaggaucccau

SEQ ID NO: 3906923 - RNA, 19 nt, Human adenovirus B [HAdV-B]
uguuuggucuuccuuggcu

SEQ ID NO: 3906924 - RNA, 18 nt, Human adenovirus B [HAdV-B]
uuaaaaaccugcugcuuc

SEQ ID NO: 3906925 - RNA, 19 nt, Human adenovirus B [HAdV-B]
uuaaauccacacugguggc

SEQ ID NO: 3906926 - RNA, 17 nt, Human adenovirus B [HAdV-B]
uuaagcauuccaccgcc

SEQ ID NO: 3906927 - RNA, 20 nt, Human adenovirus B [HAdV-B]
uuaauauaaauuaaaugacg

SEQ ID NO: 3906928 - RNA, 14 nt, Human adenovirus B [HAdV-B]
uuacaaccagaaga

SEQ ID NO: 3906929 - RNA, 12 nt, Human adenovirus B [HAdV-B]
uuaugugcauuu

SEQ ID NO: 3906930 - RNA, 17 nt, Human adenovirus B [HAdV-B]
uucucuagaaacuuuua

SEQ ID NO: 3906931 - RNA, 13 nt, Human adenovirus B [HAdV-B]
uucuuaacagugc

SEQ ID NO: 3906932 - RNA, 22 nt, Human adenovirus B [HAdV-B]
uugagcugggaugggugcauuc

SEQ ID NO: 3906933 - RNA, 17 nt, Human adenovirus B [HAdV-B]
uugcaaucgcagugcag

SEQ ID NO: 3906934 - RNA, 13 nt, Human adenovirus B [HAdV-B]
uugcaugaaagcc

SEQ ID NO: 3906935 - RNA, 16 nt, Human adenovirus B [HAdV-B]
uugcgccaacaccugu

SEQ ID NO: 3906936 - RNA, 14 nt, Human adenovirus B [HAdV-B]
uugcuaacgcugga

SEQ ID NO: 3906937 - RNA, 18 nt, Human adenovirus B [HAdV-B]
uuguaucccacuaugcaa

SEQ ID NO: 3906938 - RNA, 14 nt, Human adenovirus B [HAdV-B]
uuguaucuggugga

SEQ ID NO: 3906939 - RNA, 18 nt, Human adenovirus B [HAdV-B]
uugucuccugaacugcaa

SEQ ID NO: 3906940 - RNA, 22 nt, Human adenovirus B [HAdV-B]
uugugcggcaggcaugcaagau

SEQ ID NO: 3906941 - RNA, 17 nt, Human adenovirus B [HAdV-B]
uuuauuugaaaaucaau

SEQ ID NO: 3906942 - RNA, 11 nt, Human adenovirus B [HAdV-B]
uuuccagaagc

SEQ ID NO: 3906943 - RNA, 11 nt, Human adenovirus B [HAdV-B]
uuugcugugcc

SEQ ID NO: 3906944 - RNA, 16 nt, Human adenovirus B [HAdV-B]
uuuucucccagcagca

SEQ ID NO: 3906945 - RNA, 14 nt, Human adenovirus B [HAdV-B]
uuuucuuacuuuua

SEQ ID NO: 3906946 - RNA, 23 nt, Human adenovirus B [HAdV-B]
uuuugcacccgacacaagccgca

SEQ ID NO: 3906947 - RNA, 18 nt, Human adenovirus B [HAdV-B]
gaccccgggacuguggac

SEQ ID NO: 3906948 - RNA, 13 nt, Human adenovirus B [HAdV-B]
gaccucaucuucc

SEQ ID NO: 3906949 - RNA, 20 nt, Human adenovirus B [HAdV-B]
gaccuuucauuaacaaacug

SEQ ID NO: 3906950 - RNA, 18 nt, Human adenovirus B [HAdV-B]
gacgguaaaucugagcca

SEQ ID NO: 3906951 - RNA, 19 nt, Human adenovirus B [HAdV-B]
gacuacuugcacagagcug

SEQ ID NO: 3906952 - RNA, 17 nt, Human adenovirus B [HAdV-B]
gacucucgccugcaacg

SEQ ID NO: 3906953 - RNA, 18 nt, Human adenovirus B [HAdV-B]
gacuuuaugagccagagc

SEQ ID NO: 3906954 - RNA, 20 nt, Human adenovirus B [HAdV-B]
gacuuuaugagccagagcau

SEQ ID NO: 3906955 - RNA, 14 nt, Human adenovirus B [HAdV-B]
gagaaaaagaaaac

SEQ ID NO: 3906956 - RNA, 18 nt, Human adenovirus B [HAdV-B]
gagaaaaaucagaaauuc

SEQ ID NO: 3906957 - RNA, 22 nt, Human adenovirus B [HAdV-B]
gagaccugcuaccaaugaauua

SEQ ID NO: 3906958 - RNA, 13 nt, Human adenovirus B [HAdV-B]
gaggaauguuuau

SEQ ID NO: 3906959 - RNA, 18 nt, Human adenovirus B [HAdV-B]
gaggagaugcgagcuucc

SEQ ID NO: 3906960 - RNA, 21 nt, Human adenovirus B [HAdV-B]
gaggccacaacgcacagccug

SEQ ID NO: 3906961 - RNA, 14 nt, Human adenovirus B [HAdV-B]
gaguacuuggaaga

SEQ ID NO: 3906962 - RNA, 13 nt, Human adenovirus B [HAdV-B]
gagucgaggaacc

SEQ ID NO: 3906963 - RNA, 18 nt, Human adenovirus B [HAdV-B]
gagucugagacagacauc

SEQ ID NO: 3906964 - RNA, 21 nt, Human adenovirus B [HAdV-B]
gagucugagacagacaucgag

SEQ ID NO: 3906965 - RNA, 20 nt, Human adenovirus B [HAdV-B]
gaguuuaaugggcgaagagg

SEQ ID NO: 3906966 - RNA, 15 nt, Human adenovirus B [HAdV-B]
gauagccccaauggc

SEQ ID NO: 3906967 - RNA, 21 nt, Human adenovirus B [HAdV-B]
gauauugacagugccgguuga

SEQ ID NO: 3906968 - RNA, 15 nt, Human adenovirus B [HAdV-B]
gaucaaaagaaaugc

SEQ ID NO: 3906969 - RNA, 15 nt, Human adenovirus B [HAdV-B]
gaucacaaugugaug

SEQ ID NO: 3906970 - RNA, 19 nt, Human adenovirus B [HAdV-B]
gaucauggaaaucccaccc

SEQ ID NO: 3906971 - RNA, 17 nt, Human adenovirus B [HAdV-B]
gauccauggaugcccau

SEQ ID NO: 3906972 - RNA, 15 nt, Human adenovirus B [HAdV-B]
gauccugagguauga

SEQ ID NO: 3906973 - RNA, 23 nt, Human adenovirus B [HAdV-B]
gauccuuagauaugugcagcaga

SEQ ID NO: 3906974 - RNA, 12 nt, Human adenovirus B [HAdV-B]
gaucggacaggg

SEQ ID NO: 3906975 - RNA, 16 nt, Human adenovirus B [HAdV-B]
gaugaaaacugcccaa

SEQ ID NO: 3906976 - RNA, 16 nt, Human adenovirus B [HAdV-B]
gaugaaaugacaggga

SEQ ID NO: 3906977 - RNA, 20 nt, Human adenovirus B [HAdV-B]
gaugagcccacccugcuuua

SEQ ID NO: 3906978 - RNA, 19 nt, Human adenovirus B [HAdV-B]
gaugcauuauuggacagaa

SEQ ID NO: 3906979 - RNA, 19 nt, Human adenovirus B [HAdV-B]
gaugccuuuuccagaauga

SEQ ID NO: 3906980 - RNA, 14 nt, Human adenovirus B [HAdV-B]
gauggaaaaaccga

SEQ ID NO: 3906981 - RNA, 15 nt, Human adenovirus B [HAdV-B]
gaugguuauaaugga

SEQ ID NO: 3906982 - RNA, 18 nt, Human adenovirus B [HAdV-B]
gaugucaccugcggagca

SEQ ID NO: 3906983 - RNA, 23 nt, Human adenovirus B [HAdV-B]
gaugucccaacgacgagaaaaca

SEQ ID NO: 3906984 - RNA, 14 nt, Human adenovirus B [HAdV-B]
gauuccuugcucag

SEQ ID NO: 3906985 - RNA, 23 nt, Human adenovirus B [HAdV-B]
gauuggcggcaggcgccucccag

SEQ ID NO: 3906986 - RNA, 17 nt, Human adenovirus B [HAdV-B]
gauuucugugggacgac

SEQ ID NO: 3906987 - RNA, 20 nt, Human adenovirus B [HAdV-B]
gauuugauauugacagugcc

SEQ ID NO: 3906988 - RNA, 19 nt, Human adenovirus B [HAdV-B]
gauuugauggaagcuauca

SEQ ID NO: 3906989 - RNA, 14 nt, Human adenovirus B [HAdV-B]
gcaaaacaaugacu

SEQ ID NO: 3906990 - RNA, 19 nt, Human adenovirus B [HAdV-B]
gcaaaguucgacauguguu

SEQ ID NO: 3906991 - RNA, 22 nt, Human adenovirus B [HAdV-B]
gcaaauacaaggaagaaaugcu

SEQ ID NO: 3906992 - RNA, 23 nt, Human adenovirus B [HAdV-B]
gcaagagcucugcuacgaagagc

SEQ ID NO: 3906993 - RNA, 16 nt, Human adenovirus B [HAdV-B]
gcaaucgcagugcagg

SEQ ID NO: 3906994 - RNA, 22 nt, Human adenovirus B [HAdV-B]
gcacacuaaaaggaccucaagg

SEQ ID NO: 3906995 - RNA, 17 nt, Human adenovirus B [HAdV-B]
gcacgucuucaaccgcu

SEQ ID NO: 3906996 - RNA, 16 nt, Human adenovirus B [HAdV-B]
gcagaacacacucuuc

SEQ ID NO: 3906997 - RNA, 20 nt, Human adenovirus B [HAdV-B]
gcagagaaacaacagacaug

SEQ ID NO: 3906998 - RNA, 12 nt, Human adenovirus B [HAdV-B]
gcaggagcggag

SEQ ID NO: 3906999 - RNA, 17 nt, Human adenovirus B [HAdV-B]
gcaggaugugagcuucc

SEQ ID NO: 3907000 - RNA, 17 nt, Human adenovirus B [HAdV-B]
gcaguaacuuuuguaaa

SEQ ID NO: 3907001 - RNA, 15 nt, Human adenovirus B [HAdV-B]
gcaguacucaagcga

SEQ ID NO: 3907002 - RNA, 18 nt, Human adenovirus B [HAdV-B]
gcauacaauccagacaug

SEQ ID NO: 3907003 - RNA, 12 nt, Human adenovirus B [HAdV-B]
gcauacuuucuc

SEQ ID NO: 3907004 - RNA, 21 nt, Human adenovirus B [HAdV-B]
gcauagcuuccguggcgguuc

SEQ ID NO: 3907005 - RNA, 19 nt, Human adenovirus B [HAdV-B]
gcauccaccggucaugcca

SEQ ID NO: 3907006 - RNA, 15 nt, Human adenovirus B [HAdV-B]
gcaugaauuggcuca

SEQ ID NO: 3907007 - RNA, 23 nt, Human adenovirus B [HAdV-B]
gcaugacccagaugccugugaug

SEQ ID NO: 3907008 - RNA, 17 nt, Human adenovirus B [HAdV-B]
gccaaccguugaaggau

SEQ ID NO: 3907009 - RNA, 18 nt, Human adenovirus B [HAdV-B]
gccaacuaucucuccuac

SEQ ID NO: 3907010 - RNA, 16 nt, Human adenovirus B [HAdV-B]
gccaaugcaaccaaua

SEQ ID NO: 3907011 - RNA, 15 nt, Human adenovirus B [HAdV-B]
gccacagcuggcaga

SEQ ID NO: 3907012 - RNA, 21 nt, Human adenovirus B [HAdV-B]
gccacagggucuccagcucga

SEQ ID NO: 3907013 - RNA, 15 nt, Human adenovirus B [HAdV-B]
gccaccugcugcgca

SEQ ID NO: 3907014 - RNA, 20 nt, Human adenovirus B [HAdV-B]
gccaccugcugcgcacugcc

SEQ ID NO: 3907015 - RNA, 17 nt, Human adenovirus B [HAdV-B]
gccacgagugccaucac

SEQ ID NO: 3907016 - RNA, 19 nt, Human adenovirus B [HAdV-B]
gccagcgcaaacccgagag

SEQ ID NO: 3907017 - RNA, 15 nt, Human adenovirus B [HAdV-B]
gccagcgccaugaca

SEQ ID NO: 3907018 - RNA, 18 nt, Human adenovirus B [HAdV-B]
gccagcgguucuggagga

SEQ ID NO: 3907019 - RNA, 14 nt, Human adenovirus B [HAdV-B]
gccaugacagacag

SEQ ID NO: 3907020 - RNA, 17 nt, Human adenovirus B [HAdV-B]
gccaugcauugaaguga

SEQ ID NO: 3907021 - RNA, 18 nt, Human adenovirus B [HAdV-B]
gcccaguccugccaccac

SEQ ID NO: 3907022 - RNA, 22 nt, Human adenovirus B [HAdV-B]
gccccccgggaacaagagcagg

SEQ ID NO: 3907023 - RNA, 16 nt, Human adenovirus B [HAdV-B]
gcccuacucaaucugg

SEQ ID NO: 3907024 - RNA, 12 nt, Human adenovirus B [HAdV-B]
gccgaugugucu

SEQ ID NO: 3907025 - RNA, 20 nt, Human adenovirus B [HAdV-B]
gccuacccauggcgggcacc

SEQ ID NO: 3907026 - RNA, 14 nt, Human adenovirus B [HAdV-B]
gccuacugccaccu

SEQ ID NO: 3907027 - RNA, 15 nt, Human adenovirus B [HAdV-B]
gccuacugccaccuc

SEQ ID NO: 3907028 - RNA, 14 nt, Human adenovirus B [HAdV-B]
gccucuucucuuuc

SEQ ID NO: 3907029 - RNA, 20 nt, Human adenovirus B [HAdV-B]
gccugacuuuaugagccaga

SEQ ID NO: 3907030 - RNA, 17 nt, Human adenovirus B [HAdV-B]
gccuguacuucuccauc

SEQ ID NO: 3907031 - RNA, 16 nt, Human adenovirus B [HAdV-B]
gccuucaauuggagca

SEQ ID NO: 3907032 - RNA, 17 nt, Human adenovirus B [HAdV-B]
ucuaaggccauuugcca

SEQ ID NO: 3907033 - RNA, 18 nt, Human adenovirus B [HAdV-B]
ucuaaucccacucaugag

SEQ ID NO: 3907034 - RNA, 19 nt, Human adenovirus B [HAdV-B]
ucuaccuugacccccagac

SEQ ID NO: 3907035 - RNA, 23 nt, Human adenovirus B [HAdV-B]
ucuacuucaaccccuucuccgga

SEQ ID NO: 3907036 - RNA, 15 nt, Human adenovirus B [HAdV-B]
ucuauucugguucua

SEQ ID NO: 3907037 - RNA, 14 nt, Human adenovirus B [HAdV-B]
ucucaaccccagcu

SEQ ID NO: 3907038 - RNA, 21 nt, Human adenovirus B [HAdV-B]
ucucccagacucguacaaaua

SEQ ID NO: 3907039 - RNA, 20 nt, Human adenovirus B [HAdV-B]
ucucugaccaugacuuugag

SEQ ID NO: 3907040 - RNA, 17 nt, Human adenovirus B [HAdV-B]
ucugaacuaucagaaug

SEQ ID NO: 3907041 - RNA, 15 nt, Human adenovirus B [HAdV-B]
ucugauuccuggaua

SEQ ID NO: 3907042 - RNA, 12 nt, Human adenovirus B [HAdV-B]
ucuggggucuug

SEQ ID NO: 3907043 - RNA, 14 nt, Human adenovirus B [HAdV-B]
ucuguugaaauuuu

SEQ ID NO: 3907044 - RNA, 14 nt, Human adenovirus B [HAdV-B]
ucuuacugcuuuac

SEQ ID NO: 3907045 - RNA, 21 nt, Human adenovirus B [HAdV-B]
ucuuagguuacuggccagugc

SEQ ID NO: 3907046 - RNA, 13 nt, Human adenovirus B [HAdV-B]
ucuuaugaggaag

SEQ ID NO: 3907047 - RNA, 17 nt, Human adenovirus B [HAdV-B]
ucuucaccauacucauu

SEQ ID NO: 3907048 - RNA, 19 nt, Human adenovirus B [HAdV-B]
ucuucgcgauccuuccagu

SEQ ID NO: 3907049 - RNA, 18 nt, Human adenovirus B [HAdV-B]
ucuugcuucuugcaaaua

SEQ ID NO: 3907050 - RNA, 20 nt, Human adenovirus B [HAdV-B]
ucuuuagcgaucuucucaau

SEQ ID NO: 3907051 - RNA, 22 nt, Human adenovirus B [HAdV-B]
ucuuuugccauccuucucaacg

SEQ ID NO: 3907052 - RNA, 13 nt, Human adenovirus B [HAdV-B]
ugaaaugggcaug

SEQ ID NO: 3907053 - RNA, 17 nt, Human adenovirus B [HAdV-B]
ugaaauuaugugcauuu

SEQ ID NO: 3907054 - RNA, 14 nt, Human adenovirus B [HAdV-B]
ugaacaugguucua

SEQ ID NO: 3907055 - RNA, 13 nt, Human adenovirus B [HAdV-B]
auggcgugggcgc

SEQ ID NO: 3907056 - RNA, 21 nt, Human adenovirus B [HAdV-B]
augggcguccagcgcugccag

SEQ ID NO: 3907057 - RNA, 13 nt, Human adenovirus B [HAdV-B]
augggucuucucc

SEQ ID NO: 3907058 - RNA, 20 nt, Human adenovirus B [HAdV-B]
augggucuucuccugggcaa

SEQ ID NO: 3907059 - RNA, 15 nt, Human adenovirus B [HAdV-B]
auguaaauuuggaaa

SEQ ID NO: 3907060 - RNA, 19 nt, Human adenovirus B [HAdV-B]
auguaguuucuaugcgugu

SEQ ID NO: 3907061 - RNA, 16 nt, Human adenovirus B [HAdV-B]
augugacaccggugga

SEQ ID NO: 3907062 - RNA, 17 nt, Human adenovirus B [HAdV-B]
auguguacugaguuuaa

SEQ ID NO: 3907063 - RNA, 13 nt, Human adenovirus B [HAdV-B]
auuaaaaaaugau

SEQ ID NO: 3907064 - RNA, 21 nt, Human adenovirus B [HAdV-B]
auuacuaaugcuaaagguuuc

SEQ ID NO: 3907065 - RNA, 17 nt, Human adenovirus B [HAdV-B]
auuaucaccaaacugcu

SEQ ID NO: 3907066 - RNA, 15 nt, Human adenovirus B [HAdV-B]
auuaugugcauuuug

SEQ ID NO: 3907067 - RNA, 13 nt, Human adenovirus B [HAdV-B]
auucagaaaccuu

SEQ ID NO: 3907068 - RNA, 17 nt, Human adenovirus B [HAdV-B]
auuccaccagccagguu

SEQ ID NO: 3907069 - RNA, 22 nt, Human adenovirus B [HAdV-B]
auucccugcagaaaucuuccca

SEQ ID NO: 3907070 - RNA, 15 nt, Human adenovirus B [HAdV-B]
auugcccaggacuuu

SEQ ID NO: 3907071 - RNA, 14 nt, Human adenovirus B [HAdV-B]
auugccugacuuua

SEQ ID NO: 3907072 - RNA, 20 nt, Human adenovirus B [HAdV-B]
auugcucaccaccucagaug

SEQ ID NO: 3907073 - RNA, 21 nt, Human adenovirus B [HAdV-B]
auuggagcaguaucuggagcg

SEQ ID NO: 3907074 - RNA, 16 nt, Human adenovirus B [HAdV-B]
auuguuucugaugcaa

SEQ ID NO: 3907075 - RNA, 20 nt, Human adenovirus B [HAdV-B]
auuuacauauuggcaccauu

SEQ ID NO: 3907076 - RNA, 20 nt, Human adenovirus B [HAdV-B]
auuugauuuuggcuggaaug

SEQ ID NO: 3907077 - RNA, 21 nt, Human adenovirus B [HAdV-B]
auuugugggauuugauggaag

SEQ ID NO: 3907078 - RNA, 15 nt, Human adenovirus B [HAdV-B]
auuuucccuacuaau

SEQ ID NO: 3907079 - RNA, 16 nt, Human adenovirus B [HAdV-B]
auuuucuaacuccuca

SEQ ID NO: 3907080 - RNA, 17 nt, Human adenovirus B [HAdV-B]
auuuucucccagcggcc

SEQ ID NO: 3907081 - RNA, 15 nt, Human adenovirus B [HAdV-B]
caaaaaauuccaguc

SEQ ID NO: 3907082 - RNA, 18 nt, Human adenovirus B [HAdV-B]
caaacccaacacacaccc

SEQ ID NO: 3907083 - RNA, 14 nt, Human adenovirus B [HAdV-B]
caaagagcucugac

SEQ ID NO: 3907084 - RNA, 22 nt, Human adenovirus B [HAdV-B]
caaagaucuaccgccagugcug

SEQ ID NO: 3907085 - RNA, 16 nt, Human adenovirus B [HAdV-B]
caaaguaaaaggcaca

SEQ ID NO: 3907086 - RNA, 18 nt, Human adenovirus B [HAdV-B]
caaaguacagcgggcaca

SEQ ID NO: 3907087 - RNA, 18 nt, Human adenovirus B [HAdV-B]
caaaucaugaacuccagu

SEQ ID NO: 3907088 - RNA, 22 nt, Human adenovirus B [HAdV-B]
caaauuaggacaaggacuuaca

SEQ ID NO: 3907089 - RNA, 12 nt, Human adenovirus B [HAdV-B]
caacaaaacaaa

SEQ ID NO: 3907090 - RNA, 22 nt, Human adenovirus B [HAdV-B]
caacaaccguggucauuucuug

SEQ ID NO: 3907091 - RNA, 17 nt, Human adenovirus B [HAdV-B]
caacaaucuaugcccaa

SEQ ID NO: 3907092 - RNA, 11 nt, Human adenovirus B [HAdV-B]
caacacuuuca

SEQ ID NO: 3907093 - RNA, 18 nt, Human adenovirus B [HAdV-B]
caacagacccaacuacau

SEQ ID NO: 3907094 - RNA, 15 nt, Human adenovirus B [HAdV-B]
caacauauccuucac

SEQ ID NO: 3907095 - RNA, 17 nt, Human adenovirus B [HAdV-B]
caaccauaaaaacauac

SEQ ID NO: 3907096 - RNA, 16 nt, Human adenovirus B [HAdV-B]
caacgaacaagcugug

SEQ ID NO: 3907097 - RNA, 19 nt, Human adenovirus B [HAdV-B]
caagaauuucuacugaaaa

SEQ ID NO: 3907098 - RNA, 15 nt, Human adenovirus B [HAdV-B]
caagacaagccacag

SEQ ID NO: 3907099 - RNA, 17 nt, Human adenovirus B [HAdV-B]
caagcuuucaguuccga

SEQ ID NO: 3907100 - RNA, 12 nt, Human adenovirus B [HAdV-B]
caaggaggugaa

SEQ ID NO: 3907101 - RNA, 14 nt, Human adenovirus B [HAdV-B]
caaggccccagcag

SEQ ID NO: 3907102 - RNA, 20 nt, Human adenovirus B [HAdV-B]
caaggccccagcagccaagg

SEQ ID NO: 3907103 - RNA, 22 nt, Human adenovirus B [HAdV-B]
caagguaauuaaauccacacug

SEQ ID NO: 3907104 - RNA, 19 nt, Human adenovirus B [HAdV-B]
caaggucgcagugcauggu

SEQ ID NO: 3907105 - RNA, 15 nt, Human adenovirus B [HAdV-B]
caaguugaucaugcc

SEQ ID NO: 3907106 - RNA, 21 nt, Human adenovirus B [HAdV-B]
caaucaugcccacauccagau

SEQ ID NO: 3907107 - RNA, 16 nt, Human adenovirus B [HAdV-B]
caauccacacauuaca

SEQ ID NO: 3907108 - RNA, 13 nt, Human adenovirus B [HAdV-B]
caauguggcucua

SEQ ID NO: 3907109 - RNA, 17 nt, Human adenovirus B [HAdV-B]
caauguugccgcugccu

SEQ ID NO: 3907110 - RNA, 18 nt, Human adenovirus B [HAdV-B]
caauuaggaccagugcuu

SEQ ID NO: 3907111 - RNA, 18 nt, Human adenovirus B [HAdV-B]
cacaacaagugcagcaac

SEQ ID NO: 3907112 - RNA, 14 nt, Human adenovirus B [HAdV-B]
cacaacgcacagcc

SEQ ID NO: 3907113 - RNA, 17 nt, Human adenovirus B [HAdV-B]
cacacugguggccaccu

SEQ ID NO: 3907114 - RNA, 12 nt, Human adenovirus B [HAdV-B]
cacagacaccua

SEQ ID NO: 3907115 - RNA, 21 nt, Human adenovirus B [HAdV-B]
cacagcagcgggcgucauugu

SEQ ID NO: 3907116 - RNA, 18 nt, Human adenovirus B [HAdV-B]
cacagccaaucaccacac

SEQ ID NO: 3907117 - RNA, 23 nt, Human adenovirus B [HAdV-B]
cacagccccuacuauagccagca

SEQ ID NO: 3907118 - RNA, 20 nt, Human adenovirus B [HAdV-B]
cacaggcucccuguucccag

SEQ ID NO: 3907119 - RNA, 13 nt, Human adenovirus B [HAdV-B]
cacauacaagugc

SEQ ID NO: 3907120 - RNA, 18 nt, Human adenovirus B [HAdV-B]
cacaucacuuccaugccu

SEQ ID NO: 3907121 - RNA, 12 nt, Human adenovirus B [HAdV-B]
caccaaugcaaa

SEQ ID NO: 3907122 - RNA, 19 nt, Human adenovirus B [HAdV-B]
caccagggaaaaguacagu

SEQ ID NO: 3907123 - RNA, 15 nt, Human adenovirus B [HAdV-B]
caccccgaaacugcg

SEQ ID NO: 3907124 - RNA, 12 nt, Human adenovirus B [HAdV-B]
caccgacagcgg

SEQ ID NO: 3907125 - RNA, 19 nt, Human adenovirus B [HAdV-B]
caccucgcuuacgcacguc

SEQ ID NO: 3907126 - RNA, 14 nt, Human adenovirus B [HAdV-B]
caccugcggagcag

SEQ ID NO: 3907127 - RNA, 20 nt, Human adenovirus B [HAdV-B]
caccuuagaaaaugcaaauu

SEQ ID NO: 3907128 - RNA, 14 nt, Human adenovirus B [HAdV-B]
cacgcgcacaucca

SEQ ID NO: 3907129 - RNA, 15 nt, Human adenovirus B [HAdV-B]
cacgguggugcaaaa

SEQ ID NO: 3907130 - RNA, 18 nt, Human adenovirus B [HAdV-B]
cacugguuaccgaggaag

SEQ ID NO: 3907131 - RNA, 20 nt, Human adenovirus B [HAdV-B]
cacuuacuugaaaucagcaa

SEQ ID NO: 3907132 - RNA, 15 nt, Human adenovirus B [HAdV-B]
cagaaugaccacagc

SEQ ID NO: 3907133 - RNA, 15 nt, Human adenovirus B [HAdV-B]
cagaaugacccgcag

SEQ ID NO: 3907134 - RNA, 20 nt, Human adenovirus B [HAdV-B]
cagaccgucagccaugggca

SEQ ID NO: 3907135 - RNA, 17 nt, Human adenovirus B [HAdV-B]
cagaccucaucuuccca

SEQ ID NO: 3907136 - RNA, 19 nt, Human adenovirus B [HAdV-B]
cagaccucaucuucccaga

SEQ ID NO: 3907137 - RNA, 16 nt, Human adenovirus B [HAdV-B]
cagacgccgcaccugu

SEQ ID NO: 3907138 - RNA, 15 nt, Human adenovirus B [HAdV-B]
cagacuagcagacag

SEQ ID NO: 3907139 - RNA, 16 nt, Human adenovirus B [HAdV-B]
cagaggaacacauucc

SEQ ID NO: 3907140 - RNA, 18 nt, Human adenovirus B [HAdV-B]
cagauaaagacagcggcg

SEQ ID NO: 3907141 - RNA, 19 nt, Human adenovirus B [HAdV-B]
cagauauggcccucacuug

SEQ ID NO: 3907142 - RNA, 21 nt, Human adenovirus B [HAdV-B]
cagaugucaccugcggagcag

SEQ ID NO: 3907143 - RNA, 20 nt, Human adenovirus B [HAdV-B]
cagcacggugggaucugcaa

SEQ ID NO: 3907144 - RNA, 21 nt, Human adenovirus B [HAdV-B]
cagcacggugggaucugcaau

SEQ ID NO: 3907145 - RNA, 16 nt, Human adenovirus B [HAdV-B]
cagcagcccuucucua

SEQ ID NO: 3907146 - RNA, 17 nt, Human adenovirus B [HAdV-B]
cagcagcuccgccaguc

SEQ ID NO: 3907147 - RNA, 22 nt, Human adenovirus B [HAdV-B]
cagcagugucgcuaacaauaca

SEQ ID NO: 3907148 - RNA, 16 nt, Human adenovirus B [HAdV-B]
cagccaaacggcaccu

SEQ ID NO: 3907149 - RNA, 23 nt, Human adenovirus B [HAdV-B]
cagccaaggcgaugggucuucuc

SEQ ID NO: 3907150 - RNA, 18 nt, Human adenovirus B [HAdV-B]
cagccccccucgcagcag

SEQ ID NO: 3907151 - RNA, 15 nt, Human adenovirus B [HAdV-B]
cagccuccaaaggcc

SEQ ID NO: 3907152 - RNA, 14 nt, Human adenovirus B [HAdV-B]
cagcgcugccaggg

SEQ ID NO: 3907153 - RNA, 15 nt, Human adenovirus B [HAdV-B]
cagcuccgccagucc

SEQ ID NO: 3907154 - RNA, 18 nt, Human adenovirus B [HAdV-B]
cagcuccuuuagccagag

SEQ ID NO: 3907155 - RNA, 17 nt, Human adenovirus B [HAdV-B]
cagcuuuugcugugcca

SEQ ID NO: 3907156 - RNA, 14 nt, Human adenovirus B [HAdV-B]
caggaucacagaga

SEQ ID NO: 3907157 - RNA, 18 nt, Human adenovirus B [HAdV-B]
caggaugugagcuuccuu

SEQ ID NO: 3907158 - RNA, 19 nt, Human adenovirus B [HAdV-B]
gaagcaacgaagcuuggaa

SEQ ID NO: 3907159 - RNA, 22 nt, Human adenovirus B [HAdV-B]
gaagcuucuugcuucuugcaaa

SEQ ID NO: 3907160 - RNA, 13 nt, Human adenovirus B [HAdV-B]
gaagggguucauu

SEQ ID NO: 3907161 - RNA, 23 nt, Human adenovirus B [HAdV-B]
gaaguaggcugauugccacagau

SEQ ID NO: 3907162 - RNA, 17 nt, Human adenovirus B [HAdV-B]
gaaugaugaccaaagau

SEQ ID NO: 3907163 - RNA, 16 nt, Human adenovirus B [HAdV-B]
gaauguuuaugccuua

SEQ ID NO: 3907164 - RNA, 17 nt, Human adenovirus B [HAdV-B]
gacaaugaggcuuucag

SEQ ID NO: 3907165 - RNA, 14 nt, Human adenovirus B [HAdV-B]
gacagaaccagaua

SEQ ID NO: 3907166 - RNA, 15 nt, Human adenovirus B [HAdV-B]
gacagaauggagugc

SEQ ID NO: 3907167 - RNA, 15 nt, Human adenovirus B [HAdV-B]
gacagggaacugaug

SEQ ID NO: 3907168 - RNA, 13 nt, Human adenovirus B [HAdV-B]
gacagucaggcag

SEQ ID NO: 3907169 - RNA, 15 nt, Human adenovirus B [HAdV-B]
gacaguuuggaggag

SEQ ID NO: 3907170 - RNA, 18 nt, Human adenovirus B [HAdV-B]
gacauacucgcgugccag

SEQ ID NO: 3907171 - RNA, 19 nt, Human adenovirus B [HAdV-B]
gacaucuagaccacugccg

SEQ ID NO: 3907172 - RNA, 17 nt, Human adenovirus B [HAdV-B]
gacauuggaaaaaaacg

SEQ ID NO: 3907173 - RNA, 24 nt, Human adenovirus B [HAdV-B]
gaccccacacggcgacagguguuu

SEQ ID NO: 3907174 - RNA, 16 nt, Human adenovirus B [HAdV-B]
gacccgccgccagcaa

SEQ ID NO: 3907175 - RNA, 16 nt, Human adenovirus B [HAdV-B]
gacgauuggacccagg

SEQ ID NO: 3907176 - RNA, 15 nt, Human adenovirus B [HAdV-B]
gacggcggugaugca

SEQ ID NO: 3907177 - RNA, 12 nt, Human adenovirus B [HAdV-B]
gacggcuugcug

SEQ ID NO: 3907178 - RNA, 16 nt, Human adenovirus B [HAdV-B]
gacguaagagccggcg

SEQ ID NO: 3907179 - RNA, 22 nt, Human adenovirus B [HAdV-B]
gacuauaaacaagaauuugaaa

SEQ ID NO: 3907180 - RNA, 14 nt, Human adenovirus B [HAdV-B]
gacucuuaaagagu

SEQ ID NO: 3907181 - RNA, 14 nt, Human adenovirus B [HAdV-B]
gacugaaaaccaaa

SEQ ID NO: 3907182 - RNA, 16 nt, Human adenovirus B [HAdV-B]
gacuugcaggacagaa

SEQ ID NO: 3907183 - RNA, 23 nt, Human adenovirus B [HAdV-B]
gacuuuaccccuacggaagccag

SEQ ID NO: 3907184 - RNA, 14 nt, Human adenovirus B [HAdV-B]
gagaaaaugaaagc

SEQ ID NO: 3907185 - RNA, 15 nt, Human adenovirus B [HAdV-B]
gagaauggcaacauc

SEQ ID NO: 3907186 - RNA, 14 nt, Human adenovirus B [HAdV-B]
gagacgagccuggg

SEQ ID NO: 3907187 - RNA, 13 nt, Human adenovirus B [HAdV-B]
gagaggaugaaaa

SEQ ID NO: 3907188 - RNA, 21 nt, Human adenovirus B [HAdV-B]
gagcccagcauguaugccagu

SEQ ID NO: 3907189 - RNA, 18 nt, Human adenovirus B [HAdV-B]
gagcccgagucugcaagu

SEQ ID NO: 3907190 - RNA, 11 nt, Human adenovirus B [HAdV-B]
gagcgaagugu

SEQ ID NO: 3907191 - RNA, 17 nt, Human adenovirus B [HAdV-B]
gagcgccgcgacggcag

SEQ ID NO: 3907192 - RNA, 17 nt, Human adenovirus B [HAdV-B]
gagcgugaugcagcagc

SEQ ID NO: 3907193 - RNA, 21 nt, Human adenovirus B [HAdV-B]
gagcuuaagcauuccaccgcc

SEQ ID NO: 3907194 - RNA, 16 nt, Human adenovirus B [HAdV-B]
gaggcgcugcugaaca

SEQ ID NO: 3907195 - RNA, 17 nt, Human adenovirus B [HAdV-B]
gaggcuuucagagaggc

SEQ ID NO: 3907196 - RNA, 19 nt, Human adenovirus B [HAdV-B]
gagggcgaaggacuggcac

SEQ ID NO: 3907197 - RNA, 15 nt, Human adenovirus B [HAdV-B]
gaguacuuggaagac

SEQ ID NO: 3907198 - RNA, 14 nt, Human adenovirus B [HAdV-B]
gaguagauggaaga

SEQ ID NO: 3907199 - RNA, 15 nt, Human adenovirus B [HAdV-B]
gagucugagacagac

SEQ ID NO: 3907200 - RNA, 12 nt, Human adenovirus B [HAdV-B]
gaguuaaaucau

SEQ ID NO: 3907201 - RNA, 17 nt, Human adenovirus B [HAdV-B]
gaguuaagcgacaggga

SEQ ID NO: 3907202 - RNA, 11 nt, Human adenovirus B [HAdV-B]
gaguuggaagu

SEQ ID NO: 3907203 - RNA, 21 nt, Human adenovirus B [HAdV-B]
gauacuuaugaucacaagcag

SEQ ID NO: 3907204 - RNA, 18 nt, Human adenovirus B [HAdV-B]
gauaugugcagcagagcg

SEQ ID NO: 3907205 - RNA, 22 nt, Human adenovirus B [HAdV-B]
gauauucuugagcaggcggcug

SEQ ID NO: 3907206 - RNA, 21 nt, Human adenovirus B [HAdV-B]
gaucaguaucaucuuggccug

SEQ ID NO: 3907207 - RNA, 15 nt, Human adenovirus B [HAdV-B]
gaucccauggaugag

SEQ ID NO: 3907208 - RNA, 17 nt, Human adenovirus B [HAdV-B]
gaucuaccgccagugcu

SEQ ID NO: 3907209 - RNA, 14 nt, Human adenovirus B [HAdV-B]
gaucuccuacuaag

SEQ ID NO: 3907210 - RNA, 19 nt, Human adenovirus B [HAdV-B]
gaugcagcagcagcaggcg

SEQ ID NO: 3907211 - RNA, 23 nt, Human adenovirus B [HAdV-B]
gaugcuggaaauagggaucagaa

SEQ ID NO: 3907212 - RNA, 18 nt, Human adenovirus B [HAdV-B]
gaugguuauaauggaaua

SEQ ID NO: 3907213 - RNA, 15 nt, Human adenovirus B [HAdV-B]
gauuaugcaagguaa

SEQ ID NO: 3907214 - RNA, 16 nt, Human adenovirus B [HAdV-B]
gauucucacuugccac

SEQ ID NO: 3907215 - RNA, 13 nt, Human adenovirus B [HAdV-B]
gauugcagcacug

SEQ ID NO: 3907216 - RNA, 20 nt, Human adenovirus B [HAdV-B]
gauugggacagucaggcaga

SEQ ID NO: 3907217 - RNA, 22 nt, Human adenovirus B [HAdV-B]
gauuuccuucgcggcuggccau

SEQ ID NO: 3907218 - RNA, 13 nt, Human adenovirus B [HAdV-B]
gcaaaaacaagau

SEQ ID NO: 3907219 - RNA, 16 nt, Human adenovirus B [HAdV-B]
gcaaacucgaagagaa

SEQ ID NO: 3907220 - RNA, 22 nt, Human adenovirus B [HAdV-B]
gcaaagauucgauccgaugaca

SEQ ID NO: 3907221 - RNA, 22 nt, Human adenovirus B [HAdV-B]
gcaacucugacuucugcucgcu

SEQ ID NO: 3907222 - RNA, 14 nt, Human adenovirus B [HAdV-B]
gcaagaugaggaca

SEQ ID NO: 3907223 - RNA, 16 nt, Human adenovirus B [HAdV-B]
gcaaggccccagcagc

SEQ ID NO: 3907224 - RNA, 22 nt, Human adenovirus B [HAdV-B]
gcaagguaauuaaauccacacu

SEQ ID NO: 3907225 - RNA, 15 nt, Human adenovirus B [HAdV-B]
gcaagucuguugaug

SEQ ID NO: 3907226 - RNA, 16 nt, Human adenovirus B [HAdV-B]
gcaauccccacuggag

SEQ ID NO: 3907227 - RNA, 21 nt, Human adenovirus B [HAdV-B]
gcaaugcgggcggcgcugcag

SEQ ID NO: 3907228 - RNA, 18 nt, Human adenovirus B [HAdV-B]
gcacaagcucuaaaguga

SEQ ID NO: 3907229 - RNA, 18 nt, Human adenovirus B [HAdV-B]
gcaccacacuucugcccc

SEQ ID NO: 3907230 - RNA, 16 nt, Human adenovirus B [HAdV-B]
gcaccgacucucccag

SEQ ID NO: 3907231 - RNA, 19 nt, Human adenovirus B [HAdV-B]
gcaccuuugaauugcaagg

SEQ ID NO: 3907232 - RNA, 22 nt, Human adenovirus B [HAdV-B]
gcacugggcauagucgcaccgc

SEQ ID NO: 3907233 - RNA, 13 nt, Human adenovirus B [HAdV-B]
gcacuuuuugcuu

SEQ ID NO: 3907234 - RNA, 16 nt, Human adenovirus B [HAdV-B]
gcagaaaucuucccau

SEQ ID NO: 3907235 - RNA, 16 nt, Human adenovirus B [HAdV-B]
gcagaagcuaaggcaa

SEQ ID NO: 3907236 - RNA, 14 nt, Human adenovirus B [HAdV-B]
gcagacacaucacu

SEQ ID NO: 3907237 - RNA, 20 nt, Human adenovirus B [HAdV-B]
gcagcacuggacaugacagc

SEQ ID NO: 3907238 - RNA, 21 nt, Human adenovirus B [HAdV-B]
gcagcagcaaucacaaaaggc

SEQ ID NO: 3907239 - RNA, 14 nt, Human adenovirus B [HAdV-B]
gcagggcucugagc

SEQ ID NO: 3907240 - RNA, 14 nt, Human adenovirus B [HAdV-B]
gcaguacaggacag

SEQ ID NO: 3907241 - RNA, 19 nt, Human adenovirus B [HAdV-B]
gcauccgccagcagcagga

SEQ ID NO: 3907242 - RNA, 20 nt, Human adenovirus B [HAdV-B]
gcaugaauuggcucagcgcc

SEQ ID NO: 3907243 - RNA, 19 nt, Human adenovirus B [HAdV-B]
gcaugauggauauguggcc

SEQ ID NO: 3907244 - RNA, 16 nt, Human adenovirus B [HAdV-B]
gcauuaguaacaacac

SEQ ID NO: 3907245 - RNA, 16 nt, Human adenovirus B [HAdV-B]
gccaaggcgauggguc

SEQ ID NO: 3907246 - RNA, 22 nt, Human adenovirus B [HAdV-B]
gccagcgccaugacagacagag

SEQ ID NO: 3907247 - RNA, 15 nt, Human adenovirus B [HAdV-B]
gccagcgguucugga

SEQ ID NO: 3907248 - RNA, 20 nt, Human adenovirus B [HAdV-B]
gccauacccuaccaacacaa

SEQ ID NO: 3907249 - RNA, 18 nt, Human adenovirus B [HAdV-B]
gccaugcuuagggcggcc

SEQ ID NO: 3907250 - RNA, 13 nt, Human adenovirus B [HAdV-B]
gccauugcuguca

SEQ ID NO: 3907251 - RNA, 18 nt, Human adenovirus B [HAdV-B]
gccauugcugucaacauc

SEQ ID NO: 3907252 - RNA, 20 nt, Human adenovirus B [HAdV-B]
gcccaaucgcgaagaggcaa

SEQ ID NO: 3907253 - RNA, 23 nt, Human adenovirus B [HAdV-B]
gcccaaugcaacaugaccaaaga

SEQ ID NO: 3907254 - RNA, 16 nt, Human adenovirus B [HAdV-B]
gcccaguccugccacc

SEQ ID NO: 3907255 - RNA, 21 nt, Human adenovirus B [HAdV-B]
gcccgucuucucaaagagcuu

SEQ ID NO: 3907256 - RNA, 18 nt, Human adenovirus B [HAdV-B]
gccgcuaugaacucugau

SEQ ID NO: 3907257 - RNA, 11 nt, Human adenovirus B [HAdV-B]
gccggaggaga

SEQ ID NO: 3907258 - RNA, 18 nt, Human adenovirus B [HAdV-B]
gccuacaucuacugugga

SEQ ID NO: 3907259 - RNA, 19 nt, Human adenovirus B [HAdV-B]
gccuggacccuccagugga

SEQ ID NO: 3907260 - RNA, 14 nt, Human adenovirus B [HAdV-B]
gccuggcugcggag

SEQ ID NO: 3907261 - RNA, 17 nt, Human adenovirus B [HAdV-B]
gugaacgcguuggugga

SEQ ID NO: 3907262 - RNA, 17 nt, Human adenovirus B [HAdV-B]
gugagcuggccuggaaa

SEQ ID NO: 3907263 - RNA, 20 nt, Human adenovirus B [HAdV-B]
gugaugcagcagcagcaggc

SEQ ID NO: 3907264 - RNA, 18 nt, Human adenovirus B [HAdV-B]
gugcgccugcuugggcgc

SEQ ID NO: 3907265 - RNA, 13 nt, Human adenovirus B [HAdV-B]
gugcggcaggcau

SEQ ID NO: 3907266 - RNA, 18 nt, Human adenovirus B [HAdV-B]
gugcugcacagcacccug

SEQ ID NO: 3907267 - RNA, 15 nt, Human adenovirus B [HAdV-B]
guggugggugcagag

SEQ ID NO: 3907268 - RNA, 21 nt, Human adenovirus B [HAdV-B]
gugucuaucuguaccugugcc

SEQ ID NO: 3907269 - RNA, 22 nt, Human adenovirus B [HAdV-B]
gugucuaucuguaccugugcca

SEQ ID NO: 3907270 - RNA, 18 nt, Human adenovirus B [HAdV-B]
guguggaagagcucagcc

SEQ ID NO: 3907271 - RNA, 13 nt, Human adenovirus B [HAdV-B]
guuaaaucaucau

SEQ ID NO: 3907272 - RNA, 14 nt, Human adenovirus B [HAdV-B]
guuaacuguucacu

SEQ ID NO: 3907273 - RNA, 21 nt, Human adenovirus B [HAdV-B]
guuaaguucgacaccaggaac

SEQ ID NO: 3907274 - RNA, 14 nt, Human adenovirus B [HAdV-B]
guuccgucuggcca

SEQ ID NO: 3907275 - RNA, 18 nt, Human adenovirus B [HAdV-B]
guugaucaccugggcagc

SEQ ID NO: 3907276 - RNA, 19 nt, Human adenovirus B [HAdV-B]
guuuaugccuuaccagugu

SEQ ID NO: 3907277 - RNA, 21 nt, Human adenovirus B [HAdV-B]
guuucacuuccgcaaucccaa

SEQ ID NO: 3907278 - RNA, 18 nt, Human adenovirus B [HAdV-B]
guuucuguauugcaggag

SEQ ID NO: 3907279 - RNA, 13 nt, Human adenovirus B [HAdV-B]
guuuggaggagga

SEQ ID NO: 3907280 - RNA, 18 nt, Human adenovirus B [HAdV-B]
guuugggccauuuuggaa

SEQ ID NO: 3907281 - RNA, 20 nt, Human adenovirus B [HAdV-B]
guuugggccauuuuggaaga

SEQ ID NO: 3907282 - RNA, 22 nt, Human adenovirus B [HAdV-B]
guuugugcgcgaguuugcccca

SEQ ID NO: 3907283 - RNA, 13 nt, Human adenovirus B [HAdV-B]
uaaacaacagcac

SEQ ID NO: 3907284 - RNA, 13 nt, Human adenovirus B [HAdV-B]
uaaacaagaauuu

SEQ ID NO: 3907285 - RNA, 16 nt, Human adenovirus B [HAdV-B]
uaaaccauaauuaaaa

SEQ ID NO: 3907286 - RNA, 15 nt, Human adenovirus B [HAdV-B]
uaaacgcgaagguga

SEQ ID NO: 3907287 - RNA, 13 nt, Human adenovirus B [HAdV-B]
uaaagcuggcaga

SEQ ID NO: 3907288 - RNA, 17 nt, Human adenovirus B [HAdV-B]
uaacgcuggagagguca

SEQ ID NO: 3907289 - RNA, 23 nt, Human adenovirus B [HAdV-B]
uaaguuuaggggagaugguuaua

SEQ ID NO: 3907290 - RNA, 19 nt, Human adenovirus B [HAdV-B]
uaauggaauaguguuuaug

SEQ ID NO: 3907291 - RNA, 18 nt, Human adenovirus B [HAdV-B]
uacacaacaagugcagca

SEQ ID NO: 3907292 - RNA, 18 nt, Human adenovirus B [HAdV-B]
uaccagacaaaguacagc

SEQ ID NO: 3907293 - RNA, 18 nt, Human adenovirus B [HAdV-B]
uacccaguugaaaaccac

SEQ ID NO: 3907294 - RNA, 23 nt, Human adenovirus B [HAdV-B]
uacccuguggugggugcagagcu

SEQ ID NO: 3907295 - RNA, 19 nt, Human adenovirus B [HAdV-B]
uacccuugguuugaugcau

SEQ ID NO: 3907296 - RNA, 20 nt, Human adenovirus B [HAdV-B]
uacuaaggguugcauucacu

SEQ ID NO: 3907297 - RNA, 22 nt, Human adenovirus B [HAdV-B]
uacuggaucuacguccacugga

SEQ ID NO: 3907298 - RNA, 15 nt, Human adenovirus B [HAdV-B]
uacuggauguuuuau

SEQ ID NO: 3907299 - RNA, 20 nt, Human adenovirus B [HAdV-B]
uacuucuccaucagcagaca

SEQ ID NO: 3907300 - RNA, 19 nt, Human adenovirus B [HAdV-B]
uacuugcuauuccaccaug

SEQ ID NO: 3907301 - RNA, 16 nt, Human adenovirus B [HAdV-B]
uacuuggaagacugau

SEQ ID NO: 3907302 - RNA, 17 nt, Human adenovirus B [HAdV-B]
uacuuucucuagcagca

SEQ ID NO: 3907303 - RNA, 18 nt, Human adenovirus B [HAdV-B]
uagauugcccaggacuuu

SEQ ID NO: 3907304 - RNA, 19 nt, Human adenovirus B [HAdV-B]
uagcugaaacccacugcua

SEQ ID NO: 3907305 - RNA, 15 nt, Human adenovirus B [HAdV-B]
uauaauucuaugaaa

SEQ ID NO: 3907306 - RNA, 16 nt, Human adenovirus B [HAdV-B]
uauggagucacugcua

SEQ ID NO: 3907307 - RNA, 21 nt, Human adenovirus B [HAdV-B]
uauucuucgcgauccuuccag

SEQ ID NO: 3907308 - RNA, 13 nt, Human adenovirus B [HAdV-B]
uauugcuuuuugg

SEQ ID NO: 3907309 - RNA, 21 nt, Human adenovirus B [HAdV-B]
ucaaaacuccacuuaaucaua

SEQ ID NO: 3907310 - RNA, 13 nt, Human adenovirus B [HAdV-B]
ucaauaaacauca

SEQ ID NO: 3907311 - RNA, 20 nt, Human adenovirus B [HAdV-B]
ucaccagggaaaaguacagu

SEQ ID NO: 3907312 - RNA, 19 nt, Human adenovirus B [HAdV-B]
ucaccugcggagcagagca

SEQ ID NO: 3907313 - RNA, 14 nt, Human adenovirus B [HAdV-B]
ucacugguuuuuau

SEQ ID NO: 3907314 - RNA, 12 nt, Human adenovirus B [HAdV-B]
ucagaacaccga

SEQ ID NO: 3907315 - RNA, 17 nt, Human adenovirus B [HAdV-B]
ucagaccggcaagagaa

SEQ ID NO: 3907316 - RNA, 17 nt, Human adenovirus B [HAdV-B]
ucaggagccgaaaucuu

SEQ ID NO: 3907317 - RNA, 14 nt, Human adenovirus B [HAdV-B]
ucaggaugucccaa

SEQ ID NO: 3907318 - RNA, 17 nt, Human adenovirus B [HAdV-B]
ucaucgggagggucugc

SEQ ID NO: 3907319 - RNA, 17 nt, Human adenovirus B [HAdV-B]
ucaugauuaaacaacag

SEQ ID NO: 3907320 - RNA, 15 nt, Human adenovirus B [HAdV-B]
ucaugcauacuaaca

SEQ ID NO: 3907321 - RNA, 20 nt, Human adenovirus B [HAdV-B]
uccaaugucacucuuccaga

SEQ ID NO: 3907322 - RNA, 20 nt, Human adenovirus B [HAdV-B]
uccacacugguggccaccuc

SEQ ID NO: 3907323 - RNA, 21 nt, Human adenovirus B [HAdV-B]
uccaccgcccaguccugccac

SEQ ID NO: 3907324 - RNA, 19 nt, Human adenovirus B [HAdV-B]
uccagacaugaugaaggau

SEQ ID NO: 3907325 - RNA, 15 nt, Human adenovirus B [HAdV-B]
uccagaugaggccgg

SEQ ID NO: 3907326 - RNA, 15 nt, Human adenovirus B [HAdV-B]
uccagguguaaguuu

SEQ ID NO: 3907327 - RNA, 15 nt, Human adenovirus B [HAdV-B]
uccaguacucuucua

SEQ ID NO: 3907328 - RNA, 21 nt, Human adenovirus B [HAdV-B]
uccaucagcagacacaucacu

SEQ ID NO: 3907329 - RNA, 18 nt, Human adenovirus B [HAdV-B]
ucccaguagguuuggaag

SEQ ID NO: 3907330 - RNA, 12 nt, Human adenovirus B [HAdV-B]
ucccaguuucaa

SEQ ID NO: 3907331 - RNA, 13 nt, Human adenovirus B [HAdV-B]
uccccuacaaaac

SEQ ID NO: 3907332 - RNA, 17 nt, Human adenovirus B [HAdV-B]
ucccgcaggaccugcuc

SEQ ID NO: 3907333 - RNA, 18 nt, Human adenovirus B [HAdV-B]
uccggaucuccugggcau

SEQ ID NO: 3907334 - RNA, 14 nt, Human adenovirus B [HAdV-B]
uccuaaaaaacaag

SEQ ID NO: 3907335 - RNA, 23 nt, Human adenovirus B [HAdV-B]
uccuacauggguauucugcauga

SEQ ID NO: 3907336 - RNA, 21 nt, Human adenovirus B [HAdV-B]
uccuaccacucggaugugauc

SEQ ID NO: 3907337 - RNA, 14 nt, Human adenovirus B [HAdV-B]
uccuaugcacuuuu

SEQ ID NO: 3907338 - RNA, 21 nt, Human adenovirus B [HAdV-B]
uccuuaaacaucuagcaagac

SEQ ID NO: 3907339 - RNA, 21 nt, Human adenovirus B [HAdV-B]
ucgaagcaagggggccaccuc

SEQ ID NO: 3907340 - RNA, 19 nt, Human adenovirus B [HAdV-B]
ucgaguuuacuuugccaga

SEQ ID NO: 3907341 - RNA, 19 nt, Human adenovirus B [HAdV-B]
ucgaugcugccccaauggg

SEQ ID NO: 3907342 - RNA, 13 nt, Human adenovirus B [HAdV-B]
ucgcaaccccgcu

SEQ ID NO: 3907343 - RNA, 17 nt, Human adenovirus B [HAdV-B]
ucgcuacaaaaaguuuc

SEQ ID NO: 3907344 - RNA, 19 nt, Human adenovirus B [HAdV-B]
ucggcuuacgagcagacag

SEQ ID NO: 3907345 - RNA, 23 nt, Human adenovirus B [HAdV-B]
ucuacggccaaccguugaaggau

SEQ ID NO: 3907346 - RNA, 22 nt, Human adenovirus B [HAdV-B]
ucuacuggucgcuuccagacau

SEQ ID NO: 3907347 - RNA, 16 nt, Human adenovirus B [HAdV-B]
ucucaacgaugcgcac

SEQ ID NO: 3907348 - RNA, 15 nt, Human adenovirus B [HAdV-B]
ucucacuugccaccc

SEQ ID NO: 3907349 - RNA, 18 nt, Human adenovirus B [HAdV-B]
ucuccaaccucuccacaa

SEQ ID NO: 3907350 - RNA, 14 nt, Human adenovirus B [HAdV-B]
ucuccuaggcagag

SEQ ID NO: 3907351 - RNA, 23 nt, Human adenovirus B [HAdV-B]
ucuuaacagugcaggcagcagcu

SEQ ID NO: 3907352 - RNA, 21 nt, Human adenovirus B [HAdV-B]
ucuuaccuuuggucuccauga

SEQ ID NO: 3907353 - RNA, 22 nt, Human adenovirus B [HAdV-B]
ucuuagacucaucuaaaaccau

SEQ ID NO: 3907354 - RNA, 18 nt, Human adenovirus B [HAdV-B]
ucuucccagagcgucuca

SEQ ID NO: 3907355 - RNA, 11 nt, Human adenovirus B [HAdV-B]
ucuuccuucac

SEQ ID NO: 3907356 - RNA, 22 nt, Human adenovirus B [HAdV-B]
ucuugaccacgguggugcaaaa

SEQ ID NO: 3907357 - RNA, 15 nt, Human adenovirus B [HAdV-B]
ugaaaccuucucagu

SEQ ID NO: 3907358 - RNA, 13 nt, Human adenovirus B [HAdV-B]
ugaaagaaaacau

SEQ ID NO: 3907359 - RNA, 21 nt, Human adenovirus B [HAdV-B]
ugaacggggucaucuugcagg

SEQ ID NO: 3907360 - RNA, 13 nt, Human adenovirus B [HAdV-B]
ugaaggugcagcc

SEQ ID NO: 3907361 - RNA, 12 nt, Human adenovirus B [HAdV-B]
ugaauguuccuu

SEQ ID NO: 3907362 - RNA, 16 nt, Human adenovirus B [HAdV-B]
ugaauuaagacucucc

SEQ ID NO: 3907363 - RNA, 19 nt, Human adenovirus C
ccuccaccggccguggaga

SEQ ID NO: 3907364 - RNA, 13 nt, Human adenovirus C
ccucccggccacu

SEQ ID NO: 3907365 - RNA, 13 nt, Human adenovirus C
ccuccgcaccacu

SEQ ID NO: 3907366 - RNA, 12 nt, Human adenovirus C
ccuccgcccugc

SEQ ID NO: 3907367 - RNA, 15 nt, Human adenovirus C
ccuccgggcacagca

SEQ ID NO: 3907368 - RNA, 19 nt, Human adenovirus C
ccuccucagcagcggcaag

SEQ ID NO: 3907369 - RNA, 13 nt, Human adenovirus C
ccuccuccagaag

SEQ ID NO: 3907370 - RNA, 16 nt, Human adenovirus C
ccuccugccaggcuca

SEQ ID NO: 3907371 - RNA, 17 nt, Human adenovirus C
ccuccuuauuccacuga

SEQ ID NO: 3907372 - RNA, 15 nt, Human adenovirus C
ccucgaacaggcggc

SEQ ID NO: 3907373 - RNA, 16 nt, Human adenovirus C
ccucgccggcgcccca

SEQ ID NO: 3907374 - RNA, 22 nt, Human adenovirus C
ccucgcucgacgaagugccaaa

SEQ ID NO: 3907375 - RNA, 21 nt, Human adenovirus C
ccucguaggugagcuccucag

SEQ ID NO: 3907376 - RNA, 15 nt, Human adenovirus C
ccucuuguccugcau

SEQ ID NO: 3907377 - RNA, 17 nt, Human adenovirus C
ccucuuguccugcaucu

SEQ ID NO: 3907378 - RNA, 19 nt, Human adenovirus C
ccugagcaggggggccacu

SEQ ID NO: 3907379 - RNA, 15 nt, Human adenovirus C
ccugauuuccagggg

SEQ ID NO: 3907380 - RNA, 19 nt, Human adenovirus C
ccugcaaagggcccuggcu

SEQ ID NO: 3907381 - RNA, 23 nt, Human adenovirus C
ccugcgcgagauugagcuccacg

SEQ ID NO: 3907382 - RNA, 19 nt, Human adenovirus C
ccugcgcggccuuccggag

SEQ ID NO: 3907383 - RNA, 14 nt, Human adenovirus C
ccugcgcugggccc

SEQ ID NO: 3907384 - RNA, 20 nt, Human adenovirus C
ccugcugaaugcgcaggcgg

SEQ ID NO: 3907385 - RNA, 13 nt, Human adenovirus C
ccugcugcacgca

SEQ ID NO: 3907386 - RNA, 16 nt, Human adenovirus C
ccuggacccucgggaa

SEQ ID NO: 3907387 - RNA, 13 nt, Human adenovirus C
ccuggaggagcgc

SEQ ID NO: 3907388 - RNA, 13 nt, Human adenovirus C
ccuggccucuggc

SEQ ID NO: 3907389 - RNA, 20 nt, Human adenovirus C
ccuggcgcggcuaggagcgc

SEQ ID NO: 3907390 - RNA, 23 nt, Human adenovirus C
ccuggcggacauuaucuuccccg

SEQ ID NO: 3907391 - RNA, 16 nt, Human adenovirus C
ccugggcggcgagcac

SEQ ID NO: 3907392 - RNA, 23 nt, Human adenovirus C
ccugguaaccgcguacgagcaga

SEQ ID NO: 3907393 - RNA, 12 nt, Human adenovirus C
ccuggugcugcc

SEQ ID NO: 3907394 - RNA, 16 nt, Human adenovirus C
ccuguaacgcuggacc

SEQ ID NO: 3907395 - RNA, 14 nt, Human adenovirus C
ccugugcugccagg

SEQ ID NO: 3907396 - RNA, 17 nt, Human adenovirus C
ccuuaguaugcagcgcg

SEQ ID NO: 3907397 - RNA, 12 nt, Human adenovirus C
ccuuccaggcgc

SEQ ID NO: 3907398 - RNA, 16 nt, Human adenovirus C
ccuuccaggcgcggcg

SEQ ID NO: 3907399 - RNA, 14 nt, Human adenovirus C
ccuucccaaaaagg

SEQ ID NO: 3907400 - RNA, 23 nt, Human adenovirus C
ccuuccgcuccacgagccagauc

SEQ ID NO: 3907401 - RNA, 14 nt, Human adenovirus C
ccuucggcaucgcg

SEQ ID NO: 3907402 - RNA, 19 nt, Human adenovirus C
ccuugagcgacgaccuggg

SEQ ID NO: 3907403 - RNA, 13 nt, Human adenovirus C
ccuugauuuuccg

SEQ ID NO: 3907404 - RNA, 15 nt, Human adenovirus C
ccuugcggcagggcg

SEQ ID NO: 3907405 - RNA, 16 nt, Human adenovirus C
ccuugcuucccaggau

SEQ ID NO: 3907406 - RNA, 14 nt, Human adenovirus C
ccuuuccgccgcca

SEQ ID NO: 3907407 - RNA, 14 nt, Human adenovirus C
ccuuugccuggaac

SEQ ID NO: 3907408 - RNA, 12 nt, Human adenovirus C
ccuuuugguggu

SEQ ID NO: 3907409 - RNA, 22 nt, Human adenovirus C
cgaaccuuuggacaccucccac

SEQ ID NO: 3907410 - RNA, 12 nt, Human adenovirus C
cgaagaaaagcg

SEQ ID NO: 3907411 - RNA, 22 nt, Human adenovirus C
cgaagccuuccauccagacauc

SEQ ID NO: 3907412 - RNA, 14 nt, Human adenovirus C
cgaaugagcuccac

SEQ ID NO: 3907413 - RNA, 17 nt, Human adenovirus C
cgacagggaagaaacuc

SEQ ID NO: 3907414 - RNA, 13 nt, Human adenovirus C
cgaccacagcaac

SEQ ID NO: 3907415 - RNA, 15 nt, Human adenovirus C
cgacccggcacugcc

SEQ ID NO: 3907416 - RNA, 19 nt, Human adenovirus C
cgacccggcacugccgccc

SEQ ID NO: 3907417 - RNA, 19 nt, Human adenovirus C
cgaccgggguucgaacccc

SEQ ID NO: 3907418 - RNA, 21 nt, Human adenovirus C
cgacgagcggccgccgcagca

SEQ ID NO: 3907419 - RNA, 19 nt, Human adenovirus C
cgacgccgaaccaccacug

SEQ ID NO: 3907420 - RNA, 20 nt, Human adenovirus C
cgacugaaugaccaguggag

SEQ ID NO: 3907421 - RNA, 14 nt, Human adenovirus C
cgacuuaccgcagc

SEQ ID NO: 3907422 - RNA, 19 nt, Human adenovirus C
cgagaaggaggacagccua

SEQ ID NO: 3907423 - RNA, 20 nt, Human adenovirus C
cgagaccguguaccugcgca

SEQ ID NO: 3907424 - RNA, 21 nt, Human adenovirus C
cgagaccgugucuggaacgcc

SEQ ID NO: 3907425 - RNA, 22 nt, Human adenovirus C
cgagagcguggugagcgcggcg

SEQ ID NO: 3907426 - RNA, 19 nt, Human adenovirus C
cgagauuagguucuacgaa

SEQ ID NO: 3907427 - RNA, 13 nt, Human adenovirus C
cgagcaggcagag

SEQ ID NO: 3907428 - RNA, 20 nt, Human adenovirus C
cgagcgcauccacaaggccg

SEQ ID NO: 3907429 - RNA, 17 nt, Human adenovirus C
cgagcugcuucccaaag

SEQ ID NO: 3907430 - RNA, 17 nt, Human adenovirus C
cgagggccgcuggcugc

SEQ ID NO: 3907431 - RNA, 23 nt, Human adenovirus C
cgaggucguuggagaugcgggcc

SEQ ID NO: 3907432 - RNA, 17 nt, Human adenovirus C
cgagucucgggccggcc

SEQ ID NO: 3907433 - RNA, 21 nt, Human adenovirus C
cgagugguggcucccgggcuu

SEQ ID NO: 3907434 - RNA, 12 nt, Human adenovirus C
cgaucgcacccu

SEQ ID NO: 3907435 - RNA, 15 nt, Human adenovirus C
cgaucucuuccuccu

SEQ ID NO: 3907436 - RNA, 16 nt, Human adenovirus C
cgaucuuggccuugcu

SEQ ID NO: 3907437 - RNA, 14 nt, Human adenovirus C
cgaugagcagcugg

SEQ ID NO: 3907438 - RNA, 18 nt, Human adenovirus C
cgaugccgccaacgcgcc

SEQ ID NO: 3907439 - RNA, 19 nt, Human adenovirus C
cgauggauuccucugggac

SEQ ID NO: 3907440 - RNA, 16 nt, Human adenovirus C
cgauguuuagcugcac

SEQ ID NO: 3907441 - RNA, 14 nt, Human adenovirus C
cgcaacaccacugc

SEQ ID NO: 3907442 - RNA, 15 nt, Human adenovirus C
cgcaaccgcagaccc

SEQ ID NO: 3907443 - RNA, 13 nt, Human adenovirus C
cgcaacugggcag

SEQ ID NO: 3907444 - RNA, 22 nt, Human adenovirus C
cgcaauggccaaauccgccguc

SEQ ID NO: 3907445 - RNA, 15 nt, Human adenovirus C
cgcacccgccccccg

SEQ ID NO: 3907446 - RNA, 23 nt, Human adenovirus C
cgcaccuucgccccaggcugggg

SEQ ID NO: 3907447 - RNA, 16 nt, Human adenovirus C
cgcacgaaggaggcgu

SEQ ID NO: 3907448 - RNA, 19 nt, Human adenovirus C
cgcacggcguccggcucac

SEQ ID NO: 3907449 - RNA, 14 nt, Human adenovirus C
cgcagcagcagggc

SEQ ID NO: 3907450 - RNA, 22 nt, Human adenovirus C
cgcagcgaugugccccucgcca

SEQ ID NO: 3907451 - RNA, 16 nt, Human adenovirus C
cgcagcggugcagcca

SEQ ID NO: 3907452 - RNA, 15 nt, Human adenovirus C
cgcaguacuggcagc

SEQ ID NO: 3907453 - RNA, 21 nt, Human adenovirus C
cgcaguggucuuacaugcaca

SEQ ID NO: 3907454 - RNA, 16 nt, Human adenovirus C
cgcauccacaaggccg

SEQ ID NO: 3907455 - RNA, 21 nt, Human adenovirus C
cgcauuccacgagccagguga

SEQ ID NO: 3907456 - RNA, 20 nt, Human adenovirus C
cgccaccuguucucaccgcg

SEQ ID NO: 3907457 - RNA, 15 nt, Human adenovirus C
cgccagaccccccau

SEQ ID NO: 3907458 - RNA, 13 nt, Human adenovirus C
cgccagcccccac

SEQ ID NO: 3907459 - RNA, 20 nt, Human adenovirus C
cgccaucaucucugucaugg

SEQ ID NO: 3907460 - RNA, 21 nt, Human adenovirus C
cgcccagcguggcgcuggaca

SEQ ID NO: 3907461 - RNA, 22 nt, Human adenovirus C
cgcccaggcggcggguacagug

SEQ ID NO: 3907462 - RNA, 12 nt, Human adenovirus C
cgcccgcgccgu

SEQ ID NO: 3907463 - RNA, 22 nt, Human adenovirus C
cgcccucccguagaggagccuc

SEQ ID NO: 3907464 - RNA, 15 nt, Human adenovirus C
cgcccuggaggcagc

SEQ ID NO: 3907465 - RNA, 16 nt, Human adenovirus C
cgccgacccggcacug

SEQ ID NO: 3907466 - RNA, 16 nt, Human adenovirus C
cgccgcacgaggggca

SEQ ID NO: 3907467 - RNA, 20 nt, Human adenovirus C
cgccgccguuagcccaagag

SEQ ID NO: 3907468 - RNA, 15 nt, Human adenovirus C
cgccgcgcgcgggca

SEQ ID NO: 3907469 - RNA, 17 nt, Human adenovirus C
cgccgcuuucuucucua

SEQ ID NO: 3907470 - RNA, 14 nt, Human adenovirus C
cgccggcacugccu

SEQ ID NO: 3907471 - RNA, 19 nt, Human adenovirus C
cgccgucgccagcccgugc

SEQ ID NO: 3907472 - RNA, 23 nt, Human adenovirus C
cgccguuggagacugcagccucc

SEQ ID NO: 3907473 - RNA, 16 nt, Human adenovirus C
cgccugcugggcgagg

SEQ ID NO: 3907474 - RNA, 16 nt, Human adenovirus C
cgccuguugcugcugc

SEQ ID NO: 3907475 - RNA, 18 nt, Human adenovirus C
cgcgagcgguugcugcgc

SEQ ID NO: 3907476 - RNA, 13 nt, Human adenovirus C
cgcgcaacuacac

SEQ ID NO: 3907477 - RNA, 22 nt, Human adenovirus C
cgcgcacaaacgcggccgcacu

SEQ ID NO: 3907478 - RNA, 18 nt, Human adenovirus C
cgcgcagaugggagcugu

SEQ ID NO: 3907479 - RNA, 20 nt, Human adenovirus C
cgcgcagcagcagggcaacc

SEQ ID NO: 3907480 - RNA, 22 nt, Human adenovirus C
cgugaccuuccgcuccacgagc

SEQ ID NO: 3907481 - RNA, 19 nt, Human adenovirus C
cgugagcgcgcgcagcagc

SEQ ID NO: 3907482 - RNA, 19 nt, Human adenovirus C
cgugagcgugagccggcgg

SEQ ID NO: 3907483 - RNA, 18 nt, Human adenovirus C
cgugcaagacuccaaacu

SEQ ID NO: 3907484 - RNA, 19 nt, Human adenovirus C
cgugcgagggagcgaggag

SEQ ID NO: 3907485 - RNA, 13 nt, Human adenovirus C
cgugcggcaggga

SEQ ID NO: 3907486 - RNA, 16 nt, Human adenovirus C
cgugcucuacauuggc

SEQ ID NO: 3907487 - RNA, 13 nt, Human adenovirus C
cgugcuggccccg

SEQ ID NO: 3907488 - RNA, 20 nt, Human adenovirus C
cguggcuacaccuaccgccc

SEQ ID NO: 3907489 - RNA, 19 nt, Human adenovirus C
cguggcucguuacaacagc

SEQ ID NO: 3907490 - RNA, 13 nt, Human adenovirus C
cguggcugugauu

SEQ ID NO: 3907491 - RNA, 13 nt, Human adenovirus C
cguguggcagcaa

SEQ ID NO: 3907492 - RNA, 18 nt, Human adenovirus C
cguguucugacagggccc

SEQ ID NO: 3907493 - RNA, 17 nt, Human adenovirus C
cguucagauacccacca

SEQ ID NO: 3907494 - RNA, 22 nt, Human adenovirus C
cguucagauacccaccaccagu

SEQ ID NO: 3907495 - RNA, 19 nt, Human adenovirus C
cguuccugcucucacagau

SEQ ID NO: 3907496 - RNA, 20 nt, Human adenovirus C
cguugauguuguggcccacg

SEQ ID NO: 3907497 - RNA, 22 nt, Human adenovirus C
cguuucgcggguuggggcggcu

SEQ ID NO: 3907498 - RNA, 20 nt, Human adenovirus C
cuaaccagcguagccccuau

SEQ ID NO: 3907499 - RNA, 16 nt, Human adenovirus C
cuaaggacaaacaggu

SEQ ID NO: 3907500 - RNA, 20 nt, Human adenovirus C
cuaaugcggcaggagggaga

SEQ ID NO: 3907501 - RNA, 11 nt, Human adenovirus C
cuacaagcgcg

SEQ ID NO: 3907502 - RNA, 19 nt, Human adenovirus C
cuacaagcuacccacccag

SEQ ID NO: 3907503 - RNA, 13 nt, Human adenovirus C
cuacaauucccaa

SEQ ID NO: 3907504 - RNA, 13 nt, Human adenovirus C
cuacagccccuac

SEQ ID NO: 3907505 - RNA, 23 nt, Human adenovirus C
cuacagccugagcguaaccagac

SEQ ID NO: 3907506 - RNA, 17 nt, Human adenovirus C
cuacaucguaggugaca

SEQ ID NO: 3907507 - RNA, 13 nt, Human adenovirus C
cuacaugagcgcg

SEQ ID NO: 3907508 - RNA, 14 nt, Human adenovirus C
cuacauuccagaaa

SEQ ID NO: 3907509 - RNA, 15 nt, Human adenovirus C
cuacauuucugggaa

SEQ ID NO: 3907510 - RNA, 14 nt, Human adenovirus C
cuaccaccuucccc

SEQ ID NO: 3907511 - RNA, 19 nt, Human adenovirus C
cuaccgcgcgcccuggggc

SEQ ID NO: 3907512 - RNA, 15 nt, Human adenovirus C
cuaccucgcucccac

SEQ ID NO: 3907513 - RNA, 21 nt, Human adenovirus C
cuacggcaucucgauccagca

SEQ ID NO: 3907514 - RNA, 19 nt, Human adenovirus C
cuacucuuauaaaaugcac

SEQ ID NO: 3907515 - RNA, 18 nt, Human adenovirus C
cuacugcaccggcggcag

SEQ ID NO: 3907516 - RNA, 16 nt, Human adenovirus C
cuacuuccgcagccac

SEQ ID NO: 3907517 - RNA, 19 nt, Human adenovirus C
cuacuugcaucgcgcggcc

SEQ ID NO: 3907518 - RNA, 15 nt, Human adenovirus C
cuagacugcuccuuc

SEQ ID NO: 3907519 - RNA, 14 nt, Human adenovirus C
cuagcacuucugug

SEQ ID NO: 3907520 - RNA, 23 nt, Human adenovirus C
cuagccaacuaccuugccuacca

SEQ ID NO: 3907521 - RNA, 17 nt, Human adenovirus C
cuagcccugcaaacauc

SEQ ID NO: 3907522 - RNA, 16 nt, Human adenovirus C
cuagccgugcugaaac

SEQ ID NO: 3907523 - RNA, 22 nt, Human adenovirus C
cuagcgccugcugccaugcgcg

SEQ ID NO: 3907524 - RNA, 20 nt, Human adenovirus C
cuagcuuuuuuggccacugg

SEQ ID NO: 3907525 - RNA, 17 nt, Human adenovirus C
cuauaggacugaugcau

SEQ ID NO: 3907526 - RNA, 20 nt, Human adenovirus C
cuaucaggguccagaggacc

SEQ ID NO: 3907527 - RNA, 20 nt, Human adenovirus C
cuaucguggcuacaccuacc

SEQ ID NO: 3907528 - RNA, 14 nt, Human adenovirus C
cuaugcgccacugg

SEQ ID NO: 3907529 - RNA, 20 nt, Human adenovirus C
cuauggccccccgaagaagg

SEQ ID NO: 3907530 - RNA, 14 nt, Human adenovirus C
cuaugugcagcaga

SEQ ID NO: 3907531 - RNA, 13 nt, Human adenovirus C
cuauuaccaccac

SEQ ID NO: 3907532 - RNA, 16 nt, Human adenovirus C
cucaacccgaauaaac

SEQ ID NO: 3907533 - RNA, 17 nt, Human adenovirus C
cucacagaccugggcca

SEQ ID NO: 3907534 - RNA, 17 nt, Human adenovirus C
cucacccgcagcugccu

SEQ ID NO: 3907535 - RNA, 14 nt, Human adenovirus C
cucacucucuuccg

SEQ ID NO: 3907536 - RNA, 22 nt, Human adenovirus C
cucacucucuuccgcaucgcug

SEQ ID NO: 3907537 - RNA, 18 nt, Human adenovirus C
cucacuuaaaaaacauua

SEQ ID NO: 3907538 - RNA, 17 nt, Human adenovirus C
cucacuuaaaucagcac

SEQ ID NO: 3907539 - RNA, 20 nt, Human adenovirus C
cucacuuaaaucagcacagu

SEQ ID NO: 3907540 - RNA, 14 nt, Human adenovirus C
cucagaaaugacac

SEQ ID NO: 3907541 - RNA, 13 nt, Human adenovirus C
cucagaugcugac

SEQ ID NO: 3907542 - RNA, 13 nt, Human adenovirus C
cucagcgcagcgg

SEQ ID NO: 3907543 - RNA, 22 nt, Human adenovirus C
cucagcgccucccaaaagacau

SEQ ID NO: 3907544 - RNA, 14 nt, Human adenovirus C
cucagcuacaagcu

SEQ ID NO: 3907545 - RNA, 20 nt, Human adenovirus C
cucaggcgccgccggcacug

SEQ ID NO: 3907546 - RNA, 23 nt, Human adenovirus C
cucauguucuugucccuccgcac

SEQ ID NO: 3907547 - RNA, 23 nt, Human adenovirus C
cuccaccggccguggagacagug

SEQ ID NO: 3907548 - RNA, 19 nt, Human adenovirus C
cuccacuuaaacucaggca

SEQ ID NO: 3907549 - RNA, 23 nt, Human adenovirus C
cuccagagcgcccuccaccuuca

SEQ ID NO: 3907550 - RNA, 15 nt, Human adenovirus C
cuccagggugcgcca

SEQ ID NO: 3907551 - RNA, 19 nt, Human adenovirus C
cuccaucccaucgcgcaac

SEQ ID NO: 3907552 - RNA, 20 nt, Human adenovirus C
cucccaaaagacauauuucc

SEQ ID NO: 3907553 - RNA, 21 nt, Human adenovirus C
cucccaaaauguaaccacugu

SEQ ID NO: 3907554 - RNA, 13 nt, Human adenovirus C
cuccccccgcuga

SEQ ID NO: 3907555 - RNA, 18 nt, Human adenovirus C
cuccccggcuggccuuaa

SEQ ID NO: 3907556 - RNA, 14 nt, Human adenovirus C
cucccggccacuac

SEQ ID NO: 3907557 - RNA, 12 nt, Human adenovirus C
cucccgguacca

SEQ ID NO: 3907558 - RNA, 23 nt, Human adenovirus C
cuccgaacgguaagagccuagca

SEQ ID NO: 3907559 - RNA, 22 nt, Human adenovirus C
cuccgagauuuuccaugcauuc

SEQ ID NO: 3907560 - RNA, 23 nt, Human adenovirus C
cuccgccgcuuuggggucacugc

SEQ ID NO: 3907561 - RNA, 15 nt, Human adenovirus C
cuccgcgguaccugc

SEQ ID NO: 3907562 - RNA, 21 nt, Human adenovirus C
cuccguggccgcgcaccuggc

SEQ ID NO: 3907563 - RNA, 15 nt, Human adenovirus C
cuccucagcagcggc

SEQ ID NO: 3907564 - RNA, 17 nt, Human adenovirus C
cuccugacguaaccugc

SEQ ID NO: 3907565 - RNA, 15 nt, Human adenovirus C
cuccugccaggcuca

SEQ ID NO: 3907566 - RNA, 19 nt, Human adenovirus C
cuccuuuccuuccucccaa

SEQ ID NO: 3907567 - RNA, 18 nt, Human adenovirus C
cuccuuugucuggagaaa

SEQ ID NO: 3907568 - RNA, 20 nt, Human adenovirus C
cucgaucucuuccuccugga

SEQ ID NO: 3907569 - RNA, 17 nt, Human adenovirus C
cucgcccuacuuccgca

SEQ ID NO: 3907570 - RNA, 13 nt, Human adenovirus C
cucgccugcgcca

SEQ ID NO: 3907571 - RNA, 20 nt, Human adenovirus C
cucgccuucgaucucagcgc

SEQ ID NO: 3907572 - RNA, 15 nt, Human adenovirus C
cucgcguccaggcca

SEQ ID NO: 3907573 - RNA, 16 nt, Human adenovirus C
cucgcguccaggccag

SEQ ID NO: 3907574 - RNA, 18 nt, Human adenovirus C
cucgcguccaggccagca

SEQ ID NO: 3907575 - RNA, 12 nt, Human adenovirus C
cucgcugcugca

SEQ ID NO: 3907576 - RNA, 16 nt, Human adenovirus C
cucgcugcugcagccg

SEQ ID NO: 3907577 - RNA, 13 nt, Human adenovirus C
cucgcuguggagc

SEQ ID NO: 3907578 - RNA, 19 nt, Human adenovirus C
cucggagcuaugcuaacca

SEQ ID NO: 3907579 - RNA, 17 nt, Human adenovirus C
cucggcagacgacagca

SEQ ID NO: 3907580 - RNA, 20 nt, Human adenovirus C
cucggcuaauauggccugcu

SEQ ID NO: 3907581 - RNA, 16 nt, Human adenovirus C
cucgggcuugggagag

SEQ ID NO: 3907582 - RNA, 18 nt, Human adenovirus C
cucguccagacgggccag

SEQ ID NO: 3907583 - RNA, 17 nt, Human adenovirus C
cucuacaagcuugucua

SEQ ID NO: 3907584 - RNA, 19 nt, Human adenovirus C
cucucuacgcgucuccgaa

SEQ ID NO: 3907585 - RNA, 14 nt, Human adenovirus C
cucucugacccacg

SEQ ID NO: 3907586 - RNA, 16 nt, Human adenovirus C
cucucugaguauucca

SEQ ID NO: 3907587 - RNA, 16 nt, Human adenovirus C
cucugcgugaagacga

SEQ ID NO: 3907588 - RNA, 19 nt, Human adenovirus C
cucugguaucucagccgcc

SEQ ID NO: 3907589 - RNA, 21 nt, Human adenovirus C
cucuuccauaagggccucccc

SEQ ID NO: 3907590 - RNA, 13 nt, Human adenovirus C
cucuugcguccgc

SEQ ID NO: 3907591 - RNA, 23 nt, Human adenovirus C
cugaaaauaaaaaacaggucucu

SEQ ID NO: 3907592 - RNA, 13 nt, Human adenovirus C
cugaaacccacca

SEQ ID NO: 3907593 - RNA, 23 nt, Human adenovirus C
cugaacuguuuccagaacugaga

SEQ ID NO: 3907594 - RNA, 19 nt, Human adenovirus C
cugacacccagcagaaacc

SEQ ID NO: 3907595 - RNA, 20 nt, Human adenovirus C
cugacccggagaugcagcgc

SEQ ID NO: 3907596 - RNA, 14 nt, Human adenovirus C
gaucggcgcgcucc

SEQ ID NO: 3907597 - RNA, 18 nt, Human adenovirus C
gaucuccgcguccggcuc

SEQ ID NO: 3907598 - RNA, 12 nt, Human adenovirus C
gaucugcgccag

SEQ ID NO: 3907599 - RNA, 18 nt, Human adenovirus C
gaucuggaaggugcugag

SEQ ID NO: 3907600 - RNA, 18 nt, Human adenovirus C
gaucuuaugccaggccua

SEQ ID NO: 3907601 - RNA, 23 nt, Human adenovirus C
gaucuuaugccaggccuacaaau

SEQ ID NO: 3907602 - RNA, 13 nt, Human adenovirus C
gaugaccuggagg

SEQ ID NO: 3907603 - RNA, 17 nt, Human adenovirus C
gaugcgggccaugagcu

SEQ ID NO: 3907604 - RNA, 22 nt, Human adenovirus C
gaugcgggccaugagcugcgag

SEQ ID NO: 3907605 - RNA, 17 nt, Human adenovirus C
gauggcacccaaaaaga

SEQ ID NO: 3907606 - RNA, 18 nt, Human adenovirus C
gauuagcaaacuuguaaa

SEQ ID NO: 3907607 - RNA, 19 nt, Human adenovirus C
gauuugucacccuuauccu

SEQ ID NO: 3907608 - RNA, 23 nt, Human adenovirus C
gcaacagcaggaggaagccaggc

SEQ ID NO: 3907609 - RNA, 19 nt, Human adenovirus C
gcaacagggucugccagac

SEQ ID NO: 3907610 - RNA, 22 nt, Human adenovirus C
gcaacaucaacaacagcugccg

SEQ ID NO: 3907611 - RNA, 18 nt, Human adenovirus C
gcaacccuuccaggaggg

SEQ ID NO: 3907612 - RNA, 15 nt, Human adenovirus C
gcaaccgcgcccagg

SEQ ID NO: 3907613 - RNA, 13 nt, Human adenovirus C
gcaaccguuccca

SEQ ID NO: 3907614 - RNA, 22 nt, Human adenovirus C
gcaaccuaaaggagcugcagaa

SEQ ID NO: 3907615 - RNA, 17 nt, Human adenovirus C
gcaacuuguugggcauc

SEQ ID NO: 3907616 - RNA, 14 nt, Human adenovirus C
gcaagcacacagac

SEQ ID NO: 3907617 - RNA, 19 nt, Human adenovirus C
gcaagccgcucauggcgca

SEQ ID NO: 3907618 - RNA, 20 nt, Human adenovirus C
gcaagcuaaugauggccgca

SEQ ID NO: 3907619 - RNA, 16 nt, Human adenovirus C
gcaagcuagaggaaac

SEQ ID NO: 3907620 - RNA, 15 nt, Human adenovirus C
gcaaggccuggccag

SEQ ID NO: 3907621 - RNA, 21 nt, Human adenovirus C
gcaaggguaucauggcggacg

SEQ ID NO: 3907622 - RNA, 19 nt, Human adenovirus C
gcaaguuuuacgcccgcaa

SEQ ID NO: 3907623 - RNA, 15 nt, Human adenovirus C
gcaauaacacaggcu

SEQ ID NO: 3907624 - RNA, 19 nt, Human adenovirus C
gcaauaugagcgguggcgc

SEQ ID NO: 3907625 - RNA, 21 nt, Human adenovirus C
gcaauucaaguaacucuacaa

SEQ ID NO: 3907626 - RNA, 22 nt, Human adenovirus C
gcaccaccggcggcggcgcgcg

SEQ ID NO: 3907627 - RNA, 16 nt, Human adenovirus C
gcaccagccgcaccgc

SEQ ID NO: 3907628 - RNA, 13 nt, Human adenovirus C
gcaccaggugcac

SEQ ID NO: 3907629 - RNA, 16 nt, Human adenovirus C
gcaccgggaggcgguc

SEQ ID NO: 3907630 - RNA, 15 nt, Human adenovirus C
gcaccuacgcacgac

SEQ ID NO: 3907631 - RNA, 15 nt, Human adenovirus C
gcaccuucgccccag

SEQ ID NO: 3907632 - RNA, 15 nt, Human adenovirus C
gcacgaaggaggcgu

SEQ ID NO: 3907633 - RNA, 22 nt, Human adenovirus C
gcacgaaggaggcguaggaguc

SEQ ID NO: 3907634 - RNA, 23 nt, Human adenovirus C
gcacgaccgucagcggggucugg

SEQ ID NO: 3907635 - RNA, 19 nt, Human adenovirus C
gcacgcaaccgcgcccagg

SEQ ID NO: 3907636 - RNA, 17 nt, Human adenovirus C
gcacgucuagggcgcag

SEQ ID NO: 3907637 - RNA, 16 nt, Human adenovirus C
gcacucacagaccugg

SEQ ID NO: 3907638 - RNA, 21 nt, Human adenovirus C
gcacucacagaccugggccaa

SEQ ID NO: 3907639 - RNA, 20 nt, Human adenovirus C
gcacugggcgcaccaccguc

SEQ ID NO: 3907640 - RNA, 16 nt, Human adenovirus C
gcacuuaaccuacccc

SEQ ID NO: 3907641 - RNA, 21 nt, Human adenovirus C
gcacuucuucuucuccuuccu

SEQ ID NO: 3907642 - RNA, 21 nt, Human adenovirus C
gcagaaaccugugcugccagg

SEQ ID NO: 3907643 - RNA, 18 nt, Human adenovirus C
gcagacacgaucggcagg

SEQ ID NO: 3907644 - RNA, 20 nt, Human adenovirus C
gcagacaugcagggcacccu

SEQ ID NO: 3907645 - RNA, 15 nt, Human adenovirus C
gcagaccaaccugga

SEQ ID NO: 3907646 - RNA, 17 nt, Human adenovirus C
gcagaccguaaaccuga

SEQ ID NO: 3907647 - RNA, 23 nt, Human adenovirus C
gcagaccguaaaccugagccagg

SEQ ID NO: 3907648 - RNA, 21 nt, Human adenovirus C
gcagacuuuuaagggcguaga

SEQ ID NO: 3907649 - RNA, 15 nt, Human adenovirus C
gcagagcgugagccu

SEQ ID NO: 3907650 - RNA, 22 nt, Human adenovirus C
gcagaggagguuuuggacgagg

SEQ ID NO: 3907651 - RNA, 14 nt, Human adenovirus C
gcagaggcggcgcu

SEQ ID NO: 3907652 - RNA, 18 nt, Human adenovirus C
gcagaugggagcugucca

SEQ ID NO: 3907653 - RNA, 18 nt, Human adenovirus C
gcagcacaggccagaugc

SEQ ID NO: 3907654 - RNA, 14 nt, Human adenovirus C
gcagcagccgcagg

SEQ ID NO: 3907655 - RNA, 14 nt, Human adenovirus C
gcagccgcaggcca

SEQ ID NO: 3907656 - RNA, 12 nt, Human adenovirus C
gcagccuggagg

SEQ ID NO: 3907657 - RNA, 18 nt, Human adenovirus C
gcagcgccagugcgccau

SEQ ID NO: 3907658 - RNA, 21 nt, Human adenovirus C
gcagcggcagcaacagcagcg

SEQ ID NO: 3907659 - RNA, 20 nt, Human adenovirus C
gcagcggcgcggaagagaac

SEQ ID NO: 3907660 - RNA, 23 nt, Human adenovirus C
gcagcuagccaacuaccuugccu

SEQ ID NO: 3907661 - RNA, 20 nt, Human adenovirus C
gcagcugaugguacccaagc

SEQ ID NO: 3907662 - RNA, 12 nt, Human adenovirus C
gcagcugccugu

SEQ ID NO: 3907663 - RNA, 20 nt, Human adenovirus C
gcagcuggccuugcggcagg

SEQ ID NO: 3907664 - RNA, 21 nt, Human adenovirus C
gcagcuuguugaccagcucgg

SEQ ID NO: 3907665 - RNA, 15 nt, Human adenovirus C
gcaggaaucgcccca

SEQ ID NO: 3907666 - RNA, 18 nt, Human adenovirus C
gcaggacccuggugcugc

SEQ ID NO: 3907667 - RNA, 14 nt, Human adenovirus C
gcaggcgcagagac

SEQ ID NO: 3907668 - RNA, 16 nt, Human adenovirus C
gcaggcgcagagacac

SEQ ID NO: 3907669 - RNA, 12 nt, Human adenovirus C
gcagggugacaa

SEQ ID NO: 3907670 - RNA, 14 nt, Human adenovirus C
gcagguggcaccgg

SEQ ID NO: 3907671 - RNA, 20 nt, Human adenovirus C
gcagguggucgcgaaagguc

SEQ ID NO: 3907672 - RNA, 15 nt, Human adenovirus C
gcagguuccugagca

SEQ ID NO: 3907673 - RNA, 19 nt, Human adenovirus C
gcagguuccugagcagcug

SEQ ID NO: 3907674 - RNA, 20 nt, Human adenovirus C
gcagucugcagcgcugccaa

SEQ ID NO: 3907675 - RNA, 22 nt, Human adenovirus C
gcauaccccgcgccacuggguc

SEQ ID NO: 3907676 - RNA, 16 nt, Human adenovirus C
gcauagccgggucagg

SEQ ID NO: 3907677 - RNA, 21 nt, Human adenovirus C
gcauaguggugcaggagcgca

SEQ ID NO: 3907678 - RNA, 15 nt, Human adenovirus C
gcauccacaaggccg

SEQ ID NO: 3907679 - RNA, 17 nt, Human adenovirus C
gcauccggugcugcggc

SEQ ID NO: 3907680 - RNA, 14 nt, Human adenovirus C
gcaucugcagcgcc

SEQ ID NO: 3907681 - RNA, 16 nt, Human adenovirus C
gcaucugcagcgccag

SEQ ID NO: 3907682 - RNA, 20 nt, Human adenovirus C
gcaugauaaauauguggccg

SEQ ID NO: 3907683 - RNA, 15 nt, Human adenovirus C
gcaugcuuuugagcg

SEQ ID NO: 3907684 - RNA, 15 nt, Human adenovirus C
gcauggccggccacg

SEQ ID NO: 3907685 - RNA, 16 nt, Human adenovirus C
gcauggccggccacgg

SEQ ID NO: 3907686 - RNA, 21 nt, Human adenovirus C
gcaugucccugacuugcaugu

SEQ ID NO: 3907687 - RNA, 18 nt, Human adenovirus C
gcauguuuucccugacca

SEQ ID NO: 3907688 - RNA, 20 nt, Human adenovirus C
gcauuagcggggugguggac

SEQ ID NO: 3907689 - RNA, 13 nt, Human adenovirus C
gcauuccacgagc

SEQ ID NO: 3907690 - RNA, 20 nt, Human adenovirus C
gcauuccccucgccggcgcc

SEQ ID NO: 3907691 - RNA, 17 nt, Human adenovirus C
gcauugcguaccucagg

SEQ ID NO: 3907692 - RNA, 13 nt, Human adenovirus C
gccaaaaccugcc

SEQ ID NO: 3907693 - RNA, 20 nt, Human adenovirus C
gccaacuaccuugccuacca

SEQ ID NO: 3907694 - RNA, 23 nt, Human adenovirus C
gccacaacgcgcagcccgugggc

SEQ ID NO: 3907695 - RNA, 21 nt, Human adenovirus C
gccacacgggcggaggagaag

SEQ ID NO: 3907696 - RNA, 15 nt, Human adenovirus C
gccacauccuuggcc

SEQ ID NO: 3907697 - RNA, 17 nt, Human adenovirus C
gccacccacggacgagg

SEQ ID NO: 3907698 - RNA, 11 nt, Human adenovirus C
gccacgucaca

SEQ ID NO: 3907699 - RNA, 16 nt, Human adenovirus C
gccacuggcagggaca

SEQ ID NO: 3907700 - RNA, 15 nt, Human adenovirus C
gccagaaggcgcucg

SEQ ID NO: 3907701 - RNA, 17 nt, Human adenovirus C
gccagaggagcugcuga

SEQ ID NO: 3907702 - RNA, 24 nt, Human adenovirus C
gccagcaccugucgucagcgccau

SEQ ID NO: 3907703 - RNA, 12 nt, Human adenovirus C
gccagcgacugg

SEQ ID NO: 3907704 - RNA, 17 nt, Human adenovirus C
gccagcgcacuacugcc

SEQ ID NO: 3907705 - RNA, 16 nt, Human adenovirus C
gccagcgccugcacug

SEQ ID NO: 3907706 - RNA, 14 nt, Human adenovirus C
gccagguagcauuu

SEQ ID NO: 3907707 - RNA, 22 nt, Human adenovirus C
gccauagaugccaugaaccacc

SEQ ID NO: 3907708 - RNA, 22 nt, Human adenovirus C
gccaugcucagaaaugacacca

SEQ ID NO: 3907709 - RNA, 15 nt, Human adenovirus C
gccauggcaccgagc

SEQ ID NO: 3907710 - RNA, 22 nt, Human adenovirus C
gccauuagcauuugcagguggu

SEQ ID NO: 3907711 - RNA, 18 nt, Human adenovirus C
gcccagcgauagcaguuc

SEQ ID NO: 3907712 - RNA, 14 nt, Human adenovirus C
gcgggccaugagcu

SEQ ID NO: 3907713 - RNA, 13 nt, Human adenovirus C
gcgggcggagggu

SEQ ID NO: 3907714 - RNA, 14 nt, Human adenovirus C
gcgggcggcgcugc

SEQ ID NO: 3907715 - RNA, 14 nt, Human adenovirus C
gcgggcugcucugc

SEQ ID NO: 3907716 - RNA, 16 nt, Human adenovirus C
gcggggcuuaaagggu

SEQ ID NO: 3907717 - RNA, 15 nt, Human adenovirus C
gcggggugcugggau

SEQ ID NO: 3907718 - RNA, 14 nt, Human adenovirus C
gcgguauccugccc

SEQ ID NO: 3907719 - RNA, 14 nt, Human adenovirus C
gcggucggccaugc

SEQ ID NO: 3907720 - RNA, 15 nt, Human adenovirus C
gcggucggccaugcc

SEQ ID NO: 3907721 - RNA, 14 nt, Human adenovirus C
gcggugcaggcggc

SEQ ID NO: 3907722 - RNA, 15 nt, Human adenovirus C
gcggugcaggcggcc

SEQ ID NO: 3907723 - RNA, 16 nt, Human adenovirus C
gcggugcgggcggcgc

SEQ ID NO: 3907724 - RNA, 14 nt, Human adenovirus C
gcgguuaggcugga

SEQ ID NO: 3907725 - RNA, 15 nt, Human adenovirus C
gcguaacuugcugga

SEQ ID NO: 3907726 - RNA, 18 nt, Human adenovirus C
gcguaggagucgcgcagc

SEQ ID NO: 3907727 - RNA, 14 nt, Human adenovirus C
gcgucuggcgccca

SEQ ID NO: 3907728 - RNA, 18 nt, Human adenovirus C
gcgugacacgcgcgaggc

SEQ ID NO: 3907729 - RNA, 14 nt, Human adenovirus C
gcguguaugaugag

SEQ ID NO: 3907730 - RNA, 14 nt, Human adenovirus C
gcguguggcagcaa

SEQ ID NO: 3907731 - RNA, 20 nt, Human adenovirus C
gcuaaaauacaaccccacca

SEQ ID NO: 3907732 - RNA, 18 nt, Human adenovirus C
gcuacaaccuccgcuccu

SEQ ID NO: 3907733 - RNA, 20 nt, Human adenovirus C
gcuacaacguagcucagugc

SEQ ID NO: 3907734 - RNA, 22 nt, Human adenovirus C
gcuacaacguagcucagugcaa

SEQ ID NO: 3907735 - RNA, 19 nt, Human adenovirus C
gcuacaccuaccgccccag

SEQ ID NO: 3907736 - RNA, 18 nt, Human adenovirus C
gcuaccaccccagcaucg

SEQ ID NO: 3907737 - RNA, 23 nt, Human adenovirus C
gcuaccggagugcugggccagca

SEQ ID NO: 3907738 - RNA, 17 nt, Human adenovirus C
gcuaccucgcucccacc

SEQ ID NO: 3907739 - RNA, 15 nt, Human adenovirus C
gcuaccucuccgcgu

SEQ ID NO: 3907740 - RNA, 23 nt, Human adenovirus C
gcucaagggcgaggcgcgccgcg

SEQ ID NO: 3907741 - RNA, 16 nt, Human adenovirus C
gcucagucugggcaag

SEQ ID NO: 3907742 - RNA, 14 nt, Human adenovirus C
gcucaucuccgccg

SEQ ID NO: 3907743 - RNA, 14 nt, Human adenovirus C
gcuccagugagcag

SEQ ID NO: 3907744 - RNA, 16 nt, Human adenovirus C
gcucccaaaccucagc

SEQ ID NO: 3907745 - RNA, 17 nt, Human adenovirus C
gcucccaaaccucagcg

SEQ ID NO: 3907746 - RNA, 23 nt, Human adenovirus C
gcucccaccaugcgcgagggaca

SEQ ID NO: 3907747 - RNA, 17 nt, Human adenovirus C
gcucccuggucugcaau

SEQ ID NO: 3907748 - RNA, 23 nt, Human adenovirus C
gcuccuucagcgcgcgcugcccg

SEQ ID NO: 3907749 - RNA, 14 nt, Human adenovirus C
gcucgccgcccagc

SEQ ID NO: 3907750 - RNA, 23 nt, Human adenovirus C
gcucgcuguggagcggcauuaaa

SEQ ID NO: 3907751 - RNA, 21 nt, Human adenovirus C
gcucguccagacgggccaggg

SEQ ID NO: 3907752 - RNA, 13 nt, Human adenovirus C
gcucuacagcuuc

SEQ ID NO: 3907753 - RNA, 14 nt, Human adenovirus C
gcugaaacccacca

SEQ ID NO: 3907754 - RNA, 15 nt, Human adenovirus C
gcugaaacgcagcau

SEQ ID NO: 3907755 - RNA, 12 nt, Human adenovirus C
gcugaaagaggu

SEQ ID NO: 3907756 - RNA, 15 nt, Human adenovirus C
gcugcagagccagcc

SEQ ID NO: 3907757 - RNA, 13 nt, Human adenovirus C
gcugcagccaggg

SEQ ID NO: 3907758 - RNA, 16 nt, Human adenovirus C
gcugcagcugccgccg

SEQ ID NO: 3907759 - RNA, 21 nt, Human adenovirus C
gcugccggucuucgcccugcg

SEQ ID NO: 3907760 - RNA, 13 nt, Human adenovirus C
gcugccugcacuu

SEQ ID NO: 3907761 - RNA, 18 nt, Human adenovirus C
gcugcgagagcucggugu

SEQ ID NO: 3907762 - RNA, 23 nt, Human adenovirus C
gcugcgcgcggagguugcuggcg

SEQ ID NO: 3907763 - RNA, 15 nt, Human adenovirus C
gcugcgggguggugu

SEQ ID NO: 3907764 - RNA, 19 nt, Human adenovirus C
gcugcgguucaucccugug

SEQ ID NO: 3907765 - RNA, 21 nt, Human adenovirus C
gcugcgguucaucccugugga

SEQ ID NO: 3907766 - RNA, 16 nt, Human adenovirus C
gcugcuggaagggggu

SEQ ID NO: 3907767 - RNA, 21 nt, Human adenovirus C
gcugcuggaaggggguggugu

SEQ ID NO: 3907768 - RNA, 15 nt, Human adenovirus C
gcuggaagccaugcu

SEQ ID NO: 3907769 - RNA, 18 nt, Human adenovirus C
gcuggaagccaugcucag

SEQ ID NO: 3907770 - RNA, 15 nt, Human adenovirus C
gcuggaccugccucc

SEQ ID NO: 3907771 - RNA, 18 nt, Human adenovirus C
gcuggacgagggcaaccc

SEQ ID NO: 3907772 - RNA, 12 nt, Human adenovirus C
gcuggccgggca

SEQ ID NO: 3907773 - RNA, 15 nt, Human adenovirus C
gcugggcguggugcc

SEQ ID NO: 3907774 - RNA, 12 nt, Human adenovirus C
gcuggggccugc

SEQ ID NO: 3907775 - RNA, 15 nt, Human adenovirus C
gcuggguucccccuu

SEQ ID NO: 3907776 - RNA, 17 nt, Human adenovirus C
gcugguccugcuggugc

SEQ ID NO: 3907777 - RNA, 14 nt, Human adenovirus C
gcuggucucuggac

SEQ ID NO: 3907778 - RNA, 14 nt, Human adenovirus C
gcuguacauccugc

SEQ ID NO: 3907779 - RNA, 14 nt, Human adenovirus C
gcuguccagcugcu

SEQ ID NO: 3907780 - RNA, 13 nt, Human adenovirus C
gcuuaaggguggg

SEQ ID NO: 3907781 - RNA, 21 nt, Human adenovirus C
gcuuaccccgccaacgugccc

SEQ ID NO: 3907782 - RNA, 23 nt, Human adenovirus C
gcuuauuacagcgcuugcuuugg

SEQ ID NO: 3907783 - RNA, 19 nt, Human adenovirus C
gcuuauuuguugccuaaag

SEQ ID NO: 3907784 - RNA, 14 nt, Human adenovirus C
gcuucacuggacuc

SEQ ID NO: 3907785 - RNA, 16 nt, Human adenovirus C
gcuucagccgcugcag

SEQ ID NO: 3907786 - RNA, 23 nt, Human adenovirus C
gcuucccaaaggcccccauccaa

SEQ ID NO: 3907787 - RNA, 14 nt, Human adenovirus C
gcuugaggaggagg

SEQ ID NO: 3907788 - RNA, 16 nt, Human adenovirus C
gcuugaucugcuggcg

SEQ ID NO: 3907789 - RNA, 14 nt, Human adenovirus C
gcuuguagacugcu

SEQ ID NO: 3907790 - RNA, 22 nt, Human adenovirus C
gcuuucaagaacuugcaggggc

SEQ ID NO: 3907791 - RNA, 21 nt, Human adenovirus C
gcuuugcucccaaaccucagc

SEQ ID NO: 3907792 - RNA, 16 nt, Human adenovirus C
ggaaagacgguggugc

SEQ ID NO: 3907793 - RNA, 16 nt, Human adenovirus C
ggaacauucccagcug

SEQ ID NO: 3907794 - RNA, 21 nt, Human adenovirus C
ggaagacguaugcgcaggagc

SEQ ID NO: 3907795 - RNA, 22 nt, Human adenovirus C
ggaagacguaugcgcaggagca

SEQ ID NO: 3907796 - RNA, 19 nt, Human adenovirus C
ggaagcgacgaaugagcuc

SEQ ID NO: 3907797 - RNA, 15 nt, Human adenovirus C
ggaaggugcugaggu

SEQ ID NO: 3907798 - RNA, 15 nt, Human adenovirus C
ggaauacaacauggc

SEQ ID NO: 3907799 - RNA, 14 nt, Human adenovirus C
ggacaaaagaugaa

SEQ ID NO: 3907800 - RNA, 21 nt, Human adenovirus C
ggacaccacuggaaccagggc

SEQ ID NO: 3907801 - RNA, 12 nt, Human adenovirus C
ggacaguggcag

SEQ ID NO: 3907802 - RNA, 18 nt, Human adenovirus C
ggacccuggugcugccaa

SEQ ID NO: 3907803 - RNA, 19 nt, Human adenovirus C
ggaccuggccaaccaggca

SEQ ID NO: 3907804 - RNA, 14 nt, Human adenovirus C
ggacgagcccaccc

SEQ ID NO: 3907805 - RNA, 20 nt, Human adenovirus C
ggacgcgacgagaaacgcgc

SEQ ID NO: 3907806 - RNA, 14 nt, Human adenovirus C
ggacggcuacgacu

SEQ ID NO: 3907807 - RNA, 22 nt, Human adenovirus C
ggacgggggguuuaccuggacc

SEQ ID NO: 3907808 - RNA, 18 nt, Human adenovirus C
ggacugggcgugcagacc

SEQ ID NO: 3907809 - RNA, 16 nt, Human adenovirus C
ggagcaacagcaggag

SEQ ID NO: 3907810 - RNA, 15 nt, Human adenovirus C
ggagcagagcccaug

SEQ ID NO: 3907811 - RNA, 18 nt, Human adenovirus C
ggagccugggcuggagcc

SEQ ID NO: 3907812 - RNA, 22 nt, Human adenovirus C
ggagccugggcuggagcccgag

SEQ ID NO: 3907813 - RNA, 21 nt, Human adenovirus C
ggagcgcagcuugagccuggc

SEQ ID NO: 3907814 - RNA, 18 nt, Human adenovirus C
ggagcggggggcuucuga

SEQ ID NO: 3907815 - RNA, 19 nt, Human adenovirus C
ggagcggggggcuucugag

SEQ ID NO: 3907816 - RNA, 22 nt, Human adenovirus C
ggagcuggugcugcgcgcggag

SEQ ID NO: 3907817 - RNA, 15 nt, Human adenovirus C
ggaggagaagcgcgc

SEQ ID NO: 3907818 - RNA, 21 nt, Human adenovirus C
ggaggagcaacagcaggagga

SEQ ID NO: 3907819 - RNA, 18 nt, Human adenovirus C
ggaggauaggguggccuu

SEQ ID NO: 3907820 - RNA, 15 nt, Human adenovirus C
ggaggcagcuggggc

SEQ ID NO: 3907821 - RNA, 17 nt, Human adenovirus C
ggagugcugggccagca

SEQ ID NO: 3907822 - RNA, 22 nt, Human adenovirus C
ggaguugcgcgccgacacgguu

SEQ ID NO: 3907823 - RNA, 17 nt, Human adenovirus C
ggaucacaaccccacca

SEQ ID NO: 3907824 - RNA, 22 nt, Human adenovirus C
ggaucaccuacgaugaccugga

SEQ ID NO: 3907825 - RNA, 22 nt, Human adenovirus C
ggaugaagaagaggaagaugaa

SEQ ID NO: 3907826 - RNA, 11 nt, Human adenovirus C
ggaugagcucg

SEQ ID NO: 3907827 - RNA, 17 nt, Human adenovirus C
ggcaacaacaguggcag

SEQ ID NO: 3907828 - RNA, 19 nt, Human adenovirus C
ggcaacccguuugcgcacc

SEQ ID NO: 3907829 - RNA, 18 nt, Human adenovirus C
ugggauuuuuuaauuaag

SEQ ID NO: 3907830 - RNA, 19 nt, Human adenovirus C
ugggcaccuaugacaagcg

SEQ ID NO: 3907831 - RNA, 13 nt, Human adenovirus C
ugggccgcggggg

SEQ ID NO: 3907832 - RNA, 16 nt, Human adenovirus C
ugggcguguggcagca

SEQ ID NO: 3907833 - RNA, 16 nt, Human adenovirus C
uggggauaugagaugc

SEQ ID NO: 3907834 - RNA, 19 nt, Human adenovirus C
uggggcuccucccaggcaa

SEQ ID NO: 3907835 - RNA, 15 nt, Human adenovirus C
ugggggcgcgcgggg

SEQ ID NO: 3907836 - RNA, 19 nt, Human adenovirus C
ugguccgugugcaccagcc

SEQ ID NO: 3907837 - RNA, 22 nt, Human adenovirus C
uggugcgcucgucgggcaccag

SEQ ID NO: 3907838 - RNA, 18 nt, Human adenovirus C
ugguggacgucgcgccgc

SEQ ID NO: 3907839 - RNA, 14 nt, Human adenovirus C
ugguggaggcgcgc

SEQ ID NO: 3907840 - RNA, 16 nt, Human adenovirus C
ugguuauuaugaaugu

SEQ ID NO: 3907841 - RNA, 20 nt, Human adenovirus C
uguaagcgaagacgacgagg

SEQ ID NO: 3907842 - RNA, 16 nt, Human adenovirus C
uguaccugccagacaa

SEQ ID NO: 3907843 - RNA, 19 nt, Human adenovirus C
uguacucguucuucagaaa

SEQ ID NO: 3907844 - RNA, 11 nt, Human adenovirus C
uguagguacuc

SEQ ID NO: 3907845 - RNA, 15 nt, Human adenovirus C
uguauauuaaugcau

SEQ ID NO: 3907846 - RNA, 18 nt, Human adenovirus C
uguaugcuauauuucaac

SEQ ID NO: 3907847 - RNA, 15 nt, Human adenovirus C
uguauuuuuuccagg

SEQ ID NO: 3907848 - RNA, 17 nt, Human adenovirus C
ugucagccgcgcgcugg

SEQ ID NO: 3907849 - RNA, 16 nt, Human adenovirus C
ugucgcccucuucggc

SEQ ID NO: 3907850 - RNA, 16 nt, Human adenovirus C
ugucgcgcaccucgcg

SEQ ID NO: 3907851 - RNA, 19 nt, Human adenovirus C
ugucugcgagggccagcug

SEQ ID NO: 3907852 - RNA, 15 nt, Human adenovirus C
ugugaguuggaugau

SEQ ID NO: 3907853 - RNA, 14 nt, Human adenovirus C
uguggaaaaaucaa

SEQ ID NO: 3907854 - RNA, 18 nt, Human adenovirus C
uguggccuccgacugugg

SEQ ID NO: 3907855 - RNA, 19 nt, Human adenovirus C
ugugguacuucccagagac

SEQ ID NO: 3907856 - RNA, 12 nt, Human adenovirus C
uguuccaccgcu

SEQ ID NO: 3907857 - RNA, 22 nt, Human adenovirus C
uguucuaauggagaacuccuca

SEQ ID NO: 3907858 - RNA, 22 nt, Human adenovirus C
uguuuggaagauuuuucugcug

SEQ ID NO: 3907859 - RNA, 23 nt, Human adenovirus C
uguuuggaagauuuuucugcugu

SEQ ID NO: 3907860 - RNA, 14 nt, Human adenovirus C
uguuuugcugauuu

SEQ ID NO: 3907861 - RNA, 21 nt, Human adenovirus C
uuaaaucagcacaguaacugc

SEQ ID NO: 3907862 - RNA, 15 nt, Human adenovirus C
uuaagggugggaaag

SEQ ID NO: 3907863 - RNA, 19 nt, Human adenovirus C
uuacuuauuucugugcuac

SEQ ID NO: 3907864 - RNA, 11 nt, Human adenovirus C
uuagcccaaga

SEQ ID NO: 3907865 - RNA, 14 nt, Human adenovirus C
uuagcgaaagucaa

SEQ ID NO: 3907866 - RNA, 14 nt, Human adenovirus C
uuagcguacaguca

SEQ ID NO: 3907867 - RNA, 20 nt, Human adenovirus C
uuagguucuacgaagaccaa

SEQ ID NO: 3907868 - RNA, 19 nt, Human adenovirus C
uuauaacagcacuggcaac

SEQ ID NO: 3907869 - RNA, 18 nt, Human adenovirus C
uuauacgccaucaucucu

SEQ ID NO: 3907870 - RNA, 14 nt, Human adenovirus C
uucaaaaucccaca

SEQ ID NO: 3907871 - RNA, 22 nt, Human adenovirus C
uucaacuacaccgucaagaaaa

SEQ ID NO: 3907872 - RNA, 18 nt, Human adenovirus C
uucagagaagaacaugcc

SEQ ID NO: 3907873 - RNA, 14 nt, Human adenovirus C
uucaucccugugga

SEQ ID NO: 3907874 - RNA, 14 nt, Human adenovirus C
uuccaccgcucugc

SEQ ID NO: 3907875 - RNA, 17 nt, Human adenovirus C
uuccagaaagcuacaag

SEQ ID NO: 3907876 - RNA, 20 nt, Human adenovirus C
uuccauaagggccuccccuu

SEQ ID NO: 3907877 - RNA, 23 nt, Human adenovirus C
uuccauaggugauagaaccagau

SEQ ID NO: 3907878 - RNA, 23 nt, Human adenovirus C
uuccaugagccgguguccacgcu

SEQ ID NO: 3907879 - RNA, 16 nt, Human adenovirus C
uucccagcaucgcuac

SEQ ID NO: 3907880 - RNA, 20 nt, Human adenovirus C
uucccccguaacauccugca

SEQ ID NO: 3907881 - RNA, 17 nt, Human adenovirus C
uuccuaucaaccagaac

SEQ ID NO: 3907882 - RNA, 10 nt, Human adenovirus C
uuccucccaa

SEQ ID NO: 3907883 - RNA, 21 nt, Human adenovirus C
uuccuccggaaacagggacga

SEQ ID NO: 3907884 - RNA, 19 nt, Human adenovirus C
uucgcgaccgcgagggaga

SEQ ID NO: 3907885 - RNA, 17 nt, Human adenovirus C
uucugccacgaagaagu

SEQ ID NO: 3907886 - RNA, 23 nt, Human adenovirus C
uugacaugaccaugaagaucugg

SEQ ID NO: 3907887 - RNA, 18 nt, Human adenovirus C
uugaucaaacccagcuuc

SEQ ID NO: 3907888 - RNA, 15 nt, Human adenovirus C
uugaugaaaagaaaa

SEQ ID NO: 3907889 - RNA, 23 nt, Human adenovirus C
uugcaggggcuguggggggugcg

SEQ ID NO: 3907890 - RNA, 20 nt, Human adenovirus C
uugcauacggccgccagagc

SEQ ID NO: 3907891 - RNA, 22 nt, Human adenovirus C
uugcauuucccacgcuuugagu

SEQ ID NO: 3907892 - RNA, 13 nt, Human adenovirus C
uugccaggggcag

SEQ ID NO: 3907893 - RNA, 18 nt, Human adenovirus C
uugccaggggcaggcccu

SEQ ID NO: 3907894 - RNA, 16 nt, Human adenovirus C
uugcccgugcacucca

SEQ ID NO: 3907895 - RNA, 16 nt, Human adenovirus C
uugcgucucuggcccc

SEQ ID NO: 3907896 - RNA, 18 nt, Human adenovirus C
uugcugcgcccacaccua

SEQ ID NO: 3907897 - RNA, 18 nt, Human adenovirus C
uuggacgcaauggccaaa

SEQ ID NO: 3907898 - RNA, 16 nt, Human adenovirus C
uuggguauccugucug

SEQ ID NO: 3907899 - RNA, 21 nt, Human adenovirus C
uugucacccuuauccucaucu

SEQ ID NO: 3907900 - RNA, 12 nt, Human adenovirus C
uuguccagcuua

SEQ ID NO: 3907901 - RNA, 15 nt, Human adenovirus C
uuguuguaacccgcc

SEQ ID NO: 3907902 - RNA, 16 nt, Human adenovirus C
uuguuucuccacacaa

SEQ ID NO: 3907903 - RNA, 20 nt, Human adenovirus C
uuuaauuaaguauaugagca

SEQ ID NO: 3907904 - RNA, 16 nt, Human adenovirus C
uuuaccccccacccuu

SEQ ID NO: 3907905 - RNA, 20 nt, Human adenovirus C
uuuacgccaccuucuucccc

SEQ ID NO: 3907906 - RNA, 14 nt, Human adenovirus C
uuuacugcugcugg

SEQ ID NO: 3907907 - RNA, 14 nt, Human adenovirus C
uuuagcugcacgua

SEQ ID NO: 3907908 - RNA, 19 nt, Human adenovirus C
uuucacuccacaggcugcg

SEQ ID NO: 3907909 - RNA, 17 nt, Human adenovirus C
uuucauucaguaguaua

SEQ ID NO: 3907910 - RNA, 12 nt, Human adenovirus C
uuuccaggcuuu

SEQ ID NO: 3907911 - RNA, 15 nt, Human adenovirus C
uuucugccagcgccu

SEQ ID NO: 3907912 - RNA, 14 nt, Human adenovirus C
uuucuuaccucugg

SEQ ID NO: 3907913 - RNA, 17 nt, Human adenovirus C
uuuguccagcuuauuca

SEQ ID NO: 3907914 - RNA, 20 nt, Human adenovirus C
uuuuuggccacuggccgcgc

SEQ ID NO: 3907915 - RNA, 18 nt, Human adenovirus C
ugcucccaaaccucagcg

SEQ ID NO: 3907916 - RNA, 20 nt, Human adenovirus C
ugcuccucguuuagccaggu

SEQ ID NO: 3907917 - RNA, 23 nt, Human adenovirus C
ugcugacacuguaccgcgaggcc

SEQ ID NO: 3907918 - RNA, 22 nt, Human adenovirus C
ugcugacccggagaugcagcgc

SEQ ID NO: 3907919 - RNA, 14 nt, Human adenovirus C
ugcugagccgccgu

SEQ ID NO: 3907920 - RNA, 19 nt, Human adenovirus C
ugcugcaccugcgugaggg

SEQ ID NO: 3907921 - RNA, 19 nt, Human adenovirus C
ugcugcccacgcuugcacc

SEQ ID NO: 3907922 - RNA, 19 nt, Human adenovirus C
ugcugccgccgccgcuccg

SEQ ID NO: 3907923 - RNA, 18 nt, Human adenovirus C
ugcuggaugugaccgagg

SEQ ID NO: 3907924 - RNA, 13 nt, Human adenovirus C
ugcuggucaggca

SEQ ID NO: 3907925 - RNA, 22 nt, Human adenovirus C
ugcuuaaaaaaacaacucccau

SEQ ID NO: 3907926 - RNA, 21 nt, Human adenovirus C
ugcuuaacaguccccagguac

SEQ ID NO: 3907927 - RNA, 12 nt, Human adenovirus C
ugcuugccaccu

SEQ ID NO: 3907928 - RNA, 16 nt, Human adenovirus C
ugcuugcgcuuaaaau

SEQ ID NO: 3907929 - RNA, 19 nt, Human adenovirus C
uggaacagcagcacaggcc

SEQ ID NO: 3907930 - RNA, 19 nt, Human adenovirus C
uggacaccuccgcaccacu

SEQ ID NO: 3907931 - RNA, 13 nt, Human adenovirus C
uggaccucccggc

SEQ ID NO: 3907932 - RNA, 13 nt, Human adenovirus C
uggaccuggccaa

SEQ ID NO: 3907933 - RNA, 13 nt, Human adenovirus C
uggacuucaccca

SEQ ID NO: 3907934 - RNA, 16 nt, Human adenovirus C
uggacuuggaggaggg

SEQ ID NO: 3907935 - RNA, 15 nt, Human adenovirus C
uggagacugcagccu

SEQ ID NO: 3907936 - RNA, 18 nt, Human adenovirus C
uggagaugcgggccauga

SEQ ID NO: 3907937 - RNA, 15 nt, Human adenovirus C
uggaggaggcgccgc

SEQ ID NO: 3907938 - RNA, 14 nt, Human adenovirus C
uggaggaggcgcgc

SEQ ID NO: 3907939 - RNA, 17 nt, Human adenovirus C
uggaggaggcgcgcaac

SEQ ID NO: 3907940 - RNA, 14 nt, Human adenovirus C
uggcaaccaccgcu

SEQ ID NO: 3907941 - RNA, 16 nt, Human adenovirus C
uggcacaacacaggca

SEQ ID NO: 3907942 - RNA, 23 nt, Human adenovirus C
uggcacccaaaaagaagcugcag

SEQ ID NO: 3907943 - RNA, 15 nt, Human adenovirus C
uggcaccgggacugg

SEQ ID NO: 3907944 - RNA, 16 nt, Human adenovirus C
uggcacuuaggccaga

SEQ ID NO: 3907945 - RNA, 23 nt, Human adenovirus C
uggcagcaaggccuggaacagca

SEQ ID NO: 3907946 - RNA, 21 nt, Human adenovirus C
uggcagcaaugccuggaggag

SEQ ID NO: 3907947 - RNA, 17 nt, Human adenovirus C
uggcauuagcggggugg

SEQ ID NO: 3907948 - RNA, 22 nt, Human adenovirus C
uggccauuaccuuugacucuuc

SEQ ID NO: 3907949 - RNA, 18 nt, Human adenovirus C
uggccguagguggcgccc

SEQ ID NO: 3907950 - RNA, 20 nt, Human adenovirus C
uggcgaccccucauaaacac

SEQ ID NO: 3907951 - RNA, 21 nt, Human adenovirus C
uggcgaucguaaacgcgcugg

SEQ ID NO: 3907952 - RNA, 14 nt, Human adenovirus C
uggcgaugagcagc

SEQ ID NO: 3907953 - RNA, 22 nt, Human adenovirus C
uggcgaugagcagcuggcgcgc

SEQ ID NO: 3907954 - RNA, 20 nt, Human adenovirus C
uggcgccuucagcuggggcu

SEQ ID NO: 3907955 - RNA, 21 nt, Human adenovirus C
uggcgguguguucugccacga

SEQ ID NO: 3907956 - RNA, 20 nt, Human adenovirus C
uggcuauaggacugaugcau

SEQ ID NO: 3907957 - RNA, 13 nt, Human adenovirus C
ugggaaacuggca

SEQ ID NO: 3907958 - RNA, 20 nt, Human adenovirus C
ugggaacucaacuaaugcaa

SEQ ID NO: 3907959 - RNA, 15 nt, Human adenovirus C
ugggauaugcuccag

SEQ ID NO: 3907960 - RNA, 21 nt, Human adenovirus C
ugggcauccgcaagcggcaac

SEQ ID NO: 3907961 - RNA, 14 nt, Human adenovirus C
ugggccggggugcg

SEQ ID NO: 3907962 - RNA, 17 nt, Human adenovirus C
ugggcguguggcagcaa

SEQ ID NO: 3907963 - RNA, 14 nt, Human adenovirus C
ggcauuaacaugga

SEQ ID NO: 3907964 - RNA, 23 nt, Human adenovirus C
ggccaaucaagcagguggcaccg

SEQ ID NO: 3907965 - RNA, 18 nt, Human adenovirus C
ggccacuacccggaccag

SEQ ID NO: 3907966 - RNA, 11 nt, Human adenovirus C
ggccagaugcu

SEQ ID NO: 3907967 - RNA, 22 nt, Human adenovirus C
ggccagggugcgcuugaggcug

SEQ ID NO: 3907968 - RNA, 21 nt, Human adenovirus C
ggccauuagugcuaugacuca

SEQ ID NO: 3907969 - RNA, 16 nt, Human adenovirus C
ggccauuuccuucucc

SEQ ID NO: 3907970 - RNA, 19 nt, Human adenovirus C
ggccauuuuuucuggggug

SEQ ID NO: 3907971 - RNA, 21 nt, Human adenovirus C
ggccccgcgacacggcucgcg

SEQ ID NO: 3907972 - RNA, 20 nt, Human adenovirus C
ggcccuggcuggcacgggca

SEQ ID NO: 3907973 - RNA, 16 nt, Human adenovirus C
ggccgacgggcggcca

SEQ ID NO: 3907974 - RNA, 15 nt, Human adenovirus C
ggccgccgaccuggu

SEQ ID NO: 3907975 - RNA, 22 nt, Human adenovirus C
ggccggaaaccucaccucccaa

SEQ ID NO: 3907976 - RNA, 16 nt, Human adenovirus C
ggccggugaggcgugc

SEQ ID NO: 3907977 - RNA, 15 nt, Human adenovirus C
ggccguggagacagu

SEQ ID NO: 3907978 - RNA, 17 nt, Human adenovirus C
ggccuccccuucuucuu

SEQ ID NO: 3907979 - RNA, 17 nt, Human adenovirus C
ggccuccgacugugguu

SEQ ID NO: 3907980 - RNA, 12 nt, Human adenovirus C
ggccugcagacc

SEQ ID NO: 3907981 - RNA, 18 nt, Human adenovirus C
ggccugcgcgugcccgug

SEQ ID NO: 3907982 - RNA, 18 nt, Human adenovirus C
ggccugguaggcgcagca

SEQ ID NO: 3907983 - RNA, 19 nt, Human adenovirus C
ggccuggucuacgacgcgc

SEQ ID NO: 3907984 - RNA, 15 nt, Human adenovirus C
ggccuuugccuggaa

SEQ ID NO: 3907985 - RNA, 23 nt, Human adenovirus C
ggcgaucguaaacgcgcuggccg

SEQ ID NO: 3907986 - RNA, 13 nt, Human adenovirus C
ggcgaugagcagc

SEQ ID NO: 3907987 - RNA, 21 nt, Human adenovirus C
ggcgaugagcagcuggcgcgc

SEQ ID NO: 3907988 - RNA, 22 nt, Human adenovirus C
ggcgauuucggccaugaacugc

SEQ ID NO: 3907989 - RNA, 17 nt, Human adenovirus C
ggcgcagcaucccuuuu

SEQ ID NO: 3907990 - RNA, 12 nt, Human adenovirus C
ggcgcaggcggc

SEQ ID NO: 3907991 - RNA, 18 nt, Human adenovirus C
ggcgccuucagcuggggc

SEQ ID NO: 3907992 - RNA, 19 nt, Human adenovirus C
ggcgccuucagcuggggcu

SEQ ID NO: 3907993 - RNA, 13 nt, Human adenovirus C
ggcgcgcccgcca

SEQ ID NO: 3907994 - RNA, 13 nt, Human adenovirus C
ggcgcgcggaaag

SEQ ID NO: 3907995 - RNA, 17 nt, Human adenovirus C
ggcgcggcggcugcugc

SEQ ID NO: 3907996 - RNA, 15 nt, Human adenovirus C
ggcgcggcuaggagc

SEQ ID NO: 3907997 - RNA, 16 nt, Human adenovirus C
ggcgcggcuaggagcg

SEQ ID NO: 3907998 - RNA, 15 nt, Human adenovirus C
ggcgcgggcacaaga

SEQ ID NO: 3907999 - RNA, 14 nt, Human adenovirus C
ggcgcguucguccu

SEQ ID NO: 3908000 - RNA, 20 nt, Human adenovirus C
ggcgcucguugguccagcag

SEQ ID NO: 3908001 - RNA, 17 nt, Human adenovirus C
ggcgcugcagagccagc

SEQ ID NO: 3908002 - RNA, 21 nt, Human adenovirus C
ggcggcccugcuuaaccgcgc

SEQ ID NO: 3908003 - RNA, 15 nt, Human adenovirus C
ggcggcggcgcgcaa

SEQ ID NO: 3908004 - RNA, 14 nt, Human adenovirus C
ggcggcggcggagu

SEQ ID NO: 3908005 - RNA, 15 nt, Human adenovirus C
ggcggcguggaggaa

SEQ ID NO: 3908006 - RNA, 15 nt, Human adenovirus C
ggcgggagcuccugc

SEQ ID NO: 3908007 - RNA, 22 nt, Human adenovirus C
ggcggggauggcgcaggcggcg

SEQ ID NO: 3908008 - RNA, 19 nt, Human adenovirus C
ggcguggcccuuggcgcgc

SEQ ID NO: 3908009 - RNA, 22 nt, Human adenovirus C
ggcguugccgcuggacgagggc

SEQ ID NO: 3908010 - RNA, 20 nt, Human adenovirus C
ggcuaagugggagggguagc

SEQ ID NO: 3908011 - RNA, 19 nt, Human adenovirus C
ggcuccuuugucuggagaa

SEQ ID NO: 3908012 - RNA, 19 nt, Human adenovirus C
ggcucgcgaaggaggcagg

SEQ ID NO: 3908013 - RNA, 13 nt, Human adenovirus C
ggcucgcucccug

SEQ ID NO: 3908014 - RNA, 18 nt, Human adenovirus C
ggcucuagcgaugaagau

SEQ ID NO: 3908015 - RNA, 14 nt, Human adenovirus C
ggcugcagccaggg

SEQ ID NO: 3908016 - RNA, 16 nt, Human adenovirus C
ggcugcgcaccaucac

SEQ ID NO: 3908017 - RNA, 14 nt, Human adenovirus C
ggcugcuguugcuu

SEQ ID NO: 3908018 - RNA, 17 nt, Human adenovirus C
ggcuggagcccgagguc

SEQ ID NO: 3908019 - RNA, 10 nt, Human adenovirus C
ggcuggggcc

SEQ ID NO: 3908020 - RNA, 18 nt, Human adenovirus C
ggcugguccugcuggugc

SEQ ID NO: 3908021 - RNA, 13 nt, Human adenovirus C
ggcuugcucgccc

SEQ ID NO: 3908022 - RNA, 23 nt, Human adenovirus C
gggaauuugagccccucgccugg

SEQ ID NO: 3908023 - RNA, 16 nt, Human adenovirus C
gggacacauaccuagg

SEQ ID NO: 3908024 - RNA, 17 nt, Human adenovirus C
gggacccgccgggagag

SEQ ID NO: 3908025 - RNA, 16 nt, Human adenovirus C
gggacgcucuggccgg

SEQ ID NO: 3908026 - RNA, 15 nt, Human adenovirus C
gggagcgaggagguc

SEQ ID NO: 3908027 - RNA, 12 nt, Human adenovirus C
gggaggcggcgg

SEQ ID NO: 3908028 - RNA, 17 nt, Human adenovirus C
gggcagccuggaggcaa

SEQ ID NO: 3908029 - RNA, 19 nt, Human adenovirus C
gggcaggggcuaaaggggg

SEQ ID NO: 3908030 - RNA, 13 nt, Human adenovirus C
gggccaagaacaa

SEQ ID NO: 3908031 - RNA, 11 nt, Human adenovirus C
gggccagcaca

SEQ ID NO: 3908032 - RNA, 22 nt, Human adenovirus C
gggcccacgggcggcggccugg

SEQ ID NO: 3908033 - RNA, 16 nt, Human adenovirus C
gggcgcaguaguccag

SEQ ID NO: 3908034 - RNA, 17 nt, Human adenovirus C
gggcgcaguuggaagac

SEQ ID NO: 3908035 - RNA, 22 nt, Human adenovirus C
gggcgccgagcuguugcccgug

SEQ ID NO: 3908036 - RNA, 14 nt, Human adenovirus C
gggcuaaagggggu

SEQ ID NO: 3908037 - RNA, 16 nt, Human adenovirus C
gggcuagguccaggug

SEQ ID NO: 3908038 - RNA, 14 nt, Human adenovirus C
gggcuggcgguggc

SEQ ID NO: 3908039 - RNA, 13 nt, Human adenovirus C
ggggcagugcaga

SEQ ID NO: 3908040 - RNA, 17 nt, Human adenovirus C
uuggacaccuccgcacc

SEQ ID NO: 3908041 - RNA, 12 nt, Human adenovirus C
uugguccagcag

SEQ ID NO: 3908042 - RNA, 22 nt, Human adenovirus C
uuguaaaaaucugcuccagagc

SEQ ID NO: 3908043 - RNA, 22 nt, Human adenovirus C
uuguaaauaucaggaauuguug

SEQ ID NO: 3908044 - RNA, 16 nt, Human adenovirus C
uuuaaugacuaccuuu

SEQ ID NO: 3908045 - RNA, 16 nt, Human adenovirus C
uuuacugcugcuggaa

SEQ ID NO: 3908046 - RNA, 21 nt, Human adenovirus C
uuuagagaacacuggcaccuu

SEQ ID NO: 3908047 - RNA, 16 nt, Human adenovirus C
uuuccauuuuaugaaa

SEQ ID NO: 3908048 - RNA, 18 nt, Human adenovirus C
uuucgcgcugcuccucuu

SEQ ID NO: 3908049 - RNA, 20 nt, Human adenovirus C
uuugacgcggugaaagacuc

SEQ ID NO: 3908050 - RNA, 21 nt, Human adenovirus C
uuugacgcugcgguucauccc

SEQ ID NO: 3908051 - RNA, 12 nt, Human adenovirus C
uuugagccccuc

SEQ ID NO: 3908052 - RNA, 23 nt, Human adenovirus C
uuugccuccccgucaugcaagac

SEQ ID NO: 3908053 - RNA, 17 nt, Human adenovirus C
uuugucacuugaaaaac

SEQ ID NO: 3908054 - RNA, 15 nt, Human adenovirus C
aaaaacaaagucaaa

SEQ ID NO: 3908055 - RNA, 19 nt, Human adenovirus C
aaaacccaaagucaaacug

SEQ ID NO: 3908056 - RNA, 15 nt, Human adenovirus C
aaaaccuccuccucc

SEQ ID NO: 3908057 - RNA, 14 nt, Human adenovirus C
aaaagaaccugccu

SEQ ID NO: 3908058 - RNA, 18 nt, Human adenovirus C
aaaagaagcaagcaacau

SEQ ID NO: 3908059 - RNA, 20 nt, Human adenovirus C
aaaagaagcugcagcugccg

SEQ ID NO: 3908060 - RNA, 19 nt, Human adenovirus C
aaaauacaaccccaccaau

SEQ ID NO: 3908061 - RNA, 21 nt, Human adenovirus C
aaaaugaugacaaacuuaccc

SEQ ID NO: 3908062 - RNA, 21 nt, Human adenovirus C
aaacaacucgcugcugcagcc

SEQ ID NO: 3908063 - RNA, 16 nt, Human adenovirus C
aaacaauuacaaaaag

SEQ ID NO: 3908064 - RNA, 13 nt, Human adenovirus C
aaacccaaaguca

SEQ ID NO: 3908065 - RNA, 19 nt, Human adenovirus C
aaacccaaagucaaacugc

SEQ ID NO: 3908066 - RNA, 18 nt, Human adenovirus C
aaacccaaauagcaagcc

SEQ ID NO: 3908067 - RNA, 19 nt, Human adenovirus C
aaaccgggccuccaacugu

SEQ ID NO: 3908068 - RNA, 14 nt, Human adenovirus C
aaaccucaccuccc

SEQ ID NO: 3908069 - RNA, 16 nt, Human adenovirus C
aaaccucagcgccucc

SEQ ID NO: 3908070 - RNA, 23 nt, Human adenovirus C
aaaccuucucuacgccaacuccg

SEQ ID NO: 3908071 - RNA, 21 nt, Human adenovirus C
aaacuccgauacacuaacagu

SEQ ID NO: 3908072 - RNA, 23 nt, Human adenovirus C
aaacucuucgcggucuuuccagu

SEQ ID NO: 3908073 - RNA, 14 nt, Human adenovirus C
aaagaugacaccga

SEQ ID NO: 3908074 - RNA, 17 nt, Human adenovirus C
aaagcaggggccaagaa

SEQ ID NO: 3908075 - RNA, 14 nt, Human adenovirus C
aaagcaugaugcaa

SEQ ID NO: 3908076 - RNA, 19 nt, Human adenovirus C
aaagccaccugagccuuug

SEQ ID NO: 3908077 - RNA, 11 nt, Human adenovirus C
aaagcgcgggc

SEQ ID NO: 3908078 - RNA, 23 nt, Human adenovirus C
aaagcggaacauuaacaaaaaua

SEQ ID NO: 3908079 - RNA, 23 nt, Human adenovirus C
aaaggcuacaggggccucuucuu

SEQ ID NO: 3908080 - RNA, 12 nt, Human adenovirus C
aaaguccagaug

SEQ ID NO: 3908081 - RNA, 12 nt, Human adenovirus C
aaauagcaagcc

SEQ ID NO: 3908082 - RNA, 17 nt, Human adenovirus C
aaaugaugacaaacuua

SEQ ID NO: 3908083 - RNA, 17 nt, Human adenovirus C
aacaaacagagcgauuu

SEQ ID NO: 3908084 - RNA, 15 nt, Human adenovirus C
aacaaagucaaacau

SEQ ID NO: 3908085 - RNA, 16 nt, Human adenovirus C
aacaaagucaaacaua

SEQ ID NO: 3908086 - RNA, 12 nt, Human adenovirus C
aacaacagcgcc

SEQ ID NO: 3908087 - RNA, 14 nt, Human adenovirus C
aacaaguuuagaaa

SEQ ID NO: 3908088 - RNA, 16 nt, Human adenovirus C
aacaaucuaugccaaa

SEQ ID NO: 3908089 - RNA, 10 nt, Human adenovirus C
aacaggaggg

SEQ ID NO: 3908090 - RNA, 15 nt, Human adenovirus C
aacaguggcaaccac

SEQ ID NO: 3908091 - RNA, 21 nt, Human adenovirus C
aacaugguguguggcaacugc

SEQ ID NO: 3908092 - RNA, 12 nt, Human adenovirus C
aaccaccagcac

SEQ ID NO: 3908093 - RNA, 16 nt, Human adenovirus C
aaccauaucccaggga

SEQ ID NO: 3908094 - RNA, 18 nt, Human adenovirus C
aacccaauccccccgccg

SEQ ID NO: 3908095 - RNA, 15 nt, Human adenovirus C
aacccacacaaugaa

SEQ ID NO: 3908096 - RNA, 19 nt, Human adenovirus C
aaccccaccaauguggaaa

SEQ ID NO: 3908097 - RNA, 16 nt, Human adenovirus C
aacccuuccaggaggg

SEQ ID NO: 3908098 - RNA, 15 nt, Human adenovirus C
aaccuaaaugccaac

SEQ ID NO: 3908099 - RNA, 17 nt, Human adenovirus C
aaccuaaaugccaaccu

SEQ ID NO: 3908100 - RNA, 13 nt, Human adenovirus C
aaccuacgucacc

SEQ ID NO: 3908101 - RNA, 14 nt, Human adenovirus C
aaccuauggagaaa

SEQ ID NO: 3908102 - RNA, 13 nt, Human adenovirus C
aaccucaccuccc

SEQ ID NO: 3908103 - RNA, 20 nt, Human adenovirus C
aaccugagccaggcuuucaa

SEQ ID NO: 3908104 - RNA, 18 nt, Human adenovirus C
aacgaagcuauguccaag

SEQ ID NO: 3908105 - RNA, 13 nt, Human adenovirus C
aacgaccacagca

SEQ ID NO: 3908106 - RNA, 18 nt, Human adenovirus C
aacgcagcaucgagguca

SEQ ID NO: 3908107 - RNA, 14 nt, Human adenovirus C
aacgcgccuaccac

SEQ ID NO: 3908108 - RNA, 11 nt, Human adenovirus C
aacuacugcca

SEQ ID NO: 3908109 - RNA, 19 nt, Human adenovirus C
aacucugguaucucagccg

SEQ ID NO: 3908110 - RNA, 19 nt, Human adenovirus C
aacugcuuagcgaaaguca

SEQ ID NO: 3908111 - RNA, 18 nt, Human adenovirus C
aacuggccccaaacuccc

SEQ ID NO: 3908112 - RNA, 21 nt, Human adenovirus C
aacuggccccaaacucccaug

SEQ ID NO: 3908113 - RNA, 21 nt, Human adenovirus C
aacuggugcuuauggugggag

SEQ ID NO: 3908114 - RNA, 19 nt, Human adenovirus C
aacuuugauaauacugcca

SEQ ID NO: 3908115 - RNA, 12 nt, Human adenovirus C
aacuuugccaug

SEQ ID NO: 3908116 - RNA, 18 nt, Human adenovirus C
aagaaagucccccuggag

SEQ ID NO: 3908117 - RNA, 13 nt, Human adenovirus C
aagaagagcaaaa

SEQ ID NO: 3908118 - RNA, 21 nt, Human adenovirus C
aagacguguuuugcgacccgg

SEQ ID NO: 3908119 - RNA, 16 nt, Human adenovirus C
aagagacgcucggugc

SEQ ID NO: 3908120 - RNA, 19 nt, Human adenovirus C
aagaucuggaaggugcuga

SEQ ID NO: 3908121 - RNA, 20 nt, Human adenovirus C
aagaucuugguugugggcca

SEQ ID NO: 3908122 - RNA, 12 nt, Human adenovirus C
aagauggcuacc

SEQ ID NO: 3908123 - RNA, 11 nt, Human adenovirus C
aagcaaaacca

SEQ ID NO: 3908124 - RNA, 15 nt, Human adenovirus C
aagcaaaccucaccu

SEQ ID NO: 3908125 - RNA, 21 nt, Human adenovirus C
aagcaagauguuuggcggggc

SEQ ID NO: 3908126 - RNA, 15 nt, Human adenovirus C
aagcaggccaaacuu

SEQ ID NO: 3908127 - RNA, 22 nt, Human adenovirus C
aagcagguuccugagcagcugc

SEQ ID NO: 3908128 - RNA, 23 nt, Human adenovirus C
aagcagguuccugagcagcugcg

SEQ ID NO: 3908129 - RNA, 21 nt, Human adenovirus C
aagcccgugacacugcagcag

SEQ ID NO: 3908130 - RNA, 15 nt, Human adenovirus C
aagcgcagacgcgcc

SEQ ID NO: 3908131 - RNA, 14 nt, Human adenovirus C
aagcgcgcuggagc

SEQ ID NO: 3908132 - RNA, 20 nt, Human adenovirus C
aagcgcgcuggagcaaaacc

SEQ ID NO: 3908133 - RNA, 22 nt, Human adenovirus C
aagcgcucgaucaucuccccgc

SEQ ID NO: 3908134 - RNA, 22 nt, Human adenovirus C
aaggacugguuccuggugcaga

SEQ ID NO: 3908135 - RNA, 18 nt, Human adenovirus C
aaggccggaaaccucacc

SEQ ID NO: 3908136 - RNA, 12 nt, Human adenovirus C
aaggccuggcca

SEQ ID NO: 3908137 - RNA, 16 nt, Human adenovirus C
aaggccuggccagugu

SEQ ID NO: 3908138 - RNA, 15 nt, Human adenovirus C
aaggcuaauggcaau

SEQ ID NO: 3908139 - RNA, 15 nt, Human adenovirus C
aaggcuacaggggcc

SEQ ID NO: 3908140 - RNA, 19 nt, Human adenovirus C
aagggcacgagcugcuucc

SEQ ID NO: 3908141 - RNA, 20 nt, Human adenovirus C
aagggugcaugcccaggcuu

SEQ ID NO: 3908142 - RNA, 22 nt, Human adenovirus C
aaguauuccauagagcagcuga

SEQ ID NO: 3908143 - RNA, 17 nt, Human adenovirus C
aagucuaagcagccgcc

SEQ ID NO: 3908144 - RNA, 20 nt, Human adenovirus C
aagugauuaucgagcaggac

SEQ ID NO: 3908145 - RNA, 21 nt, Human adenovirus C
aagugauuaucgagcaggacc

SEQ ID NO: 3908146 - RNA, 13 nt, Human adenovirus C
aauacaacauggc

SEQ ID NO: 3908147 - RNA, 11 nt, Human adenovirus C
aaucaaaauaa

SEQ ID NO: 3908148 - RNA, 18 nt, Human adenovirus C
aauccacagcggcggcag

SEQ ID NO: 3908149 - RNA, 23 nt, Human adenovirus C
aauccuguggugagcuguuugau

SEQ ID NO: 3908150 - RNA, 18 nt, Human adenovirus C
aaugaaaacggugccaug

SEQ ID NO: 3908151 - RNA, 16 nt, Human adenovirus C
aaugcgccgugggcua

SEQ ID NO: 3908152 - RNA, 20 nt, Human adenovirus C
aaugugaugggcuccagcau

SEQ ID NO: 3908153 - RNA, 19 nt, Human adenovirus C
aauucuguuuauucuuaua

SEQ ID NO: 3908154 - RNA, 22 nt, Human adenovirus C
acaaacuccacccccucauuau

SEQ ID NO: 3908155 - RNA, 23 nt, Human adenovirus C
acaacagcugccgccaugggcuc

SEQ ID NO: 3908156 - RNA, 20 nt, Human adenovirus C
acaacaguggcagcggcgcg

SEQ ID NO: 3908157 - RNA, 12 nt, Human adenovirus C
acaagcagcugg

SEQ ID NO: 3908158 - RNA, 16 nt, Human adenovirus C
acaaggccugcagacc

SEQ ID NO: 3908159 - RNA, 16 nt, Human adenovirus C
acaagugcuuugcccg

SEQ ID NO: 3908160 - RNA, 13 nt, Human adenovirus C
acaauaaauuacu

SEQ ID NO: 3908161 - RNA, 20 nt, Human adenovirus C
acaauauuggcuaccagggc

SEQ ID NO: 3908162 - RNA, 17 nt, Human adenovirus C
acaaugaaaaaauucau

SEQ ID NO: 3908163 - RNA, 20 nt, Human adenovirus C
acacaccucgaccacugccg

SEQ ID NO: 3908164 - RNA, 14 nt, Human adenovirus C
acacaggcuggggc

SEQ ID NO: 3908165 - RNA, 19 nt, Human adenovirus C
acacaugucuaugcccagg

SEQ ID NO: 3908166 - RNA, 20 nt, Human adenovirus C
acacccagaaaaccgcacgc

SEQ ID NO: 3908167 - RNA, 15 nt, Human adenovirus C
acaccgaacagcgcc

SEQ ID NO: 3908168 - RNA, 16 nt, Human adenovirus C
acaccuaccgccccag

SEQ ID NO: 3908169 - RNA, 13 nt, Human adenovirus C
uccacgagccagg

SEQ ID NO: 3908170 - RNA, 23 nt, Human adenovirus C
uccacgcuggaagccaugcucag

SEQ ID NO: 3908171 - RNA, 15 nt, Human adenovirus C
uccagacgggccagg

SEQ ID NO: 3908172 - RNA, 15 nt, Human adenovirus C
uccaggaaguacggc

SEQ ID NO: 3908173 - RNA, 17 nt, Human adenovirus C
uccaggccagcacgaag

SEQ ID NO: 3908174 - RNA, 23 nt, Human adenovirus C
uccaggcgcggcggcugcugcgc

SEQ ID NO: 3908175 - RNA, 12 nt, Human adenovirus C
uccauacacaaa

SEQ ID NO: 3908176 - RNA, 18 nt, Human adenovirus C
uccauagagcagcugacc

SEQ ID NO: 3908177 - RNA, 13 nt, Human adenovirus C
uccauagcgcuua

SEQ ID NO: 3908178 - RNA, 15 nt, Human adenovirus C
uccauccggcccagg

SEQ ID NO: 3908179 - RNA, 17 nt, Human adenovirus C
uccaugggcgcacucac

SEQ ID NO: 3908180 - RNA, 15 nt, Human adenovirus C
ucccacacugcaggg

SEQ ID NO: 3908181 - RNA, 21 nt, Human adenovirus C
ucccagcaucgcuacaaccuc

SEQ ID NO: 3908182 - RNA, 13 nt, Human adenovirus C
ucccauagacaag

SEQ ID NO: 3908183 - RNA, 14 nt, Human adenovirus C
ucccaucgcgcaac

SEQ ID NO: 3908184 - RNA, 13 nt, Human adenovirus C
ucccauucuccag

SEQ ID NO: 3908185 - RNA, 15 nt, Human adenovirus C
uccccccgccgccgc

SEQ ID NO: 3908186 - RNA, 15 nt, Human adenovirus C
uccccuaucaggguc

SEQ ID NO: 3908187 - RNA, 16 nt, Human adenovirus C
uccccuuaguaugcag

SEQ ID NO: 3908188 - RNA, 13 nt, Human adenovirus C
ucccgcggcgaca

SEQ ID NO: 3908189 - RNA, 23 nt, Human adenovirus C
ucccugaccaaaugcgccagaag

SEQ ID NO: 3908190 - RNA, 16 nt, Human adenovirus C
ucccugggaucaggcu

SEQ ID NO: 3908191 - RNA, 16 nt, Human adenovirus C
ucccuuagaaccaaag

SEQ ID NO: 3908192 - RNA, 22 nt, Human adenovirus C
uccgaaccuuuggacaccuccc

SEQ ID NO: 3908193 - RNA, 20 nt, Human adenovirus C
uccgaucuaggcgcugcggc

SEQ ID NO: 3908194 - RNA, 13 nt, Human adenovirus C
uccgcaauacaga

SEQ ID NO: 3908195 - RNA, 20 nt, Human adenovirus C
uccgcacccacuaucuucau

SEQ ID NO: 3908196 - RNA, 19 nt, Human adenovirus C
uccgcauaccccgcgccac

SEQ ID NO: 3908197 - RNA, 15 nt, Human adenovirus C
uccgcgguccuccuc

SEQ ID NO: 3908198 - RNA, 20 nt, Human adenovirus C
uccgcguccagguccuccgc

SEQ ID NO: 3908199 - RNA, 19 nt, Human adenovirus C
uccgcuccucaggcgccgc

SEQ ID NO: 3908200 - RNA, 21 nt, Human adenovirus C
uccgggcugcgcgcuggccag

SEQ ID NO: 3908201 - RNA, 18 nt, Human adenovirus C
uccguagauguaccugga

SEQ ID NO: 3908202 - RNA, 14 nt, Human adenovirus C
uccguccugcagga

SEQ ID NO: 3908203 - RNA, 16 nt, Human adenovirus C
uccgugcgcuuuuugg

SEQ ID NO: 3908204 - RNA, 12 nt, Human adenovirus C
uccucaccugcc

SEQ ID NO: 3908205 - RNA, 15 nt, Human adenovirus C
uccuccagaagacgg

SEQ ID NO: 3908206 - RNA, 19 nt, Human adenovirus C
uccuccgggcacagcagcg

SEQ ID NO: 3908207 - RNA, 17 nt, Human adenovirus C
uccugaagcaaaaccag

SEQ ID NO: 3908208 - RNA, 12 nt, Human adenovirus C
uccugaaggggg

SEQ ID NO: 3908209 - RNA, 11 nt, Human adenovirus C
uccugccaggc

SEQ ID NO: 3908210 - RNA, 13 nt, Human adenovirus C
uccugccaggcuc

SEQ ID NO: 3908211 - RNA, 14 nt, Human adenovirus C
uccugccaggcuca

SEQ ID NO: 3908212 - RNA, 20 nt, Human adenovirus C
uccuuuaaugacuaccuuuc

SEQ ID NO: 3908213 - RNA, 12 nt, Human adenovirus C
ucgaccacugcc

SEQ ID NO: 3908214 - RNA, 19 nt, Human adenovirus C
ucgaggucacccacuuugc

SEQ ID NO: 3908215 - RNA, 16 nt, Human adenovirus C
ucgcaacaccacugcu

SEQ ID NO: 3908216 - RNA, 17 nt, Human adenovirus C
ucgccagcccgugcugg

SEQ ID NO: 3908217 - RNA, 22 nt, Human adenovirus C
ucgccagggcuacgugcgccag

SEQ ID NO: 3908218 - RNA, 18 nt, Human adenovirus C
ucgccggcgccccagaaa

SEQ ID NO: 3908219 - RNA, 18 nt, Human adenovirus C
ucgcgccgcaccgcgucc

SEQ ID NO: 3908220 - RNA, 19 nt, Human adenovirus C
ucgcgccuguugcugcugc

SEQ ID NO: 3908221 - RNA, 13 nt, Human adenovirus C
ucgcgcugcuccu

SEQ ID NO: 3908222 - RNA, 23 nt, Human adenovirus C
ucgcggacgcgguuccagauguu

SEQ ID NO: 3908223 - RNA, 18 nt, Human adenovirus C
ucgcguuucagccccccg

SEQ ID NO: 3908224 - RNA, 14 nt, Human adenovirus C
ucgggaagaacugg

SEQ ID NO: 3908225 - RNA, 14 nt, Human adenovirus C
ucgggaaugaaugu

SEQ ID NO: 3908226 - RNA, 14 nt, Human adenovirus C
ucgggccaggacgc

SEQ ID NO: 3908227 - RNA, 18 nt, Human adenovirus C
ucgggcggggggaccaaa

SEQ ID NO: 3908228 - RNA, 18 nt, Human adenovirus C
ucggggucaaaaaccagg

SEQ ID NO: 3908229 - RNA, 14 nt, Human adenovirus C
ucgugcgcaccacc

SEQ ID NO: 3908230 - RNA, 15 nt, Human adenovirus C
ucgugcgcaccaccg

SEQ ID NO: 3908231 - RNA, 15 nt, Human adenovirus C
ucguugguccagcag

SEQ ID NO: 3908232 - RNA, 23 nt, Human adenovirus C
ucuacagcuuccuggagcgccac

SEQ ID NO: 3908233 - RNA, 23 nt, Human adenovirus C
augcuauggaucuuaugccaggc

SEQ ID NO: 3908234 - RNA, 21 nt, Human adenovirus C
auggaaaaauaggaauuaaaa

SEQ ID NO: 3908235 - RNA, 13 nt, Human adenovirus C
auggaaauuaaaa

SEQ ID NO: 3908236 - RNA, 17 nt, Human adenovirus C
auggaagacugggacag

SEQ ID NO: 3908237 - RNA, 17 nt, Human adenovirus C
auggagaacuccucacu

SEQ ID NO: 3908238 - RNA, 19 nt, Human adenovirus C
auggaucuuaugccaggcc

SEQ ID NO: 3908239 - RNA, 20 nt, Human adenovirus C
auggaucuuaugccaggccu

SEQ ID NO: 3908240 - RNA, 14 nt, Human adenovirus C
auggcacccaaaaa

SEQ ID NO: 3908241 - RNA, 16 nt, Human adenovirus C
auggcccucaccugcc

SEQ ID NO: 3908242 - RNA, 17 nt, Human adenovirus C
auggccggccacggccu

SEQ ID NO: 3908243 - RNA, 14 nt, Human adenovirus C
auggccugcugcac

SEQ ID NO: 3908244 - RNA, 18 nt, Human adenovirus C
auggccuggccucuggca

SEQ ID NO: 3908245 - RNA, 23 nt, Human adenovirus C
auggcuaccggagugcugggcca

SEQ ID NO: 3908246 - RNA, 23 nt, Human adenovirus C
auggguguucuugcuggucaggc

SEQ ID NO: 3908247 - RNA, 18 nt, Human adenovirus C
augguacccaagcgccag

SEQ ID NO: 3908248 - RNA, 22 nt, Human adenovirus C
auguacaugagcaaacaguaca

SEQ ID NO: 3908249 - RNA, 22 nt, Human adenovirus C
auguaccuuacuuuaucucaaa

SEQ ID NO: 3908250 - RNA, 14 nt, Human adenovirus C
augucagccuugcc

SEQ ID NO: 3908251 - RNA, 14 nt, Human adenovirus C
augugccccucgcc

SEQ ID NO: 3908252 - RNA, 17 nt, Human adenovirus C
auguggaaucaggcugu

SEQ ID NO: 3908253 - RNA, 21 nt, Human adenovirus C
auguggccuccgacugugguu

SEQ ID NO: 3908254 - RNA, 21 nt, Human adenovirus C
auguuucuccacgccuuugcc

SEQ ID NO: 3908255 - RNA, 21 nt, Human adenovirus C
auuaaccuuggggcgcgcugg

SEQ ID NO: 3908256 - RNA, 19 nt, Human adenovirus C
auuaacgaggaugggcagg

SEQ ID NO: 3908257 - RNA, 17 nt, Human adenovirus C
auuacaaaaagcgggcu

SEQ ID NO: 3908258 - RNA, 15 nt, Human adenovirus C
auuaccauguacaug

SEQ ID NO: 3908259 - RNA, 18 nt, Human adenovirus C
auucaaccugccaccucc

SEQ ID NO: 3908260 - RNA, 14 nt, Human adenovirus C
auucccacgcccua

SEQ ID NO: 3908261 - RNA, 18 nt, Human adenovirus C
auuccucgaguucuuaua

SEQ ID NO: 3908262 - RNA, 21 nt, Human adenovirus C
auucguccauaaugauggcaa

SEQ ID NO: 3908263 - RNA, 17 nt, Human adenovirus C
auucuucucaaauacua

SEQ ID NO: 3908264 - RNA, 22 nt, Human adenovirus C
auugaaaaccauggaacugagg

SEQ ID NO: 3908265 - RNA, 17 nt, Human adenovirus C
auugcaucccaccuuuc

SEQ ID NO: 3908266 - RNA, 14 nt, Human adenovirus C
auugcguaccucag

SEQ ID NO: 3908267 - RNA, 13 nt, Human adenovirus C
auugcuugagccc

SEQ ID NO: 3908268 - RNA, 18 nt, Human adenovirus C
auugggguaacugacacc

SEQ ID NO: 3908269 - RNA, 23 nt, Human adenovirus C
auuugcaagacagaaacacagag

SEQ ID NO: 3908270 - RNA, 16 nt, Human adenovirus C
auuuucuggccaugca

SEQ ID NO: 3908271 - RNA, 20 nt, Human adenovirus C
auuuuuccaaaacaggaggu

SEQ ID NO: 3908272 - RNA, 21 nt, Human adenovirus C
caaaaacaugcuaccucuuug

SEQ ID NO: 3908273 - RNA, 16 nt, Human adenovirus C
caaaaggcaaacugcc

SEQ ID NO: 3908274 - RNA, 22 nt, Human adenovirus C
caaaauuggcaaguaugcugua

SEQ ID NO: 3908275 - RNA, 13 nt, Human adenovirus C
caaacaacaugga

SEQ ID NO: 3908276 - RNA, 16 nt, Human adenovirus C
caaacaacauggaaau

SEQ ID NO: 3908277 - RNA, 17 nt, Human adenovirus C
caaacaucagccccccu

SEQ ID NO: 3908278 - RNA, 19 nt, Human adenovirus C
caaacccagcuucagcuug

SEQ ID NO: 3908279 - RNA, 15 nt, Human adenovirus C
caaaccccugacaga

SEQ ID NO: 3908280 - RNA, 14 nt, Human adenovirus C
caaacgccaagaaa

SEQ ID NO: 3908281 - RNA, 15 nt, Human adenovirus C
caaacugcccucacg

SEQ ID NO: 3908282 - RNA, 20 nt, Human adenovirus C
caaagacaaaauuggcaagu

SEQ ID NO: 3908283 - RNA, 17 nt, Human adenovirus C
caaagcaaaccucaccu

SEQ ID NO: 3908284 - RNA, 18 nt, Human adenovirus C
caaagcagaccaaagcaa

SEQ ID NO: 3908285 - RNA, 14 nt, Human adenovirus C
caaagcccaagaaa

SEQ ID NO: 3908286 - RNA, 19 nt, Human adenovirus C
ugagggacaaguugaaaga

SEQ ID NO: 3908287 - RNA, 19 nt, Human adenovirus C
ugagguacgaugagacccg

SEQ ID NO: 3908288 - RNA, 22 nt, Human adenovirus C
ugagguggaucccauggacgag

SEQ ID NO: 3908289 - RNA, 21 nt, Human adenovirus C
ugagguguaccaguccgggcc

SEQ ID NO: 3908290 - RNA, 13 nt, Human adenovirus C
ugaugccuuugag

SEQ ID NO: 3908291 - RNA, 14 nt, Human adenovirus C
ugaugccuuugagg

SEQ ID NO: 3908292 - RNA, 21 nt, Human adenovirus C
ugaugcggaagggucccggca

SEQ ID NO: 3908293 - RNA, 18 nt, Human adenovirus C
ugaugggcuccagcauug

SEQ ID NO: 3908294 - RNA, 21 nt, Human adenovirus C
ugauuaaaugagacaugauuc

SEQ ID NO: 3908295 - RNA, 18 nt, Human adenovirus C
ugauucgggaguuuacca

SEQ ID NO: 3908296 - RNA, 18 nt, Human adenovirus C
ugcaaacaucagcccccc

SEQ ID NO: 3908297 - RNA, 16 nt, Human adenovirus C
ugcaaacuugcaagaa

SEQ ID NO: 3908298 - RNA, 19 nt, Human adenovirus C
ugcaaagggcccuggcugg

SEQ ID NO: 3908299 - RNA, 11 nt, Human adenovirus C
ugcaaaggugg

SEQ ID NO: 3908300 - RNA, 18 nt, Human adenovirus C
ugcaacaagaaaacagcg

SEQ ID NO: 3908301 - RNA, 12 nt, Human adenovirus C
ugcaacccgcgg

SEQ ID NO: 3908302 - RNA, 21 nt, Human adenovirus C
ugcaagaccccgugaccuucc

SEQ ID NO: 3908303 - RNA, 22 nt, Human adenovirus C
ugcaaggcgcuguauccaaagc

SEQ ID NO: 3908304 - RNA, 13 nt, Human adenovirus C
ugcacgaccccug

SEQ ID NO: 3908305 - RNA, 19 nt, Human adenovirus C
ugcacgaccccuggagagg

SEQ ID NO: 3908306 - RNA, 13 nt, Human adenovirus C
ugcagaccgugga

SEQ ID NO: 3908307 - RNA, 21 nt, Human adenovirus C
ugcagagcauaguggugcagg

SEQ ID NO: 3908308 - RNA, 20 nt, Human adenovirus C
ugcagauauggcccucaccu

SEQ ID NO: 3908309 - RNA, 13 nt, Human adenovirus C
ugcagccagggga

SEQ ID NO: 3908310 - RNA, 19 nt, Human adenovirus C
ugcagcgcaagcuagagga

SEQ ID NO: 3908311 - RNA, 17 nt, Human adenovirus C
ugcaggagcgcagcuug

SEQ ID NO: 3908312 - RNA, 22 nt, Human adenovirus C
ugcaggggcccaacucggccgc

SEQ ID NO: 3908313 - RNA, 13 nt, Human adenovirus C
ugcaucccaccuu

SEQ ID NO: 3908314 - RNA, 14 nt, Human adenovirus C
ugcaugaaagccuu

SEQ ID NO: 3908315 - RNA, 21 nt, Human adenovirus C
ugcauggugauaaaacuaaac

SEQ ID NO: 3908316 - RNA, 14 nt, Human adenovirus C
ugccacacgggcgg

SEQ ID NO: 3908317 - RNA, 17 nt, Human adenovirus C
ugccacagagggcaugg

SEQ ID NO: 3908318 - RNA, 14 nt, Human adenovirus C
ugccagacaagcua

SEQ ID NO: 3908319 - RNA, 17 nt, Human adenovirus C
ugccagacaugaugcaa

SEQ ID NO: 3908320 - RNA, 19 nt, Human adenovirus C
ugccauuaaaaaccuccuc

SEQ ID NO: 3908321 - RNA, 14 nt, Human adenovirus C
ugcccgccaccugc

SEQ ID NO: 3908322 - RNA, 16 nt, Human adenovirus C
ugcccgcggcuccggu

SEQ ID NO: 3908323 - RNA, 16 nt, Human adenovirus C
ugcccuaaauuuaccc

SEQ ID NO: 3908324 - RNA, 18 nt, Human adenovirus C
ugcccuacauccuuccau

SEQ ID NO: 3908325 - RNA, 13 nt, Human adenovirus C
ugccgcagugguc

SEQ ID NO: 3908326 - RNA, 17 nt, Human adenovirus C
ugccgccgccgccaccc

SEQ ID NO: 3908327 - RNA, 18 nt, Human adenovirus C
ugccgccugcugcacgca

SEQ ID NO: 3908328 - RNA, 20 nt, Human adenovirus C
ugccgcggggacaggaggac

SEQ ID NO: 3908329 - RNA, 19 nt, Human adenovirus C
ugccgucaucccugagcag

SEQ ID NO: 3908330 - RNA, 14 nt, Human adenovirus C
ugccgugccagagg

SEQ ID NO: 3908331 - RNA, 20 nt, Human adenovirus C
ugccuacgaacgccaccugu

SEQ ID NO: 3908332 - RNA, 14 nt, Human adenovirus C
ugccuuugagggug

SEQ ID NO: 3908333 - RNA, 16 nt, Human adenovirus C
ugccuuugaggguggc

SEQ ID NO: 3908334 - RNA, 14 nt, Human adenovirus C
ugcgacgucagaca

SEQ ID NO: 3908335 - RNA, 23 nt, Human adenovirus C
ugcgcacccgccccccgcgcaac

SEQ ID NO: 3908336 - RNA, 21 nt, Human adenovirus C
ugcgcgaggccguggcgcagc

SEQ ID NO: 3908337 - RNA, 19 nt, Human adenovirus C
ugcgcgcuggccagggugc

SEQ ID NO: 3908338 - RNA, 15 nt, Human adenovirus C
ugcgcgucggccagg

SEQ ID NO: 3908339 - RNA, 16 nt, Human adenovirus C
ugcgcgugcgcgggca

SEQ ID NO: 3908340 - RNA, 19 nt, Human adenovirus C
ugcggccaaucaagcaggu

SEQ ID NO: 3908341 - RNA, 20 nt, Human adenovirus C
ugcggccuaccggggggaga

SEQ ID NO: 3908342 - RNA, 17 nt, Human adenovirus C
ugcgucgcaaccaggaa

SEQ ID NO: 3908343 - RNA, 14 nt, Human adenovirus C
ugcgugcucuacau

SEQ ID NO: 3908344 - RNA, 13 nt, Human adenovirus C
ugcguggaagaac

SEQ ID NO: 3908345 - RNA, 13 nt, Human adenovirus C
ugcuauauuucaa

SEQ ID NO: 3908346 - RNA, 16 nt, Human adenovirus C
ugcuccagagcgcccu

SEQ ID NO: 3908347 - RNA, 20 nt, Human adenovirus C
ugcucgaucucuuccuccug

SEQ ID NO: 3908348 - RNA, 21 nt, Human adenovirus C
ugcucguccagacgggccagg

SEQ ID NO: 3908349 - RNA, 22 nt, Human adenovirus C
ugcugaguauaauaaauacaga

SEQ ID NO: 3908350 - RNA, 21 nt, Human adenovirus C
ugcugcacgcaaccgcgccca

SEQ ID NO: 3908351 - RNA, 15 nt, Human adenovirus C
ugcuggacagggggc

SEQ ID NO: 3908352 - RNA, 19 nt, Human adenovirus C
ugcuguugaagcaucugca

SEQ ID NO: 3908353 - RNA, 13 nt, Human adenovirus C
ugcuuauuacagc

SEQ ID NO: 3908354 - RNA, 18 nt, Human adenovirus C
gcugaggccgaggcagcg

SEQ ID NO: 3908355 - RNA, 14 nt, Human adenovirus C
gcugauugccaggg

SEQ ID NO: 3908356 - RNA, 14 nt, Human adenovirus C
gcugcagagccagc

SEQ ID NO: 3908357 - RNA, 13 nt, Human adenovirus C
gcugccagggccg

SEQ ID NO: 3908358 - RNA, 23 nt, Human adenovirus C
gcugcccugguguaccaggaaag

SEQ ID NO: 3908359 - RNA, 15 nt, Human adenovirus C
gcugccgccaugggc

SEQ ID NO: 3908360 - RNA, 21 nt, Human adenovirus C
gcugccuguaucacaaaagcg

SEQ ID NO: 3908361 - RNA, 12 nt, Human adenovirus C
gcugcugagccg

SEQ ID NO: 3908362 - RNA, 18 nt, Human adenovirus C
gcuggagcugcccaagac

SEQ ID NO: 3908363 - RNA, 21 nt, Human adenovirus C
gcuggaugugaccgaggagcu

SEQ ID NO: 3908364 - RNA, 19 nt, Human adenovirus C
gcuggccagggugcgcuug

SEQ ID NO: 3908365 - RNA, 23 nt, Human adenovirus C
gcugggaagaaagcagguuccug

SEQ ID NO: 3908366 - RNA, 15 nt, Human adenovirus C
gcuggggcaggagga

SEQ ID NO: 3908367 - RNA, 13 nt, Human adenovirus C
gcuggucucugga

SEQ ID NO: 3908368 - RNA, 14 nt, Human adenovirus C
gcuggugcugcgcg

SEQ ID NO: 3908369 - RNA, 20 nt, Human adenovirus C
gcugugccuuuuacugcugc

SEQ ID NO: 3908370 - RNA, 14 nt, Human adenovirus C
gcuguugcccgugc

SEQ ID NO: 3908371 - RNA, 15 nt, Human adenovirus C
gcuugcgggcggcuu

SEQ ID NO: 3908372 - RNA, 13 nt, Human adenovirus C
gcuuucagggaca

SEQ ID NO: 3908373 - RNA, 17 nt, Human adenovirus C
gcuuuccaagauggcua

SEQ ID NO: 3908374 - RNA, 17 nt, Human adenovirus C
ggaaagacgguggugcg

SEQ ID NO: 3908375 - RNA, 20 nt, Human adenovirus C
ggaaagcuuccgcaggccaa

SEQ ID NO: 3908376 - RNA, 18 nt, Human adenovirus C
ggaaaugcguggaagaac

SEQ ID NO: 3908377 - RNA, 13 nt, Human adenovirus C
ggaacaaaccgaa

SEQ ID NO: 3908378 - RNA, 21 nt, Human adenovirus C
ggaacgcggguuuggcagggc

SEQ ID NO: 3908379 - RNA, 19 nt, Human adenovirus C
ggaacggggccgaggugga

SEQ ID NO: 3908380 - RNA, 20 nt, Human adenovirus C
ggaagaaagcagguuccuga

SEQ ID NO: 3908381 - RNA, 19 nt, Human adenovirus C
ggaagaugaagaugaagaa

SEQ ID NO: 3908382 - RNA, 14 nt, Human adenovirus C
ggaagccaugcuca

SEQ ID NO: 3908383 - RNA, 17 nt, Human adenovirus C
ggaauccgcgcccaccg

SEQ ID NO: 3908384 - RNA, 21 nt, Human adenovirus C
ggaauuugaagagcuuuugaa

SEQ ID NO: 3908385 - RNA, 21 nt, Human adenovirus C
ggacaaacagguggagcugaa

SEQ ID NO: 3908386 - RNA, 18 nt, Human adenovirus C
ggacaaccccagacccau

SEQ ID NO: 3908387 - RNA, 20 nt, Human adenovirus C
ggacaaccccagacccaucu

SEQ ID NO: 3908388 - RNA, 12 nt, Human adenovirus C
ggacaccuccca

SEQ ID NO: 3908389 - RNA, 12 nt, Human adenovirus C
ggacauaaacau

SEQ ID NO: 3908390 - RNA, 13 nt, Human adenovirus C
ggaccaccacgcc

SEQ ID NO: 3908391 - RNA, 17 nt, Human adenovirus C
ggaccccauggcauggg

SEQ ID NO: 3908392 - RNA, 13 nt, Human adenovirus C
ggacccuggugcu

SEQ ID NO: 3908393 - RNA, 13 nt, Human adenovirus C
ggaccugagcgag

SEQ ID NO: 3908394 - RNA, 18 nt, Human adenovirus C
ggacugguuccuggugca

SEQ ID NO: 3908395 - RNA, 14 nt, Human adenovirus C
ggagcgaggagguc

SEQ ID NO: 3908396 - RNA, 22 nt, Human adenovirus C
ggagcucccgcggcgacagguc

SEQ ID NO: 3908397 - RNA, 16 nt, Human adenovirus C
ggagcugcccaagacu

SEQ ID NO: 3908398 - RNA, 14 nt, Human adenovirus C
ggagcugcugagcc

SEQ ID NO: 3908399 - RNA, 13 nt, Human adenovirus C
ggaggaagccagg

SEQ ID NO: 3908400 - RNA, 17 nt, Human adenovirus C
ggaggaauacugggaca

SEQ ID NO: 3908401 - RNA, 18 nt, Human adenovirus C
ggaggaauacugggacag

SEQ ID NO: 3908402 - RNA, 17 nt, Human adenovirus C
ggaggacuuugagcccg

SEQ ID NO: 3908403 - RNA, 13 nt, Human adenovirus C
ggaggaggagcgc

SEQ ID NO: 3908404 - RNA, 11 nt, Human adenovirus C
ggaggaggcgc

SEQ ID NO: 3908405 - RNA, 14 nt, Human adenovirus C
ggagggccuacccg

SEQ ID NO: 3908406 - RNA, 14 nt, Human adenovirus C
ggaggggcaacauc

SEQ ID NO: 3908407 - RNA, 17 nt, Human adenovirus C
ggaucuuaugccaggcc

SEQ ID NO: 3908408 - RNA, 13 nt, Human adenovirus C
ggauggcgcaggc

SEQ ID NO: 3908409 - RNA, 13 nt, Human adenovirus C
ggaugggugcaua

SEQ ID NO: 3908410 - RNA, 17 nt, Human adenovirus C
ggaugucaaauuccuca

SEQ ID NO: 3908411 - RNA, 15 nt, Human adenovirus C
ggcaaccugggcucc

SEQ ID NO: 3908412 - RNA, 16 nt, Human adenovirus C
ggcaacgucggcggcg

SEQ ID NO: 3908413 - RNA, 19 nt, Human adenovirus C
ggcacccccgcuugaggag

SEQ ID NO: 3908414 - RNA, 17 nt, Human adenovirus C
ggcacgucggcgccgcg

SEQ ID NO: 3908415 - RNA, 20 nt, Human adenovirus C
ggcacuaaagcaaggccugc

SEQ ID NO: 3908416 - RNA, 23 nt, Human adenovirus C
ggcacuaccuggacuuggaggag

SEQ ID NO: 3908417 - RNA, 20 nt, Human adenovirus C
ggcacucuuccguggucugg

SEQ ID NO: 3908418 - RNA, 19 nt, Human adenovirus C
ggcagaaacagagggcugc

SEQ ID NO: 3908419 - RNA, 14 nt, Human adenovirus C
ggcagaagcugccg

SEQ ID NO: 3908420 - RNA, 15 nt, Human adenovirus C
ggcagaagcugccgc

SEQ ID NO: 3908421 - RNA, 20 nt, Human adenovirus C
ggcagaugccgcggugcagg

SEQ ID NO: 3908422 - RNA, 18 nt, Human adenovirus C
ggcagcaacagcagcggu

SEQ ID NO: 3908423 - RNA, 15 nt, Human adenovirus C
ggcagcaaggccugg

SEQ ID NO: 3908424 - RNA, 20 nt, Human adenovirus C
ggcaguggucuccucagcga

SEQ ID NO: 3908425 - RNA, 15 nt, Human adenovirus C
ggcauaagcccgucu

SEQ ID NO: 3908426 - RNA, 15 nt, Human adenovirus C
ggcauagucucgccg

SEQ ID NO: 3908427 - RNA, 19 nt, Human adenovirus C
ggcaugcgucgugcgcacc

SEQ ID NO: 3908428 - RNA, 15 nt, Human adenovirus C
ggcauggagacacaa

SEQ ID NO: 3908429 - RNA, 18 nt, Human adenovirus C
ggccaagaacaagagcug

SEQ ID NO: 3908430 - RNA, 14 nt, Human adenovirus C
ggccacuacccgga

SEQ ID NO: 3908431 - RNA, 16 nt, Human adenovirus C
ggccagaugcugaggg

SEQ ID NO: 3908432 - RNA, 18 nt, Human adenovirus C
ggccagcacgaaggaggc

SEQ ID NO: 3908433 - RNA, 20 nt, Human adenovirus C
ggccauauuuuuugggcacc

SEQ ID NO: 3908434 - RNA, 21 nt, Human adenovirus C
ggccaugggcguguggcagca

SEQ ID NO: 3908435 - RNA, 18 nt, Human adenovirus C
ggcccacaacacggccuc

SEQ ID NO: 3908436 - RNA, 12 nt, Human adenovirus C
ggcccacgggcg

SEQ ID NO: 3908437 - RNA, 16 nt, Human adenovirus C
ggcccauuacaguguc

SEQ ID NO: 3908438 - RNA, 18 nt, Human adenovirus C
ggcccgcugcccuggugu

SEQ ID NO: 3908439 - RNA, 17 nt, Human adenovirus C
ggcccguagccaguggc

SEQ ID NO: 3908440 - RNA, 14 nt, Human adenovirus C
ggccgaagaggugu

SEQ ID NO: 3908441 - RNA, 12 nt, Human adenovirus C
ggccgccagagc

SEQ ID NO: 3908442 - RNA, 14 nt, Human adenovirus C
ggccgccagagcuu

SEQ ID NO: 3908443 - RNA, 16 nt, Human adenovirus C
ggccgccgcagcagcc

SEQ ID NO: 3908444 - RNA, 14 nt, Human adenovirus C
ggccgccuguggac

SEQ ID NO: 3908445 - RNA, 17 nt, Human adenovirus C
ggccgcgggcugggugu

SEQ ID NO: 3908446 - RNA, 20 nt, Human adenovirus C
ggccgcucgaaggcuggccg

SEQ ID NO: 3908447 - RNA, 12 nt, Human adenovirus C
ggccggacaggc

SEQ ID NO: 3908448 - RNA, 23 nt, Human adenovirus C
ggccggaccugggcuggcggugg

SEQ ID NO: 3908449 - RNA, 17 nt, Human adenovirus C
ggccgucuacucccagc

SEQ ID NO: 3908450 - RNA, 18 nt, Human adenovirus C
ggccguggagacaguguc

SEQ ID NO: 3908451 - RNA, 12 nt, Human adenovirus C
ggccuacccgca

SEQ ID NO: 3908452 - RNA, 23 nt, Human adenovirus C
ggccuaucauugugcucaaccca

SEQ ID NO: 3908453 - RNA, 13 nt, Human adenovirus C
ggccuccccuucu

SEQ ID NO: 3908454 - RNA, 20 nt, Human adenovirus C
ggccuugcaggcgcagagac

SEQ ID NO: 3908455 - RNA, 22 nt, Human adenovirus C
ggccuugcaggcgcagagacac

SEQ ID NO: 3908456 - RNA, 19 nt, Human adenovirus C
ggcgaaucucaguggaacg

SEQ ID NO: 3908457 - RNA, 20 nt, Human adenovirus C
ggcgaccggauagcaagacu

SEQ ID NO: 3908458 - RNA, 16 nt, Human adenovirus C
ggcgacgaggaccugc

SEQ ID NO: 3908459 - RNA, 14 nt, Human adenovirus C
ggcgaggcgcgccg

SEQ ID NO: 3908460 - RNA, 16 nt, Human adenovirus C
ggcgaggcgcgccgcg

SEQ ID NO: 3908461 - RNA, 19 nt, Human adenovirus C
ggcgaguacuaagcgguga

SEQ ID NO: 3908462 - RNA, 20 nt, Human adenovirus C
ggcgauggagcgcaggguuu

SEQ ID NO: 3908463 - RNA, 17 nt, Human adenovirus C
ggcgcaccgggaggcgg

SEQ ID NO: 3908464 - RNA, 15 nt, Human adenovirus C
ggcgcagagacacug

SEQ ID NO: 3908465 - RNA, 14 nt, Human adenovirus C
ggcgcagcgugagc

SEQ ID NO: 3908466 - RNA, 15 nt, Human adenovirus C
ggcgcagcgugagcg

SEQ ID NO: 3908467 - RNA, 15 nt, Human adenovirus C
ggcgcaguuggaaga

SEQ ID NO: 3908468 - RNA, 23 nt, Human adenovirus C
ggcgccgcgcgcgggcaggagcu

SEQ ID NO: 3908469 - RNA, 16 nt, Human adenovirus C
ggcgccgugcccggaa

SEQ ID NO: 3908470 - RNA, 17 nt, Human adenovirus C
ggcgcgcacaaacgcgg

SEQ ID NO: 3908471 - RNA, 14 nt, Human adenovirus C
ggcgcgcugcggcu

SEQ ID NO: 3908472 - RNA, 20 nt, Human adenovirus C
ggcgcggaagagaacuccaa

SEQ ID NO: 3908473 - RNA, 16 nt, Human adenovirus C
ggcgcggcggcugcug

SEQ ID NO: 3908474 - RNA, 13 nt, Human adenovirus C
cccagcgccaaaa

SEQ ID NO: 3908475 - RNA, 18 nt, Human adenovirus C
cccagcguggcgcuggac

SEQ ID NO: 3908476 - RNA, 22 nt, Human adenovirus C
cccaggcaaaguuagucugcag

SEQ ID NO: 3908477 - RNA, 15 nt, Human adenovirus C
cccaggcuggggaga

SEQ ID NO: 3908478 - RNA, 20 nt, Human adenovirus C
cccauggcauggggugggug

SEQ ID NO: 3908479 - RNA, 15 nt, Human adenovirus C
ccccaggcuggggag

SEQ ID NO: 3908480 - RNA, 18 nt, Human adenovirus C
ccccagguacagcccacc

SEQ ID NO: 3908481 - RNA, 13 nt, Human adenovirus C
ccccccaggucca

SEQ ID NO: 3908482 - RNA, 19 nt, Human adenovirus C
cccccgcugacacccagca

SEQ ID NO: 3908483 - RNA, 12 nt, Human adenovirus C
cccccuccucag

SEQ ID NO: 3908484 - RNA, 15 nt, Human adenovirus C
ccccgcugacaccca

SEQ ID NO: 3908485 - RNA, 18 nt, Human adenovirus C
ccccgggcagcaggcgcg

SEQ ID NO: 3908486 - RNA, 16 nt, Human adenovirus C
ccccgggcuggugcag

SEQ ID NO: 3908487 - RNA, 18 nt, Human adenovirus C
ccccgggcuggugcaguu

SEQ ID NO: 3908488 - RNA, 22 nt, Human adenovirus C
ccccuacugcaccggcggcagc

SEQ ID NO: 3908489 - RNA, 13 nt, Human adenovirus C
ccccuccgcggcg

SEQ ID NO: 3908490 - RNA, 22 nt, Human adenovirus C
ccccuucccugggaucaggcua

SEQ ID NO: 3908491 - RNA, 20 nt, Human adenovirus C
ccccuuugaguucgccacca

SEQ ID NO: 3908492 - RNA, 22 nt, Human adenovirus C
cccgacgccgaaccaccacugg

SEQ ID NO: 3908493 - RNA, 16 nt, Human adenovirus C
cccgcaccaggugcag

SEQ ID NO: 3908494 - RNA, 22 nt, Human adenovirus C
cccgcggcgacaggucaggcgg

SEQ ID NO: 3908495 - RNA, 17 nt, Human adenovirus C
cccgcggcgccgggccc

SEQ ID NO: 3908496 - RNA, 13 nt, Human adenovirus C
cccgcucccacca

SEQ ID NO: 3908497 - RNA, 20 nt, Human adenovirus C
cccgcuugcaaauuccuccg

SEQ ID NO: 3908498 - RNA, 22 nt, Human adenovirus C
cccggaauugcauccguggccu

SEQ ID NO: 3908499 - RNA, 14 nt, Human adenovirus C
cccggagguagggg

SEQ ID NO: 3908500 - RNA, 14 nt, Human adenovirus C
cccggccacuaccc

SEQ ID NO: 3908501 - RNA, 17 nt, Human adenovirus C
cccgggcuggugcaguu

SEQ ID NO: 3908502 - RNA, 19 nt, Human adenovirus C
cccggugagcgcuccaccc

SEQ ID NO: 3908503 - RNA, 15 nt, Human adenovirus C
cccggugccgggauu

SEQ ID NO: 3908504 - RNA, 24 nt, Human adenovirus C
cccuaacaguggcaaccaccgcuc

SEQ ID NO: 3908505 - RNA, 19 nt, Human adenovirus C
cccuagacaaggccggaaa

SEQ ID NO: 3908506 - RNA, 16 nt, Human adenovirus C
cccuaucagcagccgc

SEQ ID NO: 3908507 - RNA, 21 nt, Human adenovirus C
cccuauguaagcuuguugcau

SEQ ID NO: 3908508 - RNA, 14 nt, Human adenovirus C
cccuccgcggcgug

SEQ ID NO: 3908509 - RNA, 13 nt, Human adenovirus C
cccucuuccuccc

SEQ ID NO: 3908510 - RNA, 18 nt, Human adenovirus C
cccugcaaacaucagccc

SEQ ID NO: 3908511 - RNA, 17 nt, Human adenovirus C
cccugggaucaggcuac

SEQ ID NO: 3908512 - RNA, 13 nt, Human adenovirus C
cccuguggaccgc

SEQ ID NO: 3908513 - RNA, 22 nt, Human adenovirus C
cccuuacuacaccuacucuggc

SEQ ID NO: 3908514 - RNA, 13 nt, Human adenovirus C
cccuucccuggga

SEQ ID NO: 3908515 - RNA, 20 nt, Human adenovirus C
cccuuggaggaggcgccgca

SEQ ID NO: 3908516 - RNA, 19 nt, Human adenovirus C
ccgaagauagcggccgggc

SEQ ID NO: 3908517 - RNA, 21 nt, Human adenovirus C
ccgacacgguuaacuccuccu

SEQ ID NO: 3908518 - RNA, 11 nt, Human adenovirus C
ccgacuggcca

SEQ ID NO: 3908519 - RNA, 16 nt, Human adenovirus C
ccgaggaagaaugcac

SEQ ID NO: 3908520 - RNA, 19 nt, Human adenovirus C
ccgagggccgcuggcugcu

SEQ ID NO: 3908521 - RNA, 17 nt, Human adenovirus C
ccgaggucgagaagccu

SEQ ID NO: 3908522 - RNA, 13 nt, Human adenovirus C
ccgagguggagau

SEQ ID NO: 3908523 - RNA, 17 nt, Human adenovirus C
ccgagguugcuacgggc

SEQ ID NO: 3908524 - RNA, 22 nt, Human adenovirus C
ccgauguaaggguucggggcug

SEQ ID NO: 3908525 - RNA, 20 nt, Human adenovirus C
ccgauuuccgugcgcagggu

SEQ ID NO: 3908526 - RNA, 17 nt, Human adenovirus C
ccgcaacuucagacugg

SEQ ID NO: 3908527 - RNA, 22 nt, Human adenovirus C
ccgcacgaggggcagugcagac

SEQ ID NO: 3908528 - RNA, 19 nt, Human adenovirus C
ccgcacugggcgcaccacc

SEQ ID NO: 3908529 - RNA, 17 nt, Human adenovirus C
ccgcauaccccgcgcca

SEQ ID NO: 3908530 - RNA, 19 nt, Human adenovirus C
ccgccagaggagcugcuga

SEQ ID NO: 3908531 - RNA, 15 nt, Human adenovirus C
ccgcccgcgccugcu

SEQ ID NO: 3908532 - RNA, 12 nt, Human adenovirus C
ccgccgccgcag

SEQ ID NO: 3908533 - RNA, 14 nt, Human adenovirus C
ccgccgggagaggg

SEQ ID NO: 3908534 - RNA, 23 nt, Human adenovirus C
ccgccucgggcaaaacgugcuuc

SEQ ID NO: 3908535 - RNA, 14 nt, Human adenovirus C
ccgccugcugcacg

SEQ ID NO: 3908536 - RNA, 23 nt, Human adenovirus C
ccgcgcaccuggcggacauuauc

SEQ ID NO: 3908537 - RNA, 19 nt, Human adenovirus C
ccgcggcgugcuggacagg

SEQ ID NO: 3908538 - RNA, 18 nt, Human adenovirus C
ccgcgguugugcagggug

SEQ ID NO: 3908539 - RNA, 19 nt, Human adenovirus C
ccgcguccaucuggucaga

SEQ ID NO: 3908540 - RNA, 18 nt, Human adenovirus C
ccgcguccggcucgcucc

SEQ ID NO: 3908541 - RNA, 12 nt, Human adenovirus C
ccgcuacgugcc

SEQ ID NO: 3908542 - RNA, 18 nt, Human adenovirus C
ccgcucauggacccuccu

SEQ ID NO: 3908543 - RNA, 19 nt, Human adenovirus C
ccggaaaccucaccuccca

SEQ ID NO: 3908544 - RNA, 22 nt, Human adenovirus C
ccggaccaguuuauucccaacu

SEQ ID NO: 3908545 - RNA, 15 nt, Human adenovirus C
ccggcaaggcaaugc

SEQ ID NO: 3908546 - RNA, 13 nt, Human adenovirus C
ccggccgacgggc

SEQ ID NO: 3908547 - RNA, 13 nt, Human adenovirus C
ccggcgccagcac

SEQ ID NO: 3908548 - RNA, 14 nt, Human adenovirus C
ccggcggcagcggc

SEQ ID NO: 3908549 - RNA, 17 nt, Human adenovirus C
cgucagcggggucuggu

SEQ ID NO: 3908550 - RNA, 21 nt, Human adenovirus C
cgucauaguuguguuccagga

SEQ ID NO: 3908551 - RNA, 17 nt, Human adenovirus C
cgucaugcacgcagcac

SEQ ID NO: 3908552 - RNA, 18 nt, Human adenovirus C
cgucauuacccagggcca

SEQ ID NO: 3908553 - RNA, 12 nt, Human adenovirus C
cguccgagcgag

SEQ ID NO: 3908554 - RNA, 19 nt, Human adenovirus C
cguccuaucgagccgcacu

SEQ ID NO: 3908555 - RNA, 16 nt, Human adenovirus C
cgucgccagcccgugc

SEQ ID NO: 3908556 - RNA, 22 nt, Human adenovirus C
cgucgccagcccgugcuggccc

SEQ ID NO: 3908557 - RNA, 15 nt, Human adenovirus C
cgucggcgccgcgcg

SEQ ID NO: 3908558 - RNA, 16 nt, Human adenovirus C
cgucugaagacaccuu

SEQ ID NO: 3908559 - RNA, 12 nt, Human adenovirus C
cgucuggcugcu

SEQ ID NO: 3908560 - RNA, 12 nt, Human adenovirus C
cgugacacugca

SEQ ID NO: 3908561 - RNA, 16 nt, Human adenovirus C
cgugacacugcagcag

SEQ ID NO: 3908562 - RNA, 20 nt, Human adenovirus C
cgugaggguagacuggaagu

SEQ ID NO: 3908563 - RNA, 19 nt, Human adenovirus C
cgugcagaccaaccuggac

SEQ ID NO: 3908564 - RNA, 20 nt, Human adenovirus C
cgugcccaucuccaucccau

SEQ ID NO: 3908565 - RNA, 16 nt, Human adenovirus C
cgugcgcaccaccggc

SEQ ID NO: 3908566 - RNA, 17 nt, Human adenovirus C
cgugcgcaggguggcuc

SEQ ID NO: 3908567 - RNA, 21 nt, Human adenovirus C
cgugcgcaguacuggcagcgg

SEQ ID NO: 3908568 - RNA, 18 nt, Human adenovirus C
cgugcugaaacgcagcau

SEQ ID NO: 3908569 - RNA, 14 nt, Human adenovirus C
cguggagccugggc

SEQ ID NO: 3908570 - RNA, 15 nt, Human adenovirus C
cguggagccugggcu

SEQ ID NO: 3908571 - RNA, 19 nt, Human adenovirus C
cguggcccuuggcgcgcag

SEQ ID NO: 3908572 - RNA, 24 nt, Human adenovirus C
cguggcccuuggcgcgcagcuugc

SEQ ID NO: 3908573 - RNA, 16 nt, Human adenovirus C
cguggccuugcaggcg

SEQ ID NO: 3908574 - RNA, 21 nt, Human adenovirus C
cguggccuugcaggcgcagag

SEQ ID NO: 3908575 - RNA, 20 nt, Human adenovirus C
cguggcgaaaagcguccgcg

SEQ ID NO: 3908576 - RNA, 12 nt, Human adenovirus C
cguggcgcagcg

SEQ ID NO: 3908577 - RNA, 15 nt, Human adenovirus C
cguggcuuaagggug

SEQ ID NO: 3908578 - RNA, 20 nt, Human adenovirus C
cguucaugggaaacuggcaa

SEQ ID NO: 3908579 - RNA, 19 nt, Human adenovirus C
cguucucgcgggggcgcag

SEQ ID NO: 3908580 - RNA, 18 nt, Human adenovirus C
cguuggagacugcagccu

SEQ ID NO: 3908581 - RNA, 16 nt, Human adenovirus C
cguuucagccccccgg

SEQ ID NO: 3908582 - RNA, 14 nt, Human adenovirus C
cuaaaaaacuggaa

SEQ ID NO: 3908583 - RNA, 21 nt, Human adenovirus C
cuaaaccuaugauacuuacca

SEQ ID NO: 3908584 - RNA, 13 nt, Human adenovirus C
cuaaagcccguga

SEQ ID NO: 3908585 - RNA, 12 nt, Human adenovirus C
cuaaagcggguc

SEQ ID NO: 3908586 - RNA, 20 nt, Human adenovirus C
cuaaaggggguaaagaggga

SEQ ID NO: 3908587 - RNA, 22 nt, Human adenovirus C
cuaacaguggcaaccaccgcuc

SEQ ID NO: 3908588 - RNA, 22 nt, Human adenovirus C
cuaacauaaacacacaauaaau

SEQ ID NO: 3908589 - RNA, 16 nt, Human adenovirus C
cuaacucaggggcgca

SEQ ID NO: 3908590 - RNA, 15 nt, Human adenovirus C
cuacaacaaacagag

SEQ ID NO: 3908591 - RNA, 12 nt, Human adenovirus C
cuacaccagugu

SEQ ID NO: 3908592 - RNA, 12 nt, Human adenovirus C
cuacaccuaccg

SEQ ID NO: 3908593 - RNA, 20 nt, Human adenovirus C
cuacacgcccacgccgccac

SEQ ID NO: 3908594 - RNA, 23 nt, Human adenovirus C
cuacagcccgggggaggcaagca

SEQ ID NO: 3908595 - RNA, 12 nt, Human adenovirus C
cuacaggggccu

SEQ ID NO: 3908596 - RNA, 21 nt, Human adenovirus C
cuacaugagcgcgggacccca

SEQ ID NO: 3908597 - RNA, 17 nt, Human adenovirus C
cuacauugcccaggaau

SEQ ID NO: 3908598 - RNA, 12 nt, Human adenovirus C
cuacccccggcu

SEQ ID NO: 3908599 - RNA, 22 nt, Human adenovirus C
cuaccccguauuugccgugcca

SEQ ID NO: 3908600 - RNA, 20 nt, Human adenovirus C
cuacccgacgccgaaccacc

SEQ ID NO: 3908601 - RNA, 20 nt, Human adenovirus C
cuaccgcgucaggaggggca

SEQ ID NO: 3908602 - RNA, 15 nt, Human adenovirus C
cuaccggagugcugg

SEQ ID NO: 3908603 - RNA, 16 nt, Human adenovirus C
cuaccggagugcuggg

SEQ ID NO: 3908604 - RNA, 17 nt, Human adenovirus C
cuaccggagugcugggc

SEQ ID NO: 3908605 - RNA, 19 nt, Human adenovirus C
cuaccggagugcugggcca

SEQ ID NO: 3908606 - RNA, 17 nt, Human adenovirus C
cuacgucaucuccagcg

SEQ ID NO: 3908607 - RNA, 21 nt, Human adenovirus C
cuacgucaucuccagcggcca

SEQ ID NO: 3908608 - RNA, 20 nt, Human adenovirus C
cuacgugcccuuucacauuc

SEQ ID NO: 3908609 - RNA, 18 nt, Human adenovirus C
cuacuccgagaccaugac

SEQ ID NO: 3908610 - RNA, 21 nt, Human adenovirus C
cuacuugcaucgcgcggccgc

SEQ ID NO: 3908611 - RNA, 16 nt, Human adenovirus C
cuagacgaagcuuccg

SEQ ID NO: 3908612 - RNA, 20 nt, Human adenovirus C
cuagcauuaaguuugacagc

SEQ ID NO: 3908613 - RNA, 14 nt, Human adenovirus C
cuagcccugcaaac

SEQ ID NO: 3908614 - RNA, 20 nt, Human adenovirus C
cuagcgagguaagcacuuac

SEQ ID NO: 3908615 - RNA, 19 nt, Human adenovirus C
cuagcgccugcugccaugc

SEQ ID NO: 3908616 - RNA, 23 nt, Human adenovirus C
cuagcuacuguagcugcuuuggc

SEQ ID NO: 3908617 - RNA, 15 nt, Human adenovirus C
cuagcucccaagggc

SEQ ID NO: 3908618 - RNA, 22 nt, Human adenovirus C
cuaggggguccacucgcuccag

SEQ ID NO: 3908619 - RNA, 17 nt, Human adenovirus C
cuaggucacuugcugac

SEQ ID NO: 3908620 - RNA, 19 nt, Human adenovirus C
cuaggucacuugcugacac

SEQ ID NO: 3908621 - RNA, 13 nt, Human adenovirus C
cuaucagcagccg

SEQ ID NO: 3908622 - RNA, 14 nt, Human adenovirus C
cuauguaaacuccu

SEQ ID NO: 3908623 - RNA, 18 nt, Human adenovirus C
cuauguggaaucaggcug

SEQ ID NO: 3908624 - RNA, 16 nt, Human adenovirus C
cuauguucccagccau

SEQ ID NO: 3908625 - RNA, 15 nt, Human adenovirus C
cuauuaaaaaacacc

SEQ ID NO: 3908626 - RNA, 19 nt, Human adenovirus C
cuauuaccggcugcaacug

SEQ ID NO: 3908627 - RNA, 16 nt, Human adenovirus C
cuauucugcugcaugu

SEQ ID NO: 3908628 - RNA, 13 nt, Human adenovirus C
cucaaaagcgggc

SEQ ID NO: 3908629 - RNA, 20 nt, Human adenovirus C
cucaaaggcuacaggggccu

SEQ ID NO: 3908630 - RNA, 20 nt, Human adenovirus C
cucaacucccggaacucagg

SEQ ID NO: 3908631 - RNA, 13 nt, Human adenovirus C
cucaccaaggcca

SEQ ID NO: 3908632 - RNA, 15 nt, Human adenovirus C
cucaccaaggccaug

SEQ ID NO: 3908633 - RNA, 15 nt, Human adenovirus C
cucaccacccaggua

SEQ ID NO: 3908634 - RNA, 18 nt, Human adenovirus C
cucacuuaaaucagcaca

SEQ ID NO: 3908635 - RNA, 22 nt, Human adenovirus C
cucagcgaccgcgagcugaugc

SEQ ID NO: 3908636 - RNA, 15 nt, Human adenovirus C
cucagcgccucccaa

SEQ ID NO: 3908637 - RNA, 21 nt, Human adenovirus C
cucaggauuacaagcuccucc

SEQ ID NO: 3908638 - RNA, 22 nt, Human adenovirus C
cucaggcgccgccggcacugcc

SEQ ID NO: 3908639 - RNA, 12 nt, Human adenovirus C
cucaucugcagc

SEQ ID NO: 3908640 - RNA, 15 nt, Human adenovirus C
cuccagcggccacac

SEQ ID NO: 3908641 - RNA, 17 nt, Human adenovirus C
cuccauggucgggacgc

SEQ ID NO: 3908642 - RNA, 19 nt, Human adenovirus C
cucccauggaucacaaccc

SEQ ID NO: 3908643 - RNA, 18 nt, Human adenovirus C
cucccgccaccaguugga

SEQ ID NO: 3908644 - RNA, 19 nt, Human adenovirus C
cucccggaacucaggucaa

SEQ ID NO: 3908645 - RNA, 16 nt, Human adenovirus C
cucccggccacuaccc

SEQ ID NO: 3908646 - RNA, 15 nt, Human adenovirus C
cucccucguacgagg

SEQ ID NO: 3908647 - RNA, 15 nt, Human adenovirus C
cucccuugccgugcu

SEQ ID NO: 3908648 - RNA, 13 nt, Human adenovirus C
cuccggcacugcc

SEQ ID NO: 3908649 - RNA, 14 nt, Human adenovirus C
cuccgggcugcgcg

SEQ ID NO: 3908650 - RNA, 20 nt, Human adenovirus C
cuccguggccgcgcaccugg

SEQ ID NO: 3908651 - RNA, 17 nt, Human adenovirus C
cuccuaacuccugugag

SEQ ID NO: 3908652 - RNA, 14 nt, Human adenovirus C
cuccuccuccugcc

SEQ ID NO: 3908653 - RNA, 14 nt, Human adenovirus C
cuccugccaggcuc

SEQ ID NO: 3908654 - RNA, 21 nt, Human adenovirus C
cuccugcgccguagcgccauu

SEQ ID NO: 3908655 - RNA, 16 nt, Human adenovirus C
accgugcagcugaugg

SEQ ID NO: 3908656 - RNA, 17 nt, Human adenovirus C
accguggagccugggcu

SEQ ID NO: 3908657 - RNA, 18 nt, Human adenovirus C
accguggagccugggcug

SEQ ID NO: 3908658 - RNA, 15 nt, Human adenovirus C
accguggcgggcggc

SEQ ID NO: 3908659 - RNA, 20 nt, Human adenovirus C
accgugucuagcuugcugac

SEQ ID NO: 3908660 - RNA, 23 nt, Human adenovirus C
accgugugcuugauauggcuucc

SEQ ID NO: 3908661 - RNA, 21 nt, Human adenovirus C
accuaaacaacucgcugcugc

SEQ ID NO: 3908662 - RNA, 21 nt, Human adenovirus C
accuacgacuacaugaacaag

SEQ ID NO: 3908663 - RNA, 13 nt, Human adenovirus C
accuacucuggcu

SEQ ID NO: 3908664 - RNA, 14 nt, Human adenovirus C
accuacucuggcuc

SEQ ID NO: 3908665 - RNA, 18 nt, Human adenovirus C
accuaugacaagcgcuuu

SEQ ID NO: 3908666 - RNA, 19 nt, Human adenovirus C
accuaugauacuuaccauu

SEQ ID NO: 3908667 - RNA, 20 nt, Human adenovirus C
accucaggcgcccuaacagu

SEQ ID NO: 3908668 - RNA, 23 nt, Human adenovirus C
accuccgcuccucaggcgccgcc

SEQ ID NO: 3908669 - RNA, 17 nt, Human adenovirus C
accuccuccuccugcca

SEQ ID NO: 3908670 - RNA, 21 nt, Human adenovirus C
accuccuccuccugccaggcu

SEQ ID NO: 3908671 - RNA, 20 nt, Human adenovirus C
accucgaccacugccgccgc

SEQ ID NO: 3908672 - RNA, 18 nt, Human adenovirus C
accucuuugagcccuuug

SEQ ID NO: 3908673 - RNA, 15 nt, Human adenovirus C
accugcuugagcagg

SEQ ID NO: 3908674 - RNA, 20 nt, Human adenovirus C
accuggccaaccaggcagug

SEQ ID NO: 3908675 - RNA, 12 nt, Human adenovirus C
accugggcggcg

SEQ ID NO: 3908676 - RNA, 13 nt, Human adenovirus C
accugggcggcga

SEQ ID NO: 3908677 - RNA, 13 nt, Human adenovirus C
accugggcuggcg

SEQ ID NO: 3908678 - RNA, 17 nt, Human adenovirus C
accuguaacgcuggacc

SEQ ID NO: 3908679 - RNA, 14 nt, Human adenovirus C
accugugcugccag

SEQ ID NO: 3908680 - RNA, 14 nt, Human adenovirus C
accuuaaucaaacu

SEQ ID NO: 3908681 - RNA, 13 nt, Human adenovirus C
accuucacccagu

SEQ ID NO: 3908682 - RNA, 13 nt, Human adenovirus C
accuucuccuaca

SEQ ID NO: 3908683 - RNA, 17 nt, Human adenovirus C
accuuggggcgcgcugg

SEQ ID NO: 3908684 - RNA, 16 nt, Human adenovirus C
acgaaagccaaaaaac

SEQ ID NO: 3908685 - RNA, 14 nt, Human adenovirus C
acgaagccuuccau

SEQ ID NO: 3908686 - RNA, 20 nt, Human adenovirus C
acgagcauacuuuccaggag

SEQ ID NO: 3908687 - RNA, 21 nt, Human adenovirus C
acgaggaggaauacugggaca

SEQ ID NO: 3908688 - RNA, 17 nt, Human adenovirus C
acgaggaggcacuaaag

SEQ ID NO: 3908689 - RNA, 19 nt, Human adenovirus C
acgagguggaacugcugca

SEQ ID NO: 3908690 - RNA, 15 nt, Human adenovirus C
acgcacgaaggaggc

SEQ ID NO: 3908691 - RNA, 15 nt, Human adenovirus C
acgcagcaccuugcg

SEQ ID NO: 3908692 - RNA, 14 nt, Human adenovirus C
acgccaacuccgcc

SEQ ID NO: 3908693 - RNA, 12 nt, Human adenovirus C
acgccaagaaaa

SEQ ID NO: 3908694 - RNA, 23 nt, Human adenovirus C
acgccaccuguucucaccgcgcg

SEQ ID NO: 3908695 - RNA, 20 nt, Human adenovirus C
acgccccgcgccacgucaca

SEQ ID NO: 3908696 - RNA, 21 nt, Human adenovirus C
acgccuuccugaguacacagc

SEQ ID NO: 3908697 - RNA, 19 nt, Human adenovirus C
acgccuuugccaacuggcc

SEQ ID NO: 3908698 - RNA, 12 nt, Human adenovirus C
acgcgccagacc

SEQ ID NO: 3908699 - RNA, 17 nt, Human adenovirus C
acgcgcgagccugccga

SEQ ID NO: 3908700 - RNA, 17 nt, Human adenovirus C
acgcgcgcgcagccucc

SEQ ID NO: 3908701 - RNA, 14 nt, Human adenovirus C
acgcgcggcggcgg

SEQ ID NO: 3908702 - RNA, 15 nt, Human adenovirus C
acgcgcuccccuccg

SEQ ID NO: 3908703 - RNA, 20 nt, Human adenovirus C
acgcggguuuggcagggcga

SEQ ID NO: 3908704 - RNA, 19 nt, Human adenovirus C
acgcguugcaagagcgcag

SEQ ID NO: 3908705 - RNA, 18 nt, Human adenovirus C
acgcucgagaucaggcua

SEQ ID NO: 3908706 - RNA, 19 nt, Human adenovirus C
acgcugcccgagggcaacu

SEQ ID NO: 3908707 - RNA, 12 nt, Human adenovirus C
acgcugguggcu

SEQ ID NO: 3908708 - RNA, 18 nt, Human adenovirus C
acgcuuguggcgcgcgag

SEQ ID NO: 3908709 - RNA, 14 nt, Human adenovirus C
acggacaguggcag

SEQ ID NO: 3908710 - RNA, 18 nt, Human adenovirus C
acggccgcuacgugcccu

SEQ ID NO: 3908711 - RNA, 16 nt, Human adenovirus C
acggccuacuggagug

SEQ ID NO: 3908712 - RNA, 16 nt, Human adenovirus C
acggcgaguacuaagc

SEQ ID NO: 3908713 - RNA, 14 nt, Human adenovirus C
acgggcagccugga

SEQ ID NO: 3908714 - RNA, 17 nt, Human adenovirus C
acgggcagccuggaggc

SEQ ID NO: 3908715 - RNA, 11 nt, Human adenovirus C
acgggcgcagg

SEQ ID NO: 3908716 - RNA, 17 nt, Human adenovirus C
acgggcgcaggguccuc

SEQ ID NO: 3908717 - RNA, 17 nt, Human adenovirus C
acgggcgggcugcucug

SEQ ID NO: 3908718 - RNA, 19 nt, Human adenovirus C
acggggccgagguggagau

SEQ ID NO: 3908719 - RNA, 17 nt, Human adenovirus C
acgguuaacuccuccuc

SEQ ID NO: 3908720 - RNA, 20 nt, Human adenovirus C
acgucaucuccagcggccac

SEQ ID NO: 3908721 - RNA, 19 nt, Human adenovirus C
acgucgccaccgccgccga

SEQ ID NO: 3908722 - RNA, 17 nt, Human adenovirus C
acgugcccaucuccauc

SEQ ID NO: 3908723 - RNA, 15 nt, Human adenovirus C
acgugccgcggcaga

SEQ ID NO: 3908724 - RNA, 16 nt, Human adenovirus C
acguggcggccgccga

SEQ ID NO: 3908725 - RNA, 20 nt, Human adenovirus C
acuaaaccuaugauacuuac

SEQ ID NO: 3908726 - RNA, 14 nt, Human adenovirus C
acuacaugaacaag

SEQ ID NO: 3908727 - RNA, 20 nt, Human adenovirus C
acuacaugaacaagcgagug

SEQ ID NO: 3908728 - RNA, 21 nt, Human adenovirus C
acuacgucaucuccagcggcc

SEQ ID NO: 3908729 - RNA, 14 nt, Human adenovirus C
acuaggagacacuu

SEQ ID NO: 3908730 - RNA, 19 nt, Human adenovirus C
acucacguugugcauuguc

SEQ ID NO: 3908731 - RNA, 21 nt, Human adenovirus C
acucccauggaucacaacccc

SEQ ID NO: 3908732 - RNA, 23 nt, Human adenovirus C
acucccauuuuuccaaaacagga

SEQ ID NO: 3908733 - RNA, 23 nt, Human adenovirus C
acuccugcgccguagcgccauug

SEQ ID NO: 3908734 - RNA, 13 nt, Human adenovirus C
acucgcugcugca

SEQ ID NO: 3908735 - RNA, 17 nt, Human adenovirus C
acucggcagacgacagc

SEQ ID NO: 3908736 - RNA, 20 nt, Human adenovirus C
acucugguaucucagccgcc

SEQ ID NO: 3908737 - RNA, 20 nt, Human adenovirus C
acucuuccuuuuccucuugc

SEQ ID NO: 3908738 - RNA, 13 nt, Human adenovirus C
acugacgccagac

SEQ ID NO: 3908739 - RNA, 14 nt, Human adenovirus C
acugcaccggcggc

SEQ ID NO: 3908740 - RNA, 15 nt, Human adenovirus C
acugcagccuccgcc

SEQ ID NO: 3908741 - RNA, 19 nt, Human adenovirus C
acugcucgaucucuuccuc

SEQ ID NO: 3908742 - RNA, 21 nt, Human adenovirus C
acuggaacaaugacaguggag

SEQ ID NO: 3908743 - RNA, 22 nt, Human adenovirus C
acuggcaaagcacacugaacag

SEQ ID NO: 3908744 - RNA, 19 nt, Human adenovirus C
acuggcaccuuuuguucca

SEQ ID NO: 3908745 - RNA, 19 nt, Human adenovirus C
acuggccccaaacucccau

SEQ ID NO: 3908746 - RNA, 14 nt, Human adenovirus C
acugggacagccua

SEQ ID NO: 3908747 - RNA, 19 nt, Human adenovirus C
acuggggcuccugucgcca

SEQ ID NO: 3908748 - RNA, 18 nt, Human adenovirus C
acuggucguugccagaca

SEQ ID NO: 3908749 - RNA, 23 nt, Human adenovirus C
acuggucuugucaugccuggggu

SEQ ID NO: 3908750 - RNA, 11 nt, Human adenovirus C
acuuccagccc

SEQ ID NO: 3908751 - RNA, 20 nt, Human adenovirus C
acuucggcugcuuguccuug

SEQ ID NO: 3908752 - RNA, 13 nt, Human adenovirus C
acuucugugccuu

SEQ ID NO: 3908753 - RNA, 18 nt, Human adenovirus C
acuugcggcuggagcugc

SEQ ID NO: 3908754 - RNA, 20 nt, Human adenovirus C
acuugcggcuggagcugccc

SEQ ID NO: 3908755 - RNA, 21 nt, Human adenovirus C
acuuggcacccaccgugcagc

SEQ ID NO: 3908756 - RNA, 14 nt, Human adenovirus C
acuuggcgauggag

SEQ ID NO: 3908757 - RNA, 19 nt, Human adenovirus C
acuuucuccaaaguuuaaa

SEQ ID NO: 3908758 - RNA, 17 nt, Human adenovirus C
acuuugcgucucuggcc

SEQ ID NO: 3908759 - RNA, 15 nt, Human adenovirus C
agaaagaugaugaug

SEQ ID NO: 3908760 - RNA, 21 nt, Human adenovirus C
agaaauuuccuuuacuccaau

SEQ ID NO: 3908761 - RNA, 14 nt, Human adenovirus C
agaaccagauauuu

SEQ ID NO: 3908762 - RNA, 18 nt, Human adenovirus C
agaacgggguucuggaaa

SEQ ID NO: 3908763 - RNA, 22 nt, Human adenovirus C
agaacuccucacuuaaaaaaca

SEQ ID NO: 3908764 - RNA, 13 nt, Human adenovirus C
agacagaaacaca

SEQ ID NO: 3908765 - RNA, 22 nt, Human adenovirus C
agacagcuaugauccagauguu

SEQ ID NO: 3908766 - RNA, 19 nt, Human adenovirus C
agacaucauuuugcugcca

SEQ ID NO: 3908767 - RNA, 15 nt, Human adenovirus C
agaccaguagacaag

SEQ ID NO: 3908768 - RNA, 17 nt, Human adenovirus C
agaccgggauccgcuca

SEQ ID NO: 3908769 - RNA, 22 nt, Human adenovirus C
agaccgucugaagacaccuuca

SEQ ID NO: 3908770 - RNA, 14 nt, Human adenovirus C
agacgacagcagcg

SEQ ID NO: 3908771 - RNA, 13 nt, Human adenovirus C
agacggcggaggc

SEQ ID NO: 3908772 - RNA, 15 nt, Human adenovirus C
agacguugaagcugg

SEQ ID NO: 3908773 - RNA, 16 nt, Human adenovirus C
agacucggcggacggc

SEQ ID NO: 3908774 - RNA, 14 nt, Human adenovirus C
agcccuacuccggc

SEQ ID NO: 3908775 - RNA, 21 nt, Human adenovirus C
agccgccgccguuagcccaag

SEQ ID NO: 3908776 - RNA, 15 nt, Human adenovirus C
agccgccgugcgccc

SEQ ID NO: 3908777 - RNA, 20 nt, Human adenovirus C
agccgcggcaaugcagccgg

SEQ ID NO: 3908778 - RNA, 20 nt, Human adenovirus C
agccgcucauggcgcagcug

SEQ ID NO: 3908779 - RNA, 16 nt, Human adenovirus C
agccgcugcagccacc

SEQ ID NO: 3908780 - RNA, 12 nt, Human adenovirus C
agccggccugga

SEQ ID NO: 3908781 - RNA, 15 nt, Human adenovirus C
agccggugggcccgu

SEQ ID NO: 3908782 - RNA, 19 nt, Human adenovirus C
agccuccaugcccuucucc

SEQ ID NO: 3908783 - RNA, 14 nt, Human adenovirus C
agccucgccccccu

SEQ ID NO: 3908784 - RNA, 19 nt, Human adenovirus C
agccucgccccccuucucc

SEQ ID NO: 3908785 - RNA, 21 nt, Human adenovirus C
agccugcaaagggcccuggcu

SEQ ID NO: 3908786 - RNA, 22 nt, Human adenovirus C
agccugcaaagggcccuggcug

SEQ ID NO: 3908787 - RNA, 13 nt, Human adenovirus C
agccuggcugaca

SEQ ID NO: 3908788 - RNA, 21 nt, Human adenovirus C
agccuguaagcgggcacucuu

SEQ ID NO: 3908789 - RNA, 19 nt, Human adenovirus C
agcgaccgcgagcugaugc

SEQ ID NO: 3908790 - RNA, 11 nt, Human adenovirus C
agcgaggagga

SEQ ID NO: 3908791 - RNA, 21 nt, Human adenovirus C
agcgcagcuugagccuggcug

SEQ ID NO: 3908792 - RNA, 22 nt, Human adenovirus C
agcgcauccacaaggccgugag

SEQ ID NO: 3908793 - RNA, 16 nt, Human adenovirus C
agcgccagcgacugga

SEQ ID NO: 3908794 - RNA, 23 nt, Human adenovirus C
agcgccugauuucugccagcgcc

SEQ ID NO: 3908795 - RNA, 14 nt, Human adenovirus C
agcgcgcuggagca

SEQ ID NO: 3908796 - RNA, 17 nt, Human adenovirus C
agcgcggcgccaguggc

SEQ ID NO: 3908797 - RNA, 21 nt, Human adenovirus C
agcgcguaugccugcgcggcc

SEQ ID NO: 3908798 - RNA, 18 nt, Human adenovirus C
agcgcuccacccgcaccu

SEQ ID NO: 3908799 - RNA, 19 nt, Human adenovirus C
agcggcaacgugcagacca

SEQ ID NO: 3908800 - RNA, 16 nt, Human adenovirus C
agcggcggcagcagca

SEQ ID NO: 3908801 - RNA, 19 nt, Human adenovirus C
agcgggggguaccugcugg

SEQ ID NO: 3908802 - RNA, 22 nt, Human adenovirus C
agcgguacgguuuuccuggcca

SEQ ID NO: 3908803 - RNA, 17 nt, Human adenovirus C
agcgguguuccgcgguc

SEQ ID NO: 3908804 - RNA, 21 nt, Human adenovirus C
agcuaaagcgggucaaaaaga

SEQ ID NO: 3908805 - RNA, 15 nt, Human adenovirus C
agcuacccacccagc

SEQ ID NO: 3908806 - RNA, 17 nt, Human adenovirus C
agcuaugcuaaccagcg

SEQ ID NO: 3908807 - RNA, 14 nt, Human adenovirus C
agcucccgcggcga

SEQ ID NO: 3908808 - RNA, 20 nt, Human adenovirus C
agcucggcggugaccugcac

SEQ ID NO: 3908809 - RNA, 22 nt, Human adenovirus C
agcugaaauaugagugggugga

SEQ ID NO: 3908810 - RNA, 20 nt, Human adenovirus C
agcugaucgugcgccgugca

SEQ ID NO: 3908811 - RNA, 13 nt, Human adenovirus C
agcugaucuucuc

SEQ ID NO: 3908812 - RNA, 21 nt, Human adenovirus C
agcugauugccaggggcaggc

SEQ ID NO: 3908813 - RNA, 18 nt, Human adenovirus C
agcugcaaacuuucucca

SEQ ID NO: 3908814 - RNA, 21 nt, Human adenovirus C
agcugccgucaucccugagca

SEQ ID NO: 3908815 - RNA, 23 nt, Human adenovirus C
agcugccgucaucccugagcagg

SEQ ID NO: 3908816 - RNA, 13 nt, Human adenovirus C
agcugcugagccg

SEQ ID NO: 3908817 - RNA, 13 nt, Human adenovirus C
agcuggccgggca

SEQ ID NO: 3908818 - RNA, 21 nt, Human adenovirus C
agcuguccauggucuggagcu

SEQ ID NO: 3908819 - RNA, 18 nt, Human adenovirus C
agcuuccgcaggccaagc

SEQ ID NO: 3908820 - RNA, 17 nt, Human adenovirus C
agcuugagugcaugcag

SEQ ID NO: 3908821 - RNA, 18 nt, Human adenovirus C
agcuugccugcuccagag

SEQ ID NO: 3908822 - RNA, 14 nt, Human adenovirus C
aggaaaccccuucc

SEQ ID NO: 3908823 - RNA, 17 nt, Human adenovirus C
aggaaagucccgcuccc

SEQ ID NO: 3908824 - RNA, 23 nt, Human adenovirus C
aggaaccagccugugaugcugga

SEQ ID NO: 3908825 - RNA, 14 nt, Human adenovirus C
aggaagaagaagag

SEQ ID NO: 3908826 - RNA, 18 nt, Human adenovirus C
aggaagaugaagaugaag

SEQ ID NO: 3908827 - RNA, 12 nt, Human adenovirus C
aggaagccaggc

SEQ ID NO: 3908828 - RNA, 16 nt, Human adenovirus C
aggacccuggugcugc

SEQ ID NO: 3908829 - RNA, 23 nt, Human adenovirus C
aggagcagagcccauggaacccg

SEQ ID NO: 3908830 - RNA, 14 nt, Human adenovirus C
aggagccuccaccg

SEQ ID NO: 3908831 - RNA, 20 nt, Human adenovirus C
aggagcgcagcuugagccug

SEQ ID NO: 3908832 - RNA, 18 nt, Human adenovirus C
aggaggacuuugagcccg

SEQ ID NO: 3908833 - RNA, 21 nt, Human adenovirus C
aggagggagagugcuuaaaaa

SEQ ID NO: 3908834 - RNA, 23 nt, Human adenovirus C
aggaggucgggaccgagguugcu

SEQ ID NO: 3908835 - RNA, 21 nt, Human adenovirus C
aggaucaccuacgaugaccug

SEQ ID NO: 3908836 - RNA, 14 nt, Human adenovirus C
aggaugaagaagag

SEQ ID NO: 3908837 - RNA, 13 nt, Human adenovirus C
aggcagcuggggc

SEQ ID NO: 3908838 - RNA, 15 nt, Human adenovirus C
aggcaguagcuugaa

SEQ ID NO: 3908839 - RNA, 17 nt, Human adenovirus C
aggccagcacgaaggag

SEQ ID NO: 3908840 - RNA, 18 nt, Human adenovirus C
aggccgaggcagcggcag

SEQ ID NO: 3908841 - RNA, 21 nt, Human adenovirus C
aggccguggcgcagcgugagc

SEQ ID NO: 3908842 - RNA, 13 nt, Human adenovirus C
aggccuggaacag

SEQ ID NO: 3908843 - RNA, 14 nt, Human adenovirus C
aggccuggaacagc

SEQ ID NO: 3908844 - RNA, 14 nt, Human adenovirus C
aggcgcauguggac

SEQ ID NO: 3908845 - RNA, 19 nt, Human adenovirus C
aggcgcauguggacgagca

SEQ ID NO: 3908846 - RNA, 12 nt, Human adenovirus C
aggcgccgccgg

SEQ ID NO: 3908847 - RNA, 22 nt, Human adenovirus C
aggcgcuuuuccaagagaaggu

SEQ ID NO: 3908848 - RNA, 24 nt, Human adenovirus C
aggcggcggcaacaacaguggcag

SEQ ID NO: 3908849 - RNA, 16 nt, Human adenovirus C
aggcggucccacagcu

SEQ ID NO: 3908850 - RNA, 17 nt, Human adenovirus C
aggcguacgugccgcgg

SEQ ID NO: 3908851 - RNA, 18 nt, Human adenovirus C
aggcuacagaggaggcua

SEQ ID NO: 3908852 - RNA, 16 nt, Human adenovirus C
aggcugcuguccaacu

SEQ ID NO: 3908853 - RNA, 12 nt, Human adenovirus C
agggaguggcaa

SEQ ID NO: 3908854 - RNA, 13 nt, Human adenovirus C
agggcaaccuggg

SEQ ID NO: 3908855 - RNA, 16 nt, Human adenovirus C
agggcccuggcuggca

SEQ ID NO: 3908856 - RNA, 19 nt, Human adenovirus C
agggccucucagaugcuga

SEQ ID NO: 3908857 - RNA, 17 nt, Human adenovirus C
agggcguagagcuuggg

SEQ ID NO: 3908858 - RNA, 16 nt, Human adenovirus C
agggcugccugcacuu

SEQ ID NO: 3908859 - RNA, 18 nt, Human adenovirus C
aggggcaacauccgcggc

SEQ ID NO: 3908860 - RNA, 13 nt, Human adenovirus C
aggggccaagaac

SEQ ID NO: 3908861 - RNA, 22 nt, Human adenovirus C
aggggccaagaacaagagcuga

SEQ ID NO: 3908862 - RNA, 19 nt, Human adenovirus C
aggguauaacucaccugaa

SEQ ID NO: 3908863 - RNA, 15 nt, Human adenovirus C
agguacgccugcagg

SEQ ID NO: 3908864 - RNA, 14 nt, Human adenovirus C
agguacugaaaugu

SEQ ID NO: 3908865 - RNA, 23 nt, Human adenovirus C
agguagcaccacugcagagcuuc

SEQ ID NO: 3908866 - RNA, 11 nt, Human adenovirus C
aggucagcugc

SEQ ID NO: 3908867 - RNA, 11 nt, Human adenovirus C
agguccuccuc

SEQ ID NO: 3908868 - RNA, 19 nt, Human adenovirus C
aggugaccgugcccggucu

SEQ ID NO: 3908869 - RNA, 22 nt, Human adenovirus C
aggugaugccggcggcgguggu

SEQ ID NO: 3908870 - RNA, 18 nt, Human adenovirus C
aggugcgggcgugacaaa

SEQ ID NO: 3908871 - RNA, 11 nt, Human adenovirus C
aggugcugccc

SEQ ID NO: 3908872 - RNA, 14 nt, Human adenovirus C
aggugcugcucaaa

SEQ ID NO: 3908873 - RNA, 19 nt, Human adenovirus C
aggugguagauggccuggc

SEQ ID NO: 3908874 - RNA, 15 nt, Human adenovirus C
agguguaggccacgu

SEQ ID NO: 3908875 - RNA, 16 nt, Human adenovirus C
agguuaccucugcaaa

SEQ ID NO: 3908876 - RNA, 18 nt, Human adenovirus C
agguugcuacgggcgggc

SEQ ID NO: 3908877 - RNA, 12 nt, Human adenovirus C
agguugcuggcg

SEQ ID NO: 3908878 - RNA, 14 nt, Human adenovirus C
aguagcuugaaguu

SEQ ID NO: 3908879 - RNA, 18 nt, Human adenovirus C
agucacaagccccacuga

SEQ ID NO: 3908880 - RNA, 13 nt, Human adenovirus C
agucacuggucuu

SEQ ID NO: 3908881 - RNA, 13 nt, Human adenovirus C
aguccacaaaaaa

SEQ ID NO: 3908882 - RNA, 12 nt, Human adenovirus C
agucggugcucg

SEQ ID NO: 3908883 - RNA, 13 nt, Human adenovirus C
agugcaaaauaag

SEQ ID NO: 3908884 - RNA, 14 nt, Human adenovirus C
agugcagacuuuua

SEQ ID NO: 3908885 - RNA, 18 nt, Human adenovirus C
agugcuuguuaccgugga

SEQ ID NO: 3908886 - RNA, 14 nt, Human adenovirus C
agugcuuugcccgc

SEQ ID NO: 3908887 - RNA, 18 nt, Human adenovirus C
aguggagagcccaggacu

SEQ ID NO: 3908888 - RNA, 13 nt, Human adenovirus C
aguggagcgggag

SEQ ID NO: 3908889 - RNA, 14 nt, Human adenovirus C
aguggcggcggcgc

SEQ ID NO: 3908890 - RNA, 14 nt, Human adenovirus C
agugggcaggcaga

SEQ ID NO: 3908891 - RNA, 23 nt, Human adenovirus C
cagugucgucgcauccgcccugc

SEQ ID NO: 3908892 - RNA, 17 nt, Human adenovirus C
cagugucuccagagggg

SEQ ID NO: 3908893 - RNA, 12 nt, Human adenovirus C
caguuccaggcg

SEQ ID NO: 3908894 - RNA, 18 nt, Human adenovirus C
cauaaguuuggacaccuc

SEQ ID NO: 3908895 - RNA, 20 nt, Human adenovirus C
cauaaguuuggacaccuccg

SEQ ID NO: 3908896 - RNA, 17 nt, Human adenovirus C
cauaccuugacauuggc

SEQ ID NO: 3908897 - RNA, 15 nt, Human adenovirus C
cauagaugccaugaa

SEQ ID NO: 3908898 - RNA, 16 nt, Human adenovirus C
cauauuuccugcagau

SEQ ID NO: 3908899 - RNA, 22 nt, Human adenovirus C
caucaacgcgcgcgcagccucc

SEQ ID NO: 3908900 - RNA, 16 nt, Human adenovirus C
caucagccccccucuc

SEQ ID NO: 3908901 - RNA, 21 nt, Human adenovirus C
caucaugucgcugacugcgcg

SEQ ID NO: 3908902 - RNA, 24 nt, Human adenovirus C
cauccacaaggccgugagcgugag

SEQ ID NO: 3908903 - RNA, 21 nt, Human adenovirus C
cauccauuucaaucacgugcu

SEQ ID NO: 3908904 - RNA, 13 nt, Human adenovirus C
caucccaccuuuc

SEQ ID NO: 3908905 - RNA, 22 nt, Human adenovirus C
caucccugagcaggggggccac

SEQ ID NO: 3908906 - RNA, 13 nt, Human adenovirus C
cauccgcgccgca

SEQ ID NO: 3908907 - RNA, 14 nt, Human adenovirus C
caucuccagcggcc

SEQ ID NO: 3908908 - RNA, 16 nt, Human adenovirus C
caucuccagcggccac

SEQ ID NO: 3908909 - RNA, 13 nt, Human adenovirus C
caucucgggccag

SEQ ID NO: 3908910 - RNA, 14 nt, Human adenovirus C
caucucuacagccc

SEQ ID NO: 3908911 - RNA, 15 nt, Human adenovirus C
caucugcagcgccag

SEQ ID NO: 3908912 - RNA, 22 nt, Human adenovirus C
caucuugcgcuaugugcagcag

SEQ ID NO: 3908913 - RNA, 23 nt, Human adenovirus C
caugagcgcgggaccccacauga

SEQ ID NO: 3908914 - RNA, 12 nt, Human adenovirus C
caugcacaucuc

SEQ ID NO: 3908915 - RNA, 18 nt, Human adenovirus C
caugcagggcacccuccc

SEQ ID NO: 3908916 - RNA, 17 nt, Human adenovirus C
caugcaucuguggagag

SEQ ID NO: 3908917 - RNA, 15 nt, Human adenovirus C
caugccuuugucaau

SEQ ID NO: 3908918 - RNA, 18 nt, Human adenovirus C
caugcgcgagggacaggc

SEQ ID NO: 3908919 - RNA, 16 nt, Human adenovirus C
caugcucagucugggc

SEQ ID NO: 3908920 - RNA, 23 nt, Human adenovirus C
cauggagucagucgagaaggagg

SEQ ID NO: 3908921 - RNA, 14 nt, Human adenovirus C
cauggcgcagcugu

SEQ ID NO: 3908922 - RNA, 17 nt, Human adenovirus C
caugggaaacuggcaag

SEQ ID NO: 3908923 - RNA, 18 nt, Human adenovirus C
cauggugucauaguccag

SEQ ID NO: 3908924 - RNA, 15 nt, Human adenovirus C
caugucgcccucuuc

SEQ ID NO: 3908925 - RNA, 14 nt, Human adenovirus C
caugucgccgccag

SEQ ID NO: 3908926 - RNA, 15 nt, Human adenovirus C
caugucgcuguccag

SEQ ID NO: 3908927 - RNA, 21 nt, Human adenovirus C
caugucgcuguccagcugcug

SEQ ID NO: 3908928 - RNA, 16 nt, Human adenovirus C
cauguucucuucuuuu

SEQ ID NO: 3908929 - RNA, 12 nt, Human adenovirus C
cauuaacaaaaa

SEQ ID NO: 3908930 - RNA, 20 nt, Human adenovirus C
cauuaaguuugacagcauuu

SEQ ID NO: 3908931 - RNA, 16 nt, Human adenovirus C
cauugaaaaccaugga

SEQ ID NO: 3908932 - RNA, 15 nt, Human adenovirus C
cauugcguaccucag

SEQ ID NO: 3908933 - RNA, 18 nt, Human adenovirus C
cauugcuuucagggacaa

SEQ ID NO: 3908934 - RNA, 17 nt, Human adenovirus C
cauuuggguaacaggag

SEQ ID NO: 3908935 - RNA, 20 nt, Human adenovirus C
ccaaaccucagcgccuccca

SEQ ID NO: 3908936 - RNA, 13 nt, Human adenovirus C
ccaaagcagacca

SEQ ID NO: 3908937 - RNA, 20 nt, Human adenovirus C
ccaaagcagaccaaagcaaa

SEQ ID NO: 3908938 - RNA, 14 nt, Human adenovirus C
ccaacacacagagu

SEQ ID NO: 3908939 - RNA, 22 nt, Human adenovirus C
ccaaccgcagccgagcggacaa

SEQ ID NO: 3908940 - RNA, 14 nt, Human adenovirus C
ccaagacuacucaa

SEQ ID NO: 3908941 - RNA, 16 nt, Human adenovirus C
ccaagcaguuccaggc

SEQ ID NO: 3908942 - RNA, 12 nt, Human adenovirus C
ccaagcgccagc

SEQ ID NO: 3908943 - RNA, 18 nt, Human adenovirus C
ccaauauugcgcuguacc

SEQ ID NO: 3908944 - RNA, 15 nt, Human adenovirus C
ccacaacgcgcagcc

SEQ ID NO: 3908945 - RNA, 15 nt, Human adenovirus C
ccacaauguggccuc

SEQ ID NO: 3908946 - RNA, 15 nt, Human adenovirus C
ccacagaacaugaaa

SEQ ID NO: 3908947 - RNA, 17 nt, Human adenovirus C
ccacagcggcggcagca

SEQ ID NO: 3908948 - RNA, 19 nt, Human adenovirus C
ccacagcucgcgguugagg

SEQ ID NO: 3908949 - RNA, 22 nt, Human adenovirus C
ccacauccuuggccaauugcaa

SEQ ID NO: 3908950 - RNA, 18 nt, Human adenovirus C
ccaccaguagcacuagua

SEQ ID NO: 3908951 - RNA, 12 nt, Human adenovirus C
ccacccuugccg

SEQ ID NO: 3908952 - RNA, 22 nt, Human adenovirus C
ccaccgcaaugcgggccuccgu

SEQ ID NO: 3908953 - RNA, 21 nt, Human adenovirus C
ccaccgcagaauaagccacac

SEQ ID NO: 3908954 - RNA, 12 nt, Human adenovirus C
ccacgccuuugc

SEQ ID NO: 3908955 - RNA, 18 nt, Human adenovirus C
ccacgcuggaagccaugc

SEQ ID NO: 3908956 - RNA, 13 nt, Human adenovirus C
ccacgugccgggc

SEQ ID NO: 3908957 - RNA, 13 nt, Human adenovirus C
ccacucgcuccag

SEQ ID NO: 3908958 - RNA, 14 nt, Human adenovirus C
ccacuguuacucag

SEQ ID NO: 3908959 - RNA, 18 nt, Human adenovirus C
ccacuguuacucagccac

SEQ ID NO: 3908960 - RNA, 14 nt, Human adenovirus C
ccacuuaaaaaaac

SEQ ID NO: 3908961 - RNA, 19 nt, Human adenovirus C
ccacuuaaacucaggcaca

SEQ ID NO: 3908962 - RNA, 13 nt, Human adenovirus C
ccagaggugcuug

SEQ ID NO: 3908963 - RNA, 20 nt, Human adenovirus C
ccagauguugcgcagcggca

SEQ ID NO: 3908964 - RNA, 22 nt, Human adenovirus C
ccagauuuuggcgcgcccgcca

SEQ ID NO: 3908965 - RNA, 19 nt, Human adenovirus C
ccagcaauaugagcggugg

SEQ ID NO: 3908966 - RNA, 13 nt, Human adenovirus C
ccagcagaggcgg

SEQ ID NO: 3908967 - RNA, 17 nt, Human adenovirus C
ccagcauaacaacucag

SEQ ID NO: 3908968 - RNA, 17 nt, Human adenovirus C
ccagcaucguuuaaaag

SEQ ID NO: 3908969 - RNA, 13 nt, Human adenovirus C
ccagcgacuggaa

SEQ ID NO: 3908970 - RNA, 14 nt, Human adenovirus C
ccagcgccugcacu

SEQ ID NO: 3908971 - RNA, 15 nt, Human adenovirus C
ccagcgccugcacug

SEQ ID NO: 3908972 - RNA, 16 nt, Human adenovirus C
ccagcgccugcacugc

SEQ ID NO: 3908973 - RNA, 17 nt, Human adenovirus C
ccagcgccugcacugca

SEQ ID NO: 3908974 - RNA, 13 nt, Human adenovirus C
ccagcggucucgg

SEQ ID NO: 3908975 - RNA, 23 nt, Human adenovirus C
ccagcugcuacaacaaacagagc

SEQ ID NO: 3908976 - RNA, 20 nt, Human adenovirus C
ccagcugcugagccacaggc

SEQ ID NO: 3908977 - RNA, 17 nt, Human adenovirus C
ccagcuggccaaaaccu

SEQ ID NO: 3908978 - RNA, 20 nt, Human adenovirus C
ccaggaaagucccgcuccca

SEQ ID NO: 3908979 - RNA, 13 nt, Human adenovirus C
ccaggaacagcuc

SEQ ID NO: 3908980 - RNA, 19 nt, Human adenovirus C
ccaggcggcggguacagug

SEQ ID NO: 3908981 - RNA, 17 nt, Human adenovirus C
ccaggcuuugaguugca

SEQ ID NO: 3908982 - RNA, 18 nt, Human adenovirus C
ccaggcuuugaguugcac

SEQ ID NO: 3908983 - RNA, 15 nt, Human adenovirus C
ccagguacagcccac

SEQ ID NO: 3908984 - RNA, 21 nt, Human adenovirus C
ccaggugcgggcgugacaaac

SEQ ID NO: 3908985 - RNA, 17 nt, Human adenovirus C
ccagucguagcaggagc

SEQ ID NO: 3908986 - RNA, 13 nt, Human adenovirus C
ccaguggagaggc

SEQ ID NO: 3908987 - RNA, 20 nt, Human adenovirus C
ccaguggagaggcagagcga

SEQ ID NO: 3908988 - RNA, 13 nt, Human adenovirus C
ccauagcggaugu

SEQ ID NO: 3908989 - RNA, 16 nt, Human adenovirus C
ccauaugacacagaaa

SEQ ID NO: 3908990 - RNA, 20 nt, Human adenovirus C
ccauccaaguauaggucucu

SEQ ID NO: 3908991 - RNA, 11 nt, Human adenovirus C
ccauccagaca

SEQ ID NO: 3908992 - RNA, 20 nt, Human adenovirus C
ccaucuccuaacugcagaau

SEQ ID NO: 3908993 - RNA, 23 nt, Human adenovirus C
ccaugaaccacccuacuuuccca

SEQ ID NO: 3908994 - RNA, 21 nt, Human adenovirus C
ccaugauuacuaaacuuggag

SEQ ID NO: 3908995 - RNA, 18 nt, Human adenovirus C
ccaugcccuucucccacg

SEQ ID NO: 3908996 - RNA, 15 nt, Human adenovirus C
ccaugcucagucugg

SEQ ID NO: 3908997 - RNA, 20 nt, Human adenovirus C
ccauggacgagcccacccuu

SEQ ID NO: 3908998 - RNA, 22 nt, Human adenovirus C
ccauggcccacaacacggccuc

SEQ ID NO: 3908999 - RNA, 18 nt, Human adenovirus C
ccauggcuaccggagugc

SEQ ID NO: 3909000 - RNA, 17 nt, Human adenovirus C
ccauggucuggagcucc

SEQ ID NO: 3909001 - RNA, 21 nt, Human adenovirus C
ccaugucgccgccagaggagc

SEQ ID NO: 3909002 - RNA, 23 nt, Human adenovirus C
ccauuaacgaggaugggcagggg

SEQ ID NO: 3909003 - RNA, 19 nt, Human adenovirus C
ccauucaacuaacauaaac

SEQ ID NO: 3909004 - RNA, 21 nt, Human adenovirus C
ccauucacguagccagccacu

SEQ ID NO: 3909005 - RNA, 22 nt, Human adenovirus C
ccauuuuuacaaagcgcgggcg

SEQ ID NO: 3909006 - RNA, 18 nt, Human adenovirus C
ccauuuuuccaaaacagg

SEQ ID NO: 3909007 - RNA, 19 nt, Human adenovirus C
cccaaaaagaagcugcagc

SEQ ID NO: 3909008 - RNA, 23 nt, Human adenovirus C
gugcgcgggcacuaccgcgcgcc

SEQ ID NO: 3909009 - RNA, 13 nt, Human adenovirus C
gugcggucgcccg

SEQ ID NO: 3909010 - RNA, 14 nt, Human adenovirus C
gugcugcggcagau

SEQ ID NO: 3909011 - RNA, 19 nt, Human adenovirus C
gugcuguugaagcaucugc

SEQ ID NO: 3909012 - RNA, 15 nt, Human adenovirus C
gugcuuaccuugagc

SEQ ID NO: 3909013 - RNA, 15 nt, Human adenovirus C
gugcuugccaccuau

SEQ ID NO: 3909014 - RNA, 19 nt, Human adenovirus C
guggaacgaagcugaugcu

SEQ ID NO: 3909015 - RNA, 17 nt, Human adenovirus C
guggaccuggccaacca

SEQ ID NO: 3909016 - RNA, 22 nt, Human adenovirus C
guggacguaaaggcuaaacccu

SEQ ID NO: 3909017 - RNA, 16 nt, Human adenovirus C
guggagaugacugaau

SEQ ID NO: 3909018 - RNA, 18 nt, Human adenovirus C
guggccgggggugcuugg

SEQ ID NO: 3909019 - RNA, 18 nt, Human adenovirus C
guggccuugcaggcgcag

SEQ ID NO: 3909020 - RNA, 14 nt, Human adenovirus C
guggcgcccucuuc

SEQ ID NO: 3909021 - RNA, 14 nt, Human adenovirus C
guggcuaccucucc

SEQ ID NO: 3909022 - RNA, 16 nt, Human adenovirus C
guggcucccgggcuug

SEQ ID NO: 3909023 - RNA, 23 nt, Human adenovirus C
guggugaaaguagaagucccugc

SEQ ID NO: 3909024 - RNA, 19 nt, Human adenovirus C
guggugcaggagcgcagcu

SEQ ID NO: 3909025 - RNA, 13 nt, Human adenovirus C
gugguggaccugg

SEQ ID NO: 3909026 - RNA, 17 nt, Human adenovirus C
gugucccuaaccaugac

SEQ ID NO: 3909027 - RNA, 19 nt, Human adenovirus C
gugucgaacccaggugugc

SEQ ID NO: 3909028 - RNA, 18 nt, Human adenovirus C
gugucguugacggcggcc

SEQ ID NO: 3909029 - RNA, 20 nt, Human adenovirus C
gugugaccccgaagccccuc

SEQ ID NO: 3909030 - RNA, 20 nt, Human adenovirus C
guguggaagccuggaccgau

SEQ ID NO: 3909031 - RNA, 16 nt, Human adenovirus C
guguggcaacugcgag

SEQ ID NO: 3909032 - RNA, 13 nt, Human adenovirus C
guguggcagcaau

SEQ ID NO: 3909033 - RNA, 15 nt, Human adenovirus C
guguuacuuuucagc

SEQ ID NO: 3909034 - RNA, 19 nt, Human adenovirus C
guuaacaugguucugcaga

SEQ ID NO: 3909035 - RNA, 23 nt, Human adenovirus C
guuccaggaaguacggcaccgcc

SEQ ID NO: 3909036 - RNA, 21 nt, Human adenovirus C
guuccauccggcccaggggcg

SEQ ID NO: 3909037 - RNA, 22 nt, Human adenovirus C
guuccauccggcccaggggcgu

SEQ ID NO: 3909038 - RNA, 23 nt, Human adenovirus C
guucccagcaucgcuacaaccuc

SEQ ID NO: 3909039 - RNA, 19 nt, Human adenovirus C
guuccugcucucacagauc

SEQ ID NO: 3909040 - RNA, 15 nt, Human adenovirus C
guucggggcugugcc

SEQ ID NO: 3909041 - RNA, 16 nt, Human adenovirus C
guucggggcugugccu

SEQ ID NO: 3909042 - RNA, 20 nt, Human adenovirus C
guucugcagagcucucuggg

SEQ ID NO: 3909043 - RNA, 13 nt, Human adenovirus C
guugacggccugg

SEQ ID NO: 3909044 - RNA, 15 nt, Human adenovirus C
guugagugggggacc

SEQ ID NO: 3909045 - RNA, 17 nt, Human adenovirus C
guugccucggcgguggc

SEQ ID NO: 3909046 - RNA, 23 nt, Human adenovirus C
guugcuggugaaggucagcugca

SEQ ID NO: 3909047 - RNA, 20 nt, Human adenovirus C
guuggaauucuucaccagca

SEQ ID NO: 3909048 - RNA, 17 nt, Human adenovirus C
guuggagaucugcacca

SEQ ID NO: 3909049 - RNA, 23 nt, Human adenovirus C
guuggagaugcgggccaugagcu

SEQ ID NO: 3909050 - RNA, 19 nt, Human adenovirus C
guuucagccccccggcgcc

SEQ ID NO: 3909051 - RNA, 16 nt, Human adenovirus C
guuucgcgcugcuccu

SEQ ID NO: 3909052 - RNA, 21 nt, Human adenovirus C
guuucgcgcugcuccucuucc

SEQ ID NO: 3909053 - RNA, 23 nt, Human adenovirus C
guuucuggcggaggugcugcuga

SEQ ID NO: 3909054 - RNA, 19 nt, Human adenovirus C
guuuguaccuauugucagc

SEQ ID NO: 3909055 - RNA, 13 nt, Human adenovirus C
guuuuccuggcca

SEQ ID NO: 3909056 - RNA, 21 nt, Human adenovirus C
uaaaacauaaauaaaaaccag

SEQ ID NO: 3909057 - RNA, 20 nt, Human adenovirus C
uaaacacgcuggacauaaac

SEQ ID NO: 3909058 - RNA, 22 nt, Human adenovirus C
uaaauauggaaaccccagacac

SEQ ID NO: 3909059 - RNA, 16 nt, Human adenovirus C
uaacacaggcuggggc

SEQ ID NO: 3909060 - RNA, 18 nt, Human adenovirus C
uaacaugguguguggcaa

SEQ ID NO: 3909061 - RNA, 13 nt, Human adenovirus C
uaacaugguucug

SEQ ID NO: 3909062 - RNA, 18 nt, Human adenovirus C
uaacgcuggaccugccuc

SEQ ID NO: 3909063 - RNA, 14 nt, Human adenovirus C
uaacuccagggugc

SEQ ID NO: 3909064 - RNA, 15 nt, Human adenovirus C
uaacucuacaagcuu

SEQ ID NO: 3909065 - RNA, 12 nt, Human adenovirus C
uaacuugcaugg

SEQ ID NO: 3909066 - RNA, 15 nt, Human adenovirus C
uaagucuaagcagcc

SEQ ID NO: 3909067 - RNA, 14 nt, Human adenovirus C
uaaugacugcaaau

SEQ ID NO: 3909068 - RNA, 19 nt, Human adenovirus C
uaaugagcuugaucugcug

SEQ ID NO: 3909069 - RNA, 12 nt, Human adenovirus C
uaaugcaucaaa

SEQ ID NO: 3909070 - RNA, 21 nt, Human adenovirus C
uaauguacuaggagacacuuu

SEQ ID NO: 3909071 - RNA, 14 nt, Human adenovirus C
uacaaaaagcgggc

SEQ ID NO: 3909072 - RNA, 13 nt, Human adenovirus C
uacaacaguuucc

SEQ ID NO: 3909073 - RNA, 19 nt, Human adenovirus C
uacaacaguuuccagcgag

SEQ ID NO: 3909074 - RNA, 23 nt, Human adenovirus C
uacaaccccaccaauguggaaau

SEQ ID NO: 3909075 - RNA, 13 nt, Human adenovirus C
uacaacgcucuag

SEQ ID NO: 3909076 - RNA, 16 nt, Human adenovirus C
uacaagcuacccaccc

SEQ ID NO: 3909077 - RNA, 19 nt, Human adenovirus C
uacaaggaguaucagcagg

SEQ ID NO: 3909078 - RNA, 18 nt, Human adenovirus C
uacaaguuguggccccca

SEQ ID NO: 3909079 - RNA, 23 nt, Human adenovirus C
uacaaguuguggcccccacaaaa

SEQ ID NO: 3909080 - RNA, 18 nt, Human adenovirus C
uacaauauuggcuaccag

SEQ ID NO: 3909081 - RNA, 13 nt, Human adenovirus C
uacaucugaccuc

SEQ ID NO: 3909082 - RNA, 21 nt, Human adenovirus C
uacaugcacaucucgggccag

SEQ ID NO: 3909083 - RNA, 15 nt, Human adenovirus C
uaccaacucuuacac

SEQ ID NO: 3909084 - RNA, 11 nt, Human adenovirus C
uaccagccaca

SEQ ID NO: 3909085 - RNA, 16 nt, Human adenovirus C
uaccgcgucaggaggg

SEQ ID NO: 3909086 - RNA, 15 nt, Human adenovirus C
uaccgucaucucuac

SEQ ID NO: 3909087 - RNA, 14 nt, Human adenovirus C
uaccuggaccccca

SEQ ID NO: 3909088 - RNA, 21 nt, Human adenovirus C
uaccugugcuuugcucccaaa

SEQ ID NO: 3909089 - RNA, 17 nt, Human adenovirus C
uaccuuuuuaaugcauc

SEQ ID NO: 3909090 - RNA, 21 nt, Human adenovirus C
uacgaacccccgcggcgccgg

SEQ ID NO: 3909091 - RNA, 15 nt, Human adenovirus C
uacgaacgccaccug

SEQ ID NO: 3909092 - RNA, 18 nt, Human adenovirus C
uacgacccuuacuacacc

SEQ ID NO: 3909093 - RNA, 13 nt, Human adenovirus C
uacgccaacuccg

SEQ ID NO: 3909094 - RNA, 12 nt, Human adenovirus C
uacgcccagaaa

SEQ ID NO: 3909095 - RNA, 12 nt, Human adenovirus C
uacgucacuucc

SEQ ID NO: 3909096 - RNA, 17 nt, Human adenovirus C
uacuaaaaaacuggaag

SEQ ID NO: 3909097 - RNA, 14 nt, Human adenovirus C
uacuaagaaaacac

SEQ ID NO: 3909098 - RNA, 16 nt, Human adenovirus C
uacuaagaaaacacau

SEQ ID NO: 3909099 - RNA, 18 nt, Human adenovirus C
uacucagccacuuaaaaa

SEQ ID NO: 3909100 - RNA, 18 nt, Human adenovirus C
uacucccauuuuuccaaa

SEQ ID NO: 3909101 - RNA, 21 nt, Human adenovirus C
uacuccggcacugccuacaac

SEQ ID NO: 3909102 - RNA, 22 nt, Human adenovirus C
uacuccggcacugccuacaacg

SEQ ID NO: 3909103 - RNA, 14 nt, Human adenovirus C
uacucuuauaaaau

SEQ ID NO: 3909104 - RNA, 14 nt, Human adenovirus C
uacugaaaugugug

SEQ ID NO: 3909105 - RNA, 15 nt, Human adenovirus C
uacugcaccggcggc

SEQ ID NO: 3909106 - RNA, 23 nt, Human adenovirus C
uacugcaccggcggcagcggcag

SEQ ID NO: 3909107 - RNA, 18 nt, Human adenovirus C
uacugcccgaauaugccc

SEQ ID NO: 3909108 - RNA, 19 nt, Human adenovirus C
uacuggucguugccagaca

SEQ ID NO: 3909109 - RNA, 14 nt, Human adenovirus C
uacuuaaaaucagu

SEQ ID NO: 3909110 - RNA, 15 nt, Human adenovirus C
uacuuuucagcagau

SEQ ID NO: 3909111 - RNA, 12 nt, Human adenovirus C
uagacugcuccu

SEQ ID NO: 3909112 - RNA, 12 nt, Human adenovirus C
uagaggagccuc

SEQ ID NO: 3909113 - RNA, 23 nt, Human adenovirus C
uagauuugcaagacagaaacaca

SEQ ID NO: 3909114 - RNA, 18 nt, Human adenovirus C
uagcaccacugcagagcu

SEQ ID NO: 3909115 - RNA, 23 nt, Human adenovirus C
uagcaccgguggguugcugaaac

SEQ ID NO: 3909116 - RNA, 16 nt, Human adenovirus C
uagcauguagaacugg

SEQ ID NO: 3909117 - RNA, 21 nt, Human adenovirus C
uagcgccauugcuucuucccc

SEQ ID NO: 3909118 - RNA, 19 nt, Human adenovirus C
uaggcgauuucggccauga

SEQ ID NO: 3909119 - RNA, 14 nt, Human adenovirus C
uaggcgcagcaucc

SEQ ID NO: 3909120 - RNA, 14 nt, Human adenovirus C
uagguguaggccac

SEQ ID NO: 3909121 - RNA, 15 nt, Human adenovirus C
uagugaauccacaga

SEQ ID NO: 3909122 - RNA, 23 nt, Human adenovirus C
uaguuucgcgcccuuucucaaau

SEQ ID NO: 3909123 - RNA, 18 nt, Human adenovirus C
uaguuuuguaucuguuuu

SEQ ID NO: 3909124 - RNA, 14 nt, Human adenovirus C
cuucagcuugccug

SEQ ID NO: 3909125 - RNA, 13 nt, Human adenovirus C
cuucauucagccg

SEQ ID NO: 3909126 - RNA, 12 nt, Human adenovirus C
cuucauucaguu

SEQ ID NO: 3909127 - RNA, 12 nt, Human adenovirus C
cuuccgcagcca

SEQ ID NO: 3909128 - RNA, 16 nt, Human adenovirus C
cuuccuuccaggcgcg

SEQ ID NO: 3909129 - RNA, 21 nt, Human adenovirus C
cuucgcaaauuuguaccugag

SEQ ID NO: 3909130 - RNA, 18 nt, Human adenovirus C
cuucucccacccccacug

SEQ ID NO: 3909131 - RNA, 21 nt, Human adenovirus C
cuugaaagugggcaggcagaa

SEQ ID NO: 3909132 - RNA, 17 nt, Human adenovirus C
cuugaagucgcaguugg

SEQ ID NO: 3909133 - RNA, 21 nt, Human adenovirus C
cuugacgaccguucgcacugg

SEQ ID NO: 3909134 - RNA, 23 nt, Human adenovirus C
cuugagacgcgcgagccugccga

SEQ ID NO: 3909135 - RNA, 12 nt, Human adenovirus C
cuugaggaggag

SEQ ID NO: 3909136 - RNA, 18 nt, Human adenovirus C
cuugagugcaugcagcgg

SEQ ID NO: 3909137 - RNA, 18 nt, Human adenovirus C
cuugcagauauggcccuc

SEQ ID NO: 3909138 - RNA, 22 nt, Human adenovirus C
cuugccuacgaacgccaccugu

SEQ ID NO: 3909139 - RNA, 14 nt, Human adenovirus C
cuugccugcuccag

SEQ ID NO: 3909140 - RNA, 19 nt, Human adenovirus C
cuugcgcuaugugcagcag

SEQ ID NO: 3909141 - RNA, 20 nt, Human adenovirus C
cuugcuggaacagagcucua

SEQ ID NO: 3909142 - RNA, 22 nt, Human adenovirus C
cuugcuuguauuccccuggaca

SEQ ID NO: 3909143 - RNA, 14 nt, Human adenovirus C
cuuggaugaugcau

SEQ ID NO: 3909144 - RNA, 22 nt, Human adenovirus C
cuuggcgcgcagcuugcccuug

SEQ ID NO: 3909145 - RNA, 23 nt, Human adenovirus C
cuugggagaggggcgcuucuuuu

SEQ ID NO: 3909146 - RNA, 19 nt, Human adenovirus C
cuuggguccggccugcuga

SEQ ID NO: 3909147 - RNA, 21 nt, Human adenovirus C
cuugucccuccgcacccacua

SEQ ID NO: 3909148 - RNA, 19 nt, Human adenovirus C
cuuugcaaguagcacaaaa

SEQ ID NO: 3909149 - RNA, 11 nt, Human adenovirus C
cuuugccaacu

SEQ ID NO: 3909150 - RNA, 20 nt, Human adenovirus C
cuuuggggucacugcuaccu

SEQ ID NO: 3909151 - RNA, 20 nt, Human adenovirus C
cuuugguagcugccuuccca

SEQ ID NO: 3909152 - RNA, 22 nt, Human adenovirus C
cuuuuaagggcguagagcuugg

SEQ ID NO: 3909153 - RNA, 17 nt, Human adenovirus C
cuuuuacugcugcugga

SEQ ID NO: 3909154 - RNA, 14 nt, Human adenovirus C
gaaaacagcgaaaa

SEQ ID NO: 3909155 - RNA, 13 nt, Human adenovirus C
gaaacacagagcu

SEQ ID NO: 3909156 - RNA, 14 nt, Human adenovirus C
gaaacacagagcug

SEQ ID NO: 3909157 - RNA, 11 nt, Human adenovirus C
gaaaccccaga

SEQ ID NO: 3909158 - RNA, 16 nt, Human adenovirus C
gaaaccucaccuccca

SEQ ID NO: 3909159 - RNA, 17 nt, Human adenovirus C
gaaaccugugcugccag

SEQ ID NO: 3909160 - RNA, 15 nt, Human adenovirus C
gaaacgcgcggcaaa

SEQ ID NO: 3909161 - RNA, 20 nt, Human adenovirus C
gaaacucggaccacucugag

SEQ ID NO: 3909162 - RNA, 15 nt, Human adenovirus C
gaaagcuuccgcagg

SEQ ID NO: 3909163 - RNA, 18 nt, Human adenovirus C
gaaagcuuccgcaggcca

SEQ ID NO: 3909164 - RNA, 17 nt, Human adenovirus C
gaaagugggcaggcaga

SEQ ID NO: 3909165 - RNA, 18 nt, Human adenovirus C
gaaaugccuguuugaaag

SEQ ID NO: 3909166 - RNA, 20 nt, Human adenovirus C
gaacagcaucgugggucugg

SEQ ID NO: 3909167 - RNA, 13 nt, Human adenovirus C
gaacaggcggcua

SEQ ID NO: 3909168 - RNA, 16 nt, Human adenovirus C
gaacauucccagcugc

SEQ ID NO: 3909169 - RNA, 20 nt, Human adenovirus C
gaaccuuuggacaccuccca

SEQ ID NO: 3909170 - RNA, 17 nt, Human adenovirus C
gaacgaccggcaaggca

SEQ ID NO: 3909171 - RNA, 22 nt, Human adenovirus C
gaacgguuguuaauuaccuggg

SEQ ID NO: 3909172 - RNA, 21 nt, Human adenovirus C
gaacugaggaugaauugccaa

SEQ ID NO: 3909173 - RNA, 20 nt, Human adenovirus C
gaagaacuggaucucccgcc

SEQ ID NO: 3909174 - RNA, 16 nt, Human adenovirus C
gaagacgacgggcccg

SEQ ID NO: 3909175 - RNA, 17 nt, Human adenovirus C
gaagacguaugcgcagg

SEQ ID NO: 3909176 - RNA, 21 nt, Human adenovirus C
gaagacguaugcgcaggagca

SEQ ID NO: 3909177 - RNA, 17 nt, Human adenovirus C
gaagacgugagcgguga

SEQ ID NO: 3909178 - RNA, 18 nt, Human adenovirus C
gaagaucuggaaggugcu

SEQ ID NO: 3909179 - RNA, 19 nt, Human adenovirus C
gaagaucuggaaggugcug

SEQ ID NO: 3909180 - RNA, 20 nt, Human adenovirus C
gaagaucuggaaggugcuga

SEQ ID NO: 3909181 - RNA, 21 nt, Human adenovirus C
gaagcugcagcugccgccgcc

SEQ ID NO: 3909182 - RNA, 14 nt, Human adenovirus C
gaaggugauugguu

SEQ ID NO: 3909183 - RNA, 21 nt, Human adenovirus C
gaagugauuaucgagcaggac

SEQ ID NO: 3909184 - RNA, 22 nt, Human adenovirus C
gaagugauuaucgagcaggacc

SEQ ID NO: 3909185 - RNA, 20 nt, Human adenovirus C
gaaucaggcuguagacagcu

SEQ ID NO: 3909186 - RNA, 14 nt, Human adenovirus C
ggcaacgaccgccu

SEQ ID NO: 3909187 - RNA, 22 nt, Human adenovirus C
ggcaaugcagccgguggaggac

SEQ ID NO: 3909188 - RNA, 23 nt, Human adenovirus C
ggcacaaccauccgcggcagcuc

SEQ ID NO: 3909189 - RNA, 20 nt, Human adenovirus C
ggcacacgugcauacacuuc

SEQ ID NO: 3909190 - RNA, 21 nt, Human adenovirus C
ggcaccauccgcaauacagag

SEQ ID NO: 3909191 - RNA, 18 nt, Human adenovirus C
ggcacugccuguucgccg

SEQ ID NO: 3909192 - RNA, 16 nt, Human adenovirus C
ggcagagcgacugcgc

SEQ ID NO: 3909193 - RNA, 18 nt, Human adenovirus C
ggcagagcgacugcgccu

SEQ ID NO: 3909194 - RNA, 19 nt, Human adenovirus C
ggcagcaaugccuggagga

SEQ ID NO: 3909195 - RNA, 17 nt, Human adenovirus C
ggcagcagccgcaggcc

SEQ ID NO: 3909196 - RNA, 16 nt, Human adenovirus C
ggcagcggugcacggg

SEQ ID NO: 3909197 - RNA, 13 nt, Human adenovirus C
ggcagcucgguga

SEQ ID NO: 3909198 - RNA, 12 nt, Human adenovirus C
ggcaggacccug

SEQ ID NO: 3909199 - RNA, 19 nt, Human adenovirus C
ggcaggacccuggugcugc

SEQ ID NO: 3909200 - RNA, 22 nt, Human adenovirus C
ggcaggggcacgucggcgccgc

SEQ ID NO: 3909201 - RNA, 22 nt, Human adenovirus C
ggcaguugccgaggaugaagaa

SEQ ID NO: 3909202 - RNA, 16 nt, Human adenovirus C
ggcaucucgauccagc

SEQ ID NO: 3909203 - RNA, 16 nt, Human adenovirus C
ggccaaccaggcagug

SEQ ID NO: 3909204 - RNA, 19 nt, Human adenovirus C
ggccaaccaggcagugcaa

SEQ ID NO: 3909205 - RNA, 22 nt, Human adenovirus C
ggccaaucaagcagguggcacc

SEQ ID NO: 3909206 - RNA, 19 nt, Human adenovirus C
ggccagcuguuggggugag

SEQ ID NO: 3909207 - RNA, 17 nt, Human adenovirus C
ggccaguguuugagcac

SEQ ID NO: 3909208 - RNA, 17 nt, Human adenovirus C
ggccaucauaccacaag

SEQ ID NO: 3909209 - RNA, 16 nt, Human adenovirus C
ggccauucagaccgug

SEQ ID NO: 3909210 - RNA, 22 nt, Human adenovirus C
ggccauuuuuacaaagcgcggg

SEQ ID NO: 3909211 - RNA, 11 nt, Human adenovirus C
ggcccacgggc

SEQ ID NO: 3909212 - RNA, 20 nt, Human adenovirus C
ggccccaaacucccauggau

SEQ ID NO: 3909213 - RNA, 18 nt, Human adenovirus C
ggcccgaugaggccggcc

SEQ ID NO: 3909214 - RNA, 15 nt, Human adenovirus C
ggcccgcggugaugc

SEQ ID NO: 3909215 - RNA, 13 nt, Human adenovirus C
ggccgacgggcgg

SEQ ID NO: 3909216 - RNA, 13 nt, Human adenovirus C
ggccgaggcagcg

SEQ ID NO: 3909217 - RNA, 20 nt, Human adenovirus C
ggccgccgugaaccccgagu

SEQ ID NO: 3909218 - RNA, 17 nt, Human adenovirus C
ggccggaccugggcugg

SEQ ID NO: 3909219 - RNA, 15 nt, Human adenovirus C
ggccguagguggcgc

SEQ ID NO: 3909220 - RNA, 16 nt, Human adenovirus C
ggccguggagacagug

SEQ ID NO: 3909221 - RNA, 17 nt, Human adenovirus C
ggccguucucgcggggg

SEQ ID NO: 3909222 - RNA, 20 nt, Human adenovirus C
ggccguucucgcgggggcgc

SEQ ID NO: 3909223 - RNA, 17 nt, Human adenovirus C
ggccuacuggaguguca

SEQ ID NO: 3909224 - RNA, 14 nt, Human adenovirus C
ggccugacgggcgg

SEQ ID NO: 3909225 - RNA, 17 nt, Human adenovirus C
ggccugacgggcggcau

SEQ ID NO: 3909226 - RNA, 16 nt, Human adenovirus C
ggccuuccggagcgag

SEQ ID NO: 3909227 - RNA, 15 nt, Human adenovirus C
ggccuugcggcaggg

SEQ ID NO: 3909228 - RNA, 17 nt, Human adenovirus C
ggcgacgagcggccgcc

SEQ ID NO: 3909229 - RNA, 19 nt, Human adenovirus C
ggcgagggccuggcgcggc

SEQ ID NO: 3909230 - RNA, 22 nt, Human adenovirus C
ggcgauccuaacucugcagacc

SEQ ID NO: 3909231 - RNA, 14 nt, Human adenovirus C
ggcgaugagcagcu

SEQ ID NO: 3909232 - RNA, 21 nt, Human adenovirus C
ggcgcaccgggaggcggucga

SEQ ID NO: 3909233 - RNA, 23 nt, Human adenovirus C
ggcgcacggcguccggcucacca

SEQ ID NO: 3909234 - RNA, 16 nt, Human adenovirus C
ggcgccgcgcgcgggc

SEQ ID NO: 3909235 - RNA, 19 nt, Human adenovirus C
ggcgcgcugcggcugcugu

SEQ ID NO: 3909236 - RNA, 16 nt, Human adenovirus C
ggcgcgcuggucucug

SEQ ID NO: 3909237 - RNA, 23 nt, Human adenovirus C
ggcgcuccauggccucguagaag

SEQ ID NO: 3909238 - RNA, 12 nt, Human adenovirus C
ggcggaggcgcg

SEQ ID NO: 3909239 - RNA, 14 nt, Human adenovirus C
ggcggaggugcugc

SEQ ID NO: 3909240 - RNA, 11 nt, Human adenovirus C
ggcggcagcag

SEQ ID NO: 3909241 - RNA, 11 nt, Human adenovirus C
ggcggcagcgg

SEQ ID NO: 3909242 - RNA, 23 nt, Human adenovirus C
ggcggcagcggcagcggcagcaa

SEQ ID NO: 3909243 - RNA, 13 nt, Human adenovirus C
ggcggcgcgcaac

SEQ ID NO: 3909244 - RNA, 16 nt, Human adenovirus C
ggcggcgcugcagagc

SEQ ID NO: 3909245 - RNA, 21 nt, Human adenovirus C
ggcggcgcugcagagccagcc

SEQ ID NO: 3909246 - RNA, 14 nt, Human adenovirus C
ggcggcgcuggccg

SEQ ID NO: 3909247 - RNA, 19 nt, Human adenovirus C
ggcggcuauuaccaccaca

SEQ ID NO: 3909248 - RNA, 20 nt, Human adenovirus C
ggcggcuuucgucacagggu

SEQ ID NO: 3909249 - RNA, 12 nt, Human adenovirus C
ggcgggcggcag

SEQ ID NO: 3909250 - RNA, 16 nt, Human adenovirus C
ggcgggcggugggccg

SEQ ID NO: 3909251 - RNA, 12 nt, Human adenovirus C
ggcgggcugcuc

SEQ ID NO: 3909252 - RNA, 15 nt, Human adenovirus C
ggcggggggcugccg

SEQ ID NO: 3909253 - RNA, 21 nt, Human adenovirus C
ggcggucggccaugccccagg

SEQ ID NO: 3909254 - RNA, 14 nt, Human adenovirus C
ggcgguggcagaug

SEQ ID NO: 3909255 - RNA, 16 nt, Human adenovirus C
ggcgguggcagaugcc

SEQ ID NO: 3909256 - RNA, 22 nt, Human adenovirus C
ggcguccggcucaccacccagg

SEQ ID NO: 3909257 - RNA, 19 nt, Human adenovirus C
ggcgugcuggacagggggc

SEQ ID NO: 3909258 - RNA, 17 nt, Human adenovirus C
ggcguugccgcuggacg

SEQ ID NO: 3909259 - RNA, 15 nt, Human adenovirus C
ggcuacuaagaaaac

SEQ ID NO: 3909260 - RNA, 15 nt, Human adenovirus C
ggcuauaggacugau

SEQ ID NO: 3909261 - RNA, 15 nt, Human adenovirus C
ggcucaccacccagg

SEQ ID NO: 3909262 - RNA, 22 nt, Human adenovirus C
ggcucgcucccuguagccggag

SEQ ID NO: 3909263 - RNA, 19 nt, Human adenovirus C
ggcugacaagguggccgcc

SEQ ID NO: 3909264 - RNA, 17 nt, Human adenovirus C
ggcugacgcggcggcag

SEQ ID NO: 3909265 - RNA, 19 nt, Human adenovirus C
ggcugacgcggcggcagau

SEQ ID NO: 3909266 - RNA, 18 nt, Human adenovirus C
ggcugccgugcggcaggg

SEQ ID NO: 3909267 - RNA, 13 nt, Human adenovirus C
ggcugcuuguccu

SEQ ID NO: 3909268 - RNA, 15 nt, Human adenovirus C
ggcuggcgguggcac

SEQ ID NO: 3909269 - RNA, 23 nt, Human adenovirus C
ggcuguacauccugcacgagguu

SEQ ID NO: 3909270 - RNA, 22 nt, Human adenovirus C
ggcuugggaguguuuggaagau

SEQ ID NO: 3909271 - RNA, 21 nt, Human adenovirus C
ggcuuuguuucuccacacaag

SEQ ID NO: 3909272 - RNA, 13 nt, Human adenovirus C
gggaacaacccau

SEQ ID NO: 3909273 - RNA, 23 nt, Human adenovirus C
gggacauuucagaucggcggcgc

SEQ ID NO: 3909274 - RNA, 20 nt, Human adenovirus C
gggacuugcggcuggagcug

SEQ ID NO: 3909275 - RNA, 18 nt, Human adenovirus C
cgcaccgucgcaugcgcg

SEQ ID NO: 3909276 - RNA, 17 nt, Human adenovirus C
cgcaccuacaagcgcgu

SEQ ID NO: 3909277 - RNA, 15 nt, Human adenovirus C
cgcaccugccccuac

SEQ ID NO: 3909278 - RNA, 19 nt, Human adenovirus C
cgcacugggcgcaccaccg

SEQ ID NO: 3909279 - RNA, 21 nt, Human adenovirus C
cgcagcccuaucagcagccgc

SEQ ID NO: 3909280 - RNA, 12 nt, Human adenovirus C
cgcagccggugg

SEQ ID NO: 3909281 - RNA, 17 nt, Human adenovirus C
cgcagccggugggcccg

SEQ ID NO: 3909282 - RNA, 22 nt, Human adenovirus C
cgcagcugccuguaucacaaaa

SEQ ID NO: 3909283 - RNA, 17 nt, Human adenovirus C
cgcagcuugagccuggc

SEQ ID NO: 3909284 - RNA, 20 nt, Human adenovirus C
cgcagcuugagccuggcuga

SEQ ID NO: 3909285 - RNA, 21 nt, Human adenovirus C
cgcagcuuguugaccagcucg

SEQ ID NO: 3909286 - RNA, 15 nt, Human adenovirus C
cgcaggcggcggcaa

SEQ ID NO: 3909287 - RNA, 22 nt, Human adenovirus C
cgcaucgcuaugcgccacuggc

SEQ ID NO: 3909288 - RNA, 16 nt, Human adenovirus C
cgcaugaccaccugcg

SEQ ID NO: 3909289 - RNA, 17 nt, Human adenovirus C
cgcaugcccccaugggc

SEQ ID NO: 3909290 - RNA, 16 nt, Human adenovirus C
cgcauggucucgguga

SEQ ID NO: 3909291 - RNA, 24 nt, Human adenovirus C
cgccaaccgcgguugugcagggug

SEQ ID NO: 3909292 - RNA, 17 nt, Human adenovirus C
cgccagacgccgcaccu

SEQ ID NO: 3909293 - RNA, 19 nt, Human adenovirus C
cgccagacgccgcaccugc

SEQ ID NO: 3909294 - RNA, 15 nt, Human adenovirus C
cgccagaggagcugc

SEQ ID NO: 3909295 - RNA, 21 nt, Human adenovirus C
cgcccacaccuacagccugag

SEQ ID NO: 3909296 - RNA, 20 nt, Human adenovirus C
cgcccagcaauaacacaggc

SEQ ID NO: 3909297 - RNA, 15 nt, Human adenovirus C
cgccccaggcugggg

SEQ ID NO: 3909298 - RNA, 14 nt, Human adenovirus C
cgcccccuuugagu

SEQ ID NO: 3909299 - RNA, 23 nt, Human adenovirus C
cgcccguucaugggaaacuggca

SEQ ID NO: 3909300 - RNA, 20 nt, Human adenovirus C
cgcccuacuuccgcagccac

SEQ ID NO: 3909301 - RNA, 15 nt, Human adenovirus C
cgcccucuccugagc

SEQ ID NO: 3909302 - RNA, 20 nt, Human adenovirus C
cgcccuggaggcagcugggg

SEQ ID NO: 3909303 - RNA, 19 nt, Human adenovirus C
cgccgaaccaccacuggaa

SEQ ID NO: 3909304 - RNA, 12 nt, Human adenovirus C
cgccgcagcagc

SEQ ID NO: 3909305 - RNA, 15 nt, Human adenovirus C
cgccgcagcagccgc

SEQ ID NO: 3909306 - RNA, 13 nt, Human adenovirus C
cgccgccaccagu

SEQ ID NO: 3909307 - RNA, 15 nt, Human adenovirus C
cgccgccgacccggc

SEQ ID NO: 3909308 - RNA, 15 nt, Human adenovirus C
cgccgccgcagcccu

SEQ ID NO: 3909309 - RNA, 15 nt, Human adenovirus C
cgccgccggcacugc

SEQ ID NO: 3909310 - RNA, 18 nt, Human adenovirus C
cgccggcgccccagaaau

SEQ ID NO: 3909311 - RNA, 23 nt, Human adenovirus C
cgccgggagagggggcaggggca

SEQ ID NO: 3909312 - RNA, 15 nt, Human adenovirus C
cgccguuagcccaag

SEQ ID NO: 3909313 - RNA, 16 nt, Human adenovirus C
cgccuaccaggcaagc

SEQ ID NO: 3909314 - RNA, 14 nt, Human adenovirus C
cgccugacacaccu

SEQ ID NO: 3909315 - RNA, 12 nt, Human adenovirus C
cgccugcugcac

SEQ ID NO: 3909316 - RNA, 22 nt, Human adenovirus C
cgccugcugccaugcgcgggcg

SEQ ID NO: 3909317 - RNA, 13 nt, Human adenovirus C
cgccugcugggcg

SEQ ID NO: 3909318 - RNA, 17 nt, Human adenovirus C
cgccugcuuacucccaa

SEQ ID NO: 3909319 - RNA, 22 nt, Human adenovirus C
cgccuguggacuauucugcugc

SEQ ID NO: 3909320 - RNA, 21 nt, Human adenovirus C
cgccuucgaucucagcgcagc

SEQ ID NO: 3909321 - RNA, 15 nt, Human adenovirus C
cgcgagacugggggc

SEQ ID NO: 3909322 - RNA, 23 nt, Human adenovirus C
cgcgagcugaugcacagccugca

SEQ ID NO: 3909323 - RNA, 19 nt, Human adenovirus C
cgcgagggagaggagcccg

SEQ ID NO: 3909324 - RNA, 18 nt, Human adenovirus C
cgcgcaaaccccacgcac

SEQ ID NO: 3909325 - RNA, 22 nt, Human adenovirus C
cgcgcaaaccccacgcacgaga

SEQ ID NO: 3909326 - RNA, 14 nt, Human adenovirus C
cgcgcaccuggcgg

SEQ ID NO: 3909327 - RNA, 13 nt, Human adenovirus C
cgcgcccuggggc

SEQ ID NO: 3909328 - RNA, 16 nt, Human adenovirus C
cgcgccuaccaccuuc

SEQ ID NO: 3909329 - RNA, 18 nt, Human adenovirus C
cgcgcgcagcagcagggc

SEQ ID NO: 3909330 - RNA, 14 nt, Human adenovirus C
cgcgcgucgcaccg

SEQ ID NO: 3909331 - RNA, 14 nt, Human adenovirus C
cgcgcugcggcugc

SEQ ID NO: 3909332 - RNA, 15 nt, Human adenovirus C
cgcgcuggccagggu

SEQ ID NO: 3909333 - RNA, 15 nt, Human adenovirus C
cgcggcgacagguca

SEQ ID NO: 3909334 - RNA, 14 nt, Human adenovirus C
cgcggcgacggcgc

SEQ ID NO: 3909335 - RNA, 17 nt, Human adenovirus C
cgcggcggcggcccugc

SEQ ID NO: 3909336 - RNA, 13 nt, Human adenovirus C
cgcggcggcugcu

SEQ ID NO: 3909337 - RNA, 20 nt, Human adenovirus C
cgcggcggucaccagaggcu

SEQ ID NO: 3909338 - RNA, 15 nt, Human adenovirus C
cgcggcguaagcggu

SEQ ID NO: 3909339 - RNA, 22 nt, Human adenovirus C
cgcggcgugcuggacagggggc

SEQ ID NO: 3909340 - RNA, 15 nt, Human adenovirus C
cgcggcugacgcggc

SEQ ID NO: 3909341 - RNA, 19 nt, Human adenovirus C
cgcggcuguagaccacgcc

SEQ ID NO: 3909342 - RNA, 15 nt, Human adenovirus C
cgcgggcggagggug

SEQ ID NO: 3909343 - RNA, 13 nt, Human adenovirus C
cgcgguaggcccg

SEQ ID NO: 3909344 - RNA, 16 nt, Human adenovirus C
cgcgguucacccuggc

SEQ ID NO: 3909345 - RNA, 17 nt, Human adenovirus C
cgcgucaugcacgcagc

SEQ ID NO: 3909346 - RNA, 14 nt, Human adenovirus C
cgcguccaggccag

SEQ ID NO: 3909347 - RNA, 15 nt, Human adenovirus C
cgcguccaggccagc

SEQ ID NO: 3909348 - RNA, 16 nt, Human adenovirus C
cgcguuccggcagcag

SEQ ID NO: 3909349 - RNA, 17 nt, Human adenovirus C
cgcuaugcgccacuggc

SEQ ID NO: 3909350 - RNA, 17 nt, Human adenovirus C
cgcucauggcgcagcug

SEQ ID NO: 3909351 - RNA, 19 nt, Human adenovirus C
cgcucgucgggcaccaggu

SEQ ID NO: 3909352 - RNA, 16 nt, Human adenovirus C
cgcucugcuuauuaca

SEQ ID NO: 3909353 - RNA, 15 nt, Human adenovirus C
cgcugaggccgaggc

SEQ ID NO: 3909354 - RNA, 14 nt, Human adenovirus C
cgcugcccuggugu

SEQ ID NO: 3909355 - RNA, 19 nt, Human adenovirus C
cgcuggacaugaccgcgcg

SEQ ID NO: 3909356 - RNA, 17 nt, Human adenovirus C
cgcuggccagcacgcuc

SEQ ID NO: 3909357 - RNA, 12 nt, Human adenovirus C
cgcuggccaggg

SEQ ID NO: 3909358 - RNA, 13 nt, Human adenovirus C
cgcuggccagggu

SEQ ID NO: 3909359 - RNA, 20 nt, Human adenovirus C
cgcuggccgaaaacagggcc

SEQ ID NO: 3909360 - RNA, 13 nt, Human adenovirus C
cgcuggggcagga

SEQ ID NO: 3909361 - RNA, 17 nt, Human adenovirus C
cgcuggggcaggaggac

SEQ ID NO: 3909362 - RNA, 16 nt, Human adenovirus C
cgcuguaccugccaga

SEQ ID NO: 3909363 - RNA, 15 nt, Human adenovirus C
cgcuguacggcagua

SEQ ID NO: 3909364 - RNA, 23 nt, Human adenovirus C
cgcuguccacgaucaccucuggg

SEQ ID NO: 3909365 - RNA, 18 nt, Human adenovirus C
cggaaaccucaccuccca

SEQ ID NO: 3909366 - RNA, 19 nt, Human adenovirus C
cggaagacuaucugccuga

SEQ ID NO: 3909367 - RNA, 19 nt, Human adenovirus C
cggacuaucgcaacaccac

SEQ ID NO: 3909368 - RNA, 19 nt, Human adenovirus C
cggaggcguacaugccgca

SEQ ID NO: 3909369 - RNA, 12 nt, Human adenovirus C
acaaagcagggg

SEQ ID NO: 3909370 - RNA, 16 nt, Human adenovirus C
acaacuuugccaugga

SEQ ID NO: 3909371 - RNA, 12 nt, Human adenovirus C
acaagugggaau

SEQ ID NO: 3909372 - RNA, 18 nt, Human adenovirus C
acaagugggaauuugaag

SEQ ID NO: 3909373 - RNA, 21 nt, Human adenovirus C
acaauaggaaacaaaaaugau

SEQ ID NO: 3909374 - RNA, 14 nt, Human adenovirus C
acaaugacuacagc

SEQ ID NO: 3909375 - RNA, 22 nt, Human adenovirus C
acaauguggccuccgacugugg

SEQ ID NO: 3909376 - RNA, 14 nt, Human adenovirus C
acacagaagcaaag

SEQ ID NO: 3909377 - RNA, 13 nt, Human adenovirus C
acacagcccgcca

SEQ ID NO: 3909378 - RNA, 19 nt, Human adenovirus C
acacccggcgccagcaccu

SEQ ID NO: 3909379 - RNA, 15 nt, Human adenovirus C
acaccgucacccucg

SEQ ID NO: 3909380 - RNA, 14 nt, Human adenovirus C
acaccuacagccug

SEQ ID NO: 3909381 - RNA, 16 nt, Human adenovirus C
acaccuacgacuacau

SEQ ID NO: 3909382 - RNA, 13 nt, Human adenovirus C
acacggccuccac

SEQ ID NO: 3909383 - RNA, 18 nt, Human adenovirus C
acacugauuaaaaacaag

SEQ ID NO: 3909384 - RNA, 19 nt, Human adenovirus C
acagauaauggcauuugua

SEQ ID NO: 3909385 - RNA, 15 nt, Human adenovirus C
acagccgccugagca

SEQ ID NO: 3909386 - RNA, 20 nt, Human adenovirus C
acagcggcaacgugcagacc

SEQ ID NO: 3909387 - RNA, 15 nt, Human adenovirus C
acagcugccgccaug

SEQ ID NO: 3909388 - RNA, 20 nt, Human adenovirus C
acagcuuccuggagcgccac

SEQ ID NO: 3909389 - RNA, 13 nt, Human adenovirus C
acaggccgcguca

SEQ ID NO: 3909390 - RNA, 22 nt, Human adenovirus C
acauauuuccugcagauucacu

SEQ ID NO: 3909391 - RNA, 14 nt, Human adenovirus C
acaucauggaagac

SEQ ID NO: 3909392 - RNA, 22 nt, Human adenovirus C
acauccgcggcgugcuggacag

SEQ ID NO: 3909393 - RNA, 23 nt, Human adenovirus C
acaucgaaguagauugcauccca

SEQ ID NO: 3909394 - RNA, 17 nt, Human adenovirus C
acaucucgggccaggac

SEQ ID NO: 3909395 - RNA, 15 nt, Human adenovirus C
acaugcgagcccaac

SEQ ID NO: 3909396 - RNA, 20 nt, Human adenovirus C
acauuacucccauuuuucca

SEQ ID NO: 3909397 - RNA, 16 nt, Human adenovirus C
acauucccagcugcua

SEQ ID NO: 3909398 - RNA, 23 nt, Human adenovirus C
accaaaagugguuuuguacagug

SEQ ID NO: 3909399 - RNA, 12 nt, Human adenovirus C
accaauguggaa

SEQ ID NO: 3909400 - RNA, 18 nt, Human adenovirus C
accacagaccggucccag

SEQ ID NO: 3909401 - RNA, 14 nt, Human adenovirus C
accaccacaccucg

SEQ ID NO: 3909402 - RNA, 15 nt, Human adenovirus C
accaccacuggaacc

SEQ ID NO: 3909403 - RNA, 22 nt, Human adenovirus C
accacccgcccgcgccugcugg

SEQ ID NO: 3909404 - RNA, 16 nt, Human adenovirus C
accacccuccucaccu

SEQ ID NO: 3909405 - RNA, 15 nt, Human adenovirus C
accacuguuacucag

SEQ ID NO: 3909406 - RNA, 15 nt, Human adenovirus C
accacuuacuggcug

SEQ ID NO: 3909407 - RNA, 18 nt, Human adenovirus C
accagacauuacucccau

SEQ ID NO: 3909408 - RNA, 23 nt, Human adenovirus C
accagauauuuuucuauguggaa

SEQ ID NO: 3909409 - RNA, 19 nt, Human adenovirus C
accagcaauaugagcggug

SEQ ID NO: 3909410 - RNA, 14 nt, Human adenovirus C
accagccgcaccgc

SEQ ID NO: 3909411 - RNA, 20 nt, Human adenovirus C
accagccugugaugcuggau

SEQ ID NO: 3909412 - RNA, 21 nt, Human adenovirus C
accagcucaaucagucacagu

SEQ ID NO: 3909413 - RNA, 18 nt, Human adenovirus C
accauccuaaaccagcug

SEQ ID NO: 3909414 - RNA, 18 nt, Human adenovirus C
accaugcgcgagggacag

SEQ ID NO: 3909415 - RNA, 15 nt, Human adenovirus C
acccaacaccuagcc

SEQ ID NO: 3909416 - RNA, 18 nt, Human adenovirus C
acccaagggugcagcuga

SEQ ID NO: 3909417 - RNA, 16 nt, Human adenovirus C
acccaccgugcagcug

SEQ ID NO: 3909418 - RNA, 16 nt, Human adenovirus C
accccaacaccuacga

SEQ ID NO: 3909419 - RNA, 17 nt, Human adenovirus C
accccaaguucaugccu

SEQ ID NO: 3909420 - RNA, 14 nt, Human adenovirus C
acccccgcggcgcc

SEQ ID NO: 3909421 - RNA, 12 nt, Human adenovirus C
accccgcaccgc

SEQ ID NO: 3909422 - RNA, 18 nt, Human adenovirus C
accccgccaacgugcccu

SEQ ID NO: 3909423 - RNA, 13 nt, Human adenovirus C
accccgcgccacu

SEQ ID NO: 3909424 - RNA, 20 nt, Human adenovirus C
acccgcaccaggugcagacc

SEQ ID NO: 3909425 - RNA, 20 nt, Human adenovirus C
acccgcccgcgccugcuggg

SEQ ID NO: 3909426 - RNA, 22 nt, Human adenovirus C
acccgcccgcgccugcugggcg

SEQ ID NO: 3909427 - RNA, 15 nt, Human adenovirus C
acccgcgcgcgcugg

SEQ ID NO: 3909428 - RNA, 13 nt, Human adenovirus C
gggagaggagccc

SEQ ID NO: 3909429 - RNA, 13 nt, Human adenovirus C
gggagaggggcgc

SEQ ID NO: 3909430 - RNA, 15 nt, Human adenovirus C
gggagaucagcuggg

SEQ ID NO: 3909431 - RNA, 14 nt, Human adenovirus C
gggagcuccugcag

SEQ ID NO: 3909432 - RNA, 22 nt, Human adenovirus C
gggaggcaagcacacagaccau

SEQ ID NO: 3909433 - RNA, 14 nt, Human adenovirus C
gggcaaagaagcgc

SEQ ID NO: 3909434 - RNA, 14 nt, Human adenovirus C
gggcccggcgcacg

SEQ ID NO: 3909435 - RNA, 12 nt, Human adenovirus C
gggccggggugc

SEQ ID NO: 3909436 - RNA, 19 nt, Human adenovirus C
gggcgggcccccggaggua

SEQ ID NO: 3909437 - RNA, 14 nt, Human adenovirus C
gggcggugggccgc

SEQ ID NO: 3909438 - RNA, 19 nt, Human adenovirus C
gggcguggcuuaagggugg

SEQ ID NO: 3909439 - RNA, 16 nt, Human adenovirus C
gggcguguggcagcaa

SEQ ID NO: 3909440 - RNA, 15 nt, Human adenovirus C
gggcugcgcgcuggc

SEQ ID NO: 3909441 - RNA, 20 nt, Human adenovirus C
gggcugguugguggcggcgu

SEQ ID NO: 3909442 - RNA, 23 nt, Human adenovirus C
ggggaggggggacacggcggcga

SEQ ID NO: 3909443 - RNA, 18 nt, Human adenovirus C
ggggauucauguugugca

SEQ ID NO: 3909444 - RNA, 21 nt, Human adenovirus C
ggggcaacaucuccuucgccc

SEQ ID NO: 3909445 - RNA, 15 nt, Human adenovirus C
ggggcauggccggcc

SEQ ID NO: 3909446 - RNA, 18 nt, Human adenovirus C
ggggcgcgcuggucucug

SEQ ID NO: 3909447 - RNA, 11 nt, Human adenovirus C
ggggucacugc

SEQ ID NO: 3909448 - RNA, 21 nt, Human adenovirus C
gggguccacucgcuccagggu

SEQ ID NO: 3909449 - RNA, 13 nt, Human adenovirus C
ggggugggugagc

SEQ ID NO: 3909450 - RNA, 14 nt, Human adenovirus C
gggguuugacccag

SEQ ID NO: 3909451 - RNA, 17 nt, Human adenovirus C
ggguaacagacauauuc

SEQ ID NO: 3909452 - RNA, 13 nt, Human adenovirus C
gggucgcaggggc

SEQ ID NO: 3909453 - RNA, 21 nt, Human adenovirus C
gggucuuuuaccagcacucgc

SEQ ID NO: 3909454 - RNA, 14 nt, Human adenovirus C
gggugguggaccug

SEQ ID NO: 3909455 - RNA, 21 nt, Human adenovirus C
ggguguucuugcuggucaggc

SEQ ID NO: 3909456 - RNA, 17 nt, Human adenovirus C
ggguugaaacucacucc

SEQ ID NO: 3909457 - RNA, 21 nt, Human adenovirus C
ggguuguuucuggcggaggug

SEQ ID NO: 3909458 - RNA, 13 nt, Human adenovirus C
ggguuugccuccc

SEQ ID NO: 3909459 - RNA, 23 nt, Human adenovirus C
gguaccgcgcggcgggcgguggg

SEQ ID NO: 3909460 - RNA, 21 nt, Human adenovirus C
gguaccuuugagcugcagggu

SEQ ID NO: 3909461 - RNA, 21 nt, Human adenovirus C
gguacuucccagagacgccca

SEQ ID NO: 3909462 - RNA, 14 nt, Human adenovirus C
gguagauggccugg

SEQ ID NO: 3909463 - RNA, 20 nt, Human adenovirus C
gguagcaccacugcagagcu

SEQ ID NO: 3909464 - RNA, 22 nt, Human adenovirus C
gguaguuaagagagcugcagcu

SEQ ID NO: 3909465 - RNA, 15 nt, Human adenovirus C
ggucaggcgggagcu

SEQ ID NO: 3909466 - RNA, 16 nt, Human adenovirus C
ggucaucgcgccggag

SEQ ID NO: 3909467 - RNA, 17 nt, Human adenovirus C
gguccagcagaggcggc

SEQ ID NO: 3909468 - RNA, 17 nt, Human adenovirus C
gguccugcuggugcuga

SEQ ID NO: 3909469 - RNA, 19 nt, Human adenovirus C
gguccugcuggugcugaag

SEQ ID NO: 3909470 - RNA, 18 nt, Human adenovirus C
ggucuccguccggacggg

SEQ ID NO: 3909471 - RNA, 20 nt, Human adenovirus C
ggugagcuccucaggggagc

SEQ ID NO: 3909472 - RNA, 21 nt, Human adenovirus C
ggugaugccuuugaggguggc

SEQ ID NO: 3909473 - RNA, 15 nt, Human adenovirus C
ggugcaggagcgcag

SEQ ID NO: 3909474 - RNA, 22 nt, Human adenovirus C
ggugcaugcccaggcuuugagu

SEQ ID NO: 3909475 - RNA, 19 nt, Human adenovirus C
ggugcucguccagacgggc

SEQ ID NO: 3909476 - RNA, 18 nt, Human adenovirus C
ggugcugaagcgcugccg

SEQ ID NO: 3909477 - RNA, 11 nt, Human adenovirus C
gguggcggcga

SEQ ID NO: 3909478 - RNA, 17 nt, Human adenovirus C
gguggucgcgaaagguc

SEQ ID NO: 3909479 - RNA, 14 nt, Human adenovirus C
ggugguggaccugg

SEQ ID NO: 3909480 - RNA, 19 nt, Human adenovirus C
gguguaggccacgugaccg

SEQ ID NO: 3909481 - RNA, 13 nt, Human adenovirus C
ggugugggugagc

SEQ ID NO: 3909482 - RNA, 13 nt, Human adenovirus C
gguucccccuucg

SEQ ID NO: 3909483 - RNA, 14 nt, Human adenovirus C
gguugaucuccuga

SEQ ID NO: 3909484 - RNA, 17 nt, Human adenovirus C
gguuggcggggggcugc

SEQ ID NO: 3909485 - RNA, 12 nt, Human adenovirus C
gguuggggcggc

SEQ ID NO: 3909486 - RNA, 15 nt, Human adenovirus C
gguuuacugguccca

SEQ ID NO: 3909487 - RNA, 14 nt, Human adenovirus C
gguuuuccuggcca

SEQ ID NO: 3909488 - RNA, 17 nt, Human adenovirus C
guaagcgcgcuggagca

SEQ ID NO: 3909489 - RNA, 19 nt, Human adenovirus C
guaccaguccgggccagac

SEQ ID NO: 3909490 - RNA, 13 nt, Human adenovirus C
guaccgcagcugg

SEQ ID NO: 3909491 - RNA, 14 nt, Human adenovirus C
guaccgcgaggcca

SEQ ID NO: 3909492 - RNA, 17 nt, Human adenovirus C
guaccugagccccgggc

SEQ ID NO: 3909493 - RNA, 13 nt, Human adenovirus C
guaccuuaaucaa

SEQ ID NO: 3909494 - RNA, 16 nt, Human adenovirus C
guacggcaccgccagc

SEQ ID NO: 3909495 - RNA, 16 nt, Human adenovirus C
guacggcgacgaggac

SEQ ID NO: 3909496 - RNA, 19 nt, Human adenovirus C
guacgguuuuccuggccaa

SEQ ID NO: 3909497 - RNA, 22 nt, Human adenovirus C
guacuggcagcggugcacgggc

SEQ ID NO: 3909498 - RNA, 21 nt, Human adenovirus C
guacuuuaacggcucuucauu

SEQ ID NO: 3909499 - RNA, 18 nt, Human adenovirus C
guagacaaggccugcaga

SEQ ID NO: 3909500 - RNA, 21 nt, Human adenovirus C
guagacaaggccugcagaccg

SEQ ID NO: 3909501 - RNA, 17 nt, Human adenovirus C
guagaugauccagucgu

SEQ ID NO: 3909502 - RNA, 20 nt, Human adenovirus C
guagcaagcugauugccagg

SEQ ID NO: 3909503 - RNA, 13 nt, Human adenovirus C
guagcgccacauc

SEQ ID NO: 3909504 - RNA, 14 nt, Human adenovirus C
guaggagucgcgca

SEQ ID NO: 3909505 - RNA, 23 nt, Human adenovirus C
guaggggagaucagcugggaaga

SEQ ID NO: 3909506 - RNA, 21 nt, Human adenovirus C
guaguagucuugcaugagccu

SEQ ID NO: 3909507 - RNA, 15 nt, Human adenovirus C
guauacagacuugag

SEQ ID NO: 3909508 - RNA, 13 nt, Human adenovirus C
guauccugccccu

SEQ ID NO: 3909509 - RNA, 21 nt, Human adenovirus C
guaucgacccgcgagcuuaga

SEQ ID NO: 3909510 - RNA, 23 nt, Human adenovirus C
guauucgcgcgcaacgcaccgcc

SEQ ID NO: 3909511 - RNA, 18 nt, Human adenovirus C
gucaagcaggccaaacuu

SEQ ID NO: 3909512 - RNA, 11 nt, Human adenovirus C
gucacaaacuc

SEQ ID NO: 3909513 - RNA, 16 nt, Human adenovirus C
gucagccgcgcgcugg

SEQ ID NO: 3909514 - RNA, 21 nt, Human adenovirus C
gucagccgcgcgcuggggcag

SEQ ID NO: 3909515 - RNA, 15 nt, Human adenovirus C
gucaggaggggcaac

SEQ ID NO: 3909516 - RNA, 14 nt, Human adenovirus C
gucaggcgggagcu

SEQ ID NO: 3909517 - RNA, 14 nt, Human adenovirus C
gucauaccacugca

SEQ ID NO: 3909518 - RNA, 14 nt, Human adenovirus C
gucaucucugugcu

SEQ ID NO: 3909519 - RNA, 20 nt, Human adenovirus C
gucauggaccgcaucauguc

SEQ ID NO: 3909520 - RNA, 22 nt, Human adenovirus C
guccacaaaaaacacccagaaa

SEQ ID NO: 3909521 - RNA, 19 nt, Human adenovirus C
guccagcugcugagccaca

SEQ ID NO: 3909522 - RNA, 23 nt, Human adenovirus C
guccauccuuauaucgcccagca

SEQ ID NO: 3909523 - RNA, 15 nt, Human adenovirus C
gucccuccgcaccca

SEQ ID NO: 3909524 - RNA, 19 nt, Human adenovirus C
gucccugcgccgugccgcc

SEQ ID NO: 3909525 - RNA, 14 nt, Human adenovirus C
guccuccgggcaca

SEQ ID NO: 3909526 - RNA, 23 nt, Human adenovirus C
guccucggagccgcgcuccggag

SEQ ID NO: 3909527 - RNA, 18 nt, Human adenovirus C
gucgcauuccccucgccg

SEQ ID NO: 3909528 - RNA, 13 nt, Human adenovirus C
gucgccaccgccg

SEQ ID NO: 3909529 - RNA, 17 nt, Human adenovirus C
gucgccgccagaggagc

SEQ ID NO: 3909530 - RNA, 15 nt, Human adenovirus C
gucgcgccgcaccgc

SEQ ID NO: 3909531 - RNA, 12 nt, Human adenovirus C
gucggcgccgcg

SEQ ID NO: 3909532 - RNA, 13 nt, Human adenovirus C
gucgucagcgcca

SEQ ID NO: 3909533 - RNA, 15 nt, Human adenovirus C
gucuaagcagccgcc

SEQ ID NO: 3909534 - RNA, 22 nt, Human adenovirus C
gucuagcugcgucucguccggg

SEQ ID NO: 3909535 - RNA, 23 nt, Human adenovirus C
gucuagggcgcaguaguccaggg

SEQ ID NO: 3909536 - RNA, 16 nt, Human adenovirus C
gucucgcgcggcgguc

SEQ ID NO: 3909537 - RNA, 14 nt, Human adenovirus C
gucucuggccccgc

SEQ ID NO: 3909538 - RNA, 15 nt, Human adenovirus C
gucugcagcgcugcc

SEQ ID NO: 3909539 - RNA, 17 nt, Human adenovirus C
gucuucauucagccgcc

SEQ ID NO: 3909540 - RNA, 23 nt, Human adenovirus C
gucuuuguaguagucuugcauga

SEQ ID NO: 3909541 - RNA, 15 nt, Human adenovirus C
gugaauccacagaaa

SEQ ID NO: 3909542 - RNA, 15 nt, Human adenovirus C
gugaccuuccgcucc

SEQ ID NO: 3909543 - RNA, 22 nt, Human adenovirus C
gugacgaaaaggcuguccgugu

SEQ ID NO: 3909544 - RNA, 17 nt, Human adenovirus C
gugacuuggcacccacc

SEQ ID NO: 3909545 - RNA, 16 nt, Human adenovirus C
gugcaugcccaggcuu

SEQ ID NO: 3909546 - RNA, 23 nt, Human adenovirus C
gugccuuuuacugcugcuggaag

SEQ ID NO: 3909547 - RNA, 18 nt, Human adenovirus C
gugcgcccgcuuuccaag

SEQ ID NO: 3909548 - RNA, 16 nt, Human adenovirus C
gugcgcggcaccagcg

SEQ ID NO: 3909549 - RNA, 19 nt, Human adenovirus C
gugcguaacuugcuggaac

SEQ ID NO: 3909550 - RNA, 13 nt, Human adenovirus C
gugcugcagcagc

SEQ ID NO: 3909551 - RNA, 16 nt, Human adenovirus C
gugcugcggcagaugc

SEQ ID NO: 3909552 - RNA, 23 nt, Human adenovirus C
gugcugguggaacuugaggguga

SEQ ID NO: 3909553 - RNA, 22 nt, Human adenovirus C
gugcuuauggugggagaaaaac

SEQ ID NO: 3909554 - RNA, 22 nt, Human adenovirus C
guggaccuggccaaccaggcag

SEQ ID NO: 3909555 - RNA, 17 nt, Human adenovirus C
guggacgucgcgccgca

SEQ ID NO: 3909556 - RNA, 22 nt, Human adenovirus C
guggacguucagauacccacca

SEQ ID NO: 3909557 - RNA, 16 nt, Human adenovirus C
guggacuucacccaca

SEQ ID NO: 3909558 - RNA, 14 nt, Human adenovirus C
guggagccugggcu

SEQ ID NO: 3909559 - RNA, 16 nt, Human adenovirus C
guggagccugggcugg

SEQ ID NO: 3909560 - RNA, 17 nt, Human adenovirus C
guggagccugggcugga

SEQ ID NO: 3909561 - RNA, 14 nt, Human adenovirus C
guggcaacuggcaa

SEQ ID NO: 3909562 - RNA, 20 nt, Human adenovirus C
guggcccuuggcgcgcagcu

SEQ ID NO: 3909563 - RNA, 18 nt, Human adenovirus C
guggccuccgacuguggu

SEQ ID NO: 3909564 - RNA, 16 nt, Human adenovirus C
guggcgguguguucug

SEQ ID NO: 3909565 - RNA, 19 nt, Human adenovirus C
gugggugagcgcaaaggug

SEQ ID NO: 3909566 - RNA, 18 nt, Human adenovirus C
gugggugagcgcggaggc

SEQ ID NO: 3909567 - RNA, 19 nt, Human adenovirus C
gugguagauggccuggccu

SEQ ID NO: 3909568 - RNA, 17 nt, Human adenovirus C
guggugagcgcggcgcc

SEQ ID NO: 3909569 - RNA, 12 nt, Human adenovirus C
guggugcaggag

SEQ ID NO: 3909570 - RNA, 15 nt, Human adenovirus C
guggugcugcagcag

SEQ ID NO: 3909571 - RNA, 16 nt, Human adenovirus C
gugguggaccuggcca

SEQ ID NO: 3909572 - RNA, 17 nt, Human adenovirus C
gugguggaccuggccaa

SEQ ID NO: 3909573 - RNA, 22 nt, Human adenovirus C
guguagacacuuaagcucgccu

SEQ ID NO: 3909574 - RNA, 21 nt, Human adenovirus C
gugugaugcggaagggucccg

SEQ ID NO: 3909575 - RNA, 14 nt, Human adenovirus C
guuaauuaccuggg

SEQ ID NO: 3909576 - RNA, 17 nt, Human adenovirus C
guuccugagcagcugcg

SEQ ID NO: 3909577 - RNA, 15 nt, Human adenovirus C
guucgcacuggggcg

SEQ ID NO: 3909578 - RNA, 22 nt, Human adenovirus C
guucuaauggagaacuccucac

SEQ ID NO: 3909579 - RNA, 15 nt, Human adenovirus C
guucugcgagucaca

SEQ ID NO: 3909580 - RNA, 19 nt, Human adenovirus C
guucuucagaaacuuccag

SEQ ID NO: 3909581 - RNA, 14 nt, Human adenovirus C
guugaaagagcaaa

SEQ ID NO: 3909582 - RNA, 16 nt, Human adenovirus C
guugacggcggccugg

SEQ ID NO: 3909583 - RNA, 15 nt, Human adenovirus C
guugcauguggaaaa

SEQ ID NO: 3909584 - RNA, 13 nt, Human adenovirus C
guugcgcuuuucu

SEQ ID NO: 3909585 - RNA, 16 nt, Human adenovirus C
guugcgcuuuucugug

SEQ ID NO: 3909586 - RNA, 14 nt, Human adenovirus C
guuggagaucugca

SEQ ID NO: 3909587 - RNA, 13 nt, Human adenovirus C
guuggauguggac

SEQ ID NO: 3909588 - RNA, 19 nt, Human adenovirus C
guuguacagguggcugaac

SEQ ID NO: 3909589 - RNA, 18 nt, Human adenovirus C
guugucaagcuugguggc

SEQ ID NO: 3909590 - RNA, 21 nt, Human adenovirus C
guuuaaacagcgaggaggagc

SEQ ID NO: 3909591 - RNA, 15 nt, Human adenovirus C
guuuagagaacacug

SEQ ID NO: 3909592 - RNA, 13 nt, Human adenovirus C
guuugugccuccg

SEQ ID NO: 3909593 - RNA, 20 nt, Human adenovirus C
guuuucacuccacaggcugc

SEQ ID NO: 3909594 - RNA, 17 nt, Human adenovirus C
uaaacucaggcacaacc

SEQ ID NO: 3909595 - RNA, 15 nt, Human adenovirus C
uaaauaaaaaccaga

SEQ ID NO: 3909596 - RNA, 19 nt, Human adenovirus C
uaaaugccaaccuauggag

SEQ ID NO: 3909597 - RNA, 21 nt, Human adenovirus C
uaaaugggaugucaaauuccu

SEQ ID NO: 3909598 - RNA, 16 nt, Human adenovirus C
uaacagcacuggcaac

SEQ ID NO: 3909599 - RNA, 16 nt, Human adenovirus C
uaacaguccccaggua

SEQ ID NO: 3909600 - RNA, 15 nt, Human adenovirus C
uaacauccaccaccg

SEQ ID NO: 3909601 - RNA, 16 nt, Human adenovirus C
uaacaugguucugcag

SEQ ID NO: 3909602 - RNA, 12 nt, Human adenovirus C
uaacucuacaag

SEQ ID NO: 3909603 - RNA, 16 nt, Human adenovirus C
uaacuuggacauaaac

SEQ ID NO: 3909604 - RNA, 19 nt, Human adenovirus C
uaagauugucaguuuccaa

SEQ ID NO: 3909605 - RNA, 15 nt, Human adenovirus C
uaagcccgucucugg

SEQ ID NO: 3909606 - RNA, 21 nt, Human adenovirus C
uaaguaccuuaccugguacuu

SEQ ID NO: 3909607 - RNA, 12 nt, Human adenovirus C
uaaguuugacag

SEQ ID NO: 3909608 - RNA, 13 nt, Human adenovirus C
uaaguuugccaca

SEQ ID NO: 3909609 - RNA, 15 nt, Human adenovirus C
uaauuaccugggcgg

SEQ ID NO: 3909610 - RNA, 19 nt, Human adenovirus C
uacaaacgaagccuuccau

SEQ ID NO: 3909611 - RNA, 15 nt, Human adenovirus C
uacaacguagcucag

SEQ ID NO: 3909612 - RNA, 16 nt, Human adenovirus C
uacacaggguugcagc

SEQ ID NO: 3909613 - RNA, 19 nt, Human adenovirus C
uacacaggguugcagcacu

SEQ ID NO: 3909614 - RNA, 15 nt, Human adenovirus C
uacagagacaggacu

SEQ ID NO: 3909615 - RNA, 19 nt, Human adenovirus C
uacagccccuacugcaccg

SEQ ID NO: 3909616 - RNA, 18 nt, Human adenovirus C
uacagcccgggggaggca

SEQ ID NO: 3909617 - RNA, 20 nt, Human adenovirus C
uacaugagcgcgggacccca

SEQ ID NO: 3909618 - RNA, 15 nt, Human adenovirus C
uacauugcccaggaa

SEQ ID NO: 3909619 - RNA, 12 nt, Human adenovirus C
uaccgcgcggcg

SEQ ID NO: 3909620 - RNA, 19 nt, Human adenovirus C
uaccggagugcugggccag

SEQ ID NO: 3909621 - RNA, 23 nt, Human adenovirus C
uaccugcuggauuuucuggccau

SEQ ID NO: 3909622 - RNA, 21 nt, Human adenovirus C
uaccuguguggaagccuggac

SEQ ID NO: 3909623 - RNA, 23 nt, Human adenovirus C
uaccuuuccgccgccaacaugcu

SEQ ID NO: 3909624 - RNA, 21 nt, Human adenovirus C
uacgccaucaucucugucaug

SEQ ID NO: 3909625 - RNA, 21 nt, Human adenovirus C
uacggaggauaggguggccuu

SEQ ID NO: 3909626 - RNA, 15 nt, Human adenovirus C
uacggauuugucacc

SEQ ID NO: 3909627 - RNA, 12 nt, Human adenovirus C
uacgucaucucc

SEQ ID NO: 3909628 - RNA, 15 nt, Human adenovirus C
uacgugccgcggcag

SEQ ID NO: 3909629 - RNA, 17 nt, Human adenovirus C
uacuaagaaaacacaug

SEQ ID NO: 3909630 - RNA, 23 nt, Human adenovirus C
uacuaaggacaaacagguggagc

SEQ ID NO: 3909631 - RNA, 16 nt, Human adenovirus C
uacugcugcuggaagg

SEQ ID NO: 3909632 - RNA, 14 nt, Human adenovirus C
uacuuacuuaaaau

SEQ ID NO: 3909633 - RNA, 21 nt, Human adenovirus C
uacuugaaagugggcaggcag

SEQ ID NO: 3909634 - RNA, 13 nt, Human adenovirus C
uagauggccuggc

SEQ ID NO: 3909635 - RNA, 20 nt, Human adenovirus C
uagauugcaagaaaaaacua

SEQ ID NO: 3909636 - RNA, 23 nt, Human adenovirus C
uagcaagccgcucauggcgcagc

SEQ ID NO: 3909637 - RNA, 13 nt, Human adenovirus C
uagcacaaaacuc

SEQ ID NO: 3909638 - RNA, 17 nt, Human adenovirus C
uagcgacuuugugccca

SEQ ID NO: 3909639 - RNA, 16 nt, Human adenovirus C
uaggauuuuucccacu

SEQ ID NO: 3909640 - RNA, 16 nt, Human adenovirus C
uaggcccgggaccagc

SEQ ID NO: 3909641 - RNA, 13 nt, Human adenovirus C
uaggguagcaucu

SEQ ID NO: 3909642 - RNA, 16 nt, Human adenovirus C
uaguuaagagagcugc

SEQ ID NO: 3909643 - RNA, 22 nt, Human adenovirus C
uauaaauuuccauuuuaugaaa

SEQ ID NO: 3909644 - RNA, 21 nt, Human adenovirus C
uauaacucaccugaaaaucag

SEQ ID NO: 3909645 - RNA, 15 nt, Human adenovirus C
uauaauaaauacaga

SEQ ID NO: 3909646 - RNA, 17 nt, Human adenovirus C
uauagguguaggccacg

SEQ ID NO: 3909647 - RNA, 14 nt, Human adenovirus C
uaucagcagccgcg

SEQ ID NO: 3909648 - RNA, 13 nt, Human adenovirus C
uaucgacccgcga

SEQ ID NO: 3909649 - RNA, 16 nt, Human adenovirus C
uaugcuaaaaugaaga

SEQ ID NO: 3909650 - RNA, 18 nt, Human adenovirus C
uaugcuauuuggcagcca

SEQ ID NO: 3909651 - RNA, 17 nt, Human adenovirus C
uauggcccucaccugcc

SEQ ID NO: 3909652 - RNA, 19 nt, Human adenovirus C
uauguggaaucaggcugua

SEQ ID NO: 3909653 - RNA, 20 nt, Human adenovirus C
uauuuguugccuaaagcgca

SEQ ID NO: 3909654 - RNA, 15 nt, Human adenovirus C
ucaaacucacagaac

SEQ ID NO: 3909655 - RNA, 18 nt, Human adenovirus C
ucaaagggguucugccgc

SEQ ID NO: 3909656 - RNA, 16 nt, Human adenovirus C
ucaaauacaaaagcag

SEQ ID NO: 3909657 - RNA, 17 nt, Human adenovirus C
ucaaaucuucacuuccg

SEQ ID NO: 3909658 - RNA, 17 nt, Human adenovirus C
ucaacaaagcaggggcc

SEQ ID NO: 3909659 - RNA, 13 nt, Human adenovirus C
ucaacaacagcug

SEQ ID NO: 3909660 - RNA, 15 nt, Human adenovirus C
ucaauaugucucuaa

SEQ ID NO: 3909661 - RNA, 15 nt, Human adenovirus C
ucacaaccccaccau

SEQ ID NO: 3909662 - RNA, 11 nt, Human adenovirus C
ucaccaggcgc

SEQ ID NO: 3909663 - RNA, 15 nt, Human adenovirus C
ucacccacagccgcc

SEQ ID NO: 3909664 - RNA, 15 nt, Human adenovirus C
ucacccgcagcugcc

SEQ ID NO: 3909665 - RNA, 12 nt, Human adenovirus C
ucacccuuaucc

SEQ ID NO: 3909666 - RNA, 23 nt, Human adenovirus C
ucacccuuauccucaucugcagc

SEQ ID NO: 3909667 - RNA, 16 nt, Human adenovirus C
uggaggcuugggagug

SEQ ID NO: 3909668 - RNA, 19 nt, Human adenovirus C
uggaucggaccaccacgcc

SEQ ID NO: 3909669 - RNA, 15 nt, Human adenovirus C
uggcaaugggcccac

SEQ ID NO: 3909670 - RNA, 16 nt, Human adenovirus C
uggcaaugggcccacg

SEQ ID NO: 3909671 - RNA, 19 nt, Human adenovirus C
uggcacccaccgugcagcu

SEQ ID NO: 3909672 - RNA, 22 nt, Human adenovirus C
uggcaccccuauucgacaccac

SEQ ID NO: 3909673 - RNA, 19 nt, Human adenovirus C
uggcacccgcgcgcgcugg

SEQ ID NO: 3909674 - RNA, 20 nt, Human adenovirus C
uggcaccgggacugggcgug

SEQ ID NO: 3909675 - RNA, 11 nt, Human adenovirus C
uggcagugguc

SEQ ID NO: 3909676 - RNA, 22 nt, Human adenovirus C
uggccaauugcaagccaucaac

SEQ ID NO: 3909677 - RNA, 19 nt, Human adenovirus C
uggccauuaccuuugacuc

SEQ ID NO: 3909678 - RNA, 13 nt, Human adenovirus C
uggccgcgggcug

SEQ ID NO: 3909679 - RNA, 15 nt, Human adenovirus C
uggccugaaccgcga

SEQ ID NO: 3909680 - RNA, 14 nt, Human adenovirus C
uggcgccaggucau

SEQ ID NO: 3909681 - RNA, 19 nt, Human adenovirus C
uggcgggcgcucgggcuug

SEQ ID NO: 3909682 - RNA, 19 nt, Human adenovirus C
uggcggguuuggcuggugg

SEQ ID NO: 3909683 - RNA, 17 nt, Human adenovirus C
uggcguugccgcuggac

SEQ ID NO: 3909684 - RNA, 21 nt, Human adenovirus C
ugggagacgacgugcuguuga

SEQ ID NO: 3909685 - RNA, 21 nt, Human adenovirus C
ugggagcuguccauggucugg

SEQ ID NO: 3909686 - RNA, 23 nt, Human adenovirus C
ugggccaaaaccuucucuacgcc

SEQ ID NO: 3909687 - RNA, 11 nt, Human adenovirus C
ugggcgcacca

SEQ ID NO: 3909688 - RNA, 19 nt, Human adenovirus C
ugggcgugcagaccgugga

SEQ ID NO: 3909689 - RNA, 14 nt, Human adenovirus C
uggggauggcgggc

SEQ ID NO: 3909690 - RNA, 18 nt, Human adenovirus C
ugguacuuguccaucaac

SEQ ID NO: 3909691 - RNA, 21 nt, Human adenovirus C
ugguaguuaagagagcugcag

SEQ ID NO: 3909692 - RNA, 22 nt, Human adenovirus C
uggugacgcaaauagaugagcc

SEQ ID NO: 3909693 - RNA, 15 nt, Human adenovirus C
uggugcaggagcgca

SEQ ID NO: 3909694 - RNA, 16 nt, Human adenovirus C
uggugcgcggagcccg

SEQ ID NO: 3909695 - RNA, 20 nt, Human adenovirus C
ugguggaggaggcgcgcaac

SEQ ID NO: 3909696 - RNA, 17 nt, Human adenovirus C
ugguuccauccggccca

SEQ ID NO: 3909697 - RNA, 14 nt, Human adenovirus C
ugguuuccaugagc

SEQ ID NO: 3909698 - RNA, 14 nt, Human adenovirus C
uguaauuuacaaca

SEQ ID NO: 3909699 - RNA, 13 nt, Human adenovirus C
uguaccgcgaggc

SEQ ID NO: 3909700 - RNA, 15 nt, Human adenovirus C
uguagguuaccucug

SEQ ID NO: 3909701 - RNA, 16 nt, Human adenovirus C
uguauuauaacagcac

SEQ ID NO: 3909702 - RNA, 18 nt, Human adenovirus C
ugucauacuuauccuguc

SEQ ID NO: 3909703 - RNA, 23 nt, Human adenovirus C
ugucccuuuuuuuuccacagcuc

SEQ ID NO: 3909704 - RNA, 18 nt, Human adenovirus C
uguccuaucaacucuugc

SEQ ID NO: 3909705 - RNA, 10 nt, Human adenovirus C
uguccuugga

SEQ ID NO: 3909706 - RNA, 14 nt, Human adenovirus C
uguccuuggaugau

SEQ ID NO: 3909707 - RNA, 17 nt, Human adenovirus C
ugucgucgcauccgccc

SEQ ID NO: 3909708 - RNA, 16 nt, Human adenovirus C
ugucguuucucagcag

SEQ ID NO: 3909709 - RNA, 13 nt, Human adenovirus C
ugucuaccugcgg

SEQ ID NO: 3909710 - RNA, 15 nt, Human adenovirus C
ugucugcgagggcca

SEQ ID NO: 3909711 - RNA, 17 nt, Human adenovirus C
ugucugcgagggccagc

SEQ ID NO: 3909712 - RNA, 17 nt, Human adenovirus C
ugucuuacaaaccugga

SEQ ID NO: 3909713 - RNA, 14 nt, Human adenovirus C
ugugcuacaccugg

SEQ ID NO: 3909714 - RNA, 23 nt, Human adenovirus C
uguuaacaugguucugcagagcu

SEQ ID NO: 3909715 - RNA, 13 nt, Human adenovirus C
uguugucaucucu

SEQ ID NO: 3909716 - RNA, 14 nt, Human adenovirus C
uuaaaaaacaccac

SEQ ID NO: 3909717 - RNA, 22 nt, Human adenovirus C
uuaaaaacaaguugcaugugga

SEQ ID NO: 3909718 - RNA, 22 nt, Human adenovirus C
uuaaccuacaccaguguaaaag

SEQ ID NO: 3909719 - RNA, 13 nt, Human adenovirus C
uuacugcugcugg

SEQ ID NO: 3909720 - RNA, 13 nt, Human adenovirus C
uuagcauuugcag

SEQ ID NO: 3909721 - RNA, 20 nt, Human adenovirus C
uuagcggggugguggaccug

SEQ ID NO: 3909722 - RNA, 14 nt, Human adenovirus C
uuauaaaaugcacc

SEQ ID NO: 3909723 - RNA, 21 nt, Human adenovirus C
uuauacuagcacuucugugcc

SEQ ID NO: 3909724 - RNA, 16 nt, Human adenovirus C
uucaaaucaaacuuuc

SEQ ID NO: 3909725 - RNA, 18 nt, Human adenovirus C
uucaacuaacauaaacac

SEQ ID NO: 3909726 - RNA, 20 nt, Human adenovirus C
uucaaguaacucuacaagcu

SEQ ID NO: 3909727 - RNA, 16 nt, Human adenovirus C
uucaauugcagaaaau

SEQ ID NO: 3909728 - RNA, 13 nt, Human adenovirus C
uucaccuggcccg

SEQ ID NO: 3909729 - RNA, 20 nt, Human adenovirus C
uucacggacaguggcagcgu

SEQ ID NO: 3909730 - RNA, 23 nt, Human adenovirus C
uucagauacccaccaccaguagc

SEQ ID NO: 3909731 - RNA, 17 nt, Human adenovirus C
uucagcaaauacugcgc

SEQ ID NO: 3909732 - RNA, 15 nt, Human adenovirus C
uucaggaauucugcc

SEQ ID NO: 3909733 - RNA, 20 nt, Human adenovirus C
uucaguaguauagccccacc

SEQ ID NO: 3909734 - RNA, 21 nt, Human adenovirus C
uuccaugcucagucugggcaa

SEQ ID NO: 3909735 - RNA, 22 nt, Human adenovirus C
uuccuaucaaccagaaccucaa

SEQ ID NO: 3909736 - RNA, 15 nt, Human adenovirus C
uucuauggguuuaac

SEQ ID NO: 3909737 - RNA, 23 nt, Human adenovirus C
uucuccccggcuggccuuaaaaa

SEQ ID NO: 3909738 - RNA, 23 nt, Human adenovirus C
uucuuaccucugguuuccaugag

SEQ ID NO: 3909739 - RNA, 23 nt, Human adenovirus C
uucuugucccuccgcacccacua

SEQ ID NO: 3909740 - RNA, 17 nt, Human adenovirus C
uugaaauccugugguga

SEQ ID NO: 3909741 - RNA, 14 nt, Human adenovirus C
uugagccccucgcc

SEQ ID NO: 3909742 - RNA, 16 nt, Human adenovirus C
uugaucaaacccagcu

SEQ ID NO: 3909743 - RNA, 14 nt, Human adenovirus C
uugauggagggcaa

SEQ ID NO: 3909744 - RNA, 21 nt, Human adenovirus C
uugcaacagcgcgagcaggca

SEQ ID NO: 3909745 - RNA, 22 nt, Human adenovirus C
uugcaagacagaaacacagagc

SEQ ID NO: 3909746 - RNA, 18 nt, Human adenovirus C
uugcaauguuacauuuaa

SEQ ID NO: 3909747 - RNA, 18 nt, Human adenovirus C
uugccagacaugaugcaa

SEQ ID NO: 3909748 - RNA, 20 nt, Human adenovirus C
uugcccaggaauaaagaauc

SEQ ID NO: 3909749 - RNA, 21 nt, Human adenovirus C
uugcgcgcgcgguaggcccgg

SEQ ID NO: 3909750 - RNA, 16 nt, Human adenovirus C
uugcuggaacagagcu

SEQ ID NO: 3909751 - RNA, 15 nt, Human adenovirus C
uuggacaccucccac

SEQ ID NO: 3909752 - RNA, 19 nt, Human adenovirus C
uuggcgcgcagcuugcccu

SEQ ID NO: 3909753 - RNA, 20 nt, Human adenovirus C
uuggcgcgcccgccagcccc

SEQ ID NO: 3909754 - RNA, 22 nt, Human adenovirus C
uuggcguugccgcuggacgagg

SEQ ID NO: 3909755 - RNA, 11 nt, Human adenovirus C
uugggcaccua

SEQ ID NO: 3909756 - RNA, 13 nt, Human adenovirus C
uugguucuuacaa

SEQ ID NO: 3909757 - RNA, 20 nt, Human adenovirus C
uuguaagcgcgcuggagcaa

SEQ ID NO: 3909758 - RNA, 21 nt, Human adenovirus C
uuguagguuaccucugcaaac

SEQ ID NO: 3909759 - RNA, 20 nt, Human adenovirus C
uuguccuccgggcacagcag

SEQ ID NO: 3909760 - RNA, 12 nt, Human adenovirus C
uuguugcuacau

SEQ ID NO: 3909761 - RNA, 14 nt, Human adenovirus C
uuucaccaaugcca

SEQ ID NO: 3909762 - RNA, 23 nt, Human adenovirus C
uuuccaacguggagcucugcaac

SEQ ID NO: 3909763 - RNA, 14 nt, Human adenovirus C
uuugacucuucugu

SEQ ID NO: 3909764 - RNA, 14 nt, Human adenovirus C
uuugcuuuccugag

SEQ ID NO: 3909765 - RNA, 19 nt, Human adenovirus C
uuuguagcgccacaucuuc

SEQ ID NO: 3909766 - RNA, 11 nt, Human adenovirus C
uuuucugcugu

SEQ ID NO: 3909767 - RNA, 10 nt, Human adenovirus C
aaaaaacaac

SEQ ID NO: 3909768 - RNA, 20 nt, Human adenovirus C
aaaaagaagcugcagcugcc

SEQ ID NO: 3909769 - RNA, 19 nt, Human adenovirus C
aaaagaagcugcagcugcc

SEQ ID NO: 3909770 - RNA, 19 nt, Human adenovirus C
aaaagauuauccaaaaccu

SEQ ID NO: 3909771 - RNA, 20 nt, Human adenovirus C
aaaauacaaccccaccaaug

SEQ ID NO: 3909772 - RNA, 15 nt, Human adenovirus C
aaaaucguaaaacuu

SEQ ID NO: 3909773 - RNA, 22 nt, Human adenovirus C
aaaaugggcagcggucuuaccc

SEQ ID NO: 3909774 - RNA, 17 nt, Human adenovirus C
aaaauuuccaacgugga

SEQ ID NO: 3909775 - RNA, 18 nt, Human adenovirus C
aaacaauacuaaaaaacu

SEQ ID NO: 3909776 - RNA, 12 nt, Human adenovirus C
aaacauguaaaa

SEQ ID NO: 3909777 - RNA, 20 nt, Human adenovirus C
aaaccagcuggccaaaaccu

SEQ ID NO: 3909778 - RNA, 17 nt, Human adenovirus C
aaacccugcaacagggu

SEQ ID NO: 3909779 - RNA, 13 nt, Human adenovirus C
aaaccgggccucc

SEQ ID NO: 3909780 - RNA, 16 nt, Human adenovirus C
aaacgacugcagguac

SEQ ID NO: 3909781 - RNA, 23 nt, Human adenovirus C
aaacuacgucaucuccagcggcc

SEQ ID NO: 3909782 - RNA, 22 nt, Human adenovirus C
aaacucccuuagaaccaaaguu

SEQ ID NO: 3909783 - RNA, 23 nt, Human adenovirus C
aaacuuaccuacgaaaaaaccac

SEQ ID NO: 3909784 - RNA, 16 nt, Human adenovirus C
aaacuuuugcuaccaa

SEQ ID NO: 3909785 - RNA, 16 nt, Human adenovirus C
aaagcagaccaaagca

SEQ ID NO: 3909786 - RNA, 20 nt, Human adenovirus C
aaagcgcgggcggagggugc

SEQ ID NO: 3909787 - RNA, 18 nt, Human adenovirus C
aaagcgguuaagcuggga

SEQ ID NO: 3909788 - RNA, 21 nt, Human adenovirus C
aaagcuagcccugcaaacauc

SEQ ID NO: 3909789 - RNA, 23 nt, Human adenovirus C
aaagcuagcccugcaaacaucag

SEQ ID NO: 3909790 - RNA, 15 nt, Human adenovirus C
aaagcuauguugggu

SEQ ID NO: 3909791 - RNA, 16 nt, Human adenovirus C
aaagcuuccgcaggcc

SEQ ID NO: 3909792 - RNA, 16 nt, Human adenovirus C
aaagggcccuggcugg

SEQ ID NO: 3909793 - RNA, 13 nt, Human adenovirus C
aaaggugaugaaa

SEQ ID NO: 3909794 - RNA, 22 nt, Human adenovirus C
aaaguccacaaaaaacacccag

SEQ ID NO: 3909795 - RNA, 17 nt, Human adenovirus C
aaagugguuuuguacag

SEQ ID NO: 3909796 - RNA, 16 nt, Human adenovirus C
aaauagaugagccucc

SEQ ID NO: 3909797 - RNA, 22 nt, Human adenovirus C
aaaugaccguggagccugggcu

SEQ ID NO: 3909798 - RNA, 15 nt, Human adenovirus C
aaaugggaugucaaa

SEQ ID NO: 3909799 - RNA, 14 nt, Human adenovirus C
aacacaagcuaaac

SEQ ID NO: 3909800 - RNA, 22 nt, Human adenovirus C
aacacggccuccacgcuggaag

SEQ ID NO: 3909801 - RNA, 15 nt, Human adenovirus C
aacagagggcugccu

SEQ ID NO: 3909802 - RNA, 17 nt, Human adenovirus C
aacagcacuggcaacau

SEQ ID NO: 3909803 - RNA, 13 nt, Human adenovirus C
aacagcagcacag

SEQ ID NO: 3909804 - RNA, 18 nt, Human adenovirus C
aacagcgcgagcaggcag

SEQ ID NO: 3909805 - RNA, 21 nt, Human adenovirus C
aacagcggcaacgugcagacc

SEQ ID NO: 3909806 - RNA, 23 nt, Human adenovirus C
aacaugguucugcagagcucucu

SEQ ID NO: 3909807 - RNA, 24 nt, Human adenovirus C
aacccaccauuuguagcgccacau

SEQ ID NO: 3909808 - RNA, 23 nt, Human adenovirus C
aacccccgcggcgccgggcccgg

SEQ ID NO: 3909809 - RNA, 12 nt, Human adenovirus C
aaccccuucccu

SEQ ID NO: 3909810 - RNA, 13 nt, Human adenovirus C
aaccgcgcccagg

SEQ ID NO: 3909811 - RNA, 18 nt, Human adenovirus C
aaccgcgguugugcaggg

SEQ ID NO: 3909812 - RNA, 22 nt, Human adenovirus C
aaccgcgguugugcagggugac

SEQ ID NO: 3909813 - RNA, 14 nt, Human adenovirus C
aaccucaccuccca

SEQ ID NO: 3909814 - RNA, 15 nt, Human adenovirus C
aaccuccgcuccuca

SEQ ID NO: 3909815 - RNA, 17 nt, Human adenovirus C
aaccuggaccggcuggu

SEQ ID NO: 3909816 - RNA, 13 nt, Human adenovirus C
aaccugugcugcc

SEQ ID NO: 3909817 - RNA, 20 nt, Human adenovirus C
aaccuucuagccuauccaaa

SEQ ID NO: 3909818 - RNA, 16 nt, Human adenovirus C
aaccuuuggacaccuc

SEQ ID NO: 3909819 - RNA, 11 nt, Human adenovirus C
aacgccaagaa

SEQ ID NO: 3909820 - RNA, 18 nt, Human adenovirus C
aacgccaccaacgugccc

SEQ ID NO: 3909821 - RNA, 11 nt, Human adenovirus C
agaaaccccac

SEQ ID NO: 3909822 - RNA, 17 nt, Human adenovirus C
agaaaccgggccuccaa

SEQ ID NO: 3909823 - RNA, 14 nt, Human adenovirus C
agaacuauggcagc

SEQ ID NO: 3909824 - RNA, 12 nt, Human adenovirus C
agaagcgcgggg

SEQ ID NO: 3909825 - RNA, 17 nt, Human adenovirus C
agaagcugcagcugccg

SEQ ID NO: 3909826 - RNA, 19 nt, Human adenovirus C
agaagguaagcgggucuug

SEQ ID NO: 3909827 - RNA, 16 nt, Human adenovirus C
agaauggaagacauca

SEQ ID NO: 3909828 - RNA, 16 nt, Human adenovirus C
agacagugucuccaga

SEQ ID NO: 3909829 - RNA, 12 nt, Human adenovirus C
agacaugaugca

SEQ ID NO: 3909830 - RNA, 20 nt, Human adenovirus C
agaccaguagacaaggccug

SEQ ID NO: 3909831 - RNA, 22 nt, Human adenovirus C
agaccguaaaccugagccaggc

SEQ ID NO: 3909832 - RNA, 13 nt, Human adenovirus C
agacgacgaggau

SEQ ID NO: 3909833 - RNA, 18 nt, Human adenovirus C
agacgacgugcuguugaa

SEQ ID NO: 3909834 - RNA, 19 nt, Human adenovirus C
agacgccgcaccugccccu

SEQ ID NO: 3909835 - RNA, 13 nt, Human adenovirus C
agacgggccaggg

SEQ ID NO: 3909836 - RNA, 18 nt, Human adenovirus C
agacguugaagcuggcgu

SEQ ID NO: 3909837 - RNA, 20 nt, Human adenovirus C
agacugggguuugacccagu

SEQ ID NO: 3909838 - RNA, 22 nt, Human adenovirus C
agagaacuccaacgcggcagcc

SEQ ID NO: 3909839 - RNA, 15 nt, Human adenovirus C
agagacgcccaggcc

SEQ ID NO: 3909840 - RNA, 14 nt, Human adenovirus C
agagcagcugacca

SEQ ID NO: 3909841 - RNA, 17 nt, Human adenovirus C
agagcauaguggugcag

SEQ ID NO: 3909842 - RNA, 23 nt, Human adenovirus C
agagcauguccaaggugaaccug

SEQ ID NO: 3909843 - RNA, 17 nt, Human adenovirus C
agagccggccuggaccc

SEQ ID NO: 3909844 - RNA, 21 nt, Human adenovirus C
agagcgcagcgaugugccccu

SEQ ID NO: 3909845 - RNA, 22 nt, Human adenovirus C
agagcugaaaauaaaaaacagg

SEQ ID NO: 3909846 - RNA, 15 nt, Human adenovirus C
agagcugcagcugcc

SEQ ID NO: 3909847 - RNA, 22 nt, Human adenovirus C
agagcuuccacuuggucaggca

SEQ ID NO: 3909848 - RNA, 11 nt, Human adenovirus C
agagggcaugg

SEQ ID NO: 3909849 - RNA, 14 nt, Human adenovirus C
agagggggcagggg

SEQ ID NO: 3909850 - RNA, 20 nt, Human adenovirus C
agagugcuuaaaaaaacaac

SEQ ID NO: 3909851 - RNA, 22 nt, Human adenovirus C
agauaaugacugcaaauuuacu

SEQ ID NO: 3909852 - RNA, 16 nt, Human adenovirus C
agauccgcguccaggu

SEQ ID NO: 3909853 - RNA, 21 nt, Human adenovirus C
agaugacuaacucaggggcgc

SEQ ID NO: 3909854 - RNA, 16 nt, Human adenovirus C
agaugagguacaugau

SEQ ID NO: 3909855 - RNA, 18 nt, Human adenovirus C
agaugccgcggugcaggc

SEQ ID NO: 3909856 - RNA, 14 nt, Human adenovirus C
agauguugcacaau

SEQ ID NO: 3909857 - RNA, 19 nt, Human adenovirus C
agauuauacccacaaccuu

SEQ ID NO: 3909858 - RNA, 12 nt, Human adenovirus C
agauuuuucugc

SEQ ID NO: 3909859 - RNA, 19 nt, Human adenovirus C
agcaaaucccgaauauuaa

SEQ ID NO: 3909860 - RNA, 23 nt, Human adenovirus C
agcaaugacagcaccuucaccca

SEQ ID NO: 3909861 - RNA, 12 nt, Human adenovirus C
agcaccaugucc

SEQ ID NO: 3909862 - RNA, 23 nt, Human adenovirus C
agcaccguggcgggcggcagcgg

SEQ ID NO: 3909863 - RNA, 13 nt, Human adenovirus C
agcagcaggagga

SEQ ID NO: 3909864 - RNA, 20 nt, Human adenovirus C
agcagcagggcaaccugggc

SEQ ID NO: 3909865 - RNA, 22 nt, Human adenovirus C
agcagcagggcaaccugggcuc

SEQ ID NO: 3909866 - RNA, 16 nt, Human adenovirus C
agcagcuggccuugcg

SEQ ID NO: 3909867 - RNA, 13 nt, Human adenovirus C
agcaggaggagga

SEQ ID NO: 3909868 - RNA, 23 nt, Human adenovirus C
agcaggcagaggcggcgcugcga

SEQ ID NO: 3909869 - RNA, 16 nt, Human adenovirus C
agcaggggggccacuu

SEQ ID NO: 3909870 - RNA, 23 nt, Human adenovirus C
agcauaaaaaaauccaguggacu

SEQ ID NO: 3909871 - RNA, 15 nt, Human adenovirus C
agcauaguggugcag

SEQ ID NO: 3909872 - RNA, 11 nt, Human adenovirus C
agcaucugcag

SEQ ID NO: 3909873 - RNA, 15 nt, Human adenovirus C
agcaugauaaauaug

SEQ ID NO: 3909874 - RNA, 16 nt, Human adenovirus C
agcauuugcagguggu

SEQ ID NO: 3909875 - RNA, 16 nt, Human adenovirus C
agccaacuaccuugcc

SEQ ID NO: 3909876 - RNA, 22 nt, Human adenovirus C
agccaacuaccuugccuaccac

SEQ ID NO: 3909877 - RNA, 15 nt, Human adenovirus C
agccacacccagcca

SEQ ID NO: 3909878 - RNA, 18 nt, Human adenovirus C
agccagaggacggcgagu

SEQ ID NO: 3909879 - RNA, 17 nt, Human adenovirus C
agccaggugagcucugg

SEQ ID NO: 3909880 - RNA, 17 nt, Human adenovirus C
agccaugcucagaaaug

SEQ ID NO: 3909881 - RNA, 20 nt, Human adenovirus C
agcccaagaaauccacagcg

SEQ ID NO: 3909882 - RNA, 23 nt, Human adenovirus C
agccccuacugcaccggcggcag

SEQ ID NO: 3909883 - RNA, 15 nt, Human adenovirus C
agcccgacgcgcgga

SEQ ID NO: 3909884 - RNA, 23 nt, Human adenovirus C
agcccgccaacgugccgcgggga

SEQ ID NO: 3909885 - RNA, 21 nt, Human adenovirus C
agccgagcggacaagcagcug

SEQ ID NO: 3909886 - RNA, 13 nt, Human adenovirus C
agccgcgcgcugg

SEQ ID NO: 3909887 - RNA, 17 nt, Human adenovirus C
agccgcgcgcuggggca

SEQ ID NO: 3909888 - RNA, 23 nt, Human adenovirus C
agccgcgcgcuggggcaggagga

SEQ ID NO: 3909889 - RNA, 16 nt, Human adenovirus C
agccgcggcaaugcag

SEQ ID NO: 3909890 - RNA, 20 nt, Human adenovirus C
agccgcugcagccaccgccc

SEQ ID NO: 3909891 - RNA, 14 nt, Human adenovirus C
agccggccuggacc

SEQ ID NO: 3909892 - RNA, 14 nt, Human adenovirus C
agccggcggcgcga

SEQ ID NO: 3909893 - RNA, 22 nt, Human adenovirus C
agccuauccaaaaacccaaagu

SEQ ID NO: 3909894 - RNA, 15 nt, Human adenovirus C
agccugaauaacaag

SEQ ID NO: 3909895 - RNA, 19 nt, Human adenovirus C
agccuggaggcaacccuga

SEQ ID NO: 3909896 - RNA, 19 nt, Human adenovirus C
agcgaagaaacccaucuga

SEQ ID NO: 3909897 - RNA, 14 nt, Human adenovirus C
agcgacgaccuggg

SEQ ID NO: 3909898 - RNA, 13 nt, Human adenovirus C
agcgagugguggc

SEQ ID NO: 3909899 - RNA, 21 nt, Human adenovirus C
agcgcaaccuaaaggagcugc

SEQ ID NO: 3909900 - RNA, 23 nt, Human adenovirus C
agcgcaaccuaaaggagcugcag

SEQ ID NO: 3909901 - RNA, 18 nt, Human adenovirus C
agcgcccucuccugagcg

SEQ ID NO: 3909902 - RNA, 21 nt, Human adenovirus C
agcgcccuucacggacagugg

SEQ ID NO: 3909903 - RNA, 16 nt, Human adenovirus C
agcgcgcgcagcagca

SEQ ID NO: 3909904 - RNA, 18 nt, Human adenovirus C
agcgcgcgcagcagcagg

SEQ ID NO: 3909905 - RNA, 13 nt, Human adenovirus C
agcgcggggugcc

SEQ ID NO: 3909906 - RNA, 14 nt, Human adenovirus C
agcgcugccggucu

SEQ ID NO: 3909907 - RNA, 19 nt, Human adenovirus C
agcggaugucagccuugcc

SEQ ID NO: 3909908 - RNA, 14 nt, Human adenovirus C
agcggcauuaaaaa

SEQ ID NO: 3909909 - RNA, 12 nt, Human adenovirus C
agcggccgccgc

SEQ ID NO: 3909910 - RNA, 17 nt, Human adenovirus C
agcggcgcggaagagaa

SEQ ID NO: 3909911 - RNA, 23 nt, Human adenovirus C
agcgguguuccgcgguccuccuc

SEQ ID NO: 3909912 - RNA, 18 nt, Human adenovirus C
agcuacccacccagcgcc

SEQ ID NO: 3909913 - RNA, 19 nt, Human adenovirus C
agcucggcggugaccugca

SEQ ID NO: 3909914 - RNA, 13 nt, Human adenovirus C
agcugcagcugcc

SEQ ID NO: 3909915 - RNA, 17 nt, Human adenovirus C
agcugccgccgccgcca

SEQ ID NO: 3909916 - RNA, 20 nt, Human adenovirus C
agcuggcgcgcuggcuugag

SEQ ID NO: 3909917 - RNA, 14 nt, Human adenovirus C
agcuggugcugcgc

SEQ ID NO: 3909918 - RNA, 22 nt, Human adenovirus C
agcuguccauggucuggagcuc

SEQ ID NO: 3909919 - RNA, 20 nt, Human adenovirus C
agcuguugcccgugcacucc

SEQ ID NO: 3909920 - RNA, 17 nt, Human adenovirus C
agcuugagccuggcuga

SEQ ID NO: 3909921 - RNA, 17 nt, Human adenovirus C
agcuugcccuuggagga

SEQ ID NO: 3909922 - RNA, 20 nt, Human adenovirus C
aggacaaacagguggagcug

SEQ ID NO: 3909923 - RNA, 17 nt, Human adenovirus C
aggacccuggugcugcc

SEQ ID NO: 3909924 - RNA, 18 nt, Human adenovirus C
aggacccuggugcugcca

SEQ ID NO: 3909925 - RNA, 19 nt, Human adenovirus C
aggacccuggugcugccaa

SEQ ID NO: 3909926 - RNA, 14 nt, Human adenovirus C
aggacuaaaaaaug

SEQ ID NO: 3909927 - RNA, 19 nt, Human adenovirus C
aggagcaacagcaggagga

SEQ ID NO: 3909928 - RNA, 23 nt, Human adenovirus C
aggagcgcaaccuaaaggagcug

SEQ ID NO: 3909929 - RNA, 23 nt, Human adenovirus C
aggagcgcagcuugagccuggcu

SEQ ID NO: 3909930 - RNA, 13 nt, Human adenovirus C
aggagcugaggcc

SEQ ID NO: 3909931 - RNA, 15 nt, Human adenovirus C
aggagcugcagaagc

SEQ ID NO: 3909932 - RNA, 16 nt, Human adenovirus C
aggagcuggugcugcg

SEQ ID NO: 3909933 - RNA, 15 nt, Human adenovirus C
aggaggacacgggca

SEQ ID NO: 3909934 - RNA, 23 nt, Human adenovirus C
aggaggagaugauggaagacugg

SEQ ID NO: 3909935 - RNA, 13 nt, Human adenovirus C
aggaggggcaaca

SEQ ID NO: 3909936 - RNA, 15 nt, Human adenovirus C
aggauaggguggccu

SEQ ID NO: 3909937 - RNA, 17 nt, Human adenovirus C
aggauggcacccaaaaa

SEQ ID NO: 3909938 - RNA, 15 nt, Human adenovirus C
aggaugggcaggggc

SEQ ID NO: 3909939 - RNA, 17 nt, Human adenovirus C
aggaugggcaggggcua

SEQ ID NO: 3909940 - RNA, 22 nt, Human adenovirus C
aggauuacaagugggaauuuga

SEQ ID NO: 3909941 - RNA, 15 nt, Human adenovirus C
aggcaaugcuacuaa

SEQ ID NO: 3909942 - RNA, 13 nt, Human adenovirus C
aggcagaggaggu

SEQ ID NO: 3909943 - RNA, 14 nt, Human adenovirus C
aggcaggacccugg

SEQ ID NO: 3909944 - RNA, 16 nt, Human adenovirus C
aggcaguagcuugaag

SEQ ID NO: 3909945 - RNA, 16 nt, Human adenovirus C
aggcagugcaaaauaa

SEQ ID NO: 3909946 - RNA, 17 nt, Human adenovirus C
aggccaagcagcuuguc

SEQ ID NO: 3909947 - RNA, 14 nt, Human adenovirus C
aggcccgggaccag

SEQ ID NO: 3909948 - RNA, 17 nt, Human adenovirus C
aggccgugagcgugagc

SEQ ID NO: 3909949 - RNA, 18 nt, Human adenovirus C
aggccuggccaguguuug

SEQ ID NO: 3909950 - RNA, 16 nt, Human adenovirus C
aggcgcaaggcggcgu

SEQ ID NO: 3909951 - RNA, 18 nt, Human adenovirus C
aggcgcaaggcggcgucc

SEQ ID NO: 3909952 - RNA, 18 nt, Human adenovirus C
aggcgcagagacacugau

SEQ ID NO: 3909953 - RNA, 13 nt, Human adenovirus C
aggcgcggcggcu

SEQ ID NO: 3909954 - RNA, 19 nt, Human adenovirus C
aggcgcuccauggccucgu

SEQ ID NO: 3909955 - RNA, 23 nt, Human adenovirus C
aggcggcggcggcggcaggagca

SEQ ID NO: 3909956 - RNA, 23 nt, Human adenovirus C
aggcuaauggcaauggcucaggc

SEQ ID NO: 3909957 - RNA, 23 nt, Human adenovirus C
aggcuaccgcucguggcgcgggc

SEQ ID NO: 3909958 - RNA, 18 nt, Human adenovirus C
aggcuaccucgcucccac

SEQ ID NO: 3909959 - RNA, 16 nt, Human adenovirus C
aggcucgcguccaggc

SEQ ID NO: 3909960 - RNA, 21 nt, Human adenovirus C
aggcugagcaccguggcgggc

SEQ ID NO: 3909961 - RNA, 11 nt, Human adenovirus C
aggcuggggcc

SEQ ID NO: 3909962 - RNA, 14 nt, Human adenovirus C
aggcuguagacagc

SEQ ID NO: 3909963 - RNA, 17 nt, Human adenovirus C
aggcuguccgugucccc

SEQ ID NO: 3909964 - RNA, 17 nt, Human adenovirus C
aggcuugggaguguuug

SEQ ID NO: 3909965 - RNA, 17 nt, Human adenovirus C
agggcaacccaacaccu

SEQ ID NO: 3909966 - RNA, 16 nt, Human adenovirus C
agggcacccuccccuu

SEQ ID NO: 3909967 - RNA, 15 nt, Human adenovirus C
agggcauggagacac

SEQ ID NO: 3909968 - RNA, 16 nt, Human adenovirus C
agggccgcuggcugcu

SEQ ID NO: 3909969 - RNA, 19 nt, Human adenovirus C
agggccuccccuucuucuu

SEQ ID NO: 3909970 - RNA, 14 nt, Human adenovirus C
agggcgaaggugac

SEQ ID NO: 3909971 - RNA, 21 nt, Human adenovirus C
agggcgagguauucagcucaa

SEQ ID NO: 3909972 - RNA, 20 nt, Human adenovirus C
agggcuacaacguagcucag

SEQ ID NO: 3909973 - RNA, 20 nt, Human adenovirus C
agggcuacgugcgccaggcc

SEQ ID NO: 3909974 - RNA, 12 nt, Human adenovirus C
aggggccaagaa

SEQ ID NO: 3909975 - RNA, 20 nt, Human adenovirus C
aggggccagcguaggguggc

SEQ ID NO: 3909976 - RNA, 15 nt, Human adenovirus C
agggggguguuccua

SEQ ID NO: 3909977 - RNA, 14 nt, Human adenovirus C
ccggagcgaggugu

SEQ ID NO: 3909978 - RNA, 16 nt, Human adenovirus C
ccggagugcugggcca

SEQ ID NO: 3909979 - RNA, 18 nt, Human adenovirus C
ccggcaaggcaaugcuac

SEQ ID NO: 3909980 - RNA, 16 nt, Human adenovirus C
cggcuggagcugccca

SEQ ID NO: 3909981 - RNA, 23 nt, Human adenovirus C
cggcuuucgcuguacggcaguag

SEQ ID NO: 3909982 - RNA, 21 nt, Human adenovirus C
cgggaagaacuggaucucccg

SEQ ID NO: 3909983 - RNA, 20 nt, Human adenovirus C
cgggacgcuaccgcugcgca

SEQ ID NO: 3909984 - RNA, 19 nt, Human adenovirus C
cgggaguuuaccaagcgcc

SEQ ID NO: 3909985 - RNA, 17 nt, Human adenovirus C
cgggauagagagccuag

SEQ ID NO: 3909986 - RNA, 11 nt, Human adenovirus C
cgggcagcagc

SEQ ID NO: 3909987 - RNA, 15 nt, Human adenovirus C
cgggccaugagcugc

SEQ ID NO: 3909988 - RNA, 23 nt, Human adenovirus C
cgggccaugagcugcgagaaggc

SEQ ID NO: 3909989 - RNA, 18 nt, Human adenovirus C
cgggcccuugcuucccag

SEQ ID NO: 3909990 - RNA, 22 nt, Human adenovirus C
cgggcccuugcuucccaggaug

SEQ ID NO: 3909991 - RNA, 20 nt, Human adenovirus C
cgggccgcucgaaggcuggc

SEQ ID NO: 3909992 - RNA, 20 nt, Human adenovirus C
cgggcggccaugcgggccgc

SEQ ID NO: 3909993 - RNA, 20 nt, Human adenovirus C
cgggcggcgcugcagagcca

SEQ ID NO: 3909994 - RNA, 12 nt, Human adenovirus C
cggggacaggag

SEQ ID NO: 3909995 - RNA, 21 nt, Human adenovirus C
cggggauucauguugugcaga

SEQ ID NO: 3909996 - RNA, 21 nt, Human adenovirus C
cggggggcugccgugcggcag

SEQ ID NO: 3909997 - RNA, 22 nt, Human adenovirus C
cgggguggacuucacccacagc

SEQ ID NO: 3909998 - RNA, 14 nt, Human adenovirus C
cggggugguggacc

SEQ ID NO: 3909999 - RNA, 22 nt, Human adenovirus C
cgggucagggcgcgggcuaggu

SEQ ID NO: 3910000 - RNA, 16 nt, Human adenovirus C
cggguuuggcuggugg

SEQ ID NO: 3910001 - RNA, 14 nt, Human adenovirus C
cgguagaggggcca

SEQ ID NO: 3910002 - RNA, 14 nt, Human adenovirus C
cggucggccaugcc

SEQ ID NO: 3910003 - RNA, 21 nt, Human adenovirus C
cggugaaguuuucacuccaca

SEQ ID NO: 3910004 - RNA, 20 nt, Human adenovirus C
cggugacgcgggcgggcccc

SEQ ID NO: 3910005 - RNA, 19 nt, Human adenovirus C
cggugaggcgugcgcaguc

SEQ ID NO: 3910006 - RNA, 18 nt, Human adenovirus C
cggugcugcggcagaugc

SEQ ID NO: 3910007 - RNA, 16 nt, Human adenovirus C
cgguuaacuccuccuc

SEQ ID NO: 3910008 - RNA, 20 nt, Human adenovirus C
cgguucuuugcugacccgga

SEQ ID NO: 3910009 - RNA, 18 nt, Human adenovirus C
cgguuuuccuggccaaua

SEQ ID NO: 3910010 - RNA, 18 nt, Human adenovirus C
cguaauaaccuuaauccc

SEQ ID NO: 3910011 - RNA, 17 nt, Human adenovirus C
cguacgugccgcggcag

SEQ ID NO: 3910012 - RNA, 16 nt, Human adenovirus C
cguaggagucgcgcag

SEQ ID NO: 3910013 - RNA, 19 nt, Human adenovirus C
cguaggagucgcgcagcuu

SEQ ID NO: 3910014 - RNA, 23 nt, Human adenovirus C
cguaggcgcucguugguccagca

SEQ ID NO: 3910015 - RNA, 16 nt, Human adenovirus C
cguaggugagcuccuc

SEQ ID NO: 3910016 - RNA, 17 nt, Human adenovirus C
cguaugccugcgcggcc

SEQ ID NO: 3910017 - RNA, 14 nt, Human adenovirus C
cguaugcgcaggag

SEQ ID NO: 3910018 - RNA, 12 nt, Human adenovirus C
cgucaggagggg

SEQ ID NO: 3910019 - RNA, 16 nt, Human adenovirus C
cguccgcauaccccgc

SEQ ID NO: 3910020 - RNA, 14 nt, Human adenovirus C
cguccugcaggaau

SEQ ID NO: 3910021 - RNA, 17 nt, Human adenovirus C
cgucgcgccgcaccgcg

SEQ ID NO: 3910022 - RNA, 22 nt, Human adenovirus C
cgucgguguuggagaucugcac

SEQ ID NO: 3910023 - RNA, 20 nt, Human adenovirus C
cgugaagacgacgggcccgg

SEQ ID NO: 3910024 - RNA, 20 nt, Human adenovirus C
cgugaccggguguuccugaa

SEQ ID NO: 3910025 - RNA, 17 nt, Human adenovirus C
cgugagcgcgcgcagca

SEQ ID NO: 3910026 - RNA, 16 nt, Human adenovirus C
cgugcgcaguacuggc

SEQ ID NO: 3910027 - RNA, 17 nt, Human adenovirus C
cgugcuggacagggggc

SEQ ID NO: 3910028 - RNA, 18 nt, Human adenovirus C
cguggagccugggcugga

SEQ ID NO: 3910029 - RNA, 18 nt, Human adenovirus C
cguggccgcgcaccuggc

SEQ ID NO: 3910030 - RNA, 12 nt, Human adenovirus C
cguggcggccgc

SEQ ID NO: 3910031 - RNA, 17 nt, Human adenovirus C
cguggcuuaaggguggg

SEQ ID NO: 3910032 - RNA, 16 nt, Human adenovirus C
cgugguaaaggugacu

SEQ ID NO: 3910033 - RNA, 19 nt, Human adenovirus C
cgugguacuuguccaucaa

SEQ ID NO: 3910034 - RNA, 18 nt, Human adenovirus C
cgugguccgugugcacca

SEQ ID NO: 3910035 - RNA, 13 nt, Human adenovirus C
cguggugagcgcg

SEQ ID NO: 3910036 - RNA, 19 nt, Human adenovirus C
cguugguuuucuuguauuc

SEQ ID NO: 3910037 - RNA, 17 nt, Human adenovirus C
cguuucucagcagcugu

SEQ ID NO: 3910038 - RNA, 14 nt, Human adenovirus C
cuaaacccuucagg

SEQ ID NO: 3910039 - RNA, 17 nt, Human adenovirus C
cuaacauaaacacacaa

SEQ ID NO: 3910040 - RNA, 16 nt, Human adenovirus C
cuaacgaugcaucuca

SEQ ID NO: 3910041 - RNA, 13 nt, Human adenovirus C
cuaacucugcaga

SEQ ID NO: 3910042 - RNA, 22 nt, Human adenovirus C
cuaaugagcuugaucugcuggc

SEQ ID NO: 3910043 - RNA, 12 nt, Human adenovirus C
cuaauggcaaug

SEQ ID NO: 3910044 - RNA, 22 nt, Human adenovirus C
cuacaacguagcucagugcaac

SEQ ID NO: 3910045 - RNA, 19 nt, Human adenovirus C
cuacaccuaccgccccaga

SEQ ID NO: 3910046 - RNA, 19 nt, Human adenovirus C
cuacaccuuucgccagggc

SEQ ID NO: 3910047 - RNA, 19 nt, Human adenovirus C
cuacaucguaggugacaaa

SEQ ID NO: 3910048 - RNA, 22 nt, Human adenovirus C
cuacaugagcgcgggaccccac

SEQ ID NO: 3910049 - RNA, 14 nt, Human adenovirus C
cuacccacccagcg

SEQ ID NO: 3910050 - RNA, 20 nt, Human adenovirus C
cuaccccguauuugccgugc

SEQ ID NO: 3910051 - RNA, 21 nt, Human adenovirus C
cuaccuggacuuggaggaggg

SEQ ID NO: 3910052 - RNA, 16 nt, Human adenovirus C
cuaccugugcuuugcu

SEQ ID NO: 3910053 - RNA, 16 nt, Human adenovirus C
cuacgaaaaaaccacu

SEQ ID NO: 3910054 - RNA, 20 nt, Human adenovirus C
cuacgaaaaaaccacuaccg

SEQ ID NO: 3910055 - RNA, 17 nt, Human adenovirus C
cuacgaacgccaccugu

SEQ ID NO: 3910056 - RNA, 14 nt, Human adenovirus C
cuacgaagaccaau

SEQ ID NO: 3910057 - RNA, 17 nt, Human adenovirus C
cuacgccaacuccgccc

SEQ ID NO: 3910058 - RNA, 15 nt, Human adenovirus C
cuacgggcgggcugc

SEQ ID NO: 3910059 - RNA, 14 nt, Human adenovirus C
cuacucccagcuca

SEQ ID NO: 3910060 - RNA, 15 nt, Human adenovirus C
cuacuccggcacugc

SEQ ID NO: 3910061 - RNA, 21 nt, Human adenovirus C
cuacuuccgcagccacagugc

SEQ ID NO: 3910062 - RNA, 19 nt, Human adenovirus C
cuacuuuuaagcccuacuc

SEQ ID NO: 3910063 - RNA, 15 nt, Human adenovirus C
cuagccaacuaccuu

SEQ ID NO: 3910064 - RNA, 20 nt, Human adenovirus C
cuagccauauauccauaccu

SEQ ID NO: 3910065 - RNA, 12 nt, Human adenovirus C
cuagguccaggu

SEQ ID NO: 3910066 - RNA, 17 nt, Human adenovirus C
cuauaaaugcaggaaag

SEQ ID NO: 3910067 - RNA, 17 nt, Human adenovirus C
cuaucauugugcucaac

SEQ ID NO: 3910068 - RNA, 19 nt, Human adenovirus C
cuauccaaaaacccaaagu

SEQ ID NO: 3910069 - RNA, 14 nt, Human adenovirus C
cuauggccccccga

SEQ ID NO: 3910070 - RNA, 15 nt, Human adenovirus C
cucaaagcauccagg

SEQ ID NO: 3910071 - RNA, 19 nt, Human adenovirus C
cucaacuaaugcaaaucca

SEQ ID NO: 3910072 - RNA, 11 nt, Human adenovirus C
cucagcagcug

SEQ ID NO: 3910073 - RNA, 14 nt, Human adenovirus C
cucagcgccuccca

SEQ ID NO: 3910074 - RNA, 17 nt, Human adenovirus C
cucaggcaccauccgca

SEQ ID NO: 3910075 - RNA, 18 nt, Human adenovirus C
cucaggggcgcagcuugc

SEQ ID NO: 3910076 - RNA, 20 nt, Human adenovirus C
cucauaacuuggacauaaac

SEQ ID NO: 3910077 - RNA, 22 nt, Human adenovirus C
cucaucagugauauuaauaaac

SEQ ID NO: 3910078 - RNA, 15 nt, Human adenovirus C
cucaucugcagccuc

SEQ ID NO: 3910079 - RNA, 18 nt, Human adenovirus C
cuccaacgcggcagccgc

SEQ ID NO: 3910080 - RNA, 13 nt, Human adenovirus C
cuccacaggcugc

SEQ ID NO: 3910081 - RNA, 17 nt, Human adenovirus C
cuccacaggcugcgcac

SEQ ID NO: 3910082 - RNA, 20 nt, Human adenovirus C
cuccacgcuggaagccaugc

SEQ ID NO: 3910083 - RNA, 16 nt, Human adenovirus C
cuccacgugccgggcg

SEQ ID NO: 3910084 - RNA, 11 nt, Human adenovirus C
cuccagagggg

SEQ ID NO: 3910085 - RNA, 18 nt, Human adenovirus C
cuccagcggccacacccg

SEQ ID NO: 3910086 - RNA, 18 nt, Human adenovirus C
cuccaugcccuucuccca

SEQ ID NO: 3910087 - RNA, 18 nt, Human adenovirus C
cuccauguuguugggaaa

SEQ ID NO: 3910088 - RNA, 23 nt, Human adenovirus C
cucccaccacugugguacuuccc

SEQ ID NO: 3910089 - RNA, 14 nt, Human adenovirus C
cucccacgcagaca

SEQ ID NO: 3910090 - RNA, 23 nt, Human adenovirus C
cucccucacccgcagcugccugu

SEQ ID NO: 3910091 - RNA, 23 nt, Human adenovirus C
cuccgcaauucuggaagcggugg

SEQ ID NO: 3910092 - RNA, 18 nt, Human adenovirus C
cuccgggcugcgcgcugg

SEQ ID NO: 3910093 - RNA, 13 nt, Human adenovirus C
cuccuaacugcag

SEQ ID NO: 3910094 - RNA, 15 nt, Human adenovirus C
cuccuccuccugcca

SEQ ID NO: 3910095 - RNA, 17 nt, Human adenovirus C
cuccucuauaaacauuc

SEQ ID NO: 3910096 - RNA, 13 nt, Human adenovirus C
cuccugccaggcu

SEQ ID NO: 3910097 - RNA, 24 nt, Human adenovirus C
cuccugcgccguagcgccauugcu

SEQ ID NO: 3910098 - RNA, 15 nt, Human adenovirus C
gcgcgucccugcgcc

SEQ ID NO: 3910099 - RNA, 14 nt, Human adenovirus C
gcgcgucgcaccgu

SEQ ID NO: 3910100 - RNA, 13 nt, Human adenovirus C
gcgcuccauggcc

SEQ ID NO: 3910101 - RNA, 17 nt, Human adenovirus C
gcgcucccucacccgca

SEQ ID NO: 3910102 - RNA, 19 nt, Human adenovirus C
gcgcuccuuuuggcuuccu

SEQ ID NO: 3910103 - RNA, 14 nt, Human adenovirus C
gcgcugcagagcca

SEQ ID NO: 3910104 - RNA, 18 nt, Human adenovirus C
gcgcugcgaaaggaaagc

SEQ ID NO: 3910105 - RNA, 18 nt, Human adenovirus C
gcgcugcuccucuucccg

SEQ ID NO: 3910106 - RNA, 22 nt, Human adenovirus C
gcgcuggcaacgucggcggcgu

SEQ ID NO: 3910107 - RNA, 22 nt, Human adenovirus C
gcgcuggccgaaaacagggcca

SEQ ID NO: 3910108 - RNA, 20 nt, Human adenovirus C
gcggagguugcuggcgaacg

SEQ ID NO: 3910109 - RNA, 19 nt, Human adenovirus C
gcggaugucagccuugccu

SEQ ID NO: 3910110 - RNA, 20 nt, Human adenovirus C
gcggaugucagccuugccua

SEQ ID NO: 3910111 - RNA, 21 nt, Human adenovirus C
gcggcaacaacaguggcagcg

SEQ ID NO: 3910112 - RNA, 17 nt, Human adenovirus C
gcggcaacgugcagacc

SEQ ID NO: 3910113 - RNA, 21 nt, Human adenovirus C
gcggcaagagcaagagcagcg

SEQ ID NO: 3910114 - RNA, 16 nt, Human adenovirus C
gcggcagcggcagcaa

SEQ ID NO: 3910115 - RNA, 17 nt, Human adenovirus C
gcggcaggagcagagcc

SEQ ID NO: 3910116 - RNA, 15 nt, Human adenovirus C
gcggcagucugcagc

SEQ ID NO: 3910117 - RNA, 22 nt, Human adenovirus C
gcggcaugcgucgugcgcacca

SEQ ID NO: 3910118 - RNA, 18 nt, Human adenovirus C
gcggccacacccggcgcc

SEQ ID NO: 3910119 - RNA, 18 nt, Human adenovirus C
gcggccuaaagcgcgagu

SEQ ID NO: 3910120 - RNA, 20 nt, Human adenovirus C
gcggccuaccggggggagaa

SEQ ID NO: 3910121 - RNA, 16 nt, Human adenovirus C
gcggcgacaggucagg

SEQ ID NO: 3910122 - RNA, 15 nt, Human adenovirus C
gcggcggcugcugcg

SEQ ID NO: 3910123 - RNA, 23 nt, Human adenovirus C
gcggcgguauccugccccuccuu

SEQ ID NO: 3910124 - RNA, 19 nt, Human adenovirus C
gcggcgguugaucuccuga

SEQ ID NO: 3910125 - RNA, 13 nt, Human adenovirus C
gcggcuggagcug

SEQ ID NO: 3910126 - RNA, 14 nt, Human adenovirus C
gcgggcacucuucc

SEQ ID NO: 3910127 - RNA, 22 nt, Human adenovirus C
gcgggccuccguuaucgcucca

SEQ ID NO: 3910128 - RNA, 16 nt, Human adenovirus C
gcggggaccacagaac

SEQ ID NO: 3910129 - RNA, 14 nt, Human adenovirus C
gcggggaggcggcg

SEQ ID NO: 3910130 - RNA, 13 nt, Human adenovirus C
gcgggggcgcagu

SEQ ID NO: 3910131 - RNA, 14 nt, Human adenovirus C
gcggguuggggcgg

SEQ ID NO: 3910132 - RNA, 23 nt, Human adenovirus C
gcggucucggucguugagggucc

SEQ ID NO: 3910133 - RNA, 13 nt, Human adenovirus C
gcggucuuuccag

SEQ ID NO: 3910134 - RNA, 23 nt, Human adenovirus C
gcggucuuuccaguacucuugga

SEQ ID NO: 3910135 - RNA, 18 nt, Human adenovirus C
cuggaccaggugucaccg

SEQ ID NO: 3910136 - RNA, 15 nt, Human adenovirus C
cuggacguuagcgcc

SEQ ID NO: 3910137 - RNA, 13 nt, Human adenovirus C
cuggagaucuccg

SEQ ID NO: 3910138 - RNA, 21 nt, Human adenovirus C
cuggagaucuuucauccauga

SEQ ID NO: 3910139 - RNA, 15 nt, Human adenovirus C
cuggagcucccgcgg

SEQ ID NO: 3910140 - RNA, 21 nt, Human adenovirus C
cuggagucucacgcucgcuug

SEQ ID NO: 3910141 - RNA, 17 nt, Human adenovirus C
cuggauuuucuggccau

SEQ ID NO: 3910142 - RNA, 15 nt, Human adenovirus C
cuggcaaagcacacu

SEQ ID NO: 3910143 - RNA, 16 nt, Human adenovirus C
cuggccaguguuugag

SEQ ID NO: 3910144 - RNA, 18 nt, Human adenovirus C
cuggccccaaacucccau

SEQ ID NO: 3910145 - RNA, 19 nt, Human adenovirus C
cuggccgaaaacagggcca

SEQ ID NO: 3910146 - RNA, 16 nt, Human adenovirus C
cuggccgcgcgcggcg

SEQ ID NO: 3910147 - RNA, 21 nt, Human adenovirus C
cuggcgcaaaaucuccugcac

SEQ ID NO: 3910148 - RNA, 22 nt, Human adenovirus C
cugggcauagucucgccgcgcg

SEQ ID NO: 3910149 - RNA, 17 nt, Human adenovirus C
cugggccagcacacacc

SEQ ID NO: 3910150 - RNA, 23 nt, Human adenovirus C
cuggggcgcgcacaaacgcggcc

SEQ ID NO: 3910151 - RNA, 14 nt, Human adenovirus C
cugggucgucuuca

SEQ ID NO: 3910152 - RNA, 23 nt, Human adenovirus C
cuggucuugucaugccuggggua

SEQ ID NO: 3910153 - RNA, 13 nt, Human adenovirus C
cuggugaagguca

SEQ ID NO: 3910154 - RNA, 18 nt, Human adenovirus C
cuggugcugaagcgcugc

SEQ ID NO: 3910155 - RNA, 19 nt, Human adenovirus C
cugguguuuagugcuccac

SEQ ID NO: 3910156 - RNA, 17 nt, Human adenovirus C
cugguuuccaugagccg

SEQ ID NO: 3910157 - RNA, 20 nt, Human adenovirus C
cuguaacgcuggaccugccu

SEQ ID NO: 3910158 - RNA, 14 nt, Human adenovirus C
cuguaacugcauca

SEQ ID NO: 3910159 - RNA, 18 nt, Human adenovirus C
cuguagaccacgcccccu

SEQ ID NO: 3910160 - RNA, 17 nt, Human adenovirus C
cuguauaacgcuggaaa

SEQ ID NO: 3910161 - RNA, 16 nt, Human adenovirus C
cugucauaccacugca

SEQ ID NO: 3910162 - RNA, 13 nt, Human adenovirus C
cugucugagggua

SEQ ID NO: 3910163 - RNA, 21 nt, Human adenovirus C
cugucugcgagggccagcugu

SEQ ID NO: 3910164 - RNA, 17 nt, Human adenovirus C
cugugcuuugcucccaa

SEQ ID NO: 3910165 - RNA, 18 nt, Human adenovirus C
cuguggggcuccucccag

SEQ ID NO: 3910166 - RNA, 14 nt, Human adenovirus C
cugugguacuuccc

SEQ ID NO: 3910167 - RNA, 19 nt, Human adenovirus C
cuguguauuuuuuccagga

SEQ ID NO: 3910168 - RNA, 23 nt, Human adenovirus C
cuguugaagcaucugcagcgcca

SEQ ID NO: 3910169 - RNA, 14 nt, Human adenovirus C
cuguuuugcagcag

SEQ ID NO: 3910170 - RNA, 16 nt, Human adenovirus C
cuuacaaaccuggaaa

SEQ ID NO: 3910171 - RNA, 17 nt, Human adenovirus C
cuuacacguagccugau

SEQ ID NO: 3910172 - RNA, 21 nt, Human adenovirus C
cuuagaaauaggauuuuuccc

SEQ ID NO: 3910173 - RNA, 21 nt, Human adenovirus C
cuucaaaucaaacuuuccugg

SEQ ID NO: 3910174 - RNA, 17 nt, Human adenovirus C
cuucaaucuccucuucc

SEQ ID NO: 3910175 - RNA, 21 nt, Human adenovirus C
cuucagaaacuuccagcccau

SEQ ID NO: 3910176 - RNA, 19 nt, Human adenovirus C
cuucagagaagaacaugcc

SEQ ID NO: 3910177 - RNA, 14 nt, Human adenovirus C
ggacagggccucuc

SEQ ID NO: 3910178 - RNA, 19 nt, Human adenovirus C
ggaccucccggccacuacc

SEQ ID NO: 3910179 - RNA, 14 nt, Human adenovirus C
ggaccucugcacuc

SEQ ID NO: 3910180 - RNA, 13 nt, Human adenovirus C
ggacgacgcagag

SEQ ID NO: 3910181 - RNA, 22 nt, Human adenovirus C
ggacgcuaccgcugcgcaacag

SEQ ID NO: 3910182 - RNA, 17 nt, Human adenovirus C
ggacugggcgugcagac

SEQ ID NO: 3910183 - RNA, 15 nt, Human adenovirus C
ggagaucugcaccac

SEQ ID NO: 3910184 - RNA, 13 nt, Human adenovirus C
ggagaugcagcgc

SEQ ID NO: 3910185 - RNA, 18 nt, Human adenovirus C
ggagcaacagcaggagga

SEQ ID NO: 3910186 - RNA, 14 nt, Human adenovirus C
ggagccugggcugg

SEQ ID NO: 3910187 - RNA, 13 nt, Human adenovirus C
ggagcgaggaggu

SEQ ID NO: 3910188 - RNA, 23 nt, Human adenovirus C
ggagcgcaaccuaaaggagcugc

SEQ ID NO: 3910189 - RNA, 13 nt, Human adenovirus C
ggagcgcaggguu

SEQ ID NO: 3910190 - RNA, 19 nt, Human adenovirus C
ggagcgcugggcguggugc

SEQ ID NO: 3910191 - RNA, 16 nt, Human adenovirus C
ggagcgggagcggggu

SEQ ID NO: 3910192 - RNA, 17 nt, Human adenovirus C
ggaggacacgggcagcc

SEQ ID NO: 3910193 - RNA, 20 nt, Human adenovirus C
ggaggacacgggcagccugg

SEQ ID NO: 3910194 - RNA, 22 nt, Human adenovirus C
ggaggcaagcacacagaccauc

SEQ ID NO: 3910195 - RNA, 12 nt, Human adenovirus C
ggaggcagcugg

SEQ ID NO: 3910196 - RNA, 15 nt, Human adenovirus C
ggaggcaggacccug

SEQ ID NO: 3910197 - RNA, 12 nt, Human adenovirus C
ggaggggcaugg

SEQ ID NO: 3910198 - RNA, 11 nt, Human adenovirus C
ggaggugagcu

SEQ ID NO: 3910199 - RNA, 14 nt, Human adenovirus C
ggaggugagcucaa

SEQ ID NO: 3910200 - RNA, 11 nt, Human adenovirus C
ggagugcuggg

SEQ ID NO: 3910201 - RNA, 14 nt, Human adenovirus C
ggagugcugggcca

SEQ ID NO: 3910202 - RNA, 14 nt, Human adenovirus C
ggaguuaccagcca

SEQ ID NO: 3910203 - RNA, 21 nt, Human adenovirus C
ggaucacaaccccaccaugaa

SEQ ID NO: 3910204 - RNA, 19 nt, Human adenovirus C
ggauuacaagcuccucccg

SEQ ID NO: 3910205 - RNA, 22 nt, Human adenovirus C
ggauuugucacccuuauccuca

SEQ ID NO: 3910206 - RNA, 20 nt, Human adenovirus C
ggcaacccuuccaggagggc

SEQ ID NO: 3910207 - RNA, 16 nt, Human adenovirus C
ucaccgucacccagca

SEQ ID NO: 3910208 - RNA, 11 nt, Human adenovirus C
ucaccucccaa

SEQ ID NO: 3910209 - RNA, 14 nt, Human adenovirus C
ucaccugccgccuc

SEQ ID NO: 3910210 - RNA, 15 nt, Human adenovirus C
ucacggugaaggggu

SEQ ID NO: 3910211 - RNA, 13 nt, Human adenovirus C
ucacuccacaggc

SEQ ID NO: 3910212 - RNA, 23 nt, Human adenovirus C
ucagaaacuuccagcccaugagc

SEQ ID NO: 3910213 - RNA, 19 nt, Human adenovirus C
ucagauacaugggcauaag

SEQ ID NO: 3910214 - RNA, 18 nt, Human adenovirus C
ucagaugcgaguagccca

SEQ ID NO: 3910215 - RNA, 15 nt, Human adenovirus C
ucagaugcugaccug

SEQ ID NO: 3910216 - RNA, 18 nt, Human adenovirus C
ucagcagcggcaagagca

SEQ ID NO: 3910217 - RNA, 12 nt, Human adenovirus C
ucagccuugccu

SEQ ID NO: 3910218 - RNA, 23 nt, Human adenovirus C
ucagcgaccgcgagcugaugcac

SEQ ID NO: 3910219 - RNA, 14 nt, Human adenovirus C
ucagcuacaagcua

SEQ ID NO: 3910220 - RNA, 20 nt, Human adenovirus C
ucagcugggaagaaagcagg

SEQ ID NO: 3910221 - RNA, 13 nt, Human adenovirus C
ucaggaauucugc

SEQ ID NO: 3910222 - RNA, 18 nt, Human adenovirus C
ucaggcacaaccauccgc

SEQ ID NO: 3910223 - RNA, 20 nt, Human adenovirus C
ucaggcgauccuaacucugc

SEQ ID NO: 3910224 - RNA, 20 nt, Human adenovirus C
ucaggcgggagcuccugcag

SEQ ID NO: 3910225 - RNA, 22 nt, Human adenovirus C
ucagggcgcgggcuagguccag

SEQ ID NO: 3910226 - RNA, 17 nt, Human adenovirus C
ucauaaccagcaugaag

SEQ ID NO: 3910227 - RNA, 13 nt, Human adenovirus C
ucauaccacaagc

SEQ ID NO: 3910228 - RNA, 15 nt, Human adenovirus C
ucaucccugagcagg

SEQ ID NO: 3910229 - RNA, 17 nt, Human adenovirus C
ucauggguaacagacau

SEQ ID NO: 3910230 - RNA, 19 nt, Human adenovirus C
ucauuccacgcucaagggc

SEQ ID NO: 3910231 - RNA, 18 nt, Human adenovirus C
uccaaacuaagcauugcu

SEQ ID NO: 3910232 - RNA, 19 nt, Human adenovirus C
uccaauauugcgcuguacc

SEQ ID NO: 3910233 - RNA, 12 nt, Human adenovirus C
uccacagcucgc

SEQ ID NO: 3910234 - RNA, 21 nt, Human adenovirus C
uccacgcuggaagccaugcuc

SEQ ID NO: 3910235 - RNA, 23 nt, Human adenovirus C
uccacgguaaagaccccgggcag

SEQ ID NO: 3910236 - RNA, 20 nt, Human adenovirus C
uccaggcuuuguuucuccac

SEQ ID NO: 3910237 - RNA, 20 nt, Human adenovirus C
uccauagagcagcugaccac

SEQ ID NO: 3910238 - RNA, 17 nt, Human adenovirus C
uccauaugacacagaaa

SEQ ID NO: 3910239 - RNA, 16 nt, Human adenovirus C
uccauggucuggagcu

SEQ ID NO: 3910240 - RNA, 19 nt, Human adenovirus C
ucccaaaaagggugcaugc

SEQ ID NO: 3910241 - RNA, 14 nt, Human adenovirus C
ucccaaaagacaua

SEQ ID NO: 3910242 - RNA, 21 nt, Human adenovirus C
ucccacgauacgucacuuccc

SEQ ID NO: 3910243 - RNA, 22 nt, Human adenovirus C
ucccagaugcauccggugcugc

SEQ ID NO: 3910244 - RNA, 18 nt, Human adenovirus C
ucccaugaaaccaugcua

SEQ ID NO: 3910245 - RNA, 14 nt, Human adenovirus C
uccccagguacagc

SEQ ID NO: 3910246 - RNA, 20 nt, Human adenovirus C
uccccuccgguggcgugguc

SEQ ID NO: 3910247 - RNA, 12 nt, Human adenovirus C
ucccuugccgug

SEQ ID NO: 3910248 - RNA, 22 nt, Human adenovirus C
uccgcgcgcggcggucggagcu

SEQ ID NO: 3910249 - RNA, 13 nt, Human adenovirus C
uccggcagcagcc

SEQ ID NO: 3910250 - RNA, 21 nt, Human adenovirus C
uccggcagcagccgcaggcca

SEQ ID NO: 3910251 - RNA, 15 nt, Human adenovirus C
uccgggcacagcagc

SEQ ID NO: 3910252 - RNA, 22 nt, Human adenovirus C
uccgggcugcgcgcuggccagg

SEQ ID NO: 3910253 - RNA, 20 nt, Human adenovirus C
uccuaccuuggaauuuugca

SEQ ID NO: 3910254 - RNA, 18 nt, Human adenovirus C
uccucaggauuacaagcu

SEQ ID NO: 3910255 - RNA, 23 nt, Human adenovirus C
uccucauguucuugucccuccgc

SEQ ID NO: 3910256 - RNA, 13 nt, Human adenovirus C
uccuccugccagg

SEQ ID NO: 3910257 - RNA, 13 nt, Human adenovirus C
uccuccuggagau

SEQ ID NO: 3910258 - RNA, 20 nt, Human adenovirus C
uccucggagccgcgcuccgg

SEQ ID NO: 3910259 - RNA, 12 nt, Human adenovirus C
uccugcaucucu

SEQ ID NO: 3910260 - RNA, 12 nt, Human adenovirus C
uccugccaggcu

SEQ ID NO: 3910261 - RNA, 14 nt, Human adenovirus C
uccuggagaucucc

SEQ ID NO: 3910262 - RNA, 12 nt, Human adenovirus C
uccuggugcaga

SEQ ID NO: 3910263 - RNA, 19 nt, Human adenovirus C
uccugucgagccaaacgcu

SEQ ID NO: 3910264 - RNA, 19 nt, Human adenovirus C
uccuuggccaauugcaagc

SEQ ID NO: 3910265 - RNA, 15 nt, Human adenovirus C
ucgaaggcuggccgc

SEQ ID NO: 3910266 - RNA, 12 nt, Human adenovirus C
ucgacaccaccc

SEQ ID NO: 3910267 - RNA, 19 nt, Human adenovirus C
ucgagaaggaggacagccu

SEQ ID NO: 3910268 - RNA, 21 nt, Human adenovirus C
ucgagacgccgccucagccgc

SEQ ID NO: 3910269 - RNA, 17 nt, Human adenovirus C
ucgcaaggccuggccag

SEQ ID NO: 3910270 - RNA, 16 nt, Human adenovirus C
ucgcagggccagcuga

SEQ ID NO: 3910271 - RNA, 21 nt, Human adenovirus C
ucgccagcccgugcuggcccc

SEQ ID NO: 3910272 - RNA, 13 nt, Human adenovirus C
ucgccccaucauc

SEQ ID NO: 3910273 - RNA, 15 nt, Human adenovirus C
ucgccccccuucucc

SEQ ID NO: 3910274 - RNA, 22 nt, Human adenovirus C
ucgcccugcgcgucggccaggu

SEQ ID NO: 3910275 - RNA, 23 nt, Human adenovirus C
ucgcccuugcggcagucugcagc

SEQ ID NO: 3910276 - RNA, 13 nt, Human adenovirus C
ucgccggcgcccc

SEQ ID NO: 3910277 - RNA, 18 nt, Human adenovirus C
ucgccugcuacuguuguc

SEQ ID NO: 3910278 - RNA, 18 nt, Human adenovirus C
ucgcgcaacugggcagca

SEQ ID NO: 3910279 - RNA, 22 nt, Human adenovirus C
ucgcgcaccucgcgcucaaagg

SEQ ID NO: 3910280 - RNA, 13 nt, Human adenovirus C
ucgcguccaggcc

SEQ ID NO: 3910281 - RNA, 16 nt, Human adenovirus C
ucgcguuucagccccc

SEQ ID NO: 3910282 - RNA, 14 nt, Human adenovirus C
ucgcuaugcgccac

SEQ ID NO: 3910283 - RNA, 17 nt, Human adenovirus C
ucgcugcugcagccgca

SEQ ID NO: 3910284 - RNA, 19 nt, Human adenovirus C
ucggcagaaacagagggcu

SEQ ID NO: 3910285 - RNA, 12 nt, Human adenovirus C
ucgggcagcagc

SEQ ID NO: 3910286 - RNA, 18 nt, Human adenovirus C
ucguaaacguagaggggc

SEQ ID NO: 3910287 - RNA, 19 nt, Human adenovirus C
ucguaggugagcuccucag

SEQ ID NO: 3910288 - RNA, 15 nt, Human adenovirus C
ucguccagacgggcc

SEQ ID NO: 3910289 - RNA, 15 nt, Human adenovirus C
ucguugaggguccug

SEQ ID NO: 3910290 - RNA, 22 nt, Human adenovirus C
ucuacggcaucucgauccagca

SEQ ID NO: 3910291 - RNA, 21 nt, Human adenovirus C
ucucacgcucgcuugguccug

SEQ ID NO: 3910292 - RNA, 12 nt, Human adenovirus C
ucucagcagcug

SEQ ID NO: 3910293 - RNA, 20 nt, Human adenovirus C
ucucagcgcagcggugcagc

SEQ ID NO: 3910294 - RNA, 15 nt, Human adenovirus C
ucuccaucccaucgc

SEQ ID NO: 3910295 - RNA, 14 nt, Human adenovirus C
ucucuacagccccu

SEQ ID NO: 3910296 - RNA, 17 nt, Human adenovirus C
ucugacaaagcccaaga

SEQ ID NO: 3910297 - RNA, 22 nt, Human adenovirus C
ucugcacucuuauuaaaaccau

SEQ ID NO: 3910298 - RNA, 21 nt, Human adenovirus C
ucugcagcgccagugcgccau

SEQ ID NO: 3910299 - RNA, 13 nt, Human adenovirus C
ucugcccgccacc

SEQ ID NO: 3910300 - RNA, 20 nt, Human adenovirus C
ucugcuuaaaagccaccuga

SEQ ID NO: 3910301 - RNA, 15 nt, Human adenovirus C
ucuggcgcccaacga

SEQ ID NO: 3910302 - RNA, 22 nt, Human adenovirus C
ucuguguaguaguuguaguaua

SEQ ID NO: 3910303 - RNA, 23 nt, Human adenovirus C
ucuuacaugcacaucucgggcca

SEQ ID NO: 3910304 - RNA, 19 nt, Human adenovirus C
ucuuauauuauugacccuu

SEQ ID NO: 3910305 - RNA, 21 nt, Human adenovirus C
ucuucucaaauacuaccucuu

SEQ ID NO: 3910306 - RNA, 16 nt, Human adenovirus C
ucuuggaaaaaaugac

SEQ ID NO: 3910307 - RNA, 17 nt, Human adenovirus C
ucuuggaaaaaaugacc

SEQ ID NO: 3910308 - RNA, 18 nt, Human adenovirus C
ucuuuacgccaccuucuu

SEQ ID NO: 3910309 - RNA, 12 nt, Human adenovirus C
ucuuuuuccaaa

SEQ ID NO: 3910310 - RNA, 16 nt, Human adenovirus C
ugaaaauaaaaaacag

SEQ ID NO: 3910311 - RNA, 16 nt, Human adenovirus C
ugaaaaucagagggcg

SEQ ID NO: 3910312 - RNA, 16 nt, Human adenovirus C
ugaaacucacuccggg

SEQ ID NO: 3910313 - RNA, 20 nt, Human adenovirus C
ugaaaugugcgauauuacca

SEQ ID NO: 3910314 - RNA, 22 nt, Human adenovirus C
ugaaccgcgagcgguugcugcg

SEQ ID NO: 3910315 - RNA, 15 nt, Human adenovirus C
ugaagacgacgggcc

SEQ ID NO: 3910316 - RNA, 21 nt, Human adenovirus C
ugaagcgcugccggucuucgc

SEQ ID NO: 3910317 - RNA, 16 nt, Human adenovirus C
ugaaggggugcgcucc

SEQ ID NO: 3910318 - RNA, 22 nt, Human adenovirus C
ugaauguuguacagguggcuga

SEQ ID NO: 3910319 - RNA, 22 nt, Human adenovirus C
ugacacaccucgaccacugccg

SEQ ID NO: 3910320 - RNA, 20 nt, Human adenovirus C
ugaccagacaccguccugag

SEQ ID NO: 3910321 - RNA, 18 nt, Human adenovirus C
ugaccgucuggcugcucg

SEQ ID NO: 3910322 - RNA, 15 nt, Human adenovirus C
ugaccugcgcugggc

SEQ ID NO: 3910323 - RNA, 22 nt, Human adenovirus C
ugacgaccgcgcacaaggaagc

SEQ ID NO: 3910324 - RNA, 21 nt, Human adenovirus C
ugacggccugguaggcgcagc

SEQ ID NO: 3910325 - RNA, 15 nt, Human adenovirus C
cuguuuugcagcagc

SEQ ID NO: 3910326 - RNA, 16 nt, Human adenovirus C
uagcccugcaaacauc

SEQ ID NO: 3910327 - RNA, 16 nt, Human adenovirus C
uaggagucgcgcagcu

SEQ ID NO: 3910328 - RNA, 21 nt, Human adenovirus C
uaggcgcagcaucccuuuucu

SEQ ID NO: 3910329 - RNA, 18 nt, Human adenovirus C
uaggggagaucagcuggg

SEQ ID NO: 3910330 - RNA, 21 nt, Human adenovirus C
uaguuaagagagcugcagcug

SEQ ID NO: 3910331 - RNA, 13 nt, Human adenovirus C
uauaacagaggcc

SEQ ID NO: 3910332 - RNA, 19 nt, Human adenovirus C
uauacagacuugagaggcc

SEQ ID NO: 3910333 - RNA, 17 nt, Human adenovirus C
uauaccuuuuuaaugca

SEQ ID NO: 3910334 - RNA, 12 nt, Human adenovirus C
uaucacaucuuu

SEQ ID NO: 3910335 - RNA, 20 nt, Human adenovirus C
uaucaccgucacccagcacu

SEQ ID NO: 3910336 - RNA, 21 nt, Human adenovirus C
uaucagcagccgcgggcccuu

SEQ ID NO: 3910337 - RNA, 15 nt, Human adenovirus C
uaucccccaaggccu

SEQ ID NO: 3910338 - RNA, 16 nt, Human adenovirus C
uaugauccagauguua

SEQ ID NO: 3910339 - RNA, 16 nt, Human adenovirus C
uauggcagcaaggccu

SEQ ID NO: 3910340 - RNA, 20 nt, Human adenovirus C
uauugaucaccguaccuuaa

SEQ ID NO: 3910341 - RNA, 13 nt, Human adenovirus C
ucaaaaacaugcu

SEQ ID NO: 3910342 - RNA, 15 nt, Human adenovirus C
ucaaaaucccacagu

SEQ ID NO: 3910343 - RNA, 12 nt, Human adenovirus C
ucaaacccagcu

SEQ ID NO: 3910344 - RNA, 18 nt, Human adenovirus C
ucaaaggcuacaggggcc

SEQ ID NO: 3910345 - RNA, 23 nt, Human adenovirus C
ucaacgcgcgcgcagccuccaug

SEQ ID NO: 3910346 - RNA, 23 nt, Human adenovirus C
ucaacuuugcgucucuggccccg

SEQ ID NO: 3910347 - RNA, 19 nt, Human adenovirus C
ucaauccguucugguuccg

SEQ ID NO: 3910348 - RNA, 20 nt, Human adenovirus C
ucaauguuggcacaacacag

SEQ ID NO: 3910349 - RNA, 14 nt, Human adenovirus C
ucacaagccccacu

SEQ ID NO: 3910350 - RNA, 23 nt, Human adenovirus C
ucacaccuauuaccggcugcaac

SEQ ID NO: 3910351 - RNA, 22 nt, Human adenovirus C
ucacaucgaaguagauugcauc

SEQ ID NO: 3910352 - RNA, 12 nt, Human adenovirus C
ucaccaaggcca

SEQ ID NO: 3910353 - RNA, 16 nt, Human adenovirus C
ucacccuggcuguggg

SEQ ID NO: 3910354 - RNA, 18 nt, Human adenovirus C
ucacggugaaggggugcg

SEQ ID NO: 3910355 - RNA, 17 nt, Human adenovirus C
ucacugcuaccuucugc

SEQ ID NO: 3910356 - RNA, 20 nt, Human adenovirus C
ucacuugcugaagaccauuc

SEQ ID NO: 3910357 - RNA, 18 nt, Human adenovirus C
ucacuuggugcuggccug

SEQ ID NO: 3910358 - RNA, 14 nt, Human adenovirus C
ucacuuuccgcuuc

SEQ ID NO: 3910359 - RNA, 14 nt, Human adenovirus C
ucagagaagaacau

SEQ ID NO: 3910360 - RNA, 18 nt, Human adenovirus C
ucagauaaugacugcaaa

SEQ ID NO: 3910361 - RNA, 17 nt, Human adenovirus C
ucagauacccaccacca

SEQ ID NO: 3910362 - RNA, 22 nt, Human adenovirus C
ucagcagguuggaauucuucac

SEQ ID NO: 3910363 - RNA, 13 nt, Human adenovirus C
ucagccacuuaaa

SEQ ID NO: 3910364 - RNA, 17 nt, Human adenovirus C
ucagccgcgcgcugggg

SEQ ID NO: 3910365 - RNA, 16 nt, Human adenovirus C
ucagccgcugcagcca

SEQ ID NO: 3910366 - RNA, 20 nt, Human adenovirus C
ucagccugaauaacaaguuu

SEQ ID NO: 3910367 - RNA, 20 nt, Human adenovirus C
ucagcgcagcggugcagcca

SEQ ID NO: 3910368 - RNA, 22 nt, Human adenovirus C
ucagcgccauuaugagcaagga

SEQ ID NO: 3910369 - RNA, 13 nt, Human adenovirus C
ucagcgccuccca

SEQ ID NO: 3910370 - RNA, 17 nt, Human adenovirus C
ucagcuugccugcucca

SEQ ID NO: 3910371 - RNA, 23 nt, Human adenovirus C
ucaggaauucugcccgccaccug

SEQ ID NO: 3910372 - RNA, 21 nt, Human adenovirus C
ucaggcgccgccggcacugcc

SEQ ID NO: 3910373 - RNA, 13 nt, Human adenovirus C
ucauccaugacag

SEQ ID NO: 3910374 - RNA, 23 nt, Human adenovirus C
ucaucggcugaagcagggccagg

SEQ ID NO: 3910375 - RNA, 17 nt, Human adenovirus C
ucaucucuacagccccu

SEQ ID NO: 3910376 - RNA, 23 nt, Human adenovirus C
ucauguucuugucccuccgcacc

SEQ ID NO: 3910377 - RNA, 13 nt, Human adenovirus C
ucauuccacgcuc

SEQ ID NO: 3910378 - RNA, 22 nt, Human adenovirus C
ucauugugcucaacccacacaa

SEQ ID NO: 3910379 - RNA, 15 nt, Human adenovirus C
uccaagauggcuacc

SEQ ID NO: 3910380 - RNA, 16 nt, Human adenovirus C
uccacccgcaccuaca

SEQ ID NO: 3910381 - RNA, 16 nt, Human adenovirus C
caccggcggcggcgcg

SEQ ID NO: 3910382 - RNA, 17 nt, Human adenovirus C
caccgucacccagcacu

SEQ ID NO: 3910383 - RNA, 19 nt, Human adenovirus C
caccgugcuuucacuuucc

SEQ ID NO: 3910384 - RNA, 18 nt, Human adenovirus C
caccuacgacuacaugaa

SEQ ID NO: 3910385 - RNA, 17 nt, Human adenovirus C
caccuacgaugaccugg

SEQ ID NO: 3910386 - RNA, 18 nt, Human adenovirus C
caccuacgaugaccugga

SEQ ID NO: 3910387 - RNA, 16 nt, Human adenovirus C
caccucgaccacugcc

SEQ ID NO: 3910388 - RNA, 12 nt, Human adenovirus C
caccucugggga

SEQ ID NO: 3910389 - RNA, 19 nt, Human adenovirus C
caccugaaaaucagagggc

SEQ ID NO: 3910390 - RNA, 20 nt, Human adenovirus C
caccuguaacgcuggaccug

SEQ ID NO: 3910391 - RNA, 17 nt, Human adenovirus C
caccugucgucagcgcc

SEQ ID NO: 3910392 - RNA, 18 nt, Human adenovirus C
cacgaccccuggagaggg

SEQ ID NO: 3910393 - RNA, 19 nt, Human adenovirus C
cacgcaaccgcgcccaggc

SEQ ID NO: 3910394 - RNA, 21 nt, Human adenovirus C
cacgcaaccgcgcccaggcgg

SEQ ID NO: 3910395 - RNA, 19 nt, Human adenovirus C
cacgcuggaagccaugcuc

SEQ ID NO: 3910396 - RNA, 13 nt, Human adenovirus C
cacggcggcgacg

SEQ ID NO: 3910397 - RNA, 20 nt, Human adenovirus C
cacggcggcgacgacggcgc

SEQ ID NO: 3910398 - RNA, 21 nt, Human adenovirus C
cacgggacgcuaccgcugcgc

SEQ ID NO: 3910399 - RNA, 14 nt, Human adenovirus C
cacgggcggcggcc

SEQ ID NO: 3910400 - RNA, 17 nt, Human adenovirus C
cacgguuuccugucgag

SEQ ID NO: 3910401 - RNA, 23 nt, Human adenovirus C
cacguacuuugacauccgcggcg

SEQ ID NO: 3910402 - RNA, 13 nt, Human adenovirus C
cacgucuccugag

SEQ ID NO: 3910403 - RNA, 23 nt, Human adenovirus C
cacuaccggcaaccgccucagcu

SEQ ID NO: 3910404 - RNA, 18 nt, Human adenovirus C
cacuaguauugccacugc

SEQ ID NO: 3910405 - RNA, 16 nt, Human adenovirus C
cacuagugaauccaca

SEQ ID NO: 3910406 - RNA, 17 nt, Human adenovirus C
cacucacagaccugggc

SEQ ID NO: 3910407 - RNA, 13 nt, Human adenovirus C
cacuccacaggcu

SEQ ID NO: 3910408 - RNA, 15 nt, Human adenovirus C
cacuccacaggcugc

SEQ ID NO: 3910409 - RNA, 14 nt, Human adenovirus C
cacuccugcgccgu

SEQ ID NO: 3910410 - RNA, 16 nt, Human adenovirus C
cacucgcuccagggug

SEQ ID NO: 3910411 - RNA, 13 nt, Human adenovirus C
cacucgugcuggc

SEQ ID NO: 3910412 - RNA, 22 nt, Human adenovirus C
cacucucgcaaggccuggccag

SEQ ID NO: 3910413 - RNA, 13 nt, Human adenovirus C
cacugaacagcau

SEQ ID NO: 3910414 - RNA, 17 nt, Human adenovirus C
cacugaucgccgcggcg

SEQ ID NO: 3910415 - RNA, 17 nt, Human adenovirus C
cacugccgccgccacaa

SEQ ID NO: 3910416 - RNA, 20 nt, Human adenovirus C
cacugcuaccuucugcagcu

SEQ ID NO: 3910417 - RNA, 22 nt, Human adenovirus C
cacugugguacuucccagagac

SEQ ID NO: 3910418 - RNA, 19 nt, Human adenovirus C
cacuguuacucagccacuu

SEQ ID NO: 3910419 - RNA, 15 nt, Human adenovirus C
cacuuggugcuggcc

SEQ ID NO: 3910420 - RNA, 15 nt, Human adenovirus C
cacuuucaauaaagg

SEQ ID NO: 3910421 - RNA, 19 nt, Human adenovirus C
cagaaaccgggccuccaac

SEQ ID NO: 3910422 - RNA, 18 nt, Human adenovirus C
cagaaacuuccagcccau

SEQ ID NO: 3910423 - RNA, 15 nt, Human adenovirus C
cagaaggcgcucgcc

SEQ ID NO: 3910424 - RNA, 16 nt, Human adenovirus C
cagacaaugcagaaac

SEQ ID NO: 3910425 - RNA, 17 nt, Human adenovirus C
cagacacacaucugucu

SEQ ID NO: 3910426 - RNA, 21 nt, Human adenovirus C
cgcugcgguucaucccugugg

SEQ ID NO: 3910427 - RNA, 13 nt, Human adenovirus C
cgcuggccagcac

SEQ ID NO: 3910428 - RNA, 18 nt, Human adenovirus C
cgcugucugcgagggcca

SEQ ID NO: 3910429 - RNA, 22 nt, Human adenovirus C
cgcuugcaagcagugcagcuuc

SEQ ID NO: 3910430 - RNA, 15 nt, Human adenovirus C
cggacaagcagcugg

SEQ ID NO: 3910431 - RNA, 12 nt, Human adenovirus C
cggacaggccgc

SEQ ID NO: 3910432 - RNA, 22 nt, Human adenovirus C
cggaccacucugagacgaaggc

SEQ ID NO: 3910433 - RNA, 15 nt, Human adenovirus C
cggacccggcggugc

SEQ ID NO: 3910434 - RNA, 12 nt, Human adenovirus C
cggaccugggcu

SEQ ID NO: 3910435 - RNA, 20 nt, Human adenovirus C
cggagaugcagcgcaagcua

SEQ ID NO: 3910436 - RNA, 21 nt, Human adenovirus C
cggagcuaugcuaaccagcgu

SEQ ID NO: 3910437 - RNA, 14 nt, Human adenovirus C
cggagggugccaga

SEQ ID NO: 3910438 - RNA, 15 nt, Human adenovirus C
cggaguaccugagcc

SEQ ID NO: 3910439 - RNA, 15 nt, Human adenovirus C
cggagugcugggcca

SEQ ID NO: 3910440 - RNA, 18 nt, Human adenovirus C
cggcaaccgccucagcua

SEQ ID NO: 3910441 - RNA, 17 nt, Human adenovirus C
cggcacuuaaccuaccc

SEQ ID NO: 3910442 - RNA, 16 nt, Human adenovirus C
cggcagaagauccccu

SEQ ID NO: 3910443 - RNA, 20 nt, Human adenovirus C
cggcagacaugcagggcacc

SEQ ID NO: 3910444 - RNA, 14 nt, Human adenovirus C
cggcagaugcgccc

SEQ ID NO: 3910445 - RNA, 18 nt, Human adenovirus C
cggcagaugcgccccccu

SEQ ID NO: 3910446 - RNA, 14 nt, Human adenovirus C
cggcagcggcagca

SEQ ID NO: 3910447 - RNA, 21 nt, Human adenovirus C
cggcaguagucggugcucguc

SEQ ID NO: 3910448 - RNA, 20 nt, Human adenovirus C
cggcaugcgucgugcgcacc

SEQ ID NO: 3910449 - RNA, 19 nt, Human adenovirus C
cggccacuuccccgccagg

SEQ ID NO: 3910450 - RNA, 19 nt, Human adenovirus C
cggccaugcgggccgcucg

SEQ ID NO: 3910451 - RNA, 11 nt, Human adenovirus C
cggccccaccg

SEQ ID NO: 3910452 - RNA, 18 nt, Human adenovirus C
cggcccgaugaggccggc

SEQ ID NO: 3910453 - RNA, 19 nt, Human adenovirus C
cggcccguagccaguggca

SEQ ID NO: 3910454 - RNA, 22 nt, Human adenovirus C
cggcccugcuuaaccgcgcacg

SEQ ID NO: 3910455 - RNA, 24 nt, Human adenovirus C
cggccguggagacagugucuccag

SEQ ID NO: 3910456 - RNA, 16 nt, Human adenovirus C
cggccuaccgggggga

SEQ ID NO: 3910457 - RNA, 17 nt, Human adenovirus C
cggccuuccggagcgag

SEQ ID NO: 3910458 - RNA, 18 nt, Human adenovirus C
cggcgacccucagaccgg

SEQ ID NO: 3910459 - RNA, 16 nt, Human adenovirus C
cggcgccagcaccugu

SEQ ID NO: 3910460 - RNA, 15 nt, Human adenovirus C
cggcgccgggcccgg

SEQ ID NO: 3910461 - RNA, 13 nt, Human adenovirus C
cggcgcugcagag

SEQ ID NO: 3910462 - RNA, 15 nt, Human adenovirus C
cggcgcugcagagcc

SEQ ID NO: 3910463 - RNA, 13 nt, Human adenovirus C
cggcggcagaaga

SEQ ID NO: 3910464 - RNA, 15 nt, Human adenovirus C
cggcggcggcaggag

SEQ ID NO: 3910465 - RNA, 15 nt, Human adenovirus C
cggcggcuggcggua

SEQ ID NO: 3910466 - RNA, 23 nt, Human adenovirus C
cggcguaguuucgcaggcgcuga

SEQ ID NO: 3910467 - RNA, 17 nt, Human adenovirus C
cggcguccggcucacca

SEQ ID NO: 3910468 - RNA, 13 nt, Human adenovirus C
cggcuaggucucg

SEQ ID NO: 3910469 - RNA, 21 nt, Human adenovirus C
cggcuauuaccaccacaccuc

SEQ ID NO: 3910470 - RNA, 18 nt, Human adenovirus C
cggcucaaccaucgcgcc

SEQ ID NO: 3910471 - RNA, 15 nt, Human adenovirus C
cggcucaccacccag

SEQ ID NO: 3910472 - RNA, 14 nt, Human adenovirus C
cggcucgcgcccgu

SEQ ID NO: 3910473 - RNA, 13 nt, Human adenovirus C
cggcuggagcugc

SEQ ID NO: 3910474 - RNA, 20 nt, Human adenovirus C
cgggacgcucuggccgguga

SEQ ID NO: 3910475 - RNA, 17 nt, Human adenovirus C
cgggagagggggcaggg

SEQ ID NO: 3910476 - RNA, 15 nt, Human adenovirus C
cgggcagcaggcgcg

SEQ ID NO: 3910477 - RNA, 16 nt, Human adenovirus C
cgggcagccuggaggc

SEQ ID NO: 3910478 - RNA, 15 nt, Human adenovirus C
cgggcaggagcuggu

SEQ ID NO: 3910479 - RNA, 16 nt, Human adenovirus C
cgggccaugagcugcg

SEQ ID NO: 3910480 - RNA, 20 nt, Human adenovirus C
cgggcccuugcuucccagga

SEQ ID NO: 3910481 - RNA, 19 nt, Human adenovirus C
cgggccgaacacucgugcu

SEQ ID NO: 3910482 - RNA, 19 nt, Human adenovirus C
cgggccgcucgaaggcugg

SEQ ID NO: 3910483 - RNA, 14 nt, Human adenovirus C
cgggcgcagggucc

SEQ ID NO: 3910484 - RNA, 12 nt, Human adenovirus C
cgggcggcaugc

SEQ ID NO: 3910485 - RNA, 14 nt, Human adenovirus C
cgggcuagguccag

SEQ ID NO: 3910486 - RNA, 21 nt, Human adenovirus C
cgggcugcgcgcuggccaggg

SEQ ID NO: 3910487 - RNA, 21 nt, Human adenovirus C
cggggaguaggcauccgcgcc

SEQ ID NO: 3910488 - RNA, 18 nt, Human adenovirus C
cggggggcuucugaggcu

SEQ ID NO: 3910489 - RNA, 23 nt, Human adenovirus C
cgggucaaaaagaaaaagaaaga

SEQ ID NO: 3910490 - RNA, 14 nt, Human adenovirus C
cgguaccuuugagc

SEQ ID NO: 3910491 - RNA, 15 nt, Human adenovirus C
cgguagaggggccag

SEQ ID NO: 3910492 - RNA, 22 nt, Human adenovirus C
cgguagugggucuagcugcguc

SEQ ID NO: 3910493 - RNA, 15 nt, Human adenovirus C
cggucaccagaggcu

SEQ ID NO: 3910494 - RNA, 13 nt, Human adenovirus C
cggucccacagcu

SEQ ID NO: 3910495 - RNA, 13 nt, Human adenovirus C
cggucggccaugc

SEQ ID NO: 3910496 - RNA, 15 nt, Human adenovirus C
cggucguugaggguc

SEQ ID NO: 3910497 - RNA, 18 nt, Human adenovirus C
cggucguugaggguccug

SEQ ID NO: 3910498 - RNA, 11 nt, Human adenovirus C
cggugagcgcu

SEQ ID NO: 3910499 - RNA, 17 nt, Human adenovirus C
cggugagcgcuccaccc

SEQ ID NO: 3910500 - RNA, 22 nt, Human adenovirus C
cggugaugccuuugaggguggc

SEQ ID NO: 3910501 - RNA, 19 nt, Human adenovirus C
cggugcaggcggccgcugc

SEQ ID NO: 3910502 - RNA, 11 nt, Human adenovirus C
cggugccauga

SEQ ID NO: 3910503 - RNA, 20 nt, Human adenovirus C
cggugccaugauuacuaaac

SEQ ID NO: 3910504 - RNA, 12 nt, Human adenovirus C
cgguggcaccua

SEQ ID NO: 3910505 - RNA, 21 nt, Human adenovirus C
cgguguuggagaucugcacca

SEQ ID NO: 3910506 - RNA, 21 nt, Human adenovirus C
cgguugacaguauuacccaga

SEQ ID NO: 3910507 - RNA, 21 nt, Human adenovirus C
cguacacuggauggccuuugc

SEQ ID NO: 3910508 - RNA, 19 nt, Human adenovirus C
cguaugcgcaggagcacag

SEQ ID NO: 3910509 - RNA, 22 nt, Human adenovirus C
cgucaccgguugcugcgcccac

SEQ ID NO: 3910510 - RNA, 17 nt, Human adenovirus C
cgucaucccugagcagg

SEQ ID NO: 3910511 - RNA, 19 nt, Human adenovirus C
cguccagacgggccagggu

SEQ ID NO: 3910512 - RNA, 14 nt, Human adenovirus C
cgucccugcgccgu

SEQ ID NO: 3910513 - RNA, 16 nt, Human adenovirus C
cgucuagggcgcagua

SEQ ID NO: 3910514 - RNA, 19 nt, Human adenovirus C
cgugacacugcagcaggug

SEQ ID NO: 3910515 - RNA, 21 nt, Human adenovirus C
cgugacacugcagcaggugcu

SEQ ID NO: 3910516 - RNA, 16 nt, Human adenovirus C
cgugcacuccaagagc

SEQ ID NO: 3910517 - RNA, 15 nt, Human adenovirus C
cgugcagaccgugga

SEQ ID NO: 3910518 - RNA, 16 nt, Human adenovirus C
cgugcauacacuuccu

SEQ ID NO: 3910519 - RNA, 17 nt, Human adenovirus C
cgugccaaccgcagccg

SEQ ID NO: 3910520 - RNA, 20 nt, Human adenovirus C
cgugcuguugaagcaucugc

SEQ ID NO: 3910521 - RNA, 13 nt, Human adenovirus C
cguggcgggcggc

SEQ ID NO: 3910522 - RNA, 16 nt, Human adenovirus C
cguggcuacaccuacc

SEQ ID NO: 3910523 - RNA, 17 nt, Human adenovirus C
cgugggucugggggugc

SEQ ID NO: 3910524 - RNA, 21 nt, Human adenovirus C
cgugugaccccgaagccccuc

SEQ ID NO: 3910525 - RNA, 18 nt, Human adenovirus C
cgugugcaccagccgcac

SEQ ID NO: 3910526 - RNA, 22 nt, Human adenovirus C
cguucaggaauucugcccgcca

SEQ ID NO: 3910527 - RNA, 15 nt, Human adenovirus C
cguuccggcagcagc

SEQ ID NO: 3910528 - RNA, 16 nt, Human adenovirus C
cguuggagacugcagc

SEQ ID NO: 3910529 - RNA, 13 nt, Human adenovirus C
cuaaaccagcugg

SEQ ID NO: 3910530 - RNA, 17 nt, Human adenovirus C
cuacuccggcacugccu

SEQ ID NO: 3910531 - RNA, 15 nt, Human adenovirus C
cuacuucggcugcuu

SEQ ID NO: 3910532 - RNA, 23 nt, Human adenovirus C
cuagccuaaagcccgugacacug

SEQ ID NO: 3910533 - RNA, 15 nt, Human adenovirus C
cuagcgagguaagca

SEQ ID NO: 3910534 - RNA, 13 nt, Human adenovirus C
cuagcuugcugac

SEQ ID NO: 3910535 - RNA, 21 nt, Human adenovirus C
cuagcuuuuuuggccacuggc

SEQ ID NO: 3910536 - RNA, 21 nt, Human adenovirus C
cuagggcgcaguaguccaggg

SEQ ID NO: 3910537 - RNA, 15 nt, Human adenovirus C
cuauauuucaacaaa

SEQ ID NO: 3910538 - RNA, 19 nt, Human adenovirus C
cuaucaccgucacccagca

SEQ ID NO: 3910539 - RNA, 18 nt, Human adenovirus C
cuauccugccgugccaac

SEQ ID NO: 3910540 - RNA, 20 nt, Human adenovirus C
cuaugcaccccgcaccgcuc

SEQ ID NO: 3910541 - RNA, 20 nt, Human adenovirus C
cuauguugggucaacaaucu

SEQ ID NO: 3910542 - RNA, 22 nt, Human adenovirus C
cuauuuauguaaauaauggaaa

SEQ ID NO: 3910543 - RNA, 13 nt, Human adenovirus C
cucaaagcaucca

SEQ ID NO: 3910544 - RNA, 15 nt, Human adenovirus C
cucaaauacuaccuc

SEQ ID NO: 3910545 - RNA, 15 nt, Human adenovirus C
cucaaauauggaaca

SEQ ID NO: 3910546 - RNA, 14 nt, Human adenovirus C
cucaacuaaugcaa

SEQ ID NO: 3910547 - RNA, 16 nt, Human adenovirus C
cucacagaccugggcc

SEQ ID NO: 3910548 - RNA, 15 nt, Human adenovirus C
cucacccgcagcugc

SEQ ID NO: 3910549 - RNA, 12 nt, Human adenovirus C
cucaccucccaa

SEQ ID NO: 3910550 - RNA, 16 nt, Human adenovirus C
cucagcagcggcaaga

SEQ ID NO: 3910551 - RNA, 23 nt, Human adenovirus C
cucagccgccuuuuagcugcaaa

SEQ ID NO: 3910552 - RNA, 23 nt, Human adenovirus C
cucagcgaccgcgagcugaugca

SEQ ID NO: 3910553 - RNA, 21 nt, Human adenovirus C
cucagcgcagcggugcagcca

SEQ ID NO: 3910554 - RNA, 16 nt, Human adenovirus C
cucagugcaacaugac

SEQ ID NO: 3910555 - RNA, 22 nt, Human adenovirus C
cucaguggaacgaagcugaugc

SEQ ID NO: 3910556 - RNA, 17 nt, Human adenovirus C
cucaucggcugaagcag

SEQ ID NO: 3910557 - RNA, 17 nt, Human adenovirus C
cuccaccgaugccgcca

SEQ ID NO: 3910558 - RNA, 15 nt, Human adenovirus C
cuccacgccuuugcc

SEQ ID NO: 3910559 - RNA, 16 nt, Human adenovirus C
cuccacgccuuugcca

SEQ ID NO: 3910560 - RNA, 23 nt, Human adenovirus C
cuccacgcuggaagccaugcuca

SEQ ID NO: 3910561 - RNA, 21 nt, Human adenovirus C
cuccacuuaaacucaggcaca

SEQ ID NO: 3910562 - RNA, 19 nt, Human adenovirus C
cuccagagcgcccuccacc

SEQ ID NO: 3910563 - RNA, 20 nt, Human adenovirus C
cuccagaggggcguggcgaa

SEQ ID NO: 3910564 - RNA, 23 nt, Human adenovirus C
cuccagauaucaacccaauaaaa

SEQ ID NO: 3910565 - RNA, 20 nt, Human adenovirus C
cuccaggcgggcaagauuau

SEQ ID NO: 3910566 - RNA, 14 nt, Human adenovirus C
cuccaugcccuucu

SEQ ID NO: 3910567 - RNA, 21 nt, Human adenovirus C
cucccaaaagacauauuuccu

SEQ ID NO: 3910568 - RNA, 17 nt, Human adenovirus C
cucccaaaauguaacca

SEQ ID NO: 3910569 - RNA, 23 nt, Human adenovirus C
cucccaaaauguaaccacuguua

SEQ ID NO: 3910570 - RNA, 16 nt, Human adenovirus C
cucccacccccacuga

SEQ ID NO: 3910571 - RNA, 13 nt, Human adenovirus C
cucccacgcagac

SEQ ID NO: 3910572 - RNA, 13 nt, Human adenovirus C
cucccgccaccag

SEQ ID NO: 3910573 - RNA, 19 nt, Human adenovirus C
cucccgguaccauauaaac

SEQ ID NO: 3910574 - RNA, 17 nt, Human adenovirus C
cucccguguagacacuu

SEQ ID NO: 3910575 - RNA, 11 nt, Human adenovirus C
cuccucaccug

SEQ ID NO: 3910576 - RNA, 18 nt, Human adenovirus C
cuccucaggggagcugag

SEQ ID NO: 3910577 - RNA, 15 nt, Human adenovirus C
cuccuccugccaggc

SEQ ID NO: 3910578 - RNA, 17 nt, Human adenovirus C
cuccugaaucuggcgcc

SEQ ID NO: 3910579 - RNA, 23 nt, Human adenovirus C
cuccugcgccguagcgccauugc

SEQ ID NO: 3910580 - RNA, 17 nt, Human adenovirus C
cuccuucagcgcgcgcu

SEQ ID NO: 3910581 - RNA, 14 nt, Human adenovirus C
cuccuuugcacucc

SEQ ID NO: 3910582 - RNA, 20 nt, Human adenovirus C
cucgacgaagugccaaaaau

SEQ ID NO: 3910583 - RNA, 17 nt, Human adenovirus C
cucgaucucuuccuccu

SEQ ID NO: 3910584 - RNA, 21 nt, Human adenovirus C
cucgcaaggccuggccagugu

SEQ ID NO: 3910585 - RNA, 21 nt, Human adenovirus C
cucgcauuccacgagccaggu

SEQ ID NO: 3910586 - RNA, 21 nt, Human adenovirus C
cucgccccccuucucccaccc

SEQ ID NO: 3910587 - RNA, 22 nt, Human adenovirus C
cucgccuucgaucucagcgcag

SEQ ID NO: 3910588 - RNA, 20 nt, Human adenovirus C
cucgcgcucaaaggcuacag

SEQ ID NO: 3910589 - RNA, 17 nt, Human adenovirus C
cucgcucccaccaugcg

SEQ ID NO: 3910590 - RNA, 19 nt, Human adenovirus C
cucgcucgacgaagugcca

SEQ ID NO: 3910591 - RNA, 11 nt, Human adenovirus C
cucgcugcugc

SEQ ID NO: 3910592 - RNA, 23 nt, Human adenovirus C
cucgcugcugcagccgcagcgcg

SEQ ID NO: 3910593 - RNA, 23 nt, Human adenovirus C
cucggcuaauauggccugcugca

SEQ ID NO: 3910594 - RNA, 16 nt, Human adenovirus C
cucggucgcauucccc

SEQ ID NO: 3910595 - RNA, 18 nt, Human adenovirus C
cucgguuagcggccugcg

SEQ ID NO: 3910596 - RNA, 19 nt, Human adenovirus C
cucguccagacgggccagg

SEQ ID NO: 3910597 - RNA, 18 nt, Human adenovirus C
cucguuacaacagcggca

SEQ ID NO: 3910598 - RNA, 21 nt, Human adenovirus C
cucuaugugggauaugcucca

SEQ ID NO: 3910599 - RNA, 13 nt, Human adenovirus C
cucugcaaccugg

SEQ ID NO: 3910600 - RNA, 18 nt, Human adenovirus C
cucugcagaccucguccu

SEQ ID NO: 3910601 - RNA, 21 nt, Human adenovirus C
cucugcgugaagacgacgggc

SEQ ID NO: 3910602 - RNA, 17 nt, Human adenovirus C
cucugguaucucagccg

SEQ ID NO: 3910603 - RNA, 14 nt, Human adenovirus C
cucuuacaccuucu

SEQ ID NO: 3910604 - RNA, 14 nt, Human adenovirus C
cucuuguccugcau

SEQ ID NO: 3910605 - RNA, 16 nt, Human adenovirus C
cugaagcagggccagg

SEQ ID NO: 3910606 - RNA, 20 nt, Human adenovirus C
cugaaucuggcgccucugcg

SEQ ID NO: 3910607 - RNA, 15 nt, Human adenovirus C
cugacaaagcccaag

SEQ ID NO: 3910608 - RNA, 22 nt, Human adenovirus C
cugacaaagcccaagaaaucca

SEQ ID NO: 3910609 - RNA, 17 nt, Human adenovirus C
cugacagaggacagcaa

SEQ ID NO: 3910610 - RNA, 13 nt, Human adenovirus C
cugacagggccca

SEQ ID NO: 3910611 - RNA, 22 nt, Human adenovirus C
cugaccaaaugcgccagaaggc

SEQ ID NO: 3910612 - RNA, 23 nt, Human adenovirus C
cugaccaaaugcgccagaaggcg

SEQ ID NO: 3910613 - RNA, 22 nt, Human adenovirus C
cugaccacuuacuggcugcagc

SEQ ID NO: 3910614 - RNA, 17 nt, Human adenovirus C
cugacgaccgcgcacaa

SEQ ID NO: 3910615 - RNA, 23 nt, Human adenovirus C
cugacgccagacgccgcaccugc

SEQ ID NO: 3910616 - RNA, 18 nt, Human adenovirus C
cugagacaccgcaaagug

SEQ ID NO: 3910617 - RNA, 14 nt, Human adenovirus C
cugagacgaaggcu

SEQ ID NO: 3910618 - RNA, 22 nt, Human adenovirus C
cugagcaacuuguugggcaucc

SEQ ID NO: 3910619 - RNA, 19 nt, Human adenovirus C
cugaggcccgaucacuugg

SEQ ID NO: 3910620 - RNA, 14 nt, Human adenovirus C
cugaguauuccaag

SEQ ID NO: 3910621 - RNA, 16 nt, Human adenovirus C
cugaguuggcaccccu

SEQ ID NO: 3910622 - RNA, 14 nt, Human adenovirus C
cugaucucacuuaa

SEQ ID NO: 3910623 - RNA, 19 nt, Human adenovirus C
cugaugguacccaagcgcc

SEQ ID NO: 3910624 - RNA, 19 nt, Human adenovirus C
cugcaaacaucagcccccc

SEQ ID NO: 3910625 - RNA, 19 nt, Human adenovirus C
cugcaccugcgugagggua

SEQ ID NO: 3910626 - RNA, 15 nt, Human adenovirus C
cugcacgucuccuga

SEQ ID NO: 3910627 - RNA, 15 nt, Human adenovirus C
cugcagaccucgucc

SEQ ID NO: 3910628 - RNA, 10 nt, Human adenovirus C
cugcagagca

SEQ ID NO: 3910629 - RNA, 14 nt, Human adenovirus C
cugcagagccagcc

SEQ ID NO: 3910630 - RNA, 18 nt, Human adenovirus C
cugcagagcucucuggga

SEQ ID NO: 3910631 - RNA, 13 nt, Human adenovirus C
cugcagccagggg

SEQ ID NO: 3910632 - RNA, 21 nt, Human adenovirus C
cugcagccuccgccgccgcuu

SEQ ID NO: 3910633 - RNA, 14 nt, Human adenovirus C
cugcagcgcugcca

SEQ ID NO: 3910634 - RNA, 15 nt, Human adenovirus C
cugcagcgcugccaa

SEQ ID NO: 3910635 - RNA, 14 nt, Human adenovirus C
cugcagcugccgcc

SEQ ID NO: 3910636 - RNA, 21 nt, Human adenovirus C
cugcagcugccgccgccgcca

SEQ ID NO: 3910637 - RNA, 12 nt, Human adenovirus C
gcgagggccugg

SEQ ID NO: 3910638 - RNA, 18 nt, Human adenovirus C
gcgagguauucagcucaa

SEQ ID NO: 3910639 - RNA, 18 nt, Human adenovirus C
gcgaggugugggugagcg

SEQ ID NO: 3910640 - RNA, 17 nt, Human adenovirus C
gcgagugguggcucccg

SEQ ID NO: 3910641 - RNA, 22 nt, Human adenovirus C
gcgauccuaacucugcagaccu

SEQ ID NO: 3910642 - RNA, 14 nt, Human adenovirus C
gcgaugagcagcug

SEQ ID NO: 3910643 - RNA, 16 nt, Human adenovirus C
gcgcaacgcaccgcca

SEQ ID NO: 3910644 - RNA, 16 nt, Human adenovirus C
gcgcacaaacgcggcc

SEQ ID NO: 3910645 - RNA, 19 nt, Human adenovirus C
gcgcacaaacgcggccgca

SEQ ID NO: 3910646 - RNA, 17 nt, Human adenovirus C
gcgcaccaccggcggcg

SEQ ID NO: 3910647 - RNA, 21 nt, Human adenovirus C
gcgcaccaccggcggcggcgc

SEQ ID NO: 3910648 - RNA, 18 nt, Human adenovirus C
gcgcagcagcagggcaac

SEQ ID NO: 3910649 - RNA, 16 nt, Human adenovirus C
gcgcagcggugcagcc

SEQ ID NO: 3910650 - RNA, 13 nt, Human adenovirus C
gcgcaggguggcu

SEQ ID NO: 3910651 - RNA, 22 nt, Human adenovirus C
gcgcauccacaaggccgugagc

SEQ ID NO: 3910652 - RNA, 19 nt, Human adenovirus C
gcgcaucccauucuccagu

SEQ ID NO: 3910653 - RNA, 20 nt, Human adenovirus C
gcgccacaauguggccuccg

SEQ ID NO: 3910654 - RNA, 20 nt, Human adenovirus C
gcgcccacaccuacagccug

SEQ ID NO: 3910655 - RNA, 20 nt, Human adenovirus C
gcgcccauggcuaccggagu

SEQ ID NO: 3910656 - RNA, 13 nt, Human adenovirus C
gcgcccgcccacc

SEQ ID NO: 3910657 - RNA, 13 nt, Human adenovirus C
gcgcccuggaggc

SEQ ID NO: 3910658 - RNA, 20 nt, Human adenovirus C
gcgcccuggaggcagcuggg

SEQ ID NO: 3910659 - RNA, 21 nt, Human adenovirus C
gcgcccuucacggacaguggc

SEQ ID NO: 3910660 - RNA, 17 nt, Human adenovirus C
gcgccgcacgaggggca

SEQ ID NO: 3910661 - RNA, 20 nt, Human adenovirus C
gcgccguagcgccauugcuu

SEQ ID NO: 3910662 - RNA, 16 nt, Human adenovirus C
gcgccgugccgccagc

SEQ ID NO: 3910663 - RNA, 12 nt, Human adenovirus C
gcgccuaccacc

SEQ ID NO: 3910664 - RNA, 21 nt, Human adenovirus C
gcgccugauuucugccagcgc

SEQ ID NO: 3910665 - RNA, 15 nt, Human adenovirus C
gcgccuucagcuggg

SEQ ID NO: 3910666 - RNA, 23 nt, Human adenovirus C
gcgcgcuggccagggugcgcuug

SEQ ID NO: 3910667 - RNA, 23 nt, Human adenovirus C
gcgcgucccugcgccgugccgcc

SEQ ID NO: 3910668 - RNA, 14 nt, Human adenovirus C
gcgcgucggccagg

SEQ ID NO: 3910669 - RNA, 19 nt, Human adenovirus C
gcgcgugcccgugcgcacc

SEQ ID NO: 3910670 - RNA, 17 nt, Human adenovirus C
gcgcucaaaaacaugcu

SEQ ID NO: 3910671 - RNA, 18 nt, Human adenovirus C
gcgcuccuuggccgcgau

SEQ ID NO: 3910672 - RNA, 15 nt, Human adenovirus C
gcgcugaccugcgcu

SEQ ID NO: 3910673 - RNA, 20 nt, Human adenovirus C
gcgcugaccugcgcugggcc

SEQ ID NO: 3910674 - RNA, 13 nt, Human adenovirus C
gcgcugcuccucu

SEQ ID NO: 3910675 - RNA, 19 nt, Human adenovirus C
gcgcuggccgcucuucauu

SEQ ID NO: 3910676 - RNA, 15 nt, Human adenovirus C
gcgcuggggcaggag

SEQ ID NO: 3910677 - RNA, 19 nt, Human adenovirus C
gcgcuguaccugccagaca

SEQ ID NO: 3910678 - RNA, 15 nt, Human adenovirus C
gcggaggagaagcgc

SEQ ID NO: 3910679 - RNA, 15 nt, Human adenovirus C
gcggcaccagcgcau

SEQ ID NO: 3910680 - RNA, 17 nt, Human adenovirus C
gcggcagacaugcaggg

SEQ ID NO: 3910681 - RNA, 16 nt, Human adenovirus C
gcggcagcaacagcag

SEQ ID NO: 3910682 - RNA, 12 nt, Human adenovirus C
gcggcaggagca

SEQ ID NO: 3910683 - RNA, 14 nt, Human adenovirus C
gcggcaggagcaga

SEQ ID NO: 3910684 - RNA, 13 nt, Human adenovirus C
gcggccaugcggg

SEQ ID NO: 3910685 - RNA, 17 nt, Human adenovirus C
gcggccgcacugggcgc

SEQ ID NO: 3910686 - RNA, 24 nt, Human adenovirus C
gcggccguucucgcgggggcgcag

SEQ ID NO: 3910687 - RNA, 18 nt, Human adenovirus C
gcggccuuccggagcgag

SEQ ID NO: 3910688 - RNA, 19 nt, Human adenovirus C
gcggcgccaguggcggcgg

SEQ ID NO: 3910689 - RNA, 14 nt, Human adenovirus C
gcggcgcgcaacga

SEQ ID NO: 3910690 - RNA, 15 nt, Human adenovirus C
gcggcgcggaagaga

SEQ ID NO: 3910691 - RNA, 14 nt, Human adenovirus C
gcggcgcugcagag

SEQ ID NO: 3910692 - RNA, 16 nt, Human adenovirus C
gcggcgcugcagagcc

SEQ ID NO: 3910693 - RNA, 13 nt, Human adenovirus C
gcggcggcggcug

SEQ ID NO: 3910694 - RNA, 15 nt, Human adenovirus C
gcggcggucggagcu

SEQ ID NO: 3910695 - RNA, 18 nt, Human adenovirus C
gcggcggugggggagggg

SEQ ID NO: 3910696 - RNA, 23 nt, Human adenovirus C
gcggcgucgaugacuugcaagag

SEQ ID NO: 3910697 - RNA, 13 nt, Human adenovirus C
gcggcgugcugga

SEQ ID NO: 3910698 - RNA, 21 nt, Human adenovirus C
gcggcugacgcggcggcagau

SEQ ID NO: 3910699 - RNA, 12 nt, Human adenovirus C
gcggcugcuguu

SEQ ID NO: 3910700 - RNA, 13 nt, Human adenovirus C
gcggcugcuguug

SEQ ID NO: 3910701 - RNA, 17 nt, Human adenovirus C
gcggcuggcgguagagg

SEQ ID NO: 3910702 - RNA, 23 nt, Human adenovirus C
gcgggcacucuuccguggucugg

SEQ ID NO: 3910703 - RNA, 18 nt, Human adenovirus C
gcgggcccuugcuuccca

SEQ ID NO: 3910704 - RNA, 14 nt, Human adenovirus C
gcggggugcccuug

SEQ ID NO: 3910705 - RNA, 22 nt, Human adenovirus C
gcggguauugucacugugcccc

SEQ ID NO: 3910706 - RNA, 17 nt, Human adenovirus C
gcgguauccugccccuc

SEQ ID NO: 3910707 - RNA, 17 nt, Human adenovirus C
gcggugcgggcggcgcu

SEQ ID NO: 3910708 - RNA, 17 nt, Human adenovirus C
gcgguucacccuggcug

SEQ ID NO: 3910709 - RNA, 19 nt, Human adenovirus C
gcgguucacccuggcugug

SEQ ID NO: 3910710 - RNA, 21 nt, Human adenovirus C
gcguagcacgucgccaccgcc

SEQ ID NO: 3910711 - RNA, 22 nt, Human adenovirus C
gcgucccugcgccgugccgcca

SEQ ID NO: 3910712 - RNA, 21 nt, Human adenovirus C
gcguccuggauuugggaggga

SEQ ID NO: 3910713 - RNA, 18 nt, Human adenovirus C
gcgugucccgggacacau

SEQ ID NO: 3910714 - RNA, 19 nt, Human adenovirus C
gcguugcaagagcgcagcg

SEQ ID NO: 3910715 - RNA, 17 nt, Human adenovirus C
gcguuucagccccccgg

SEQ ID NO: 3910716 - RNA, 20 nt, Human adenovirus C
gcuaauggcaauggcucagg

SEQ ID NO: 3910717 - RNA, 17 nt, Human adenovirus C
gcuacaaauaggaucag

SEQ ID NO: 3910718 - RNA, 19 nt, Human adenovirus C
gcuacaacguagcucagug

SEQ ID NO: 3910719 - RNA, 23 nt, Human adenovirus C
gcuacaacguagcucagugcaac

SEQ ID NO: 3910720 - RNA, 17 nt, Human adenovirus C
gcuacaagcuacccacc

SEQ ID NO: 3910721 - RNA, 18 nt, Human adenovirus C
gcuaccggagugcugggc

SEQ ID NO: 3910722 - RNA, 20 nt, Human adenovirus C
gcuaccggagugcugggcca

SEQ ID NO: 3910723 - RNA, 22 nt, Human adenovirus C
gcuaccggagugcugggccagc

SEQ ID NO: 3910724 - RNA, 23 nt, Human adenovirus C
gcuaccucuccgcguaggcgcuc

SEQ ID NO: 3910725 - RNA, 21 nt, Human adenovirus C
gcuaccuucugcagcuagcca

SEQ ID NO: 3910726 - RNA, 19 nt, Human adenovirus C
gcuagugaaaagcguggcu

SEQ ID NO: 3910727 - RNA, 16 nt, Human adenovirus C
gcuauaaaugcaggaa

SEQ ID NO: 3910728 - RNA, 23 nt, Human adenovirus C
gcuaugcgccacuggcagggaca

SEQ ID NO: 3910729 - RNA, 14 nt, Human adenovirus C
gcuaugugcagcag

SEQ ID NO: 3910730 - RNA, 14 nt, Human adenovirus C
gcucagggcgaacg

SEQ ID NO: 3910731 - RNA, 22 nt, Human adenovirus C
gcuccacuuaaacucaggcaca

SEQ ID NO: 3910732 - RNA, 12 nt, Human adenovirus C
gcucccaagggc

SEQ ID NO: 3910733 - RNA, 14 nt, Human adenovirus C
gcucccaccacugu

SEQ ID NO: 3910734 - RNA, 15 nt, Human adenovirus C
gcucccaccaugcgc

SEQ ID NO: 3910735 - RNA, 17 nt, Human adenovirus C
gcucccucacccgcagc

SEQ ID NO: 3910736 - RNA, 21 nt, Human adenovirus C
gcucccucacccgcagcugcc

SEQ ID NO: 3910737 - RNA, 17 nt, Human adenovirus C
gcuccguccugcaggaa

SEQ ID NO: 3910738 - RNA, 16 nt, Human adenovirus C
gcuccuaacuccugug

SEQ ID NO: 3910739 - RNA, 20 nt, Human adenovirus C
gcuccucaggcgccgccggc

SEQ ID NO: 3910740 - RNA, 12 nt, Human adenovirus C
gcuccucucuug

SEQ ID NO: 3910741 - RNA, 21 nt, Human adenovirus C
gcuccuuugucuggagaaaca

SEQ ID NO: 3910742 - RNA, 19 nt, Human adenovirus C
gcuccuuuuggcuuccuuc

SEQ ID NO: 3910743 - RNA, 21 nt, Human adenovirus C
gcuccuuuuggcuuccuucca

SEQ ID NO: 3910744 - RNA, 13 nt, Human adenovirus C
gcucgaggggagu

SEQ ID NO: 3910745 - RNA, 15 nt, Human adenovirus C
gcucgaucucuuccu

SEQ ID NO: 3910746 - RNA, 16 nt, Human adenovirus C
gcucgaucucuuccuc

SEQ ID NO: 3910747 - RNA, 21 nt, Human adenovirus C
gcucgaucucuuccuccugga

SEQ ID NO: 3910748 - RNA, 22 nt, Human adenovirus C
gcucggugaaguuuucacucca

SEQ ID NO: 3910749 - RNA, 15 nt, Human adenovirus C
gcucuacagcuuccu

SEQ ID NO: 3910750 - RNA, 19 nt, Human adenovirus C
gcucuagaccgugcaaaag

SEQ ID NO: 3910751 - RNA, 18 nt, Human adenovirus C
gcucuagcgaugaagaua

SEQ ID NO: 3910752 - RNA, 13 nt, Human adenovirus C
gcucugcaaccug

SEQ ID NO: 3910753 - RNA, 22 nt, Human adenovirus C
gcucuggccggugaggcgugcg

SEQ ID NO: 3910754 - RNA, 17 nt, Human adenovirus C
gcugaggcccgaucacu

SEQ ID NO: 3910755 - RNA, 13 nt, Human adenovirus C
cucgaccacugcc

SEQ ID NO: 3910756 - RNA, 15 nt, Human adenovirus C
cucgagaucaggcua

SEQ ID NO: 3910757 - RNA, 16 nt, Human adenovirus C
cucgagaucaggcuac

SEQ ID NO: 3910758 - RNA, 19 nt, Human adenovirus C
cucgcauuccacgagccag

SEQ ID NO: 3910759 - RNA, 20 nt, Human adenovirus C
cucgcauuccacgagccagg

SEQ ID NO: 3910760 - RNA, 19 nt, Human adenovirus C
cucgccugcgccauaguca

SEQ ID NO: 3910761 - RNA, 15 nt, Human adenovirus C
cucgcgccuguugcu

SEQ ID NO: 3910762 - RNA, 17 nt, Human adenovirus C
cucgcguccaggccagc

SEQ ID NO: 3910763 - RNA, 12 nt, Human adenovirus C
cucgcuguggag

SEQ ID NO: 3910764 - RNA, 21 nt, Human adenovirus C
cucgcuuacuaaggacaaaca

SEQ ID NO: 3910765 - RNA, 17 nt, Human adenovirus C
cucggaccacucugaga

SEQ ID NO: 3910766 - RNA, 19 nt, Human adenovirus C
cucggaguaccugagcccc

SEQ ID NO: 3910767 - RNA, 12 nt, Human adenovirus C
cucgucacaucc

SEQ ID NO: 3910768 - RNA, 17 nt, Human adenovirus C
cucguccagacgggcca

SEQ ID NO: 3910769 - RNA, 20 nt, Human adenovirus C
cucguccagacgggccaggg

SEQ ID NO: 3910770 - RNA, 16 nt, Human adenovirus C
cucgucgggcaccagg

SEQ ID NO: 3910771 - RNA, 16 nt, Human adenovirus C
cucguggcgcgggcac

SEQ ID NO: 3910772 - RNA, 15 nt, Human adenovirus C
cucuagcgaugaaga

SEQ ID NO: 3910773 - RNA, 23 nt, Human adenovirus C
cucuaugugggauaugcuccagg

SEQ ID NO: 3910774 - RNA, 16 nt, Human adenovirus C
cucucuucagcaaaua

SEQ ID NO: 3910775 - RNA, 19 nt, Human adenovirus C
cucuggggauggcgggcgc

SEQ ID NO: 3910776 - RNA, 22 nt, Human adenovirus C
cucuuauaaaaugcaccacaga

SEQ ID NO: 3910777 - RNA, 19 nt, Human adenovirus C
cucuuccuuuuccucuugc

SEQ ID NO: 3910778 - RNA, 22 nt, Human adenovirus C
cugaaagagguaguugagggug

SEQ ID NO: 3910779 - RNA, 18 nt, Human adenovirus C
cugaacauaaucgugcag

SEQ ID NO: 3910780 - RNA, 14 nt, Human adenovirus C
cugaagcagggcca

SEQ ID NO: 3910781 - RNA, 23 nt, Human adenovirus C
cugacccggagaugcagcgcaag

SEQ ID NO: 3910782 - RNA, 17 nt, Human adenovirus C
cugaccugcgcugggcc

SEQ ID NO: 3910783 - RNA, 19 nt, Human adenovirus C
cugacgcguuccggcagca

SEQ ID NO: 3910784 - RNA, 16 nt, Human adenovirus C
cugagacgaaggcucg

SEQ ID NO: 3910785 - RNA, 15 nt, Human adenovirus C
cugagacgcauuuua

SEQ ID NO: 3910786 - RNA, 16 nt, Human adenovirus C
cugagcaggggggcca

SEQ ID NO: 3910787 - RNA, 13 nt, Human adenovirus C
cugagccccgggc

SEQ ID NO: 3910788 - RNA, 22 nt, Human adenovirus C
cugagcccguguucugacaggg

SEQ ID NO: 3910789 - RNA, 22 nt, Human adenovirus C
cugaggacuaccacgcccacga

SEQ ID NO: 3910790 - RNA, 16 nt, Human adenovirus C
cugaggcuacagagga

SEQ ID NO: 3910791 - RNA, 17 nt, Human adenovirus C
cugaggcuacagaggag

SEQ ID NO: 3910792 - RNA, 22 nt, Human adenovirus C
cugaguauaauaaauacagaaa

SEQ ID NO: 3910793 - RNA, 15 nt, Human adenovirus C
cugaucuucucagaa

SEQ ID NO: 3910794 - RNA, 14 nt, Human adenovirus C
cugauugccagggg

SEQ ID NO: 3910795 - RNA, 16 nt, Human adenovirus C
cugauugccaggggca

SEQ ID NO: 3910796 - RNA, 21 nt, Human adenovirus C
cugauuggccggacaggccgc

SEQ ID NO: 3910797 - RNA, 18 nt, Human adenovirus C
cugcaaagggcccuggcu

SEQ ID NO: 3910798 - RNA, 14 nt, Human adenovirus C
cugcaacaagaaaa

SEQ ID NO: 3910799 - RNA, 12 nt, Human adenovirus C
cugcaacccgcg

SEQ ID NO: 3910800 - RNA, 16 nt, Human adenovirus C
cugcaagaugaggguu

SEQ ID NO: 3910801 - RNA, 22 nt, Human adenovirus C
cugcaagaugaggguuggaagc

SEQ ID NO: 3910802 - RNA, 20 nt, Human adenovirus C
cugcacgcaaccgcgcccag

SEQ ID NO: 3910803 - RNA, 16 nt, Human adenovirus C
cugcagaauuaaggag

SEQ ID NO: 3910804 - RNA, 23 nt, Human adenovirus C
cugcagaccguaaaccugagcca

SEQ ID NO: 3910805 - RNA, 14 nt, Human adenovirus C
cugcagccagggga

SEQ ID NO: 3910806 - RNA, 20 nt, Human adenovirus C
cugcagggaagaccucgcac

SEQ ID NO: 3910807 - RNA, 14 nt, Human adenovirus C
cugccacagagggc

SEQ ID NO: 3910808 - RNA, 18 nt, Human adenovirus C
cugccaccucccucccaa

SEQ ID NO: 3910809 - RNA, 20 nt, Human adenovirus C
cugccaugcgcgggcggcaa

SEQ ID NO: 3910810 - RNA, 18 nt, Human adenovirus C
cugcccacgcuugcaccg

SEQ ID NO: 3910811 - RNA, 13 nt, Human adenovirus C
cugcccgccaccu

SEQ ID NO: 3910812 - RNA, 17 nt, Human adenovirus C
cugcccgccaccugcug

SEQ ID NO: 3910813 - RNA, 21 nt, Human adenovirus C
cugcccguuuucgcucgucac

SEQ ID NO: 3910814 - RNA, 13 nt, Human adenovirus C
cugccgccgccac

SEQ ID NO: 3910815 - RNA, 20 nt, Human adenovirus C
cugccgccgccgccacccac

SEQ ID NO: 3910816 - RNA, 20 nt, Human adenovirus C
cugccggucuucgcccugcg

SEQ ID NO: 3910817 - RNA, 15 nt, Human adenovirus C
cugcgacgcguugca

SEQ ID NO: 3910818 - RNA, 17 nt, Human adenovirus C
cugcgagagcucggugu

SEQ ID NO: 3910819 - RNA, 13 nt, Human adenovirus C
cugcgaggacagg

SEQ ID NO: 3910820 - RNA, 22 nt, Human adenovirus C
cugcgaggacagggccucucag

SEQ ID NO: 3910821 - RNA, 12 nt, Human adenovirus C
cugcgagggcca

SEQ ID NO: 3910822 - RNA, 15 nt, Human adenovirus C
cugcgcgaggaggac

SEQ ID NO: 3910823 - RNA, 16 nt, Human adenovirus C
cugcgcucccucaccc

SEQ ID NO: 3910824 - RNA, 18 nt, Human adenovirus C
cugcggcuaauggugacu

SEQ ID NO: 3910825 - RNA, 16 nt, Human adenovirus C
cugcggcucggagcag

SEQ ID NO: 3910826 - RNA, 21 nt, Human adenovirus C
cugcgucauuacccagggcca

SEQ ID NO: 3910827 - RNA, 21 nt, Human adenovirus C
cugcgugaagacgacgggccc

SEQ ID NO: 3910828 - RNA, 21 nt, Human adenovirus C
cugcugccaugcgcgggcggc

SEQ ID NO: 3910829 - RNA, 19 nt, Human adenovirus C
cugcuuaaaagccaccuga

SEQ ID NO: 3910830 - RNA, 21 nt, Human adenovirus C
cugcuuaaaagccaccugagc

SEQ ID NO: 3910831 - RNA, 15 nt, Human adenovirus C
cugcuugagcaggcc

SEQ ID NO: 3910832 - RNA, 20 nt, Human adenovirus C
cuggaacagagcucuaacag

SEQ ID NO: 3910833 - RNA, 16 nt, Human adenovirus C
cuggaacagcagcaca

SEQ ID NO: 3910834 - RNA, 17 nt, Human adenovirus C
cuggaacagcagcacag

SEQ ID NO: 3910835 - RNA, 17 nt, Human adenovirus C
cuggaagccaugcucag

SEQ ID NO: 3910836 - RNA, 23 nt, Human adenovirus C
cuggaaugccauagaugccauga

SEQ ID NO: 3910837 - RNA, 20 nt, Human adenovirus C
cuggaccggcugguggggga

SEQ ID NO: 3910838 - RNA, 17 nt, Human adenovirus C
cuggagcucccgcggcg

SEQ ID NO: 3910839 - RNA, 17 nt, Human adenovirus C
cuggaggcagcuggggc

SEQ ID NO: 3910840 - RNA, 21 nt, Human adenovirus C
cuggaugugaccgaggagcug

SEQ ID NO: 3910841 - RNA, 18 nt, Human adenovirus C
cuggauuuucuggccaug

SEQ ID NO: 3910842 - RNA, 13 nt, Human adenovirus C
cuggcagggacac

SEQ ID NO: 3910843 - RNA, 12 nt, Human adenovirus C
cuggcagugaca

SEQ ID NO: 3910844 - RNA, 18 nt, Human adenovirus C
cuggccccgcgacacggc

SEQ ID NO: 3910845 - RNA, 22 nt, Human adenovirus C
cuggccgcggguauugucacug

SEQ ID NO: 3910846 - RNA, 15 nt, Human adenovirus C
cuggccgcucuucau

SEQ ID NO: 3910847 - RNA, 23 nt, Human adenovirus C
cuggccugcacccgcgcugaguu

SEQ ID NO: 3910848 - RNA, 22 nt, Human adenovirus C
cuggcgaacgcgacgacgcggc

SEQ ID NO: 3910849 - RNA, 20 nt, Human adenovirus C
cuggcggacauuaucuuccc

SEQ ID NO: 3910850 - RNA, 13 nt, Human adenovirus C
cuggcggcggugg

SEQ ID NO: 3910851 - RNA, 20 nt, Human adenovirus C
cuggcuaccgcccccugguu

SEQ ID NO: 3910852 - RNA, 16 nt, Human adenovirus C
cuggcugcagccaggg

SEQ ID NO: 3910853 - RNA, 12 nt, Human adenovirus C
cugggacagccu

SEQ ID NO: 3910854 - RNA, 17 nt, Human adenovirus C
cugggacagucaggcag

SEQ ID NO: 3910855 - RNA, 16 nt, Human adenovirus C
cugggggcaacaucca

SEQ ID NO: 3910856 - RNA, 14 nt, Human adenovirus C
cugggggcguacac

SEQ ID NO: 3910857 - RNA, 23 nt, Human adenovirus C
cuggggugaugcaguagaaggua

SEQ ID NO: 3910858 - RNA, 13 nt, Human adenovirus C
cuggguucccccu

SEQ ID NO: 3910859 - RNA, 21 nt, Human adenovirus C
cugguaggcgcagcaucccuu

SEQ ID NO: 3910860 - RNA, 17 nt, Human adenovirus C
cuggugcaguuugcccg

SEQ ID NO: 3910861 - RNA, 14 nt, Human adenovirus C
cuggugcugccaac

SEQ ID NO: 3910862 - RNA, 15 nt, Human adenovirus C
cugguuuccaugagc

SEQ ID NO: 3910863 - RNA, 19 nt, Human adenovirus C
cuguccacgaucaccucug

SEQ ID NO: 3910864 - RNA, 18 nt, Human adenovirus C
cugucccuuuuuuuucca

SEQ ID NO: 3910865 - RNA, 21 nt, Human adenovirus C
cugucccuuuuuuuuccacag

SEQ ID NO: 3910866 - RNA, 22 nt, Human adenovirus C
cugucgccauccugugaacgcc

SEQ ID NO: 3910867 - RNA, 19 nt, Human adenovirus C
cugugccuuuuacugcugc

SEQ ID NO: 3910868 - RNA, 16 nt, Human adenovirus C
cugugcugccagggcc

SEQ ID NO: 3910869 - RNA, 19 nt, Human adenovirus C
cuguggugagcuguuugau

SEQ ID NO: 3910870 - RNA, 21 nt, Human adenovirus C
cuguuuauucuuauacuagca

SEQ ID NO: 3910871 - RNA, 18 nt, Human adenovirus C
ccagcgcacuacugcccg

SEQ ID NO: 3910872 - RNA, 10 nt, Human adenovirus C
ccagcggcgg

SEQ ID NO: 3910873 - RNA, 15 nt, Human adenovirus C
ccagcucggcgguga

SEQ ID NO: 3910874 - RNA, 14 nt, Human adenovirus C
ccagcugcuacaac

SEQ ID NO: 3910875 - RNA, 16 nt, Human adenovirus C
ccagcuguugggguga

SEQ ID NO: 3910876 - RNA, 13 nt, Human adenovirus C
ccagcuuauucag

SEQ ID NO: 3910877 - RNA, 23 nt, Human adenovirus C
ccaggaaguacggcaccgccagc

SEQ ID NO: 3910878 - RNA, 18 nt, Human adenovirus C
ccaggacgacgcagaggc

SEQ ID NO: 3910879 - RNA, 12 nt, Human adenovirus C
ccaggccagcac

SEQ ID NO: 3910880 - RNA, 18 nt, Human adenovirus C
ccaggcgacgagcggccg

SEQ ID NO: 3910881 - RNA, 13 nt, Human adenovirus C
ccaggcgcggcgg

SEQ ID NO: 3910882 - RNA, 23 nt, Human adenovirus C
ccaggcgcggcggcugcugcgcu

SEQ ID NO: 3910883 - RNA, 19 nt, Human adenovirus C
ccaggcuccuuugucugga

SEQ ID NO: 3910884 - RNA, 22 nt, Human adenovirus C
ccaggcuuugaguugcacucgc

SEQ ID NO: 3910885 - RNA, 22 nt, Human adenovirus C
ccagggugcgcuugaggcuggu

SEQ ID NO: 3910886 - RNA, 13 nt, Human adenovirus C
ccagguacagccc

SEQ ID NO: 3910887 - RNA, 19 nt, Human adenovirus C
ccagguacagcccacccug

SEQ ID NO: 3910888 - RNA, 19 nt, Human adenovirus C
ccagguccuccgcguugcu

SEQ ID NO: 3910889 - RNA, 14 nt, Human adenovirus C
ccaggugcagaccc

SEQ ID NO: 3910890 - RNA, 16 nt, Human adenovirus C
ccaguagacaaggccu

SEQ ID NO: 3910891 - RNA, 15 nt, Human adenovirus C
ccaguggcaacuggc

SEQ ID NO: 3910892 - RNA, 22 nt, Human adenovirus C
ccauaagggccuccccuucuuc

SEQ ID NO: 3910893 - RNA, 13 nt, Human adenovirus C
ccauagagcagcu

SEQ ID NO: 3910894 - RNA, 14 nt, Human adenovirus C
ccauccgcggcagc

SEQ ID NO: 3910895 - RNA, 21 nt, Human adenovirus C
ccauccuuauaucgcccagca

SEQ ID NO: 3910896 - RNA, 17 nt, Human adenovirus C
ccaucgcgcaacugggc

SEQ ID NO: 3910897 - RNA, 19 nt, Human adenovirus C
ccaucgcgcaacugggcag

SEQ ID NO: 3910898 - RNA, 14 nt, Human adenovirus C
ccaugcgcgaggga

SEQ ID NO: 3910899 - RNA, 19 nt, Human adenovirus C
ccauggcccacaacacggc

SEQ ID NO: 3910900 - RNA, 17 nt, Human adenovirus C
ccauuaaaaaccuccuc

SEQ ID NO: 3910901 - RNA, 19 nt, Human adenovirus C
ccauuaaguaccgugaaug

SEQ ID NO: 3910902 - RNA, 21 nt, Human adenovirus C
ccauuccugaaucagcguaaa

SEQ ID NO: 3910903 - RNA, 19 nt, Human adenovirus C
ccauucuccaguaacuuua

SEQ ID NO: 3910904 - RNA, 17 nt, Human adenovirus C
ccauuucaaucacgugc

SEQ ID NO: 3910905 - RNA, 21 nt, Human adenovirus C
ccauuuguagcgccacaucuu

SEQ ID NO: 3910906 - RNA, 16 nt, Human adenovirus C
cccaaaaagaagcugc

SEQ ID NO: 3910907 - RNA, 22 nt, Human adenovirus C
cccaaccguagaugggacacca

SEQ ID NO: 3910908 - RNA, 20 nt, Human adenovirus C
cccaacucggccgccugugg

SEQ ID NO: 3910909 - RNA, 23 nt, Human adenovirus C
cccaccauuuguagcgccacauc

SEQ ID NO: 3910910 - RNA, 24 nt, Human adenovirus C
cccacgauguaaaguuccaagaag

SEQ ID NO: 3910911 - RNA, 14 nt, Human adenovirus C
cccacucuguaugc

SEQ ID NO: 3910912 - RNA, 21 nt, Human adenovirus C
cccagcaauaacacaggcugg

SEQ ID NO: 3910913 - RNA, 17 nt, Human adenovirus C
cccagcgauagcaguuc

SEQ ID NO: 3910914 - RNA, 16 nt, Human adenovirus C
ccggcggcagcggcag

SEQ ID NO: 3910915 - RNA, 19 nt, Human adenovirus C
ccggcucgcuccacggugg

SEQ ID NO: 3910916 - RNA, 16 nt, Human adenovirus C
ccgggacugggcgugc

SEQ ID NO: 3910917 - RNA, 23 nt, Human adenovirus C
ccgggacugggcgugcagaccgu

SEQ ID NO: 3910918 - RNA, 16 nt, Human adenovirus C
ccgggagagggggcag

SEQ ID NO: 3910919 - RNA, 12 nt, Human adenovirus C
ccgggcagcagg

SEQ ID NO: 3910920 - RNA, 21 nt, Human adenovirus C
ccggggcgcgcugcggcugcu

SEQ ID NO: 3910921 - RNA, 21 nt, Human adenovirus C
ccgggucagggcgcgggcuag

SEQ ID NO: 3910922 - RNA, 15 nt, Human adenovirus C
ccggugcugcggcag

SEQ ID NO: 3910923 - RNA, 18 nt, Human adenovirus C
ccgugacacugcagcagg

SEQ ID NO: 3910924 - RNA, 20 nt, Human adenovirus C
ccgugcugaaacgcagcauc

SEQ ID NO: 3910925 - RNA, 16 nt, Human adenovirus C
ccguggcgggcggcag

SEQ ID NO: 3910926 - RNA, 19 nt, Human adenovirus C
ccguguaccugcgcacgcc

SEQ ID NO: 3910927 - RNA, 20 nt, Human adenovirus C
ccgugugcaccagccgcacc

SEQ ID NO: 3910928 - RNA, 22 nt, Human adenovirus C
ccgugugcaccagccgcaccgc

SEQ ID NO: 3910929 - RNA, 12 nt, Human adenovirus C
ccguucccagca

SEQ ID NO: 3910930 - RNA, 21 nt, Human adenovirus C
ccguucgcacuggggcggcga

SEQ ID NO: 3910931 - RNA, 14 nt, Human adenovirus C
ccguugaacaaaac

SEQ ID NO: 3910932 - RNA, 19 nt, Human adenovirus C
ccguugauguuguggccca

SEQ ID NO: 3910933 - RNA, 13 nt, Human adenovirus C
ccuaacccuggau

SEQ ID NO: 3910934 - RNA, 13 nt, Human adenovirus C
ccuacaccagugu

SEQ ID NO: 3910935 - RNA, 16 nt, Human adenovirus C
ccuaccggggggagaa

SEQ ID NO: 3910936 - RNA, 16 nt, Human adenovirus C
ccuagccgcgcguccc

SEQ ID NO: 3910937 - RNA, 12 nt, Human adenovirus C
ccuaucagcagc

SEQ ID NO: 3910938 - RNA, 15 nt, Human adenovirus C
ccuauccugccgugc

SEQ ID NO: 3910939 - RNA, 15 nt, Human adenovirus C
ccucacucucuuccg

SEQ ID NO: 3910940 - RNA, 20 nt, Human adenovirus C
ccucagcgaugauucgcacc

SEQ ID NO: 3910941 - RNA, 13 nt, Human adenovirus C
ccucagcgccucc

SEQ ID NO: 3910942 - RNA, 21 nt, Human adenovirus C
ccucagcgccucccaaaagac

SEQ ID NO: 3910943 - RNA, 19 nt, Human adenovirus C
ccucaggcgccgccggcac

SEQ ID NO: 3910944 - RNA, 15 nt, Human adenovirus C
ccucaggggagcuga

SEQ ID NO: 3910945 - RNA, 16 nt, Human adenovirus C
ccucaucggcugaagc

SEQ ID NO: 3910946 - RNA, 15 nt, Human adenovirus C
ccucccuugccgugc

SEQ ID NO: 3910947 - RNA, 12 nt, Human adenovirus C
ccuccgcaccca

SEQ ID NO: 3910948 - RNA, 19 nt, Human adenovirus C
cugccaaaaagguugaguu

SEQ ID NO: 3910949 - RNA, 12 nt, Human adenovirus C
augaacugcucg

SEQ ID NO: 3910950 - RNA, 16 nt, Human adenovirus C
augaagaucuggaagg

SEQ ID NO: 3910951 - RNA, 17 nt, Human adenovirus C
augaauggaacuucagg

SEQ ID NO: 3910952 - RNA, 17 nt, Human adenovirus C
augacaaacuuacccug

SEQ ID NO: 3910953 - RNA, 21 nt, Human adenovirus C
augacaacaucgcgcagaugg

SEQ ID NO: 3910954 - RNA, 22 nt, Human adenovirus C
augacaccgaacagggcgggga

SEQ ID NO: 3910955 - RNA, 15 nt, Human adenovirus C
augaccaccugcgcg

SEQ ID NO: 3910956 - RNA, 14 nt, Human adenovirus C
augaccaugaagau

SEQ ID NO: 3910957 - RNA, 22 nt, Human adenovirus C
augacugcaaauuuacuuuggu

SEQ ID NO: 3910958 - RNA, 12 nt, Human adenovirus C
augagacaugau

SEQ ID NO: 3910959 - RNA, 14 nt, Human adenovirus C
augagcagcuggcg

SEQ ID NO: 3910960 - RNA, 21 nt, Human adenovirus C
augagcagcuggcgcgcuggc

SEQ ID NO: 3910961 - RNA, 16 nt, Human adenovirus C
augauggccgcagugc

SEQ ID NO: 3910962 - RNA, 20 nt, Human adenovirus C
augcacaucucgggccagga

SEQ ID NO: 3910963 - RNA, 13 nt, Human adenovirus C
augcaucaaacaa

SEQ ID NO: 3910964 - RNA, 19 nt, Human adenovirus C
augcaucuaaaagcgguga

SEQ ID NO: 3910965 - RNA, 20 nt, Human adenovirus C
augccaggccuacaaauccu

SEQ ID NO: 3910966 - RNA, 16 nt, Human adenovirus C
augcgccagaaggcgc

SEQ ID NO: 3910967 - RNA, 17 nt, Human adenovirus C
augcgcgggcggcaagc

SEQ ID NO: 3910968 - RNA, 14 nt, Human adenovirus C
augcggcaggaggg

SEQ ID NO: 3910969 - RNA, 20 nt, Human adenovirus C
augcgggccaugagcugcga

SEQ ID NO: 3910970 - RNA, 18 nt, Human adenovirus C
augcuaaaaugaagagac

SEQ ID NO: 3910971 - RNA, 16 nt, Human adenovirus C
augcucagucugggca

SEQ ID NO: 3910972 - RNA, 15 nt, Human adenovirus C
augcuccccuggacc

SEQ ID NO: 3910973 - RNA, 22 nt, Human adenovirus C
augcuuuugagcguuugaccaa

SEQ ID NO: 3910974 - RNA, 16 nt, Human adenovirus C
auggaagacugggaca

SEQ ID NO: 3910975 - RNA, 18 nt, Human adenovirus C
auggcagcaaggccugga

SEQ ID NO: 3910976 - RNA, 17 nt, Human adenovirus C
auggccugaaccgcgag

SEQ ID NO: 3910977 - RNA, 13 nt, Human adenovirus C
auggcgcagcugu

SEQ ID NO: 3910978 - RNA, 22 nt, Human adenovirus C
auguagcaugauaaauaugugg

SEQ ID NO: 3910979 - RNA, 19 nt, Human adenovirus C
auguccaaggugaaccuga

SEQ ID NO: 3910980 - RNA, 21 nt, Human adenovirus C
augucguaaacguagaggggc

SEQ ID NO: 3910981 - RNA, 22 nt, Human adenovirus C
augugaccgaggagcugaggcc

SEQ ID NO: 3910982 - RNA, 13 nt, Human adenovirus C
augugcccggccc

SEQ ID NO: 3910983 - RNA, 17 nt, Human adenovirus C
augugggauaugcucca

SEQ ID NO: 3910984 - RNA, 23 nt, Human adenovirus C
auuaaacauggcgccauccacca

SEQ ID NO: 3910985 - RNA, 22 nt, Human adenovirus C
auuaagaaaugccuguuugaaa

SEQ ID NO: 3910986 - RNA, 13 nt, Human adenovirus C
auuaccauguaca

SEQ ID NO: 3910987 - RNA, 23 nt, Human adenovirus C
auuagcggggugguggaccuggc

SEQ ID NO: 3910988 - RNA, 23 nt, Human adenovirus C
auuaugagcaaggaaauucccac

SEQ ID NO: 3910989 - RNA, 14 nt, Human adenovirus C
auugacgcgguggu

SEQ ID NO: 3910990 - RNA, 13 nt, Human adenovirus C
auugaggaguucg

SEQ ID NO: 3910991 - RNA, 18 nt, Human adenovirus C
auugcgcuguaccugcca

SEQ ID NO: 3910992 - RNA, 18 nt, Human adenovirus C
auuggacggucugaaacc

SEQ ID NO: 3910993 - RNA, 13 nt, Human adenovirus C
auuuauguaaaua

SEQ ID NO: 3910994 - RNA, 18 nt, Human adenovirus C
auuuccaacguggagcuc

SEQ ID NO: 3910995 - RNA, 23 nt, Human adenovirus C
auuucugccagcgccugcacugc

SEQ ID NO: 3910996 - RNA, 18 nt, Human adenovirus C
auuuggguaacaggaggg

SEQ ID NO: 3910997 - RNA, 23 nt, Human adenovirus C
auuuguagcgccacaucuucucu

SEQ ID NO: 3910998 - RNA, 18 nt, Human adenovirus C
auuugucacccuuauccu

SEQ ID NO: 3910999 - RNA, 18 nt, Human adenovirus C
auuuuaaaaaaacuacaa

SEQ ID NO: 3911000 - RNA, 23 nt, Human adenovirus C
caaaaccuucucuacgccaacuc

SEQ ID NO: 3911001 - RNA, 22 nt, Human adenovirus C
caaaagugguuuuguacaguga

SEQ ID NO: 3911002 - RNA, 18 nt, Human adenovirus C
caaaauuuccaacgugga

SEQ ID NO: 3911003 - RNA, 17 nt, Human adenovirus C
caaacaauacuaaaaaa

SEQ ID NO: 3911004 - RNA, 14 nt, Human adenovirus C
caaacacaucugag

SEQ ID NO: 3911005 - RNA, 20 nt, Human adenovirus C
caaaccgaagauagcggccg

SEQ ID NO: 3911006 - RNA, 20 nt, Human adenovirus C
caaacgacccguagagggcg

SEQ ID NO: 3911007 - RNA, 14 nt, Human adenovirus C
caaacgaggaacaa

SEQ ID NO: 3911008 - RNA, 22 nt, Human adenovirus C
caaacucuucgcggucuuucca

SEQ ID NO: 3911009 - RNA, 15 nt, Human adenovirus C
caaacuuucuccaaa

SEQ ID NO: 3911010 - RNA, 20 nt, Human adenovirus C
caaagcaaaccucaccuccg

SEQ ID NO: 3911011 - RNA, 14 nt, Human adenovirus C
caaagcaggggcca

SEQ ID NO: 3911012 - RNA, 17 nt, Human adenovirus C
caaagcaggggccaaga

SEQ ID NO: 3911013 - RNA, 13 nt, Human adenovirus C
caaauauggaaca

SEQ ID NO: 3911014 - RNA, 14 nt, Human adenovirus C
caacaccuagccua

SEQ ID NO: 3911015 - RNA, 15 nt, Human adenovirus C
caacacggccuccac

SEQ ID NO: 3911016 - RNA, 19 nt, Human adenovirus C
caacacggccuccacgcug

SEQ ID NO: 3911017 - RNA, 13 nt, Human adenovirus C
caacacguaauga

SEQ ID NO: 3911018 - RNA, 22 nt, Human adenovirus C
caacagcaggaggaagccaggc

SEQ ID NO: 3911019 - RNA, 22 nt, Human adenovirus C
caacccaauccccccgccgccg

SEQ ID NO: 3911020 - RNA, 16 nt, Human adenovirus C
caaccccaccaaugug

SEQ ID NO: 3911021 - RNA, 16 nt, Human adenovirus C
caacccuuccaggagg

SEQ ID NO: 3911022 - RNA, 16 nt, Human adenovirus C
caaccuauggagaaau

SEQ ID NO: 3911023 - RNA, 18 nt, Human adenovirus C
caacgugcccaucuccau

SEQ ID NO: 3911024 - RNA, 14 nt, Human adenovirus C
caagaaaaacacca

SEQ ID NO: 3911025 - RNA, 18 nt, Human adenovirus C
caagaaaaacaccaccac

SEQ ID NO: 3911026 - RNA, 17 nt, Human adenovirus C
caagaacuugcaggggc

SEQ ID NO: 3911027 - RNA, 16 nt, Human adenovirus C
caagaaguugaagaca

SEQ ID NO: 3911028 - RNA, 19 nt, Human adenovirus C
caagacagaaacacagagc

SEQ ID NO: 3911029 - RNA, 13 nt, Human adenovirus C
caagacuacucaa

SEQ ID NO: 3911030 - RNA, 12 nt, Human adenovirus C
caagacuguggg

SEQ ID NO: 3911031 - RNA, 15 nt, Human adenovirus C
caagcaggccaaacu

SEQ ID NO: 3911032 - RNA, 21 nt, Human adenovirus C
caagccccacugaccgugcaa

SEQ ID NO: 3911033 - RNA, 12 nt, Human adenovirus C
caagcgcaaaau

SEQ ID NO: 3911034 - RNA, 19 nt, Human adenovirus C
caagcuacccacccagcgc

SEQ ID NO: 3911035 - RNA, 16 nt, Human adenovirus C
caagcuugguggcaaa

SEQ ID NO: 3911036 - RNA, 17 nt, Human adenovirus C
caaggccggaaaccuca

SEQ ID NO: 3911037 - RNA, 23 nt, Human adenovirus C
caaggccggaaaccucaccuccc

SEQ ID NO: 3911038 - RNA, 20 nt, Human adenovirus C
caagggcgaggcgcgccgcg

SEQ ID NO: 3911039 - RNA, 18 nt, Human adenovirus C
caaggguaucauggcgga

SEQ ID NO: 3911040 - RNA, 18 nt, Human adenovirus C
caagggugcagcugaagc

SEQ ID NO: 3911041 - RNA, 18 nt, Human adenovirus C
caaggucaacgcuggugg

SEQ ID NO: 3911042 - RNA, 20 nt, Human adenovirus C
caagucuagcgccugcugcc

SEQ ID NO: 3911043 - RNA, 18 nt, Human adenovirus C
caaguugaaagagcaaaa

SEQ ID NO: 3911044 - RNA, 23 nt, Human adenovirus C
caaguuguggcccccacaaaagu

SEQ ID NO: 3911045 - RNA, 18 nt, Human adenovirus C
cacaacacggccuccacg

SEQ ID NO: 3911046 - RNA, 19 nt, Human adenovirus C
cacaagaaucgccugcuac

SEQ ID NO: 3911047 - RNA, 13 nt, Human adenovirus C
cacaagcucgccu

SEQ ID NO: 3911048 - RNA, 16 nt, Human adenovirus C
cacacacgggaggagc

SEQ ID NO: 3911049 - RNA, 15 nt, Human adenovirus C
cacagccgccugagc

SEQ ID NO: 3911050 - RNA, 16 nt, Human adenovirus C
cacagcggcggcagca

SEQ ID NO: 3911051 - RNA, 18 nt, Human adenovirus C
cacagggaugugcccggc

SEQ ID NO: 3911052 - RNA, 16 nt, Human adenovirus C
cacaggguugcagcac

SEQ ID NO: 3911053 - RNA, 23 nt, Human adenovirus C
cacaguccuuucuccccggcugg

SEQ ID NO: 3911054 - RNA, 20 nt, Human adenovirus C
cacaguuuaaacagcgagga

SEQ ID NO: 3911055 - RNA, 15 nt, Human adenovirus C
cacaucucgggccag

SEQ ID NO: 3911056 - RNA, 21 nt, Human adenovirus C
cacaugucuaugcccaggcuc

SEQ ID NO: 3911057 - RNA, 19 nt, Human adenovirus C
caccaacgugcccaucucc

SEQ ID NO: 3911058 - RNA, 13 nt, Human adenovirus C
caccaccacccuc

SEQ ID NO: 3911059 - RNA, 15 nt, Human adenovirus C
caccacccuccucac

SEQ ID NO: 3911060 - RNA, 12 nt, Human adenovirus C
caccacugcaga

SEQ ID NO: 3911061 - RNA, 15 nt, Human adenovirus C
caccaggugcagacc

SEQ ID NO: 3911062 - RNA, 21 nt, Human adenovirus C
caccaugcgcgagggacaggc

SEQ ID NO: 3911063 - RNA, 15 nt, Human adenovirus C
cacccggcgccagca

SEQ ID NO: 3911064 - RNA, 16 nt, Human adenovirus C
caccgcggaugcuggc

SEQ ID NO: 3911065 - RNA, 23 nt, Human adenovirus C
caccggccgacgggcggccaugc

SEQ ID NO: 3911066 - RNA, 15 nt, Human adenovirus C
caccgggacugggcg

SEQ ID NO: 3911067 - RNA, 14 nt, Human adenovirus C
agggugacaagguc

SEQ ID NO: 3911068 - RNA, 20 nt, Human adenovirus C
aggguggcucgcgaaggagg

SEQ ID NO: 3911069 - RNA, 13 nt, Human adenovirus C
aggguucggggcu

SEQ ID NO: 3911070 - RNA, 16 nt, Human adenovirus C
agguacgaugagaccc

SEQ ID NO: 3911071 - RNA, 13 nt, Human adenovirus C
agguacugaaaug

SEQ ID NO: 3911072 - RNA, 21 nt, Human adenovirus C
agguaggcgaucccuacugua

SEQ ID NO: 3911073 - RNA, 16 nt, Human adenovirus C
aggucugcacggacca

SEQ ID NO: 3911074 - RNA, 14 nt, Human adenovirus C
aggugcccgagggu

SEQ ID NO: 3911075 - RNA, 22 nt, Human adenovirus C
agguggcaccgggacugggcgu

SEQ ID NO: 3911076 - RNA, 18 nt, Human adenovirus C
agguggucgcgaaagguc

SEQ ID NO: 3911077 - RNA, 14 nt, Human adenovirus C
agguuaccucugca

SEQ ID NO: 3911078 - RNA, 14 nt, Human adenovirus C
agguuccugagcag

SEQ ID NO: 3911079 - RNA, 17 nt, Human adenovirus C
agguuccugagcagcug

SEQ ID NO: 3911080 - RNA, 19 nt, Human adenovirus C
agguuccugagcagcugcg

SEQ ID NO: 3911081 - RNA, 17 nt, Human adenovirus C
aguacaagauuagcaaa

SEQ ID NO: 3911082 - RNA, 15 nt, Human adenovirus C
aguaccaacagagga

SEQ ID NO: 3911083 - RNA, 15 nt, Human adenovirus C
aguaccucuugguuu

SEQ ID NO: 3911084 - RNA, 13 nt, Human adenovirus C
aguaccugagccc

SEQ ID NO: 3911085 - RNA, 16 nt, Human adenovirus C
aguagcacaaaacucc

SEQ ID NO: 3911086 - RNA, 16 nt, Human adenovirus C
agucacuggucuuguc

SEQ ID NO: 3911087 - RNA, 14 nt, Human adenovirus C
agucauccaugucc

SEQ ID NO: 3911088 - RNA, 14 nt, Human adenovirus C
aguccgggccagac

SEQ ID NO: 3911089 - RNA, 17 nt, Human adenovirus C
agucugcagcgcugcca

SEQ ID NO: 3911090 - RNA, 18 nt, Human adenovirus C
agucugcagcgcugccaa

SEQ ID NO: 3911091 - RNA, 20 nt, Human adenovirus C
agugcagcacagcagggaca

SEQ ID NO: 3911092 - RNA, 22 nt, Human adenovirus C
agugcccgcugucauaccacug

SEQ ID NO: 3911093 - RNA, 14 nt, Human adenovirus C
agugcugggccagc

SEQ ID NO: 3911094 - RNA, 15 nt, Human adenovirus C
agugcugggccagca

SEQ ID NO: 3911095 - RNA, 16 nt, Human adenovirus C
agugcuuaaaaaaaca

SEQ ID NO: 3911096 - RNA, 23 nt, Human adenovirus C
aguggaaaauacaccacugaaac

SEQ ID NO: 3911097 - RNA, 16 nt, Human adenovirus C
aguggucuuacaugca

SEQ ID NO: 3911098 - RNA, 15 nt, Human adenovirus C
aguguccacagugga

SEQ ID NO: 3911099 - RNA, 20 nt, Human adenovirus C
aguucgugccuucgguuuac

SEQ ID NO: 3911100 - RNA, 17 nt, Human adenovirus C
aguugagggugguggcg

SEQ ID NO: 3911101 - RNA, 14 nt, Human adenovirus C
aguugcauguggaa

SEQ ID NO: 3911102 - RNA, 22 nt, Human adenovirus C
aguugcuugcuugcaagacugu

SEQ ID NO: 3911103 - RNA, 17 nt, Human adenovirus C
aguuggaagacgccgcc

SEQ ID NO: 3911104 - RNA, 19 nt, Human adenovirus C
aguuggcccgcugcccugg

SEQ ID NO: 3911105 - RNA, 15 nt, Human adenovirus C
aguuucgcaggcgcu

SEQ ID NO: 3911106 - RNA, 21 nt, Human adenovirus C
aguuucgcgcccuuucucaaa

SEQ ID NO: 3911107 - RNA, 21 nt, Human adenovirus C
aguuuuauaaaggauaaaugg

SEQ ID NO: 3911108 - RNA, 17 nt, Human adenovirus C
auaacagcacuggcaac

SEQ ID NO: 3911109 - RNA, 15 nt, Human adenovirus C
auaagggccuccccu

SEQ ID NO: 3911110 - RNA, 22 nt, Human adenovirus C
auacggaggauaggguggccuu

SEQ ID NO: 3911111 - RNA, 19 nt, Human adenovirus C
auacugggacagucaggca

SEQ ID NO: 3911112 - RNA, 15 nt, Human adenovirus C
auagccgggucaggg

SEQ ID NO: 3911113 - RNA, 19 nt, Human adenovirus C
auagcuaacgugucguaug

SEQ ID NO: 3911114 - RNA, 22 nt, Human adenovirus C
auauaaaccucugauuaaacau

SEQ ID NO: 3911115 - RNA, 20 nt, Human adenovirus C
auaugaguggguggaguuca

SEQ ID NO: 3911116 - RNA, 21 nt, Human adenovirus C
auauggcccucaccugccgcc

SEQ ID NO: 3911117 - RNA, 20 nt, Human adenovirus C
auaugguuggacgcuggaag

SEQ ID NO: 3911118 - RNA, 14 nt, Human adenovirus C
auauuguucaaaau

SEQ ID NO: 3911119 - RNA, 11 nt, Human adenovirus C
aucacaaaagc

SEQ ID NO: 3911120 - RNA, 21 nt, Human adenovirus C
aucagauccgcguccaggucc

SEQ ID NO: 3911121 - RNA, 18 nt, Human adenovirus C
aucagcguaaaucccaca

SEQ ID NO: 3911122 - RNA, 18 nt, Human adenovirus C
aucagcuucggcgcacgc

SEQ ID NO: 3911123 - RNA, 21 nt, Human adenovirus C
aucagcuucggcgcacgcugg

SEQ ID NO: 3911124 - RNA, 12 nt, Human adenovirus C
aucauugaaaac

SEQ ID NO: 3911125 - RNA, 16 nt, Human adenovirus C
auccacagcggcggca

SEQ ID NO: 3911126 - RNA, 19 nt, Human adenovirus C
auccagcggcggcggcgcg

SEQ ID NO: 3911127 - RNA, 17 nt, Human adenovirus C
aucccacacugcaggga

SEQ ID NO: 3911128 - RNA, 23 nt, Human adenovirus C
aucccauggacgagcccacccuu

SEQ ID NO: 3911129 - RNA, 13 nt, Human adenovirus C
aucccuccgggga

SEQ ID NO: 3911130 - RNA, 15 nt, Human adenovirus C
aucccugaacuacca

SEQ ID NO: 3911131 - RNA, 22 nt, Human adenovirus C
aucccugagcaggggggccacu

SEQ ID NO: 3911132 - RNA, 12 nt, Human adenovirus C
auccgcccugcu

SEQ ID NO: 3911133 - RNA, 21 nt, Human adenovirus C
auccgcggcgugcuggacagg

SEQ ID NO: 3911134 - RNA, 17 nt, Human adenovirus C
auccuaacucugcagac

SEQ ID NO: 3911135 - RNA, 15 nt, Human adenovirus C
auccucaucugcagc

SEQ ID NO: 3911136 - RNA, 18 nt, Human adenovirus C
auccucaucugcagccuc

SEQ ID NO: 3911137 - RNA, 23 nt, Human adenovirus C
auccugccgugccaaccgcagcc

SEQ ID NO: 3911138 - RNA, 14 nt, Human adenovirus C
aucgcccagcaaua

SEQ ID NO: 3911139 - RNA, 18 nt, Human adenovirus C
aucgcgcccauggcuacc

SEQ ID NO: 3911140 - RNA, 16 nt, Human adenovirus C
aucgcucaguaccaac

SEQ ID NO: 3911141 - RNA, 22 nt, Human adenovirus C
aucgcuuucccgagaaccagau

SEQ ID NO: 3911142 - RNA, 13 nt, Human adenovirus C
aucguuuaaaagc

SEQ ID NO: 3911143 - RNA, 19 nt, Human adenovirus C
aucuccagcggccacaccc

SEQ ID NO: 3911144 - RNA, 16 nt, Human adenovirus C
aucucccgccaccagu

SEQ ID NO: 3911145 - RNA, 13 nt, Human adenovirus C
aucuccuaacugc

SEQ ID NO: 3911146 - RNA, 16 nt, Human adenovirus C
aucucgucgaagccgu

SEQ ID NO: 3911147 - RNA, 13 nt, Human adenovirus C
aucugagcggggg

SEQ ID NO: 3911148 - RNA, 19 nt, Human adenovirus C
aucugggucaccaggcgcu

SEQ ID NO: 3911149 - RNA, 12 nt, Human adenovirus C
acggcaccgcca

SEQ ID NO: 3911150 - RNA, 14 nt, Human adenovirus C
acggccgccagagc

SEQ ID NO: 3911151 - RNA, 20 nt, Human adenovirus C
acggccgccagagcuuccac

SEQ ID NO: 3911152 - RNA, 22 nt, Human adenovirus C
acggccuucaacgagcgcuccg

SEQ ID NO: 3911153 - RNA, 13 nt, Human adenovirus C
acggcggccuggc

SEQ ID NO: 3911154 - RNA, 16 nt, Human adenovirus C
acgggcagccuggagg

SEQ ID NO: 3911155 - RNA, 16 nt, Human adenovirus C
acgggcccggugagcu

SEQ ID NO: 3911156 - RNA, 16 nt, Human adenovirus C
acgguuuuccuggcca

SEQ ID NO: 3911157 - RNA, 22 nt, Human adenovirus C
acgucauaguuguguuccagga

SEQ ID NO: 3911158 - RNA, 16 nt, Human adenovirus C
acgucuagggcgcagu

SEQ ID NO: 3911159 - RNA, 12 nt, Human adenovirus C
acgugcagacca

SEQ ID NO: 3911160 - RNA, 19 nt, Human adenovirus C
acgugcagaccaaccugga

SEQ ID NO: 3911161 - RNA, 20 nt, Human adenovirus C
acgugcauacacuuccucag

SEQ ID NO: 3911162 - RNA, 19 nt, Human adenovirus C
acgugcccaucuccauccc

SEQ ID NO: 3911163 - RNA, 21 nt, Human adenovirus C
acgugccgcggggacaggagg

SEQ ID NO: 3911164 - RNA, 23 nt, Human adenovirus C
acgugccgcggggacaggaggac

SEQ ID NO: 3911165 - RNA, 19 nt, Human adenovirus C
acgugcgccaggccugcaa

SEQ ID NO: 3911166 - RNA, 21 nt, Human adenovirus C
acguuuacaaggcccugggca

SEQ ID NO: 3911167 - RNA, 20 nt, Human adenovirus C
acuaaacuuugauaauacug

SEQ ID NO: 3911168 - RNA, 15 nt, Human adenovirus C
acuaacauaaacaca

SEQ ID NO: 3911169 - RNA, 18 nt, Human adenovirus C
acuacaauauuggcuacc

SEQ ID NO: 3911170 - RNA, 22 nt, Human adenovirus C
acuacauggacaaaagaugaaa

SEQ ID NO: 3911171 - RNA, 21 nt, Human adenovirus C
acuaccgcgcgcccuggggcg

SEQ ID NO: 3911172 - RNA, 20 nt, Human adenovirus C
acuagcuacuguagcugcuu

SEQ ID NO: 3911173 - RNA, 20 nt, Human adenovirus C
acuaucgcaacaccacugcu

SEQ ID NO: 3911174 - RNA, 22 nt, Human adenovirus C
acuaucugccugaagauggcau

SEQ ID NO: 3911175 - RNA, 17 nt, Human adenovirus C
acuauucugcugcaugu

SEQ ID NO: 3911176 - RNA, 17 nt, Human adenovirus C
acucacagaccugggcc

SEQ ID NO: 3911177 - RNA, 17 nt, Human adenovirus C
acucaggucaaaaaagc

SEQ ID NO: 3911178 - RNA, 14 nt, Human adenovirus C
acuccacaggcugc

SEQ ID NO: 3911179 - RNA, 20 nt, Human adenovirus C
acucccauuuuuccaaaaca

SEQ ID NO: 3911180 - RNA, 22 nt, Human adenovirus C
acucgcgccuguugcugcugcu

SEQ ID NO: 3911181 - RNA, 14 nt, Human adenovirus C
acucgcugcugcag

SEQ ID NO: 3911182 - RNA, 18 nt, Human adenovirus C
acucggaccacucugaga

SEQ ID NO: 3911183 - RNA, 15 nt, Human adenovirus C
acucugacaaagccc

SEQ ID NO: 3911184 - RNA, 21 nt, Human adenovirus C
acucugacaaagcccaagaaa

SEQ ID NO: 3911185 - RNA, 20 nt, Human adenovirus C
acugcagagcuucaugcugc

SEQ ID NO: 3911186 - RNA, 17 nt, Human adenovirus C
acugcagcacagcacca

SEQ ID NO: 3911187 - RNA, 20 nt, Human adenovirus C
acugcagcaggugcugccca

SEQ ID NO: 3911188 - RNA, 15 nt, Human adenovirus C
acugccacagagggc

SEQ ID NO: 3911189 - RNA, 16 nt, Human adenovirus C
acugccacagagggca

SEQ ID NO: 3911190 - RNA, 19 nt, Human adenovirus C
acugcgccugacacaccuc

SEQ ID NO: 3911191 - RNA, 15 nt, Human adenovirus C
acugcuaaaaauaac

SEQ ID NO: 3911192 - RNA, 21 nt, Human adenovirus C
acugcuaaaaauaacauuguc

SEQ ID NO: 3911193 - RNA, 16 nt, Human adenovirus C
acuggaaccagggccg

SEQ ID NO: 3911194 - RNA, 16 nt, Human adenovirus C
acuggaacccgccgcc

SEQ ID NO: 3911195 - RNA, 18 nt, Human adenovirus C
acuggaacccgccgccgc

SEQ ID NO: 3911196 - RNA, 21 nt, Human adenovirus C
acuggcaccuuuuguuccacc

SEQ ID NO: 3911197 - RNA, 19 nt, Human adenovirus C
acuggccauuuccuucucc

SEQ ID NO: 3911198 - RNA, 13 nt, Human adenovirus C
acuggcugcagcc

SEQ ID NO: 3911199 - RNA, 17 nt, Human adenovirus C
acuggcugcagccaggg

SEQ ID NO: 3911200 - RNA, 17 nt, Human adenovirus C
acugucacuugcugaag

SEQ ID NO: 3911201 - RNA, 18 nt, Human adenovirus C
acuuacuggcugcagcca

SEQ ID NO: 3911202 - RNA, 23 nt, Human adenovirus C
acuucaggaaggauguuaacaug

SEQ ID NO: 3911203 - RNA, 14 nt, Human adenovirus C
acuuccagcccaug

SEQ ID NO: 3911204 - RNA, 22 nt, Human adenovirus C
acuugcaucgcgcggccgccgu

SEQ ID NO: 3911205 - RNA, 21 nt, Human adenovirus C
acuugcauggugauaaaacua

SEQ ID NO: 3911206 - RNA, 14 nt, Human adenovirus C
acuugcggcuggag

SEQ ID NO: 3911207 - RNA, 23 nt, Human adenovirus C
acuuggcacccaccgugcagcug

SEQ ID NO: 3911208 - RNA, 22 nt, Human adenovirus C
acuuuccuggacguuagcgccu

SEQ ID NO: 3911209 - RNA, 16 nt, Human adenovirus C
acuuugcgucucuggc

SEQ ID NO: 3911210 - RNA, 22 nt, Human adenovirus C
acuuuuaagcccuacuccggca

SEQ ID NO: 3911211 - RNA, 20 nt, Human adenovirus C
acuuuuagcuuaaugaccag

SEQ ID NO: 3911212 - RNA, 22 nt, Human adenovirus C
agaaaagcgcggccuaaagcgc

SEQ ID NO: 3911213 - RNA, 13 nt, Human adenovirus C
agaaacacaagcu

SEQ ID NO: 3911214 - RNA, 14 nt, Human adenovirus C
agaaacacagagcu

SEQ ID NO: 3911215 - RNA, 12 nt, Human adenovirus C
cgagguggagau

SEQ ID NO: 3911216 - RNA, 19 nt, Human adenovirus C
cgagucuggugacuuggca

SEQ ID NO: 3911217 - RNA, 14 nt, Human adenovirus C
cgagugguggcucc

SEQ ID NO: 3911218 - RNA, 17 nt, Human adenovirus C
cgauauuaccauguaca

SEQ ID NO: 3911219 - RNA, 20 nt, Human adenovirus C
cgaucacuuggugcuggccu

SEQ ID NO: 3911220 - RNA, 15 nt, Human adenovirus C
cgaucgaugcggccc

SEQ ID NO: 3911221 - RNA, 14 nt, Human adenovirus C
cgaucguggagcac

SEQ ID NO: 3911222 - RNA, 14 nt, Human adenovirus C
cgaugagacccgca

SEQ ID NO: 3911223 - RNA, 17 nt, Human adenovirus C
cgaugagacccgcacca

SEQ ID NO: 3911224 - RNA, 18 nt, Human adenovirus C
cgaugaugccgcaguggu

SEQ ID NO: 3911225 - RNA, 17 nt, Human adenovirus C
cgcaaccgcagacccug

SEQ ID NO: 3911226 - RNA, 21 nt, Human adenovirus C
cgcaaccuaaaggagcugcag

SEQ ID NO: 3911227 - RNA, 13 nt, Human adenovirus C
cgcaaggccuggc

SEQ ID NO: 3911228 - RNA, 13 nt, Human adenovirus C
cgcaauucuggaa

SEQ ID NO: 3911229 - RNA, 18 nt, Human adenovirus C
cgcaccgcguccgcgcuc

SEQ ID NO: 3911230 - RNA, 21 nt, Human adenovirus C
cacgguuaacuccuccuccag

SEQ ID NO: 3911231 - RNA, 20 nt, Human adenovirus C
cacuacccggaccaguuuau

SEQ ID NO: 3911232 - RNA, 13 nt, Human adenovirus C
cacuaucagcgcc

SEQ ID NO: 3911233 - RNA, 20 nt, Human adenovirus C
cacucgcccuacuuccgcag

SEQ ID NO: 3911234 - RNA, 14 nt, Human adenovirus C
cacucgugcuggcu

SEQ ID NO: 3911235 - RNA, 16 nt, Human adenovirus C
cacucucgcaaggccu

SEQ ID NO: 3911236 - RNA, 15 nt, Human adenovirus C
cacugcagcaggugc

SEQ ID NO: 3911237 - RNA, 13 nt, Human adenovirus C
cacugccacagag

SEQ ID NO: 3911238 - RNA, 15 nt, Human adenovirus C
cacugcuaccggacu

SEQ ID NO: 3911239 - RNA, 24 nt, Human adenovirus C
cacugcuaccuucugcagcuagcc

SEQ ID NO: 3911240 - RNA, 15 nt, Human adenovirus C
cacuggcaacauggg

SEQ ID NO: 3911241 - RNA, 22 nt, Human adenovirus C
cacuggucuugucaugccuggg

SEQ ID NO: 3911242 - RNA, 23 nt, Human adenovirus C
cacuggucuugucaugccugggg

SEQ ID NO: 3911243 - RNA, 17 nt, Human adenovirus C
cacugucgcugcaaccu

SEQ ID NO: 3911244 - RNA, 23 nt, Human adenovirus C
cacugugccccccagguccaggc

SEQ ID NO: 3911245 - RNA, 17 nt, Human adenovirus C
cagaaaccugugcugcc

SEQ ID NO: 3911246 - RNA, 21 nt, Human adenovirus C
cagaaaccugugcugccaggg

SEQ ID NO: 3911247 - RNA, 14 nt, Human adenovirus C
cagaaccaccagca

SEQ ID NO: 3911248 - RNA, 15 nt, Human adenovirus C
cagaagcugccgccc

SEQ ID NO: 3911249 - RNA, 17 nt, Human adenovirus C
cagaaggugaccgugcc

SEQ ID NO: 3911250 - RNA, 17 nt, Human adenovirus C
cagacaaugcagaaaca

SEQ ID NO: 3911251 - RNA, 19 nt, Human adenovirus C
cagacaucauuuugcugcc

SEQ ID NO: 3911252 - RNA, 21 nt, Human adenovirus C
cagacaucauuuugcugccag

SEQ ID NO: 3911253 - RNA, 14 nt, Human adenovirus C
cagaccugggccaa

SEQ ID NO: 3911254 - RNA, 14 nt, Human adenovirus C
cagacgacagcagc

SEQ ID NO: 3911255 - RNA, 14 nt, Human adenovirus C
cagacgcgccagac

SEQ ID NO: 3911256 - RNA, 20 nt, Human adenovirus C
cagacgcgccagacccccca

SEQ ID NO: 3911257 - RNA, 12 nt, Human adenovirus C
cagacgggccag

SEQ ID NO: 3911258 - RNA, 20 nt, Human adenovirus C
cagacuauuuuuuccagacc

SEQ ID NO: 3911259 - RNA, 15 nt, Human adenovirus C
cagagacgcccaggc

SEQ ID NO: 3911260 - RNA, 20 nt, Human adenovirus C
cagagcauaguggugcagga

SEQ ID NO: 3911261 - RNA, 22 nt, Human adenovirus C
cagagcauaguggugcaggagc

SEQ ID NO: 3911262 - RNA, 13 nt, Human adenovirus C
cagagcgugagcc

SEQ ID NO: 3911263 - RNA, 23 nt, Human adenovirus C
cagagcgugagccuuaaccugau

SEQ ID NO: 3911264 - RNA, 12 nt, Human adenovirus C
cagagcuguccu

SEQ ID NO: 3911265 - RNA, 22 nt, Human adenovirus C
cagagcuuccacuuggucaggc

SEQ ID NO: 3911266 - RNA, 13 nt, Human adenovirus C
cagaggacagcaa

SEQ ID NO: 3911267 - RNA, 18 nt, Human adenovirus C
cagaggagcugcugagcc

SEQ ID NO: 3911268 - RNA, 13 nt, Human adenovirus C
cagaggcggcgcu

SEQ ID NO: 3911269 - RNA, 20 nt, Human adenovirus C
cagagugggaauuugagccc

SEQ ID NO: 3911270 - RNA, 17 nt, Human adenovirus C
cagaugcugagggacaa

SEQ ID NO: 3911271 - RNA, 14 nt, Human adenovirus C
cagauucacucaaa

SEQ ID NO: 3911272 - RNA, 20 nt, Human adenovirus C
cagcaauaacacaggcuggg

SEQ ID NO: 3911273 - RNA, 15 nt, Human adenovirus C
cagcacagcaccaca

SEQ ID NO: 3911274 - RNA, 11 nt, Human adenovirus C
cagcacagcag

SEQ ID NO: 3911275 - RNA, 22 nt, Human adenovirus C
cagcacaguguauccggugcac

SEQ ID NO: 3911276 - RNA, 17 nt, Human adenovirus C
cagcacucggcagaaac

SEQ ID NO: 3911277 - RNA, 15 nt, Human adenovirus C
cagcagauuaaggau

SEQ ID NO: 3911278 - RNA, 15 nt, Human adenovirus C
cagcagccgcaggcc

SEQ ID NO: 3911279 - RNA, 16 nt, Human adenovirus C
cagcagccgcaggcca

SEQ ID NO: 3911280 - RNA, 13 nt, Human adenovirus C
cagcagccgcggc

SEQ ID NO: 3911281 - RNA, 14 nt, Human adenovirus C
cagcagccgcgggc

SEQ ID NO: 3911282 - RNA, 14 nt, Human adenovirus C
cagcagcgcacccu

SEQ ID NO: 3911283 - RNA, 14 nt, Human adenovirus C
cagcaggugcugcc

SEQ ID NO: 3911284 - RNA, 19 nt, Human adenovirus C
cagcagguuucugcccuga

SEQ ID NO: 3911285 - RNA, 14 nt, Human adenovirus C
cagcaucaccuccu

SEQ ID NO: 3911286 - RNA, 18 nt, Human adenovirus C
cagcaucgcuacaaccuc

SEQ ID NO: 3911287 - RNA, 12 nt, Human adenovirus C
cagccacagugc

SEQ ID NO: 3911288 - RNA, 21 nt, Human adenovirus C
cagccacucucgcaaggccug

SEQ ID NO: 3911289 - RNA, 14 nt, Human adenovirus C
cagcccuaucagca

SEQ ID NO: 3911290 - RNA, 20 nt, Human adenovirus C
cagccgagcggacaagcagc

SEQ ID NO: 3911291 - RNA, 12 nt, Human adenovirus C
cagccgcagcgc

SEQ ID NO: 3911292 - RNA, 13 nt, Human adenovirus C
cagccgcaggcca

SEQ ID NO: 3911293 - RNA, 13 nt, Human adenovirus C
cagccgccugagc

SEQ ID NO: 3911294 - RNA, 13 nt, Human adenovirus C
cagccgcggccau

SEQ ID NO: 3911295 - RNA, 13 nt, Human adenovirus C
cagccgcugcagc

SEQ ID NO: 3911296 - RNA, 17 nt, Human adenovirus C
cagccgguggaggacau

SEQ ID NO: 3911297 - RNA, 23 nt, Human adenovirus C
cagccuagacgaagcuuccgagg

SEQ ID NO: 3911298 - RNA, 22 nt, Human adenovirus C
cagccugcaaagggcccuggcu

SEQ ID NO: 3911299 - RNA, 23 nt, Human adenovirus C
cagccugcaaagggcccuggcug

SEQ ID NO: 3911300 - RNA, 14 nt, Human adenovirus C
cagcgccaaggcua

SEQ ID NO: 3911301 - RNA, 13 nt, Human adenovirus C
cagcgccgggugg

SEQ ID NO: 3911302 - RNA, 19 nt, Human adenovirus C
cagcggcaacgugcagacc

SEQ ID NO: 3911303 - RNA, 24 nt, Human adenovirus C
cagcggcaagagcaagagcagcgg

SEQ ID NO: 3911304 - RNA, 22 nt, Human adenovirus C
cagcggcagacaugcagggcac

SEQ ID NO: 3911305 - RNA, 17 nt, Human adenovirus C
cagcggcggcagcagca

SEQ ID NO: 3911306 - RNA, 15 nt, Human adenovirus C
cagcggugcagccac

SEQ ID NO: 3911307 - RNA, 17 nt, Human adenovirus C
cagcuaaaugccguggu

SEQ ID NO: 3911308 - RNA, 14 nt, Human adenovirus C
cagcugccgccgcc

SEQ ID NO: 3911309 - RNA, 21 nt, Human adenovirus C
cagcugcgacuuaccgcagcc

SEQ ID NO: 3911310 - RNA, 14 nt, Human adenovirus C
cagcuggggccgga

SEQ ID NO: 3911311 - RNA, 15 nt, Human adenovirus C
cagcugguaccuugc

SEQ ID NO: 3911312 - RNA, 13 nt, Human adenovirus C
cagcuguuggggu

SEQ ID NO: 3911313 - RNA, 19 nt, Human adenovirus C
cagcuugccugcuccagag

SEQ ID NO: 3911314 - RNA, 17 nt, Human adenovirus C
caggaaagucccgcucc

SEQ ID NO: 3911315 - RNA, 18 nt, Human adenovirus C
caggaacagcucuacagc

SEQ ID NO: 3911316 - RNA, 14 nt, Human adenovirus C
caggaaccaugaca

SEQ ID NO: 3911317 - RNA, 22 nt, Human adenovirus C
caggacgccucggaguaccuga

SEQ ID NO: 3911318 - RNA, 19 nt, Human adenovirus C
caggaggugagcucaacuc

SEQ ID NO: 3911319 - RNA, 21 nt, Human adenovirus C
caggcacaaccauccgcggca

SEQ ID NO: 3911320 - RNA, 13 nt, Human adenovirus C
caggcagaggagg

SEQ ID NO: 3911321 - RNA, 18 nt, Human adenovirus C
caggccgucuacucccag

SEQ ID NO: 3911322 - RNA, 14 nt, Human adenovirus C
caggcgacgagcgg

SEQ ID NO: 3911323 - RNA, 23 nt, Human adenovirus C
caggcgauccuaacucugcagac

SEQ ID NO: 3911324 - RNA, 13 nt, Human adenovirus C
caggcgcagagac

SEQ ID NO: 3911325 - RNA, 14 nt, Human adenovirus C
caggcgcagagaca

SEQ ID NO: 3911326 - RNA, 16 nt, Human adenovirus C
caggcgcggcggcugc

SEQ ID NO: 3911327 - RNA, 17 nt, Human adenovirus C
caggcgcggcggcugcu

SEQ ID NO: 3911328 - RNA, 23 nt, Human adenovirus C
caggcggcggcggcggcaggagc

SEQ ID NO: 3911329 - RNA, 16 nt, Human adenovirus C
caggcggcuauuacca

SEQ ID NO: 3911330 - RNA, 18 nt, Human adenovirus C
caggcuggggccugcgcu

SEQ ID NO: 3911331 - RNA, 15 nt, Human adenovirus C
caggcuuaccccgcc

SEQ ID NO: 3911332 - RNA, 14 nt, Human adenovirus C
cagggaugcgcugc

SEQ ID NO: 3911333 - RNA, 16 nt, Human adenovirus C
caggggagcugagccc

SEQ ID NO: 3911334 - RNA, 16 nt, Human adenovirus C
caggggccaagaacaa

SEQ ID NO: 3911335 - RNA, 14 nt, Human adenovirus C
caggggccucuucu

SEQ ID NO: 3911336 - RNA, 16 nt, Human adenovirus C
cagggugacaagguca

SEQ ID NO: 3911337 - RNA, 13 nt, Human adenovirus C
cagguacagccca

SEQ ID NO: 3911338 - RNA, 14 nt, Human adenovirus C
caggucaucgcgcc

SEQ ID NO: 3911339 - RNA, 15 nt, Human adenovirus C
caggugcacgcgcca

SEQ ID NO: 3911340 - RNA, 15 nt, Human adenovirus C
caggugcagacccug

SEQ ID NO: 3911341 - RNA, 21 nt, Human adenovirus C
cagguggagaugacugaaucu

SEQ ID NO: 3911342 - RNA, 17 nt, Human adenovirus C
cagguuggaauucuuca

SEQ ID NO: 3911343 - RNA, 20 nt, Human adenovirus C
cagguuggaauucuucacca

SEQ ID NO: 3911344 - RNA, 16 nt, Human adenovirus C
cagucacaagccccac

SEQ ID NO: 3911345 - RNA, 19 nt, Human adenovirus C
caguccccagguacagccc

SEQ ID NO: 3911346 - RNA, 15 nt, Human adenovirus C
caguccgggccagac

SEQ ID NO: 3911347 - RNA, 22 nt, Human adenovirus C
cagucgagaaggaggacagccu

SEQ ID NO: 3911348 - RNA, 18 nt, Human adenovirus C
cagucugcagcgcugcca

SEQ ID NO: 3911349 - RNA, 18 nt, Human adenovirus C
caguggagaggcagagcg

SEQ ID NO: 3911350 - RNA, 19 nt, Human adenovirus C
cagugucagauggaaagcu

SEQ ID NO: 3911351 - RNA, 14 nt, Human adenovirus C
caguguccacagug

SEQ ID NO: 3911352 - RNA, 21 nt, Human adenovirus C
caguuccaggcggucccacag

SEQ ID NO: 3911353 - RNA, 16 nt, Human adenovirus C
caguuggaggaguggc

SEQ ID NO: 3911354 - RNA, 18 nt, Human adenovirus C
caguuggggccuccgccc

SEQ ID NO: 3911355 - RNA, 14 nt, Human adenovirus C
cauaaaagaagcaa

SEQ ID NO: 3911356 - RNA, 13 nt, Human adenovirus C
cauaccacugcaa

SEQ ID NO: 3911357 - RNA, 20 nt, Human adenovirus C
cauacccgccaacgccacca

SEQ ID NO: 3911358 - RNA, 14 nt, Human adenovirus C
cauacugacccgcu

SEQ ID NO: 3911359 - RNA, 14 nt, Human adenovirus C
cauaguagagcccg

SEQ ID NO: 3911360 - RNA, 14 nt, Human adenovirus C
cauccacaaggccg

SEQ ID NO: 3911361 - RNA, 16 nt, Human adenovirus C
cauccaggugaugccg

SEQ ID NO: 3911362 - RNA, 18 nt, Human adenovirus C
cauccgcccugcucccag

SEQ ID NO: 3911363 - RNA, 16 nt, Human adenovirus C
cauccgcggcagcucg

SEQ ID NO: 3911364 - RNA, 15 nt, Human adenovirus C
caucguaggugacaa

SEQ ID NO: 3911365 - RNA, 21 nt, Human adenovirus C
caucguuuaaaagccggucuu

SEQ ID NO: 3911366 - RNA, 17 nt, Human adenovirus C
caucuccuaacugcaga

SEQ ID NO: 3911367 - RNA, 13 nt, Human adenovirus C
caucugcagccuc

SEQ ID NO: 3911368 - RNA, 14 nt, Human adenovirus C
caucugcagccucg

SEQ ID NO: 3911369 - RNA, 14 nt, Human adenovirus C
caugaaaccaugcu

SEQ ID NO: 3911370 - RNA, 14 nt, Human adenovirus C
caugaaccacccua

SEQ ID NO: 3911371 - RNA, 13 nt, Human adenovirus C
caugagccggugu

SEQ ID NO: 3911372 - RNA, 21 nt, Human adenovirus C
caugcgagcccaacccgcgcc

SEQ ID NO: 3911373 - RNA, 21 nt, Human adenovirus C
caugcgcgagggacaggcuua

SEQ ID NO: 3911374 - RNA, 14 nt, Human adenovirus C
cauggcgccaucca

SEQ ID NO: 3911375 - RNA, 21 nt, Human adenovirus C
cauggcgccauccaccaccau

SEQ ID NO: 3911376 - RNA, 24 nt, Human adenovirus C
caugguguguggcaacugcgagga

SEQ ID NO: 3911377 - RNA, 14 nt, Human adenovirus C
caugucgcugucca

SEQ ID NO: 3911378 - RNA, 21 nt, Human adenovirus C
caugucuaccugcggggcgau

SEQ ID NO: 3911379 - RNA, 21 nt, Human adenovirus C
caugucuuuccacgggcgcag

SEQ ID NO: 3911380 - RNA, 23 nt, Human adenovirus C
cauguuguaauucaccaccuccc

SEQ ID NO: 3911381 - RNA, 13 nt, Human adenovirus C
cauuacccagggc

SEQ ID NO: 3911382 - RNA, 17 nt, Human adenovirus C
cauucaacuaacauaaa

SEQ ID NO: 3911383 - RNA, 19 nt, Human adenovirus C
cauucagggaugcgcugcu

SEQ ID NO: 3911384 - RNA, 13 nt, Human adenovirus C
cauucccagcugc

SEQ ID NO: 3911385 - RNA, 17 nt, Human adenovirus C
ccaaaaagaagcugcag

SEQ ID NO: 3911386 - RNA, 13 nt, Human adenovirus C
ccaaaaccuucuc

SEQ ID NO: 3911387 - RNA, 15 nt, Human adenovirus C
ccaaaagcagggcuu

SEQ ID NO: 3911388 - RNA, 15 nt, Human adenovirus C
ccaaagcagaccaaa

SEQ ID NO: 3911389 - RNA, 15 nt, Human adenovirus C
ccaaccaggcagugc

SEQ ID NO: 3911390 - RNA, 14 nt, Human adenovirus C
ccaacccgcgccuc

SEQ ID NO: 3911391 - RNA, 13 nt, Human adenovirus C
ccaaccggcggca

SEQ ID NO: 3911392 - RNA, 15 nt, Human adenovirus C
ccaacuaccuugccu

SEQ ID NO: 3911393 - RNA, 14 nt, Human adenovirus C
ccaacuccaugcuu

SEQ ID NO: 3911394 - RNA, 17 nt, Human adenovirus C
ccaagaacaagagcuga

SEQ ID NO: 3911395 - RNA, 22 nt, Human adenovirus C
ccaagcaguuccaggcgguccc

SEQ ID NO: 3911396 - RNA, 22 nt, Human adenovirus C
ccaaggacugguuccuggugca

SEQ ID NO: 3911397 - RNA, 18 nt, Human adenovirus C
ccaaggccauggcaccga

SEQ ID NO: 3911398 - RNA, 22 nt, Human adenovirus C
ccaaguggacguaaaggcuaaa

SEQ ID NO: 3911399 - RNA, 16 nt, Human adenovirus C
ccaaguucaugccuuu

SEQ ID NO: 3911400 - RNA, 22 nt, Human adenovirus C
ccaauugcaagccaucaacaaa

SEQ ID NO: 3911401 - RNA, 16 nt, Human adenovirus C
ccacacaagcucgccu

SEQ ID NO: 3911402 - RNA, 15 nt, Human adenovirus C
ccacacugcagggaa

SEQ ID NO: 3911403 - RNA, 16 nt, Human adenovirus C
ccacagaaacuagcga

SEQ ID NO: 3911404 - RNA, 20 nt, Human adenovirus C
ccacagagggcauggagaca

SEQ ID NO: 3911405 - RNA, 17 nt, Human adenovirus C
ccacagccgccugagca

SEQ ID NO: 3911406 - RNA, 19 nt, Human adenovirus C
ccacagcggcggcagcagc

SEQ ID NO: 3911407 - RNA, 20 nt, Human adenovirus C
ccacagcggcggcagcagca

SEQ ID NO: 3911408 - RNA, 17 nt, Human adenovirus C
ccaccaauguggaaaua

SEQ ID NO: 3911409 - RNA, 15 nt, Human adenovirus C
ccaccaccacauagc

SEQ ID NO: 3911410 - RNA, 15 nt, Human adenovirus C
ccaccacgccgcgcg

SEQ ID NO: 3911411 - RNA, 13 nt, Human adenovirus C
ccacccuccucac

SEQ ID NO: 3911412 - RNA, 14 nt, Human adenovirus C
ccacgagccaggug

SEQ ID NO: 3911413 - RNA, 12 nt, Human adenovirus C
ccacgcucggug

SEQ ID NO: 3911414 - RNA, 13 nt, Human adenovirus C
ccacgcucgguga

SEQ ID NO: 3911415 - RNA, 16 nt, Human adenovirus C
ccacgcuggaagccau

SEQ ID NO: 3911416 - RNA, 23 nt, Human adenovirus C
ccacuaggggguccacucgcucc

SEQ ID NO: 3911417 - RNA, 15 nt, Human adenovirus C
ccacucgacacggca

SEQ ID NO: 3911418 - RNA, 19 nt, Human adenovirus C
ccacuguuacucagccacu

SEQ ID NO: 3911419 - RNA, 21 nt, Human adenovirus C
ccacuucuuuuugucacuuga

SEQ ID NO: 3911420 - RNA, 14 nt, Human adenovirus C
ccagaacgaccaca

SEQ ID NO: 3911421 - RNA, 16 nt, Human adenovirus C
ccagacauuacuccca

SEQ ID NO: 3911422 - RNA, 18 nt, Human adenovirus C
ccagaccgucugaagaca

SEQ ID NO: 3911423 - RNA, 21 nt, Human adenovirus C
ccagacuauuuuuuccagacc

SEQ ID NO: 3911424 - RNA, 18 nt, Human adenovirus C
ccagaggaccucugcacu

SEQ ID NO: 3911425 - RNA, 23 nt, Human adenovirus C
ccagaggagcugcugagccgccg

SEQ ID NO: 3911426 - RNA, 17 nt, Human adenovirus C
ccagcaauaacacaggc

SEQ ID NO: 3911427 - RNA, 20 nt, Human adenovirus C
ccagcaccugucgucagcgc

SEQ ID NO: 3911428 - RNA, 21 nt, Human adenovirus C
ccagcagaaaccugugcugcc

SEQ ID NO: 3911429 - RNA, 18 nt, Human adenovirus C
ccagcccaugagccggca

SEQ ID NO: 3911430 - RNA, 17 nt, Human adenovirus C
ccagcccgugcuggccc

SEQ ID NO: 3911431 - RNA, 18 nt, Human adenovirus C
ccagcgcggccacuuccc

SEQ ID NO: 3911432 - RNA, 17 nt, Human adenovirus C
ccagcggccacacccgg

SEQ ID NO: 3911433 - RNA, 22 nt, Human adenovirus C
ccagcggccacacccggcgcca

SEQ ID NO: 3911434 - RNA, 15 nt, Human adenovirus C
ccagcugcugagcca

SEQ ID NO: 3911435 - RNA, 18 nt, Human adenovirus C
ccagcugcugagccacag

SEQ ID NO: 3911436 - RNA, 23 nt, Human adenovirus C
ccagcuucagcuugccugcucca

SEQ ID NO: 3911437 - RNA, 21 nt, Human adenovirus C
ccaggaacagcucuacagcuu

SEQ ID NO: 3911438 - RNA, 19 nt, Human adenovirus C
ccaggacgacgcagaggca

SEQ ID NO: 3911439 - RNA, 12 nt, Human adenovirus C
ccaggacgccuc

SEQ ID NO: 3911440 - RNA, 12 nt, Human adenovirus C
ccaggcgccccc

SEQ ID NO: 3911441 - RNA, 22 nt, Human adenovirus C
ccaggcgcggcggcugcugcgc

SEQ ID NO: 3911442 - RNA, 20 nt, Human adenovirus C
ccaggcggcggcggcggcag

SEQ ID NO: 3911443 - RNA, 19 nt, Human adenovirus C
ccaggcggucccacagcuc

SEQ ID NO: 3911444 - RNA, 21 nt, Human adenovirus C
ccagggcuucuacauuccaga

SEQ ID NO: 3911445 - RNA, 11 nt, Human adenovirus C
gcaaccaggaa

SEQ ID NO: 3911446 - RNA, 15 nt, Human adenovirus C
gcaacccaacaccua

SEQ ID NO: 3911447 - RNA, 19 nt, Human adenovirus C
gcaaccuaaaggagcugca

SEQ ID NO: 3911448 - RNA, 20 nt, Human adenovirus C
gcaaccuaaaggagcugcag

SEQ ID NO: 3911449 - RNA, 12 nt, Human adenovirus C
gcaacgccacaa

SEQ ID NO: 3911450 - RNA, 15 nt, Human adenovirus C
gcaacgccacaacau

SEQ ID NO: 3911451 - RNA, 23 nt, Human adenovirus C
gcaacuuggcgauggagcgcagg

SEQ ID NO: 3911452 - RNA, 23 nt, Human adenovirus C
gcaacuuuccgguggugggcgcc

SEQ ID NO: 3911453 - RNA, 13 nt, Human adenovirus C
gcaagaccaggac

SEQ ID NO: 3911454 - RNA, 19 nt, Human adenovirus C
gcaagacucugacaaagcc

SEQ ID NO: 3911455 - RNA, 20 nt, Human adenovirus C
gcaagcaacaucaacaacag

SEQ ID NO: 3911456 - RNA, 13 nt, Human adenovirus C
gcaaggccuggaa

SEQ ID NO: 3911457 - RNA, 21 nt, Human adenovirus C
gcaaggccuggaacagcagca

SEQ ID NO: 3911458 - RNA, 23 nt, Human adenovirus C
gcaaggccuggaacagcagcaca

SEQ ID NO: 3911459 - RNA, 20 nt, Human adenovirus C
gcacagggaugugcccggcc

SEQ ID NO: 3911460 - RNA, 20 nt, Human adenovirus C
gcacaguguauccggugcac

SEQ ID NO: 3911461 - RNA, 18 nt, Human adenovirus C
gcacaucucgggccagga

SEQ ID NO: 3911462 - RNA, 17 nt, Human adenovirus C
gcacaugcgagcccaac

SEQ ID NO: 3911463 - RNA, 14 nt, Human adenovirus C
gcaccaggugcacg

SEQ ID NO: 3911464 - RNA, 15 nt, Human adenovirus C
gcaccaggugcagac

SEQ ID NO: 3911465 - RNA, 23 nt, Human adenovirus C
gcacccaaaaagaagcugcagcu

SEQ ID NO: 3911466 - RNA, 14 nt, Human adenovirus C
gcaccccgcaccgc

SEQ ID NO: 3911467 - RNA, 21 nt, Human adenovirus C
gcaccccuauucgacaccacc

SEQ ID NO: 3911468 - RNA, 15 nt, Human adenovirus C
gcaccgcccgcagca

SEQ ID NO: 3911469 - RNA, 13 nt, Human adenovirus C
gcaccggcggcag

SEQ ID NO: 3911470 - RNA, 19 nt, Human adenovirus C
gcaccgggacugggcgugc

SEQ ID NO: 3911471 - RNA, 18 nt, Human adenovirus C
gcaccguccgaagaaaag

SEQ ID NO: 3911472 - RNA, 21 nt, Human adenovirus C
gcaccguccgaagaaaagcgc

SEQ ID NO: 3911473 - RNA, 19 nt, Human adenovirus C
gcacgaccgucagcggggu

SEQ ID NO: 3911474 - RNA, 18 nt, Human adenovirus C
gcacgacguaaccacaga

SEQ ID NO: 3911475 - RNA, 15 nt, Human adenovirus C
gcacgcuggccagca

SEQ ID NO: 3911476 - RNA, 19 nt, Human adenovirus C
gcacgcuggccagcacgcu

SEQ ID NO: 3911477 - RNA, 14 nt, Human adenovirus C
gcacgucgcaccgg

SEQ ID NO: 3911478 - RNA, 22 nt, Human adenovirus C
gcacugccgcccaacgcgcggc

SEQ ID NO: 3911479 - RNA, 17 nt, Human adenovirus C
gcagaaaccugugcugc

SEQ ID NO: 3911480 - RNA, 18 nt, Human adenovirus C
gcagaauaagccacaccc

SEQ ID NO: 3911481 - RNA, 20 nt, Human adenovirus C
gcagacccugcgaguguggc

SEQ ID NO: 3911482 - RNA, 14 nt, Human adenovirus C
gcagaccguggacg

SEQ ID NO: 3911483 - RNA, 16 nt, Human adenovirus C
gcagacgacagcagcg

SEQ ID NO: 3911484 - RNA, 16 nt, Human adenovirus C
gcagagcgacugcgcc

SEQ ID NO: 3911485 - RNA, 19 nt, Human adenovirus C
gcagaggcggccgcccuug

SEQ ID NO: 3911486 - RNA, 16 nt, Human adenovirus C
gcagauguuggccaac

SEQ ID NO: 3911487 - RNA, 19 nt, Human adenovirus C
gcagcaaugccuggaggag

SEQ ID NO: 3911488 - RNA, 13 nt, Human adenovirus C
gcagcacagcacc

SEQ ID NO: 3911489 - RNA, 15 nt, Human adenovirus C
gcagcacaggccaga

SEQ ID NO: 3911490 - RNA, 18 nt, Human adenovirus C
gcagcagccgcaggccaa

SEQ ID NO: 3911491 - RNA, 13 nt, Human adenovirus C
gcagcaggaggag

SEQ ID NO: 3911492 - RNA, 14 nt, Human adenovirus C
gcagcaggaggagg

SEQ ID NO: 3911493 - RNA, 10 nt, Human adenovirus C
gcagccacag

SEQ ID NO: 3911494 - RNA, 16 nt, Human adenovirus C
gcagccaccgcccgcg

SEQ ID NO: 3911495 - RNA, 19 nt, Human adenovirus C
gcagccgcgggcccuugcu

SEQ ID NO: 3911496 - RNA, 17 nt, Human adenovirus C
gcagccggugggcccgu

SEQ ID NO: 3911497 - RNA, 16 nt, Human adenovirus C
gcagccucgucacugu

SEQ ID NO: 3911498 - RNA, 17 nt, Human adenovirus C
gcagcgccagugcgcca

SEQ ID NO: 3911499 - RNA, 23 nt, Human adenovirus C
gcagcggcaagagcaagagcagc

SEQ ID NO: 3911500 - RNA, 22 nt, Human adenovirus C
gcagcggcagacaugcagggca

SEQ ID NO: 3911501 - RNA, 23 nt, Human adenovirus C
gcagcggcagacaugcagggcac

SEQ ID NO: 3911502 - RNA, 16 nt, Human adenovirus C
gcagcggguggcgguc

SEQ ID NO: 3911503 - RNA, 19 nt, Human adenovirus C
gcagcgugagcgcgcgcag

SEQ ID NO: 3911504 - RNA, 16 nt, Human adenovirus C
gcagcuggcgcgcugg

SEQ ID NO: 3911505 - RNA, 22 nt, Human adenovirus C
gcagcuguuggaucugcgccag

SEQ ID NO: 3911506 - RNA, 12 nt, Human adenovirus C
gcaggacccagg

SEQ ID NO: 3911507 - RNA, 17 nt, Human adenovirus C
gcaggagcgcugggcgu

SEQ ID NO: 3911508 - RNA, 17 nt, Human adenovirus C
gcaggaggaagccaggc

SEQ ID NO: 3911509 - RNA, 12 nt, Human adenovirus C
gcaggcagaacg

SEQ ID NO: 3911510 - RNA, 15 nt, Human adenovirus C
gcaggcggccgcugc

SEQ ID NO: 3911511 - RNA, 14 nt, Human adenovirus C
gcagggccagcuga

SEQ ID NO: 3911512 - RNA, 14 nt, Human adenovirus C
acacguccuccaug

SEQ ID NO: 3911513 - RNA, 20 nt, Human adenovirus C
acacugcagcaggugcugcc

SEQ ID NO: 3911514 - RNA, 14 nt, Human adenovirus C
acacuggauggccu

SEQ ID NO: 3911515 - RNA, 22 nt, Human adenovirus C
acagaagcaccauguccuuggg

SEQ ID NO: 3911516 - RNA, 19 nt, Human adenovirus C
acagagggcauggagacac

SEQ ID NO: 3911517 - RNA, 22 nt, Human adenovirus C
acagagggcugccugcacuucc

SEQ ID NO: 3911518 - RNA, 20 nt, Human adenovirus C
acagcagcggucacacagaa

SEQ ID NO: 3911519 - RNA, 15 nt, Human adenovirus C
acagcaggaggaagc

SEQ ID NO: 3911520 - RNA, 17 nt, Human adenovirus C
acagccccuacugcacc

SEQ ID NO: 3911521 - RNA, 20 nt, Human adenovirus C
acagccugcaaagggcccug

SEQ ID NO: 3911522 - RNA, 20 nt, Human adenovirus C
acaggucucugcgcucccuc

SEQ ID NO: 3911523 - RNA, 22 nt, Human adenovirus C
acagucuuccaaggugaaaauc

SEQ ID NO: 3911524 - RNA, 20 nt, Human adenovirus C
acaguguauccggugcacuu

SEQ ID NO: 3911525 - RNA, 20 nt, Human adenovirus C
acaucauuuugcugccagga

SEQ ID NO: 3911526 - RNA, 23 nt, Human adenovirus C
acaugcacaucucgggccaggac

SEQ ID NO: 3911527 - RNA, 18 nt, Human adenovirus C
acauguggugguuuucca

SEQ ID NO: 3911528 - RNA, 13 nt, Human adenovirus C
acauucccagcug

SEQ ID NO: 3911529 - RNA, 19 nt, Human adenovirus C
acauugcuuucagggacaa

SEQ ID NO: 3911530 - RNA, 20 nt, Human adenovirus C
accaaccuggaccggcuggu

SEQ ID NO: 3911531 - RNA, 22 nt, Human adenovirus C
accacccuacuuucccagugcc

SEQ ID NO: 3911532 - RNA, 19 nt, Human adenovirus C
accacuaccggcaaccgcc

SEQ ID NO: 3911533 - RNA, 15 nt, Human adenovirus C
accacucgacacggc

SEQ ID NO: 3911534 - RNA, 16 nt, Human adenovirus C
accagcaugaagggca

SEQ ID NO: 3911535 - RNA, 11 nt, Human adenovirus C
accagccacaa

SEQ ID NO: 3911536 - RNA, 20 nt, Human adenovirus C
accaggacgacgcagaggca

SEQ ID NO: 3911537 - RNA, 19 nt, Human adenovirus C
accaguuggaggaguggcu

SEQ ID NO: 3911538 - RNA, 15 nt, Human adenovirus C
accaucgcgcccaca

SEQ ID NO: 3911539 - RNA, 14 nt, Human adenovirus C
accauuuuugcccu

SEQ ID NO: 3911540 - RNA, 21 nt, Human adenovirus C
acccaaaaagaagcugcagcu

SEQ ID NO: 3911541 - RNA, 16 nt, Human adenovirus C
acccacccaaagcaga

SEQ ID NO: 3911542 - RNA, 14 nt, Human adenovirus C
acccacccagcgcc

SEQ ID NO: 3911543 - RNA, 17 nt, Human adenovirus C
acccagcacucggcaga

SEQ ID NO: 3911544 - RNA, 21 nt, Human adenovirus C
acccagcacucggcagaaaca

SEQ ID NO: 3911545 - RNA, 16 nt, Human adenovirus C
accccccacccuugcc

SEQ ID NO: 3911546 - RNA, 21 nt, Human adenovirus C
acccgcccgcgccugcugggc

SEQ ID NO: 3911547 - RNA, 13 nt, Human adenovirus C
acccuccucaccu

SEQ ID NO: 3911548 - RNA, 17 nt, Human adenovirus C
acccuccucaccugccg

SEQ ID NO: 3911549 - RNA, 23 nt, Human adenovirus C
acccuuauccucaucugcagccu

SEQ ID NO: 3911550 - RNA, 16 nt, Human adenovirus C
acccuuccaggagggc

SEQ ID NO: 3911551 - RNA, 13 nt, Human adenovirus C
accgcccgcggga

SEQ ID NO: 3911552 - RNA, 16 nt, Human adenovirus C
accgcgcgcccugggg

SEQ ID NO: 3911553 - RNA, 17 nt, Human adenovirus C
accgcgcgcccuggggc

SEQ ID NO: 3911554 - RNA, 15 nt, Human adenovirus C
accgcucccuggucu

SEQ ID NO: 3911555 - RNA, 22 nt, Human adenovirus C
accggcacuucuucuucuccuu

SEQ ID NO: 3911556 - RNA, 21 nt, Human adenovirus C
accgggguacccaacuccaug

SEQ ID NO: 3911557 - RNA, 17 nt, Human adenovirus C
accgucaagaaaaacac

SEQ ID NO: 3911558 - RNA, 18 nt, Human adenovirus C
accguucgcacuggggcg

SEQ ID NO: 3911559 - RNA, 15 nt, Human adenovirus C
accuaaaugccaacc

SEQ ID NO: 3911560 - RNA, 20 nt, Human adenovirus C
accuaucaccgucacccagc

SEQ ID NO: 3911561 - RNA, 12 nt, Human adenovirus C
accucagcgccu

SEQ ID NO: 3911562 - RNA, 13 nt, Human adenovirus C
accucaggcacca

SEQ ID NO: 3911563 - RNA, 14 nt, Human adenovirus C
accucauggaggcu

SEQ ID NO: 3911564 - RNA, 22 nt, Human adenovirus C
accuccuccuccugccaggcuc

SEQ ID NO: 3911565 - RNA, 15 nt, Human adenovirus C
accucgaccacugcc

SEQ ID NO: 3911566 - RNA, 23 nt, Human adenovirus C
accugaacgggguguuugacaug

SEQ ID NO: 3911567 - RNA, 17 nt, Human adenovirus C
accugagccccgggcug

SEQ ID NO: 3911568 - RNA, 19 nt, Human adenovirus C
accugagccccgggcuggu

SEQ ID NO: 3911569 - RNA, 12 nt, Human adenovirus C
accugagccuuu

SEQ ID NO: 3911570 - RNA, 21 nt, Human adenovirus C
accugagccuuugcgccuuca

SEQ ID NO: 3911571 - RNA, 16 nt, Human adenovirus C
accugaggacuaccac

SEQ ID NO: 3911572 - RNA, 16 nt, Human adenovirus C
accugccagacaagcu

SEQ ID NO: 3911573 - RNA, 23 nt, Human adenovirus C
accugccuccccccgcugacacc

SEQ ID NO: 3911574 - RNA, 14 nt, Human adenovirus C
accugcgcugggcc

SEQ ID NO: 3911575 - RNA, 21 nt, Human adenovirus C
accugcucggacggcaacugu

SEQ ID NO: 3911576 - RNA, 11 nt, Human adenovirus C
accugcuggau

SEQ ID NO: 3911577 - RNA, 23 nt, Human adenovirus C
accugggcuggcgguggcacccg

SEQ ID NO: 3911578 - RNA, 21 nt, Human adenovirus C
accuguguggaagccuggacc

SEQ ID NO: 3911579 - RNA, 16 nt, Human adenovirus C
accuucgccccaggcu

SEQ ID NO: 3911580 - RNA, 15 nt, Human adenovirus C
accuuuccgccgcca

SEQ ID NO: 3911581 - RNA, 19 nt, Human adenovirus C
acgaagccuuccauccaga

SEQ ID NO: 3911582 - RNA, 12 nt, Human adenovirus C
acgagccagagg

SEQ ID NO: 3911583 - RNA, 14 nt, Human adenovirus C
acgagccagaggac

SEQ ID NO: 3911584 - RNA, 18 nt, Human adenovirus C
acgaggaggaggagauga

SEQ ID NO: 3911585 - RNA, 16 nt, Human adenovirus C
acgaucggcaggcuca

SEQ ID NO: 3911586 - RNA, 22 nt, Human adenovirus C
acgauguaaaguuccaagaagc

SEQ ID NO: 3911587 - RNA, 12 nt, Human adenovirus C
acgccaccuucu

SEQ ID NO: 3911588 - RNA, 15 nt, Human adenovirus C
acgccaucaucucug

SEQ ID NO: 3911589 - RNA, 20 nt, Human adenovirus C
acgcccggugagcgcuccac

SEQ ID NO: 3911590 - RNA, 19 nt, Human adenovirus C
acgccucggaguaccugag

SEQ ID NO: 3911591 - RNA, 18 nt, Human adenovirus C
acgcgcagcccgugggcu

SEQ ID NO: 3911592 - RNA, 23 nt, Human adenovirus C
acgcgccaaccgcgguugugcag

SEQ ID NO: 3911593 - RNA, 14 nt, Human adenovirus C
acgcgcccuggagg

SEQ ID NO: 3911594 - RNA, 22 nt, Human adenovirus C
acgcgcgaggcguacgugccgc

SEQ ID NO: 3911595 - RNA, 14 nt, Human adenovirus C
acgcggcagccgcg

SEQ ID NO: 3911596 - RNA, 23 nt, Human adenovirus C
acgcguuccggcagcagccgcag

SEQ ID NO: 3911597 - RNA, 14 nt, Human adenovirus C
acgcucuggccggu

SEQ ID NO: 3911598 - RNA, 16 nt, Human adenovirus C
acgcugcccgagggca

SEQ ID NO: 3911599 - RNA, 20 nt, Human adenovirus C
acgcuggaagacgcggaggc

SEQ ID NO: 3911600 - RNA, 15 nt, Human adenovirus C
acgcuggaccugccu

SEQ ID NO: 3911601 - RNA, 13 nt, Human adenovirus C
acgcuggccagca

SEQ ID NO: 3911602 - RNA, 23 nt, Human adenovirus C
acgcuuguggcgcgcgaggaggu

SEQ ID NO: 3911603 - RNA, 12 nt, Human adenovirus C
acggacaguggc

SEQ ID NO: 3911604 - RNA, 16 nt, Human adenovirus C
acggacgacuggcgcc

SEQ ID NO: 3911605 - RNA, 19 nt, Human adenovirus C
acggccugguaggcgcagc

SEQ ID NO: 3911606 - RNA, 23 nt, Human adenovirus C
acggccugguaggcgcagcaucc

SEQ ID NO: 3911607 - RNA, 19 nt, Human adenovirus C
acggcgacgaggaccugcu

SEQ ID NO: 3911608 - RNA, 22 nt, Human adenovirus C
acggcguccggcucaccaccca

SEQ ID NO: 3911609 - RNA, 16 nt, Human adenovirus C
acgggccagggucaug

SEQ ID NO: 3911610 - RNA, 18 nt, Human adenovirus C
acgggcggcaugcgucgu

SEQ ID NO: 3911611 - RNA, 22 nt, Human adenovirus C
acgguuguuaauuaccugggcg

SEQ ID NO: 3911612 - RNA, 19 nt, Human adenovirus C
acgguuugaggccguccgc

SEQ ID NO: 3911613 - RNA, 17 nt, Human adenovirus C
acgguuuuccuggccaa

SEQ ID NO: 3911614 - RNA, 21 nt, Human adenovirus C
acguccccgguugccucggcg

SEQ ID NO: 3911615 - RNA, 18 nt, Human adenovirus C
acgucgcaccggccgacg

SEQ ID NO: 3911616 - RNA, 17 nt, Human adenovirus C
acgucgccaccgccgcc

SEQ ID NO: 3911617 - RNA, 13 nt, Human adenovirus C
acgucgcgccgca

SEQ ID NO: 3911618 - RNA, 15 nt, Human adenovirus C
acgucuuaaacuggg

SEQ ID NO: 3911619 - RNA, 21 nt, Human adenovirus C
acgugcagaccaaccuggacc

SEQ ID NO: 3911620 - RNA, 14 nt, Human adenovirus C
acgugccgcgggga

SEQ ID NO: 3911621 - RNA, 22 nt, Human adenovirus C
acgugccgcggggacaggagga

SEQ ID NO: 3911622 - RNA, 19 nt, Human adenovirus C
acgugccgggcgaagacgg

SEQ ID NO: 3911623 - RNA, 17 nt, Human adenovirus C
acguggagcucugcaac

SEQ ID NO: 3911624 - RNA, 22 nt, Human adenovirus C
acguggcggccgccgaccuggu

SEQ ID NO: 3911625 - RNA, 21 nt, Human adenovirus C
acuacaccuuucgccagggcu

SEQ ID NO: 3911626 - RNA, 22 nt, Human adenovirus C
acuacccgacgccgaaccacca

SEQ ID NO: 3911627 - RNA, 16 nt, Human adenovirus C
acuaccuugccuacca

SEQ ID NO: 3911628 - RNA, 16 nt, Human adenovirus C
caaauacaaaagcaga

SEQ ID NO: 3911629 - RNA, 19 nt, Human adenovirus C
caaauacaaaagcagacgc

SEQ ID NO: 3911630 - RNA, 17 nt, Human adenovirus C
caaauacuaccucuuug

SEQ ID NO: 3911631 - RNA, 23 nt, Human adenovirus C
caaauauggaacauucccagcug

SEQ ID NO: 3911632 - RNA, 17 nt, Human adenovirus C
caaauccauacacaaau

SEQ ID NO: 3911633 - RNA, 12 nt, Human adenovirus C
caaauccuuuug

SEQ ID NO: 3911634 - RNA, 15 nt, Human adenovirus C
caaaucuucacuucc

SEQ ID NO: 3911635 - RNA, 14 nt, Human adenovirus C
caaauuugaucaaa

SEQ ID NO: 3911636 - RNA, 17 nt, Human adenovirus C
caacaaaaggugguaga

SEQ ID NO: 3911637 - RNA, 15 nt, Human adenovirus C
caacaaucuaugcca

SEQ ID NO: 3911638 - RNA, 11 nt, Human adenovirus C
caacagcagcg

SEQ ID NO: 3911639 - RNA, 15 nt, Human adenovirus C
caacagcgccaaggc

SEQ ID NO: 3911640 - RNA, 15 nt, Human adenovirus C
caacagggucugcca

SEQ ID NO: 3911641 - RNA, 20 nt, Human adenovirus C
caacauaaaagaagcaagca

SEQ ID NO: 3911642 - RNA, 20 nt, Human adenovirus C
caacaugaccaaggacuggu

SEQ ID NO: 3911643 - RNA, 17 nt, Human adenovirus C
caacccuuccaggaggg

SEQ ID NO: 3911644 - RNA, 18 nt, Human adenovirus C
caaccgcgcccaggcggc

SEQ ID NO: 3911645 - RNA, 20 nt, Human adenovirus C
caaccguagaugggacacca

SEQ ID NO: 3911646 - RNA, 19 nt, Human adenovirus C
caaccuaaaggagcugcag

SEQ ID NO: 3911647 - RNA, 21 nt, Human adenovirus C
caaccuccgcuccucaggcgc

SEQ ID NO: 3911648 - RNA, 19 nt, Human adenovirus C
caacgagcgcuccguggcc

SEQ ID NO: 3911649 - RNA, 16 nt, Human adenovirus C
caacgcugguggcuac

SEQ ID NO: 3911650 - RNA, 21 nt, Human adenovirus C
caacggacuaucgcaacacca

SEQ ID NO: 3911651 - RNA, 16 nt, Human adenovirus C
caacgugccgcgggga

SEQ ID NO: 3911652 - RNA, 14 nt, Human adenovirus C
caacucgcugcugc

SEQ ID NO: 3911653 - RNA, 16 nt, Human adenovirus C
caacuggcaaagcaca

SEQ ID NO: 3911654 - RNA, 17 nt, Human adenovirus C
caagaaaaacaccacca

SEQ ID NO: 3911655 - RNA, 19 nt, Human adenovirus C
caagaacaagagcugaaaa

SEQ ID NO: 3911656 - RNA, 12 nt, Human adenovirus C
caagaccaggac

SEQ ID NO: 3911657 - RNA, 15 nt, Human adenovirus C
caagagcaagagcag

SEQ ID NO: 3911658 - RNA, 18 nt, Human adenovirus C
caagagcaagagcagcgg

SEQ ID NO: 3911659 - RNA, 15 nt, Human adenovirus C
caagcacacagacca

SEQ ID NO: 3911660 - RNA, 20 nt, Human adenovirus C
caagccgcucauggcgcagc

SEQ ID NO: 3911661 - RNA, 16 nt, Human adenovirus C
caaggaaauucccacg

SEQ ID NO: 3911662 - RNA, 16 nt, Human adenovirus C
caaggccauggcaccg

SEQ ID NO: 3911663 - RNA, 20 nt, Human adenovirus C
caaggccggaaaccucaccu

SEQ ID NO: 3911664 - RNA, 15 nt, Human adenovirus C
caaggccugcagacc

SEQ ID NO: 3911665 - RNA, 16 nt, Human adenovirus C
caaggccugcccacca

SEQ ID NO: 3911666 - RNA, 19 nt, Human adenovirus C
caaggccugcccaccaccc

SEQ ID NO: 3911667 - RNA, 13 nt, Human adenovirus C
caaggccuggaac

SEQ ID NO: 3911668 - RNA, 23 nt, Human adenovirus C
caaggccuggaacagcagcacag

SEQ ID NO: 3911669 - RNA, 21 nt, Human adenovirus C
caaguacuagcuacuguagcu

SEQ ID NO: 3911670 - RNA, 21 nt, Human adenovirus C
caagucgggcggggggaccaa

SEQ ID NO: 3911671 - RNA, 16 nt, Human adenovirus C
caaucaaucagccucg

SEQ ID NO: 3911672 - RNA, 13 nt, Human adenovirus C
caaugacuacagc

SEQ ID NO: 3911673 - RNA, 12 nt, Human adenovirus C
caauugcagaaa

SEQ ID NO: 3911674 - RNA, 22 nt, Human adenovirus C
cacaaccauccgcggcagcucg

SEQ ID NO: 3911675 - RNA, 14 nt, Human adenovirus C
cacaacgcgcagcc

SEQ ID NO: 3911676 - RNA, 14 nt, Human adenovirus C
cacaagccccacug

SEQ ID NO: 3911677 - RNA, 17 nt, Human adenovirus C
cacaagcucgccugcgc

SEQ ID NO: 3911678 - RNA, 19 nt, Human adenovirus C
cacaagcucgccugcgcca

SEQ ID NO: 3911679 - RNA, 23 nt, Human adenovirus C
cacacaaccuucucggcuucaac

SEQ ID NO: 3911680 - RNA, 19 nt, Human adenovirus C
cacaccucgaccacugccg

SEQ ID NO: 3911681 - RNA, 24 nt, Human adenovirus C
cacaccucguaauaaccuuaaucc

SEQ ID NO: 3911682 - RNA, 20 nt, Human adenovirus C
cacagaacaugaaaagcuua

SEQ ID NO: 3911683 - RNA, 15 nt, Human adenovirus C
cacagaagcaaaggc

SEQ ID NO: 3911684 - RNA, 23 nt, Human adenovirus C
cacagagggcauggagacacaaa

SEQ ID NO: 3911685 - RNA, 21 nt, Human adenovirus C
cacagccugcaaagggcccug

SEQ ID NO: 3911686 - RNA, 18 nt, Human adenovirus C
cacaggguugcagcacug

SEQ ID NO: 3911687 - RNA, 14 nt, Human adenovirus C
cacaguaacugcag

SEQ ID NO: 3911688 - RNA, 15 nt, Human adenovirus C
caccaccaguagcac

SEQ ID NO: 3911689 - RNA, 13 nt, Human adenovirus C
caccaccgccucc

SEQ ID NO: 3911690 - RNA, 15 nt, Human adenovirus C
caccaccgccuccac

SEQ ID NO: 3911691 - RNA, 12 nt, Human adenovirus C
caccaccucccg

SEQ ID NO: 3911692 - RNA, 19 nt, Human adenovirus C
caccacugaaacuuuugcu

SEQ ID NO: 3911693 - RNA, 11 nt, Human adenovirus C
caccaugcgcg

SEQ ID NO: 3911694 - RNA, 22 nt, Human adenovirus C
caccaugcgcgagggacaggcu

SEQ ID NO: 3911695 - RNA, 20 nt, Human adenovirus C
cacccaaugguuuccaagaa

SEQ ID NO: 3911696 - RNA, 17 nt, Human adenovirus C
cacccaccgugcagcug

SEQ ID NO: 3911697 - RNA, 19 nt, Human adenovirus C
cacccaguaccgcagcugg

SEQ ID NO: 3911698 - RNA, 14 nt, Human adenovirus C
caccccgcaccgcu

SEQ ID NO: 3911699 - RNA, 19 nt, Human adenovirus C
cacccgucccaucgcgccc

SEQ ID NO: 3911700 - RNA, 17 nt, Human adenovirus C
cacccuacuuucccagu

SEQ ID NO: 3911701 - RNA, 18 nt, Human adenovirus C
cacccugcgucgcaacca

SEQ ID NO: 3911702 - RNA, 22 nt, Human adenovirus C
caccgccgccgacccggcacug

SEQ ID NO: 3911703 - RNA, 13 nt, Human adenovirus C
caccggcggcagc

SEQ ID NO: 3911704 - RNA, 15 nt, Human adenovirus C
caccggcggcagcgg

SEQ ID NO: 3911705 - RNA, 20 nt, Human adenovirus C
caccggggcgcgcugcggcu

SEQ ID NO: 3911706 - RNA, 22 nt, Human adenovirus C
caccgguugcugcgcccacacc

SEQ ID NO: 3911707 - RNA, 23 nt, Human adenovirus C
caccgucaagaaaaacaccacca

SEQ ID NO: 3911708 - RNA, 23 nt, Human adenovirus C
caccuccuuuccuuccucccaac

SEQ ID NO: 3911709 - RNA, 15 nt, Human adenovirus C
caccucgaccacugc

SEQ ID NO: 3911710 - RNA, 18 nt, Human adenovirus C
caccugucgucagcgcca

SEQ ID NO: 3911711 - RNA, 20 nt, Human adenovirus C
caccuuuuguuccaccgcuc

SEQ ID NO: 3911712 - RNA, 19 nt, Human adenovirus C
cacgaaaaccgccucgggc

SEQ ID NO: 3911713 - RNA, 17 nt, Human adenovirus C
cacgagaaggugcuggc

SEQ ID NO: 3911714 - RNA, 14 nt, Human adenovirus C
cacgagcugcuucc

SEQ ID NO: 3911715 - RNA, 18 nt, Human adenovirus C
cacgaucuuggccuugcu

SEQ ID NO: 3911716 - RNA, 21 nt, Human adenovirus C
cacgccuuugccaacuggccc

SEQ ID NO: 3911717 - RNA, 13 nt, Human adenovirus C
cacgcugcccgag

SEQ ID NO: 3911718 - RNA, 13 nt, Human adenovirus C
cacgcuggccagc

SEQ ID NO: 3911719 - RNA, 18 nt, Human adenovirus C
cacgcuugaagacaaagg

SEQ ID NO: 3911720 - RNA, 18 nt, Human adenovirus C
cacggcguggccuucccc

SEQ ID NO: 3911721 - RNA, 14 nt, Human adenovirus C
cacggcucgcgccc

SEQ ID NO: 3911722 - RNA, 22 nt, Human adenovirus C
cacgguaaagaccccgggcagc

SEQ ID NO: 3911723 - RNA, 18 nt, Human adenovirus C
cacgguguaagcuucuau

SEQ ID NO: 3911724 - RNA, 19 nt, Human adenovirus C
cacgguuaacuccuccucc

SEQ ID NO: 3911725 - RNA, 20 nt, Human adenovirus C
cacguggccaucauaccaca

SEQ ID NO: 3911726 - RNA, 16 nt, Human adenovirus C
cacuaaagcaaggccu

SEQ ID NO: 3911727 - RNA, 21 nt, Human adenovirus C
cacuacaccuuucgccagggc

SEQ ID NO: 3911728 - RNA, 19 nt, Human adenovirus C
cacuaccgcgcgcccuggg

SEQ ID NO: 3911729 - RNA, 19 nt, Human adenovirus C
cacuaguauugccacugcc

SEQ ID NO: 3911730 - RNA, 21 nt, Human adenovirus C
cacuaguauugccacugccac

SEQ ID NO: 3911731 - RNA, 23 nt, Human adenovirus C
cacuccugacguaaccugcggcu

SEQ ID NO: 3911732 - RNA, 13 nt, Human adenovirus C
cacuccugcgccg

SEQ ID NO: 3911733 - RNA, 22 nt, Human adenovirus C
cacucgcccuacuuccgcagcc

SEQ ID NO: 3911734 - RNA, 12 nt, Human adenovirus C
cacucgcuccag

SEQ ID NO: 3911735 - RNA, 13 nt, Human adenovirus C
cacugccgccgcc

SEQ ID NO: 3911736 - RNA, 17 nt, Human adenovirus C
cacuggaacccgccgcc

SEQ ID NO: 3911737 - RNA, 16 nt, Human adenovirus C
cacuguaccgcgaggc

SEQ ID NO: 3911738 - RNA, 18 nt, Human adenovirus C
cacugugguacuucccag

SEQ ID NO: 3911739 - RNA, 16 nt, Human adenovirus C
cacuguuacucagcca

SEQ ID NO: 3911740 - RNA, 22 nt, Human adenovirus C
cacuguuggauguggacgccua

SEQ ID NO: 3911741 - RNA, 14 nt, Human adenovirus C
cacuuacuggcugc

SEQ ID NO: 3911742 - RNA, 16 nt, Human adenovirus C
cacuuacuggcugcag

SEQ ID NO: 3911743 - RNA, 15 nt, Human adenovirus C
cagaaacuuccagcc

SEQ ID NO: 3911744 - RNA, 18 nt, Human adenovirus C
ggcaacccuuccaggagg

SEQ ID NO: 3911745 - RNA, 17 nt, Human adenovirus C
ggcaagauaucggcacc

SEQ ID NO: 3911746 - RNA, 20 nt, Human adenovirus C
ggcaccaggugcacgcgcca

SEQ ID NO: 3911747 - RNA, 22 nt, Human adenovirus C
ggcacccaaaaagaagcugcag

SEQ ID NO: 3911748 - RNA, 19 nt, Human adenovirus C
ggcacccgcgcgcgcuggc

SEQ ID NO: 3911749 - RNA, 16 nt, Human adenovirus C
ggcagaaacagagggc

SEQ ID NO: 3911750 - RNA, 17 nt, Human adenovirus C
ggcagaggcggcgcugc

SEQ ID NO: 3911751 - RNA, 20 nt, Human adenovirus C
ggcagcaaugccuggaggag

SEQ ID NO: 3911752 - RNA, 23 nt, Human adenovirus C
ggcagcagcggaugauccuccag

SEQ ID NO: 3911753 - RNA, 20 nt, Human adenovirus C
ggcagccaggugacacuaac

SEQ ID NO: 3911754 - RNA, 14 nt, Human adenovirus C
ggcagccgcggcaa

SEQ ID NO: 3911755 - RNA, 14 nt, Human adenovirus C
ggcagccuggaggc

SEQ ID NO: 3911756 - RNA, 13 nt, Human adenovirus C
ggcagcggcagca

SEQ ID NO: 3911757 - RNA, 12 nt, Human adenovirus C
ggcagcgggugg

SEQ ID NO: 3911758 - RNA, 15 nt, Human adenovirus C
ggcagcuggggccgg

SEQ ID NO: 3911759 - RNA, 22 nt, Human adenovirus C
ggcagcuggggccggaccuggg

SEQ ID NO: 3911760 - RNA, 17 nt, Human adenovirus C
ggcaggacccuggugcu

SEQ ID NO: 3911761 - RNA, 23 nt, Human adenovirus C
ggcaggaggacacgggcagccug

SEQ ID NO: 3911762 - RNA, 16 nt, Human adenovirus C
ggcagucugcagcgcu

SEQ ID NO: 3911763 - RNA, 15 nt, Human adenovirus C
ggcauccgcgccgca

SEQ ID NO: 3911764 - RNA, 11 nt, Human adenovirus C
ggcaugacuuc

SEQ ID NO: 3911765 - RNA, 14 nt, Human adenovirus C
ggccaaccaggcag

SEQ ID NO: 3911766 - RNA, 20 nt, Human adenovirus C
ggccaagaacaagagcugaa

SEQ ID NO: 3911767 - RNA, 18 nt, Human adenovirus C
ggccacacccggcgccag

SEQ ID NO: 3911768 - RNA, 12 nt, Human adenovirus C
ggccagcuguug

SEQ ID NO: 3911769 - RNA, 17 nt, Human adenovirus C
ggccagcuguuggggug

SEQ ID NO: 3911770 - RNA, 20 nt, Human adenovirus C
ggccagcuguuggggugagu

SEQ ID NO: 3911771 - RNA, 18 nt, Human adenovirus C
ggccaggacgccucggag

SEQ ID NO: 3911772 - RNA, 14 nt, Human adenovirus C
ggccagggugcgcu

SEQ ID NO: 3911773 - RNA, 18 nt, Human adenovirus C
ggccaguguuugagcaca

SEQ ID NO: 3911774 - RNA, 15 nt, Human adenovirus C
ggccaugagcugcga

SEQ ID NO: 3911775 - RNA, 14 nt, Human adenovirus C
ggccaugcaucugu

SEQ ID NO: 3911776 - RNA, 21 nt, Human adenovirus C
ggcccgaugaggccggccugg

SEQ ID NO: 3911777 - RNA, 20 nt, Human adenovirus C
ggcccgcggugaugccuuug

SEQ ID NO: 3911778 - RNA, 21 nt, Human adenovirus C
ggcccuuggcgcgcagcuugc

SEQ ID NO: 3911779 - RNA, 17 nt, Human adenovirus C
ggccgaaaacagggcca

SEQ ID NO: 3911780 - RNA, 19 nt, Human adenovirus C
ggccgaacacucgugcugg

SEQ ID NO: 3911781 - RNA, 21 nt, Human adenovirus C
ggccgcgauguuuagcugcac

SEQ ID NO: 3911782 - RNA, 22 nt, Human adenovirus C
ggccgcgauguuuagcugcacg

SEQ ID NO: 3911783 - RNA, 18 nt, Human adenovirus C
ggccgcggucgcucacau

SEQ ID NO: 3911784 - RNA, 22 nt, Human adenovirus C
ggccgcgucaugcacgcagcac

SEQ ID NO: 3911785 - RNA, 16 nt, Human adenovirus C
ggccggacaggccgcg

SEQ ID NO: 3911786 - RNA, 14 nt, Human adenovirus C
ggccggcaacgcca

SEQ ID NO: 3911787 - RNA, 12 nt, Human adenovirus C
ggccgggcaguu

SEQ ID NO: 3911788 - RNA, 13 nt, Human adenovirus C
ggccucuucuucu

SEQ ID NO: 3911789 - RNA, 14 nt, Human adenovirus C
ggccucuucuucuu

SEQ ID NO: 3911790 - RNA, 16 nt, Human adenovirus C
ggccugaaccgcgagc

SEQ ID NO: 3911791 - RNA, 19 nt, Human adenovirus C
ggccugcaaaauuuccaac

SEQ ID NO: 3911792 - RNA, 23 nt, Human adenovirus C
ggccuggcgcaaaaucuccugca

SEQ ID NO: 3911793 - RNA, 16 nt, Human adenovirus C
ggccugguaggcgcag

SEQ ID NO: 3911794 - RNA, 23 nt, Human adenovirus C
ggccuugcggcagggcgcuguca

SEQ ID NO: 3911795 - RNA, 20 nt, Human adenovirus C
ggcgaaaagcguccgcggcc

SEQ ID NO: 3911796 - RNA, 20 nt, Human adenovirus C
ggcgaccccucauaaacacg

SEQ ID NO: 3911797 - RNA, 15 nt, Human adenovirus C
ggcgaggcgcgccgc

SEQ ID NO: 3911798 - RNA, 19 nt, Human adenovirus C
ggcgauccuaacucugcag

SEQ ID NO: 3911799 - RNA, 13 nt, Human adenovirus C
ggcgauggagcgc

SEQ ID NO: 3911800 - RNA, 14 nt, Human adenovirus C
ggcgauggagcgca

SEQ ID NO: 3911801 - RNA, 15 nt, Human adenovirus C
ggcgauuggcgccgu

SEQ ID NO: 3911802 - RNA, 23 nt, Human adenovirus C
ggcgcacucacagaccugggcca

SEQ ID NO: 3911803 - RNA, 17 nt, Human adenovirus C
ggcgcaggcggcggcaa

SEQ ID NO: 3911804 - RNA, 20 nt, Human adenovirus C
ggcgcaggguccucgucagc

SEQ ID NO: 3911805 - RNA, 20 nt, Human adenovirus C
ggcgcaguaguccaggguuu

SEQ ID NO: 3911806 - RNA, 17 nt, Human adenovirus C
ggcgccauccaccacca

SEQ ID NO: 3911807 - RNA, 14 nt, Human adenovirus C
ggcgcggcggcugc

SEQ ID NO: 3911808 - RNA, 13 nt, Human adenovirus C
ggcgcugcagagc

SEQ ID NO: 3911809 - RNA, 18 nt, Human adenovirus C
ggcgcugcagagccagcc

SEQ ID NO: 3911810 - RNA, 18 nt, Human adenovirus C
ggcgcuggguucccccuu

SEQ ID NO: 3911811 - RNA, 18 nt, Human adenovirus C
ggcggcaggagcagagcc

SEQ ID NO: 3911812 - RNA, 18 nt, Human adenovirus C
ggcggccaugcgggccgc

SEQ ID NO: 3911813 - RNA, 17 nt, Human adenovirus C
ggcggcgacgacggcgc

SEQ ID NO: 3911814 - RNA, 20 nt, Human adenovirus C
ggcggcggaguuuggccgua

SEQ ID NO: 3911815 - RNA, 14 nt, Human adenovirus C
ggcggcggcaggag

SEQ ID NO: 3911816 - RNA, 13 nt, Human adenovirus C
ggcggcggcccug

SEQ ID NO: 3911817 - RNA, 17 nt, Human adenovirus C
ggcggcuauuaccacca

SEQ ID NO: 3911818 - RNA, 17 nt, Human adenovirus C
ggcgggcggugggccgc

SEQ ID NO: 3911819 - RNA, 15 nt, Human adenovirus C
ggcggggaccacaga

SEQ ID NO: 3911820 - RNA, 18 nt, Human adenovirus C
ggcggucccacagcucgg

SEQ ID NO: 3911821 - RNA, 17 nt, Human adenovirus C
ggcggugcgggcggcgc

SEQ ID NO: 3911822 - RNA, 15 nt, Human adenovirus C
ggcgucgaugacuug

SEQ ID NO: 3911823 - RNA, 13 nt, Human adenovirus C
ggcgugcuggaca

SEQ ID NO: 3911824 - RNA, 14 nt, Human adenovirus C
ggcguggccuuccc

SEQ ID NO: 3911825 - RNA, 15 nt, Human adenovirus C
ggcguguggcagcaa

SEQ ID NO: 3911826 - RNA, 19 nt, Human adenovirus C
ggcucgcguccaggccagc

SEQ ID NO: 3911827 - RNA, 18 nt, Human adenovirus C
ggcugcucugcucggaag

SEQ ID NO: 3911828 - RNA, 17 nt, Human adenovirus C
ggcuggcacgggcagcg

SEQ ID NO: 3911829 - RNA, 20 nt, Human adenovirus C
ggcuucuacauuccagaaag

SEQ ID NO: 3911830 - RNA, 22 nt, Human adenovirus C
ggcuuucgcuguacggcaguag

SEQ ID NO: 3911831 - RNA, 21 nt, Human adenovirus C
gggaagagcuggaagaaccau

SEQ ID NO: 3911832 - RNA, 13 nt, Human adenovirus C
gggacaccacugg

SEQ ID NO: 3911833 - RNA, 21 nt, Human adenovirus C
gggagaucagcugggaagaaa

SEQ ID NO: 3911834 - RNA, 19 nt, Human adenovirus C
gggagcggggggcuucuga

SEQ ID NO: 3911835 - RNA, 16 nt, Human adenovirus C
gggauagagagccuag

SEQ ID NO: 3911836 - RNA, 19 nt, Human adenovirus C
gggauggcgcaggcggcgg

SEQ ID NO: 3911837 - RNA, 19 nt, Human adenovirus C
gggauuugaggugcccgag

SEQ ID NO: 3911838 - RNA, 16 nt, Human adenovirus C
gggcaggagcuggugc

SEQ ID NO: 3911839 - RNA, 18 nt, Human adenovirus C
gggccaggucggcgacaa

SEQ ID NO: 3911840 - RNA, 16 nt, Human adenovirus C
gggcccauuacagugu

SEQ ID NO: 3911841 - RNA, 19 nt, Human adenovirus C
gggccccaagccgacgcgc

SEQ ID NO: 3911842 - RNA, 14 nt, Human adenovirus C
gggcccccggaggu

SEQ ID NO: 3911843 - RNA, 23 nt, Human adenovirus C
gggccgcucgaaggcuggccgcg

SEQ ID NO: 3911844 - RNA, 19 nt, Human adenovirus C
gggcgagguauucagcuca

SEQ ID NO: 3911845 - RNA, 19 nt, Human adenovirus C
gggcgcacucacagaccug

SEQ ID NO: 3911846 - RNA, 15 nt, Human adenovirus C
gggcguagagcuugg

SEQ ID NO: 3911847 - RNA, 13 nt, Human adenovirus C
gggcuagguccag

SEQ ID NO: 3911848 - RNA, 20 nt, Human adenovirus C
gggcucccacaggcgaccgc

SEQ ID NO: 3911849 - RNA, 21 nt, Human adenovirus C
gggcugcucugcucggaagac

SEQ ID NO: 3911850 - RNA, 18 nt, Human adenovirus C
gggcuguacauccugcac

SEQ ID NO: 3911851 - RNA, 14 nt, Human adenovirus C
gggcuucugaggcu

SEQ ID NO: 3911852 - RNA, 15 nt, Human adenovirus C
ggggccggaccuggg

SEQ ID NO: 3911853 - RNA, 19 nt, Human adenovirus C
ggguaucauggcggacgac

SEQ ID NO: 3911854 - RNA, 21 nt, Human adenovirus C
gggugauggugucgcgcucgc

SEQ ID NO: 3911855 - RNA, 19 nt, Human adenovirus C
ggguggugcacgcuggcca

SEQ ID NO: 3911856 - RNA, 14 nt, Human adenovirus C
gggugguggcggug

SEQ ID NO: 3911857 - RNA, 15 nt, Human adenovirus C
gggugguggcggugu

SEQ ID NO: 3911858 - RNA, 22 nt, Human adenovirus C
ggguguucuugcuggucaggca

SEQ ID NO: 3911859 - RNA, 13 nt, Human adenovirus C
gguaacaggaggg

SEQ ID NO: 3911860 - RNA, 22 nt, Human adenovirus C
uauaacucaccugaaaaucaga

SEQ ID NO: 3911861 - RNA, 18 nt, Human adenovirus C
uauaccuuuuuaaugcau

SEQ ID NO: 3911862 - RNA, 18 nt, Human adenovirus C
uauauccacucucucaaa

SEQ ID NO: 3911863 - RNA, 21 nt, Human adenovirus C
uaucagcgccggguggugcac

SEQ ID NO: 3911864 - RNA, 13 nt, Human adenovirus C
uaucccuccgggg

SEQ ID NO: 3911865 - RNA, 15 nt, Human adenovirus C
uaugacacagaaacc

SEQ ID NO: 3911866 - RNA, 15 nt, Human adenovirus C
uaugagcaauucaag

SEQ ID NO: 3911867 - RNA, 20 nt, Human adenovirus C
uaugcaccccgcaccgcucc

SEQ ID NO: 3911868 - RNA, 14 nt, Human adenovirus C
uaugcacugcaggg

SEQ ID NO: 3911869 - RNA, 22 nt, Human adenovirus C
uauggaucuuaugccaggccua

SEQ ID NO: 3911870 - RNA, 13 nt, Human adenovirus C
uauguucccagcc

SEQ ID NO: 3911871 - RNA, 22 nt, Human adenovirus C
uauuuccugaagcaaaaccagg

SEQ ID NO: 3911872 - RNA, 15 nt, Human adenovirus C
ucaaacccagcuuca

SEQ ID NO: 3911873 - RNA, 20 nt, Human adenovirus C
ucaacgcgcgcgcagccucc

SEQ ID NO: 3911874 - RNA, 15 nt, Human adenovirus C
ucaacgcugguggcu

SEQ ID NO: 3911875 - RNA, 19 nt, Human adenovirus C
ucaacggaauccgcgccca

SEQ ID NO: 3911876 - RNA, 15 nt, Human adenovirus C
ucaacuaacauaaac

SEQ ID NO: 3911877 - RNA, 19 nt, Human adenovirus C
ucaagaaaaacaccaccac

SEQ ID NO: 3911878 - RNA, 13 nt, Human adenovirus C
ucaaguacuagcu

SEQ ID NO: 3911879 - RNA, 19 nt, Human adenovirus C
ucaauguuggcacaacaca

SEQ ID NO: 3911880 - RNA, 17 nt, Human adenovirus C
ucacagaccugggccaa

SEQ ID NO: 3911881 - RNA, 13 nt, Human adenovirus C
ucaccacccaggu

SEQ ID NO: 3911882 - RNA, 19 nt, Human adenovirus C
ucaccgguugcugcgccca

SEQ ID NO: 3911883 - RNA, 16 nt, Human adenovirus C
ucaccugaaaaucaga

SEQ ID NO: 3911884 - RNA, 19 nt, Human adenovirus C
ucacgcucgcuugguccug

SEQ ID NO: 3911885 - RNA, 16 nt, Human adenovirus C
ucacugucgcugcaac

SEQ ID NO: 3911886 - RNA, 15 nt, Human adenovirus C
ucacugugcccccca

SEQ ID NO: 3911887 - RNA, 14 nt, Human adenovirus C
ucacuuggugcugg

SEQ ID NO: 3911888 - RNA, 19 nt, Human adenovirus C
ucagacaaugcagaaacac

SEQ ID NO: 3911889 - RNA, 19 nt, Human adenovirus C
ucagagaagaacaugccgc

SEQ ID NO: 3911890 - RNA, 22 nt, Human adenovirus C
ucagccacuuaaaaaaacaaag

SEQ ID NO: 3911891 - RNA, 21 nt, Human adenovirus C
ucagcgcagcggugcagccac

SEQ ID NO: 3911892 - RNA, 15 nt, Human adenovirus C
ucagcgccucccaaa

SEQ ID NO: 3911893 - RNA, 20 nt, Human adenovirus C
ucagcuggggcucgcugugg

SEQ ID NO: 3911894 - RNA, 21 nt, Human adenovirus C
ucaggcgcauguggacgagca

SEQ ID NO: 3911895 - RNA, 12 nt, Human adenovirus C
ucaggcgccgcc

SEQ ID NO: 3911896 - RNA, 17 nt, Human adenovirus C
ucaggcuacuaagaaaa

SEQ ID NO: 3911897 - RNA, 14 nt, Human adenovirus C
ucaguaccaacaga

SEQ ID NO: 3911898 - RNA, 22 nt, Human adenovirus C
ucagugcaacaugaccaaggac

SEQ ID NO: 3911899 - RNA, 22 nt, Human adenovirus C
ucauagauuggacggucugaaa

SEQ ID NO: 3911900 - RNA, 16 nt, Human adenovirus C
ucauauuuccugaagc

SEQ ID NO: 3911901 - RNA, 13 nt, Human adenovirus C
ucaucugcagccu

SEQ ID NO: 3911902 - RNA, 17 nt, Human adenovirus C
ucaugcugcgggguggu

SEQ ID NO: 3911903 - RNA, 19 nt, Human adenovirus C
ucauggcggggaccacaga

SEQ ID NO: 3911904 - RNA, 21 nt, Human adenovirus C
ucauugugcucaacccacaca

SEQ ID NO: 3911905 - RNA, 23 nt, Human adenovirus C
ucauuuuuguuuugcugauuuuu

SEQ ID NO: 3911906 - RNA, 13 nt, Human adenovirus C
uccaagagcuucu

SEQ ID NO: 3911907 - RNA, 14 nt, Human adenovirus C
uccaagauggcuac

SEQ ID NO: 3911908 - RNA, 18 nt, Human adenovirus C
uccacagcggcggcagca

SEQ ID NO: 3911909 - RNA, 14 nt, Human adenovirus C
uccaccggccgugg

SEQ ID NO: 3911910 - RNA, 20 nt, Human adenovirus C
uccacggacgacuggcgcca

SEQ ID NO: 3911911 - RNA, 16 nt, Human adenovirus C
uccagacgggccaggg

SEQ ID NO: 3911912 - RNA, 18 nt, Human adenovirus C
uccagagcgcccuccacc

SEQ ID NO: 3911913 - RNA, 21 nt, Human adenovirus C
uccagaggaccucugcacucu

SEQ ID NO: 3911914 - RNA, 22 nt, Human adenovirus C
uccagcuuauucagcaucaccu

SEQ ID NO: 3911915 - RNA, 14 nt, Human adenovirus C
uccaggcgacgagc

SEQ ID NO: 3911916 - RNA, 22 nt, Human adenovirus C
uccaggcggucccacagcucgg

SEQ ID NO: 3911917 - RNA, 22 nt, Human adenovirus C
uccauagagcagcugaccacuu

SEQ ID NO: 3911918 - RNA, 16 nt, Human adenovirus C
uccauccggcccaggg

SEQ ID NO: 3911919 - RNA, 23 nt, Human adenovirus C
ucccaaaccucagcgccucccaa

SEQ ID NO: 3911920 - RNA, 14 nt, Human adenovirus C
ucccacggcaugcu

SEQ ID NO: 3911921 - RNA, 20 nt, Human adenovirus C
ucccagcugcuacaacaaac

SEQ ID NO: 3911922 - RNA, 16 nt, Human adenovirus C
ucccagggaacaaccc

SEQ ID NO: 3911923 - RNA, 21 nt, Human adenovirus C
ucccaucgcgcccauggcuac

SEQ ID NO: 3911924 - RNA, 18 nt, Human adenovirus C
ucccguagaggagccucc

SEQ ID NO: 3911925 - RNA, 17 nt, Human adenovirus C
ucccuuagaaccaaagu

SEQ ID NO: 3911926 - RNA, 23 nt, Human adenovirus C
uccgcaagcggcaacccuuccag

SEQ ID NO: 3911927 - RNA, 23 nt, Human adenovirus C
uccgccgaacuucauaaccagca

SEQ ID NO: 3911928 - RNA, 15 nt, Human adenovirus C
uccgccgccaacaug

SEQ ID NO: 3911929 - RNA, 16 nt, Human adenovirus C
uccgccguaggcaugc

SEQ ID NO: 3911930 - RNA, 13 nt, Human adenovirus C
uccguccugcagg

SEQ ID NO: 3911931 - RNA, 21 nt, Human adenovirus C
uccguggccuugcaggcgcag

SEQ ID NO: 3911932 - RNA, 21 nt, Human adenovirus C
uccucagcgaugauucgcacc

SEQ ID NO: 3911933 - RNA, 14 nt, Human adenovirus C
uccuccugccaggc

SEQ ID NO: 3911934 - RNA, 18 nt, Human adenovirus C
uccucggagccgcgcucc

SEQ ID NO: 3911935 - RNA, 20 nt, Human adenovirus C
uccucugauaguuacuagcg

SEQ ID NO: 3911936 - RNA, 12 nt, Human adenovirus C
uccugccccucc

SEQ ID NO: 3911937 - RNA, 16 nt, Human adenovirus C
uccuggauuugggagg

SEQ ID NO: 3911938 - RNA, 19 nt, Human adenovirus C
uccuuccuaucaaccagaa

SEQ ID NO: 3911939 - RNA, 13 nt, Human adenovirus C
ucgaugcuccccu

SEQ ID NO: 3911940 - RNA, 22 nt, Human adenovirus C
ucgccagcccgugcuggccccg

SEQ ID NO: 3911941 - RNA, 15 nt, Human adenovirus C
ucgccccaggcuggg

SEQ ID NO: 3911942 - RNA, 18 nt, Human adenovirus C
ucgccccaucaucgucac

SEQ ID NO: 3911943 - RNA, 13 nt, Human adenovirus C
ucgccugcgccau

SEQ ID NO: 3911944 - RNA, 15 nt, Human adenovirus C
ucgcguccaggccag

SEQ ID NO: 3911945 - RNA, 16 nt, Human adenovirus C
ucgcguccaggccagc

SEQ ID NO: 3911946 - RNA, 19 nt, Human adenovirus C
ucgcuacaaccuccgcucc

SEQ ID NO: 3911947 - RNA, 16 nt, Human adenovirus C
ucgcucccaccaugcg

SEQ ID NO: 3911948 - RNA, 22 nt, Human adenovirus C
ucggaagacuaucugccugaag

SEQ ID NO: 3911949 - RNA, 21 nt, Human adenovirus C
ucggccccaccgguucuucac

SEQ ID NO: 3911950 - RNA, 14 nt, Human adenovirus C
ucgucauaggccau

SEQ ID NO: 3911951 - RNA, 22 nt, Human adenovirus C
ucguggcuacaccuaccgcccc

SEQ ID NO: 3911952 - RNA, 20 nt, Human adenovirus C
ucuacagccccuacugcacc

SEQ ID NO: 3911953 - RNA, 20 nt, Human adenovirus C
ucuacuggggcuccugucgc

SEQ ID NO: 3911954 - RNA, 18 nt, Human adenovirus C
ucuauguggaaucaggcu

SEQ ID NO: 3911955 - RNA, 17 nt, Human adenovirus C
ucucagaugcugaccug

SEQ ID NO: 3911956 - RNA, 15 nt, Human adenovirus C
ucuccgcguccggcu

SEQ ID NO: 3911957 - RNA, 13 nt, Human adenovirus C
ucuccugcacguc

SEQ ID NO: 3911958 - RNA, 15 nt, Human adenovirus C
ucucuuccuccugga

SEQ ID NO: 3911959 - RNA, 20 nt, Human adenovirus C
ucugacaaccccaacaccua

SEQ ID NO: 3911960 - RNA, 16 nt, Human adenovirus C
ucugcagcgcugccaa

SEQ ID NO: 3911961 - RNA, 21 nt, Human adenovirus C
ucugccagcgccugcacugca

SEQ ID NO: 3911962 - RNA, 17 nt, Human adenovirus C
ucugcccgccaccugcu

SEQ ID NO: 3911963 - RNA, 20 nt, Human adenovirus C
ucugcgacgcguugcaagag

SEQ ID NO: 3911964 - RNA, 12 nt, Human adenovirus C
ucuggacuacau

SEQ ID NO: 3911965 - RNA, 17 nt, Human adenovirus C
ucuggugacuuggcacc

SEQ ID NO: 3911966 - RNA, 21 nt, Human adenovirus C
ucugguuccggaugaaaaagg

SEQ ID NO: 3911967 - RNA, 22 nt, Human adenovirus C
ucugugccuuaggguugccgcc

SEQ ID NO: 3911968 - RNA, 20 nt, Human adenovirus C
ucuuaugccaggccuacaaa

SEQ ID NO: 3911969 - RNA, 15 nt, Human adenovirus C
ucuuauuaaaaccau

SEQ ID NO: 3911970 - RNA, 17 nt, Human adenovirus C
ucuucagcaaauacugc

SEQ ID NO: 3911971 - RNA, 18 nt, Human adenovirus C
ucuucauucagccgccgc

SEQ ID NO: 3911972 - RNA, 12 nt, Human adenovirus C
ucuuccuccugg

SEQ ID NO: 3911973 - RNA, 19 nt, Human adenovirus C
ucuucggcaucaaggaagg

SEQ ID NO: 3911974 - RNA, 23 nt, Human adenovirus C
ucuugcauacggccgccagagcu

SEQ ID NO: 3911975 - RNA, 16 nt, Human adenovirus C
ucuugcuggucaggca

SEQ ID NO: 3911976 - RNA, 21 nt, Human adenovirus C
aaaaagaagcugcagcugccg

SEQ ID NO: 3911977 - RNA, 23 nt, Human adenovirus C
aaaaccuaucaccgucacccagc

SEQ ID NO: 3911978 - RNA, 19 nt, Human adenovirus C
aaaacuacgucuuaaacug

SEQ ID NO: 3911979 - RNA, 14 nt, Human adenovirus C
aaaaggcaaacugc

SEQ ID NO: 3911980 - RNA, 22 nt, Human adenovirus C
aaaaggcuguccguguccccgu

SEQ ID NO: 3911981 - RNA, 21 nt, Human adenovirus C
aaaaugugggagucaaguacu

SEQ ID NO: 3911982 - RNA, 12 nt, Human adenovirus C
cgcgcccauggc

SEQ ID NO: 3911983 - RNA, 19 nt, Human adenovirus C
cgcgccuaccaccuucccc

SEQ ID NO: 3911984 - RNA, 13 nt, Human adenovirus C
cgcgcgcagcagc

SEQ ID NO: 3911985 - RNA, 13 nt, Human adenovirus C
cgcgcgcuggggc

SEQ ID NO: 3911986 - RNA, 16 nt, Human adenovirus C
cgcgcgcuggggcagg

SEQ ID NO: 3911987 - RNA, 18 nt, Human adenovirus C
cgcgcggagguugcuggc

SEQ ID NO: 3911988 - RNA, 20 nt, Human adenovirus C
cgcgcggcggcggcccugcu

SEQ ID NO: 3911989 - RNA, 17 nt, Human adenovirus C
cgcgcggcgggcggugg

SEQ ID NO: 3911990 - RNA, 17 nt, Human adenovirus C
cgcgcgucccugcgccg

SEQ ID NO: 3911991 - RNA, 11 nt, Human adenovirus C
cgcggagcccg

SEQ ID NO: 3911992 - RNA, 20 nt, Human adenovirus C
cgcggcaaacgcucugcaac

SEQ ID NO: 3911993 - RNA, 21 nt, Human adenovirus C
cgcggcaaacgcucugcaaca

SEQ ID NO: 3911994 - RNA, 13 nt, Human adenovirus C
cgcggccgcacug

SEQ ID NO: 3911995 - RNA, 16 nt, Human adenovirus C
cgcggcgauuggcgcc

SEQ ID NO: 3911996 - RNA, 15 nt, Human adenovirus C
cgcggcgccgggccc

SEQ ID NO: 3911997 - RNA, 14 nt, Human adenovirus C
cgcggcggcggccc

SEQ ID NO: 3911998 - RNA, 15 nt, Human adenovirus C
cgcggcggcugcugc

SEQ ID NO: 3911999 - RNA, 19 nt, Human adenovirus C
cgcggcgugcuggacaggg

SEQ ID NO: 3912000 - RNA, 20 nt, Human adenovirus C
cgcgggcacuaccgcgcgcc

SEQ ID NO: 3912001 - RNA, 19 nt, Human adenovirus C
cgcgggcaggagcuggugc

SEQ ID NO: 3912002 - RNA, 18 nt, Human adenovirus C
cgcgggcccuugcuuccc

SEQ ID NO: 3912003 - RNA, 21 nt, Human adenovirus C
cgcgggcgcugaccugcgcug

SEQ ID NO: 3912004 - RNA, 20 nt, Human adenovirus C
cgcgggcuagguccagguga

SEQ ID NO: 3912005 - RNA, 21 nt, Human adenovirus C
cgcggugcaggcggccgcugc

SEQ ID NO: 3912006 - RNA, 21 nt, Human adenovirus C
cgcguagcacgucgccaccgc

SEQ ID NO: 3912007 - RNA, 13 nt, Human adenovirus C
cgcguccaggcca

SEQ ID NO: 3912008 - RNA, 17 nt, Human adenovirus C
cgcguccaucuggucag

SEQ ID NO: 3912009 - RNA, 17 nt, Human adenovirus C
cgcgucggccagguagc

SEQ ID NO: 3912010 - RNA, 22 nt, Human adenovirus C
cgcguucguccucacucucuuc

SEQ ID NO: 3912011 - RNA, 17 nt, Human adenovirus C
cgcucaguugacgggga

SEQ ID NO: 3912012 - RNA, 22 nt, Human adenovirus C
cgcuccacgguggcggcgaggu

SEQ ID NO: 3912013 - RNA, 18 nt, Human adenovirus C
cgcucgagaucaggcuac

SEQ ID NO: 3912014 - RNA, 20 nt, Human adenovirus C
cgcucgucgggcaccaggug

SEQ ID NO: 3912015 - RNA, 16 nt, Human adenovirus C
cgcugaccugcgcugg

SEQ ID NO: 3912016 - RNA, 18 nt, Human adenovirus C
cgcugcgucuggcgccca

SEQ ID NO: 3912017 - RNA, 18 nt, Human adenovirus C
cgcuggaaaaguccaccc

SEQ ID NO: 3912018 - RNA, 22 nt, Human adenovirus C
cgcuggaagacguugaagcugg

SEQ ID NO: 3912019 - RNA, 16 nt, Human adenovirus C
cgcuggaccugccucc

SEQ ID NO: 3912020 - RNA, 14 nt, Human adenovirus C
cgcuggccagcacg

SEQ ID NO: 3912021 - RNA, 17 nt, Human adenovirus C
cgcuggccgcucuucau

SEQ ID NO: 3912022 - RNA, 14 nt, Human adenovirus C
cgcuguggagcggc

SEQ ID NO: 3912023 - RNA, 16 nt, Human adenovirus C
cgcuucacuggacucu

SEQ ID NO: 3912024 - RNA, 14 nt, Human adenovirus C
cgcuugaggaggag

SEQ ID NO: 3912025 - RNA, 19 nt, Human adenovirus C
cgcuugcuuguauuccccu

SEQ ID NO: 3912026 - RNA, 19 nt, Human adenovirus C
cggaaacagggacgagccc

SEQ ID NO: 3912027 - RNA, 15 nt, Human adenovirus C
cggaaaccucaccuc

SEQ ID NO: 3912028 - RNA, 16 nt, Human adenovirus C
cggaacauuaacaaaa

SEQ ID NO: 3912029 - RNA, 13 nt, Human adenovirus C
cggaggaguccag

SEQ ID NO: 3912030 - RNA, 21 nt, Human adenovirus C
cggaggcucucuucagcaaau

SEQ ID NO: 3912031 - RNA, 22 nt, Human adenovirus C
cggagucaacuuugguagcugc

SEQ ID NO: 3912032 - RNA, 14 nt, Human adenovirus C
cggagugcugggcc

SEQ ID NO: 3912033 - RNA, 14 nt, Human adenovirus C
cggcaccagcaaua

SEQ ID NO: 3912034 - RNA, 21 nt, Human adenovirus C
cggcacugccgcccaacgcgc

SEQ ID NO: 3912035 - RNA, 18 nt, Human adenovirus C
cggcagacaugcagggca

SEQ ID NO: 3912036 - RNA, 14 nt, Human adenovirus C
cggcagacgacagc

SEQ ID NO: 3912037 - RNA, 21 nt, Human adenovirus C
cggcagaugcgccccccuccu

SEQ ID NO: 3912038 - RNA, 14 nt, Human adenovirus C
cggcagcagccgca

SEQ ID NO: 3912039 - RNA, 20 nt, Human adenovirus C
cggccaaucaagcagguggc

SEQ ID NO: 3912040 - RNA, 21 nt, Human adenovirus C
cggccaugaacugcucgaucu

SEQ ID NO: 3912041 - RNA, 16 nt, Human adenovirus C
cggccauucagaccgu

SEQ ID NO: 3912042 - RNA, 20 nt, Human adenovirus C
cggccgacgggcggccaugc

SEQ ID NO: 3912043 - RNA, 14 nt, Human adenovirus C
cggccgcugcggcc

SEQ ID NO: 3912044 - RNA, 16 nt, Human adenovirus C
cggccgggcaguugcc

SEQ ID NO: 3912045 - RNA, 20 nt, Human adenovirus C
cggcgaguacuaagcgguga

SEQ ID NO: 3912046 - RNA, 16 nt, Human adenovirus C
cggcgauuggcgccgu

SEQ ID NO: 3912047 - RNA, 20 nt, Human adenovirus C
cggcgcaccgggaggcgguc

SEQ ID NO: 3912048 - RNA, 22 nt, Human adenovirus C
cggcgccgcgcgcgggcaggag

SEQ ID NO: 3912049 - RNA, 16 nt, Human adenovirus C
cggcgcgcaacgaagc

SEQ ID NO: 3912050 - RNA, 14 nt, Human adenovirus C
cggcgcgcuccuug

SEQ ID NO: 3912051 - RNA, 14 nt, Human adenovirus C
cggcggcgcgcaac

SEQ ID NO: 3912052 - RNA, 14 nt, Human adenovirus C
cggcggcugcugcg

SEQ ID NO: 3912053 - RNA, 17 nt, Human adenovirus C
cggcggucggagcuuga

SEQ ID NO: 3912054 - RNA, 22 nt, Human adenovirus C
cggcguaagcgguuaggcugga

SEQ ID NO: 3912055 - RNA, 14 nt, Human adenovirus C
cggcgugcuggaca

SEQ ID NO: 3912056 - RNA, 20 nt, Human adenovirus C
cggcuauuaccaccacaccu

SEQ ID NO: 3912057 - RNA, 18 nt, Human adenovirus C
cggcugaagcagggccag

SEQ ID NO: 3912058 - RNA, 15 nt, Human adenovirus C
cggcugcuguugcuu

SEQ ID NO: 3912059 - RNA, 15 nt, Human adenovirus C
cggcuggagcugccc

SEQ ID NO: 3912060 - RNA, 18 nt, Human adenovirus C
cgggacgcucuggccggu

SEQ ID NO: 3912061 - RNA, 16 nt, Human adenovirus C
cgggagagggggcagg

SEQ ID NO: 3912062 - RNA, 22 nt, Human adenovirus C
cgggagagggggcaggggcacg

SEQ ID NO: 3912063 - RNA, 24 nt, Human adenovirus C
cgggcaagauuauacccacaaccu

SEQ ID NO: 3912064 - RNA, 16 nt, Human adenovirus C
cgggcacagcagcgca

SEQ ID NO: 3912065 - RNA, 13 nt, Human adenovirus C
cgggcacuaccgc

SEQ ID NO: 3912066 - RNA, 16 nt, Human adenovirus C
cgggcacuaccgcgcg

SEQ ID NO: 3912067 - RNA, 14 nt, Human adenovirus C
cgggccaugagcug

SEQ ID NO: 3912068 - RNA, 18 nt, Human adenovirus C
cgggcccggugagcuuga

SEQ ID NO: 3912069 - RNA, 17 nt, Human adenovirus C
cgggcggaggagaagcg

SEQ ID NO: 3912070 - RNA, 22 nt, Human adenovirus C
cgggcggcagcggguggcgguc

SEQ ID NO: 3912071 - RNA, 22 nt, Human adenovirus C
cgggcggcaugcgucgugcgca

SEQ ID NO: 3912072 - RNA, 15 nt, Human adenovirus C
cgggcggcgcugcag

SEQ ID NO: 3912073 - RNA, 19 nt, Human adenovirus C
cgggcggcgcugcagagcc

SEQ ID NO: 3912074 - RNA, 23 nt, Human adenovirus C
cgggcugggugugcgcggcacca

SEQ ID NO: 3912075 - RNA, 24 nt, Human adenovirus C
cggggcaaagaagcgcuccgacca

SEQ ID NO: 3912076 - RNA, 21 nt, Human adenovirus C
cgggucaacggaauccgcgcc

SEQ ID NO: 3912077 - RNA, 14 nt, Human adenovirus C
cggucaccagaggc

SEQ ID NO: 3912078 - RNA, 15 nt, Human adenovirus C
cggucgcauuccccu

SEQ ID NO: 3912079 - RNA, 18 nt, Human adenovirus C
cggucucggucguugagg

SEQ ID NO: 3912080 - RNA, 15 nt, Human adenovirus C
cggucuucgcccugc

SEQ ID NO: 3912081 - RNA, 14 nt, Human adenovirus C
cggugaaggggugc

SEQ ID NO: 3912082 - RNA, 21 nt, Human adenovirus C
cgguucaucccuguggaccgc

SEQ ID NO: 3912083 - RNA, 20 nt, Human adenovirus C
cgguucgagucucgggccgg

SEQ ID NO: 3912084 - RNA, 20 nt, Human adenovirus C
cguacgugccgcggcagaac

SEQ ID NO: 3912085 - RNA, 16 nt, Human adenovirus C
cguagcucagugcaac

SEQ ID NO: 3912086 - RNA, 21 nt, Human adenovirus C
cguagguggcgcccucuuccu

SEQ ID NO: 3912087 - RNA, 18 nt, Human adenovirus C
cguaguuucgcaggcgcu

SEQ ID NO: 3912088 - RNA, 15 nt, Human adenovirus C
cgucacccagcacuc

SEQ ID NO: 3912089 - RNA, 14 nt, Human adenovirus C
cgucaucuccagcg

SEQ ID NO: 3912090 - RNA, 19 nt, Human adenovirus C
cgucaucucuacagccccu

SEQ ID NO: 3912091 - RNA, 16 nt, Human adenovirus C
cguccagacgggccag

SEQ ID NO: 3912092 - RNA, 13 nt, Human adenovirus C
cguccugagugug

SEQ ID NO: 3912093 - RNA, 14 nt, Human adenovirus C
cgucgcaaccagga

SEQ ID NO: 3912094 - RNA, 17 nt, Human adenovirus C
cgucgccaccgccgccg

SEQ ID NO: 3912095 - RNA, 14 nt, Human adenovirus C
cgucuagggcgcag

SEQ ID NO: 3912096 - RNA, 15 nt, Human adenovirus C
cgucuggcugcucga

SEQ ID NO: 3912097 - RNA, 20 nt, Human adenovirus C
cgugacacugcagcaggugc

SEQ ID NO: 3912098 - RNA, 16 nt, Human adenovirus C
gaacaagagcugaaaa

SEQ ID NO: 3912099 - RNA, 16 nt, Human adenovirus C
gaacagcagcacaggc

SEQ ID NO: 3912100 - RNA, 12 nt, Human adenovirus C
gaacccccgcgg

SEQ ID NO: 3912101 - RNA, 18 nt, Human adenovirus C
gaaccccggauccggccg

SEQ ID NO: 3912102 - RNA, 19 nt, Human adenovirus C
gaacccuaguauucaaccu

SEQ ID NO: 3912103 - RNA, 15 nt, Human adenovirus C
gaaccugaacggggu

SEQ ID NO: 3912104 - RNA, 19 nt, Human adenovirus C
gaaccuuuggacaccuccc

SEQ ID NO: 3912105 - RNA, 20 nt, Human adenovirus C
gaacgcggguuuggcagggc

SEQ ID NO: 3912106 - RNA, 18 nt, Human adenovirus C
gaacgggguguuugacau

SEQ ID NO: 3912107 - RNA, 23 nt, Human adenovirus C
gaacuauggcagcaaggccugga

SEQ ID NO: 3912108 - RNA, 15 nt, Human adenovirus C
gaagaaacucuggug

SEQ ID NO: 3912109 - RNA, 21 nt, Human adenovirus C
gaagauacagauugagguacu

SEQ ID NO: 3912110 - RNA, 17 nt, Human adenovirus C
gaagccucagaagaaac

SEQ ID NO: 3912111 - RNA, 20 nt, Human adenovirus C
gaagcgugacacgcgcgagg

SEQ ID NO: 3912112 - RNA, 18 nt, Human adenovirus C
gaaggcucgcguccaggc

SEQ ID NO: 3912113 - RNA, 23 nt, Human adenovirus C
gaaggcucgcguccaggccagca

SEQ ID NO: 3912114 - RNA, 12 nt, Human adenovirus C
gaagguggccau

SEQ ID NO: 3912115 - RNA, 22 nt, Human adenovirus C
gaaguauuccauagagcagcug

SEQ ID NO: 3912116 - RNA, 13 nt, Human adenovirus C
gaagucuuugacg

SEQ ID NO: 3912117 - RNA, 21 nt, Human adenovirus C
gaauaugcccuacauccuucc

SEQ ID NO: 3912118 - RNA, 11 nt, Human adenovirus C
gaaucaggcug

SEQ ID NO: 3912119 - RNA, 15 nt, Human adenovirus C
gaaugcgcaggcggu

SEQ ID NO: 3912120 - RNA, 14 nt, Human adenovirus C
gacaaagcccaaga

SEQ ID NO: 3912121 - RNA, 22 nt, Human adenovirus C
gacaacgaggcauucagggaug

SEQ ID NO: 3912122 - RNA, 16 nt, Human adenovirus C
gacaaggagguaaaga

SEQ ID NO: 3912123 - RNA, 14 nt, Human adenovirus C
gacaaguugaaaga

SEQ ID NO: 3912124 - RNA, 18 nt, Human adenovirus C
gacacugcagcaggugcu

SEQ ID NO: 3912125 - RNA, 19 nt, Human adenovirus C
gacacuuucaauaaaggca

SEQ ID NO: 3912126 - RNA, 17 nt, Human adenovirus C
gacagcaacuuggcgau

SEQ ID NO: 3912127 - RNA, 14 nt, Human adenovirus C
gacagcauuugucu

SEQ ID NO: 3912128 - RNA, 13 nt, Human adenovirus C
gacagggaagaaa

SEQ ID NO: 3912129 - RNA, 15 nt, Human adenovirus C
gacaugcagggcacc

SEQ ID NO: 3912130 - RNA, 22 nt, Human adenovirus C
gacauguuggcguugccgcugg

SEQ ID NO: 3912131 - RNA, 21 nt, Human adenovirus C
gacauuucagaucggcggcgc

SEQ ID NO: 3912132 - RNA, 13 nt, Human adenovirus C
gaccaaagcaaac

SEQ ID NO: 3912133 - RNA, 15 nt, Human adenovirus C
gaccaaccggcggca

SEQ ID NO: 3912134 - RNA, 18 nt, Human adenovirus C
gaccaguuaacggucugg

SEQ ID NO: 3912135 - RNA, 15 nt, Human adenovirus C
gaccccgggcagcag

SEQ ID NO: 3912136 - RNA, 17 nt, Human adenovirus C
gaccccuguauauuaau

SEQ ID NO: 3912137 - RNA, 19 nt, Human adenovirus C
gacccgccguuugugccuc

SEQ ID NO: 3912138 - RNA, 13 nt, Human adenovirus C
gaccggcuggugg

SEQ ID NO: 3912139 - RNA, 16 nt, Human adenovirus C
gaccgucuggcugcuc

SEQ ID NO: 3912140 - RNA, 17 nt, Human adenovirus C
gaccgucuggcugcucg

SEQ ID NO: 3912141 - RNA, 19 nt, Human adenovirus C
gaccgugguuugcaacugu

SEQ ID NO: 3912142 - RNA, 22 nt, Human adenovirus C
gaccgugucuagcuugcugacg

SEQ ID NO: 3912143 - RNA, 11 nt, Human adenovirus C
gaccugcacgu

SEQ ID NO: 3912144 - RNA, 16 nt, Human adenovirus C
gaccugcucggacggc

SEQ ID NO: 3912145 - RNA, 23 nt, Human adenovirus C
gacgaagcuuccgaggccgaaga

SEQ ID NO: 3912146 - RNA, 12 nt, Human adenovirus C
gacgacgaggug

SEQ ID NO: 3912147 - RNA, 19 nt, Human adenovirus C
gacgcaaauagaugagccu

SEQ ID NO: 3912148 - RNA, 16 nt, Human adenovirus C
gacgcgggcgggcccc

SEQ ID NO: 3912149 - RNA, 14 nt, Human adenovirus C
gacgcgguggugga

SEQ ID NO: 3912150 - RNA, 23 nt, Human adenovirus C
gacgcguugcaagagcgcagcga

SEQ ID NO: 3912151 - RNA, 13 nt, Human adenovirus C
gacgggguaacgc

SEQ ID NO: 3912152 - RNA, 23 nt, Human adenovirus C
gacuaccuuuccgccgccaacau

SEQ ID NO: 3912153 - RNA, 18 nt, Human adenovirus C
gacuacgguaccgcgcgg

SEQ ID NO: 3912154 - RNA, 14 nt, Human adenovirus C
gacuacucaacccg

SEQ ID NO: 3912155 - RNA, 19 nt, Human adenovirus C
gacuacuugcaucgcgcgg

SEQ ID NO: 3912156 - RNA, 18 nt, Human adenovirus C
gacucgguuagcggccug

SEQ ID NO: 3912157 - RNA, 16 nt, Human adenovirus C
gacucugacaaagccc

SEQ ID NO: 3912158 - RNA, 22 nt, Human adenovirus C
gacugaaugaccaguggagagg

SEQ ID NO: 3912159 - RNA, 18 nt, Human adenovirus C
gacugcgguauaaugguu

SEQ ID NO: 3912160 - RNA, 21 nt, Human adenovirus C
gacugcuacauuaaccuuggg

SEQ ID NO: 3912161 - RNA, 13 nt, Human adenovirus C
gacuggaagaugu

SEQ ID NO: 3912162 - RNA, 20 nt, Human adenovirus C
gacugggguuugacccaguc

SEQ ID NO: 3912163 - RNA, 20 nt, Human adenovirus C
gacuuugcuuuccugagccc

SEQ ID NO: 3912164 - RNA, 17 nt, Human adenovirus C
gagaacgccuaaaacaa

SEQ ID NO: 3912165 - RNA, 21 nt, Human adenovirus C
gagaacuccucacuuaaaaaa

SEQ ID NO: 3912166 - RNA, 22 nt, Human adenovirus C
gagaaggucaucaagacuuugg

SEQ ID NO: 3912167 - RNA, 17 nt, Human adenovirus C
gagaauguuuuaaaaaa

SEQ ID NO: 3912168 - RNA, 11 nt, Human adenovirus C
gagacaugauu

SEQ ID NO: 3912169 - RNA, 19 nt, Human adenovirus C
gagacugcagccuccgccg

SEQ ID NO: 3912170 - RNA, 19 nt, Human adenovirus C
gagagggggcaggggcacg

SEQ ID NO: 3912171 - RNA, 14 nt, Human adenovirus C
gagcaacaacagcg

SEQ ID NO: 3912172 - RNA, 18 nt, Human adenovirus C
gagcacagucaugagcga

SEQ ID NO: 3912173 - RNA, 19 nt, Human adenovirus C
gagcauacuuuccaggaga

SEQ ID NO: 3912174 - RNA, 18 nt, Human adenovirus C
gagccccgggcuggugca

SEQ ID NO: 3912175 - RNA, 19 nt, Human adenovirus C
gagccccgggcuggugcag

SEQ ID NO: 3912176 - RNA, 22 nt, Human adenovirus C
gagcccgacgcgcggaccggga

SEQ ID NO: 3912177 - RNA, 15 nt, Human adenovirus C
gagccugggcuggag

SEQ ID NO: 3912178 - RNA, 19 nt, Human adenovirus C
gagcgacgcaagcuaauga

SEQ ID NO: 3912179 - RNA, 18 nt, Human adenovirus C
gagcgcagcuugagccug

SEQ ID NO: 3912180 - RNA, 21 nt, Human adenovirus C
gagcgcagcuugagccuggcu

SEQ ID NO: 3912181 - RNA, 20 nt, Human adenovirus C
gagcgcuccacccgcaccua

SEQ ID NO: 3912182 - RNA, 21 nt, Human adenovirus C
gagcggggggcuucugaggcu

SEQ ID NO: 3912183 - RNA, 17 nt, Human adenovirus C
gagcuccacgugccggg

SEQ ID NO: 3912184 - RNA, 22 nt, Human adenovirus C
gagcugcccaagacuacucaac

SEQ ID NO: 3912185 - RNA, 14 nt, Human adenovirus C
gaggaagaugaaga

SEQ ID NO: 3912186 - RNA, 16 nt, Human adenovirus C
gaggaauacugggaca

SEQ ID NO: 3912187 - RNA, 18 nt, Human adenovirus C
gaggacacgggcagccug

SEQ ID NO: 3912188 - RNA, 13 nt, Human adenovirus C
gaggacuaccacg

SEQ ID NO: 3912189 - RNA, 18 nt, Human adenovirus C
gaggagcaacagcaggag

SEQ ID NO: 3912190 - RNA, 17 nt, Human adenovirus C
gaggagccuccaccggc

SEQ ID NO: 3912191 - RNA, 16 nt, Human adenovirus C
gaggaggcgccgcacg

SEQ ID NO: 3912192 - RNA, 23 nt, Human adenovirus C
gaggaugaagaagaggaagauga

SEQ ID NO: 3912193 - RNA, 16 nt, Human adenovirus C
gaggccguggcgcagc

SEQ ID NO: 3912194 - RNA, 13 nt, Human adenovirus C
gaggccucccucg

SEQ ID NO: 3912195 - RNA, 18 nt, Human adenovirus C
gaggcuaagugggagggg

SEQ ID NO: 3912196 - RNA, 15 nt, Human adenovirus C
gagggcgagggccug

SEQ ID NO: 3912197 - RNA, 18 nt, Human adenovirus C
gagggcgagggccuggcg

SEQ ID NO: 3912198 - RNA, 20 nt, Human adenovirus C
gagggcguuggacagcaacu

SEQ ID NO: 3912199 - RNA, 23 nt, Human adenovirus C
gagguugaccugacgaccgcgca

SEQ ID NO: 3912200 - RNA, 19 nt, Human adenovirus C
gagguugcuacgggcgggc

SEQ ID NO: 3912201 - RNA, 23 nt, Human adenovirus C
gaguacuaagcggugauguuucu

SEQ ID NO: 3912202 - RNA, 19 nt, Human adenovirus C
gagucaacuuugguagcug

SEQ ID NO: 3912203 - RNA, 23 nt, Human adenovirus C
gaguugcaacagcgcgagcaggc

SEQ ID NO: 3912204 - RNA, 17 nt, Human adenovirus C
gauagcggccgggcagu

SEQ ID NO: 3912205 - RNA, 13 nt, Human adenovirus C
gauaucaacccaa

SEQ ID NO: 3912206 - RNA, 22 nt, Human adenovirus C
gauauccguagauguaccugga

SEQ ID NO: 3912207 - RNA, 20 nt, Human adenovirus C
gauauuuuucuauguggaau

SEQ ID NO: 3912208 - RNA, 15 nt, Human adenovirus C
gaucacaaccccacc

SEQ ID NO: 3912209 - RNA, 17 nt, Human adenovirus C
gaucacuuggugcuggc

SEQ ID NO: 3912210 - RNA, 10 nt, Human adenovirus C
gaucaggcua

SEQ ID NO: 3912211 - RNA, 17 nt, Human adenovirus C
gaucaggcuacuaagaa

SEQ ID NO: 3912212 - RNA, 14 nt, Human adenovirus C
gaucauggagucag

SEQ ID NO: 3912213 - RNA, 20 nt, Human adenovirus C
gauccuaacucugcagaccu

SEQ ID NO: 3912214 - RNA, 22 nt, Human adenovirus C
aggcacccccgcuugaggagga

SEQ ID NO: 3912215 - RNA, 21 nt, Human adenovirus C
aggcagaacgggguucuggaa

SEQ ID NO: 3912216 - RNA, 14 nt, Human adenovirus C
aggcagcuggggcc

SEQ ID NO: 3912217 - RNA, 21 nt, Human adenovirus C
aggcagugcaaaauaagauua

SEQ ID NO: 3912218 - RNA, 15 nt, Human adenovirus C
aggccgaggcagcgg

SEQ ID NO: 3912219 - RNA, 13 nt, Human adenovirus C
aggccggccuggu

SEQ ID NO: 3912220 - RNA, 14 nt, Human adenovirus C
aggccugcagaccg

SEQ ID NO: 3912221 - RNA, 18 nt, Human adenovirus C
aggcgacgagcggccgcc

SEQ ID NO: 3912222 - RNA, 18 nt, Human adenovirus C
aggcgccgcacgaggggc

SEQ ID NO: 3912223 - RNA, 20 nt, Human adenovirus C
aggcgcgcaacuacacgccc

SEQ ID NO: 3912224 - RNA, 15 nt, Human adenovirus C
aggcgcgccgcgacu

SEQ ID NO: 3912225 - RNA, 19 nt, Human adenovirus C
aggcgcuguauccaaagcu

SEQ ID NO: 3912226 - RNA, 17 nt, Human adenovirus C
aggcguugaggccuccc

SEQ ID NO: 3912227 - RNA, 19 nt, Human adenovirus C
aggcguugaggccucccuc

SEQ ID NO: 3912228 - RNA, 16 nt, Human adenovirus C
aggcuacagaggaggc

SEQ ID NO: 3912229 - RNA, 21 nt, Human adenovirus C
aggcuacuaagaaaacacaug

SEQ ID NO: 3912230 - RNA, 14 nt, Human adenovirus C
aggcugcuguccaa

SEQ ID NO: 3912231 - RNA, 21 nt, Human adenovirus C
agggacaaguugaaagagcaa

SEQ ID NO: 3912232 - RNA, 19 nt, Human adenovirus C
agggcacccuccccuucuc

SEQ ID NO: 3912233 - RNA, 14 nt, Human adenovirus C
agggcacgagcugc

SEQ ID NO: 3912234 - RNA, 21 nt, Human adenovirus C
agggcccggcgcacggcgucc

SEQ ID NO: 3912235 - RNA, 13 nt, Human adenovirus C
agggccuccccuu

SEQ ID NO: 3912236 - RNA, 18 nt, Human adenovirus C
agggccuccccuucuucu

SEQ ID NO: 3912237 - RNA, 20 nt, Human adenovirus C
agggcgcuccuaacuccugu

SEQ ID NO: 3912238 - RNA, 20 nt, Human adenovirus C
agggcgcugucauaccugau

SEQ ID NO: 3912239 - RNA, 19 nt, Human adenovirus C
agggcggggauggcgcagg

SEQ ID NO: 3912240 - RNA, 19 nt, Human adenovirus C
aggggcaacauccgcggcu

SEQ ID NO: 3912241 - RNA, 13 nt, Human adenovirus C
aggggcagugcag

SEQ ID NO: 3912242 - RNA, 22 nt, Human adenovirus C
aggggcauggccggccacggcc

SEQ ID NO: 3912243 - RNA, 17 nt, Human adenovirus C
aggggccucuucuucuu

SEQ ID NO: 3912244 - RNA, 20 nt, Human adenovirus C
aggggugcgcuccgggcugc

SEQ ID NO: 3912245 - RNA, 15 nt, Human adenovirus C
agggucaugucuuuc

SEQ ID NO: 3912246 - RNA, 14 nt, Human adenovirus C
aggguccucgucag

SEQ ID NO: 3912247 - RNA, 17 nt, Human adenovirus C
agggugcaugcccaggc

SEQ ID NO: 3912248 - RNA, 15 nt, Human adenovirus C
agggugccagacugc

SEQ ID NO: 3912249 - RNA, 21 nt, Human adenovirus C
aggguggcucgcgaaggaggc

SEQ ID NO: 3912250 - RNA, 15 nt, Human adenovirus C
aggucacuugcugac

SEQ ID NO: 3912251 - RNA, 21 nt, Human adenovirus C
agguccaggcgacgagcggcc

SEQ ID NO: 3912252 - RNA, 19 nt, Human adenovirus C
aggucccuucgcagggcca

SEQ ID NO: 3912253 - RNA, 18 nt, Human adenovirus C
agguccgcgugcggccaa

SEQ ID NO: 3912254 - RNA, 20 nt, Human adenovirus C
aggugaaaaucguaaaacuu

SEQ ID NO: 3912255 - RNA, 21 nt, Human adenovirus C
aggugagcuccucaggggagc

SEQ ID NO: 3912256 - RNA, 21 nt, Human adenovirus C
agguggcuauaggacugaugc

SEQ ID NO: 3912257 - RNA, 20 nt, Human adenovirus C
aggugucaccguugaacaaa

SEQ ID NO: 3912258 - RNA, 17 nt, Human adenovirus C
aguaacucuacaagcuu

SEQ ID NO: 3912259 - RNA, 22 nt, Human adenovirus C
aguaaguuugccacacaaccuu

SEQ ID NO: 3912260 - RNA, 14 nt, Human adenovirus C
aguaccgcagcugg

SEQ ID NO: 3912261 - RNA, 18 nt, Human adenovirus C
aguacgagucacuccugc

SEQ ID NO: 3912262 - RNA, 13 nt, Human adenovirus C
aguagcacaaaac

SEQ ID NO: 3912263 - RNA, 12 nt, Human adenovirus C
aguaguccaggg

SEQ ID NO: 3912264 - RNA, 13 nt, Human adenovirus C
aguaguuacugga

SEQ ID NO: 3912265 - RNA, 16 nt, Human adenovirus C
aguaugauuaaaugag

SEQ ID NO: 3912266 - RNA, 12 nt, Human adenovirus C
agucacuccugc

SEQ ID NO: 3912267 - RNA, 11 nt, Human adenovirus C
agucacugugg

SEQ ID NO: 3912268 - RNA, 18 nt, Human adenovirus C
agucagcaaaucuuuguc

SEQ ID NO: 3912269 - RNA, 13 nt, Human adenovirus C
agucgcaggaccc

SEQ ID NO: 3912270 - RNA, 14 nt, Human adenovirus C
agucuaagcagccg

SEQ ID NO: 3912271 - RNA, 13 nt, Human adenovirus C
agucucgggccgg

SEQ ID NO: 3912272 - RNA, 20 nt, Human adenovirus C
agucugcagcgcugccaaaa

SEQ ID NO: 3912273 - RNA, 15 nt, Human adenovirus C
agugcccgcugucau

SEQ ID NO: 3912274 - RNA, 18 nt, Human adenovirus C
agugcgcgugcgcgggca

SEQ ID NO: 3912275 - RNA, 13 nt, Human adenovirus C
agugcggcggcgg

SEQ ID NO: 3912276 - RNA, 22 nt, Human adenovirus C
agugcuuguuaccguggagcuu

SEQ ID NO: 3912277 - RNA, 20 nt, Human adenovirus C
aguggaaaauacaccacuga

SEQ ID NO: 3912278 - RNA, 23 nt, Human adenovirus C
aguuccucguaggugagcuccuc

SEQ ID NO: 3912279 - RNA, 20 nt, Human adenovirus C
aguugccgaggaugaagaag

SEQ ID NO: 3912280 - RNA, 13 nt, Human adenovirus C
aguuggaagacgc

SEQ ID NO: 3912281 - RNA, 15 nt, Human adenovirus C
aguuggcccgcugcc

SEQ ID NO: 3912282 - RNA, 16 nt, Human adenovirus C
aguuggggccuccgcc

SEQ ID NO: 3912283 - RNA, 19 nt, Human adenovirus C
aguuuucacuccacaggcu

SEQ ID NO: 3912284 - RNA, 16 nt, Human adenovirus C
auaaacauuaccucuu

SEQ ID NO: 3912285 - RNA, 13 nt, Human adenovirus C
auacaaaagcaga

SEQ ID NO: 3912286 - RNA, 23 nt, Human adenovirus C
auagauacggaggauaggguggc

SEQ ID NO: 3912287 - RNA, 22 nt, Human adenovirus C
auagccgggucagggcgcgggc

SEQ ID NO: 3912288 - RNA, 14 nt, Human adenovirus C
caugcccaggcuuu

SEQ ID NO: 3912289 - RNA, 15 nt, Human adenovirus C
cauggaaauuaaaac

SEQ ID NO: 3912290 - RNA, 17 nt, Human adenovirus C
cauggccggccacggcc

SEQ ID NO: 3912291 - RNA, 18 nt, Human adenovirus C
cauggccggccacggccu

SEQ ID NO: 3912292 - RNA, 20 nt, Human adenovirus C
cauggcggggaccacagaac

SEQ ID NO: 3912293 - RNA, 22 nt, Human adenovirus C
cauggcggggaccacagaaccc

SEQ ID NO: 3912294 - RNA, 12 nt, Human adenovirus C
caugggcgcacu

SEQ ID NO: 3912295 - RNA, 14 nt, Human adenovirus C
cauggugauaaaac

SEQ ID NO: 3912296 - RNA, 19 nt, Human adenovirus C
cauguaugcguccaugucg

SEQ ID NO: 3912297 - RNA, 19 nt, Human adenovirus C
caugucgcuguccagcugc

SEQ ID NO: 3912298 - RNA, 20 nt, Human adenovirus C
caugucuaugcccaggcucc

SEQ ID NO: 3912299 - RNA, 14 nt, Human adenovirus C
cauguugugcagaa

SEQ ID NO: 3912300 - RNA, 16 nt, Human adenovirus C
cauuaccuuugacucu

SEQ ID NO: 3912301 - RNA, 21 nt, Human adenovirus C
cauucagauaaugacugcaaa

SEQ ID NO: 3912302 - RNA, 13 nt, Human adenovirus C
cauuccagcaccu

SEQ ID NO: 3912303 - RNA, 15 nt, Human adenovirus C
cauuccagcaccuuc

SEQ ID NO: 3912304 - RNA, 22 nt, Human adenovirus C
cauucccagcugcuacaacaaa

SEQ ID NO: 3912305 - RNA, 16 nt, Human adenovirus C
cauucgggcagcagcg

SEQ ID NO: 3912306 - RNA, 12 nt, Human adenovirus C
cauucugcagag

SEQ ID NO: 3912307 - RNA, 16 nt, Human adenovirus C
cauugucaaagaucuu

SEQ ID NO: 3912308 - RNA, 21 nt, Human adenovirus C
ccaaaagauuauccaaaaccu

SEQ ID NO: 3912309 - RNA, 13 nt, Human adenovirus C
ccaaaagcagggc

SEQ ID NO: 3912310 - RNA, 20 nt, Human adenovirus C
ccaaagcaaaccucaccucc

SEQ ID NO: 3912311 - RNA, 14 nt, Human adenovirus C
ccaacagaggauaa

SEQ ID NO: 3912312 - RNA, 14 nt, Human adenovirus C
ccaaccaggcagug

SEQ ID NO: 3912313 - RNA, 13 nt, Human adenovirus C
ccaacgcgcggcg

SEQ ID NO: 3912314 - RNA, 14 nt, Human adenovirus C
ccaacgcgcggcgg

SEQ ID NO: 3912315 - RNA, 21 nt, Human adenovirus C
ccaacuacaauauuggcuacc

SEQ ID NO: 3912316 - RNA, 18 nt, Human adenovirus C
ccaacucugguaucucag

SEQ ID NO: 3912317 - RNA, 13 nt, Human adenovirus C
ccaacuggcccca

SEQ ID NO: 3912318 - RNA, 15 nt, Human adenovirus C
ccaagaaauccacag

SEQ ID NO: 3912319 - RNA, 20 nt, Human adenovirus C
ccaagaugagguacaugauu

SEQ ID NO: 3912320 - RNA, 11 nt, Human adenovirus C
ccaagcaguuc

SEQ ID NO: 3912321 - RNA, 18 nt, Human adenovirus C
ccaagccgacgcgcccug

SEQ ID NO: 3912322 - RNA, 17 nt, Human adenovirus C
ccaagcgccagcgacug

SEQ ID NO: 3912323 - RNA, 15 nt, Human adenovirus C
ccaagggugcagcug

SEQ ID NO: 3912324 - RNA, 16 nt, Human adenovirus C
ccaaucaaucagccuc

SEQ ID NO: 3912325 - RNA, 17 nt, Human adenovirus C
ccaaucaaucagccucg

SEQ ID NO: 3912326 - RNA, 22 nt, Human adenovirus C
ccaaucaaucagccucgccccc

SEQ ID NO: 3912327 - RNA, 16 nt, Human adenovirus C
ccaaucccgcccgcca

SEQ ID NO: 3912328 - RNA, 18 nt, Human adenovirus C
ccacaaccuucaaaucaa

SEQ ID NO: 3912329 - RNA, 18 nt, Human adenovirus C
ccacaccuacagccugag

SEQ ID NO: 3912330 - RNA, 19 nt, Human adenovirus C
ccacacgggcggaggagaa

SEQ ID NO: 3912331 - RNA, 16 nt, Human adenovirus C
ccacauuucggcccca

SEQ ID NO: 3912332 - RNA, 13 nt, Human adenovirus C
ccaccacaccucg

SEQ ID NO: 3912333 - RNA, 18 nt, Human adenovirus C
ccaccaguuggaggagug

SEQ ID NO: 3912334 - RNA, 15 nt, Human adenovirus C
ccacccaaagcagac

SEQ ID NO: 3912335 - RNA, 13 nt, Human adenovirus C
ccacccagcgcca

SEQ ID NO: 3912336 - RNA, 17 nt, Human adenovirus C
ccaccggcggcggcgcg

SEQ ID NO: 3912337 - RNA, 15 nt, Human adenovirus C
ccaccgugcagcuga

SEQ ID NO: 3912338 - RNA, 22 nt, Human adenovirus C
ccaccugcgcgagauugagcuc

SEQ ID NO: 3912339 - RNA, 13 nt, Human adenovirus C
ccaccuucagccu

SEQ ID NO: 3912340 - RNA, 16 nt, Human adenovirus C
ccaccuucagccucaa

SEQ ID NO: 3912341 - RNA, 20 nt, Human adenovirus C
ccacgccccgcgccacguca

SEQ ID NO: 3912342 - RNA, 19 nt, Human adenovirus C
ccacgcccuacauguggag

SEQ ID NO: 3912343 - RNA, 18 nt, Human adenovirus C
ccacggacgacuggcgcc

SEQ ID NO: 3912344 - RNA, 23 nt, Human adenovirus C
ccacggcuaggucucgcgcggcg

SEQ ID NO: 3912345 - RNA, 15 nt, Human adenovirus C
ccacgguggcaccua

SEQ ID NO: 3912346 - RNA, 22 nt, Human adenovirus C
ccacgugaccggguguuccuga

SEQ ID NO: 3912347 - RNA, 15 nt, Human adenovirus C
ccacgugcgcacgcu

SEQ ID NO: 3912348 - RNA, 22 nt, Human adenovirus C
ccacucucgcaaggccuggcca

SEQ ID NO: 3912349 - RNA, 15 nt, Human adenovirus C
ccacugccacagagg

SEQ ID NO: 3912350 - RNA, 19 nt, Human adenovirus C
ccacuggaacccgccgccg

SEQ ID NO: 3912351 - RNA, 14 nt, Human adenovirus C
ccagacgcggcugu

SEQ ID NO: 3912352 - RNA, 14 nt, Human adenovirus C
ccagacgggccagg

SEQ ID NO: 3912353 - RNA, 23 nt, Human adenovirus C
ccagacuauuuuuuccagaccag

SEQ ID NO: 3912354 - RNA, 23 nt, Human adenovirus C
ccagcauugauggucgccccguc

SEQ ID NO: 3912355 - RNA, 18 nt, Human adenovirus C
ccagccugugaugcugga

SEQ ID NO: 3912356 - RNA, 14 nt, Human adenovirus C
aagaaaaacaccac

SEQ ID NO: 3912357 - RNA, 21 nt, Human adenovirus C
aagaaucgugaaccuguugca

SEQ ID NO: 3912358 - RNA, 22 nt, Human adenovirus C
aagaccauucacguagccagcc

SEQ ID NO: 3912359 - RNA, 14 nt, Human adenovirus C
aagacucggcggac

SEQ ID NO: 3912360 - RNA, 16 nt, Human adenovirus C
aagacugugggggcaa

SEQ ID NO: 3912361 - RNA, 14 nt, Human adenovirus C
aagagcugaaaaua

SEQ ID NO: 3912362 - RNA, 12 nt, Human adenovirus C
aagaucagcuuc

SEQ ID NO: 3912363 - RNA, 17 nt, Human adenovirus C
aagaucuggaaggugcu

SEQ ID NO: 3912364 - RNA, 23 nt, Human adenovirus C
aagaucuuuguugucaucucugu

SEQ ID NO: 3912365 - RNA, 15 nt, Human adenovirus C
aagaugaagaagagg

SEQ ID NO: 3912366 - RNA, 16 nt, Human adenovirus C
aagauggcaugugagu

SEQ ID NO: 3912367 - RNA, 13 nt, Human adenovirus C
aagcaagcaacau

SEQ ID NO: 3912368 - RNA, 16 nt, Human adenovirus C
aagcaggggccaagaa

SEQ ID NO: 3912369 - RNA, 19 nt, Human adenovirus C
aagcaggggccaagaacaa

SEQ ID NO: 3912370 - RNA, 18 nt, Human adenovirus C
aagccaugcucagaaaug

SEQ ID NO: 3912371 - RNA, 13 nt, Human adenovirus C
aagccgacgcgcc

SEQ ID NO: 3912372 - RNA, 18 nt, Human adenovirus C
aagccgcucauggcgcag

SEQ ID NO: 3912373 - RNA, 14 nt, Human adenovirus C
aagcgcgcugaggc

SEQ ID NO: 3912374 - RNA, 14 nt, Human adenovirus C
aagcgggucaaaaa

SEQ ID NO: 3912375 - RNA, 15 nt, Human adenovirus C
aagcgugcaggggcc

SEQ ID NO: 3912376 - RNA, 14 nt, Human adenovirus C
aagcuacaaggacc

SEQ ID NO: 3912377 - RNA, 15 nt, Human adenovirus C
aagcucgccugcgcc

SEQ ID NO: 3912378 - RNA, 16 nt, Human adenovirus C
aagcucgccugcgcca

SEQ ID NO: 3912379 - RNA, 22 nt, Human adenovirus C
aaggaggacagccuaaccgccc

SEQ ID NO: 3912380 - RNA, 16 nt, Human adenovirus C
aaggcuaauggcaaug

SEQ ID NO: 3912381 - RNA, 17 nt, Human adenovirus C
aaggcucgcguccaggc

SEQ ID NO: 3912382 - RNA, 13 nt, Human adenovirus C
aagggcccuggcu

SEQ ID NO: 3912383 - RNA, 11 nt, Human adenovirus C
aagggccuccc

SEQ ID NO: 3912384 - RNA, 14 nt, Human adenovirus C
aagggugcagcuga

SEQ ID NO: 3912385 - RNA, 18 nt, Human adenovirus C
aagggugcaugcccaggc

SEQ ID NO: 3912386 - RNA, 20 nt, Human adenovirus C
aaggguugagucgcaggacc

SEQ ID NO: 3912387 - RNA, 15 nt, Human adenovirus C
aauaagauuaacagu

SEQ ID NO: 3912388 - RNA, 15 nt, Human adenovirus C
aauacuaaaaaacug

SEQ ID NO: 3912389 - RNA, 12 nt, Human adenovirus C
aaucuccugcac

SEQ ID NO: 3912390 - RNA, 12 nt, Human adenovirus C
aaugacugggcg

SEQ ID NO: 3912391 - RNA, 13 nt, Human adenovirus C
aaugcaccacaga

SEQ ID NO: 3912392 - RNA, 23 nt, Human adenovirus C
aaugcaggaaagggucuggaguu

SEQ ID NO: 3912393 - RNA, 18 nt, Human adenovirus C
aauggggcggggcuuaaa

SEQ ID NO: 3912394 - RNA, 23 nt, Human adenovirus C
aauguauuauaacagcacuggca

SEQ ID NO: 3912395 - RNA, 17 nt, Human adenovirus C
aaugugagguuuacugg

SEQ ID NO: 3912396 - RNA, 17 nt, Human adenovirus C
aauuaaccuaaaugcca

SEQ ID NO: 3912397 - RNA, 20 nt, Human adenovirus C
aauuaaguauaugagcaauu

SEQ ID NO: 3912398 - RNA, 14 nt, Human adenovirus C
aauuaccugggcgg

SEQ ID NO: 3912399 - RNA, 22 nt, Human adenovirus C
aauucuuuaauuaugaaacgga

SEQ ID NO: 3912400 - RNA, 15 nt, Human adenovirus C
aauuuccaacgugga

SEQ ID NO: 3912401 - RNA, 15 nt, Human adenovirus C
aauuuuucuggaauu

SEQ ID NO: 3912402 - RNA, 22 nt, Human adenovirus C
acaacaguuuccagcgagacga

SEQ ID NO: 3912403 - RNA, 12 nt, Human adenovirus C
acaacucagggg

SEQ ID NO: 3912404 - RNA, 18 nt, Human adenovirus C
acaagaaguugaagacau

SEQ ID NO: 3912405 - RNA, 11 nt, Human adenovirus C
acaagcagcug

SEQ ID NO: 3912406 - RNA, 17 nt, Human adenovirus C
acaagcgagugguggcu

SEQ ID NO: 3912407 - RNA, 18 nt, Human adenovirus C
acaagcuaaaauacaacc

SEQ ID NO: 3912408 - RNA, 18 nt, Human adenovirus C
acaagcuacccacccagc

SEQ ID NO: 3912409 - RNA, 21 nt, Human adenovirus C
acaaggccggaaaccucaccu

SEQ ID NO: 3912410 - RNA, 18 nt, Human adenovirus C
acaaggccugcagaccgu

SEQ ID NO: 3912411 - RNA, 22 nt, Human adenovirus C
acaauacuaaaaaacuggaagu

SEQ ID NO: 3912412 - RNA, 15 nt, Human adenovirus C
acacaagcuaaaccu

SEQ ID NO: 3912413 - RNA, 22 nt, Human adenovirus C
acacaccucgaccacugccgcc

SEQ ID NO: 3912414 - RNA, 15 nt, Human adenovirus C
acacagaagcaaagg

SEQ ID NO: 3912415 - RNA, 15 nt, Human adenovirus C
acacaggcuggggcc

SEQ ID NO: 3912416 - RNA, 13 nt, Human adenovirus C
acacccuuacugu

SEQ ID NO: 3912417 - RNA, 17 nt, Human adenovirus C
acaccuagccuaaagcc

SEQ ID NO: 3912418 - RNA, 18 nt, Human adenovirus C
acaccuagccuaaagccc

SEQ ID NO: 3912419 - RNA, 15 nt, Human adenovirus C
acacgggcagccugg

SEQ ID NO: 3912420 - RNA, 18 nt, Human adenovirus C
acacuaacaguaguuacu

SEQ ID NO: 3912421 - RNA, 21 nt, Human adenovirus C
acacugcagcaggugcugccc

SEQ ID NO: 3912422 - RNA, 20 nt, Human adenovirus C
acagaacccacguggccauc

SEQ ID NO: 3912423 - RNA, 17 nt, Human adenovirus C
acagagcgaguauauau

SEQ ID NO: 3912424 - RNA, 15 nt, Human adenovirus C
acagaggaggcuagg

SEQ ID NO: 3912425 - RNA, 15 nt, Human adenovirus C
acagcgccugcauga

SEQ ID NO: 3912426 - RNA, 15 nt, Human adenovirus C
acagcgcgagcaggc

SEQ ID NO: 3912427 - RNA, 19 nt, Human adenovirus C
acagcggcggcagcagcag

SEQ ID NO: 3912428 - RNA, 14 nt, Human adenovirus C
acagugaagaugua

SEQ ID NO: 3912429 - RNA, 22 nt, Human adenovirus C
acaucaacuuugcgucucuggc

SEQ ID NO: 3912430 - RNA, 17 nt, Human adenovirus C
acaugaccaaggacugg

SEQ ID NO: 3912431 - RNA, 23 nt, Human adenovirus C
acaugcgagcccaacccgcgccu

SEQ ID NO: 3912432 - RNA, 20 nt, Human adenovirus C
acaugucuaugcccaggcuc

SEQ ID NO: 3912433 - RNA, 13 nt, Human adenovirus C
acauuccagcacc

SEQ ID NO: 3912434 - RNA, 19 nt, Human adenovirus C
accaaagcaaaccucaccu

SEQ ID NO: 3912435 - RNA, 18 nt, Human adenovirus C
accaacgugcccaucucc

SEQ ID NO: 3912436 - RNA, 11 nt, Human adenovirus C
accaccacccu

SEQ ID NO: 3912437 - RNA, 19 nt, Human adenovirus C
accaccauccuaaaccagc

SEQ ID NO: 3912438 - RNA, 18 nt, Human adenovirus C
accacuguuacucagcca

SEQ ID NO: 3912439 - RNA, 20 nt, Human adenovirus C
accacuuacaauuaccucag

SEQ ID NO: 3912440 - RNA, 22 nt, Human adenovirus C
accacuuacuggcugcagccag

SEQ ID NO: 3912441 - RNA, 18 nt, Human adenovirus C
accagccugugaugcugg

SEQ ID NO: 3912442 - RNA, 13 nt, Human adenovirus C
accaggcagugca

SEQ ID NO: 3912443 - RNA, 22 nt, Human adenovirus C
accagggcuucuacauuccaga

SEQ ID NO: 3912444 - RNA, 14 nt, Human adenovirus C
accaguccgggcca

SEQ ID NO: 3912445 - RNA, 21 nt, Human adenovirus C
accaguggagaggcagagcga

SEQ ID NO: 3912446 - RNA, 18 nt, Human adenovirus C
accaguuaacggucuggu

SEQ ID NO: 3912447 - RNA, 18 nt, Human adenovirus C
accaguuggaggaguggc

SEQ ID NO: 3912448 - RNA, 19 nt, Human adenovirus C
accauccuaaaccagcugg

SEQ ID NO: 3912449 - RNA, 22 nt, Human adenovirus C
agcggcaacccuuccaggaggg

SEQ ID NO: 3912450 - RNA, 17 nt, Human adenovirus C
agcggcagcggcagcaa

SEQ ID NO: 3912451 - RNA, 16 nt, Human adenovirus C
agcggggggcuucuga

SEQ ID NO: 3912452 - RNA, 20 nt, Human adenovirus C
agcggggggcuucugaggcu

SEQ ID NO: 3912453 - RNA, 14 nt, Human adenovirus C
agcgggguggugga

SEQ ID NO: 3912454 - RNA, 17 nt, Human adenovirus C
agcggggugguggaccu

SEQ ID NO: 3912455 - RNA, 20 nt, Human adenovirus C
agcggucacacagaagcaaa

SEQ ID NO: 3912456 - RNA, 19 nt, Human adenovirus C
agcggugacgcgggcgggc

SEQ ID NO: 3912457 - RNA, 16 nt, Human adenovirus C
agcgguuaagcuggga

SEQ ID NO: 3912458 - RNA, 17 nt, Human adenovirus C
agcgguuaagcugggau

SEQ ID NO: 3912459 - RNA, 18 nt, Human adenovirus C
agcgugcaggggcccaac

SEQ ID NO: 3912460 - RNA, 19 nt, Human adenovirus C
agcuaaaauacaaccccac

SEQ ID NO: 3912461 - RNA, 17 nt, Human adenovirus C
agcuacccacccagcgc

SEQ ID NO: 3912462 - RNA, 23 nt, Human adenovirus C
agcuacuuuaauuugacaggugg

SEQ ID NO: 3912463 - RNA, 23 nt, Human adenovirus C
agcucagugcaacaugaccaagg

SEQ ID NO: 3912464 - RNA, 18 nt, Human adenovirus C
agcuccucaggggagcug

SEQ ID NO: 3912465 - RNA, 18 nt, Human adenovirus C
agcucugcaaccuggucu

SEQ ID NO: 3912466 - RNA, 19 nt, Human adenovirus C
agcucugcaaccuggucuc

SEQ ID NO: 3912467 - RNA, 22 nt, Human adenovirus C
agcugccgucaucccugagcag

SEQ ID NO: 3912468 - RNA, 19 nt, Human adenovirus C
agcuuauuauucgccacaa

SEQ ID NO: 3912469 - RNA, 15 nt, Human adenovirus C
agcuugagccuggcu

SEQ ID NO: 3912470 - RNA, 15 nt, Human adenovirus C
agcuugaucugcugg

SEQ ID NO: 3912471 - RNA, 16 nt, Human adenovirus C
agcuugaucugcuggc

SEQ ID NO: 3912472 - RNA, 17 nt, Human adenovirus C
agcuugaucugcuggcg

SEQ ID NO: 3912473 - RNA, 12 nt, Human adenovirus C
agcuugguggca

SEQ ID NO: 3912474 - RNA, 14 nt, Human adenovirus C
agcuuguugaccag

SEQ ID NO: 3912475 - RNA, 22 nt, Human adenovirus C
aggaaccagccugugaugcugg

SEQ ID NO: 3912476 - RNA, 11 nt, Human adenovirus C
aggaaggugau

SEQ ID NO: 3912477 - RNA, 14 nt, Human adenovirus C
aggacagggccucu

SEQ ID NO: 3912478 - RNA, 22 nt, Human adenovirus C
aggacgaugaguacgagccaga

SEQ ID NO: 3912479 - RNA, 12 nt, Human adenovirus C
aggacugaugca

SEQ ID NO: 3912480 - RNA, 20 nt, Human adenovirus C
aggagaagcgcgcugaggcc

SEQ ID NO: 3912481 - RNA, 20 nt, Human adenovirus C
aggaggcaggacccuggugc

SEQ ID NO: 3912482 - RNA, 15 nt, Human adenovirus C
aggaugcggggugga

SEQ ID NO: 3912483 - RNA, 16 nt, Human adenovirus C
aggaugggcaggggcu

SEQ ID NO: 3912484 - RNA, 14 nt, Human adenovirus C
aggcaaacgaggaa

SEQ ID NO: 3912485 - RNA, 13 nt, Human adenovirus C
ugggcuccagcau

SEQ ID NO: 3912486 - RNA, 15 nt, Human adenovirus C
uggggcaggaggaca

SEQ ID NO: 3912487 - RNA, 17 nt, Human adenovirus C
ugguacuucccagagac

SEQ ID NO: 3912488 - RNA, 14 nt, Human adenovirus C
uggugcugccaaca

SEQ ID NO: 3912489 - RNA, 16 nt, Human adenovirus C
ugguggcuaccucucc

SEQ ID NO: 3912490 - RNA, 13 nt, Human adenovirus C
uggugggcgccga

SEQ ID NO: 3912491 - RNA, 16 nt, Human adenovirus C
ugguuaugauucauca

SEQ ID NO: 3912492 - RNA, 11 nt, Human adenovirus C
ugguuuccaag

SEQ ID NO: 3912493 - RNA, 23 nt, Human adenovirus C
uguaguagucuugcaugagccuu

SEQ ID NO: 3912494 - RNA, 22 nt, Human adenovirus C
uguaguauauccacucucucaa

SEQ ID NO: 3912495 - RNA, 14 nt, Human adenovirus C
ugucagauggaaag

SEQ ID NO: 3912496 - RNA, 11 nt, Human adenovirus C
ugucagccgcg

SEQ ID NO: 3912497 - RNA, 22 nt, Human adenovirus C
uguccacaguggacgcggccau

SEQ ID NO: 3912498 - RNA, 23 nt, Human adenovirus C
ugucccuaaccaugacuuugagg

SEQ ID NO: 3912499 - RNA, 22 nt, Human adenovirus C
ugucccuuuuuuuuccacagcu

SEQ ID NO: 3912500 - RNA, 21 nt, Human adenovirus C
uguccuuggguccggccugcu

SEQ ID NO: 3912501 - RNA, 17 nt, Human adenovirus C
ugucgcgaucggcgcgc

SEQ ID NO: 3912502 - RNA, 17 nt, Human adenovirus C
ugucguuucucagcagc

SEQ ID NO: 3912503 - RNA, 15 nt, Human adenovirus C
ugucuaugcccaggc

SEQ ID NO: 3912504 - RNA, 13 nt, Human adenovirus C
ugucucuaagcaa

SEQ ID NO: 3912505 - RNA, 17 nt, Human adenovirus C
ugucuuuacgccaccuu

SEQ ID NO: 3912506 - RNA, 19 nt, Human adenovirus C
ugucuuuccacgggcgcag

SEQ ID NO: 3912507 - RNA, 15 nt, Human adenovirus C
ugugcaccagccgca

SEQ ID NO: 3912508 - RNA, 12 nt, Human adenovirus C
ugugcccggccc

SEQ ID NO: 3912509 - RNA, 18 nt, Human adenovirus C
ugugcgacgucagacaac

SEQ ID NO: 3912510 - RNA, 17 nt, Human adenovirus C
ugugcguaacuugcugg

SEQ ID NO: 3912511 - RNA, 11 nt, Human adenovirus C
uguggaagccu

SEQ ID NO: 3912512 - RNA, 21 nt, Human adenovirus C
ugugucauguaugcguccaug

SEQ ID NO: 3912513 - RNA, 14 nt, Human adenovirus C
uguguggucaagca

SEQ ID NO: 3912514 - RNA, 22 nt, Human adenovirus C
uguuaccguggagcuugagugc

SEQ ID NO: 3912515 - RNA, 14 nt, Human adenovirus C
uguuauauuccaca

SEQ ID NO: 3912516 - RNA, 22 nt, Human adenovirus C
uguucccagcggucccauccaa

SEQ ID NO: 3912517 - RNA, 16 nt, Human adenovirus C
uguuucuccacgccuu

SEQ ID NO: 3912518 - RNA, 17 nt, Human adenovirus C
uuaaaucagcacaguaa

SEQ ID NO: 3912519 - RNA, 22 nt, Human adenovirus C
uuaaaucagcacaguaacugca

SEQ ID NO: 3912520 - RNA, 20 nt, Human adenovirus C
uuaagaaaugccuguuugaa

SEQ ID NO: 3912521 - RNA, 19 nt, Human adenovirus C
uuacaagugggaauuugaa

SEQ ID NO: 3912522 - RNA, 18 nt, Human adenovirus C
uuacaauaggaaacaaaa

SEQ ID NO: 3912523 - RNA, 16 nt, Human adenovirus C
uuacauuuaaaucaga

SEQ ID NO: 3912524 - RNA, 18 nt, Human adenovirus C
uuaccaagcgcccccugc

SEQ ID NO: 3912525 - RNA, 13 nt, Human adenovirus C
uuacuguaacugc

SEQ ID NO: 3912526 - RNA, 16 nt, Human adenovirus C
uuaggccagauugcaa

SEQ ID NO: 3912527 - RNA, 15 nt, Human adenovirus C
uucaacuaacauaaa

SEQ ID NO: 3912528 - RNA, 19 nt, Human adenovirus C
uucacacgcuugaagacaa

SEQ ID NO: 3912529 - RNA, 22 nt, Human adenovirus C
uucacccacagccgccugagca

SEQ ID NO: 3912530 - RNA, 15 nt, Human adenovirus C
uucagagaagaacau

SEQ ID NO: 3912531 - RNA, 12 nt, Human adenovirus C
uuccagaacuga

SEQ ID NO: 3912532 - RNA, 22 nt, Human adenovirus C
uuccaggcgcggcggcugcugc

SEQ ID NO: 3912533 - RNA, 17 nt, Human adenovirus C
uuccgcgguccuccucg

SEQ ID NO: 3912534 - RNA, 17 nt, Human adenovirus C
uuccggcagcagccgca

SEQ ID NO: 3912535 - RNA, 23 nt, Human adenovirus C
uucgcccugcgcgucggccaggu

SEQ ID NO: 3912536 - RNA, 21 nt, Human adenovirus C
uucgggaaagacgguggugcg

SEQ ID NO: 3912537 - RNA, 23 nt, Human adenovirus C
uucgugcgagggagcgaggaggu

SEQ ID NO: 3912538 - RNA, 14 nt, Human adenovirus C
uucuaaagcuaugu

SEQ ID NO: 3912539 - RNA, 15 nt, Human adenovirus C
uucugcccgccaccu

SEQ ID NO: 3912540 - RNA, 10 nt, Human adenovirus C
uucugcugug

SEQ ID NO: 3912541 - RNA, 12 nt, Human adenovirus C
uucugcugugcg

SEQ ID NO: 3912542 - RNA, 20 nt, Human adenovirus C
uucuucacgaucuuggccuu

SEQ ID NO: 3912543 - RNA, 11 nt, Human adenovirus C
uugaagacaug

SEQ ID NO: 3912544 - RNA, 17 nt, Human adenovirus C
uugacaacucaggggcc

SEQ ID NO: 3912545 - RNA, 22 nt, Human adenovirus C
uugagccuggcugacaaggugg

SEQ ID NO: 3912546 - RNA, 23 nt, Human adenovirus C
uugaguuuaaggaaccagcuugc

SEQ ID NO: 3912547 - RNA, 17 nt, Human adenovirus C
uugauauucaccuggcc

SEQ ID NO: 3912548 - RNA, 17 nt, Human adenovirus C
uugcaagacagaaacac

SEQ ID NO: 3912549 - RNA, 14 nt, Human adenovirus C
uugcauuuggguaa

SEQ ID NO: 3912550 - RNA, 13 nt, Human adenovirus C
uugcccgcgccac

SEQ ID NO: 3912551 - RNA, 16 nt, Human adenovirus C
uugcgcccuaccugug

SEQ ID NO: 3912552 - RNA, 14 nt, Human adenovirus C
uugcucgcccuugc

SEQ ID NO: 3912553 - RNA, 22 nt, Human adenovirus C
uugcugcgcccacaccuacagc

SEQ ID NO: 3912554 - RNA, 17 nt, Human adenovirus C
uugcugcgcgaggagga

SEQ ID NO: 3912555 - RNA, 20 nt, Human adenovirus C
uuggaaaaaaugaccgugga

SEQ ID NO: 3912556 - RNA, 22 nt, Human adenovirus C
ggggccagcguaggguggccgg

SEQ ID NO: 3912557 - RNA, 17 nt, Human adenovirus C
ggggcuccgggggcgag

SEQ ID NO: 3912558 - RNA, 11 nt, Human adenovirus C
ggggcugugcc

SEQ ID NO: 3912559 - RNA, 20 nt, Human adenovirus C
gggggcaacauccaagauga

SEQ ID NO: 3912560 - RNA, 15 nt, Human adenovirus C
gggguaccugcugga

SEQ ID NO: 3912561 - RNA, 22 nt, Human adenovirus C
gggguccacucgcuccagggug

SEQ ID NO: 3912562 - RNA, 22 nt, Human adenovirus C
gggugcuuggcauggacggggu

SEQ ID NO: 3912563 - RNA, 16 nt, Human adenovirus C
gguaccauauaaaccu

SEQ ID NO: 3912564 - RNA, 17 nt, Human adenovirus C
gguaccuuugagcugca

SEQ ID NO: 3912565 - RNA, 18 nt, Human adenovirus C
gguaccuuugagcugcag

SEQ ID NO: 3912566 - RNA, 17 nt, Human adenovirus C
gguagugggucuagcug

SEQ ID NO: 3912567 - RNA, 17 nt, Human adenovirus C
gguauugggguaacuga

SEQ ID NO: 3912568 - RNA, 22 nt, Human adenovirus C
ggucacccacuuugccuacccg

SEQ ID NO: 3912569 - RNA, 19 nt, Human adenovirus C
ggucacggugaaggggugc

SEQ ID NO: 3912570 - RNA, 12 nt, Human adenovirus C
ggucagcugcaa

SEQ ID NO: 3912571 - RNA, 18 nt, Human adenovirus C
ggucagggcgcgggcuag

SEQ ID NO: 3912572 - RNA, 19 nt, Human adenovirus C
gguccgugugcaccagccg

SEQ ID NO: 3912573 - RNA, 16 nt, Human adenovirus C
ggucgcccgggcaggg

SEQ ID NO: 3912574 - RNA, 21 nt, Human adenovirus C
ggugagcuccucaggggagcu

SEQ ID NO: 3912575 - RNA, 13 nt, Human adenovirus C
ggugcagacccug

SEQ ID NO: 3912576 - RNA, 13 nt, Human adenovirus C
ggugcgcggagcc

SEQ ID NO: 3912577 - RNA, 17 nt, Human adenovirus C
gguggaccuggccaacc

SEQ ID NO: 3912578 - RNA, 21 nt, Human adenovirus C
gguggcaccgggacugggcgu

SEQ ID NO: 3912579 - RNA, 22 nt, Human adenovirus C
gguggcaccgggacugggcgug

SEQ ID NO: 3912580 - RNA, 19 nt, Human adenovirus C
gguggcacuuaggccagau

SEQ ID NO: 3912581 - RNA, 20 nt, Human adenovirus C
gguggcguggucaaacucua

SEQ ID NO: 3912582 - RNA, 17 nt, Human adenovirus C
gguggcucccgggcuug

SEQ ID NO: 3912583 - RNA, 15 nt, Human adenovirus C
gguggucuucuacuu

SEQ ID NO: 3912584 - RNA, 14 nt, Human adenovirus C
ggugguuuuccaua

SEQ ID NO: 3912585 - RNA, 14 nt, Human adenovirus C
gguguaagcuucua

SEQ ID NO: 3912586 - RNA, 21 nt, Human adenovirus C
ggugucauaguccagccccuc

SEQ ID NO: 3912587 - RNA, 22 nt, Human adenovirus C
gguguguucugccacgaagaag

SEQ ID NO: 3912588 - RNA, 20 nt, Human adenovirus C
gguucgagucucgggccggc

SEQ ID NO: 3912589 - RNA, 22 nt, Human adenovirus C
gguuuacuucaaccccuuuucu

SEQ ID NO: 3912590 - RNA, 14 nt, Human adenovirus C
guaaacgcgcuggc

SEQ ID NO: 3912591 - RNA, 16 nt, Human adenovirus C
guaaaggugacucugg

SEQ ID NO: 3912592 - RNA, 22 nt, Human adenovirus C
guaaaguuccaagaagcgcggg

SEQ ID NO: 3912593 - RNA, 23 nt, Human adenovirus C
guaacaggagggggguguuccua

SEQ ID NO: 3912594 - RNA, 15 nt, Human adenovirus C
guaacucuacaagcu

SEQ ID NO: 3912595 - RNA, 20 nt, Human adenovirus C
guaacuuuauguccaugggc

SEQ ID NO: 3912596 - RNA, 20 nt, Human adenovirus C
guacacagcccgccaacgug

SEQ ID NO: 3912597 - RNA, 15 nt, Human adenovirus C
guacagcccacccug

SEQ ID NO: 3912598 - RNA, 21 nt, Human adenovirus C
cuuaaaaaacauuacuggaac

SEQ ID NO: 3912599 - RNA, 22 nt, Human adenovirus C
cuuaaaagccaccugagccuuu

SEQ ID NO: 3912600 - RNA, 16 nt, Human adenovirus C
cuuaacaguccccagg

SEQ ID NO: 3912601 - RNA, 15 nt, Human adenovirus C
cuuaaugaccagaca

SEQ ID NO: 3912602 - RNA, 16 nt, Human adenovirus C
cuuaccucccuugccg

SEQ ID NO: 3912603 - RNA, 16 nt, Human adenovirus C
cuuacuacaccuacuc

SEQ ID NO: 3912604 - RNA, 20 nt, Human adenovirus C
cuuacuggcugcagccaggg

SEQ ID NO: 3912605 - RNA, 15 nt, Human adenovirus C
cuuacuguaacugca

SEQ ID NO: 3912606 - RNA, 20 nt, Human adenovirus C
cuuauacuagcacuucugug

SEQ ID NO: 3912607 - RNA, 17 nt, Human adenovirus C
cuuauucagcaucaccu

SEQ ID NO: 3912608 - RNA, 17 nt, Human adenovirus C
cuucaacuacaccguca

SEQ ID NO: 3912609 - RNA, 18 nt, Human adenovirus C
cuucagcuugccugcucc

SEQ ID NO: 3912610 - RNA, 18 nt, Human adenovirus C
cuucauauuguugcagau

SEQ ID NO: 3912611 - RNA, 16 nt, Human adenovirus C
cuucauucagccgccg

SEQ ID NO: 3912612 - RNA, 22 nt, Human adenovirus C
cuucauucaguucauugacugg

SEQ ID NO: 3912613 - RNA, 16 nt, Human adenovirus C
cuuccagcccaugagc

SEQ ID NO: 3912614 - RNA, 23 nt, Human adenovirus C
cuuccaggcgcggcggcugcugc

SEQ ID NO: 3912615 - RNA, 23 nt, Human adenovirus C
cuuccauaagggccuccccuucu

SEQ ID NO: 3912616 - RNA, 19 nt, Human adenovirus C
cuucccugggaucaggcua

SEQ ID NO: 3912617 - RNA, 11 nt, Human adenovirus C
cuuccucccaa

SEQ ID NO: 3912618 - RNA, 19 nt, Human adenovirus C
cuucgaugcuccccuggac

SEQ ID NO: 3912619 - RNA, 15 nt, Human adenovirus C
cuucuaaauagcuaa

SEQ ID NO: 3912620 - RNA, 20 nt, Human adenovirus C
cuucucggccggcaacgcca

SEQ ID NO: 3912621 - RNA, 17 nt, Human adenovirus C
cuugaaagugggcaggc

SEQ ID NO: 3912622 - RNA, 16 nt, Human adenovirus C
cuugaacccgcacugg

SEQ ID NO: 3912623 - RNA, 22 nt, Human adenovirus C
cuugacgaccguucgcacuggg

SEQ ID NO: 3912624 - RNA, 13 nt, Human adenovirus C
cuugagaggccug

SEQ ID NO: 3912625 - RNA, 24 nt, Human adenovirus C
cuugagcaggccaacgagcgccuc

SEQ ID NO: 3912626 - RNA, 13 nt, Human adenovirus C
cuugaucugcugg

SEQ ID NO: 3912627 - RNA, 14 nt, Human adenovirus C
cuugcaaggaagca

SEQ ID NO: 3912628 - RNA, 20 nt, Human adenovirus C
cuugcagauauggcccucac

SEQ ID NO: 3912629 - RNA, 14 nt, Human adenovirus C
cuugcccuuggagg

SEQ ID NO: 3912630 - RNA, 15 nt, Human adenovirus C
cuugccugcuccaga

SEQ ID NO: 3912631 - RNA, 13 nt, Human adenovirus C
cuugcuagacugc

SEQ ID NO: 3912632 - RNA, 16 nt, Human adenovirus C
cuuggagacgcccuug

SEQ ID NO: 3912633 - RNA, 23 nt, Human adenovirus C
cuuggcacccaccgugcagcuga

SEQ ID NO: 3912634 - RNA, 20 nt, Human adenovirus C
cuuggguauccugucugagg

SEQ ID NO: 3912635 - RNA, 20 nt, Human adenovirus C
cuugugacgagucuucuucg

SEQ ID NO: 3912636 - RNA, 14 nt, Human adenovirus C
cuuuaauuaugaaa

SEQ ID NO: 3912637 - RNA, 16 nt, Human adenovirus C
cuuuccaagauggcua

SEQ ID NO: 3912638 - RNA, 11 nt, Human adenovirus C
cuuuccaggcu

SEQ ID NO: 3912639 - RNA, 22 nt, Human adenovirus C
cuuugaguucgccaccaccgcc

SEQ ID NO: 3912640 - RNA, 17 nt, Human adenovirus C
cuuuggacaccucccac

SEQ ID NO: 3912641 - RNA, 13 nt, Human adenovirus C
cuuugugagcgca

SEQ ID NO: 3912642 - RNA, 20 nt, Human adenovirus C
cuuuuauguauaaauuucca

SEQ ID NO: 3912643 - RNA, 15 nt, Human adenovirus C
cuuuuuugaguuuua

SEQ ID NO: 3912644 - RNA, 14 nt, Human adenovirus C
gaaaagcuuauuau

SEQ ID NO: 3912645 - RNA, 16 nt, Human adenovirus C
gaaaauucuaaagcua

SEQ ID NO: 3912646 - RNA, 21 nt, Human adenovirus C
gaaacacaagcuaaaccugua

SEQ ID NO: 3912647 - RNA, 18 nt, Human adenovirus C
gaaaccccacgguggcac

SEQ ID NO: 3912648 - RNA, 16 nt, Human adenovirus C
gaaacuuccagcccau

SEQ ID NO: 3912649 - RNA, 11 nt, Human adenovirus C
gaaagcuaaag

SEQ ID NO: 3912650 - RNA, 14 nt, Human adenovirus C
gaaagugggcaggc

SEQ ID NO: 3912651 - RNA, 22 nt, Human adenovirus C
gaacagggcggggauggcgcag

SEQ ID NO: 3912652 - RNA, 19 nt, Human adenovirus C
gaacgcggguuuggcaggg

SEQ ID NO: 3912653 - RNA, 16 nt, Human adenovirus C
gaacuaccugcugacc

SEQ ID NO: 3912654 - RNA, 19 nt, Human adenovirus C
gaacuauggcagcaaggcc

SEQ ID NO: 3912655 - RNA, 17 nt, Human adenovirus C
gaagaccaaucccgccc

SEQ ID NO: 3912656 - RNA, 21 nt, Human adenovirus C
gaagaccauucacguagccag

SEQ ID NO: 3912657 - RNA, 15 nt, Human adenovirus C
gaagaugucuuggaa

SEQ ID NO: 3912658 - RNA, 21 nt, Human adenovirus C
gaagaugucuuggaaaaaaug

SEQ ID NO: 3912659 - RNA, 18 nt, Human adenovirus C
gaagauuuuucugcugug

SEQ ID NO: 3912660 - RNA, 18 nt, Human adenovirus C
gaagccccucaucggcug

SEQ ID NO: 3912661 - RNA, 22 nt, Human adenovirus C
gaagcgacgaaugagcuccaca

SEQ ID NO: 3912662 - RNA, 14 nt, Human adenovirus C
gaagcugcagcugc

SEQ ID NO: 3912663 - RNA, 18 nt, Human adenovirus C
gaagcuggcgucugugag

SEQ ID NO: 3912664 - RNA, 21 nt, Human adenovirus C
gaaggcucgcguccaggccag

SEQ ID NO: 3912665 - RNA, 14 nt, Human adenovirus C
gaagggcacgagcu

SEQ ID NO: 3912666 - RNA, 19 nt, Human adenovirus C
gaagggcacgagcugcuuc

SEQ ID NO: 3912667 - RNA, 23 nt, Human adenovirus C
gaaggggguggugugucgcccca

SEQ ID NO: 3912668 - RNA, 19 nt, Human adenovirus C
gaagucccugcgacgggcc

SEQ ID NO: 3912669 - RNA, 16 nt, Human adenovirus C
gaaucuaacuuuuagc

SEQ ID NO: 3912670 - RNA, 16 nt, Human adenovirus C
gaaucuacuggggcuc

SEQ ID NO: 3912671 - RNA, 14 nt, Human adenovirus C
gaaucuggcgccuc

SEQ ID NO: 3912672 - RNA, 16 nt, Human adenovirus C
gaaugcgcaggcgguc

SEQ ID NO: 3912673 - RNA, 17 nt, Human adenovirus C
gacaaagcccaagaaau

SEQ ID NO: 3912674 - RNA, 13 nt, Human adenovirus C
gacaacgcgcaug

SEQ ID NO: 3912675 - RNA, 16 nt, Human adenovirus C
gacaacgcgcaugccc

SEQ ID NO: 3912676 - RNA, 19 nt, Human adenovirus C
gacaagcgcuuuccaggcu

SEQ ID NO: 3912677 - RNA, 15 nt, Human adenovirus C
gacaagcuaaaauac

SEQ ID NO: 3912678 - RNA, 17 nt, Human adenovirus C
gacaaguugaaagagca

SEQ ID NO: 3912679 - RNA, 16 nt, Human adenovirus C
gacaaugcagaaacac

SEQ ID NO: 3912680 - RNA, 19 nt, Human adenovirus C
gacacccaagggugcagcu

SEQ ID NO: 3912681 - RNA, 15 nt, Human adenovirus C
gacaccuucaacccc

SEQ ID NO: 3912682 - RNA, 12 nt, Human adenovirus C
gacacggcggcg

SEQ ID NO: 3912683 - RNA, 17 nt, Human adenovirus C
gacacuguaccgcgagg

SEQ ID NO: 3912684 - RNA, 12 nt, Human adenovirus C
gacagaaacaca

SEQ ID NO: 3912685 - RNA, 14 nt, Human adenovirus C
gacagaaacacaga

SEQ ID NO: 3912686 - RNA, 17 nt, Human adenovirus C
gacagaaacacagagcu

SEQ ID NO: 3912687 - RNA, 13 nt, Human adenovirus C
gacagcaagaaac

SEQ ID NO: 3912688 - RNA, 21 nt, Human adenovirus C
gacagggcccagucugcaaga

SEQ ID NO: 3912689 - RNA, 23 nt, Human adenovirus C
gacaugcagggcacccuccccuu

SEQ ID NO: 3912690 - RNA, 22 nt, Human adenovirus C
gacauuggcuggaaugccauag

SEQ ID NO: 3912691 - RNA, 20 nt, Human adenovirus C
gacauuucagaucggcggcg

SEQ ID NO: 3912692 - RNA, 21 nt, Human adenovirus C
gaccaaagcaaaccucaccuc

SEQ ID NO: 3912693 - RNA, 12 nt, Human adenovirus C
gaccccauggca

SEQ ID NO: 3912694 - RNA, 16 nt, Human adenovirus C
gaccggcaaggcaaug

SEQ ID NO: 3912695 - RNA, 17 nt, Human adenovirus C
gaccguaaaccugagcc

SEQ ID NO: 3912696 - RNA, 20 nt, Human adenovirus C
gaccguggagccugggcugg

SEQ ID NO: 3912697 - RNA, 17 nt, Human adenovirus C
gaccugccuccccccgc

SEQ ID NO: 3912698 - RNA, 11 nt, Human adenovirus C
gaccuggccaa

SEQ ID NO: 3912699 - RNA, 14 nt, Human adenovirus C
gaccuggccaacca

SEQ ID NO: 3912700 - RNA, 16 nt, Human adenovirus C
gaccuggccaaccagg

SEQ ID NO: 3912701 - RNA, 14 nt, Human adenovirus C
gacgaaggcucgcg

SEQ ID NO: 3912702 - RNA, 18 nt, Human adenovirus C
gacgaaguaaguuugcca

SEQ ID NO: 3912703 - RNA, 14 nt, Human adenovirus C
gacgacagcagcgu

SEQ ID NO: 3912704 - RNA, 18 nt, Human adenovirus C
gacgacauagacgacagc

SEQ ID NO: 3912705 - RNA, 11 nt, Human adenovirus C
gacgaccuggg

SEQ ID NO: 3912706 - RNA, 19 nt, Human adenovirus C
gacgagguggaacugcugc

SEQ ID NO: 3912707 - RNA, 13 nt, Human adenovirus C
gacgccgccucag

SEQ ID NO: 3912708 - RNA, 22 nt, Human adenovirus C
gacgcggaggcucucuucagca

SEQ ID NO: 3912709 - RNA, 12 nt, Human adenovirus C
gacgcggcggca

SEQ ID NO: 3912710 - RNA, 12 nt, Human adenovirus C
gacgcucggugc

SEQ ID NO: 3912711 - RNA, 13 nt, Human adenovirus C
gacggaugagcuc

SEQ ID NO: 3912712 - RNA, 13 nt, Human adenovirus C
gacggcgcaccgg

SEQ ID NO: 3912713 - RNA, 12 nt, Human adenovirus C
gacggcggccug

SEQ ID NO: 3912714 - RNA, 24 nt, Human adenovirus C
gacggcguaguuucgcaggcgcug

SEQ ID NO: 3912715 - RNA, 12 nt, Human adenovirus C
gacgguggugcg

SEQ ID NO: 3912716 - RNA, 15 nt, Human adenovirus C
gacguacuucagccu

SEQ ID NO: 3912717 - RNA, 23 nt, Human adenovirus C
cccuaacaguggcaaccaccgcu

SEQ ID NO: 3912718 - RNA, 12 nt, Human adenovirus C
cccuccccuucu

SEQ ID NO: 3912719 - RNA, 14 nt, Human adenovirus C
cccuccucaccugc

SEQ ID NO: 3912720 - RNA, 17 nt, Human adenovirus C
cccucgccggcgcccca

SEQ ID NO: 3912721 - RNA, 19 nt, Human adenovirus C
cccugcaaacaucagcccc

SEQ ID NO: 3912722 - RNA, 23 nt, Human adenovirus C
cccugcaaacaucagccccccuc

SEQ ID NO: 3912723 - RNA, 22 nt, Human adenovirus C
cccugcgucgcaaccaggaaca

SEQ ID NO: 3912724 - RNA, 16 nt, Human adenovirus C
cccuggaggcagcugg

SEQ ID NO: 3912725 - RNA, 19 nt, Human adenovirus C
cccuggcuggcacgggcag

SEQ ID NO: 3912726 - RNA, 13 nt, Human adenovirus C
cccuggcuguggg

SEQ ID NO: 3912727 - RNA, 13 nt, Human adenovirus C
cccuggugcugcc

SEQ ID NO: 3912728 - RNA, 17 nt, Human adenovirus C
cccuguggaccgcgagg

SEQ ID NO: 3912729 - RNA, 15 nt, Human adenovirus C
cccuucucccacccc

SEQ ID NO: 3912730 - RNA, 13 nt, Human adenovirus C
cccuucuucuucu

SEQ ID NO: 3912731 - RNA, 9 nt, Human adenovirus C
cccuugccg

SEQ ID NO: 3912732 - RNA, 22 nt, Human adenovirus C
ccgaaccuuuggacaccuccca

SEQ ID NO: 3912733 - RNA, 21 nt, Human adenovirus C
ccgaagaggugucagacgaaa

SEQ ID NO: 3912734 - RNA, 14 nt, Human adenovirus C
ccgacccggcacug

SEQ ID NO: 3912735 - RNA, 15 nt, Human adenovirus C
ccgacccggcacugc

SEQ ID NO: 3912736 - RNA, 15 nt, Human adenovirus C
ccgaggucgagaagc

SEQ ID NO: 3912737 - RNA, 22 nt, Human adenovirus C
ccgaucacuuggugcuggccug

SEQ ID NO: 3912738 - RNA, 20 nt, Human adenovirus C
ccgcaauacagagacaggac

SEQ ID NO: 3912739 - RNA, 22 nt, Human adenovirus C
ccgcaccgcucccuggucugca

SEQ ID NO: 3912740 - RNA, 23 nt, Human adenovirus C
ccgcacgcgaaccuacgcccaga

SEQ ID NO: 3912741 - RNA, 21 nt, Human adenovirus C
ccgcacuggcuaccgcccccu

SEQ ID NO: 3912742 - RNA, 20 nt, Human adenovirus C
ccgcagcccuaucagcagcc

SEQ ID NO: 3912743 - RNA, 21 nt, Human adenovirus C
ccgcagcccuaucagcagccg

SEQ ID NO: 3912744 - RNA, 19 nt, Human adenovirus C
ccgcaggccaagcagcuug

SEQ ID NO: 3912745 - RNA, 23 nt, Human adenovirus C
ccgccagcccccaccaucaccac

SEQ ID NO: 3912746 - RNA, 15 nt, Human adenovirus C
ccgccgcaccgugcg

SEQ ID NO: 3912747 - RNA, 13 nt, Human adenovirus C
ccgccgccgcagc

SEQ ID NO: 3912748 - RNA, 12 nt, Human adenovirus C
ccgccgccgccg

SEQ ID NO: 3912749 - RNA, 21 nt, Human adenovirus C
ccgccgcuuuggggucacugc

SEQ ID NO: 3912750 - RNA, 15 nt, Human adenovirus C
ccgccggcacugccu

SEQ ID NO: 3912751 - RNA, 14 nt, Human adenovirus C
ccgccucagccgcu

SEQ ID NO: 3912752 - RNA, 14 nt, Human adenovirus C
ccgccucagcuaca

SEQ ID NO: 3912753 - RNA, 19 nt, Human adenovirus C
ccgccuuuuagcugcaaac

SEQ ID NO: 3912754 - RNA, 15 nt, Human adenovirus C
ccgcgagcuuagaaa

SEQ ID NO: 3912755 - RNA, 23 nt, Human adenovirus C
ccgcgcacaaggaagcagagugg

SEQ ID NO: 3912756 - RNA, 13 nt, Human adenovirus C
ccgcgcccaccga

SEQ ID NO: 3912757 - RNA, 15 nt, Human adenovirus C
ccgcgcgcuggggca

SEQ ID NO: 3912758 - RNA, 18 nt, Human adenovirus C
ccgcggcgacaggucagg

SEQ ID NO: 3912759 - RNA, 15 nt, Human adenovirus C
ccgcggcguggcccu

SEQ ID NO: 3912760 - RNA, 13 nt, Human adenovirus C
ccgcggggacagg

SEQ ID NO: 3912761 - RNA, 19 nt, Human adenovirus C
ccgcgguugugcaggguga

SEQ ID NO: 3912762 - RNA, 23 nt, Human adenovirus C
ccgcgguugugcagggugacaag

SEQ ID NO: 3912763 - RNA, 21 nt, Human adenovirus C
ccgcguacgagcagacgguga

SEQ ID NO: 3912764 - RNA, 14 nt, Human adenovirus C
ccgcguccgcgcuc

SEQ ID NO: 3912765 - RNA, 20 nt, Human adenovirus C
ccgcuccucaggcgccgccg

SEQ ID NO: 3912766 - RNA, 18 nt, Human adenovirus C
ccgcucgaaggcuggccg

SEQ ID NO: 3912767 - RNA, 21 nt, Human adenovirus C
ccgcuuuccaagauggcuacc

SEQ ID NO: 3912768 - RNA, 12 nt, Human adenovirus C
ccggaaacaggg

SEQ ID NO: 3912769 - RNA, 21 nt, Human adenovirus C
ccggaccugggcuggcggugg

SEQ ID NO: 3912770 - RNA, 12 nt, Human adenovirus C
ccggcacugccg

SEQ ID NO: 3912771 - RNA, 22 nt, Human adenovirus C
ccggcagcagccgcaggccaac

SEQ ID NO: 3912772 - RNA, 15 nt, Human adenovirus C
ccggcgccagcaccu

SEQ ID NO: 3912773 - RNA, 20 nt, Human adenovirus C
ccggcgcgcgcaaaccccac

SEQ ID NO: 3912774 - RNA, 15 nt, Human adenovirus C
ccggcggcagcggca

SEQ ID NO: 3912775 - RNA, 17 nt, Human adenovirus C
ccggcggcgguggugga

SEQ ID NO: 3912776 - RNA, 13 nt, Human adenovirus C
ccgggcacagcag

SEQ ID NO: 3912777 - RNA, 11 nt, Human adenovirus C
ccgggcagcag

SEQ ID NO: 3912778 - RNA, 17 nt, Human adenovirus C
ccgggcagcaggcgcgc

SEQ ID NO: 3912779 - RNA, 20 nt, Human adenovirus C
ccgggcugcgcgcuggccag

SEQ ID NO: 3912780 - RNA, 23 nt, Human adenovirus C
ccggggcgcgcugcggcugcugu

SEQ ID NO: 3912781 - RNA, 14 nt, Human adenovirus C
ccggggcuguggac

SEQ ID NO: 3912782 - RNA, 20 nt, Human adenovirus C
ccgggggugcuuggcaugga

SEQ ID NO: 3912783 - RNA, 13 nt, Human adenovirus C
ccgggucagggcg

SEQ ID NO: 3912784 - RNA, 23 nt, Human adenovirus C
ccgucaagaaaaacaccaccacc

SEQ ID NO: 3912785 - RNA, 13 nt, Human adenovirus C
ccgucacccagca

SEQ ID NO: 3912786 - RNA, 20 nt, Human adenovirus C
ccguccgccgugauccaugc

SEQ ID NO: 3912787 - RNA, 18 nt, Human adenovirus C
ccgucuacucccagcuca

SEQ ID NO: 3912788 - RNA, 15 nt, Human adenovirus C
ccgugauccaugcgg

SEQ ID NO: 3912789 - RNA, 15 nt, Human adenovirus C
ccgugcuggccccga

SEQ ID NO: 3912790 - RNA, 19 nt, Human adenovirus C
ccguggagccugggcugga

SEQ ID NO: 3912791 - RNA, 20 nt, Human adenovirus C
ccgugggcucguggugcuug

SEQ ID NO: 3912792 - RNA, 14 nt, Human adenovirus C
ccguucucgcgggg

SEQ ID NO: 3912793 - RNA, 20 nt, Human adenovirus C
ccguuggagacugcagccuc

SEQ ID NO: 3912794 - RNA, 13 nt, Human adenovirus C
ccguuuucccacg

SEQ ID NO: 3912795 - RNA, 20 nt, Human adenovirus C
ccuaaacaacucgcugcugc

SEQ ID NO: 3912796 - RNA, 14 nt, Human adenovirus C
ccuaaaccagcugg

SEQ ID NO: 3912797 - RNA, 14 nt, Human adenovirus C
ccuaaaggagcugc

SEQ ID NO: 3912798 - RNA, 12 nt, Human adenovirus C
ccuaaaugccaa

SEQ ID NO: 3912799 - RNA, 16 nt, Human adenovirus C
ccuacuccggcacugc

SEQ ID NO: 3912800 - RNA, 15 nt, Human adenovirus C
ccuaucauugugcuc

SEQ ID NO: 3912801 - RNA, 13 nt, Human adenovirus C
ccuauuaaaaaac

SEQ ID NO: 3912802 - RNA, 14 nt, Human adenovirus C
ccucacccgcagcu

SEQ ID NO: 3912803 - RNA, 15 nt, Human adenovirus C
ccucacccgcagcug

SEQ ID NO: 3912804 - RNA, 12 nt, Human adenovirus C
ccucagcagcgg

SEQ ID NO: 3912805 - RNA, 15 nt, Human adenovirus C
ccucagcuacaagcu

SEQ ID NO: 3912806 - RNA, 18 nt, Human adenovirus C
ccuccaccuucagccuca

SEQ ID NO: 3912807 - RNA, 16 nt, Human adenovirus C
ccuccccuucuccuac

SEQ ID NO: 3912808 - RNA, 14 nt, Human adenovirus C
ccuccgcccugcgc

SEQ ID NO: 3912809 - RNA, 17 nt, Human adenovirus C
ccuccgcccugcgcgcg

SEQ ID NO: 3912810 - RNA, 13 nt, Human adenovirus C
ccuccucccuccu

SEQ ID NO: 3912811 - RNA, 15 nt, Human adenovirus C
ccuccuccugccagg

SEQ ID NO: 3912812 - RNA, 22 nt, Human adenovirus C
ccucggacucgagacgccgccu

SEQ ID NO: 3912813 - RNA, 18 nt, Human adenovirus C
ccucuucccgacuggcca

SEQ ID NO: 3912814 - RNA, 14 nt, Human adenovirus C
ccucuuccucccau

SEQ ID NO: 3912815 - RNA, 20 nt, Human adenovirus C
ccucuuguccugcaucucuu

SEQ ID NO: 3912816 - RNA, 22 nt, Human adenovirus C
ccugaacuaccagaacgaccac

SEQ ID NO: 3912817 - RNA, 13 nt, Human adenovirus C
ccugaauaacaag

SEQ ID NO: 3912818 - RNA, 23 nt, Human adenovirus C
ccugacgcguuccggcagcagcc

SEQ ID NO: 3912819 - RNA, 16 nt, Human adenovirus C
ccugagccccgggcug

SEQ ID NO: 3912820 - RNA, 13 nt, Human adenovirus C
ccugagccuuugc

SEQ ID NO: 3912821 - RNA, 17 nt, Human adenovirus C
ccugagcguaaccagac

SEQ ID NO: 3912822 - RNA, 18 nt, Human adenovirus C
ccugcaggaaucgcccca

SEQ ID NO: 3912823 - RNA, 20 nt, Human adenovirus C
ccugcaggaaucgccccauc

SEQ ID NO: 3912824 - RNA, 18 nt, Human adenovirus C
ccugccagacaagcuaaa

SEQ ID NO: 3912825 - RNA, 22 nt, Human adenovirus C
ccugccgugccaaccgcagccg

SEQ ID NO: 3912826 - RNA, 15 nt, Human adenovirus C
ccugcgacgggccga

SEQ ID NO: 3912827 - RNA, 18 nt, Human adenovirus C
ccugcgccguagcgccau

SEQ ID NO: 3912828 - RNA, 12 nt, Human adenovirus C
ccugcgccgugc

SEQ ID NO: 3912829 - RNA, 20 nt, Human adenovirus C
ccugcgucauuacccagggc

SEQ ID NO: 3912830 - RNA, 19 nt, Human adenovirus C
ccugcugaaugcgcaggcg

SEQ ID NO: 3912831 - RNA, 19 nt, Human adenovirus C
ccuggccaaccaggcagug

SEQ ID NO: 3912832 - RNA, 22 nt, Human adenovirus C
ccuggcugacaagguggccgcc

SEQ ID NO: 3912833 - RNA, 16 nt, Human adenovirus C
ccuggcuggcacgggc

SEQ ID NO: 3912834 - RNA, 20 nt, Human adenovirus C
ccuguaacgcuggaccugcc

SEQ ID NO: 3912835 - RNA, 16 nt, Human adenovirus C
ccuguauauuaaugca

SEQ ID NO: 3912836 - RNA, 18 nt, Human adenovirus C
ccuguauauuaaugcauc

SEQ ID NO: 3912837 - RNA, 15 nt, Human adenovirus C
ccugugaugcuggau

SEQ ID NO: 3912838 - RNA, 16 nt, Human adenovirus C
ccugugcugccagggc

SEQ ID NO: 3912839 - RNA, 17 nt, Human adenovirus C
ccugugcuuugcuccca

SEQ ID NO: 3912840 - RNA, 22 nt, Human adenovirus C
ccugugcuuugcucccaaaccu

SEQ ID NO: 3912841 - RNA, 19 nt, Human adenovirus C
ccuguguggaagccuggac

SEQ ID NO: 3912842 - RNA, 20 nt, Human adenovirus C
ccuguguggaagccuggacc

SEQ ID NO: 3912843 - RNA, 22 nt, Human adenovirus C
ccuuaguaugcagcgcgcggcg

SEQ ID NO: 3912844 - RNA, 16 nt, Human adenovirus C
ccuuauaucgcccagc

SEQ ID NO: 3912845 - RNA, 21 nt, Human adenovirus C
ccuucagccucaagcagcgaa

SEQ ID NO: 3912846 - RNA, 14 nt, Human adenovirus C
ccuucucccacccc

SEQ ID NO: 3912847 - RNA, 18 nt, Human adenovirus C
ccuugacggaaccuucua

SEQ ID NO: 3912848 - RNA, 14 nt, Human adenovirus C
ccuugccgugcuug

SEQ ID NO: 3912849 - RNA, 20 nt, Human adenovirus C
ccuuggaggaggcgccgcac

SEQ ID NO: 3912850 - RNA, 22 nt, Human adenovirus C
ccuuucacauucaggugcccca

SEQ ID NO: 3912851 - RNA, 14 nt, Human adenovirus C
ccuuugagcugcag

SEQ ID NO: 3912852 - RNA, 13 nt, Human adenovirus C
cgaacccccgcgg

SEQ ID NO: 3912853 - RNA, 20 nt, Human adenovirus C
cgaagaaggaagagcaggau

SEQ ID NO: 3912854 - RNA, 19 nt, Human adenovirus C
cgaagagcauaucgagggc

SEQ ID NO: 3912855 - RNA, 20 nt, Human adenovirus C
cgacacgguuaacuccuccu

SEQ ID NO: 3912856 - RNA, 16 nt, Human adenovirus C
cgacccgcgagcuuag

SEQ ID NO: 3912857 - RNA, 14 nt, Human adenovirus C
cgacgaaugagcuc

SEQ ID NO: 3912858 - RNA, 16 nt, Human adenovirus C
cgacgccgaaccacca

SEQ ID NO: 3912859 - RNA, 23 nt, Human adenovirus C
cgacgcggcgguugaucuccuga

SEQ ID NO: 3912860 - RNA, 24 nt, Human adenovirus C
cgacuacaugaacaagcgaguggu

SEQ ID NO: 3912861 - RNA, 20 nt, Human adenovirus C
cgagagcguggugagcgcgg

SEQ ID NO: 3912862 - RNA, 16 nt, Human adenovirus C
cgagauugagcuccac

SEQ ID NO: 3912863 - RNA, 20 nt, Human adenovirus C
cgagcggccgccgcagcagc

SEQ ID NO: 3912864 - RNA, 17 nt, Human adenovirus C
cgagcgguugcugcgcg

SEQ ID NO: 3912865 - RNA, 13 nt, Human adenovirus C
cgaggagcugagg

SEQ ID NO: 3912866 - RNA, 20 nt, Human adenovirus C
cgaggaggacuuugagcccg

SEQ ID NO: 3912867 - RNA, 13 nt, Human adenovirus C
cgaggaggaggag

SEQ ID NO: 3912868 - RNA, 19 nt, Human adenovirus C
cgaggaucgcucaguacca

SEQ ID NO: 3912869 - RNA, 17 nt, Human adenovirus C
cgaggaugaagaagagg

SEQ ID NO: 3912870 - RNA, 13 nt, Human adenovirus C
cgagggagaggag

SEQ ID NO: 3912871 - RNA, 14 nt, Human adenovirus C
cgagggccagcugu

SEQ ID NO: 3912872 - RNA, 12 nt, Human adenovirus C
cgagggccuggc

SEQ ID NO: 3912873 - RNA, 19 nt, Human adenovirus C
cgaggggaguuauggugga

SEQ ID NO: 3912874 - RNA, 23 nt, Human adenovirus C
cgagucuggugacuuggcaccca

SEQ ID NO: 3912875 - RNA, 15 nt, Human adenovirus C
cgaucggcaggcuca

SEQ ID NO: 3912876 - RNA, 18 nt, Human adenovirus C
cgaucggcaggcucagcg

SEQ ID NO: 3912877 - RNA, 21 nt, Human adenovirus C
cgaucguaaacgcgcuggccg

SEQ ID NO: 3912878 - RNA, 24 nt, Human adenovirus C
cgaugacucggcagacgacagcag

SEQ ID NO: 3912879 - RNA, 13 nt, Human adenovirus C
cgaugagcagcug

SEQ ID NO: 3912880 - RNA, 20 nt, Human adenovirus C
cgaugaggccggccuggucu

SEQ ID NO: 3912881 - RNA, 16 nt, Human adenovirus C
cgaugauucgcaccgc

SEQ ID NO: 3912882 - RNA, 23 nt, Human adenovirus C
cgaugccgccaacgcgccuacca

SEQ ID NO: 3912883 - RNA, 15 nt, Human adenovirus C
cgcaacaccacugcu

SEQ ID NO: 3912884 - RNA, 13 nt, Human adenovirus C
cgcaaccgcagac

SEQ ID NO: 3912885 - RNA, 19 nt, Human adenovirus C
cgcaacuagauugcaagaa

SEQ ID NO: 3912886 - RNA, 12 nt, Human adenovirus C
cgcaacugggca

SEQ ID NO: 3912887 - RNA, 14 nt, Human adenovirus C
cgcaacugggcagc

SEQ ID NO: 3912888 - RNA, 14 nt, Human adenovirus C
cgcaccugccccua

SEQ ID NO: 3912889 - RNA, 19 nt, Human adenovirus C
cgcacgaggggcagugcag

SEQ ID NO: 3912890 - RNA, 21 nt, Human adenovirus C
cgcacggcguccggcucacca

SEQ ID NO: 3912891 - RNA, 24 nt, Human adenovirus C
cgcagacacgaucggcaggcucag

SEQ ID NO: 3912892 - RNA, 16 nt, Human adenovirus C
cgcagaugggagcugu

SEQ ID NO: 3912893 - RNA, 13 nt, Human adenovirus C
cgcagcagcaggg

SEQ ID NO: 3912894 - RNA, 18 nt, Human adenovirus C
cgcagcccuaucagcagc

SEQ ID NO: 3912895 - RNA, 15 nt, Human adenovirus C
cgcagcuugagccug

SEQ ID NO: 3912896 - RNA, 20 nt, Human adenovirus C
cgcagcuuguugaccagcuc

SEQ ID NO: 3912897 - RNA, 23 nt, Human adenovirus C
cgcaguuggcgaugagcagcugg

SEQ ID NO: 3912898 - RNA, 17 nt, Human adenovirus C
cgcaguuggggccuccg

SEQ ID NO: 3912899 - RNA, 23 nt, Human adenovirus C
cgcaucuugcgcuaugugcagca

SEQ ID NO: 3912900 - RNA, 21 nt, Human adenovirus C
cgcauugcguaccucaggcac

SEQ ID NO: 3912901 - RNA, 21 nt, Human adenovirus C
cgccaaccgcgguugugcagg

SEQ ID NO: 3912902 - RNA, 21 nt, Human adenovirus C
cgccaacuccgcccacgcgcu

SEQ ID NO: 3912903 - RNA, 16 nt, Human adenovirus C
cgccaccaccgccucc

SEQ ID NO: 3912904 - RNA, 22 nt, Human adenovirus C
cgccaccaccgccuccaccgau

SEQ ID NO: 3912905 - RNA, 17 nt, Human adenovirus C
cgccaccaguuggagga

SEQ ID NO: 3912906 - RNA, 21 nt, Human adenovirus C
cgccaccgagacguacuucag

SEQ ID NO: 3912907 - RNA, 21 nt, Human adenovirus C
cgccaccuucuuccccauggc

SEQ ID NO: 3912908 - RNA, 19 nt, Human adenovirus C
cgccagagcuuccacuugg

SEQ ID NO: 3912909 - RNA, 19 nt, Human adenovirus C
cgccagaggagcugcugag

SEQ ID NO: 3912910 - RNA, 21 nt, Human adenovirus C
cgccagaggagcugcugagcc

SEQ ID NO: 3912911 - RNA, 13 nt, Human adenovirus C
cgccagcccgugc

SEQ ID NO: 3912912 - RNA, 15 nt, Human adenovirus C
cgccagcgacuggaa

SEQ ID NO: 3912913 - RNA, 13 nt, Human adenovirus C
cgccagugcgcca

SEQ ID NO: 3912914 - RNA, 19 nt, Human adenovirus C
cgccaguggcggcggcgcu

SEQ ID NO: 3912915 - RNA, 13 nt, Human adenovirus C
cgccauagucaau

SEQ ID NO: 3912916 - RNA, 15 nt, Human adenovirus C
cgccaugggcuccag

SEQ ID NO: 3912917 - RNA, 23 nt, Human adenovirus C
cgccaugggcuccagugagcagg

SEQ ID NO: 3912918 - RNA, 17 nt, Human adenovirus C
cgcccgcgccugcuggg

SEQ ID NO: 3912919 - RNA, 16 nt, Human adenovirus C
cgcccucuuccuccca

SEQ ID NO: 3912920 - RNA, 22 nt, Human adenovirus C
cgcccugcgcgucggccaggua

SEQ ID NO: 3912921 - RNA, 17 nt, Human adenovirus C
cgccgagcuguugcccg

SEQ ID NO: 3912922 - RNA, 16 nt, Human adenovirus C
cgccgccacccacgga

SEQ ID NO: 3912923 - RNA, 14 nt, Human adenovirus C
cgccgccagaggag

SEQ ID NO: 3912924 - RNA, 20 nt, Human adenovirus C
cgccgcuucagccgcugcag

SEQ ID NO: 3912925 - RNA, 18 nt, Human adenovirus C
cgccggagaucuauggcc

SEQ ID NO: 3912926 - RNA, 20 nt, Human adenovirus C
cgccgggcccggcacuaccu

SEQ ID NO: 3912927 - RNA, 15 nt, Human adenovirus C
cgccuacccccggcu

SEQ ID NO: 3912928 - RNA, 21 nt, Human adenovirus C
cgccugcgucauuacccaggg

SEQ ID NO: 3912929 - RNA, 21 nt, Human adenovirus C
cgcgaccgugucuagcuugcu

SEQ ID NO: 3912930 - RNA, 22 nt, Human adenovirus C
cgcgaggaggacuuugagcccg

SEQ ID NO: 3912931 - RNA, 23 nt, Human adenovirus C
cgcgaggccauaggucaggcgca

SEQ ID NO: 3912932 - RNA, 15 nt, Human adenovirus C
cgcgagucuggugac

SEQ ID NO: 3912933 - RNA, 20 nt, Human adenovirus C
cgcgcacgucgcaccggccg

SEQ ID NO: 3912934 - RNA, 22 nt, Human adenovirus C
cgcgcaugcccccaugggccgg

SEQ ID NO: 3912935 - RNA, 14 nt, Human adenovirus C
cgcgcccuggaggc

SEQ ID NO: 3912936 - RNA, 13 nt, Human adenovirus C
cgcgccgacacgg

SEQ ID NO: 3912937 - RNA, 11 nt, Human adenovirus C
cgcgccgcacc

SEQ ID NO: 3912938 - RNA, 17 nt, Human adenovirus C
cgcgccuaccaccuucc

SEQ ID NO: 3912939 - RNA, 19 nt, Human adenovirus C
cgcgccuguugcugcugcu

SEQ ID NO: 3912940 - RNA, 14 nt, Human adenovirus C
cgcgcgcggcgguc

SEQ ID NO: 3912941 - RNA, 23 nt, Human adenovirus C
cgcgcucaaaggcuacaggggcc

SEQ ID NO: 3912942 - RNA, 12 nt, Human adenovirus C
cgcgcuggagca

SEQ ID NO: 3912943 - RNA, 17 nt, Human adenovirus C
cgcgcuggccagggugc

SEQ ID NO: 3912944 - RNA, 15 nt, Human adenovirus C
cgcgcuggucucugg

SEQ ID NO: 3912945 - RNA, 18 nt, Human adenovirus C
cgcggcaaacgcucugca

SEQ ID NO: 3912946 - RNA, 13 nt, Human adenovirus C
cgcggcaccagcg

SEQ ID NO: 3912947 - RNA, 12 nt, Human adenovirus C
cgcggcagaacc

SEQ ID NO: 3912948 - RNA, 16 nt, Human adenovirus C
cgcggcggcugcugcg

SEQ ID NO: 3912949 - RNA, 15 nt, Human adenovirus C
cgcggcggucaccag

SEQ ID NO: 3912950 - RNA, 19 nt, Human adenovirus C
cgcgggcggagggugccag

SEQ ID NO: 3912951 - RNA, 22 nt, Human adenovirus C
cgcggggacaggaggacuacac

SEQ ID NO: 3912952 - RNA, 16 nt, Human adenovirus C
cgcgguaccugcggcc

SEQ ID NO: 3912953 - RNA, 12 nt, Human adenovirus C
cgcgguggugga

SEQ ID NO: 3912954 - RNA, 14 nt, Human adenovirus C
caggagcgcugggc

SEQ ID NO: 3912955 - RNA, 13 nt, Human adenovirus C
caggcagaggcgg

SEQ ID NO: 3912956 - RNA, 13 nt, Human adenovirus C
caggccaacgagc

SEQ ID NO: 3912957 - RNA, 14 nt, Human adenovirus C
caggcgaccgcgcg

SEQ ID NO: 3912958 - RNA, 19 nt, Human adenovirus C
caggcggccgcugcggccg

SEQ ID NO: 3912959 - RNA, 17 nt, Human adenovirus C
caggcggucggccaugc

SEQ ID NO: 3912960 - RNA, 20 nt, Human adenovirus C
caggcuacuaagaaaacaca

SEQ ID NO: 3912961 - RNA, 11 nt, Human adenovirus C
caggcugggga

SEQ ID NO: 3912962 - RNA, 21 nt, Human adenovirus C
cagggaagaaacucuggugac

SEQ ID NO: 3912963 - RNA, 20 nt, Human adenovirus C
cagggcuacgugcgccaggc

SEQ ID NO: 3912964 - RNA, 17 nt, Human adenovirus C
caggguauaacucaccu

SEQ ID NO: 3912965 - RNA, 18 nt, Human adenovirus C
caggguauaacucaccug

SEQ ID NO: 3912966 - RNA, 14 nt, Human adenovirus C
cagggucugccaga

SEQ ID NO: 3912967 - RNA, 12 nt, Human adenovirus C
cagggugcgcca

SEQ ID NO: 3912968 - RNA, 15 nt, Human adenovirus C
caggucaucgcgccg

SEQ ID NO: 3912969 - RNA, 22 nt, Human adenovirus C
caggucucugcgcucccucacc

SEQ ID NO: 3912970 - RNA, 14 nt, Human adenovirus C
caggugagcucugg

SEQ ID NO: 3912971 - RNA, 16 nt, Human adenovirus C
cagguuucugcccuga

SEQ ID NO: 3912972 - RNA, 22 nt, Human adenovirus C
cagguuuuguaagcgaagacga

SEQ ID NO: 3912973 - RNA, 13 nt, Human adenovirus C
caguaacugcagc

SEQ ID NO: 3912974 - RNA, 14 nt, Human adenovirus C
caguacuggcagcg

SEQ ID NO: 3912975 - RNA, 18 nt, Human adenovirus C
caguagucggugcucguc

SEQ ID NO: 3912976 - RNA, 15 nt, Human adenovirus C
caguauuacccagaa

SEQ ID NO: 3912977 - RNA, 21 nt, Human adenovirus C
cagucaaguuuacuugcaugg

SEQ ID NO: 3912978 - RNA, 19 nt, Human adenovirus C
cagucacaagccccacuga

SEQ ID NO: 3912979 - RNA, 14 nt, Human adenovirus C
cagucacagucgca

SEQ ID NO: 3912980 - RNA, 13 nt, Human adenovirus C
cagucaggcagag

SEQ ID NO: 3912981 - RNA, 19 nt, Human adenovirus C
cagucaugagcgagcugau

SEQ ID NO: 3912982 - RNA, 17 nt, Human adenovirus C
cagucgagaaggaggac

SEQ ID NO: 3912983 - RNA, 13 nt, Human adenovirus C
cagucugcaagau

SEQ ID NO: 3912984 - RNA, 15 nt, Human adenovirus C
cagucugcagcgcug

SEQ ID NO: 3912985 - RNA, 21 nt, Human adenovirus C
cagugcaacaugaccaaggac

SEQ ID NO: 3912986 - RNA, 20 nt, Human adenovirus C
caguggaacgaagcugaugc

SEQ ID NO: 3912987 - RNA, 15 nt, Human adenovirus C
caguggcagcggcgc

SEQ ID NO: 3912988 - RNA, 15 nt, Human adenovirus C
caguggucuccucag

SEQ ID NO: 3912989 - RNA, 15 nt, Human adenovirus C
caguucauugacugg

SEQ ID NO: 3912990 - RNA, 12 nt, Human adenovirus C
caguuuccaaaa

SEQ ID NO: 3912991 - RNA, 14 nt, Human adenovirus C
cauaaaaaaaucca

SEQ ID NO: 3912992 - RNA, 21 nt, Human adenovirus C
cauaaacacgcuggacauaaa

SEQ ID NO: 3912993 - RNA, 15 nt, Human adenovirus C
cauaacauggugugu

SEQ ID NO: 3912994 - RNA, 17 nt, Human adenovirus C
cauacggccgccagagc

SEQ ID NO: 3912995 - RNA, 20 nt, Human adenovirus C
cauauauccauaccuugaca

SEQ ID NO: 3912996 - RNA, 22 nt, Human adenovirus C
caucaccuccuuuccuuccucc

SEQ ID NO: 3912997 - RNA, 17 nt, Human adenovirus C
caucaucgucacaaagg

SEQ ID NO: 3912998 - RNA, 14 nt, Human adenovirus C
caucaucucuguca

SEQ ID NO: 3912999 - RNA, 14 nt, Human adenovirus C
cauccauguccaca

SEQ ID NO: 3913000 - RNA, 15 nt, Human adenovirus C
cauccgcccugcucc

SEQ ID NO: 3913001 - RNA, 13 nt, Human adenovirus C
cauccgcggcagc

SEQ ID NO: 3913002 - RNA, 18 nt, Human adenovirus C
cauccggugcugcggcag

SEQ ID NO: 3913003 - RNA, 21 nt, Human adenovirus C
cauccguggccuugcaggcgc

SEQ ID NO: 3913004 - RNA, 18 nt, Human adenovirus C
caucgcagcuaaaugccg

SEQ ID NO: 3913005 - RNA, 17 nt, Human adenovirus C
caucgcgcaacugggca

SEQ ID NO: 3913006 - RNA, 18 nt, Human adenovirus C
caucuccuaacugcagaa

SEQ ID NO: 3913007 - RNA, 20 nt, Human adenovirus C
caucuccuucgcccgccgcu

SEQ ID NO: 3913008 - RNA, 15 nt, Human adenovirus C
caucucgggccagga

SEQ ID NO: 3913009 - RNA, 13 nt, Human adenovirus C
caucugcagcgcc

SEQ ID NO: 3913010 - RNA, 14 nt, Human adenovirus C
caucuuccaccgcg

SEQ ID NO: 3913011 - RNA, 19 nt, Human adenovirus C
caucuugcgcuaugugcag

SEQ ID NO: 3913012 - RNA, 14 nt, Human adenovirus C
caugaaagccuuga

SEQ ID NO: 3913013 - RNA, 21 nt, Human adenovirus C
caugaagggcacgagcugcuu

SEQ ID NO: 3913014 - RNA, 18 nt, Human adenovirus C
caugagccgguguccacg

SEQ ID NO: 3913015 - RNA, 14 nt, Human adenovirus C
caugagcgagcuga

SEQ ID NO: 3913016 - RNA, 15 nt, Human adenovirus C
caugcagggcacccu

SEQ ID NO: 3913017 - RNA, 16 nt, Human adenovirus C
caugcgcgagggacag

SEQ ID NO: 3913018 - RNA, 21 nt, Human adenovirus C
caugcgcgggcggcaagcgcg

SEQ ID NO: 3913019 - RNA, 22 nt, Human adenovirus C
caugcuauaccccauacccgcc

SEQ ID NO: 3913020 - RNA, 22 nt, Human adenovirus C
cauggaccgcaucaugucgcug

SEQ ID NO: 3913021 - RNA, 14 nt, Human adenovirus C
cauggcauggggug

SEQ ID NO: 3913022 - RNA, 17 nt, Human adenovirus C
cauggcauggggugggu

SEQ ID NO: 3913023 - RNA, 20 nt, Human adenovirus C
cauggguguucuugcugguc

SEQ ID NO: 3913024 - RNA, 17 nt, Human adenovirus C
cauguacucguucuuca

SEQ ID NO: 3913025 - RNA, 13 nt, Human adenovirus C
caugucccugacu

SEQ ID NO: 3913026 - RNA, 13 nt, Human adenovirus C
caugucgccgcca

SEQ ID NO: 3913027 - RNA, 17 nt, Human adenovirus C
caugucuaugcccaggc

SEQ ID NO: 3913028 - RNA, 19 nt, Human adenovirus C
cauguggaguuaccagcca

SEQ ID NO: 3913029 - RNA, 22 nt, Human adenovirus C
cauguggaguuaccagccacaa

SEQ ID NO: 3913030 - RNA, 12 nt, Human adenovirus C
cauuaacaugga

SEQ ID NO: 3913031 - RNA, 15 nt, Human adenovirus C
cauucagaccguggu

SEQ ID NO: 3913032 - RNA, 19 nt, Human adenovirus C
cauuccacgagccagguga

SEQ ID NO: 3913033 - RNA, 14 nt, Human adenovirus C
cauucccagcugcu

SEQ ID NO: 3913034 - RNA, 18 nt, Human adenovirus C
cauucgcggcgacaccuu

SEQ ID NO: 3913035 - RNA, 14 nt, Human adenovirus C
cauucugcagagca

SEQ ID NO: 3913036 - RNA, 15 nt, Human adenovirus C
cauucugcagagcau

SEQ ID NO: 3913037 - RNA, 17 nt, Human adenovirus C
cauuguaaaaaucugcu

SEQ ID NO: 3913038 - RNA, 13 nt, Human adenovirus C
cauuuuaaaaaaa

SEQ ID NO: 3913039 - RNA, 15 nt, Human adenovirus C
cauuuuaaaaaaacu

SEQ ID NO: 3913040 - RNA, 18 nt, Human adenovirus C
cauuuuaaaaaaacuaca

SEQ ID NO: 3913041 - RNA, 15 nt, Human adenovirus C
cauuuuugcccuagc

SEQ ID NO: 3913042 - RNA, 22 nt, Human adenovirus C
cauuuuuucuggggugaugcag

SEQ ID NO: 3913043 - RNA, 20 nt, Human adenovirus C
ccaaaaagaagcugcagcug

SEQ ID NO: 3913044 - RNA, 14 nt, Human adenovirus C
ccaaaccucagcgc

SEQ ID NO: 3913045 - RNA, 17 nt, Human adenovirus C
ccaaacgccaagaaaac

SEQ ID NO: 3913046 - RNA, 22 nt, Human adenovirus C
ccaaacuuaccuacgaaaaaac

SEQ ID NO: 3913047 - RNA, 13 nt, Human adenovirus C
ccaaagcaaaccu

SEQ ID NO: 3913048 - RNA, 20 nt, Human adenovirus C
ccaaagcgugcaggggccca

SEQ ID NO: 3913049 - RNA, 22 nt, Human adenovirus C
ccaaaugcggagcuuaccgccu

SEQ ID NO: 3913050 - RNA, 17 nt, Human adenovirus C
ccaacaccuagccuaaa

SEQ ID NO: 3913051 - RNA, 12 nt, Human adenovirus C
ccaaccgcagcc

SEQ ID NO: 3913052 - RNA, 22 nt, Human adenovirus C
ccaaccgcgguugugcagggug

SEQ ID NO: 3913053 - RNA, 23 nt, Human adenovirus C
ccaacgcgccuaccaccuucccc

SEQ ID NO: 3913054 - RNA, 15 nt, Human adenovirus C
ccaacgcggcagccg

SEQ ID NO: 3913055 - RNA, 18 nt, Human adenovirus C
ccaacgcggcagccgcgg

SEQ ID NO: 3913056 - RNA, 22 nt, Human adenovirus C
ccaacgugccgcggggacagga

SEQ ID NO: 3913057 - RNA, 18 nt, Human adenovirus C
ccaacguggagcucugca

SEQ ID NO: 3913058 - RNA, 15 nt, Human adenovirus C
ccaacucggccgccu

SEQ ID NO: 3913059 - RNA, 21 nt, Human adenovirus C
ccaacucugguaucucagccg

SEQ ID NO: 3913060 - RNA, 20 nt, Human adenovirus C
ccaagaaauccacagcggcg

SEQ ID NO: 3913061 - RNA, 13 nt, Human adenovirus C
ccaagaagcgcgg

SEQ ID NO: 3913062 - RNA, 21 nt, Human adenovirus C
ccaagagcaacaacagcgcca

SEQ ID NO: 3913063 - RNA, 24 nt, Human adenovirus C
ccaagccgacgcgcccuggaggca

SEQ ID NO: 3913064 - RNA, 18 nt, Human adenovirus C
ccaagguuaugagcacag

SEQ ID NO: 3913065 - RNA, 11 nt, Human adenovirus C
ccaaguacaga

SEQ ID NO: 3913066 - RNA, 20 nt, Human adenovirus C
ccaauccccccgccgccgca

SEQ ID NO: 3913067 - RNA, 23 nt, Human adenovirus C
ccaauccccccgccgccgcagcc

SEQ ID NO: 3913068 - RNA, 15 nt, Human adenovirus C
ccacacaagcucgcc

SEQ ID NO: 3913069 - RNA, 17 nt, Human adenovirus C
ccacacccagccaaccu

SEQ ID NO: 3913070 - RNA, 15 nt, Human adenovirus C
ccacaccuacagccu

SEQ ID NO: 3913071 - RNA, 18 nt, Human adenovirus C
ccacagaccggucccagc

SEQ ID NO: 3913072 - RNA, 22 nt, Human adenovirus C
ccacagcucggucacgugcucu

SEQ ID NO: 3913073 - RNA, 17 nt, Human adenovirus C
ccacaggcugcugucca

SEQ ID NO: 3913074 - RNA, 18 nt, Human adenovirus C
ccacaggcugcuguccaa

SEQ ID NO: 3913075 - RNA, 12 nt, Human adenovirus C
ccaccaacgugc

SEQ ID NO: 3913076 - RNA, 12 nt, Human adenovirus C
ccaccaccgccu

SEQ ID NO: 3913077 - RNA, 12 nt, Human adenovirus C
ccaccacuggaa

SEQ ID NO: 3913078 - RNA, 13 nt, Human adenovirus C
ccaccacuggaac

SEQ ID NO: 3913079 - RNA, 13 nt, Human adenovirus C
ccaccauccuaaa

SEQ ID NO: 3913080 - RNA, 23 nt, Human adenovirus C
ccacccgcccgcgccugcugggc

SEQ ID NO: 3913081 - RNA, 13 nt, Human adenovirus C
ccacccuucuuua

SEQ ID NO: 3913082 - RNA, 18 nt, Human adenovirus C
ccaccgcggaugcuggcg

SEQ ID NO: 3913083 - RNA, 13 nt, Human adenovirus C
ccaccggccgugg

SEQ ID NO: 3913084 - RNA, 15 nt, Human adenovirus C
ccaccggccguggag

SEQ ID NO: 3913085 - RNA, 22 nt, Human adenovirus C
ccaccugagccuuugcgccuuc

SEQ ID NO: 3913086 - RNA, 22 nt, Human adenovirus C
ccaccuucuuccccauggccca

SEQ ID NO: 3913087 - RNA, 17 nt, Human adenovirus C
ccacgcucggugacgaa

SEQ ID NO: 3913088 - RNA, 17 nt, Human adenovirus C
ccacgguaaagaccccg

SEQ ID NO: 3913089 - RNA, 22 nt, Human adenovirus C
ccacuaccggcaaccgccucag

SEQ ID NO: 3913090 - RNA, 16 nt, Human adenovirus C
ccacucgcccuacuuc

SEQ ID NO: 3913091 - RNA, 21 nt, Human adenovirus C
ccacuggcagggacacguugc

SEQ ID NO: 3913092 - RNA, 16 nt, Human adenovirus C
ccacuguuacucagcc

SEQ ID NO: 3913093 - RNA, 17 nt, Human adenovirus C
ccacuguuacucagcca

SEQ ID NO: 3913094 - RNA, 19 nt, Human adenovirus C
ccacuuacaauuaccucag

SEQ ID NO: 3913095 - RNA, 11 nt, Human adenovirus C
ccacuucuuuu

SEQ ID NO: 3913096 - RNA, 18 nt, Human adenovirus C
ccagaacgaccacagcaa

SEQ ID NO: 3913097 - RNA, 21 nt, Human adenovirus C
ccagacaagcuaaaauacaac

SEQ ID NO: 3913098 - RNA, 14 nt, Human adenovirus C
ccagacacacaucu

SEQ ID NO: 3913099 - RNA, 21 nt, Human adenovirus C
ccagacaucauuuugcugcca

SEQ ID NO: 3913100 - RNA, 21 nt, Human adenovirus C
ccagaccaguagacaaggccu

SEQ ID NO: 3913101 - RNA, 21 nt, Human adenovirus C
ccagaccgucugaagacaccu

SEQ ID NO: 3913102 - RNA, 14 nt, Human adenovirus C
ccagacgccgcacc

SEQ ID NO: 3913103 - RNA, 15 nt, Human adenovirus C
ccagacgggccaggg

SEQ ID NO: 3913104 - RNA, 20 nt, Human adenovirus C
ccagagaugaccggcucaac

SEQ ID NO: 3913105 - RNA, 16 nt, Human adenovirus C
ccagaggagcugcuga

SEQ ID NO: 3913106 - RNA, 20 nt, Human adenovirus C
ccagaggagcugcugagccg

SEQ ID NO: 3913107 - RNA, 21 nt, Human adenovirus C
ccagauguccgcgcgcggcgg

SEQ ID NO: 3913108 - RNA, 17 nt, Human adenovirus C
ccagauugcaaguacaa

SEQ ID NO: 3913109 - RNA, 13 nt, Human adenovirus C
ccagcacacaccu

SEQ ID NO: 3913110 - RNA, 16 nt, Human adenovirus C
ccagcaucgcuacaac

SEQ ID NO: 3913111 - RNA, 24 nt, Human adenovirus C
ccagcccaugagccggcaaguggu

SEQ ID NO: 3913112 - RNA, 13 nt, Human adenovirus C
ccagccugugaug

SEQ ID NO: 3913113 - RNA, 14 nt, Human adenovirus C
ccagcgacuggaag

SEQ ID NO: 3913114 - RNA, 12 nt, Human adenovirus C
ccagcggccaca

SEQ ID NO: 3913115 - RNA, 14 nt, Human adenovirus C
ccagcggccacacc

SEQ ID NO: 3913116 - RNA, 22 nt, Human adenovirus C
ccagcucggcggugaccugcac

SEQ ID NO: 3913117 - RNA, 23 nt, Human adenovirus C
ccagcuuauucagcaucaccucc

SEQ ID NO: 3913118 - RNA, 18 nt, Human adenovirus C
ccaggaaccaugacaaaa

SEQ ID NO: 3913119 - RNA, 15 nt, Human adenovirus C
ccaggauggcaccca

SEQ ID NO: 3913120 - RNA, 21 nt, Human adenovirus C
ccaggccagcacgaaggaggc

SEQ ID NO: 3913121 - RNA, 18 nt, Human adenovirus C
ccaggccgucuacuccca

SEQ ID NO: 3913122 - RNA, 21 nt, Human adenovirus C
ccaggcgacgagcggccgccg

SEQ ID NO: 3913123 - RNA, 20 nt, Human adenovirus C
ccaggcgcggcggcugcugc

SEQ ID NO: 3913124 - RNA, 12 nt, Human adenovirus C
ccaggcgggcaa

SEQ ID NO: 3913125 - RNA, 14 nt, Human adenovirus C
ccaggcggucccac

SEQ ID NO: 3913126 - RNA, 21 nt, Human adenovirus C
ccaggguuuccuugaugaugu

SEQ ID NO: 3913127 - RNA, 20 nt, Human adenovirus C
ccaggugaugccggcggcgg

SEQ ID NO: 3913128 - RNA, 22 nt, Human adenovirus C
ccaguagcacuaguauugccac

SEQ ID NO: 3913129 - RNA, 15 nt, Human adenovirus C
ccaguccgggccaga

SEQ ID NO: 3913130 - RNA, 16 nt, Human adenovirus C
ccaguccgggccagac

SEQ ID NO: 3913131 - RNA, 21 nt, Human adenovirus C
ccaguccuuuaaugacuaccu

SEQ ID NO: 3913132 - RNA, 19 nt, Human adenovirus C
ccagucguagcaggagcgc

SEQ ID NO: 3913133 - RNA, 15 nt, Human adenovirus C
ccagugagcaggaac

SEQ ID NO: 3913134 - RNA, 17 nt, Human adenovirus C
ccaguggagaggcagag

SEQ ID NO: 3913135 - RNA, 18 nt, Human adenovirus C
ccaguggcaacuggcaaa

SEQ ID NO: 3913136 - RNA, 21 nt, Human adenovirus C
ccaguggcggcggcgcugggu

SEQ ID NO: 3913137 - RNA, 18 nt, Human adenovirus C
ccauagcggaugucagcc

SEQ ID NO: 3913138 - RNA, 15 nt, Human adenovirus C
ccaucaacaaagccc

SEQ ID NO: 3913139 - RNA, 19 nt, Human adenovirus C
ccaucaacaaagcccgcca

SEQ ID NO: 3913140 - RNA, 12 nt, Human adenovirus C
ccaucaccaccg

SEQ ID NO: 3913141 - RNA, 14 nt, Human adenovirus C
ccauccggcccagg

SEQ ID NO: 3913142 - RNA, 19 nt, Human adenovirus C
ccaucgcgcccauggcuac

SEQ ID NO: 3913143 - RNA, 20 nt, Human adenovirus C
ccaucgcgcccauggcuacc

SEQ ID NO: 3913144 - RNA, 19 nt, Human adenovirus C
ccaucuauaggccuaucau

SEQ ID NO: 3913145 - RNA, 14 nt, Human adenovirus C
ccaucugagcgggg

SEQ ID NO: 3913146 - RNA, 13 nt, Human adenovirus C
ccaugcuuuuuga

SEQ ID NO: 3913147 - RNA, 22 nt, Human adenovirus C
ccauuacaauaggaaacaaaaa

SEQ ID NO: 3913148 - RNA, 22 nt, Human adenovirus C
ccauuugaugcucaaacaaaac

SEQ ID NO: 3913149 - RNA, 18 nt, Human adenovirus C
ccauuuuugcccuagcca

SEQ ID NO: 3913150 - RNA, 22 nt, Human adenovirus C
cccaaaaagaagcugcagcugc

SEQ ID NO: 3913151 - RNA, 17 nt, Human adenovirus C
cccaacccgcgccucaa

SEQ ID NO: 3913152 - RNA, 23 nt, Human adenovirus C
cccaacucugguaucucagccgc

SEQ ID NO: 3913153 - RNA, 17 nt, Human adenovirus C
cccaagggugcagcuga

SEQ ID NO: 3913154 - RNA, 13 nt, Human adenovirus C
cccaccacugugg

SEQ ID NO: 3913155 - RNA, 11 nt, Human adenovirus C
cccagacacac

SEQ ID NO: 3913156 - RNA, 24 nt, Human adenovirus C
cccagaugcauccggugcugcggc

SEQ ID NO: 3913157 - RNA, 18 nt, Human adenovirus C
cccagcacucggcagaaa

SEQ ID NO: 3913158 - RNA, 23 nt, Human adenovirus C
cccagcacucggcagaaacagag

SEQ ID NO: 3913159 - RNA, 14 nt, Human adenovirus C
cccagcugcuacaa

SEQ ID NO: 3913160 - RNA, 16 nt, Human adenovirus C
cccagcuucagcuugc

SEQ ID NO: 3913161 - RNA, 20 nt, Human adenovirus C
cccaggcggcggguacagug

SEQ ID NO: 3913162 - RNA, 14 nt, Human adenovirus C
cccagggccacauc

SEQ ID NO: 3913163 - RNA, 21 nt, Human adenovirus C
cccauggacgagcccacccuu

SEQ ID NO: 3913164 - RNA, 16 nt, Human adenovirus C
cccauggcccacaaca

SEQ ID NO: 3913165 - RNA, 20 nt, Human adenovirus C
cccauggcccacaacacggc

SEQ ID NO: 3913166 - RNA, 19 nt, Human adenovirus C
ccccaaaaguuuuuugcca

SEQ ID NO: 3913167 - RNA, 12 nt, Human adenovirus C
ccccacaugaua

SEQ ID NO: 3913168 - RNA, 16 nt, Human adenovirus C
ccccagguccaggcga

SEQ ID NO: 3913169 - RNA, 16 nt, Human adenovirus C
ccccgggcagcaggcg

SEQ ID NO: 3913170 - RNA, 24 nt, Human adenovirus C
ccccgguugccucggcgguggcag

SEQ ID NO: 3913171 - RNA, 17 nt, Human adenovirus C
ccccuucgaugcucccc

SEQ ID NO: 3913172 - RNA, 20 nt, Human adenovirus C
ccccuucggcaucgcgggcg

SEQ ID NO: 3913173 - RNA, 19 nt, Human adenovirus C
cccgagagccggccuggac

SEQ ID NO: 3913174 - RNA, 15 nt, Human adenovirus C
cccgagggccgcugg

SEQ ID NO: 3913175 - RNA, 19 nt, Human adenovirus C
cccgagggccgcuggcugc

SEQ ID NO: 3913176 - RNA, 20 nt, Human adenovirus C
cccgagggccgcuggcugcu

SEQ ID NO: 3913177 - RNA, 16 nt, Human adenovirus C
cccgccaacgugccgc

SEQ ID NO: 3913178 - RNA, 15 nt, Human adenovirus C
cccgccaccaguugg

SEQ ID NO: 3913179 - RNA, 22 nt, Human adenovirus C
cccgccaccugcugugcgcuuc

SEQ ID NO: 3913180 - RNA, 17 nt, Human adenovirus C
cccgccgccgcagcccu

SEQ ID NO: 3913181 - RNA, 18 nt, Human adenovirus C
cccgccgggagagggggc

SEQ ID NO: 3913182 - RNA, 14 nt, Human adenovirus C
cccgcgccacuggg

SEQ ID NO: 3913183 - RNA, 14 nt, Human adenovirus C
cccgcggugcuccu

SEQ ID NO: 3913184 - RNA, 21 nt, Human adenovirus C
cccggaauugcauccguggcc

SEQ ID NO: 3913185 - RNA, 18 nt, Human adenovirus C
cccggccacuacccggac

SEQ ID NO: 3913186 - RNA, 13 nt, Human adenovirus C
cccggcgccagca

SEQ ID NO: 3913187 - RNA, 15 nt, Human adenovirus C
cccggcggugcgggc

SEQ ID NO: 3913188 - RNA, 16 nt, Human adenovirus C
cccggcggugcgggcg

SEQ ID NO: 3913189 - RNA, 21 nt, Human adenovirus C
cccguagaggagccuccaccg

SEQ ID NO: 3913190 - RNA, 13 nt, Human adenovirus C
cccgugggcucgu

SEQ ID NO: 3913191 - RNA, 20 nt, Human adenovirus C
cccguucaugggaaacuggc

SEQ ID NO: 3913192 - RNA, 17 nt, Human adenovirus C
aggcaucgcagcuaaau

SEQ ID NO: 3913193 - RNA, 14 nt, Human adenovirus C
aggccaagcagcuu

SEQ ID NO: 3913194 - RNA, 13 nt, Human adenovirus C
aggccagaugcug

SEQ ID NO: 3913195 - RNA, 12 nt, Human adenovirus C
aggcccugggca

SEQ ID NO: 3913196 - RNA, 14 nt, Human adenovirus C
aggcccuuggugua

SEQ ID NO: 3913197 - RNA, 14 nt, Human adenovirus C
aggcgccgccggca

SEQ ID NO: 3913198 - RNA, 20 nt, Human adenovirus C
aggcggccgcccuugcgcga

SEQ ID NO: 3913199 - RNA, 19 nt, Human adenovirus C
aggcggcggguacagugga

SEQ ID NO: 3913200 - RNA, 22 nt, Human adenovirus C
aggcggucuugagacggcggau

SEQ ID NO: 3913201 - RNA, 14 nt, Human adenovirus C
aggcguacgugccg

SEQ ID NO: 3913202 - RNA, 15 nt, Human adenovirus C
aggcuaauggcaaug

SEQ ID NO: 3913203 - RNA, 17 nt, Human adenovirus C
aggcucucuucagcaaa

SEQ ID NO: 3913204 - RNA, 16 nt, Human adenovirus C
agggaagaaacucugg

SEQ ID NO: 3913205 - RNA, 15 nt, Human adenovirus C
agggcaaccugggcu

SEQ ID NO: 3913206 - RNA, 13 nt, Human adenovirus C
agggcccuggcug

SEQ ID NO: 3913207 - RNA, 14 nt, Human adenovirus C
agggccgcuggcug

SEQ ID NO: 3913208 - RNA, 15 nt, Human adenovirus C
agggccgcuggcugc

SEQ ID NO: 3913209 - RNA, 22 nt, Human adenovirus C
aggggcaacguguacugggugc

SEQ ID NO: 3913210 - RNA, 17 nt, Human adenovirus C
aggguaucauggcggac

SEQ ID NO: 3913211 - RNA, 15 nt, Human adenovirus C
aggguggccgcgucc

SEQ ID NO: 3913212 - RNA, 16 nt, Human adenovirus C
aggucacuugcugaca

SEQ ID NO: 3913213 - RNA, 13 nt, Human adenovirus C
aggucagcugcaa

SEQ ID NO: 3913214 - RNA, 17 nt, Human adenovirus C
agguccgcgugcggcca

SEQ ID NO: 3913215 - RNA, 22 nt, Human adenovirus C
aggucguuggagaugcgggcca

SEQ ID NO: 3913216 - RNA, 13 nt, Human adenovirus C
aggugaugaaaau

SEQ ID NO: 3913217 - RNA, 12 nt, Human adenovirus C
aggugcagaccc

SEQ ID NO: 3913218 - RNA, 13 nt, Human adenovirus C
agguggaacugcu

SEQ ID NO: 3913219 - RNA, 22 nt, Human adenovirus C
agguggagauagauacggagga

SEQ ID NO: 3913220 - RNA, 19 nt, Human adenovirus C
agguggcacuuaggccaga

SEQ ID NO: 3913221 - RNA, 22 nt, Human adenovirus C
agguguaccaguccgggccaga

SEQ ID NO: 3913222 - RNA, 14 nt, Human adenovirus C
agguugaguuuaag

SEQ ID NO: 3913223 - RNA, 16 nt, Human adenovirus C
agguuucuguggggcu

SEQ ID NO: 3913224 - RNA, 15 nt, Human adenovirus C
aguaacugcagcaca

SEQ ID NO: 3913225 - RNA, 17 nt, Human adenovirus C
aguaaguuugccacaca

SEQ ID NO: 3913226 - RNA, 15 nt, Human adenovirus C
aguaccuuaccuggu

SEQ ID NO: 3913227 - RNA, 13 nt, Human adenovirus C
aguacgagccaga

SEQ ID NO: 3913228 - RNA, 20 nt, Human adenovirus C
aguacggcaccgccagcgca

SEQ ID NO: 3913229 - RNA, 22 nt, Human adenovirus C
aguagaagucccugcgacgggc

SEQ ID NO: 3913230 - RNA, 22 nt, Human adenovirus C
agucagucgagaaggaggacag

SEQ ID NO: 3913231 - RNA, 15 nt, Human adenovirus C
aguccacaaaaaaca

SEQ ID NO: 3913232 - RNA, 17 nt, Human adenovirus C
aguccacaaaaaacacc

SEQ ID NO: 3913233 - RNA, 17 nt, Human adenovirus C
aguccacgccuacaugg

SEQ ID NO: 3913234 - RNA, 18 nt, Human adenovirus C
aguccccagguacagccc

SEQ ID NO: 3913235 - RNA, 22 nt, Human adenovirus C
agucgagaaggaggacagccua

SEQ ID NO: 3913236 - RNA, 22 nt, Human adenovirus C
agucuagcgccugcugccaugc

SEQ ID NO: 3913237 - RNA, 22 nt, Human adenovirus C
agucucacgcucgcuugguccu

SEQ ID NO: 3913238 - RNA, 14 nt, Human adenovirus C
agucucgggccggc

SEQ ID NO: 3913239 - RNA, 21 nt, Human adenovirus C
agucugcagcgcugccaaaaa

SEQ ID NO: 3913240 - RNA, 15 nt, Human adenovirus C
agucuuccaagguga

SEQ ID NO: 3913241 - RNA, 15 nt, Human adenovirus C
agugaagauguaaau

SEQ ID NO: 3913242 - RNA, 21 nt, Human adenovirus C
agugcaaaauaagauuaacag

SEQ ID NO: 3913243 - RNA, 18 nt, Human adenovirus C
agugcagcacagcaggga

SEQ ID NO: 3913244 - RNA, 12 nt, Human adenovirus C
agugcggcggcg

SEQ ID NO: 3913245 - RNA, 13 nt, Human adenovirus C
agugcugggccag

SEQ ID NO: 3913246 - RNA, 22 nt, Human adenovirus C
agugcuuaaaaaaacaacuccc

SEQ ID NO: 3913247 - RNA, 15 nt, Human adenovirus C
aguggacaagaugag

SEQ ID NO: 3913248 - RNA, 13 nt, Human adenovirus C
agugggcaggcag

SEQ ID NO: 3913249 - RNA, 18 nt, Human adenovirus C
agugucgucgcauccgcc

SEQ ID NO: 3913250 - RNA, 18 nt, Human adenovirus C
agugucuugcugucuuua

SEQ ID NO: 3913251 - RNA, 17 nt, Human adenovirus C
aguuaagagagcugcag

SEQ ID NO: 3913252 - RNA, 18 nt, Human adenovirus C
aguucaugucgcugucca

SEQ ID NO: 3913253 - RNA, 20 nt, Human adenovirus C
aguuccaagaagcgcggggu

SEQ ID NO: 3913254 - RNA, 20 nt, Human adenovirus C
gucucggugacggcgcggcc

SEQ ID NO: 3913255 - RNA, 16 nt, Human adenovirus C
gucugcgagggccagc

SEQ ID NO: 3913256 - RNA, 14 nt, Human adenovirus C
gucuggagcucccg

SEQ ID NO: 3913257 - RNA, 15 nt, Human adenovirus C
gucugggucacggug

SEQ ID NO: 3913258 - RNA, 18 nt, Human adenovirus C
gucuugcauacggccgcc

SEQ ID NO: 3913259 - RNA, 16 nt, Human adenovirus C
gucuugucaugccugg

SEQ ID NO: 3913260 - RNA, 14 nt, Human adenovirus C
gucuuuccacgggc

SEQ ID NO: 3913261 - RNA, 19 nt, Human adenovirus C
gugaagacgacgggcccgg

SEQ ID NO: 3913262 - RNA, 21 nt, Human adenovirus C
gugacaacgcgcgccuagccg

SEQ ID NO: 3913263 - RNA, 24 nt, Human adenovirus C
gugacaaggucaacgcugguggcu

SEQ ID NO: 3913264 - RNA, 14 nt, Human adenovirus C
gugacggcgcggcc

SEQ ID NO: 3913265 - RNA, 13 nt, Human adenovirus C
gugagcgcacugc

SEQ ID NO: 3913266 - RNA, 14 nt, Human adenovirus C
gugagcgcggcgcc

SEQ ID NO: 3913267 - RNA, 17 nt, Human adenovirus C
gugagcuguuugauucu

SEQ ID NO: 3913268 - RNA, 23 nt, Human adenovirus C
gugauugguuuauagguguaggc

SEQ ID NO: 3913269 - RNA, 20 nt, Human adenovirus C
gugcacgaccccuggagagg

SEQ ID NO: 3913270 - RNA, 11 nt, Human adenovirus C
gugcagaccaa

SEQ ID NO: 3913271 - RNA, 12 nt, Human adenovirus C
gugcagcacagc

SEQ ID NO: 3913272 - RNA, 14 nt, Human adenovirus C
gugcaguuggccau

SEQ ID NO: 3913273 - RNA, 21 nt, Human adenovirus C
gugcaguuugcccgcgccacc

SEQ ID NO: 3913274 - RNA, 13 nt, Human adenovirus C
gugcaugcccagg

SEQ ID NO: 3913275 - RNA, 22 nt, Human adenovirus C
gugccaaaaaucuuugaggguc

SEQ ID NO: 3913276 - RNA, 13 nt, Human adenovirus C
gugccagaggugc

SEQ ID NO: 3913277 - RNA, 17 nt, Human adenovirus C
gugccccccagguccag

SEQ ID NO: 3913278 - RNA, 17 nt, Human adenovirus C
gugccccucgccauagc

SEQ ID NO: 3913279 - RNA, 15 nt, Human adenovirus C
gugcgcaguacuggc

SEQ ID NO: 3913280 - RNA, 20 nt, Human adenovirus C
gugcgccacaauguggccuc

SEQ ID NO: 3913281 - RNA, 15 nt, Human adenovirus C
gugcgcuuaccuccc

SEQ ID NO: 3913282 - RNA, 21 nt, Human adenovirus C
gugcuuaaaaaaacaacuccc

SEQ ID NO: 3913283 - RNA, 15 nt, Human adenovirus C
guggaccuggccaac

SEQ ID NO: 3913284 - RNA, 17 nt, Human adenovirus C
guggaggaggcgcgcaa

SEQ ID NO: 3913285 - RNA, 22 nt, Human adenovirus C
guggcaaccaccgcuccucuga

SEQ ID NO: 3913286 - RNA, 22 nt, Human adenovirus C
guggcaccgggacugggcgugc

SEQ ID NO: 3913287 - RNA, 22 nt, Human adenovirus C
gugggccgcggggguguccuug

SEQ ID NO: 3913288 - RNA, 19 nt, Human adenovirus C
guggggcuccucccaggca

SEQ ID NO: 3913289 - RNA, 21 nt, Human adenovirus C
gugggggaugugcgcgaggcc

SEQ ID NO: 3913290 - RNA, 17 nt, Human adenovirus C
gugggucugggggugca

SEQ ID NO: 3913291 - RNA, 20 nt, Human adenovirus C
guggucaagcaggccaaacu

SEQ ID NO: 3913292 - RNA, 20 nt, Human adenovirus C
gugguccgugugcaccagcc

SEQ ID NO: 3913293 - RNA, 17 nt, Human adenovirus C
guguaccaguccgggcc

SEQ ID NO: 3913294 - RNA, 20 nt, Human adenovirus C
guguaggccacgugaccggg

SEQ ID NO: 3913295 - RNA, 18 nt, Human adenovirus C
gugucagacgaaacaccg

SEQ ID NO: 3913296 - RNA, 22 nt, Human adenovirus C
gugugggcguggcuuaagggug

SEQ ID NO: 3913297 - RNA, 19 nt, Human adenovirus C
guguuccgcgguccuccuc

SEQ ID NO: 3913298 - RNA, 20 nt, Human adenovirus C
guuaacaugguucugcagag

SEQ ID NO: 3913299 - RNA, 16 nt, Human adenovirus C
guuagucugcagaauu

SEQ ID NO: 3913300 - RNA, 20 nt, Human adenovirus C
guucaugggaaacuggcaag

SEQ ID NO: 3913301 - RNA, 14 nt, Human adenovirus C
guuccacgcagggc

SEQ ID NO: 3913302 - RNA, 19 nt, Human adenovirus C
guuccagacgcggcuguag

SEQ ID NO: 3913303 - RNA, 18 nt, Human adenovirus C
guuccucguaggugagcu

SEQ ID NO: 3913304 - RNA, 14 nt, Human adenovirus C
guuccugagcagcu

SEQ ID NO: 3913305 - RNA, 16 nt, Human adenovirus C
guuccuugcauuuggg

SEQ ID NO: 3913306 - RNA, 18 nt, Human adenovirus C
guucgagucucgggccgg

SEQ ID NO: 3913307 - RNA, 15 nt, Human adenovirus C
guucuugcuggucag

SEQ ID NO: 3913308 - RNA, 17 nt, Human adenovirus C
guugaagcaucugcagc

SEQ ID NO: 3913309 - RNA, 17 nt, Human adenovirus C
guugacggggagggcua

SEQ ID NO: 3913310 - RNA, 14 nt, Human adenovirus C
guugaggguggugg

SEQ ID NO: 3913311 - RNA, 17 nt, Human adenovirus C
guugagucgcaggaccc

SEQ ID NO: 3913312 - RNA, 13 nt, Human adenovirus C
guugcauguggaa

SEQ ID NO: 3913313 - RNA, 14 nt, Human adenovirus C
guugccgcuggacg

SEQ ID NO: 3913314 - RNA, 15 nt, Human adenovirus C
guuggacgcuggaag

SEQ ID NO: 3913315 - RNA, 15 nt, Human adenovirus C
guuggaggaguggcu

SEQ ID NO: 3913316 - RNA, 18 nt, Human adenovirus C
guuggcggggggcugccg

SEQ ID NO: 3913317 - RNA, 22 nt, Human adenovirus C
guuggcggggggcugccgugcg

SEQ ID NO: 3913318 - RNA, 16 nt, Human adenovirus C
guugucaagcuuggug

SEQ ID NO: 3913319 - RNA, 15 nt, Human adenovirus C
guuuacuucaacccc

SEQ ID NO: 3913320 - RNA, 21 nt, Human adenovirus C
guuucuggcggaggugcugcu

SEQ ID NO: 3913321 - RNA, 22 nt, Human adenovirus C
guuugcaacuguccuaacccug

SEQ ID NO: 3913322 - RNA, 13 nt, Human adenovirus C
guuugccuccccg

SEQ ID NO: 3913323 - RNA, 14 nt, Human adenovirus C
guuuggcggggcaa

SEQ ID NO: 3913324 - RNA, 18 nt, Human adenovirus C
uaaacaacucgcugcugc

SEQ ID NO: 3913325 - RNA, 23 nt, Human adenovirus C
uaaacguagaggggcucucugag

SEQ ID NO: 3913326 - RNA, 22 nt, Human adenovirus C
uaaagcaaggccugcccaccac

SEQ ID NO: 3913327 - RNA, 15 nt, Human adenovirus C
uaaaugagacaugau

SEQ ID NO: 3913328 - RNA, 13 nt, Human adenovirus C
uaacagcacuggc

SEQ ID NO: 3913329 - RNA, 22 nt, Human adenovirus C
uaacccugacgcguuccggcag

SEQ ID NO: 3913330 - RNA, 17 nt, Human adenovirus C
uaaccuaaaugccaacc

SEQ ID NO: 3913331 - RNA, 19 nt, Human adenovirus C
uaacgcuggaccugccucc

SEQ ID NO: 3913332 - RNA, 21 nt, Human adenovirus C
uaacgugucguaugugucaug

SEQ ID NO: 3913333 - RNA, 21 nt, Human adenovirus C
uaacucaggggcgcagcuugc

SEQ ID NO: 3913334 - RNA, 10 nt, Human adenovirus C
uaacuccugu

SEQ ID NO: 3913335 - RNA, 16 nt, Human adenovirus C
uaacuuuauguccaug

SEQ ID NO: 3913336 - RNA, 17 nt, Human adenovirus C
uaagaacuauggcagca

SEQ ID NO: 3913337 - RNA, 18 nt, Human adenovirus C
uaagagagcugcagcugc

SEQ ID NO: 3913338 - RNA, 15 nt, Human adenovirus C
uaagcacuuacucua

SEQ ID NO: 3913339 - RNA, 18 nt, Human adenovirus C
uaagcauugcuacuaaag

SEQ ID NO: 3913340 - RNA, 22 nt, Human adenovirus C
uaaguuccucguaggugagcuc

SEQ ID NO: 3913341 - RNA, 21 nt, Human adenovirus C
uaauacugccauagcuauaaa

SEQ ID NO: 3913342 - RNA, 13 nt, Human adenovirus C
uaaugaaauagga

SEQ ID NO: 3913343 - RNA, 14 nt, Human adenovirus C
uaauggacuacuug

SEQ ID NO: 3913344 - RNA, 13 nt, Human adenovirus C
uaauucaccaccu

SEQ ID NO: 3913345 - RNA, 20 nt, Human adenovirus C
uacaaagcgcgguucacccu

SEQ ID NO: 3913346 - RNA, 16 nt, Human adenovirus C
uacaaccccaccaaug

SEQ ID NO: 3913347 - RNA, 23 nt, Human adenovirus C
uacacaguccuuucuccccggcu

SEQ ID NO: 3913348 - RNA, 15 nt, Human adenovirus C
uacacucucggguga

SEQ ID NO: 3913349 - RNA, 17 nt, Human adenovirus C
uacagucacaagcccca

SEQ ID NO: 3913350 - RNA, 16 nt, Human adenovirus C
uacaugagcaaacagu

SEQ ID NO: 3913351 - RNA, 21 nt, Human adenovirus C
uacauggacaaaagaugaaac

SEQ ID NO: 3913352 - RNA, 18 nt, Human adenovirus C
uacauucgggcagcagcg

SEQ ID NO: 3913353 - RNA, 20 nt, Human adenovirus C
uacauugcccaggaauaaag

SEQ ID NO: 3913354 - RNA, 14 nt, Human adenovirus C
uaccaccacaccuc

SEQ ID NO: 3913355 - RNA, 20 nt, Human adenovirus C
uacccacccaaagcagacca

SEQ ID NO: 3913356 - RNA, 22 nt, Human adenovirus C
uaccgcgucaggaggggcaaca

SEQ ID NO: 3913357 - RNA, 19 nt, Human adenovirus C
uaccucugcaaacgacugc

SEQ ID NO: 3913358 - RNA, 19 nt, Human adenovirus C
uaccuggacuuggaggagg

SEQ ID NO: 3913359 - RNA, 22 nt, Human adenovirus C
uaccuguguggaagccuggacc

SEQ ID NO: 3913360 - RNA, 15 nt, Human adenovirus C
uacgaaaaaaccacu

SEQ ID NO: 3913361 - RNA, 21 nt, Human adenovirus C
uacggcaucucgauccagcau

SEQ ID NO: 3913362 - RNA, 16 nt, Human adenovirus C
uacucccauuuuucca

SEQ ID NO: 3913363 - RNA, 15 nt, Human adenovirus C
uacugacgccagacg

SEQ ID NO: 3913364 - RNA, 19 nt, Human adenovirus C
uacugggacagucaggcag

SEQ ID NO: 3913365 - RNA, 14 nt, Human adenovirus C
uacuuuccaggaga

SEQ ID NO: 3913366 - RNA, 21 nt, Human adenovirus C
uagaaaccccacgguggcacc

SEQ ID NO: 3913367 - RNA, 22 nt, Human adenovirus C
uagaaccaaaguugcaggagcu

SEQ ID NO: 3913368 - RNA, 16 nt, Human adenovirus C
uagaggggcucucuga

SEQ ID NO: 3913369 - RNA, 21 nt, Human adenovirus C
uagauugcaucccaccuuuca

SEQ ID NO: 3913370 - RNA, 18 nt, Human adenovirus C
uagcaggucgggcgccga

SEQ ID NO: 3913371 - RNA, 21 nt, Human adenovirus C
uagcauuaaguuugacagcau

SEQ ID NO: 3913372 - RNA, 11 nt, Human adenovirus C
ggcggaggcgc

SEQ ID NO: 3913373 - RNA, 19 nt, Human adenovirus C
ggcggaggcgcguagcacg

SEQ ID NO: 3913374 - RNA, 22 nt, Human adenovirus C
ggcggcaacaacaguggcagcg

SEQ ID NO: 3913375 - RNA, 15 nt, Human adenovirus C
ggcggcaggagcaga

SEQ ID NO: 3913376 - RNA, 13 nt, Human adenovirus C
ggcggcggcgcgc

SEQ ID NO: 3913377 - RNA, 13 nt, Human adenovirus C
ggcggcggcgcug

SEQ ID NO: 3913378 - RNA, 12 nt, Human adenovirus C
ggcggcgguggg

SEQ ID NO: 3913379 - RNA, 14 nt, Human adenovirus C
ggcgggagcuccug

SEQ ID NO: 3913380 - RNA, 15 nt, Human adenovirus C
ggcgggcccccggag

SEQ ID NO: 3913381 - RNA, 17 nt, Human adenovirus C
ggcgggcgcucgggcuu

SEQ ID NO: 3913382 - RNA, 21 nt, Human adenovirus C
ggcggguacaguggaaagguc

SEQ ID NO: 3913383 - RNA, 13 nt, Human adenovirus C
ggcggugaccugc

SEQ ID NO: 3913384 - RNA, 17 nt, Human adenovirus C
ggcggugguggaggcgc

SEQ ID NO: 3913385 - RNA, 18 nt, Human adenovirus C
ggcgucaucgagaccgug

SEQ ID NO: 3913386 - RNA, 20 nt, Human adenovirus C
ggcguccggcucaccaccca

SEQ ID NO: 3913387 - RNA, 13 nt, Human adenovirus C
ggcgugcagaccg

SEQ ID NO: 3913388 - RNA, 13 nt, Human adenovirus C
ggcguuggacagc

SEQ ID NO: 3913389 - RNA, 16 nt, Human adenovirus C
ggcuacaggggccucu

SEQ ID NO: 3913390 - RNA, 21 nt, Human adenovirus C
ggcuaccgcucguggcgcggg

SEQ ID NO: 3913391 - RNA, 13 nt, Human adenovirus C
ggcucaccaccca

SEQ ID NO: 3913392 - RNA, 22 nt, Human adenovirus C
ggcucuccgcaauucuggaagc

SEQ ID NO: 3913393 - RNA, 21 nt, Human adenovirus C
ggcugcgcgcuggccagggug

SEQ ID NO: 3913394 - RNA, 17 nt, Human adenovirus C
ggcuguugaugugguga

SEQ ID NO: 3913395 - RNA, 19 nt, Human adenovirus C
ggcuugagacgcgcgagcc

SEQ ID NO: 3913396 - RNA, 15 nt, Human adenovirus C
gggaacaacccauuc

SEQ ID NO: 3913397 - RNA, 21 nt, Human adenovirus C
gggacgggggguuuaccugga

SEQ ID NO: 3913398 - RNA, 16 nt, Human adenovirus C
gggagaucagcuggga

SEQ ID NO: 3913399 - RNA, 13 nt, Human adenovirus C
gggagcugagccc

SEQ ID NO: 3913400 - RNA, 23 nt, Human adenovirus C
gggaugcaaacuugcaagaacaa

SEQ ID NO: 3913401 - RNA, 12 nt, Human adenovirus C
gggauggcgggc

SEQ ID NO: 3913402 - RNA, 18 nt, Human adenovirus C
gggauuccgaggaagaau

SEQ ID NO: 3913403 - RNA, 22 nt, Human adenovirus C
gggcacagcagcgcacccugau

SEQ ID NO: 3913404 - RNA, 19 nt, Human adenovirus C
gggcauccgcaagcggcaa

SEQ ID NO: 3913405 - RNA, 19 nt, Human adenovirus C
gggcccggcacuaccugga

SEQ ID NO: 3913406 - RNA, 14 nt, Human adenovirus C
gggccggaccuggg

SEQ ID NO: 3913407 - RNA, 13 nt, Human adenovirus C
gggcgaggcgcgc

SEQ ID NO: 3913408 - RNA, 12 nt, Human adenovirus C
gggcggcaagcg

SEQ ID NO: 3913409 - RNA, 13 nt, Human adenovirus C
gggcguguggcag

SEQ ID NO: 3913410 - RNA, 12 nt, Human adenovirus C
gggcucgggacc

SEQ ID NO: 3913411 - RNA, 18 nt, Human adenovirus C
gggcugcgcgcuggccag

SEQ ID NO: 3913412 - RNA, 16 nt, Human adenovirus C
gggcuguggggggugc

SEQ ID NO: 3913413 - RNA, 22 nt, Human adenovirus C
ggggaggcaagcacacagacca

SEQ ID NO: 3913414 - RNA, 13 nt, Human adenovirus C
ggggcauggccgg

SEQ ID NO: 3913415 - RNA, 13 nt, Human adenovirus C
ggggccuccgccc

SEQ ID NO: 3913416 - RNA, 12 nt, Human adenovirus C
gggggcgagguc

SEQ ID NO: 3913417 - RNA, 13 nt, Human adenovirus C
gggggcugccgug

SEQ ID NO: 3913418 - RNA, 18 nt, Human adenovirus C
ggggguccacucgcucca

SEQ ID NO: 3913419 - RNA, 18 nt, Human adenovirus C
gggguccacucgcuccag

SEQ ID NO: 3913420 - RNA, 14 nt, Human adenovirus C
ggggugggugagcg

SEQ ID NO: 3913421 - RNA, 15 nt, Human adenovirus C
gggucaaaaaccagg

SEQ ID NO: 3913422 - RNA, 13 nt, Human adenovirus C
ggguccagaggac

SEQ ID NO: 3913423 - RNA, 20 nt, Human adenovirus C
gggucugccagacuucacca

SEQ ID NO: 3913424 - RNA, 11 nt, Human adenovirus C
gggugcccuug

SEQ ID NO: 3913425 - RNA, 18 nt, Human adenovirus C
gggugguggaccuggcca

SEQ ID NO: 3913426 - RNA, 14 nt, Human adenovirus C
gguacccaacucca

SEQ ID NO: 3913427 - RNA, 18 nt, Human adenovirus C
gguacgaugagacccgca

SEQ ID NO: 3913428 - RNA, 23 nt, Human adenovirus C
gguaguuaagagagcugcagcug

SEQ ID NO: 3913429 - RNA, 23 nt, Human adenovirus C
gguccacucgcuccaggguguga

SEQ ID NO: 3913430 - RNA, 13 nt, Human adenovirus C
ggucccacagcuc

SEQ ID NO: 3913431 - RNA, 12 nt, Human adenovirus C
ggucccuguguu

SEQ ID NO: 3913432 - RNA, 17 nt, Human adenovirus C
ggucgcccgggcagggu

SEQ ID NO: 3913433 - RNA, 15 nt, Human adenovirus C
ggugagcuccucagg

SEQ ID NO: 3913434 - RNA, 19 nt, Human adenovirus C
ggugcagacccugcgagug

SEQ ID NO: 3913435 - RNA, 22 nt, Human adenovirus C
ggugcgggcggcgcugcagagc

SEQ ID NO: 3913436 - RNA, 18 nt, Human adenovirus C
ggugcugcgcgcggaggu

SEQ ID NO: 3913437 - RNA, 22 nt, Human adenovirus C
gguggaccuggccaaccaggca

SEQ ID NO: 3913438 - RNA, 16 nt, Human adenovirus C
gguggacgucgcgccg

SEQ ID NO: 3913439 - RNA, 14 nt, Human adenovirus C
gguggaggaggcgc

SEQ ID NO: 3913440 - RNA, 15 nt, Human adenovirus C
gguggaggaggcgcg

SEQ ID NO: 3913441 - RNA, 13 nt, Human adenovirus C
gguggcagaugcc

SEQ ID NO: 3913442 - RNA, 23 nt, Human adenovirus C
gguggccgcguccaucuggucag

SEQ ID NO: 3913443 - RNA, 15 nt, Human adenovirus C
gguggcggcgagguc

SEQ ID NO: 3913444 - RNA, 19 nt, Human adenovirus C
ggugggccgcggggguguc

SEQ ID NO: 3913445 - RNA, 16 nt, Human adenovirus C
ggugggugagcgcgga

SEQ ID NO: 3913446 - RNA, 23 nt, Human adenovirus C
ggugguagauggccuggccucug

SEQ ID NO: 3913447 - RNA, 16 nt, Human adenovirus C
ggugugggaggacgau

SEQ ID NO: 3913448 - RNA, 15 nt, Human adenovirus C
gguuaacuccuccuc

SEQ ID NO: 3913449 - RNA, 15 nt, Human adenovirus C
gguuauccuuacucu

SEQ ID NO: 3913450 - RNA, 17 nt, Human adenovirus C
gguuccugagcagcugc

SEQ ID NO: 3913451 - RNA, 22 nt, Human adenovirus C
gguugugcagggugacaagguc

SEQ ID NO: 3913452 - RNA, 19 nt, Human adenovirus C
gguuucugcccugaaggcu

SEQ ID NO: 3913453 - RNA, 19 nt, Human adenovirus C
guacaaguuguggccccca

SEQ ID NO: 3913454 - RNA, 13 nt, Human adenovirus C
guacagcccaccc

SEQ ID NO: 3913455 - RNA, 13 nt, Human adenovirus C
guacccaacucca

SEQ ID NO: 3913456 - RNA, 23 nt, Human adenovirus C
guaccugagccccgggcuggugc

SEQ ID NO: 3913457 - RNA, 12 nt, Human adenovirus C
guaccugcugga

SEQ ID NO: 3913458 - RNA, 17 nt, Human adenovirus C
guaccuuaccugguacu

SEQ ID NO: 3913459 - RNA, 18 nt, Human adenovirus C
guacggcaccgccagcgc

SEQ ID NO: 3913460 - RNA, 24 nt, Human adenovirus C
guacucccucucaaaagcgggcau

SEQ ID NO: 3913461 - RNA, 21 nt, Human adenovirus C
guacuccgccaccgagggacc

SEQ ID NO: 3913462 - RNA, 17 nt, Human adenovirus C
guacucguacaaagcgc

SEQ ID NO: 3913463 - RNA, 19 nt, Human adenovirus C
guagaggggcucucugagu

SEQ ID NO: 3913464 - RNA, 17 nt, Human adenovirus C
guagcaccacugcagag

SEQ ID NO: 3913465 - RNA, 15 nt, Human adenovirus C
guagcugccuuccca

SEQ ID NO: 3913466 - RNA, 16 nt, Human adenovirus C
guagguacuccgccac

SEQ ID NO: 3913467 - RNA, 16 nt, Human adenovirus C
guaggugagcuccuca

SEQ ID NO: 3913468 - RNA, 19 nt, Human adenovirus C
guagguggcgcccucuucc

SEQ ID NO: 3913469 - RNA, 13 nt, Human adenovirus C
guaguccaggguu

SEQ ID NO: 3913470 - RNA, 15 nt, Human adenovirus C
guaguuucgcaggcg

SEQ ID NO: 3913471 - RNA, 21 nt, Human adenovirus C
guaugcguccaugucgccgcc

SEQ ID NO: 3913472 - RNA, 17 nt, Human adenovirus C
guauugccacugccaca

SEQ ID NO: 3913473 - RNA, 21 nt, Human adenovirus C
gucacuguagucaucgccuuc

SEQ ID NO: 3913474 - RNA, 21 nt, Human adenovirus C
gucaggcgauccuaacucugc

SEQ ID NO: 3913475 - RNA, 20 nt, Human adenovirus C
gucaggcgggagcuccugca

SEQ ID NO: 3913476 - RNA, 16 nt, Human adenovirus C
gucaucaagacuuugg

SEQ ID NO: 3913477 - RNA, 16 nt, Human adenovirus C
gucaucucuacagccc

SEQ ID NO: 3913478 - RNA, 18 nt, Human adenovirus C
gucaucucuacagccccu

SEQ ID NO: 3913479 - RNA, 15 nt, Human adenovirus C
gucaugucuuuccac

SEQ ID NO: 3913480 - RNA, 22 nt, Human adenovirus C
guccaggcgacgagcggccgcc

SEQ ID NO: 3913481 - RNA, 23 nt, Human adenovirus C
guccccagguacagcccacccug

SEQ ID NO: 3913482 - RNA, 20 nt, Human adenovirus C
guccgaagaaaagcgcggcc

SEQ ID NO: 3913483 - RNA, 21 nt, Human adenovirus C
guccggacgggacauuucaga

SEQ ID NO: 3913484 - RNA, 14 nt, Human adenovirus C
guccguguccccgu

SEQ ID NO: 3913485 - RNA, 20 nt, Human adenovirus C
gucgcaccggccgacgggcg

SEQ ID NO: 3913486 - RNA, 15 nt, Human adenovirus C
gucgccaccgccgcc

SEQ ID NO: 3913487 - RNA, 12 nt, Human adenovirus C
gucgccagcccg

SEQ ID NO: 3913488 - RNA, 16 nt, Human adenovirus C
gucgccgucgccagcc

SEQ ID NO: 3913489 - RNA, 23 nt, Human adenovirus C
gucgugcgcaccaccggcggcgg

SEQ ID NO: 3913490 - RNA, 20 nt, Human adenovirus C
gucucgcauuccacgagcca

SEQ ID NO: 3913491 - RNA, 19 nt, Human adenovirus C
acuuugcuuuccugagccc

SEQ ID NO: 3913492 - RNA, 14 nt, Human adenovirus C
agaaagaugaugau

SEQ ID NO: 3913493 - RNA, 21 nt, Human adenovirus C
agaacugguugacggccuggu

SEQ ID NO: 3913494 - RNA, 14 nt, Human adenovirus C
agaagaacaugccg

SEQ ID NO: 3913495 - RNA, 13 nt, Human adenovirus C
agaagaagagcaa

SEQ ID NO: 3913496 - RNA, 14 nt, Human adenovirus C
agaagcgcuccgac

SEQ ID NO: 3913497 - RNA, 14 nt, Human adenovirus C
agaagcugcagcug

SEQ ID NO: 3913498 - RNA, 15 nt, Human adenovirus C
agaagcugcagcugc

SEQ ID NO: 3913499 - RNA, 16 nt, Human adenovirus C
agaaggcguugaggcc

SEQ ID NO: 3913500 - RNA, 15 nt, Human adenovirus C
agaaggugcuggcga

SEQ ID NO: 3913501 - RNA, 18 nt, Human adenovirus C
agaauggcgguagugggu

SEQ ID NO: 3913502 - RNA, 16 nt, Human adenovirus C
agacaccuucaacccc

SEQ ID NO: 3913503 - RNA, 19 nt, Human adenovirus C
agacacgaucggcaggcuc

SEQ ID NO: 3913504 - RNA, 16 nt, Human adenovirus C
agacacuuaagcucgc

SEQ ID NO: 3913505 - RNA, 18 nt, Human adenovirus C
agaccugggccaaaaccu

SEQ ID NO: 3913506 - RNA, 12 nt, Human adenovirus C
agacgacagcgu

SEQ ID NO: 3913507 - RNA, 16 nt, Human adenovirus C
agacgccgcaccugcc

SEQ ID NO: 3913508 - RNA, 23 nt, Human adenovirus C
agacggcguaguuucgcaggcgc

SEQ ID NO: 3913509 - RNA, 20 nt, Human adenovirus C
agacucugacaaagcccaag

SEQ ID NO: 3913510 - RNA, 17 nt, Human adenovirus C
agacugugggggcaaca

SEQ ID NO: 3913511 - RNA, 12 nt, Human adenovirus C
agagagcugcag

SEQ ID NO: 3913512 - RNA, 15 nt, Human adenovirus C
agagagcugcagcug

SEQ ID NO: 3913513 - RNA, 13 nt, Human adenovirus C
agagcccgagggc

SEQ ID NO: 3913514 - RNA, 14 nt, Human adenovirus C
agagcccgagggcc

SEQ ID NO: 3913515 - RNA, 14 nt, Human adenovirus C
agagccggccugga

SEQ ID NO: 3913516 - RNA, 14 nt, Human adenovirus C
agagcugcagcugc

SEQ ID NO: 3913517 - RNA, 12 nt, Human adenovirus C
agaggccgcauc

SEQ ID NO: 3913518 - RNA, 17 nt, Human adenovirus C
agagggagcggggggcu

SEQ ID NO: 3913519 - RNA, 14 nt, Human adenovirus C
agaguuucugcuac

SEQ ID NO: 3913520 - RNA, 24 nt, Human adenovirus C
agauaccccuauccugccgugcca

SEQ ID NO: 3913521 - RNA, 16 nt, Human adenovirus C
agaugaagaagaggaa

SEQ ID NO: 3913522 - RNA, 17 nt, Human adenovirus C
agaugaagaugaagaag

SEQ ID NO: 3913523 - RNA, 22 nt, Human adenovirus C
agaugugggagacgacgugcug

SEQ ID NO: 3913524 - RNA, 15 nt, Human adenovirus C
agcaaaccucaccuc

SEQ ID NO: 3913525 - RNA, 21 nt, Human adenovirus C
agcaacagcagcggucacaca

SEQ ID NO: 3913526 - RNA, 20 nt, Human adenovirus C
agcaaggaaauucccacgcc

SEQ ID NO: 3913527 - RNA, 18 nt, Human adenovirus C
agcaaggccugcccacca

SEQ ID NO: 3913528 - RNA, 14 nt, Human adenovirus C
agcaaugacagcac

SEQ ID NO: 3913529 - RNA, 19 nt, Human adenovirus C
agcacaacauacugacccg

SEQ ID NO: 3913530 - RNA, 20 nt, Human adenovirus C
agcaccgguggguugcugaa

SEQ ID NO: 3913531 - RNA, 16 nt, Human adenovirus C
agcaccugucgucagc

SEQ ID NO: 3913532 - RNA, 14 nt, Human adenovirus C
agcacgaaggaggc

SEQ ID NO: 3913533 - RNA, 22 nt, Human adenovirus C
agcacuaguauugccacugcca

SEQ ID NO: 3913534 - RNA, 23 nt, Human adenovirus C
agcagagcgugagccuuaaccug

SEQ ID NO: 3913535 - RNA, 21 nt, Human adenovirus C
agcagcggaugauccuccagu

SEQ ID NO: 3913536 - RNA, 22 nt, Human adenovirus C
agcagcugcgacuuaccgcagc

SEQ ID NO: 3913537 - RNA, 14 nt, Human adenovirus C
agcaggagcgcugg

SEQ ID NO: 3913538 - RNA, 15 nt, Human adenovirus C
agcaggagcgcuggg

SEQ ID NO: 3913539 - RNA, 17 nt, Human adenovirus C
agcaggaggaggagcgc

SEQ ID NO: 3913540 - RNA, 22 nt, Human adenovirus C
agcaggccaacgagcgccucgg

SEQ ID NO: 3913541 - RNA, 13 nt, Human adenovirus C
agcagggccaggu

SEQ ID NO: 3913542 - RNA, 14 nt, Human adenovirus C
agcaggggggccac

SEQ ID NO: 3913543 - RNA, 13 nt, Human adenovirus C
agcagugcagcuu

SEQ ID NO: 3913544 - RNA, 16 nt, Human adenovirus C
agcaguuccaggcggu

SEQ ID NO: 3913545 - RNA, 20 nt, Human adenovirus C
agcauaaaaaaauccagugg

SEQ ID NO: 3913546 - RNA, 19 nt, Human adenovirus C
agcauaguggugcaggagc

SEQ ID NO: 3913547 - RNA, 12 nt, Human adenovirus C
agcaugaagggc

SEQ ID NO: 3913548 - RNA, 20 nt, Human adenovirus C
agcaugaagggcacgagcug

SEQ ID NO: 3913549 - RNA, 18 nt, Human adenovirus C
agcauugauggucgcccc

SEQ ID NO: 3913550 - RNA, 13 nt, Human adenovirus C
agcauuugaccau

SEQ ID NO: 3913551 - RNA, 21 nt, Human adenovirus C
agccacuuaaaaaaacaaagu

SEQ ID NO: 3913552 - RNA, 14 nt, Human adenovirus C
agccaggucuugca

SEQ ID NO: 3913553 - RNA, 15 nt, Human adenovirus C
agccaguggcaacug

SEQ ID NO: 3913554 - RNA, 15 nt, Human adenovirus C
agcccgagagcaugu

SEQ ID NO: 3913555 - RNA, 13 nt, Human adenovirus C
agccgccugagca

SEQ ID NO: 3913556 - RNA, 14 nt, Human adenovirus C
agccgcugcagcca

SEQ ID NO: 3913557 - RNA, 16 nt, Human adenovirus C
agccugggcuggagcc

SEQ ID NO: 3913558 - RNA, 15 nt, Human adenovirus C
agcgacgaccugggc

SEQ ID NO: 3913559 - RNA, 14 nt, Human adenovirus C
agcgaguccgcauc

SEQ ID NO: 3913560 - RNA, 13 nt, Human adenovirus C
agcgcacuacugc

SEQ ID NO: 3913561 - RNA, 14 nt, Human adenovirus C
agcgcacugcggcu

SEQ ID NO: 3913562 - RNA, 23 nt, Human adenovirus C
agcgcagcgaugugccccucgcc

SEQ ID NO: 3913563 - RNA, 20 nt, Human adenovirus C
agcgcagcggugcagccaca

SEQ ID NO: 3913564 - RNA, 20 nt, Human adenovirus C
agcgcagcuugagccuggcu

SEQ ID NO: 3913565 - RNA, 20 nt, Human adenovirus C
agcgccugcaugaaagccuu

SEQ ID NO: 3913566 - RNA, 17 nt, Human adenovirus C
agcgcgaaaagaaccug

SEQ ID NO: 3913567 - RNA, 15 nt, Human adenovirus C
agcggcauaaggaca

SEQ ID NO: 3913568 - RNA, 22 nt, Human adenovirus C
agcggcggcagcagcaggagga

SEQ ID NO: 3913569 - RNA, 14 nt, Human adenovirus C
agcgggcacucuuc

SEQ ID NO: 3913570 - RNA, 20 nt, Human adenovirus C
agcgggggguaccugcugga

SEQ ID NO: 3913571 - RNA, 22 nt, Human adenovirus C
agcggggugguggaccuggcca

SEQ ID NO: 3913572 - RNA, 19 nt, Human adenovirus C
agcggucccauccaagguc

SEQ ID NO: 3913573 - RNA, 21 nt, Human adenovirus C
agcgguuaagcugggaugggu

SEQ ID NO: 3913574 - RNA, 15 nt, Human adenovirus C
agcgguuaggcugga

SEQ ID NO: 3913575 - RNA, 14 nt, Human adenovirus C
agcgguugcugcgc

SEQ ID NO: 3913576 - RNA, 13 nt, Human adenovirus C
agcguccgcggcc

SEQ ID NO: 3913577 - RNA, 16 nt, Human adenovirus C
agcguggcgcuggaca

SEQ ID NO: 3913578 - RNA, 17 nt, Human adenovirus C
agcuaaaauacaacccc

SEQ ID NO: 3913579 - RNA, 18 nt, Human adenovirus C
agcucauggcggggacca

SEQ ID NO: 3913580 - RNA, 21 nt, Human adenovirus C
agcugcaaacuuucuccaaag

SEQ ID NO: 3913581 - RNA, 18 nt, Human adenovirus C
agcugcagcugccgccgc

SEQ ID NO: 3913582 - RNA, 21 nt, Human adenovirus C
agcugccgccgccgccaccca

SEQ ID NO: 3913583 - RNA, 17 nt, Human adenovirus C
agcugccuucccaaaaa

SEQ ID NO: 3913584 - RNA, 21 nt, Human adenovirus C
agcuggggccggaccugggcu

SEQ ID NO: 3913585 - RNA, 15 nt, Human adenovirus C
agcuguccuaucaac

SEQ ID NO: 3913586 - RNA, 15 nt, Human adenovirus C
agcuuaaaagaugac

SEQ ID NO: 3913587 - RNA, 14 nt, Human adenovirus C
agcuugaucugcug

SEQ ID NO: 3913588 - RNA, 15 nt, Human adenovirus C
agcuugccugcucca

SEQ ID NO: 3913589 - RNA, 20 nt, Human adenovirus C
agcuugccugcuccagagau

SEQ ID NO: 3913590 - RNA, 17 nt, Human adenovirus C
agcuuguugaccagcuc

SEQ ID NO: 3913591 - RNA, 13 nt, Human adenovirus C
agcuuuugaaauc

SEQ ID NO: 3913592 - RNA, 13 nt, Human adenovirus C
aggaagagcagga

SEQ ID NO: 3913593 - RNA, 16 nt, Human adenovirus C
aggaauacugggacag

SEQ ID NO: 3913594 - RNA, 15 nt, Human adenovirus C
aggaccucugcacuc

SEQ ID NO: 3913595 - RNA, 19 nt, Human adenovirus C
aggacgugguaaaggugac

SEQ ID NO: 3913596 - RNA, 15 nt, Human adenovirus C
aggagcgcugggcgu

SEQ ID NO: 3913597 - RNA, 12 nt, Human adenovirus C
aggagcugaggc

SEQ ID NO: 3913598 - RNA, 15 nt, Human adenovirus C
aggagcugaggcccg

SEQ ID NO: 3913599 - RNA, 19 nt, Human adenovirus C
aggagcugcagaagcugcu

SEQ ID NO: 3913600 - RNA, 19 nt, Human adenovirus C
aggaggacuuugagcccga

SEQ ID NO: 3913601 - RNA, 14 nt, Human adenovirus C
aggaggagcgcugc

SEQ ID NO: 3913602 - RNA, 21 nt, Human adenovirus C
aggaggauuacaagugggaau

SEQ ID NO: 3913603 - RNA, 15 nt, Human adenovirus C
aggaggcacuaaagc

SEQ ID NO: 3913604 - RNA, 21 nt, Human adenovirus C
aggaggcuaagugggaggggu

SEQ ID NO: 3913605 - RNA, 15 nt, Human adenovirus C
aggagggcgagggcc

SEQ ID NO: 3913606 - RNA, 16 nt, Human adenovirus C
aggaugaagaagagga

SEQ ID NO: 3913607 - RNA, 14 nt, Human adenovirus C
aggcacuaaagcaa

SEQ ID NO: 3913608 - RNA, 19 nt, Human adenovirus C
aggcacuaaagcaaggccu

SEQ ID NO: 3913609 - RNA, 21 nt, Human adenovirus C
aggcaggacccuggugcugcc

SEQ ID NO: 3913610 - RNA, 17 nt, Human adenovirus C
aggcauccgcgccgcag

SEQ ID NO: 3913611 - RNA, 17 nt, Human adenovirus C
acaccuacucuggcucc

SEQ ID NO: 3913612 - RNA, 18 nt, Human adenovirus C
acaccucgaccacugccg

SEQ ID NO: 3913613 - RNA, 15 nt, Human adenovirus C
acacguggcggccgc

SEQ ID NO: 3913614 - RNA, 22 nt, Human adenovirus C
acacugcagcaggugcugccca

SEQ ID NO: 3913615 - RNA, 16 nt, Human adenovirus C
acacuuaagcucgccu

SEQ ID NO: 3913616 - RNA, 14 nt, Human adenovirus C
acagagacaggacu

SEQ ID NO: 3913617 - RNA, 13 nt, Human adenovirus C
acagcacuggcaa

SEQ ID NO: 3913618 - RNA, 17 nt, Human adenovirus C
acagcgaggaggagcgc

SEQ ID NO: 3913619 - RNA, 14 nt, Human adenovirus C
acagcgcgagcagg

SEQ ID NO: 3913620 - RNA, 18 nt, Human adenovirus C
acagcuaugauccagaug

SEQ ID NO: 3913621 - RNA, 17 nt, Human adenovirus C
acaggccagaugcugag

SEQ ID NO: 3913622 - RNA, 19 nt, Human adenovirus C
acaggcggcuauuaccacc

SEQ ID NO: 3913623 - RNA, 20 nt, Human adenovirus C
acagggcccagucugcaaga

SEQ ID NO: 3913624 - RNA, 14 nt, Human adenovirus C
acagguggagauga

SEQ ID NO: 3913625 - RNA, 21 nt, Human adenovirus C
acagguggagcugaaauauga

SEQ ID NO: 3913626 - RNA, 22 nt, Human adenovirus C
acaguaacugcagcacagcacc

SEQ ID NO: 3913627 - RNA, 24 nt, Human adenovirus C
acaguaugauuaaaugagacauga

SEQ ID NO: 3913628 - RNA, 14 nt, Human adenovirus C
acagucaggcagag

SEQ ID NO: 3913629 - RNA, 16 nt, Human adenovirus C
acagucaggcagagga

SEQ ID NO: 3913630 - RNA, 16 nt, Human adenovirus C
acauaaacuauaacag

SEQ ID NO: 3913631 - RNA, 18 nt, Human adenovirus C
acaucaacuuugcgucuc

SEQ ID NO: 3913632 - RNA, 18 nt, Human adenovirus C
acaucauuuugcugccag

SEQ ID NO: 3913633 - RNA, 23 nt, Human adenovirus C
acauccaggugaugccggcggcg

SEQ ID NO: 3913634 - RNA, 14 nt, Human adenovirus C
acaugaccaaggac

SEQ ID NO: 3913635 - RNA, 21 nt, Human adenovirus C
acaugcagggcacccuccccu

SEQ ID NO: 3913636 - RNA, 21 nt, Human adenovirus C
acaugcuaccucuuugagccc

SEQ ID NO: 3913637 - RNA, 21 nt, Human adenovirus C
acauggguguucuugcugguc

SEQ ID NO: 3913638 - RNA, 13 nt, Human adenovirus C
acauguggaguua

SEQ ID NO: 3913639 - RNA, 14 nt, Human adenovirus C
acauuacuggaacu

SEQ ID NO: 3913640 - RNA, 15 nt, Human adenovirus C
acauucaggugcccc

SEQ ID NO: 3913641 - RNA, 15 nt, Human adenovirus C
acauuggcuggaaug

SEQ ID NO: 3913642 - RNA, 16 nt, Human adenovirus C
accaaaguugcaggag

SEQ ID NO: 3913643 - RNA, 19 nt, Human adenovirus C
accaacaugccaaauguga

SEQ ID NO: 3913644 - RNA, 16 nt, Human adenovirus C
accaaggacugguucc

SEQ ID NO: 3913645 - RNA, 14 nt, Human adenovirus C
accaccacccuccu

SEQ ID NO: 3913646 - RNA, 11 nt, Human adenovirus C
accacuguggu

SEQ ID NO: 3913647 - RNA, 16 nt, Human adenovirus C
accagaacgaccacag

SEQ ID NO: 3913648 - RNA, 23 nt, Human adenovirus C
accagacauuacucccauuuuuc

SEQ ID NO: 3913649 - RNA, 15 nt, Human adenovirus C
accaucaaucuugac

SEQ ID NO: 3913650 - RNA, 16 nt, Human adenovirus C
accauccuaaaccagc

SEQ ID NO: 3913651 - RNA, 18 nt, Human adenovirus C
accauuaacgaggauggg

SEQ ID NO: 3913652 - RNA, 17 nt, Human adenovirus C
acccaaaaagaagcugc

SEQ ID NO: 3913653 - RNA, 20 nt, Human adenovirus C
acccaaaaagaagcugcagc

SEQ ID NO: 3913654 - RNA, 15 nt, Human adenovirus C
acccaagggugcagc

SEQ ID NO: 3913655 - RNA, 15 nt, Human adenovirus C
acccaccgugcagcu

SEQ ID NO: 3913656 - RNA, 15 nt, Human adenovirus C
acccagcagaaaccu

SEQ ID NO: 3913657 - RNA, 21 nt, Human adenovirus C
acccagcagaaaccugugcug

SEQ ID NO: 3913658 - RNA, 21 nt, Human adenovirus C
acccauuugaugcucaaacaa

SEQ ID NO: 3913659 - RNA, 22 nt, Human adenovirus C
accccacgguggcaccuacgca

SEQ ID NO: 3913660 - RNA, 21 nt, Human adenovirus C
accccgugaccuuccgcucca

SEQ ID NO: 3913661 - RNA, 15 nt, Human adenovirus C
accccuauccugccg

SEQ ID NO: 3913662 - RNA, 16 nt, Human adenovirus C
accccugacagaggac

SEQ ID NO: 3913663 - RNA, 14 nt, Human adenovirus C
acccgcagcugccu

SEQ ID NO: 3913664 - RNA, 15 nt, Human adenovirus C
acccgucggccuccg

SEQ ID NO: 3913665 - RNA, 11 nt, Human adenovirus C
acccuccccuu

SEQ ID NO: 3913666 - RNA, 15 nt, Human adenovirus C
acccuggcugugggu

SEQ ID NO: 3913667 - RNA, 21 nt, Human adenovirus C
acccuuauccucaucugcagc

SEQ ID NO: 3913668 - RNA, 21 nt, Human adenovirus C
accgaagauagcggccgggca

SEQ ID NO: 3913669 - RNA, 13 nt, Human adenovirus C
accgcccccuggu

SEQ ID NO: 3913670 - RNA, 19 nt, Human adenovirus C
accgcgcacgucgcaccgg

SEQ ID NO: 3913671 - RNA, 19 nt, Human adenovirus C
accgggacugggcgugcag

SEQ ID NO: 3913672 - RNA, 20 nt, Human adenovirus C
accgggguacccaacuccau

SEQ ID NO: 3913673 - RNA, 14 nt, Human adenovirus C
accgguggguugcu

SEQ ID NO: 3913674 - RNA, 21 nt, Human adenovirus C
accguaccuuaaucaaacuca

SEQ ID NO: 3913675 - RNA, 16 nt, Human adenovirus C
accguagaugggacac

SEQ ID NO: 3913676 - RNA, 13 nt, Human adenovirus C
accguaggagggg

SEQ ID NO: 3913677 - RNA, 18 nt, Human adenovirus C
accgucaucucuacagcc

SEQ ID NO: 3913678 - RNA, 12 nt, Human adenovirus C
accucccuugcc

SEQ ID NO: 3913679 - RNA, 20 nt, Human adenovirus C
accuccuuuccuuccuccca

SEQ ID NO: 3913680 - RNA, 17 nt, Human adenovirus C
accucuuugagcccuuu

SEQ ID NO: 3913681 - RNA, 20 nt, Human adenovirus C
accugccaccucccucccaa

SEQ ID NO: 3913682 - RNA, 12 nt, Human adenovirus C
accugcggccua

SEQ ID NO: 3913683 - RNA, 21 nt, Human adenovirus C
accuggaaaaggugaugaaaa

SEQ ID NO: 3913684 - RNA, 16 nt, Human adenovirus C
accuggaccggcuggu

SEQ ID NO: 3913685 - RNA, 18 nt, Human adenovirus C
accuggccaaccaggcag

SEQ ID NO: 3913686 - RNA, 14 nt, Human adenovirus C
accuggucuccuac

SEQ ID NO: 3913687 - RNA, 12 nt, Human adenovirus C
accugugcugcc

SEQ ID NO: 3913688 - RNA, 23 nt, Human adenovirus C
accugugcuuugcucccaaaccu

SEQ ID NO: 3913689 - RNA, 18 nt, Human adenovirus C
accuucuuccccauggcc

SEQ ID NO: 3913690 - RNA, 16 nt, Human adenovirus C
acgaacccccgcggcg

SEQ ID NO: 3913691 - RNA, 14 nt, Human adenovirus C
acgaccccuggaga

SEQ ID NO: 3913692 - RNA, 12 nt, Human adenovirus C
acgaccugggcg

SEQ ID NO: 3913693 - RNA, 14 nt, Human adenovirus C
acgacgggcccggu

SEQ ID NO: 3913694 - RNA, 16 nt, Human adenovirus C
acgagaaacgcgcggc

SEQ ID NO: 3913695 - RNA, 16 nt, Human adenovirus C
acgaggggcagugcag

SEQ ID NO: 3913696 - RNA, 18 nt, Human adenovirus C
acgagucacuccugcgcc

SEQ ID NO: 3913697 - RNA, 17 nt, Human adenovirus C
acgaucuuggccuugcu

SEQ ID NO: 3913698 - RNA, 23 nt, Human adenovirus C
acgaugcuucuaaauagcuaacg

SEQ ID NO: 3913699 - RNA, 17 nt, Human adenovirus C
acgccaccaacgugccc

SEQ ID NO: 3913700 - RNA, 23 nt, Human adenovirus C
acgccaccuucuuccccauggcc

SEQ ID NO: 3913701 - RNA, 23 nt, Human adenovirus C
acgccauugacgcggugguggag

SEQ ID NO: 3913702 - RNA, 22 nt, Human adenovirus C
acgcccagcguggcgcuggaca

SEQ ID NO: 3913703 - RNA, 14 nt, Human adenovirus C
acgcgcgagccugc

SEQ ID NO: 3913704 - RNA, 20 nt, Human adenovirus C
acgcgcgcgcagccuccaug

SEQ ID NO: 3913705 - RNA, 23 nt, Human adenovirus C
acgcgcggcaaacgcucugcaac

SEQ ID NO: 3913706 - RNA, 17 nt, Human adenovirus C
acgcggaggcucucuuc

SEQ ID NO: 3913707 - RNA, 19 nt, Human adenovirus C
acgcguuccggcagcagcc

SEQ ID NO: 3913708 - RNA, 19 nt, Human adenovirus C
acgcucaagggcgaggcgc

SEQ ID NO: 3913709 - RNA, 14 nt, Human adenovirus C
acgcuggaagacgu

SEQ ID NO: 3913710 - RNA, 13 nt, Human adenovirus C
acgcuggaccugc

SEQ ID NO: 3913711 - RNA, 14 nt, Human adenovirus C
acggacgaggagga

SEQ ID NO: 3913712 - RNA, 13 nt, Human adenovirus C
acggcaccgccag

SEQ ID NO: 3913713 - RNA, 17 nt, Human adenovirus C
acggcaccgccagcgca

SEQ ID NO: 3913714 - RNA, 17 nt, Human adenovirus C
acggccgcuacgugccc

SEQ ID NO: 3913715 - RNA, 14 nt, Human adenovirus C
acggccuacuggag

SEQ ID NO: 3913716 - RNA, 18 nt, Human adenovirus C
acggcgacgaggaccugc

SEQ ID NO: 3913717 - RNA, 15 nt, Human adenovirus C
acgggcggaggagaa

SEQ ID NO: 3913718 - RNA, 19 nt, Human adenovirus C
acgggcggcggccugggcg

SEQ ID NO: 3913719 - RNA, 20 nt, Human adenovirus C
acgggcggcggccugggcga

SEQ ID NO: 3913720 - RNA, 19 nt, Human adenovirus C
acgguaaagaccccgggca

SEQ ID NO: 3913721 - RNA, 21 nt, Human adenovirus C
acguagaggggcucucugagu

SEQ ID NO: 3913722 - RNA, 19 nt, Human adenovirus C
acgucaucuccagcggcca

SEQ ID NO: 3913723 - RNA, 15 nt, Human adenovirus C
acgugguccgugugc

SEQ ID NO: 3913724 - RNA, 14 nt, Human adenovirus C
acuaaagcaaggcc

SEQ ID NO: 3913725 - RNA, 12 nt, Human adenovirus C
acuaccacgccc

SEQ ID NO: 3913726 - RNA, 21 nt, Human adenovirus C
acuaccuuuccgccgccaaca

SEQ ID NO: 3913727 - RNA, 12 nt, Human adenovirus C
acuacguccgcg

SEQ ID NO: 3913728 - RNA, 21 nt, Human adenovirus C
acuacuugaaagugggcaggc

SEQ ID NO: 3913729 - RNA, 13 nt, Human adenovirus C
acuauaacagagg

SEQ ID NO: 3913730 - RNA, 18 nt, Human adenovirus C
acucacagaccugggcca

SEQ ID NO: 3913731 - RNA, 14 nt, Human adenovirus C
acucaccaaggcca

SEQ ID NO: 3913732 - RNA, 15 nt, Human adenovirus C
acucacuccggggcu

SEQ ID NO: 3913733 - RNA, 19 nt, Human adenovirus C
acucagggucgcaggggca

SEQ ID NO: 3913734 - RNA, 16 nt, Human adenovirus C
acuccucacuuaaaaa

SEQ ID NO: 3913735 - RNA, 19 nt, Human adenovirus C
acucgcuccagggugugaa

SEQ ID NO: 3913736 - RNA, 17 nt, Human adenovirus C
acucuaugucuuuuaca

SEQ ID NO: 3913737 - RNA, 20 nt, Human adenovirus C
acucugacaaagcccaagaa

SEQ ID NO: 3913738 - RNA, 22 nt, Human adenovirus C
acugacuuugcuuuccugagcc

SEQ ID NO: 3913739 - RNA, 12 nt, Human adenovirus C
acugaggaugaa

SEQ ID NO: 3913740 - RNA, 21 nt, Human adenovirus C
acugcaacagguuauugcccc

SEQ ID NO: 3913741 - RNA, 13 nt, Human adenovirus C
acugcagcaggug

SEQ ID NO: 3913742 - RNA, 18 nt, Human adenovirus C
acugcagcaggugcugcc

SEQ ID NO: 3913743 - RNA, 23 nt, Human adenovirus C
acugcagguacgccugcaggaau

SEQ ID NO: 3913744 - RNA, 13 nt, Human adenovirus C
acugccgccgcca

SEQ ID NO: 3913745 - RNA, 14 nt, Human adenovirus C
acugcuaccuucug

SEQ ID NO: 3913746 - RNA, 12 nt, Human adenovirus C
acugcugcugga

SEQ ID NO: 3913747 - RNA, 13 nt, Human adenovirus C
acugcugcuggaa

SEQ ID NO: 3913748 - RNA, 15 nt, Human adenovirus C
acuggcagcggugca

SEQ ID NO: 3913749 - RNA, 14 nt, Human adenovirus C
acuggcagggacac

SEQ ID NO: 3913750 - RNA, 13 nt, Human adenovirus C
acugggaguugcg

SEQ ID NO: 3913751 - RNA, 13 nt, Human adenovirus C
acuggggcggcga

SEQ ID NO: 3913752 - RNA, 22 nt, Human adenovirus C
acuggucuugucaugccugggg

SEQ ID NO: 3913753 - RNA, 20 nt, Human adenovirus C
acugguguuuagugcuccac

SEQ ID NO: 3913754 - RNA, 19 nt, Human adenovirus C
acuguugucuuccguccgc

SEQ ID NO: 3913755 - RNA, 15 nt, Human adenovirus C
acuuacccuguggac

SEQ ID NO: 3913756 - RNA, 15 nt, Human adenovirus C
acuucacccacagcc

SEQ ID NO: 3913757 - RNA, 15 nt, Human adenovirus C
acuucagacuggggu

SEQ ID NO: 3913758 - RNA, 19 nt, Human adenovirus C
acuuccccgccaggaacca

SEQ ID NO: 3913759 - RNA, 22 nt, Human adenovirus C
acuugcauggcguguuaaaugg

SEQ ID NO: 3913760 - RNA, 13 nt, Human adenovirus C
acuugcuggaaca

SEQ ID NO: 3913761 - RNA, 21 nt, Human adenovirus C
acuuggugcuggccugcaccc

SEQ ID NO: 3913762 - RNA, 23 nt, Human adenovirus C
acuuuaacggcucuucauuugua

SEQ ID NO: 3913763 - RNA, 13 nt, Human adenovirus C
acuuucuccaaag

SEQ ID NO: 3913764 - RNA, 21 nt, Human adenovirus C
acuuugcgucucuggccccgc

SEQ ID NO: 3913765 - RNA, 18 nt, Human adenovirus C
acuuugcuuuccugagcc

SEQ ID NO: 3913766 - RNA, 14 nt, Human adenovirus C
gaagaagaggaaga

SEQ ID NO: 3913767 - RNA, 21 nt, Human adenovirus C
gcagaaguauuccauagagca

SEQ ID NO: 3913768 - RNA, 15 nt, Human adenovirus C
gcagagcccauggaa

SEQ ID NO: 3913769 - RNA, 18 nt, Human adenovirus C
gcagagcucucugggaaa

SEQ ID NO: 3913770 - RNA, 18 nt, Human adenovirus C
gcagaugcgccccccucc

SEQ ID NO: 3913771 - RNA, 15 nt, Human adenovirus C
gcagcacagcaggga

SEQ ID NO: 3913772 - RNA, 13 nt, Human adenovirus C
gcagcacaggcca

SEQ ID NO: 3913773 - RNA, 22 nt, Human adenovirus C
gcagcacaggccagaugcugag

SEQ ID NO: 3913774 - RNA, 14 nt, Human adenovirus C
gcagcaccuugcgu

SEQ ID NO: 3913775 - RNA, 15 nt, Human adenovirus C
gcagcagggcaaccu

SEQ ID NO: 3913776 - RNA, 15 nt, Human adenovirus C
gcagcaucgagguca

SEQ ID NO: 3913777 - RNA, 17 nt, Human adenovirus C
gcagccacaacgcgcag

SEQ ID NO: 3913778 - RNA, 17 nt, Human adenovirus C
gcagccgcaggccaacc

SEQ ID NO: 3913779 - RNA, 18 nt, Human adenovirus C
gcagcggugcagccacaa

SEQ ID NO: 3913780 - RNA, 23 nt, Human adenovirus C
gcagcugccgccgccgccaccca

SEQ ID NO: 3913781 - RNA, 22 nt, Human adenovirus C
gcagcuggggccggaccugggc

SEQ ID NO: 3913782 - RNA, 17 nt, Human adenovirus C
gcagcuuguugaccagc

SEQ ID NO: 3913783 - RNA, 14 nt, Human adenovirus C
gcaggagcgcagcu

SEQ ID NO: 3913784 - RNA, 14 nt, Human adenovirus C
gcagggcaaccugg

SEQ ID NO: 3913785 - RNA, 13 nt, Human adenovirus C
gcagggccagcug

SEQ ID NO: 3913786 - RNA, 16 nt, Human adenovirus C
gcagggugacaagguc

SEQ ID NO: 3913787 - RNA, 17 nt, Human adenovirus C
gcagguacgccugcagg

SEQ ID NO: 3913788 - RNA, 16 nt, Human adenovirus C
gcagguuccugagcag

SEQ ID NO: 3913789 - RNA, 18 nt, Human adenovirus C
gcagguuccugagcagcu

SEQ ID NO: 3913790 - RNA, 21 nt, Human adenovirus C
gcagguuccugagcagcugcg

SEQ ID NO: 3913791 - RNA, 16 nt, Human adenovirus C
gcaguagucggugcuc

SEQ ID NO: 3913792 - RNA, 18 nt, Human adenovirus C
gcaguggucuccucagcg

SEQ ID NO: 3913793 - RNA, 13 nt, Human adenovirus C
gcaguuccaggcg

SEQ ID NO: 3913794 - RNA, 15 nt, Human adenovirus C
gcauacggccgccag

SEQ ID NO: 3913795 - RNA, 11 nt, Human adenovirus C
gcaucccaccu

SEQ ID NO: 3913796 - RNA, 19 nt, Human adenovirus C
gcauccgcaagcggcaacc

SEQ ID NO: 3913797 - RNA, 20 nt, Human adenovirus C
gcaugaagggcacgagcugc

SEQ ID NO: 3913798 - RNA, 22 nt, Human adenovirus C
gcaugaagggcacgagcugcuu

SEQ ID NO: 3913799 - RNA, 16 nt, Human adenovirus C
gcauguagaacugguu

SEQ ID NO: 3913800 - RNA, 15 nt, Human adenovirus C
gcauguuuucccuga

SEQ ID NO: 3913801 - RNA, 15 nt, Human adenovirus C
gcauuaacauggaag

SEQ ID NO: 3913802 - RNA, 19 nt, Human adenovirus C
gcauuaaguggcucgcucc

SEQ ID NO: 3913803 - RNA, 19 nt, Human adenovirus C
gcauugcguaccucaggca

SEQ ID NO: 3913804 - RNA, 21 nt, Human adenovirus C
gccaaaaaucuuugagggucu

SEQ ID NO: 3913805 - RNA, 17 nt, Human adenovirus C
gccaaccaggcagugca

SEQ ID NO: 3913806 - RNA, 23 nt, Human adenovirus C
gccaacuacaauauuggcuacca

SEQ ID NO: 3913807 - RNA, 21 nt, Human adenovirus C
gccaaucaagcagguggcacc

SEQ ID NO: 3913808 - RNA, 19 nt, Human adenovirus C
gccacaacgcgcagcccgu

SEQ ID NO: 3913809 - RNA, 16 nt, Human adenovirus C
gccacaagugcuuugc

SEQ ID NO: 3913810 - RNA, 12 nt, Human adenovirus C
gccacagagggc

SEQ ID NO: 3913811 - RNA, 14 nt, Human adenovirus C
gccaccgcccgcgg

SEQ ID NO: 3913812 - RNA, 15 nt, Human adenovirus C
gccaccuucuucccc

SEQ ID NO: 3913813 - RNA, 11 nt, Human adenovirus C
gccacugccac

SEQ ID NO: 3913814 - RNA, 23 nt, Human adenovirus C
gccagacuauuuuuuccagacca

SEQ ID NO: 3913815 - RNA, 13 nt, Human adenovirus C
gccagcacgcucu

SEQ ID NO: 3913816 - RNA, 21 nt, Human adenovirus C
gccagcagguuucugcccuga

SEQ ID NO: 3913817 - RNA, 14 nt, Human adenovirus C
gccagcgccugcac

SEQ ID NO: 3913818 - RNA, 17 nt, Human adenovirus C
gccagcgccugcacugc

SEQ ID NO: 3913819 - RNA, 18 nt, Human adenovirus C
gccagcgccugcacugca

SEQ ID NO: 3913820 - RNA, 15 nt, Human adenovirus C
gccaggacgccucgg

SEQ ID NO: 3913821 - RNA, 17 nt, Human adenovirus C
gccauagcggaugucag

SEQ ID NO: 3913822 - RNA, 15 nt, Human adenovirus C
gccaugccccaggcu

SEQ ID NO: 3913823 - RNA, 22 nt, Human adenovirus C
gcccaacucggccgccugugga

SEQ ID NO: 3913824 - RNA, 23 nt, Human adenovirus C
gcccacaacacggccuccacgcu

SEQ ID NO: 3913825 - RNA, 17 nt, Human adenovirus C
gcccacaccuacagccu

SEQ ID NO: 3913826 - RNA, 13 nt, Human adenovirus C
gcccaggcggcgg

SEQ ID NO: 3913827 - RNA, 18 nt, Human adenovirus C
gccccaaucaaucagccu

SEQ ID NO: 3913828 - RNA, 17 nt, Human adenovirus C
gccccaggcuggggaga

SEQ ID NO: 3913829 - RNA, 17 nt, Human adenovirus C
gccccccuucucccacc

SEQ ID NO: 3913830 - RNA, 15 nt, Human adenovirus C
gccccucgccauagc

SEQ ID NO: 3913831 - RNA, 15 nt, Human adenovirus C
gcccgaggguaacga

SEQ ID NO: 3913832 - RNA, 12 nt, Human adenovirus C
gcccgccaccug

SEQ ID NO: 3913833 - RNA, 17 nt, Human adenovirus C
gcccgccagcccccacc

SEQ ID NO: 3913834 - RNA, 14 nt, Human adenovirus C
gcccgcgccaccga

SEQ ID NO: 3913835 - RNA, 15 nt, Human adenovirus C
gcccgcgccugcugg

SEQ ID NO: 3913836 - RNA, 14 nt, Human adenovirus C
gcccgggaccagcg

SEQ ID NO: 3913837 - RNA, 15 nt, Human adenovirus C
gcccgucucuggggu

SEQ ID NO: 3913838 - RNA, 21 nt, Human adenovirus C
gcccguguucugacagggccc

SEQ ID NO: 3913839 - RNA, 14 nt, Human adenovirus C
gcccuaacaguggc

SEQ ID NO: 3913840 - RNA, 19 nt, Human adenovirus C
gcccuacuuccgcagccac

SEQ ID NO: 3913841 - RNA, 17 nt, Human adenovirus C
gcccucaccugccgccu

SEQ ID NO: 3913842 - RNA, 13 nt, Human adenovirus C
gcccucuuccucc

SEQ ID NO: 3913843 - RNA, 14 nt, Human adenovirus C
gcccuggaggcagc

SEQ ID NO: 3913844 - RNA, 20 nt, Human adenovirus C
gcccuggaggcagcuggggc

SEQ ID NO: 3913845 - RNA, 21 nt, Human adenovirus C
gcccuucacggacaguggcag

SEQ ID NO: 3913846 - RNA, 18 nt, Human adenovirus C
gcccuugauggagggcaa

SEQ ID NO: 3913847 - RNA, 24 nt, Human adenovirus C
gcccuugcggcagucugcagcgcu

SEQ ID NO: 3913848 - RNA, 13 nt, Human adenovirus C
gccgaaaacaggg

SEQ ID NO: 3913849 - RNA, 16 nt, Human adenovirus C
gccgcacgaggggcag

SEQ ID NO: 3913850 - RNA, 20 nt, Human adenovirus C
gccgcacgaggggcagugca

SEQ ID NO: 3913851 - RNA, 18 nt, Human adenovirus C
gccgcacugggcgcacca

SEQ ID NO: 3913852 - RNA, 14 nt, Human adenovirus C
gccgcaggccccgc

SEQ ID NO: 3913853 - RNA, 13 nt, Human adenovirus C
gccgcauccccgc

SEQ ID NO: 3913854 - RNA, 18 nt, Human adenovirus C
gccgccaugggcuccagu

SEQ ID NO: 3913855 - RNA, 19 nt, Human adenovirus C
gccgcgauguuuagcugca

SEQ ID NO: 3913856 - RNA, 14 nt, Human adenovirus C
gccgcggcagaacc

SEQ ID NO: 3913857 - RNA, 13 nt, Human adenovirus C
gccgcggugcagg

SEQ ID NO: 3913858 - RNA, 12 nt, Human adenovirus C
gccggccuggac

SEQ ID NO: 3913859 - RNA, 17 nt, Human adenovirus C
gccggucuucgcccugc

SEQ ID NO: 3913860 - RNA, 17 nt, Human adenovirus C
gccgugccaaccgcagc

SEQ ID NO: 3913861 - RNA, 20 nt, Human adenovirus C
gccgugccaaccgcagccga

SEQ ID NO: 3913862 - RNA, 15 nt, Human adenovirus C
gccuaccaggcaagc

SEQ ID NO: 3913863 - RNA, 13 nt, Human adenovirus C
gccuacccgcagu

SEQ ID NO: 3913864 - RNA, 17 nt, Human adenovirus C
gccuccaacugugcccu

SEQ ID NO: 3913865 - RNA, 15 nt, Human adenovirus C
gccuccgcccugcgc

SEQ ID NO: 3913866 - RNA, 15 nt, Human adenovirus C
gccucuggcauuagc

SEQ ID NO: 3913867 - RNA, 22 nt, Human adenovirus C
gccugcaaaauuuccaacgugg

SEQ ID NO: 3913868 - RNA, 19 nt, Human adenovirus C
gccugccgacuuggaggag

SEQ ID NO: 3913869 - RNA, 23 nt, Human adenovirus C
gccugcgucauuacccagggcca

SEQ ID NO: 3913870 - RNA, 21 nt, Human adenovirus C
gccugcuuaaaacccugcaac

SEQ ID NO: 3913871 - RNA, 13 nt, Human adenovirus C
gccuggaggagcg

SEQ ID NO: 3913872 - RNA, 22 nt, Human adenovirus C
gccuggcggguuuggcuggugg

SEQ ID NO: 3913873 - RNA, 16 nt, Human adenovirus C
gccugggcuggagccc

SEQ ID NO: 3913874 - RNA, 23 nt, Human adenovirus C
gccuuaggguugccgccugcugc

SEQ ID NO: 3913875 - RNA, 18 nt, Human adenovirus C
gccuugcaggcgcagaga

SEQ ID NO: 3913876 - RNA, 13 nt, Human adenovirus C
gccuuugccaacu

SEQ ID NO: 3913877 - RNA, 14 nt, Human adenovirus C
gccuuugccuggaa

SEQ ID NO: 3913878 - RNA, 19 nt, Human adenovirus C
gccuuuuacugcugcugga

SEQ ID NO: 3913879 - RNA, 11 nt, Human adenovirus C
gcgaagaucag

SEQ ID NO: 3913880 - RNA, 14 nt, Human adenovirus C
gcgaaucucagugg

SEQ ID NO: 3913881 - RNA, 20 nt, Human adenovirus C
gcgaccgcgagcugaugcac

SEQ ID NO: 3913882 - RNA, 18 nt, Human adenovirus C
gcgacgaaugagcuccac

SEQ ID NO: 3913883 - RNA, 15 nt, Human adenovirus C
gcgacgucagacaac

SEQ ID NO: 3913884 - RNA, 21 nt, Human adenovirus C
gcgagaaggcguugaggccuc

SEQ ID NO: 3913885 - RNA, 13 nt, Human adenovirus C
gcgaggagcucaa

SEQ ID NO: 3913886 - RNA, 12 nt, Human adenovirus C
gcgagggccagc

SEQ ID NO: 3913887 - RNA, 17 nt, Human adenovirus C
gacgugguccgugugca

SEQ ID NO: 3913888 - RNA, 21 nt, Human adenovirus C
gacuacuugcaucgcgcggcc

SEQ ID NO: 3913889 - RNA, 20 nt, Human adenovirus C
gacuauuuuuuccagaccag

SEQ ID NO: 3913890 - RNA, 16 nt, Human adenovirus C
gacucgagacgccgcc

SEQ ID NO: 3913891 - RNA, 21 nt, Human adenovirus C
gacugcagguacgccugcagg

SEQ ID NO: 3913892 - RNA, 20 nt, Human adenovirus C
gacugggggcguacacugga

SEQ ID NO: 3913893 - RNA, 22 nt, Human adenovirus C
gagaacuccaacgcggcagccg

SEQ ID NO: 3913894 - RNA, 11 nt, Human adenovirus C
gagaagaacau

SEQ ID NO: 3913895 - RNA, 14 nt, Human adenovirus C
gagaaggugcuggc

SEQ ID NO: 3913896 - RNA, 12 nt, Human adenovirus C
gagacagugucu

SEQ ID NO: 3913897 - RNA, 16 nt, Human adenovirus C
gagacggcggaggcgc

SEQ ID NO: 3913898 - RNA, 18 nt, Human adenovirus C
gagacguacuucagccug

SEQ ID NO: 3913899 - RNA, 11 nt, Human adenovirus C
gagaggagccc

SEQ ID NO: 3913900 - RNA, 22 nt, Human adenovirus C
gagcacaacauacugacccgcu

SEQ ID NO: 3913901 - RNA, 13 nt, Human adenovirus C
gagcacagggaug

SEQ ID NO: 3913902 - RNA, 15 nt, Human adenovirus C
gagcacuacuugaaa

SEQ ID NO: 3913903 - RNA, 22 nt, Human adenovirus C
gagcagacggugaaccaggaga

SEQ ID NO: 3913904 - RNA, 18 nt, Human adenovirus C
gagcagcggcagacaugc

SEQ ID NO: 3913905 - RNA, 13 nt, Human adenovirus C
gagcaggacccag

SEQ ID NO: 3913906 - RNA, 15 nt, Human adenovirus C
gagcaggucuacugg

SEQ ID NO: 3913907 - RNA, 13 nt, Human adenovirus C
gagccccucgccu

SEQ ID NO: 3913908 - RNA, 15 nt, Human adenovirus C
gagccuccaccggcc

SEQ ID NO: 3913909 - RNA, 16 nt, Human adenovirus C
gagcgacgaccugggc

SEQ ID NO: 3913910 - RNA, 14 nt, Human adenovirus C
gagcgagguguggg

SEQ ID NO: 3913911 - RNA, 19 nt, Human adenovirus C
gagcgcugcgucuggcgcc

SEQ ID NO: 3913912 - RNA, 19 nt, Human adenovirus C
gagcgugagccggcggcgc

SEQ ID NO: 3913913 - RNA, 15 nt, Human adenovirus C
gagcucagcgaccgc

SEQ ID NO: 3913914 - RNA, 21 nt, Human adenovirus C
gagcucuaacaguaccucuug

SEQ ID NO: 3913915 - RNA, 20 nt, Human adenovirus C
gagcugaugcacagccugca

SEQ ID NO: 3913916 - RNA, 23 nt, Human adenovirus C
gagcugcugagccgccgugcgcc

SEQ ID NO: 3913917 - RNA, 21 nt, Human adenovirus C
gaggaagugauuaucgagcag

SEQ ID NO: 3913918 - RNA, 21 nt, Human adenovirus C
gaggagccuccaccggccgug

SEQ ID NO: 3913919 - RNA, 13 nt, Human adenovirus C
gaggauagggugg

SEQ ID NO: 3913920 - RNA, 13 nt, Human adenovirus C
gaggaugaagaag

SEQ ID NO: 3913921 - RNA, 21 nt, Human adenovirus C
gaggcacuaaagcaaggccug

SEQ ID NO: 3913922 - RNA, 19 nt, Human adenovirus C
gaggcagagcgacugcgcc

SEQ ID NO: 3913923 - RNA, 20 nt, Human adenovirus C
gaggccauaggucaggcgca

SEQ ID NO: 3913924 - RNA, 15 nt, Human adenovirus C
gaggccgaggcagcg

SEQ ID NO: 3913925 - RNA, 15 nt, Human adenovirus C
gaggccguggcgcag

SEQ ID NO: 3913926 - RNA, 21 nt, Human adenovirus C
gaggcgccgcacgaggggcag

SEQ ID NO: 3913927 - RNA, 13 nt, Human adenovirus C
gaggcuugggagu

SEQ ID NO: 3913928 - RNA, 13 nt, Human adenovirus C
gagggacaggcuu

SEQ ID NO: 3913929 - RNA, 17 nt, Human adenovirus C
gagggaccugagcgagu

SEQ ID NO: 3913930 - RNA, 17 nt, Human adenovirus C
gagggcauggagacaca

SEQ ID NO: 3913931 - RNA, 22 nt, Human adenovirus C
gagggccagcuguuggggugag

SEQ ID NO: 3913932 - RNA, 16 nt, Human adenovirus C
gagggcccggcgcacg

SEQ ID NO: 3913933 - RNA, 16 nt, Human adenovirus C
gaggggcagugcagac

SEQ ID NO: 3913934 - RNA, 19 nt, Human adenovirus C
gagggugacaacgcgcgcc

SEQ ID NO: 3913935 - RNA, 16 nt, Human adenovirus C
gagguccgcgugcggc

SEQ ID NO: 3913936 - RNA, 16 nt, Human adenovirus C
gagucucgggccggcc

SEQ ID NO: 3913937 - RNA, 16 nt, Human adenovirus C
gaguuuaaggaaccag

SEQ ID NO: 3913938 - RNA, 20 nt, Human adenovirus C
gaguuuaaggaaccagcuug

SEQ ID NO: 3913939 - RNA, 13 nt, Human adenovirus C
gauaaauggagcg

SEQ ID NO: 3913940 - RNA, 16 nt, Human adenovirus C
gauaucggcaccagca

SEQ ID NO: 3913941 - RNA, 14 nt, Human adenovirus C
gauaucuugaaguc

SEQ ID NO: 3913942 - RNA, 18 nt, Human adenovirus C
gauaugcuccaggcgggc

SEQ ID NO: 3913943 - RNA, 15 nt, Human adenovirus C
gaucaggcuacuaag

SEQ ID NO: 3913944 - RNA, 14 nt, Human adenovirus C
gaucggcaggcuca

SEQ ID NO: 3913945 - RNA, 21 nt, Human adenovirus C
gaucuccugaaucuggcgccu

SEQ ID NO: 3913946 - RNA, 15 nt, Human adenovirus C
gaucugcgccagcag

SEQ ID NO: 3913947 - RNA, 21 nt, Human adenovirus C
gaucugcuuaaaagccaccug

SEQ ID NO: 3913948 - RNA, 19 nt, Human adenovirus C
gaucuugguugugggccau

SEQ ID NO: 3913949 - RNA, 14 nt, Human adenovirus C
gaugaagaagagga

SEQ ID NO: 3913950 - RNA, 15 nt, Human adenovirus C
gaugaagaagaggaa

SEQ ID NO: 3913951 - RNA, 18 nt, Human adenovirus C
gaugaccggcucaaccau

SEQ ID NO: 3913952 - RNA, 13 nt, Human adenovirus C
gaugaggccggcc

SEQ ID NO: 3913953 - RNA, 12 nt, Human adenovirus C
gaugcaaaauaa

SEQ ID NO: 3913954 - RNA, 18 nt, Human adenovirus C
gaugccaugaaccacccu

SEQ ID NO: 3913955 - RNA, 13 nt, Human adenovirus C
gaugcgaguagcc

SEQ ID NO: 3913956 - RNA, 16 nt, Human adenovirus C
gaugcgggccaugagc

SEQ ID NO: 3913957 - RNA, 16 nt, Human adenovirus C
gaugcugaccugcucg

SEQ ID NO: 3913958 - RNA, 24 nt, Human adenovirus C
gauggcgggcgcucgggcuuggga

SEQ ID NO: 3913959 - RNA, 20 nt, Human adenovirus C
gaugugaccgaggagcugag

SEQ ID NO: 3913960 - RNA, 19 nt, Human adenovirus C
gauguggcaucccugaacu

SEQ ID NO: 3913961 - RNA, 16 nt, Human adenovirus C
gauuaaaaacaaguug

SEQ ID NO: 3913962 - RNA, 16 nt, Human adenovirus C
gauuucugccagcgcc

SEQ ID NO: 3913963 - RNA, 20 nt, Human adenovirus C
gauuugggagggaguggcaa

SEQ ID NO: 3913964 - RNA, 14 nt, Human adenovirus C
gcaaaacgcucgag

SEQ ID NO: 3913965 - RNA, 23 nt, Human adenovirus C
gcaaaacgcucgagaucaggcua

SEQ ID NO: 3913966 - RNA, 18 nt, Human adenovirus C
gcaaaaucuccugcacgu

SEQ ID NO: 3913967 - RNA, 21 nt, Human adenovirus C
gcaaagcacacugaacagcau

SEQ ID NO: 3913968 - RNA, 15 nt, Human adenovirus C
gcaaaucuuugucca

SEQ ID NO: 3913969 - RNA, 14 nt, Human adenovirus C
gcaacaccacugcu

SEQ ID NO: 3913970 - RNA, 17 nt, Human adenovirus C
gcaacagcgcgagcagg

SEQ ID NO: 3913971 - RNA, 20 nt, Human adenovirus C
gcaacaucaacaacagcugc

SEQ ID NO: 3913972 - RNA, 20 nt, Human adenovirus C
gcaacccuuccaggagggcu

SEQ ID NO: 3913973 - RNA, 16 nt, Human adenovirus C
gcaacgaccgccugcu

SEQ ID NO: 3913974 - RNA, 21 nt, Human adenovirus C
gcaacgugcagaccaaccugg

SEQ ID NO: 3913975 - RNA, 13 nt, Human adenovirus C
gcaacugggcagc

SEQ ID NO: 3913976 - RNA, 20 nt, Human adenovirus C
gcaacuuucuaaccacgguc

SEQ ID NO: 3913977 - RNA, 17 nt, Human adenovirus C
gcaagaccaggacgacg

SEQ ID NO: 3913978 - RNA, 17 nt, Human adenovirus C
gcaagauaccccuaucc

SEQ ID NO: 3913979 - RNA, 12 nt, Human adenovirus C
gcaaggccuggc

SEQ ID NO: 3913980 - RNA, 14 nt, Human adenovirus C
gcaauaacacaggc

SEQ ID NO: 3913981 - RNA, 20 nt, Human adenovirus C
gcaauaacacaggcuggggc

SEQ ID NO: 3913982 - RNA, 17 nt, Human adenovirus C
gcaauacagagacagga

SEQ ID NO: 3913983 - RNA, 13 nt, Human adenovirus C
gcaaugacagcac

SEQ ID NO: 3913984 - RNA, 18 nt, Human adenovirus C
gcacacugaacagcaucg

SEQ ID NO: 3913985 - RNA, 14 nt, Human adenovirus C
gcacagcagggaca

SEQ ID NO: 3913986 - RNA, 17 nt, Human adenovirus C
gcacaucucgggccagg

SEQ ID NO: 3913987 - RNA, 21 nt, Human adenovirus C
gcaccacauuucggccccacc

SEQ ID NO: 3913988 - RNA, 21 nt, Human adenovirus C
gcaccagcucaaucagucaca

SEQ ID NO: 3913989 - RNA, 23 nt, Human adenovirus C
gcaccagcucaaucagucacagu

SEQ ID NO: 3913990 - RNA, 17 nt, Human adenovirus C
gcaccaggugcagaccc

SEQ ID NO: 3913991 - RNA, 15 nt, Human adenovirus C
gcacccuccccuucu

SEQ ID NO: 3913992 - RNA, 19 nt, Human adenovirus C
gcacccugaucucacuuaa

SEQ ID NO: 3913993 - RNA, 14 nt, Human adenovirus C
gcaccgccagcgca

SEQ ID NO: 3913994 - RNA, 15 nt, Human adenovirus C
gcaccggcggcagcg

SEQ ID NO: 3913995 - RNA, 18 nt, Human adenovirus C
gcaccggcggcagcggca

SEQ ID NO: 3913996 - RNA, 18 nt, Human adenovirus C
gcacgagcugcuucccaa

SEQ ID NO: 3913997 - RNA, 20 nt, Human adenovirus C
gcacgcccuucucggccggc

SEQ ID NO: 3913998 - RNA, 16 nt, Human adenovirus C
gcacgcuggccagcac

SEQ ID NO: 3913999 - RNA, 23 nt, Human adenovirus C
gcacggcguccggcucaccaccc

SEQ ID NO: 3914000 - RNA, 18 nt, Human adenovirus C
gcacucacagaccugggc

SEQ ID NO: 3914001 - RNA, 19 nt, Human adenovirus C
gcacucacagaccugggcc

SEQ ID NO: 3914002 - RNA, 13 nt, Human adenovirus C
gcacucgcaccgu

SEQ ID NO: 3914003 - RNA, 15 nt, Human adenovirus C
gcacugccgcccaac

SEQ ID NO: 3914004 - RNA, 13 nt, Human adenovirus C
gcagaaacacaag

SEQ ID NO: 3914005 - RNA, 15 nt, Human adenovirus C
gcagaagcugccgcc

SEQ ID NO: 3914006 - RNA, 14 nt, Human adenovirus C
cggugcgaggaugc

SEQ ID NO: 3914007 - RNA, 15 nt, Human adenovirus C
cggugguaugcgccc

SEQ ID NO: 3914008 - RNA, 18 nt, Human adenovirus C
cggugguggaggaggcgc

SEQ ID NO: 3914009 - RNA, 18 nt, Human adenovirus C
cgguugccucggcggugg

SEQ ID NO: 3914010 - RNA, 15 nt, Human adenovirus C
cgguuuuccuggcca

SEQ ID NO: 3914011 - RNA, 17 nt, Human adenovirus C
cguaaaccugagccagg

SEQ ID NO: 3914012 - RNA, 22 nt, Human adenovirus C
cguagaggagccuccaccggcc

SEQ ID NO: 3914013 - RNA, 20 nt, Human adenovirus C
cguagccaguggcaacuggc

SEQ ID NO: 3914014 - RNA, 23 nt, Human adenovirus C
cguagccugauucgggaguuuac

SEQ ID NO: 3914015 - RNA, 20 nt, Human adenovirus C
cguaggagucgcgcagcuug

SEQ ID NO: 3914016 - RNA, 21 nt, Human adenovirus C
cguaggcgcucguugguccag

SEQ ID NO: 3914017 - RNA, 12 nt, Human adenovirus C
cguaggugagcu

SEQ ID NO: 3914018 - RNA, 14 nt, Human adenovirus C
cgucacccagcacu

SEQ ID NO: 3914019 - RNA, 17 nt, Human adenovirus C
cgcauagccgggucagg

SEQ ID NO: 3914020 - RNA, 17 nt, Human adenovirus C
cgcauugcguaccucag

SEQ ID NO: 3914021 - RNA, 15 nt, Human adenovirus C
cgccaacgcgccuac

SEQ ID NO: 3914022 - RNA, 16 nt, Human adenovirus C
cgccaacuccgcccac

SEQ ID NO: 3914023 - RNA, 19 nt, Human adenovirus C
cgccacaauguggccuccg

SEQ ID NO: 3914024 - RNA, 23 nt, Human adenovirus C
cgccaccguuuuuacccacccaa

SEQ ID NO: 3914025 - RNA, 17 nt, Human adenovirus C
cgccagcccccaccauc

SEQ ID NO: 3914026 - RNA, 20 nt, Human adenovirus C
cgccagggcuacgugcgcca

SEQ ID NO: 3914027 - RNA, 12 nt, Human adenovirus C
cgcccagcaaua

SEQ ID NO: 3914028 - RNA, 14 nt, Human adenovirus C
cgccccaggcuggg

SEQ ID NO: 3914029 - RNA, 21 nt, Human adenovirus C
cgcccugcgcgucggccaggu

SEQ ID NO: 3914030 - RNA, 14 nt, Human adenovirus C
cgccgaaccaccac

SEQ ID NO: 3914031 - RNA, 20 nt, Human adenovirus C
cgccgcgcgcgggcaggagc

SEQ ID NO: 3914032 - RNA, 15 nt, Human adenovirus C
cgccgugccgccagc

SEQ ID NO: 3914033 - RNA, 21 nt, Human adenovirus C
cgccucggaguaccugagccc

SEQ ID NO: 3914034 - RNA, 23 nt, Human adenovirus C
cgccugacgaaaaguccgcggcu

SEQ ID NO: 3914035 - RNA, 21 nt, Human adenovirus C
cgccugauuucugccagcgcc

SEQ ID NO: 3914036 - RNA, 14 nt, Human adenovirus C
cgccugcaggaauc

SEQ ID NO: 3914037 - RNA, 14 nt, Human adenovirus C
cgccugcugggcga

SEQ ID NO: 3914038 - RNA, 18 nt, Human adenovirus C
cgccuuuuagcugcaaac

SEQ ID NO: 3914039 - RNA, 21 nt, Human adenovirus C
cgcgacuacgguaccgcgcgg

SEQ ID NO: 3914040 - RNA, 23 nt, Human adenovirus C
cgcgaggcguacgugccgcggca

SEQ ID NO: 3914041 - RNA, 18 nt, Human adenovirus C
cgcgcaacgaagcuaugu

SEQ ID NO: 3914042 - RNA, 16 nt, Human adenovirus C
cgcgcacgucgcaccg

SEQ ID NO: 3914043 - RNA, 12 nt, Human adenovirus C
cgcgccagaccc

SEQ ID NO: 3914044 - RNA, 16 nt, Human adenovirus C
cgcgcccuggaggcag

SEQ ID NO: 3914045 - RNA, 22 nt, Human adenovirus C
cgcgcccuggaggcagcugggg

SEQ ID NO: 3914046 - RNA, 23 nt, Human adenovirus C
cgcgcgagcccaaaguccagaug

SEQ ID NO: 3914047 - RNA, 14 nt, Human adenovirus C
cgcgcgcgggcagg

SEQ ID NO: 3914048 - RNA, 14 nt, Human adenovirus C
cgcgcuccuuggcc

SEQ ID NO: 3914049 - RNA, 21 nt, Human adenovirus C
cgcgcugcggcugcuguugcu

SEQ ID NO: 3914050 - RNA, 14 nt, Human adenovirus C
cgcgcugcuccucu

SEQ ID NO: 3914051 - RNA, 13 nt, Human adenovirus C
cgcgcuggccagg

SEQ ID NO: 3914052 - RNA, 14 nt, Human adenovirus C
cgcgcuggccaggg

SEQ ID NO: 3914053 - RNA, 16 nt, Human adenovirus C
cgcgcuggggcaggag

SEQ ID NO: 3914054 - RNA, 15 nt, Human adenovirus C
cgcggcagccgcggc

SEQ ID NO: 3914055 - RNA, 15 nt, Human adenovirus C
cgcggcccgacaggg

SEQ ID NO: 3914056 - RNA, 16 nt, Human adenovirus C
cgcggcgccgggcccg

SEQ ID NO: 3914057 - RNA, 13 nt, Human adenovirus C
cgcggcggcggcc

SEQ ID NO: 3914058 - RNA, 15 nt, Human adenovirus C
cgcggcgugcuggac

SEQ ID NO: 3914059 - RNA, 14 nt, Human adenovirus C
cgcggcugacgcgg

SEQ ID NO: 3914060 - RNA, 13 nt, Human adenovirus C
cgcgggcgggccc

SEQ ID NO: 3914061 - RNA, 16 nt, Human adenovirus C
cgcgggcuagguccag

SEQ ID NO: 3914062 - RNA, 15 nt, Human adenovirus C
cgcgggggcgcaguu

SEQ ID NO: 3914063 - RNA, 15 nt, Human adenovirus C
cgcggugcaggcggc

SEQ ID NO: 3914064 - RNA, 20 nt, Human adenovirus C
cgcguccuaucgagccgcac

SEQ ID NO: 3914065 - RNA, 14 nt, Human adenovirus C
cgcguuccggcagc

SEQ ID NO: 3914066 - RNA, 16 nt, Human adenovirus C
cgcuaugugcagcaga

SEQ ID NO: 3914067 - RNA, 13 nt, Human adenovirus C
cgcucccuggucu

SEQ ID NO: 3914068 - RNA, 14 nt, Human adenovirus C
cgcuccuaacuccu

SEQ ID NO: 3914069 - RNA, 20 nt, Human adenovirus C
cgcucgggcuugggagaggg

SEQ ID NO: 3914070 - RNA, 18 nt, Human adenovirus C
cgcucguugguccagcag

SEQ ID NO: 3914071 - RNA, 19 nt, Human adenovirus C
cgcucguugguccagcaga

SEQ ID NO: 3914072 - RNA, 14 nt, Human adenovirus C
cgcugacacccagc

SEQ ID NO: 3914073 - RNA, 23 nt, Human adenovirus C
cgcugaggccgaggcagcggcag

SEQ ID NO: 3914074 - RNA, 16 nt, Human adenovirus C
cgcugcggccgcgucc

SEQ ID NO: 3914075 - RNA, 20 nt, Human adenovirus C
cgcuggacgagggcaaccca

SEQ ID NO: 3914076 - RNA, 18 nt, Human adenovirus C
cgcuucagccgcugcagc

SEQ ID NO: 3914077 - RNA, 19 nt, Human adenovirus C
cgcuugcaaauuccuccgg

SEQ ID NO: 3914078 - RNA, 19 nt, Human adenovirus C
cgcuugcaagcagugcagc

SEQ ID NO: 3914079 - RNA, 19 nt, Human adenovirus C
cggaaaccucaccucccaa

SEQ ID NO: 3914080 - RNA, 12 nt, Human adenovirus C
cggaaagcggca

SEQ ID NO: 3914081 - RNA, 18 nt, Human adenovirus C
cggaccaguuuauuccca

SEQ ID NO: 3914082 - RNA, 15 nt, Human adenovirus C
cggaccugggcuggc

SEQ ID NO: 3914083 - RNA, 20 nt, Human adenovirus C
cggacuaucgcaacaccacu

SEQ ID NO: 3914084 - RNA, 18 nt, Human adenovirus C
cggagaucuauggccccc

SEQ ID NO: 3914085 - RNA, 20 nt, Human adenovirus C
cggagaucuauggccccccg

SEQ ID NO: 3914086 - RNA, 14 nt, Human adenovirus C
cggagaugcagcgc

SEQ ID NO: 3914087 - RNA, 20 nt, Human adenovirus C
cggaggagcaacagcaggag

SEQ ID NO: 3914088 - RNA, 15 nt, Human adenovirus C
cggaggugcugcuga

SEQ ID NO: 3914089 - RNA, 15 nt, Human adenovirus C
cggcaaccgccucag

SEQ ID NO: 3914090 - RNA, 17 nt, Human adenovirus C
cggcaacugucacuugc

SEQ ID NO: 3914091 - RNA, 16 nt, Human adenovirus C
cggcacuaccuggacu

SEQ ID NO: 3914092 - RNA, 14 nt, Human adenovirus C
cggcagaaacagag

SEQ ID NO: 3914093 - RNA, 17 nt, Human adenovirus C
cggcagaaacagagggc

SEQ ID NO: 3914094 - RNA, 17 nt, Human adenovirus C
cggcagcagcaggagga

SEQ ID NO: 3914095 - RNA, 15 nt, Human adenovirus C
cggcagcggcagcaa

SEQ ID NO: 3914096 - RNA, 16 nt, Human adenovirus C
cggcagcggcagcggc

SEQ ID NO: 3914097 - RNA, 15 nt, Human adenovirus C
cggccacuacccgga

SEQ ID NO: 3914098 - RNA, 16 nt, Human adenovirus C
cggccaugcgggccgc

SEQ ID NO: 3914099 - RNA, 23 nt, Human adenovirus C
cggcccguagccaguggcaacug

SEQ ID NO: 3914100 - RNA, 19 nt, Human adenovirus C
cggccgccgcagcagccgc

SEQ ID NO: 3914101 - RNA, 12 nt, Human adenovirus C
cggccguccgcc

SEQ ID NO: 3914102 - RNA, 13 nt, Human adenovirus C
cggccuggcgcaa

SEQ ID NO: 3914103 - RNA, 16 nt, Human adenovirus C
cggccugguaggcgca

SEQ ID NO: 3914104 - RNA, 17 nt, Human adenovirus C
cggccugguaggcgcag

SEQ ID NO: 3914105 - RNA, 18 nt, Human adenovirus C
cggccugguaggcgcagc

SEQ ID NO: 3914106 - RNA, 16 nt, Human adenovirus C
cggcgacaggucaggc

SEQ ID NO: 3914107 - RNA, 20 nt, Human adenovirus C
cggcgacaggucaggcggga

SEQ ID NO: 3914108 - RNA, 12 nt, Human adenovirus C
cggcgacgggga

SEQ ID NO: 3914109 - RNA, 21 nt, Human adenovirus C
cggcgccaguggcggcggcgc

SEQ ID NO: 3914110 - RNA, 21 nt, Human adenovirus C
cggcgccgcgcgcgggcagga

SEQ ID NO: 3914111 - RNA, 16 nt, Human adenovirus C
cggcgccgggcccggc

SEQ ID NO: 3914112 - RNA, 22 nt, Human adenovirus C
cggcgcggaagagaacuccaac

SEQ ID NO: 3914113 - RNA, 12 nt, Human adenovirus C
cggcggcagcag

SEQ ID NO: 3914114 - RNA, 15 nt, Human adenovirus C
cggcggcagcagcag

SEQ ID NO: 3914115 - RNA, 16 nt, Human adenovirus C
cggcggccuggcgcaa

SEQ ID NO: 3914116 - RNA, 12 nt, Human adenovirus C
cggcggcggugg

SEQ ID NO: 3914117 - RNA, 13 nt, Human adenovirus C
cggcgggcggugg

SEQ ID NO: 3914118 - RNA, 16 nt, Human adenovirus C
cggcgguggcagaugc

SEQ ID NO: 3914119 - RNA, 19 nt, Human adenovirus C
cggcugaagcagggccagg

SEQ ID NO: 3914120 - RNA, 18 nt, Human adenovirus C
cggcugacgcggcggcag

SEQ ID NO: 3914121 - RNA, 14 nt, Human adenovirus C
cgggaagaacugga

SEQ ID NO: 3914122 - RNA, 15 nt, Human adenovirus C
cgggacugggcgugc

SEQ ID NO: 3914123 - RNA, 15 nt, Human adenovirus C
cgggcacuaccgcgc

SEQ ID NO: 3914124 - RNA, 13 nt, Human adenovirus C
cgggcagcaggcg

SEQ ID NO: 3914125 - RNA, 13 nt, Human adenovirus C
cgggcagcggcga

SEQ ID NO: 3914126 - RNA, 13 nt, Human adenovirus C
cgggcaggagcug

SEQ ID NO: 3914127 - RNA, 18 nt, Human adenovirus C
cgggcaggagcuggugcu

SEQ ID NO: 3914128 - RNA, 19 nt, Human adenovirus C
cgggcccuugcuucccagg

SEQ ID NO: 3914129 - RNA, 16 nt, Human adenovirus C
cgggcggaggagaagc

SEQ ID NO: 3914130 - RNA, 18 nt, Human adenovirus C
cgggcggccaugcgggcc

SEQ ID NO: 3914131 - RNA, 19 nt, Human adenovirus C
cggggauggcgcaggcggc

SEQ ID NO: 3914132 - RNA, 20 nt, Human adenovirus C
cggggcuccgggggcgaggu

SEQ ID NO: 3914133 - RNA, 22 nt, Human adenovirus C
cgguaaagaccccgggcagcag

SEQ ID NO: 3914134 - RNA, 19 nt, Human adenovirus C
cgguaccuuugagcugcag

SEQ ID NO: 3914135 - RNA, 21 nt, Human adenovirus C
cgguccuuugcaaguagcaca

SEQ ID NO: 3914136 - RNA, 14 nt, Human adenovirus C
cggugaaccaggag

SEQ ID NO: 3914137 - RNA, 14 nt, Human adenovirus C
cggugacgcgggcg

SEQ ID NO: 3914138 - RNA, 19 nt, Human adenovirus C
cggugagcgcuccacccgc

SEQ ID NO: 3914139 - RNA, 18 nt, Human adenovirus C
ccuccgcuccucaggcgc

SEQ ID NO: 3914140 - RNA, 20 nt, Human adenovirus C
ccuccgggcacagcagcgca

SEQ ID NO: 3914141 - RNA, 17 nt, Human adenovirus C
ccuccucagcagcggca

SEQ ID NO: 3914142 - RNA, 21 nt, Human adenovirus C
ccucgcgcaaaaaagcaagca

SEQ ID NO: 3914143 - RNA, 13 nt, Human adenovirus C
ccucgcucccacc

SEQ ID NO: 3914144 - RNA, 18 nt, Human adenovirus C
ccucggucgcauuccccu

SEQ ID NO: 3914145 - RNA, 22 nt, Human adenovirus C
ccucguaggugagcuccucagg

SEQ ID NO: 3914146 - RNA, 18 nt, Human adenovirus C
ccucguccucggagccgc

SEQ ID NO: 3914147 - RNA, 16 nt, Human adenovirus C
ccucuuugagcccuuu

SEQ ID NO: 3914148 - RNA, 23 nt, Human adenovirus C
ccugcaacagggucugccagacu

SEQ ID NO: 3914149 - RNA, 12 nt, Human adenovirus C
ccugccaccucc

SEQ ID NO: 3914150 - RNA, 19 nt, Human adenovirus C
ccugccaccucccucccaa

SEQ ID NO: 3914151 - RNA, 15 nt, Human adenovirus C
ccugccgugccaacc

SEQ ID NO: 3914152 - RNA, 17 nt, Human adenovirus C
ccugcgcgugcccgugc

SEQ ID NO: 3914153 - RNA, 15 nt, Human adenovirus C
ccugcggggcgauga

SEQ ID NO: 3914154 - RNA, 14 nt, Human adenovirus C
ccuggaggcagcug

SEQ ID NO: 3914155 - RNA, 20 nt, Human adenovirus C
ccuggccaaccaggcagugc

SEQ ID NO: 3914156 - RNA, 19 nt, Human adenovirus C
ccugggcauagucucgccg

SEQ ID NO: 3914157 - RNA, 12 nt, Human adenovirus C
ccugggcuggcg

SEQ ID NO: 3914158 - RNA, 16 nt, Human adenovirus C
ccugguaggcgcagca

SEQ ID NO: 3914159 - RNA, 15 nt, Human adenovirus C
ccuguaagcgggcac

SEQ ID NO: 3914160 - RNA, 22 nt, Human adenovirus C
ccuguaagcgggcacucuuccg

SEQ ID NO: 3914161 - RNA, 20 nt, Human adenovirus C
ccuucacccaguaccgcagc

SEQ ID NO: 3914162 - RNA, 15 nt, Human adenovirus C
ccuucagcuggggcu

SEQ ID NO: 3914163 - RNA, 21 nt, Human adenovirus C
ccuucuccuaccgcgucagga

SEQ ID NO: 3914164 - RNA, 19 nt, Human adenovirus C
ccuugcggcagucugcagc

SEQ ID NO: 3914165 - RNA, 15 nt, Human adenovirus C
ccuugcuucccagga

SEQ ID NO: 3914166 - RNA, 20 nt, Human adenovirus C
ccuuggccaauugcaagcca

SEQ ID NO: 3914167 - RNA, 17 nt, Human adenovirus C
ccuuggcgcgcagcuug

SEQ ID NO: 3914168 - RNA, 17 nt, Human adenovirus C
ccuuuccuuccucccaa

SEQ ID NO: 3914169 - RNA, 19 nt, Human adenovirus C
ccuuugaguucgccaccac

SEQ ID NO: 3914170 - RNA, 17 nt, Human adenovirus C
ccuuuuguuccaccgcu

SEQ ID NO: 3914171 - RNA, 15 nt, Human adenovirus C
cgaaaaggcuguccg

SEQ ID NO: 3914172 - RNA, 17 nt, Human adenovirus C
cgaaagcuaaagcgggu

SEQ ID NO: 3914173 - RNA, 19 nt, Human adenovirus C
cgaagccuuccauccagac

SEQ ID NO: 3914174 - RNA, 20 nt, Human adenovirus C
cgaagcuauguccaagcgca

SEQ ID NO: 3914175 - RNA, 18 nt, Human adenovirus C
cgaaucaugauugcaaaa

SEQ ID NO: 3914176 - RNA, 22 nt, Human adenovirus C
cgacacccaagggugcagcuga

SEQ ID NO: 3914177 - RNA, 22 nt, Human adenovirus C
cgacaggucaggcgggagcucc

SEQ ID NO: 3914178 - RNA, 12 nt, Human adenovirus C
cgaccacagcaa

SEQ ID NO: 3914179 - RNA, 12 nt, Human adenovirus C
cgaccaggccgu

SEQ ID NO: 3914180 - RNA, 15 nt, Human adenovirus C
cgaccgcgagcugau

SEQ ID NO: 3914181 - RNA, 21 nt, Human adenovirus C
cgacgaggaccugcuugagca

SEQ ID NO: 3914182 - RNA, 22 nt, Human adenovirus C
cgacgcggcgguugaucuccug

SEQ ID NO: 3914183 - RNA, 17 nt, Human adenovirus C
cgacgcguugcaagagc

SEQ ID NO: 3914184 - RNA, 13 nt, Human adenovirus C
cgacugcgccuga

SEQ ID NO: 3914185 - RNA, 22 nt, Human adenovirus C
cgacugcgccugacacaccucg

SEQ ID NO: 3914186 - RNA, 20 nt, Human adenovirus C
cgagacguacuucagccuga

SEQ ID NO: 3914187 - RNA, 18 nt, Human adenovirus C
cgagagccggccuggacc

SEQ ID NO: 3914188 - RNA, 16 nt, Human adenovirus C
cgagcaggacccaggu

SEQ ID NO: 3914189 - RNA, 15 nt, Human adenovirus C
cgagcaggcagaggc

SEQ ID NO: 3914190 - RNA, 15 nt, Human adenovirus C
cgagccaggugagcu

SEQ ID NO: 3914191 - RNA, 17 nt, Human adenovirus C
cgagcccaacccgcgcc

SEQ ID NO: 3914192 - RNA, 16 nt, Human adenovirus C
cgagcggccgccgcag

SEQ ID NO: 3914193 - RNA, 14 nt, Human adenovirus C
cgagcgguguuccg

SEQ ID NO: 3914194 - RNA, 14 nt, Human adenovirus C
cgagcgguugcugc

SEQ ID NO: 3914195 - RNA, 23 nt, Human adenovirus C
cgagcgguugcugcgcgaggagg

SEQ ID NO: 3914196 - RNA, 16 nt, Human adenovirus C
cgagcugaugcacagc

SEQ ID NO: 3914197 - RNA, 23 nt, Human adenovirus C
cgagcugcuucccaaaggccccc

SEQ ID NO: 3914198 - RNA, 16 nt, Human adenovirus C
cgaggacagggccucu

SEQ ID NO: 3914199 - RNA, 22 nt, Human adenovirus C
cgaggaccugcuugagcaggcc

SEQ ID NO: 3914200 - RNA, 22 nt, Human adenovirus C
cgaggacgaugaguacgagcca

SEQ ID NO: 3914201 - RNA, 23 nt, Human adenovirus C
cgaggaggcacuaaagcaaggcc

SEQ ID NO: 3914202 - RNA, 16 nt, Human adenovirus C
cgaggcauucagggau

SEQ ID NO: 3914203 - RNA, 14 nt, Human adenovirus C
cgaggccgaagagg

SEQ ID NO: 3914204 - RNA, 16 nt, Human adenovirus C
cgaggccguggcgcag

SEQ ID NO: 3914205 - RNA, 17 nt, Human adenovirus C
cgagggagaggagcccg

SEQ ID NO: 3914206 - RNA, 18 nt, Human adenovirus C
cgagguccgcgugcggcc

SEQ ID NO: 3914207 - RNA, 15 nt, Human adenovirus C
cgaggucgagaagcc

SEQ ID NO: 3914208 - RNA, 21 nt, Human adenovirus C
cgaggucgauggccgcgggcu

SEQ ID NO: 3914209 - RNA, 17 nt, Human adenovirus C
cgaugaguacgagccag

SEQ ID NO: 3914210 - RNA, 19 nt, Human adenovirus C
cgaugauauccguagaugu

SEQ ID NO: 3914211 - RNA, 17 nt, Human adenovirus C
cgaugcuccccuggacc

SEQ ID NO: 3914212 - RNA, 21 nt, Human adenovirus C
cgaugcuccccuggacccgcc

SEQ ID NO: 3914213 - RNA, 17 nt, Human adenovirus C
cgcaaccgcgcccaggc

SEQ ID NO: 3914214 - RNA, 15 nt, Human adenovirus C
cgcaacuucagacug

SEQ ID NO: 3914215 - RNA, 14 nt, Human adenovirus C
cgcacccgcccccc

SEQ ID NO: 3914216 - RNA, 16 nt, Human adenovirus C
cgcacccgccccccgc

SEQ ID NO: 3914217 - RNA, 19 nt, Human adenovirus C
cgcaccuacaagcgcgugu

SEQ ID NO: 3914218 - RNA, 12 nt, Human adenovirus C
cgcaccucgcgc

SEQ ID NO: 3914219 - RNA, 15 nt, Human adenovirus C
cgcacgcccuucucg

SEQ ID NO: 3914220 - RNA, 15 nt, Human adenovirus C
cgcagcagcagggca

SEQ ID NO: 3914221 - RNA, 14 nt, Human adenovirus C
cgcagccuccaugc

SEQ ID NO: 3914222 - RNA, 18 nt, Human adenovirus C
cgcagcgaugugccccuc

SEQ ID NO: 3914223 - RNA, 18 nt, Human adenovirus C
cgcagcuugagccuggcu

SEQ ID NO: 3914224 - RNA, 17 nt, Human adenovirus C
aaaaacccaaagucaaa

SEQ ID NO: 3914225 - RNA, 12 nt, Human adenovirus C
aaaacaaaguca

SEQ ID NO: 3914226 - RNA, 12 nt, Human adenovirus C
aaaaccuucucu

SEQ ID NO: 3914227 - RNA, 13 nt, Human adenovirus C
aaaacuaaaauug

SEQ ID NO: 3914228 - RNA, 20 nt, Human adenovirus C
aaaaucagucagcaaaucuu

SEQ ID NO: 3914229 - RNA, 15 nt, Human adenovirus C
aaaaucugcuccaga

SEQ ID NO: 3914230 - RNA, 17 nt, Human adenovirus C
aaaaugaaagucacugu

SEQ ID NO: 3914231 - RNA, 20 nt, Human adenovirus C
aaaaugaaagucacugugga

SEQ ID NO: 3914232 - RNA, 17 nt, Human adenovirus C
aaaaugugggagucaag

SEQ ID NO: 3914233 - RNA, 18 nt, Human adenovirus C
aaacaauuacaaaaagcg

SEQ ID NO: 3914234 - RNA, 21 nt, Human adenovirus C
aaaccuauuaaaaaacaccac

SEQ ID NO: 3914235 - RNA, 14 nt, Human adenovirus C
aaaccugagccagg

SEQ ID NO: 3914236 - RNA, 16 nt, Human adenovirus C
aaaccugugcugccag

SEQ ID NO: 3914237 - RNA, 23 nt, Human adenovirus C
aaacuaagcauugcuacuaaagg

SEQ ID NO: 3914238 - RNA, 12 nt, Human adenovirus C
aaacuacaugag

SEQ ID NO: 3914239 - RNA, 19 nt, Human adenovirus C
aaacuacgucuuaaacugg

SEQ ID NO: 3914240 - RNA, 23 nt, Human adenovirus C
aaacuuuuauguauaaauuucca

SEQ ID NO: 3914241 - RNA, 20 nt, Human adenovirus C
aaagaacagauaauggcauu

SEQ ID NO: 3914242 - RNA, 17 nt, Human adenovirus C
aaagacaaucuuuuugu

SEQ ID NO: 3914243 - RNA, 20 nt, Human adenovirus C
aaagagggagcggggggcuu

SEQ ID NO: 3914244 - RNA, 21 nt, Human adenovirus C
aaagcgcgguucacccuggcu

SEQ ID NO: 3914245 - RNA, 21 nt, Human adenovirus C
aaaggugguagauggccuggc

SEQ ID NO: 3914246 - RNA, 17 nt, Human adenovirus C
aaagucccccuggaguu

SEQ ID NO: 3914247 - RNA, 16 nt, Human adenovirus C
aaaguuuuuugccauu

SEQ ID NO: 3914248 - RNA, 22 nt, Human adenovirus C
aaauauguggccgggggugcuu

SEQ ID NO: 3914249 - RNA, 16 nt, Human adenovirus C
aaaucaggcaaagccu

SEQ ID NO: 3914250 - RNA, 19 nt, Human adenovirus C
aacaacgggauagagagcc

SEQ ID NO: 3914251 - RNA, 19 nt, Human adenovirus C
aacaaguugcauguggaaa

SEQ ID NO: 3914252 - RNA, 19 nt, Human adenovirus C
aacacaugucuaugcccag

SEQ ID NO: 3914253 - RNA, 20 nt, Human adenovirus C
aacagcgaaaaugaaaguca

SEQ ID NO: 3914254 - RNA, 20 nt, Human adenovirus C
aacagcgccaaggcuaccgc

SEQ ID NO: 3914255 - RNA, 16 nt, Human adenovirus C
aacaugcuaccucuuu

SEQ ID NO: 3914256 - RNA, 19 nt, Human adenovirus C
aacauuccagcaccuucaa

SEQ ID NO: 3914257 - RNA, 17 nt, Human adenovirus C
aacauucugcagagcau

SEQ ID NO: 3914258 - RNA, 16 nt, Human adenovirus C
aaccaaaguugcagga

SEQ ID NO: 3914259 - RNA, 20 nt, Human adenovirus C
aacccacacugauuaugaca

SEQ ID NO: 3914260 - RNA, 17 nt, Human adenovirus C
aacccagcuucagcuug

SEQ ID NO: 3914261 - RNA, 11 nt, Human adenovirus C
aacccuucagg

SEQ ID NO: 3914262 - RNA, 18 nt, Human adenovirus C
aaccuaucaccgucaccc

SEQ ID NO: 3914263 - RNA, 19 nt, Human adenovirus C
aaccuuuggacaccuccca

SEQ ID NO: 3914264 - RNA, 21 nt, Human adenovirus C
aacgacgagucggugagcucc

SEQ ID NO: 3914265 - RNA, 14 nt, Human adenovirus C
aacgcaccgccauu

SEQ ID NO: 3914266 - RNA, 21 nt, Human adenovirus C
aacgccacaacauaaaagaag

SEQ ID NO: 3914267 - RNA, 14 nt, Human adenovirus C
aacgcgcggcggcg

SEQ ID NO: 3914268 - RNA, 18 nt, Human adenovirus C
aacgcguuuagcaggucg

SEQ ID NO: 3914269 - RNA, 15 nt, Human adenovirus C
aacgggguguuugac

SEQ ID NO: 3914270 - RNA, 15 nt, Human adenovirus C
aacguguacugggug

SEQ ID NO: 3914271 - RNA, 17 nt, Human adenovirus C
aacuacaccgucaagaa

SEQ ID NO: 3914272 - RNA, 16 nt, Human adenovirus C
aacuauuuuguagaau

SEQ ID NO: 3914273 - RNA, 16 nt, Human adenovirus C
aacucaccugaaaauc

SEQ ID NO: 3914274 - RNA, 16 nt, Human adenovirus C
aacuccaacgcggcag

SEQ ID NO: 3914275 - RNA, 23 nt, Human adenovirus C
aacucgcgccuguugcugcugcu

SEQ ID NO: 3914276 - RNA, 14 nt, Human adenovirus C
aacucgcugcugca

SEQ ID NO: 3914277 - RNA, 20 nt, Human adenovirus C
aacugcgaggacagggccuc

SEQ ID NO: 3914278 - RNA, 20 nt, Human adenovirus C
aacuuugauaauacugccau

SEQ ID NO: 3914279 - RNA, 15 nt, Human adenovirus C
auaggacugaugcau

SEQ ID NO: 3914280 - RNA, 19 nt, Human adenovirus C
auagugcagcacagcaggg

SEQ ID NO: 3914281 - RNA, 14 nt, Human adenovirus C
auaguggugcagga

SEQ ID NO: 3914282 - RNA, 19 nt, Human adenovirus C
auaugagaugcaucuugga

SEQ ID NO: 3914283 - RNA, 18 nt, Human adenovirus C
auauggcccucaccugcc

SEQ ID NO: 3914284 - RNA, 21 nt, Human adenovirus C
aucaaaauaaaaagucuggag

SEQ ID NO: 3914285 - RNA, 14 nt, Human adenovirus C
aucaaacccagcuu

SEQ ID NO: 3914286 - RNA, 14 nt, Human adenovirus C
aucagaugaugcaa

SEQ ID NO: 3914287 - RNA, 14 nt, Human adenovirus C
aucagccccccucu

SEQ ID NO: 3914288 - RNA, 19 nt, Human adenovirus C
aucaggguccagaggaccu

SEQ ID NO: 3914289 - RNA, 18 nt, Human adenovirus C
auccagucguagcaggag

SEQ ID NO: 3914290 - RNA, 16 nt, Human adenovirus C
auccauaugacacaga

SEQ ID NO: 3914291 - RNA, 16 nt, Human adenovirus C
aucccuuuaaccacca

SEQ ID NO: 3914292 - RNA, 15 nt, Human adenovirus C
auccgcggcagcucg

SEQ ID NO: 3914293 - RNA, 14 nt, Human adenovirus C
auccggugcugcgg

SEQ ID NO: 3914294 - RNA, 22 nt, Human adenovirus C
aucgaaguagauugcaucccac

SEQ ID NO: 3914295 - RNA, 13 nt, Human adenovirus C
aucgccgcggcga

SEQ ID NO: 3914296 - RNA, 15 nt, Human adenovirus C
aucgcuacggcggcg

SEQ ID NO: 3914297 - RNA, 22 nt, Human adenovirus C
aucgcugucugcgagggccagc

SEQ ID NO: 3914298 - RNA, 18 nt, Human adenovirus C
aucggcugaagcagggcc

SEQ ID NO: 3914299 - RNA, 17 nt, Human adenovirus C
aucucaaauacaaaagc

SEQ ID NO: 3914300 - RNA, 12 nt, Human adenovirus C
aucuccucuucc

SEQ ID NO: 3914301 - RNA, 15 nt, Human adenovirus C
aucucgauccagcau

SEQ ID NO: 3914302 - RNA, 23 nt, Human adenovirus C
aucugagcgggggguaccugcug

SEQ ID NO: 3914303 - RNA, 15 nt, Human adenovirus C
aucugcgccagcagg

SEQ ID NO: 3914304 - RNA, 13 nt, Human adenovirus C
aucugcgucuccg

SEQ ID NO: 3914305 - RNA, 15 nt, Human adenovirus C
aucuuaugccaggcc

SEQ ID NO: 3914306 - RNA, 20 nt, Human adenovirus C
aucuucucagaauucuuuaa

SEQ ID NO: 3914307 - RNA, 22 nt, Human adenovirus C
augaacuugacgacgaggugga

SEQ ID NO: 3914308 - RNA, 15 nt, Human adenovirus C
augaagaagaggaag

SEQ ID NO: 3914309 - RNA, 20 nt, Human adenovirus C
augaaugugagguuuacugg

SEQ ID NO: 3914310 - RNA, 14 nt, Human adenovirus C
augacuaacucagg

SEQ ID NO: 3914311 - RNA, 11 nt, Human adenovirus C
augagcagcug

SEQ ID NO: 3914312 - RNA, 12 nt, Human adenovirus C
augagcagcugg

SEQ ID NO: 3914313 - RNA, 14 nt, Human adenovirus C
augaugacaaacuu

SEQ ID NO: 3914314 - RNA, 20 nt, Human adenovirus C
augauggaagacugggacag

SEQ ID NO: 3914315 - RNA, 23 nt, Human adenovirus C
augcaguagaagguaagcggguc

SEQ ID NO: 3914316 - RNA, 17 nt, Human adenovirus C
augcauccggugcugcg

SEQ ID NO: 3914317 - RNA, 16 nt, Human adenovirus C
augccaaccuauggag

SEQ ID NO: 3914318 - RNA, 16 nt, Human adenovirus C
augccauucgcggcga

SEQ ID NO: 3914319 - RNA, 12 nt, Human adenovirus C
augccgcagugg

SEQ ID NO: 3914320 - RNA, 14 nt, Human adenovirus C
augccugcgcggcc

SEQ ID NO: 3914321 - RNA, 18 nt, Human adenovirus C
augcgagcccaacccgcg

SEQ ID NO: 3914322 - RNA, 20 nt, Human adenovirus C
augcgagccgaucgggaaga

SEQ ID NO: 3914323 - RNA, 23 nt, Human adenovirus C
augcgccccccuccucagcagcg

SEQ ID NO: 3914324 - RNA, 13 nt, Human adenovirus C
caccgggacuggg

SEQ ID NO: 3914325 - RNA, 21 nt, Human adenovirus C
caccgucgcaugcgcggcggu

SEQ ID NO: 3914326 - RNA, 23 nt, Human adenovirus C
caccgugcagcugaugguaccca

SEQ ID NO: 3914327 - RNA, 19 nt, Human adenovirus C
caccguuuuuacccaccca

SEQ ID NO: 3914328 - RNA, 18 nt, Human adenovirus C
caccuacucuggcuccau

SEQ ID NO: 3914329 - RNA, 13 nt, Human adenovirus C
caccugagccuuu

SEQ ID NO: 3914330 - RNA, 17 nt, Human adenovirus C
caccuuucgccagggcu

SEQ ID NO: 3914331 - RNA, 16 nt, Human adenovirus C
cacgaaaaccgccucg

SEQ ID NO: 3914332 - RNA, 21 nt, Human adenovirus C
cacgaaggaggcguaggaguc

SEQ ID NO: 3914333 - RNA, 17 nt, Human adenovirus C
cacgaucggcaggcuca

SEQ ID NO: 3914334 - RNA, 19 nt, Human adenovirus C
cacgaucuuggccuugcua

SEQ ID NO: 3914335 - RNA, 14 nt, Human adenovirus C
cacgcaaccgcgcc

SEQ ID NO: 3914336 - RNA, 18 nt, Human adenovirus C
cacgcacgaaggaggcgu

SEQ ID NO: 3914337 - RNA, 18 nt, Human adenovirus C
cacgcccacgccgccacc

SEQ ID NO: 3914338 - RNA, 17 nt, Human adenovirus C
cacgcuggaagacgcgg

SEQ ID NO: 3914339 - RNA, 18 nt, Human adenovirus C
cacgcuggaagccaugcu

SEQ ID NO: 3914340 - RNA, 16 nt, Human adenovirus C
cacgggcagccuggag

SEQ ID NO: 3914341 - RNA, 21 nt, Human adenovirus C
cacgggcggcggccugggcga

SEQ ID NO: 3914342 - RNA, 21 nt, Human adenovirus C
cacgggcuguacauccugcac

SEQ ID NO: 3914343 - RNA, 14 nt, Human adenovirus C
cacgucgcaccggc

SEQ ID NO: 3914344 - RNA, 23 nt, Human adenovirus C
cacguggcggccgccgaccuggu

SEQ ID NO: 3914345 - RNA, 14 nt, Human adenovirus C
cacuaaagcaaggc

SEQ ID NO: 3914346 - RNA, 12 nt, Human adenovirus C
cacuacccggac

SEQ ID NO: 3914347 - RNA, 13 nt, Human adenovirus C
cacuaccuggacu

SEQ ID NO: 3914348 - RNA, 20 nt, Human adenovirus C
cacuagugaauccacagaaa

SEQ ID NO: 3914349 - RNA, 20 nt, Human adenovirus C
cacucacagaccugggccaa

SEQ ID NO: 3914350 - RNA, 13 nt, Human adenovirus C
cacucgcuccagg

SEQ ID NO: 3914351 - RNA, 15 nt, Human adenovirus C
cacucugagacgaag

SEQ ID NO: 3914352 - RNA, 21 nt, Human adenovirus C
cacucuguaugcuauauuuca

SEQ ID NO: 3914353 - RNA, 21 nt, Human adenovirus C
cacugcagagcuucaugcugc

SEQ ID NO: 3914354 - RNA, 16 nt, Human adenovirus C
cacuggaaccagggcc

SEQ ID NO: 3914355 - RNA, 13 nt, Human adenovirus C
cacuggcagggac

SEQ ID NO: 3914356 - RNA, 21 nt, Human adenovirus C
cacugugguacuucccagaga

SEQ ID NO: 3914357 - RNA, 17 nt, Human adenovirus C
cacuuaaaaaaacaaag

SEQ ID NO: 3914358 - RNA, 19 nt, Human adenovirus C
cacuuaauggcacuaguga

SEQ ID NO: 3914359 - RNA, 13 nt, Human adenovirus C
cacuuaggccaga

SEQ ID NO: 3914360 - RNA, 16 nt, Human adenovirus C
cacuuggucaggcagu

SEQ ID NO: 3914361 - RNA, 17 nt, Human adenovirus C
cacuuggugcuggccug

SEQ ID NO: 3914362 - RNA, 19 nt, Human adenovirus C
cacuuggugcuggccugca

SEQ ID NO: 3914363 - RNA, 22 nt, Human adenovirus C
cagaaaccugugcugccagggc

SEQ ID NO: 3914364 - RNA, 18 nt, Human adenovirus C
cagaagacggaugagcuc

SEQ ID NO: 3914365 - RNA, 23 nt, Human adenovirus C
cagaaggcgcucgccgcccagcg

SEQ ID NO: 3914366 - RNA, 13 nt, Human adenovirus C
cagacaaugcaga

SEQ ID NO: 3914367 - RNA, 14 nt, Human adenovirus C
cagacaaugcagaa

SEQ ID NO: 3914368 - RNA, 19 nt, Human adenovirus C
cagacaaugcagaaacaca

SEQ ID NO: 3914369 - RNA, 16 nt, Human adenovirus C
cagacacgaucggcag

SEQ ID NO: 3914370 - RNA, 21 nt, Human adenovirus C
cagacacgaucggcaggcuca

SEQ ID NO: 3914371 - RNA, 15 nt, Human adenovirus C
cagacaugcagggca

SEQ ID NO: 3914372 - RNA, 23 nt, Human adenovirus C
cagaccaaagcaaaccucaccuc

SEQ ID NO: 3914373 - RNA, 22 nt, Human adenovirus C
cagaccaguagacaaggccugc

SEQ ID NO: 3914374 - RNA, 15 nt, Human adenovirus C
cagacgggccagggu

SEQ ID NO: 3914375 - RNA, 17 nt, Human adenovirus C
cagacgggccaggguca

SEQ ID NO: 3914376 - RNA, 18 nt, Human adenovirus C
cagacggugaaccaggag

SEQ ID NO: 3914377 - RNA, 15 nt, Human adenovirus C
cagacuugagaggcc

SEQ ID NO: 3914378 - RNA, 19 nt, Human adenovirus C
cagagaagaacaugccgca

SEQ ID NO: 3914379 - RNA, 22 nt, Human adenovirus C
cagagcaaaaaguccgugcgcu

SEQ ID NO: 3914380 - RNA, 20 nt, Human adenovirus C
cagagcgauuugucagaagc

SEQ ID NO: 3914381 - RNA, 19 nt, Human adenovirus C
cagagggcgagguauucag

SEQ ID NO: 3914382 - RNA, 18 nt, Human adenovirus C
cagagggcugccugcacu

SEQ ID NO: 3914383 - RNA, 16 nt, Human adenovirus C
cagauccuuccuauca

SEQ ID NO: 3914384 - RNA, 23 nt, Human adenovirus C
cagauccuuccuaucaaccagaa

SEQ ID NO: 3914385 - RNA, 19 nt, Human adenovirus C
cagaugaaacgcgccagac

SEQ ID NO: 3914386 - RNA, 21 nt, Human adenovirus C
cagaugaaacgcgccagaccg

SEQ ID NO: 3914387 - RNA, 15 nt, Human adenovirus C
cagaugccgcggugc

SEQ ID NO: 3914388 - RNA, 15 nt, Human adenovirus C
cagaugggagcuguc

SEQ ID NO: 3914389 - RNA, 15 nt, Human adenovirus C
cagcaaauacugcgc

SEQ ID NO: 3914390 - RNA, 16 nt, Human adenovirus C
cagcaaauacugcgcg

SEQ ID NO: 3914391 - RNA, 17 nt, Human adenovirus C
cagcaaggccuggaaca

SEQ ID NO: 3914392 - RNA, 21 nt, Human adenovirus C
cagcacuggaacacuaucagc

SEQ ID NO: 3914393 - RNA, 14 nt, Human adenovirus C
cagcagccgcggcc

SEQ ID NO: 3914394 - RNA, 21 nt, Human adenovirus C
cagcaggaggaagccaggcgg

SEQ ID NO: 3914395 - RNA, 18 nt, Human adenovirus C
cagcauaacaacucagga

SEQ ID NO: 3914396 - RNA, 20 nt, Human adenovirus C
cagccauaucccuccgggga

SEQ ID NO: 3914397 - RNA, 13 nt, Human adenovirus C
cagccccccggcg

SEQ ID NO: 3914398 - RNA, 16 nt, Human adenovirus C
cagccccuccgcggcg

SEQ ID NO: 3914399 - RNA, 13 nt, Human adenovirus C
cagccgcaccgcg

SEQ ID NO: 3914400 - RNA, 16 nt, Human adenovirus C
cagccgcaggccaacc

SEQ ID NO: 3914401 - RNA, 16 nt, Human adenovirus C
cagccgccgcaccgug

SEQ ID NO: 3914402 - RNA, 14 nt, Human adenovirus C
cagccucgcccccc

SEQ ID NO: 3914403 - RNA, 22 nt, Human adenovirus C
cagccucgccccccuucuccca

SEQ ID NO: 3914404 - RNA, 21 nt, Human adenovirus C
cagccugagcguaaccagaca

SEQ ID NO: 3914405 - RNA, 22 nt, Human adenovirus C
cagccuggaggcaacccugaac

SEQ ID NO: 3914406 - RNA, 22 nt, Human adenovirus C
cagcgaaaaugaaagucacugu

SEQ ID NO: 3914407 - RNA, 22 nt, Human adenovirus C
cagcgaccgcgagcugaugcac

SEQ ID NO: 3914408 - RNA, 13 nt, Human adenovirus C
cagcgaggaggag

SEQ ID NO: 3914409 - RNA, 16 nt, Human adenovirus C
cagcgcacuacugccc

SEQ ID NO: 3914410 - RNA, 22 nt, Human adenovirus C
cagcgccggguggugcacgcug

SEQ ID NO: 3914411 - RNA, 18 nt, Human adenovirus C
cagcgccucccaaaagac

SEQ ID NO: 3914412 - RNA, 22 nt, Human adenovirus C
cagcggcaaaaagugcuccaug

SEQ ID NO: 3914413 - RNA, 20 nt, Human adenovirus C
cagcggcaacgugcagacca

SEQ ID NO: 3914414 - RNA, 21 nt, Human adenovirus C
cagcggcaagagcaagagcag

SEQ ID NO: 3914415 - RNA, 13 nt, Human adenovirus C
cagcggcagaagc

SEQ ID NO: 3914416 - RNA, 20 nt, Human adenovirus C
cagcggcagacaugcagggc

SEQ ID NO: 3914417 - RNA, 14 nt, Human adenovirus C
cagcggcggcagca

SEQ ID NO: 3914418 - RNA, 15 nt, Human adenovirus C
cagcggcggcagcag

SEQ ID NO: 3914419 - RNA, 18 nt, Human adenovirus C
cagcggcggcagcagcag

SEQ ID NO: 3914420 - RNA, 15 nt, Human adenovirus C
cagcggcggcggcgc

SEQ ID NO: 3914421 - RNA, 21 nt, Human adenovirus C
cagcggguuuaucaccgugcu

SEQ ID NO: 3914422 - RNA, 22 nt, Human adenovirus C
cagcggucccauccaaggucca

SEQ ID NO: 3914423 - RNA, 13 nt, Human adenovirus C
cagcucuacagcu

SEQ ID NO: 3914424 - RNA, 21 nt, Human adenovirus C
cagcugaccacuuacuggcug

SEQ ID NO: 3914425 - RNA, 22 nt, Human adenovirus C
cagcugaugguacccaagcgcc

SEQ ID NO: 3914426 - RNA, 17 nt, Human adenovirus C
cagcugccgccgccgcc

SEQ ID NO: 3914427 - RNA, 20 nt, Human adenovirus C
cagcuggggccggaccuggg

SEQ ID NO: 3914428 - RNA, 22 nt, Human adenovirus C
cagcuggggccggaccugggcu

SEQ ID NO: 3914429 - RNA, 23 nt, Human adenovirus C
cagcuggggccggaccugggcug

SEQ ID NO: 3914430 - RNA, 21 nt, Human adenovirus C
cagcuggggcucgcuguggag

SEQ ID NO: 3914431 - RNA, 20 nt, Human adenovirus C
cagcuguuggaucugcgcca

SEQ ID NO: 3914432 - RNA, 14 nt, Human adenovirus C
cagcuuauucagca

SEQ ID NO: 3914433 - RNA, 14 nt, Human adenovirus C
cagcuucagcuugc

SEQ ID NO: 3914434 - RNA, 17 nt, Human adenovirus C
cagcuugagccuggcug

SEQ ID NO: 3914435 - RNA, 12 nt, Human adenovirus C
cagcuugccugc

SEQ ID NO: 3914436 - RNA, 14 nt, Human adenovirus C
caggaacugaaagc

SEQ ID NO: 3914437 - RNA, 14 nt, Human adenovirus C
caggacccuggugc

SEQ ID NO: 3914438 - RNA, 18 nt, Human adenovirus C
caggacccuggugcugcc

SEQ ID NO: 3914439 - RNA, 14 nt, Human adenovirus C
caggagcagagccc

SEQ ID NO: 3914440 - RNA, 13 nt, Human adenovirus C
caggagcuggugc

SEQ ID NO: 3914441 - RNA, 17 nt, Human adenovirus C
caggagcuggugcugcg

SEQ ID NO: 3914442 - RNA, 19 nt, Human adenovirus C
augcgcggcgguauccugc

SEQ ID NO: 3914443 - RNA, 18 nt, Human adenovirus C
augcggcaggagggagag

SEQ ID NO: 3914444 - RNA, 23 nt, Human adenovirus C
augcuggaugugaccgaggagcu

SEQ ID NO: 3914445 - RNA, 17 nt, Human adenovirus C
auggaucacaaccccac

SEQ ID NO: 3914446 - RNA, 21 nt, Human adenovirus C
auggcagcaaggccuggaaca

SEQ ID NO: 3914447 - RNA, 19 nt, Human adenovirus C
auggcaguggucuccucag

SEQ ID NO: 3914448 - RNA, 16 nt, Human adenovirus C
auggccuuugccugga

SEQ ID NO: 3914449 - RNA, 23 nt, Human adenovirus C
augggacuugcggcuggagcugc

SEQ ID NO: 3914450 - RNA, 23 nt, Human adenovirus C
augggcgcacucacagaccuggg

SEQ ID NO: 3914451 - RNA, 21 nt, Human adenovirus C
augguuaaccuacaccagugu

SEQ ID NO: 3914452 - RNA, 19 nt, Human adenovirus C
auguacuaggagacacuuu

SEQ ID NO: 3914453 - RNA, 22 nt, Human adenovirus C
auguaugcguccaugucgccgc

SEQ ID NO: 3914454 - RNA, 22 nt, Human adenovirus C
auguauuauaacagcacuggca

SEQ ID NO: 3914455 - RNA, 19 nt, Human adenovirus C
auguccacaaagcgguggu

SEQ ID NO: 3914456 - RNA, 20 nt, Human adenovirus C
auguccaugggcgcacucac

SEQ ID NO: 3914457 - RNA, 16 nt, Human adenovirus C
augucgcuguccagcu

SEQ ID NO: 3914458 - RNA, 20 nt, Human adenovirus C
augucguuucucagcagcug

SEQ ID NO: 3914459 - RNA, 18 nt, Human adenovirus C
auguuacauuuaaaucag

SEQ ID NO: 3914460 - RNA, 19 nt, Human adenovirus C
auguucagauacaugggca

SEQ ID NO: 3914461 - RNA, 16 nt, Human adenovirus C
auguuguacagguggc

SEQ ID NO: 3914462 - RNA, 17 nt, Human adenovirus C
auguuuuguuugaaguc

SEQ ID NO: 3914463 - RNA, 14 nt, Human adenovirus C
auuaacaaaaauac

SEQ ID NO: 3914464 - RNA, 20 nt, Human adenovirus C
auuaagaaaugccuguuuga

SEQ ID NO: 3914465 - RNA, 19 nt, Human adenovirus C
auuaugaaacggaguguca

SEQ ID NO: 3914466 - RNA, 13 nt, Human adenovirus C
auucagccgccgc

SEQ ID NO: 3914467 - RNA, 16 nt, Human adenovirus C
auucagguuccucaca

SEQ ID NO: 3914468 - RNA, 19 nt, Human adenovirus C
auucaguaguauagcccca

SEQ ID NO: 3914469 - RNA, 13 nt, Human adenovirus C
auucccagcugcu

SEQ ID NO: 3914470 - RNA, 23 nt, Human adenovirus C
auugauggucgccccguccugcc

SEQ ID NO: 3914471 - RNA, 20 nt, Human adenovirus C
auugcguaccucaggcacca

SEQ ID NO: 3914472 - RNA, 17 nt, Human adenovirus C
auuggcuaccagggcuu

SEQ ID NO: 3914473 - RNA, 17 nt, Human adenovirus C
auuuaccccccacccuu

SEQ ID NO: 3914474 - RNA, 16 nt, Human adenovirus C
auuucaacaaagcagg

SEQ ID NO: 3914475 - RNA, 20 nt, Human adenovirus C
auuucaaucacgugcuccuu

SEQ ID NO: 3914476 - RNA, 20 nt, Human adenovirus C
auuucugccagcgccugcac

SEQ ID NO: 3914477 - RNA, 18 nt, Human adenovirus C
auuugaagagcuuuugaa

SEQ ID NO: 3914478 - RNA, 19 nt, Human adenovirus C
auuugaagagcuuuugaaa

SEQ ID NO: 3914479 - RNA, 17 nt, Human adenovirus C
auuugaugcucaaacaa

SEQ ID NO: 3914480 - RNA, 23 nt, Human adenovirus C
auuugucuuuacgccaccuucuu

SEQ ID NO: 3914481 - RNA, 21 nt, Human adenovirus C
auuuuuucuggggugaugcag

SEQ ID NO: 3914482 - RNA, 16 nt, Human adenovirus C
caaaaagaagcugcag

SEQ ID NO: 3914483 - RNA, 14 nt, Human adenovirus C
caaaagcagggcuu

SEQ ID NO: 3914484 - RNA, 16 nt, Human adenovirus C
caaaauaaaaagucug

SEQ ID NO: 3914485 - RNA, 21 nt, Human adenovirus C
caaaauguaaccacuguuacu

SEQ ID NO: 3914486 - RNA, 21 nt, Human adenovirus C
caaaauuuccaacaaaaggug

SEQ ID NO: 3914487 - RNA, 21 nt, Human adenovirus C
caaacagagcgauuugucaga

SEQ ID NO: 3914488 - RNA, 20 nt, Human adenovirus C
caaacagguggagcugaaau

SEQ ID NO: 3914489 - RNA, 22 nt, Human adenovirus C
caaaccuggaaaaggugaugaa

SEQ ID NO: 3914490 - RNA, 13 nt, Human adenovirus C
caaacgacugcag

SEQ ID NO: 3914491 - RNA, 18 nt, Human adenovirus C
caaacuuucuccaaaguu

SEQ ID NO: 3914492 - RNA, 13 nt, Human adenovirus C
caaagcacacuga

SEQ ID NO: 3914493 - RNA, 19 nt, Human adenovirus C
caaagcaggggccaagaac

SEQ ID NO: 3914494 - RNA, 20 nt, Human adenovirus C
caaagcgugcaggggcccaa

SEQ ID NO: 3914495 - RNA, 13 nt, Human adenovirus C
caaaggugucccu

SEQ ID NO: 3914496 - RNA, 14 nt, Human adenovirus C
caaauacaaaagca

SEQ ID NO: 3914497 - RNA, 12 nt, Human adenovirus C
caaauccauaca

SEQ ID NO: 3914498 - RNA, 23 nt, Human adenovirus C
caacauacugacccgcuguuccu

SEQ ID NO: 3914499 - RNA, 19 nt, Human adenovirus C
caacauccgcggcugacgc

SEQ ID NO: 3914500 - RNA, 19 nt, Human adenovirus C
caaccaggaacagcucuac

SEQ ID NO: 3914501 - RNA, 17 nt, Human adenovirus C
caaccaggcagugcaaa

SEQ ID NO: 3914502 - RNA, 16 nt, Human adenovirus C
caacccaacaccuagc

SEQ ID NO: 3914503 - RNA, 11 nt, Human adenovirus C
caaccccacca

SEQ ID NO: 3914504 - RNA, 20 nt, Human adenovirus C
caacccgaggucgagaagcc

SEQ ID NO: 3914505 - RNA, 18 nt, Human adenovirus C
caacccgcggugcuccuc

SEQ ID NO: 3914506 - RNA, 13 nt, Human adenovirus C
caaccgcgcccag

SEQ ID NO: 3914507 - RNA, 15 nt, Human adenovirus C
caaccguucccagca

SEQ ID NO: 3914508 - RNA, 20 nt, Human adenovirus C
caaccuggaccggcuggugg

SEQ ID NO: 3914509 - RNA, 23 nt, Human adenovirus C
caaccuucaaaucaaacuuuccu

SEQ ID NO: 3914510 - RNA, 16 nt, Human adenovirus C
caacggaauccgcgcc

SEQ ID NO: 3914511 - RNA, 18 nt, Human adenovirus C
caacggacccggcggugc

SEQ ID NO: 3914512 - RNA, 19 nt, Human adenovirus C
caacguguuuauuuuucaa

SEQ ID NO: 3914513 - RNA, 19 nt, Human adenovirus C
caacucggccgccugugga

SEQ ID NO: 3914514 - RNA, 20 nt, Human adenovirus C
caacugcgaggacagggccu

SEQ ID NO: 3914515 - RNA, 11 nt, Human adenovirus C
caacuggcaaa

SEQ ID NO: 3914516 - RNA, 23 nt, Human adenovirus C
caacuuugguagcugccuuccca

SEQ ID NO: 3914517 - RNA, 13 nt, Human adenovirus C
caagacagaaaca

SEQ ID NO: 3914518 - RNA, 19 nt, Human adenovirus C
caagagcaagagcagcggc

SEQ ID NO: 3914519 - RNA, 13 nt, Human adenovirus C
caagagcagcggc

SEQ ID NO: 3914520 - RNA, 14 nt, Human adenovirus C
caagagcagcggca

SEQ ID NO: 3914521 - RNA, 20 nt, Human adenovirus C
caagauuauacccacaaccu

SEQ ID NO: 3914522 - RNA, 13 nt, Human adenovirus C
caagcacacagac

SEQ ID NO: 3914523 - RNA, 14 nt, Human adenovirus C
caagcagugcagcu

SEQ ID NO: 3914524 - RNA, 18 nt, Human adenovirus C
caagcagugcagcuuccc

SEQ ID NO: 3914525 - RNA, 19 nt, Human adenovirus C
caagcgagugguggcuccc

SEQ ID NO: 3914526 - RNA, 23 nt, Human adenovirus C
caagcgcaaaaucaaagaagaga

SEQ ID NO: 3914527 - RNA, 20 nt, Human adenovirus C
caagcggcaacccuuccagg

SEQ ID NO: 3914528 - RNA, 15 nt, Human adenovirus C
caagcuugguggcaa

SEQ ID NO: 3914529 - RNA, 13 nt, Human adenovirus C
caagggugcagcu

SEQ ID NO: 3914530 - RNA, 15 nt, Human adenovirus C
caaguauaggucucu

SEQ ID NO: 3914531 - RNA, 20 nt, Human adenovirus C
caagugcuuugcccgcggcu

SEQ ID NO: 3914532 - RNA, 19 nt, Human adenovirus C
caaucuccucuuccauaag

SEQ ID NO: 3914533 - RNA, 12 nt, Human adenovirus C
caaugggcccac

SEQ ID NO: 3914534 - RNA, 23 nt, Human adenovirus C
caauuucggugucguugacggcg

SEQ ID NO: 3914535 - RNA, 18 nt, Human adenovirus C
cacaacuuccucaaaucu

SEQ ID NO: 3914536 - RNA, 20 nt, Human adenovirus C
cacaagaaucgccugcuacu

SEQ ID NO: 3914537 - RNA, 17 nt, Human adenovirus C
cacacagaccaucaauc

SEQ ID NO: 3914538 - RNA, 23 nt, Human adenovirus C
cacaccggggcgcgcugcggcug

SEQ ID NO: 3914539 - RNA, 21 nt, Human adenovirus C
cacacgggcggaggagaagcg

SEQ ID NO: 3914540 - RNA, 13 nt, Human adenovirus C
cacagaccugggc

SEQ ID NO: 3914541 - RNA, 18 nt, Human adenovirus C
cacagcggcggcagcagc

SEQ ID NO: 3914542 - RNA, 21 nt, Human adenovirus C
cacaggccagaugcugaggga

SEQ ID NO: 3914543 - RNA, 17 nt, Human adenovirus C
cacaggguugcagcacu

SEQ ID NO: 3914544 - RNA, 16 nt, Human adenovirus C
cacaguaacugcagca

SEQ ID NO: 3914545 - RNA, 14 nt, Human adenovirus C
cacaguggacgcgg

SEQ ID NO: 3914546 - RNA, 16 nt, Human adenovirus C
caccaacgaccagucc

SEQ ID NO: 3914547 - RNA, 22 nt, Human adenovirus C
caccacugugguacuucccaga

SEQ ID NO: 3914548 - RNA, 15 nt, Human adenovirus C
caccagcauaacaac

SEQ ID NO: 3914549 - RNA, 22 nt, Human adenovirus C
caccagcucaaucagucacagu

SEQ ID NO: 3914550 - RNA, 16 nt, Human adenovirus C
caccaguguaaaagag

SEQ ID NO: 3914551 - RNA, 19 nt, Human adenovirus C
cacccaaaaagaagcugca

SEQ ID NO: 3914552 - RNA, 14 nt, Human adenovirus C
cacccaccgugcag

SEQ ID NO: 3914553 - RNA, 17 nt, Human adenovirus C
cacccacggacgaggag

SEQ ID NO: 3914554 - RNA, 17 nt, Human adenovirus C
cacccagcgccaaaaac

SEQ ID NO: 3914555 - RNA, 17 nt, Human adenovirus C
cacccgcaacuucagac

SEQ ID NO: 3914556 - RNA, 14 nt, Human adenovirus C
cacccgcagcugcc

SEQ ID NO: 3914557 - RNA, 13 nt, Human adenovirus C
cacccgccccguu

SEQ ID NO: 3914558 - RNA, 21 nt, Human adenovirus C
cacccuugccgucugcgccgu

SEQ ID NO: 3914559 - RNA, 21 nt, Human adenovirus C
caccggccgacgggcggccau

SEQ ID NO: 3914560 - RNA, 16 nt, Human adenovirus C
gaagaaggaagagcag

SEQ ID NO: 3914561 - RNA, 13 nt, Human adenovirus C
gaagacgcggagg

SEQ ID NO: 3914562 - RNA, 14 nt, Human adenovirus C
gaagacugggacag

SEQ ID NO: 3914563 - RNA, 14 nt, Human adenovirus C
gaagaucuggaagg

SEQ ID NO: 3914564 - RNA, 19 nt, Human adenovirus C
gaagauuuuucugcugugc

SEQ ID NO: 3914565 - RNA, 22 nt, Human adenovirus C
gaagcaucugcagcgccagugc

SEQ ID NO: 3914566 - RNA, 14 nt, Human adenovirus C
gaagccuggaccga

SEQ ID NO: 3914567 - RNA, 18 nt, Human adenovirus C
gaagcugcuaaagcaaaa

SEQ ID NO: 3914568 - RNA, 19 nt, Human adenovirus C
gaaggaaaugcguggaaga

SEQ ID NO: 3914569 - RNA, 21 nt, Human adenovirus C
gaaggucaucaagacuuugga

SEQ ID NO: 3914570 - RNA, 18 nt, Human adenovirus C
gaaugagcuccacagguc

SEQ ID NO: 3914571 - RNA, 16 nt, Human adenovirus C
gaauggcgguaguggg

SEQ ID NO: 3914572 - RNA, 15 nt, Human adenovirus C
gacaacaucgcgcag

SEQ ID NO: 3914573 - RNA, 21 nt, Human adenovirus C
gacaccacccguguguaccuu

SEQ ID NO: 3914574 - RNA, 20 nt, Human adenovirus C
gacaccacuggaaccagggc

SEQ ID NO: 3914575 - RNA, 20 nt, Human adenovirus C
gacacccaagggugcagcug

SEQ ID NO: 3914576 - RNA, 15 nt, Human adenovirus C
gacacgggcagccug

SEQ ID NO: 3914577 - RNA, 16 nt, Human adenovirus C
gacacgggcagccugg

SEQ ID NO: 3914578 - RNA, 15 nt, Human adenovirus C
gacagaggacagcaa

SEQ ID NO: 3914579 - RNA, 18 nt, Human adenovirus C
gacagcaccuucacccag

SEQ ID NO: 3914580 - RNA, 17 nt, Human adenovirus C
gacauauuuccugcaga

SEQ ID NO: 3914581 - RNA, 23 nt, Human adenovirus C
gaccacuuacuggcugcagccag

SEQ ID NO: 3914582 - RNA, 20 nt, Human adenovirus C
gaccaguggagaggcagagc

SEQ ID NO: 3914583 - RNA, 13 nt, Human adenovirus C
gaccaugaagauc

SEQ ID NO: 3914584 - RNA, 18 nt, Human adenovirus C
gaccauucacguagccag

SEQ ID NO: 3914585 - RNA, 19 nt, Human adenovirus C
gaccauucacguagccagc

SEQ ID NO: 3914586 - RNA, 13 nt, Human adenovirus C
gaccccuggagag

SEQ ID NO: 3914587 - RNA, 14 nt, Human adenovirus C
gacccggcugcgag

SEQ ID NO: 3914588 - RNA, 16 nt, Human adenovirus C
gacccuggugcugcca

SEQ ID NO: 3914589 - RNA, 18 nt, Human adenovirus C
gaccgaggagcugaggcc

SEQ ID NO: 3914590 - RNA, 20 nt, Human adenovirus C
gaccgagguugcuacgggcg

SEQ ID NO: 3914591 - RNA, 14 nt, Human adenovirus C
gaccguggagccug

SEQ ID NO: 3914592 - RNA, 19 nt, Human adenovirus C
gaccucguccucggagccg

SEQ ID NO: 3914593 - RNA, 14 nt, Human adenovirus C
gaccucugcacucu

SEQ ID NO: 3914594 - RNA, 21 nt, Human adenovirus C
gaccuggccaaccaggcagug

SEQ ID NO: 3914595 - RNA, 19 nt, Human adenovirus C
gacgaaguaaguuugccac

SEQ ID NO: 3914596 - RNA, 14 nt, Human adenovirus C
gacgaaugagcucc

SEQ ID NO: 3914597 - RNA, 12 nt, Human adenovirus C
gacgacagcagc

SEQ ID NO: 3914598 - RNA, 16 nt, Human adenovirus C
gacgagaaacgcgcgg

SEQ ID NO: 3914599 - RNA, 22 nt, Human adenovirus C
gacgagcauacuuuccaggaga

SEQ ID NO: 3914600 - RNA, 16 nt, Human adenovirus C
gacgagucggugagcu

SEQ ID NO: 3914601 - RNA, 18 nt, Human adenovirus C
gacgaugacucggcagac

SEQ ID NO: 3914602 - RNA, 21 nt, Human adenovirus C
gacgaugcuucuaaauagcua

SEQ ID NO: 3914603 - RNA, 18 nt, Human adenovirus C
gacgcggugguggaggag

SEQ ID NO: 3914604 - RNA, 20 nt, Human adenovirus C
gacgcguuccggcagcagcc

SEQ ID NO: 3914605 - RNA, 24 nt, Human adenovirus C
gacggccugguaggcgcagcaucc

SEQ ID NO: 3914606 - RNA, 14 nt, Human adenovirus C
gacgggccaggguc

SEQ ID NO: 3914607 - RNA, 17 nt, Human adenovirus C
gacgggcccggugagcu

SEQ ID NO: 3914608 - RNA, 19 nt, Human adenovirus C
gacguaugcgcaggagcac

SEQ ID NO: 3914609 - RNA, 14 nt, Human adenovirus C
gacuacaugaacaa

SEQ ID NO: 3914610 - RNA, 21 nt, Human adenovirus C
gacuaucgcaacaccacugcu

SEQ ID NO: 3914611 - RNA, 22 nt, Human adenovirus C
gacugacuuugcuuuccugagc

SEQ ID NO: 3914612 - RNA, 21 nt, Human adenovirus C
gacuggaagaugucuuggaaa

SEQ ID NO: 3914613 - RNA, 13 nt, Human adenovirus C
gacuuugugccca

SEQ ID NO: 3914614 - RNA, 17 nt, Human adenovirus C
gagaaggaggacagccu

SEQ ID NO: 3914615 - RNA, 15 nt, Human adenovirus C
gagaaggucaucaag

SEQ ID NO: 3914616 - RNA, 20 nt, Human adenovirus C
gagacguacuucagccugaa

SEQ ID NO: 3914617 - RNA, 15 nt, Human adenovirus C
gagagccggccugga

SEQ ID NO: 3914618 - RNA, 14 nt, Human adenovirus C
gagagggggcaggg

SEQ ID NO: 3914619 - RNA, 16 nt, Human adenovirus C
gagcaaaauuuccaac

SEQ ID NO: 3914620 - RNA, 23 nt, Human adenovirus C
gagcaacagcaggaggaagccag

SEQ ID NO: 3914621 - RNA, 15 nt, Human adenovirus C
gagcagcuggcgcgc

SEQ ID NO: 3914622 - RNA, 19 nt, Human adenovirus C
gagcaggcagaggcggcgc

SEQ ID NO: 3914623 - RNA, 15 nt, Human adenovirus C
gagccagaggacggc

SEQ ID NO: 3914624 - RNA, 16 nt, Human adenovirus C
gagccaggugagcucu

SEQ ID NO: 3914625 - RNA, 17 nt, Human adenovirus C
gagccccuuuuuugcuu

SEQ ID NO: 3914626 - RNA, 23 nt, Human adenovirus C
gagcccgagguccgcgugcggcc

SEQ ID NO: 3914627 - RNA, 16 nt, Human adenovirus C
gagccgguguccacgc

SEQ ID NO: 3914628 - RNA, 21 nt, Human adenovirus C
gagccugggcuggagcccgag

SEQ ID NO: 3914629 - RNA, 16 nt, Human adenovirus C
gagccuguaagcgggc

SEQ ID NO: 3914630 - RNA, 15 nt, Human adenovirus C
gagcgacgaccuggg

SEQ ID NO: 3914631 - RNA, 21 nt, Human adenovirus C
gagcgcaaccuaaaggagcug

SEQ ID NO: 3914632 - RNA, 19 nt, Human adenovirus C
gagcgcccucuccugagcg

SEQ ID NO: 3914633 - RNA, 15 nt, Human adenovirus C
gagcgcuccacccgc

SEQ ID NO: 3914634 - RNA, 18 nt, Human adenovirus C
gagcuaugcuaaccagcg

SEQ ID NO: 3914635 - RNA, 23 nt, Human adenovirus C
gagcucggcgacagugucgcgca

SEQ ID NO: 3914636 - RNA, 20 nt, Human adenovirus C
gagcucuggccguucggggu

SEQ ID NO: 3914637 - RNA, 14 nt, Human adenovirus C
gagcugcagcugcc

SEQ ID NO: 3914638 - RNA, 21 nt, Human adenovirus C
gagcuuccacuuggucaggca

SEQ ID NO: 3914639 - RNA, 15 nt, Human adenovirus C
gaggacuaccacgcc

SEQ ID NO: 3914640 - RNA, 16 nt, Human adenovirus C
gaggacuaccacgccc

SEQ ID NO: 3914641 - RNA, 18 nt, Human adenovirus C
gaggaggaauacugggac

SEQ ID NO: 3914642 - RNA, 18 nt, Human adenovirus C
gaggcaaacgaggaacaa

SEQ ID NO: 3914643 - RNA, 20 nt, Human adenovirus C
gaggcaagcacacagaccau

SEQ ID NO: 3914644 - RNA, 23 nt, Human adenovirus C
gaggcacuaaagcaaggccugcc

SEQ ID NO: 3914645 - RNA, 15 nt, Human adenovirus C
gaggcagcuggggcc

SEQ ID NO: 3914646 - RNA, 17 nt, Human adenovirus C
gaggccucccucguucc

SEQ ID NO: 3914647 - RNA, 19 nt, Human adenovirus C
gaggcguaggagucgcgca

SEQ ID NO: 3914648 - RNA, 21 nt, Human adenovirus C
gaggcguaggagucgcgcagc

SEQ ID NO: 3914649 - RNA, 16 nt, Human adenovirus C
gaggcugguccugcug

SEQ ID NO: 3914650 - RNA, 13 nt, Human adenovirus C
gagggacaaguug

SEQ ID NO: 3914651 - RNA, 16 nt, Human adenovirus C
gagggagaggagcccg

SEQ ID NO: 3914652 - RNA, 13 nt, Human adenovirus C
gagggcccggcgc

SEQ ID NO: 3914653 - RNA, 20 nt, Human adenovirus C
gaggggggacacggcggcga

SEQ ID NO: 3914654 - RNA, 12 nt, Human adenovirus C
gaggugagcuca

SEQ ID NO: 3914655 - RNA, 13 nt, Human adenovirus C
gaggugcuugcca

SEQ ID NO: 3914656 - RNA, 17 nt, Human adenovirus C
gaggugcuugccaccua

SEQ ID NO: 3914657 - RNA, 17 nt, Human adenovirus C
gagucgcgcagcuuguu

SEQ ID NO: 3914658 - RNA, 21 nt, Human adenovirus C
gaguggcuguugaugugguga

SEQ ID NO: 3914659 - RNA, 11 nt, Human adenovirus C
gauacgucacu

SEQ ID NO: 3914660 - RNA, 15 nt, Human adenovirus C
gauacgucacuuccc

SEQ ID NO: 3914661 - RNA, 22 nt, Human adenovirus C
gauauggcccucaccugccgcc

SEQ ID NO: 3914662 - RNA, 15 nt, Human adenovirus C
gaucaaacccagcuu

SEQ ID NO: 3914663 - RNA, 18 nt, Human adenovirus C
gaucagcuucggcgcacg

SEQ ID NO: 3914664 - RNA, 17 nt, Human adenovirus C
gaucuauggccccccga

SEQ ID NO: 3914665 - RNA, 16 nt, Human adenovirus C
gaucuugguugugggc

SEQ ID NO: 3914666 - RNA, 16 nt, Human adenovirus C
gaugaagaagaggaag

SEQ ID NO: 3914667 - RNA, 15 nt, Human adenovirus C
gaugaagaugaagaa

SEQ ID NO: 3914668 - RNA, 18 nt, Human adenovirus C
gaugacgccauugacgcg

SEQ ID NO: 3914669 - RNA, 18 nt, Human adenovirus C
gaugacuugcaagaggcc

SEQ ID NO: 3914670 - RNA, 19 nt, Human adenovirus C
gaugagguguacggcgacg

SEQ ID NO: 3914671 - RNA, 21 nt, Human adenovirus C
gaugcaaacuugcaagaacaa

SEQ ID NO: 3914672 - RNA, 22 nt, Human adenovirus C
gaugccgccaacgcgccuacca

SEQ ID NO: 3914673 - RNA, 20 nt, Human adenovirus C
gaugccggcggcgguggugg

SEQ ID NO: 3914674 - RNA, 15 nt, Human adenovirus C
gauggaagacuggga

SEQ ID NO: 3914675 - RNA, 17 nt, Human adenovirus C
gauggaagacugggaca

SEQ ID NO: 3914676 - RNA, 18 nt, Human adenovirus C
gauggccgcgggcugggu

SEQ ID NO: 3914677 - RNA, 13 nt, Human adenovirus C
gaugugcccggcc

SEQ ID NO: 3914678 - RNA, 15 nt, Human adenovirus C
gauuccucugggacg

SEQ ID NO: 3914679 - RNA, 13 nt, Human adenovirus C
gcaaaauaaaaaa

SEQ ID NO: 3914680 - RNA, 22 nt, Human adenovirus C
gcaaaaucaaagaagagaugcu

SEQ ID NO: 3914681 - RNA, 15 nt, Human adenovirus C
gcaaacaucagcccc

SEQ ID NO: 3914682 - RNA, 18 nt, Human adenovirus C
gcaaaccucaccuccggu

SEQ ID NO: 3914683 - RNA, 21 nt, Human adenovirus C
gcaacagcgcgagcaggcaga

SEQ ID NO: 3914684 - RNA, 16 nt, Human adenovirus C
gcaaccaggaacagcu

SEQ ID NO: 3914685 - RNA, 20 nt, Human adenovirus C
gcaacccgcggugcuccucg

SEQ ID NO: 3914686 - RNA, 15 nt, Human adenovirus C
gcaaccgccucagcu

SEQ ID NO: 3914687 - RNA, 20 nt, Human adenovirus C
gcaacuagauugcaagaaaa

SEQ ID NO: 3914688 - RNA, 20 nt, Human adenovirus C
gcaacuggcaaagcacacug

SEQ ID NO: 3914689 - RNA, 15 nt, Human adenovirus C
gcaagacuccaaacu

SEQ ID NO: 3914690 - RNA, 16 nt, Human adenovirus C
gcaagagcgcagcgau

SEQ ID NO: 3914691 - RNA, 19 nt, Human adenovirus C
gcaagccaucaacaaagcc

SEQ ID NO: 3914692 - RNA, 20 nt, Human adenovirus C
gcaagccgcucauggcgcag

SEQ ID NO: 3914693 - RNA, 20 nt, Human adenovirus C
gcaagcugauugccaggggc

SEQ ID NO: 3914694 - RNA, 21 nt, Human adenovirus C
gcaagcugauugccaggggca

SEQ ID NO: 3914695 - RNA, 22 nt, Human adenovirus C
gcaagcugauugccaggggcag

SEQ ID NO: 3914696 - RNA, 23 nt, Human adenovirus C
gcaagucuagcgccugcugccau

SEQ ID NO: 3914697 - RNA, 14 nt, Human adenovirus C
gcaaugcuacuaaa

SEQ ID NO: 3914698 - RNA, 22 nt, Human adenovirus C
gcacaacauacugacccgcugu

SEQ ID NO: 3914699 - RNA, 13 nt, Human adenovirus C
gcaccagccgcac

SEQ ID NO: 3914700 - RNA, 20 nt, Human adenovirus C
gcacccaaaaagaagcugca

SEQ ID NO: 3914701 - RNA, 21 nt, Human adenovirus C
gcacccaaaaagaagcugcag

SEQ ID NO: 3914702 - RNA, 21 nt, Human adenovirus C
gcaccguggcgggcggcagcg

SEQ ID NO: 3914703 - RNA, 23 nt, Human adenovirus C
gcaccuaugacaagcgcuuucca

SEQ ID NO: 3914704 - RNA, 20 nt, Human adenovirus C
gcaccucgcgcucaaaggcu

SEQ ID NO: 3914705 - RNA, 23 nt, Human adenovirus C
gcaccuucgccccaggcugggga

SEQ ID NO: 3914706 - RNA, 14 nt, Human adenovirus C
gcacgcaaccgcgc

SEQ ID NO: 3914707 - RNA, 18 nt, Human adenovirus C
gcacgcuuguggcgcgcg

SEQ ID NO: 3914708 - RNA, 13 nt, Human adenovirus C
gcacgggcagcgg

SEQ ID NO: 3914709 - RNA, 13 nt, Human adenovirus C
gcacuacugcccg

SEQ ID NO: 3914710 - RNA, 20 nt, Human adenovirus C
gcacuaguauugccacugcc

SEQ ID NO: 3914711 - RNA, 23 nt, Human adenovirus C
gcacuccugacguaaccugcggc

SEQ ID NO: 3914712 - RNA, 15 nt, Human adenovirus C
gcacuggcaacaugg

SEQ ID NO: 3914713 - RNA, 14 nt, Human adenovirus C
gcacugggcgcacc

SEQ ID NO: 3914714 - RNA, 19 nt, Human adenovirus C
gcacuucuucuucuccuuc

SEQ ID NO: 3914715 - RNA, 14 nt, Human adenovirus C
gcagacaugcaggg

SEQ ID NO: 3914716 - RNA, 17 nt, Human adenovirus C
gcagaccaaccuggacc

SEQ ID NO: 3914717 - RNA, 19 nt, Human adenovirus C
gcagacccugcgagugugg

SEQ ID NO: 3914718 - RNA, 17 nt, Human adenovirus C
gcagacgcgccagaccc

SEQ ID NO: 3914719 - RNA, 21 nt, Human adenovirus C
gcagaggagguuuuggacgag

SEQ ID NO: 3914720 - RNA, 16 nt, Human adenovirus C
gcagaggcggcgcugc

SEQ ID NO: 3914721 - RNA, 17 nt, Human adenovirus C
gcagaugggagcugucc

SEQ ID NO: 3914722 - RNA, 13 nt, Human adenovirus C
gcagcaaggccug

SEQ ID NO: 3914723 - RNA, 15 nt, Human adenovirus C
gcagcaaggccugga

SEQ ID NO: 3914724 - RNA, 13 nt, Human adenovirus C
gcagcagcagggc

SEQ ID NO: 3914725 - RNA, 13 nt, Human adenovirus C
gcagcagccgcag

SEQ ID NO: 3914726 - RNA, 14 nt, Human adenovirus C
gcagcaggugcugc

SEQ ID NO: 3914727 - RNA, 18 nt, Human adenovirus C
gcagccacaacgcgcagc

SEQ ID NO: 3914728 - RNA, 18 nt, Human adenovirus C
gcagcccuaucagcagcc

SEQ ID NO: 3914729 - RNA, 13 nt, Human adenovirus C
gcagccgcaggcc

SEQ ID NO: 3914730 - RNA, 20 nt, Human adenovirus C
gcagcgaugugccccucgcc

SEQ ID NO: 3914731 - RNA, 15 nt, Human adenovirus C
gcagcgcgaaaagaa

SEQ ID NO: 3914732 - RNA, 20 nt, Human adenovirus C
gcagcggcagaagcugccgc

SEQ ID NO: 3914733 - RNA, 13 nt, Human adenovirus C
gcagcggcagaca

SEQ ID NO: 3914734 - RNA, 15 nt, Human adenovirus C
gcagcggcagacaug

SEQ ID NO: 3914735 - RNA, 12 nt, Human adenovirus C
gcagcggcagca

SEQ ID NO: 3914736 - RNA, 13 nt, Human adenovirus C
gcagcggcgcgga

SEQ ID NO: 3914737 - RNA, 16 nt, Human adenovirus C
gcagcggugcagccac

SEQ ID NO: 3914738 - RNA, 17 nt, Human adenovirus C
gcagcuaaaugccgugg

SEQ ID NO: 3914739 - RNA, 15 nt, Human adenovirus C
gcagcuggccuugcg

SEQ ID NO: 3914740 - RNA, 21 nt, Human adenovirus C
gcagcuguuggaucugcgcca

SEQ ID NO: 3914741 - RNA, 14 nt, Human adenovirus C
gcaggaggaagcca

SEQ ID NO: 3914742 - RNA, 19 nt, Human adenovirus C
gcaggaggacacgggcagc

SEQ ID NO: 3914743 - RNA, 21 nt, Human adenovirus C
gcaggaggacacgggcagccu

SEQ ID NO: 3914744 - RNA, 16 nt, Human adenovirus C
gcaggauuacaagccc

SEQ ID NO: 3914745 - RNA, 14 nt, Human adenovirus C
gcaggccaagcagc

SEQ ID NO: 3914746 - RNA, 14 nt, Human adenovirus C
gcaggcggccgcug

SEQ ID NO: 3914747 - RNA, 16 nt, Human adenovirus C
gcagggauacggcgcu

SEQ ID NO: 3914748 - RNA, 14 nt, Human adenovirus C
gcagggcacccucc

SEQ ID NO: 3914749 - RNA, 15 nt, Human adenovirus C
gcagggcacccuccc

SEQ ID NO: 3914750 - RNA, 18 nt, Human adenovirus C
gcagggcgaaggugacau

SEQ ID NO: 3914751 - RNA, 19 nt, Human adenovirus C
gcagggcgcugucauaccu

SEQ ID NO: 3914752 - RNA, 15 nt, Human adenovirus C
gcagguacgccugca

SEQ ID NO: 3914753 - RNA, 22 nt, Human adenovirus C
gcagguuggaauucuucaccag

SEQ ID NO: 3914754 - RNA, 16 nt, Human adenovirus C
gcaguaguccaggguu

SEQ ID NO: 3914755 - RNA, 14 nt, Human adenovirus C
gcaguagucggugc

SEQ ID NO: 3914756 - RNA, 19 nt, Human adenovirus C
gcauccgcccugcucccag

SEQ ID NO: 3914757 - RNA, 22 nt, Human adenovirus C
gcaucgcugucugcgagggcca

SEQ ID NO: 3914758 - RNA, 14 nt, Human adenovirus C
gcaugaagggcacg

SEQ ID NO: 3914759 - RNA, 16 nt, Human adenovirus C
gcaugcccccaugggc

SEQ ID NO: 3914760 - RNA, 15 nt, Human adenovirus C
gcauggcgacuaccu

SEQ ID NO: 3914761 - RNA, 15 nt, Human adenovirus C
gcauggucucgguga

SEQ ID NO: 3914762 - RNA, 24 nt, Human adenovirus C
gcaugugaguuggaugauaugguu

SEQ ID NO: 3914763 - RNA, 16 nt, Human adenovirus C
gccaaaaccuucucua

SEQ ID NO: 3914764 - RNA, 19 nt, Human adenovirus C
gccaaccaggcagugcaaa

SEQ ID NO: 3914765 - RNA, 16 nt, Human adenovirus C
gccaaccuacacauuc

SEQ ID NO: 3914766 - RNA, 12 nt, Human adenovirus C
gccaaguacaga

SEQ ID NO: 3914767 - RNA, 13 nt, Human adenovirus C
gccacacccagcc

SEQ ID NO: 3914768 - RNA, 22 nt, Human adenovirus C
gccacccacggacgaggaggaa

SEQ ID NO: 3914769 - RNA, 19 nt, Human adenovirus C
gccaccgagggaccugagc

SEQ ID NO: 3914770 - RNA, 20 nt, Human adenovirus C
gccaccucccucccaacaca

SEQ ID NO: 3914771 - RNA, 13 nt, Human adenovirus C
gccaccugagccu

SEQ ID NO: 3914772 - RNA, 16 nt, Human adenovirus C
gccacugccacagagg

SEQ ID NO: 3914773 - RNA, 18 nt, Human adenovirus C
gccagaaggcgcucgccg

SEQ ID NO: 3914774 - RNA, 16 nt, Human adenovirus C
gccagcacgcucuugu

SEQ ID NO: 3914775 - RNA, 19 nt, Human adenovirus C
gccaguggcaacuggcaaa

SEQ ID NO: 3914776 - RNA, 15 nt, Human adenovirus C
gccaugcaucugugg

SEQ ID NO: 3914777 - RNA, 22 nt, Human adenovirus C
gccaugggcguguggcagcaau

SEQ ID NO: 3914778 - RNA, 14 nt, Human adenovirus C
gccauugcuucuuc

SEQ ID NO: 3914779 - RNA, 15 nt, Human adenovirus C
gccauuuccuucucc

SEQ ID NO: 3914780 - RNA, 17 nt, Human adenovirus C
gccauuuuuucuggggu

SEQ ID NO: 3914781 - RNA, 13 nt, Human adenovirus C
gcccaacccgcgc

SEQ ID NO: 3914782 - RNA, 19 nt, Human adenovirus C
gcccagcaauaacacaggc

SEQ ID NO: 3914783 - RNA, 16 nt, Human adenovirus C
gccccaggcuggggag

SEQ ID NO: 3914784 - RNA, 21 nt, Human adenovirus C
gccccccuucucccaccccca

SEQ ID NO: 3914785 - RNA, 23 nt, Human adenovirus C
gcccccuuugaguucgccaccac

SEQ ID NO: 3914786 - RNA, 13 nt, Human adenovirus C
gcccgacagggaa

SEQ ID NO: 3914787 - RNA, 20 nt, Human adenovirus C
gcccgagggccgcuggcugc

SEQ ID NO: 3914788 - RNA, 18 nt, Human adenovirus C
gcccgcgccugcugggcg

SEQ ID NO: 3914789 - RNA, 20 nt, Human adenovirus C
gcccgcuugcaagcagugca

SEQ ID NO: 3914790 - RNA, 19 nt, Human adenovirus C
gcccgugcacuccaagagc

SEQ ID NO: 3914791 - RNA, 13 nt, Human adenovirus C
gcccgugcuggcc

SEQ ID NO: 3914792 - RNA, 22 nt, Human adenovirus C
gcccguguucugacagggccca

SEQ ID NO: 3914793 - RNA, 15 nt, Human adenovirus C
gcccuaccugugcuu

SEQ ID NO: 3914794 - RNA, 18 nt, Human adenovirus C
gcccuaccugugcuuugc

SEQ ID NO: 3914795 - RNA, 23 nt, Human adenovirus C
gcccuagccgcgcgucccugcgc

SEQ ID NO: 3914796 - RNA, 14 nt, Human adenovirus C
gcccucuccugagc

SEQ ID NO: 3914797 - RNA, 20 nt, Human adenovirus C
gcccugcgcgucggccaggu

SEQ ID NO: 3914798 - RNA, 22 nt, Human adenovirus C
uaccuugagcgacgaccugggc

SEQ ID NO: 3914799 - RNA, 22 nt, Human adenovirus C
uaccuuggguauccugucugag

SEQ ID NO: 3914800 - RNA, 18 nt, Human adenovirus C
uacgagagcguggugagc

SEQ ID NO: 3914801 - RNA, 13 nt, Human adenovirus C
uacgaugaccugg

SEQ ID NO: 3914802 - RNA, 11 nt, Human adenovirus C
uacgccaccuu

SEQ ID NO: 3914803 - RNA, 18 nt, Human adenovirus C
uacgccaccuucuucccc

SEQ ID NO: 3914804 - RNA, 16 nt, Human adenovirus C
uacuaccgucaucucu

SEQ ID NO: 3914805 - RNA, 12 nt, Human adenovirus C
uacuaccucuuu

SEQ ID NO: 3914806 - RNA, 14 nt, Human adenovirus C
uacuagcuacugua

SEQ ID NO: 3914807 - RNA, 17 nt, Human adenovirus C
uacucugaguuggcacc

SEQ ID NO: 3914808 - RNA, 13 nt, Human adenovirus C
uacucuggcucca

SEQ ID NO: 3914809 - RNA, 15 nt, Human adenovirus C
uacuggcugcagcca

SEQ ID NO: 3914810 - RNA, 21 nt, Human adenovirus C
uacuucccagagacgcccagg

SEQ ID NO: 3914811 - RNA, 15 nt, Human adenovirus C
uacuuuaucucaaau

SEQ ID NO: 3914812 - RNA, 22 nt, Human adenovirus C
uagaaucauugaaaaccaugga

SEQ ID NO: 3914813 - RNA, 22 nt, Human adenovirus C
uagcaagcugauugccaggggc

SEQ ID NO: 3914814 - RNA, 15 nt, Human adenovirus C
uaggaggggcauggc

SEQ ID NO: 3914815 - RNA, 17 nt, Human adenovirus C
uaggaucagacaaugca

SEQ ID NO: 3914816 - RNA, 15 nt, Human adenovirus C
uaggcccgggaccag

SEQ ID NO: 3914817 - RNA, 20 nt, Human adenovirus C
uaggcgcucguugguccagc

SEQ ID NO: 3914818 - RNA, 14 nt, Human adenovirus C
uaggcuaccucgcu

SEQ ID NO: 3914819 - RNA, 20 nt, Human adenovirus C
uaggcuggaaagcgaaagca

SEQ ID NO: 3914820 - RNA, 18 nt, Human adenovirus C
uagggcgcaguaguccag

SEQ ID NO: 3914821 - RNA, 18 nt, Human adenovirus C
uagguucuacgaagacca

SEQ ID NO: 3914822 - RNA, 17 nt, Human adenovirus C
uaguauagccccaccac

SEQ ID NO: 3914823 - RNA, 15 nt, Human adenovirus C
uagugcagcacagca

SEQ ID NO: 3914824 - RNA, 19 nt, Human adenovirus C
uauaaugucacagucuucc

SEQ ID NO: 3914825 - RNA, 17 nt, Human adenovirus C
uauacccacaaccuuca

SEQ ID NO: 3914826 - RNA, 19 nt, Human adenovirus C
uauacgccaucaucucugu

SEQ ID NO: 3914827 - RNA, 21 nt, Human adenovirus C
uaucucaaauacaaaagcaga

SEQ ID NO: 3914828 - RNA, 19 nt, Human adenovirus C
uaucugacaaccccaacac

SEQ ID NO: 3914829 - RNA, 18 nt, Human adenovirus C
uaugagcgguggcgccuu

SEQ ID NO: 3914830 - RNA, 14 nt, Human adenovirus C
uaugauucaucaaa

SEQ ID NO: 3914831 - RNA, 16 nt, Human adenovirus C
uauguauaaauuucca

SEQ ID NO: 3914832 - RNA, 17 nt, Human adenovirus C
uauuauucgccacaaag

SEQ ID NO: 3914833 - RNA, 23 nt, Human adenovirus C
uauucugcugcauguuucuccac

SEQ ID NO: 3914834 - RNA, 11 nt, Human adenovirus C
ucaaaaaccag

SEQ ID NO: 3914835 - RNA, 20 nt, Human adenovirus C
ucaaaaugaagaucuauuaa

SEQ ID NO: 3914836 - RNA, 13 nt, Human adenovirus C
ucaaacccagcuu

SEQ ID NO: 3914837 - RNA, 23 nt, Human adenovirus C
ucaaauauggaacauucccagcu

SEQ ID NO: 3914838 - RNA, 16 nt, Human adenovirus C
ucaaaucuucacuucc

SEQ ID NO: 3914839 - RNA, 20 nt, Human adenovirus C
ucaacaaagcccgccaagag

SEQ ID NO: 3914840 - RNA, 23 nt, Human adenovirus C
ucaacggaauccgcgcccaccga

SEQ ID NO: 3914841 - RNA, 20 nt, Human adenovirus C
ucaacuacaccgucaagaaa

SEQ ID NO: 3914842 - RNA, 20 nt, Human adenovirus C
ucaacucccggaacucaggu

SEQ ID NO: 3914843 - RNA, 16 nt, Human adenovirus C
ucacaagccccacuga

SEQ ID NO: 3914844 - RNA, 14 nt, Human adenovirus C
ucacagauuugcau

SEQ ID NO: 3914845 - RNA, 20 nt, Human adenovirus C
ucaccaacgcguuuagcagg

SEQ ID NO: 3914846 - RNA, 11 nt, Human adenovirus C
ucaccagcaua

SEQ ID NO: 3914847 - RNA, 20 nt, Human adenovirus C
ucaccagcauaacaacucag

SEQ ID NO: 3914848 - RNA, 14 nt, Human adenovirus C
ucacccgcagcugc

SEQ ID NO: 3914849 - RNA, 15 nt, Human adenovirus C
ucacccuggcugugg

SEQ ID NO: 3914850 - RNA, 13 nt, Human adenovirus C
ucaccuccuuucc

SEQ ID NO: 3914851 - RNA, 20 nt, Human adenovirus C
ucacggugaaggggugcgcu

SEQ ID NO: 3914852 - RNA, 14 nt, Human adenovirus C
ucacuccacaggcu

SEQ ID NO: 3914853 - RNA, 20 nt, Human adenovirus C
ucagcacaguaacugcagca

SEQ ID NO: 3914854 - RNA, 19 nt, Human adenovirus C
ucagccgcgcgcuggggca

SEQ ID NO: 3914855 - RNA, 16 nt, Human adenovirus C
ucagccucgccccccu

SEQ ID NO: 3914856 - RNA, 11 nt, Human adenovirus C
ucagcugcaac

SEQ ID NO: 3914857 - RNA, 21 nt, Human adenovirus C
ucagcugggaagaaagcaggu

SEQ ID NO: 3914858 - RNA, 22 nt, Human adenovirus C
ucagcuggggcucgcuguggag

SEQ ID NO: 3914859 - RNA, 17 nt, Human adenovirus C
ucaggaauucugcccgc

SEQ ID NO: 3914860 - RNA, 15 nt, Human adenovirus C
ucaggcgggagcucc

SEQ ID NO: 3914861 - RNA, 23 nt, Human adenovirus C
ucagggcgcgggcuagguccagg

SEQ ID NO: 3914862 - RNA, 14 nt, Human adenovirus C
ucaguagcaagcug

SEQ ID NO: 3914863 - RNA, 23 nt, Human adenovirus C
ucaguaguauagccccaccacca

SEQ ID NO: 3914864 - RNA, 18 nt, Human adenovirus C
ucagucgagaaggaggac

SEQ ID NO: 3914865 - RNA, 18 nt, Human adenovirus C
ucauaguuguguuccagg

SEQ ID NO: 3914866 - RNA, 14 nt, Human adenovirus C
ucaucccugagcag

SEQ ID NO: 3914867 - RNA, 14 nt, Human adenovirus C
ucaucccuguggac

SEQ ID NO: 3914868 - RNA, 13 nt, Human adenovirus C
ucaucucugugcu

SEQ ID NO: 3914869 - RNA, 14 nt, Human adenovirus C
ucaugagcgagcug

SEQ ID NO: 3914870 - RNA, 18 nt, Human adenovirus C
ucaugggaaacuggcaag

SEQ ID NO: 3914871 - RNA, 17 nt, Human adenovirus C
ucauuuguaauuuacaa

SEQ ID NO: 3914872 - RNA, 13 nt, Human adenovirus C
ucauuuugcugcc

SEQ ID NO: 3914873 - RNA, 20 nt, Human adenovirus C
uccaagaugagguacaugau

SEQ ID NO: 3914874 - RNA, 17 nt, Human adenovirus C
uccaagcgcaaaaucaa

SEQ ID NO: 3914875 - RNA, 19 nt, Human adenovirus C
uccacaaaaaacacccaga

SEQ ID NO: 3914876 - RNA, 13 nt, Human adenovirus C
uccacacaagcuc

SEQ ID NO: 3914877 - RNA, 13 nt, Human adenovirus C
uccacagaaacua

SEQ ID NO: 3914878 - RNA, 20 nt, Human adenovirus C
uccacgggcgcaggguccuc

SEQ ID NO: 3914879 - RNA, 16 nt, Human adenovirus C
uccacucgcuccaggg

SEQ ID NO: 3914880 - RNA, 22 nt, Human adenovirus C
uccagacaucauuuugcugcca

SEQ ID NO: 3914881 - RNA, 13 nt, Human adenovirus C
uccauaagggccu

SEQ ID NO: 3914882 - RNA, 17 nt, Human adenovirus C
uccauagagcagcugac

SEQ ID NO: 3914883 - RNA, 24 nt, Human adenovirus C
uccaugcccuucucccacgcagac

SEQ ID NO: 3914884 - RNA, 13 nt, Human adenovirus C
ucccacccccacu

SEQ ID NO: 3914885 - RNA, 17 nt, Human adenovirus C
ucccaggauggcaccca

SEQ ID NO: 3914886 - RNA, 21 nt, Human adenovirus C
ucccauccaagguccacggcu

SEQ ID NO: 3914887 - RNA, 22 nt, Human adenovirus C
ucccaucgcgcaacugggcagc

SEQ ID NO: 3914888 - RNA, 21 nt, Human adenovirus C
ucccccaugcuuuuugaugcg

SEQ ID NO: 3914889 - RNA, 19 nt, Human adenovirus C
ucccccguaacauccugca

SEQ ID NO: 3914890 - RNA, 20 nt, Human adenovirus C
ucccgcggcgacaggucagg

SEQ ID NO: 3914891 - RNA, 22 nt, Human adenovirus C
ucccguagaggagccuccaccg

SEQ ID NO: 3914892 - RNA, 16 nt, Human adenovirus C
ucccguucauccgccc

SEQ ID NO: 3914893 - RNA, 15 nt, Human adenovirus C
ucccugggaucaggc

SEQ ID NO: 3914894 - RNA, 17 nt, Human adenovirus C
ucccugggaucaggcua

SEQ ID NO: 3914895 - RNA, 17 nt, Human adenovirus C
ucccuguagccggaggg

SEQ ID NO: 3914896 - RNA, 14 nt, Human adenovirus C
uccgaggccgaaga

SEQ ID NO: 3914897 - RNA, 14 nt, Human adenovirus C
uccgcauaccccgc

SEQ ID NO: 3914898 - RNA, 13 nt, Human adenovirus C
uccggggggucug

SEQ ID NO: 3914899 - RNA, 18 nt, Human adenovirus C
uccgggguugaaacucac

SEQ ID NO: 3914900 - RNA, 18 nt, Human adenovirus C
uccuaacucugcagaccu

SEQ ID NO: 3914901 - RNA, 13 nt, Human adenovirus C
uccuacauugccc

SEQ ID NO: 3914902 - RNA, 18 nt, Human adenovirus C
uccuacuuugacgcgggc

SEQ ID NO: 3914903 - RNA, 20 nt, Human adenovirus C
uccucaaaucuucacuuccg

SEQ ID NO: 3914904 - RNA, 15 nt, Human adenovirus C
uccucaggggagcug

SEQ ID NO: 3914905 - RNA, 17 nt, Human adenovirus C
uccucgaguucuuauau

SEQ ID NO: 3914906 - RNA, 15 nt, Human adenovirus C
uccugagcagcugcg

SEQ ID NO: 3914907 - RNA, 16 nt, Human adenovirus C
uccugagcagcugcga

SEQ ID NO: 3914908 - RNA, 18 nt, Human adenovirus C
uccuuuccuuccucccaa

SEQ ID NO: 3914909 - RNA, 17 nt, Human adenovirus C
ucgaagccguugauguu

SEQ ID NO: 3914910 - RNA, 13 nt, Human adenovirus C
ucgagaaggagga

SEQ ID NO: 3914911 - RNA, 20 nt, Human adenovirus C
ucgagaaggaggacagccua

SEQ ID NO: 3914912 - RNA, 12 nt, Human adenovirus C
ucgagaucaggc

SEQ ID NO: 3914913 - RNA, 17 nt, Human adenovirus C
ucgaugacuugcaagag

SEQ ID NO: 3914914 - RNA, 16 nt, Human adenovirus C
ucgcuguccagcugcu

SEQ ID NO: 3914915 - RNA, 16 nt, Human adenovirus C
ucgcuguggagcggca

SEQ ID NO: 3914916 - RNA, 16 nt, Human adenovirus C
ucgcuuacuaaggaca

SEQ ID NO: 3914917 - RNA, 16 nt, Human adenovirus C
ucggaccaccacgccg

SEQ ID NO: 3914918 - RNA, 14 nt, Human adenovirus C
ucggcgguggcaga

SEQ ID NO: 3914919 - RNA, 20 nt, Human adenovirus C
ucuaacaguaccucuugguu

SEQ ID NO: 3914920 - RNA, 16 nt, Human adenovirus C
ucuaagcagccgccgc

SEQ ID NO: 3914921 - RNA, 21 nt, Human adenovirus C
ucuagggcgcaguaguccagg

SEQ ID NO: 3914922 - RNA, 18 nt, Human adenovirus C
ucuaugcccaggcuccuu

SEQ ID NO: 3914923 - RNA, 15 nt, Human adenovirus C
ucuccuucgcccgcc

SEQ ID NO: 3914924 - RNA, 13 nt, Human adenovirus C
ucucgauccagca

SEQ ID NO: 3914925 - RNA, 21 nt, Human adenovirus C
ucugacaaagcccaagaaauc

SEQ ID NO: 3914926 - RNA, 19 nt, Human adenovirus C
ucugacaaccccaacaccu

SEQ ID NO: 3914927 - RNA, 16 nt, Human adenovirus C
ucuggagcucccgcgg

SEQ ID NO: 3914928 - RNA, 19 nt, Human adenovirus C
ucuggugacuuggcaccca

SEQ ID NO: 3914929 - RNA, 13 nt, Human adenovirus C
ucuuauacuagca

SEQ ID NO: 3914930 - RNA, 13 nt, Human adenovirus C
ucuuaugccaggc

SEQ ID NO: 3914931 - RNA, 13 nt, Human adenovirus C
ucuucagaaacuu

SEQ ID NO: 3914932 - RNA, 12 nt, Human adenovirus C
ugaaaccaugcu

SEQ ID NO: 3914933 - RNA, 10 nt, Human adenovirus C
ugaaacuuuu

SEQ ID NO: 3914934 - RNA, 14 nt, Human adenovirus C
ugaaagagguaguu

SEQ ID NO: 3914935 - RNA, 21 nt, Human adenovirus C
ugaacgggguguuugacauga

SEQ ID NO: 3914936 - RNA, 19 nt, Human adenovirus C
ugaagaaaaccguuuccgg

SEQ ID NO: 3914937 - RNA, 13 nt, Human adenovirus C
ugaaguuugccuu

SEQ ID NO: 3914938 - RNA, 22 nt, Human adenovirus C
ugacaaaagaacccacacugau

SEQ ID NO: 3914939 - RNA, 18 nt, Human adenovirus C
ugacaguauuacccagaa

SEQ ID NO: 3914940 - RNA, 19 nt, Human adenovirus C
ugacaucggcgcaggucuu

SEQ ID NO: 3914941 - RNA, 20 nt, Human adenovirus C
ugaccaacgacucaagcagg

SEQ ID NO: 3914942 - RNA, 18 nt, Human adenovirus C
ugaccacuuacuggcugc

SEQ ID NO: 3914943 - RNA, 12 nt, Human adenovirus C
ugaccagcucgg

SEQ ID NO: 3914944 - RNA, 18 nt, Human adenovirus C
ugaccgugcccggucugg

SEQ ID NO: 3914945 - RNA, 21 nt, Human adenovirus C
ugacgcgggcgcugaccugcg

SEQ ID NO: 3914946 - RNA, 18 nt, Human adenovirus C
ugacgcguuccggcagca

SEQ ID NO: 3914947 - RNA, 20 nt, Human adenovirus C
ugacgcguuccggcagcagc

SEQ ID NO: 3914948 - RNA, 23 nt, Human adenovirus C
ugacggccugguaggcgcagcau

SEQ ID NO: 3914949 - RNA, 17 nt, Human adenovirus C
ugagacaugauuccucg

SEQ ID NO: 3914950 - RNA, 14 nt, Human adenovirus C
ugagacgcgcgagc

SEQ ID NO: 3914951 - RNA, 21 nt, Human adenovirus C
ugagcaaggaaauucccacgc

SEQ ID NO: 3914952 - RNA, 22 nt, Human adenovirus C
ugagcaaggaaauucccacgcc

SEQ ID NO: 3914953 - RNA, 21 nt, Human adenovirus C
ugagcacagucaugagcgagc

SEQ ID NO: 3914954 - RNA, 23 nt, Human adenovirus C
ugagcccgacgcgcggaccggga

SEQ ID NO: 3914955 - RNA, 23 nt, Human adenovirus C
ugagcccguguucugacagggcc

SEQ ID NO: 3914956 - RNA, 18 nt, Human adenovirus C
ugagcgcgcgcagcagca

SEQ ID NO: 3914957 - RNA, 13 nt, Human adenovirus C
ugagcgcgggacc

SEQ ID NO: 3914958 - RNA, 20 nt, Human adenovirus C
ugagcgugagccggcggcgc

SEQ ID NO: 3914959 - RNA, 17 nt, Human adenovirus C
ugagcuccacgugccgg

SEQ ID NO: 3914960 - RNA, 21 nt, Human adenovirus C
ugaggacuaccacgcccacga

SEQ ID NO: 3914961 - RNA, 18 nt, Human adenovirus C
ugaggcuacagaggaggc

SEQ ID NO: 3914962 - RNA, 18 nt, Human adenovirus C
ugaggcugguccugcugg

SEQ ID NO: 3914963 - RNA, 15 nt, Human adenovirus C
ugagguacaugauuu

SEQ ID NO: 3914964 - RNA, 13 nt, Human adenovirus C
ugauaaauaugug

SEQ ID NO: 3914965 - RNA, 22 nt, Human adenovirus C
ugauaggcgauuucggccauga

SEQ ID NO: 3914966 - RNA, 16 nt, Human adenovirus C
ugauaugguuggacgc

SEQ ID NO: 3914967 - RNA, 15 nt, Human adenovirus C
ugaucaaacccagcu

SEQ ID NO: 3914968 - RNA, 18 nt, Human adenovirus C
ugauccagucguagcagg

SEQ ID NO: 3914969 - RNA, 22 nt, Human adenovirus C
ugaucugcuuaaaagccaccug

SEQ ID NO: 3914970 - RNA, 14 nt, Human adenovirus C
ugaugaaaauucua

SEQ ID NO: 3914971 - RNA, 12 nt, Human adenovirus C
ugaugacaaacu

SEQ ID NO: 3914972 - RNA, 18 nt, Human adenovirus C
ugauggaagacugggaca

SEQ ID NO: 3914973 - RNA, 21 nt, Human adenovirus C
ugauggaagcauugugagcuc

SEQ ID NO: 3914974 - RNA, 18 nt, Human adenovirus C
ugauggccgcagugcuug

SEQ ID NO: 3914975 - RNA, 19 nt, Human adenovirus C
ugcaaacuugcaagaacaa

SEQ ID NO: 3914976 - RNA, 18 nt, Human adenovirus C
ugcaaacuuucuccaaag

SEQ ID NO: 3914977 - RNA, 18 nt, Human adenovirus C
ugcaacagguuauugccc

SEQ ID NO: 3914978 - RNA, 16 nt, Human adenovirus C
ugcaagcagugcagcu

SEQ ID NO: 3914979 - RNA, 17 nt, Human adenovirus C
ugcaagcagugcagcuu

SEQ ID NO: 3914980 - RNA, 19 nt, Human adenovirus C
ugcaagucuagcgccugcu

SEQ ID NO: 3914981 - RNA, 22 nt, Human adenovirus C
ugcacaguuuaaacagcgagga

SEQ ID NO: 3914982 - RNA, 18 nt, Human adenovirus C
ugcacaucucgggccagg

SEQ ID NO: 3914983 - RNA, 19 nt, Human adenovirus C
ugcaccacagaacaugaaa

SEQ ID NO: 3914984 - RNA, 21 nt, Human adenovirus C
ugcaccguaggaggggcaugg

SEQ ID NO: 3914985 - RNA, 15 nt, Human adenovirus C
ugcacgcuggccagc

SEQ ID NO: 3914986 - RNA, 18 nt, Human adenovirus C
ugcacgcuggccagcacg

SEQ ID NO: 3914987 - RNA, 20 nt, Human adenovirus C
ugcacgcuggccagcacgcu

SEQ ID NO: 3914988 - RNA, 15 nt, Human adenovirus C
ugcagaccaaccugg

SEQ ID NO: 3914989 - RNA, 18 nt, Human adenovirus C
ugcagaccaaccuggacc

SEQ ID NO: 3914990 - RNA, 17 nt, Human adenovirus C
ugcagauguuggccaac

SEQ ID NO: 3914991 - RNA, 18 nt, Human adenovirus C
ugcauacacuuccucagg

SEQ ID NO: 3914992 - RNA, 13 nt, Human adenovirus C
ugcaugcccaggc

SEQ ID NO: 3914993 - RNA, 20 nt, Human adenovirus C
ugcauguuucuccacgccuu

SEQ ID NO: 3914994 - RNA, 16 nt, Human adenovirus C
ugccacagagggcaug

SEQ ID NO: 3914995 - RNA, 18 nt, Human adenovirus C
ugccaccucccucccaac

SEQ ID NO: 3914996 - RNA, 22 nt, Human adenovirus C
ugccagaggugcuugccaccua

SEQ ID NO: 3914997 - RNA, 16 nt, Human adenovirus C
ugccaugcgcgggcgg

SEQ ID NO: 3914998 - RNA, 18 nt, Human adenovirus C
ugccauuaaaaaccuccu

SEQ ID NO: 3914999 - RNA, 12 nt, Human adenovirus C
ugcccaggcucc

SEQ ID NO: 3915000 - RNA, 17 nt, Human adenovirus C
ugccccaaucaaucagc

SEQ ID NO: 3915001 - RNA, 17 nt, Human adenovirus C
ugccccucgccauagcg

SEQ ID NO: 3915002 - RNA, 13 nt, Human adenovirus C
ugcccgccaccug

SEQ ID NO: 3915003 - RNA, 16 nt, Human adenovirus C
ugcccgccaccugcug

SEQ ID NO: 3915004 - RNA, 22 nt, Human adenovirus C
ugcccgcugucauaccacugca

SEQ ID NO: 3915005 - RNA, 18 nt, Human adenovirus C
ugcccggaauugcauccg

SEQ ID NO: 3915006 - RNA, 13 nt, Human adenovirus C
ugcccuccgccgc

SEQ ID NO: 3915007 - RNA, 14 nt, Human adenovirus C
ugcccuccgccgcu

SEQ ID NO: 3915008 - RNA, 13 nt, Human adenovirus C
ugccgcggcagaa

SEQ ID NO: 3915009 - RNA, 19 nt, Human adenovirus C
ugccgcggggacaggagga

SEQ ID NO: 3915010 - RNA, 23 nt, Human adenovirus C
ugccuuugucaaugacugggcga

SEQ ID NO: 3915011 - RNA, 13 nt, Human adenovirus C
ugccuuuuacugc

SEQ ID NO: 3915012 - RNA, 23 nt, Human adenovirus C
ugcgauacacaggguugcagcac

SEQ ID NO: 3915013 - RNA, 14 nt, Human adenovirus C
ugcgcagcggcaaa

SEQ ID NO: 3915014 - RNA, 14 nt, Human adenovirus C
ugcgcaggagcaca

SEQ ID NO: 3915015 - RNA, 20 nt, Human adenovirus C
ugcgcccacaccuacagccu

SEQ ID NO: 3915016 - RNA, 22 nt, Human adenovirus C
ugcgccccccuccucagcagcg

SEQ ID NO: 3915017 - RNA, 19 nt, Human adenovirus C
ugcgccguuuaaaaaucaa

SEQ ID NO: 3915018 - RNA, 17 nt, Human adenovirus C
ugcgcgagggacaggcu

SEQ ID NO: 3915019 - RNA, 18 nt, Human adenovirus C
ugcgcuguaccugccaga

SEQ ID NO: 3915020 - RNA, 20 nt, Human adenovirus C
ugcgcuugaggcugguccug

SEQ ID NO: 3915021 - RNA, 12 nt, Human adenovirus C
ugcgcuuuucug

SEQ ID NO: 3915022 - RNA, 18 nt, Human adenovirus C
ugcgcuuuuuggaacgcg

SEQ ID NO: 3915023 - RNA, 15 nt, Human adenovirus C
ugcggaagggucccg

SEQ ID NO: 3915024 - RNA, 18 nt, Human adenovirus C
ugcggcuggagcugccca

SEQ ID NO: 3915025 - RNA, 17 nt, Human adenovirus C
ugcgggccaugagcugc

SEQ ID NO: 3915026 - RNA, 18 nt, Human adenovirus C
ugcguaacuugcuggaac

SEQ ID NO: 3915027 - RNA, 16 nt, Human adenovirus C
ugcgucauuacccagg

SEQ ID NO: 3915028 - RNA, 23 nt, Human adenovirus C
ugcgugugaccccgaagccccuc

SEQ ID NO: 3915029 - RNA, 11 nt, Human adenovirus C
ugcuaccucuu

SEQ ID NO: 3915030 - RNA, 12 nt, Human adenovirus C
ugcuaccucuuu

SEQ ID NO: 3915031 - RNA, 16 nt, Human adenovirus C
ugcuaccucuuugagc

SEQ ID NO: 3915032 - RNA, 18 nt, Human adenovirus C
ugcuacgaaagggacggg

SEQ ID NO: 3915033 - RNA, 17 nt, Human adenovirus C
ugcuacgggcgggcugc

SEQ ID NO: 3915034 - RNA, 22 nt, Human adenovirus C
ugcuauggaucuuaugccaggc

SEQ ID NO: 3915035 - RNA, 17 nt, Human adenovirus C
ugcucaacccacacaau

SEQ ID NO: 3915036 - RNA, 19 nt, Human adenovirus C
guacagugaagauguaaau

SEQ ID NO: 3915037 - RNA, 17 nt, Human adenovirus C
guaccugaggacuacca

SEQ ID NO: 3915038 - RNA, 13 nt, Human adenovirus C
guaccugccagac

SEQ ID NO: 3915039 - RNA, 16 nt, Human adenovirus C
guaccugccagacaag

SEQ ID NO: 3915040 - RNA, 14 nt, Human adenovirus C
guaccugcgcacgc

SEQ ID NO: 3915041 - RNA, 15 nt, Human adenovirus C
guacuucccagagac

SEQ ID NO: 3915042 - RNA, 12 nt, Human adenovirus C
guagacuggaag

SEQ ID NO: 3915043 - RNA, 23 nt, Human adenovirus C
guagcaagcugauugccaggggc

SEQ ID NO: 3915044 - RNA, 13 nt, Human adenovirus C
guaggugagcucc

SEQ ID NO: 3915045 - RNA, 20 nt, Human adenovirus C
guaguggcaucagaagguga

SEQ ID NO: 3915046 - RNA, 18 nt, Human adenovirus C
guauacgcagauccuucc

SEQ ID NO: 3915047 - RNA, 14 nt, Human adenovirus C
guauauuccuuaga

SEQ ID NO: 3915048 - RNA, 15 nt, Human adenovirus C
guaugcgcaggagca

SEQ ID NO: 3915049 - RNA, 21 nt, Human adenovirus C
guauguauccagcggcggcgg

SEQ ID NO: 3915050 - RNA, 12 nt, Human adenovirus C
gucacacagaag

SEQ ID NO: 3915051 - RNA, 22 nt, Human adenovirus C
gucacccuuauccucaucugca

SEQ ID NO: 3915052 - RNA, 21 nt, Human adenovirus C
gucagacaacgggggagcgcu

SEQ ID NO: 3915053 - RNA, 15 nt, Human adenovirus C
gucagcguagucugg

SEQ ID NO: 3915054 - RNA, 16 nt, Human adenovirus C
gucauaccacugcaac

SEQ ID NO: 3915055 - RNA, 14 nt, Human adenovirus C
gucaucccugagca

SEQ ID NO: 3915056 - RNA, 12 nt, Human adenovirus C
gucaucucugug

SEQ ID NO: 3915057 - RNA, 15 nt, Human adenovirus C
gucaucucugugcug

SEQ ID NO: 3915058 - RNA, 21 nt, Human adenovirus C
gucauuacccagggccacauc

SEQ ID NO: 3915059 - RNA, 13 nt, Human adenovirus C
guccaaggugaac

SEQ ID NO: 3915060 - RNA, 13 nt, Human adenovirus C
guccagcagaggc

SEQ ID NO: 3915061 - RNA, 17 nt, Human adenovirus C
guccagccccuccgcgg

SEQ ID NO: 3915062 - RNA, 20 nt, Human adenovirus C
guccaggcgacgagcggccg

SEQ ID NO: 3915063 - RNA, 15 nt, Human adenovirus C
guccaucuggucaga

SEQ ID NO: 3915064 - RNA, 18 nt, Human adenovirus C
gucccagcguuugacgcu

SEQ ID NO: 3915065 - RNA, 19 nt, Human adenovirus C
guccuccgcguugcucagg

SEQ ID NO: 3915066 - RNA, 21 nt, Human adenovirus C
guccuccgcguugcucagggc

SEQ ID NO: 3915067 - RNA, 22 nt, Human adenovirus C
guccuguguauuuuuuccagga

SEQ ID NO: 3915068 - RNA, 20 nt, Human adenovirus C
gucgcaaccaggaacagcuc

SEQ ID NO: 3915069 - RNA, 13 nt, Human adenovirus C
gucgccgccagag

SEQ ID NO: 3915070 - RNA, 14 nt, Human adenovirus C
gucgccgccagagg

SEQ ID NO: 3915071 - RNA, 18 nt, Human adenovirus C
gucuaagcagccgccgcc

SEQ ID NO: 3915072 - RNA, 23 nt, Human adenovirus C
gucuccuaccuuggaauuuugca

SEQ ID NO: 3915073 - RNA, 19 nt, Human adenovirus C
gucugcagcgcugccaaaa

SEQ ID NO: 3915074 - RNA, 16 nt, Human adenovirus C
gugacaaagagacgcu

SEQ ID NO: 3915075 - RNA, 20 nt, Human adenovirus C
gugacacugcagcaggugcu

SEQ ID NO: 3915076 - RNA, 19 nt, Human adenovirus C
gugaccccgaagccccuca

SEQ ID NO: 3915077 - RNA, 16 nt, Human adenovirus C
gugaccgaggagcuga

SEQ ID NO: 3915078 - RNA, 18 nt, Human adenovirus C
gugacucuggauguucag

SEQ ID NO: 3915079 - RNA, 14 nt, Human adenovirus C
gugagcgcuccacc

SEQ ID NO: 3915080 - RNA, 16 nt, Human adenovirus C
gugaugccggcggcgg

SEQ ID NO: 3915081 - RNA, 13 nt, Human adenovirus C
gugaugcuggaug

SEQ ID NO: 3915082 - RNA, 21 nt, Human adenovirus C
gugauuauuuaccccccaccc

SEQ ID NO: 3915083 - RNA, 22 nt, Human adenovirus C
gugcacgaccccuggagaggga

SEQ ID NO: 3915084 - RNA, 13 nt, Human adenovirus C
gugcagcugaugg

SEQ ID NO: 3915085 - RNA, 19 nt, Human adenovirus C
gugccaaaaaucuuugagg

SEQ ID NO: 3915086 - RNA, 18 nt, Human adenovirus C
gugcccgugcgcacccgc

SEQ ID NO: 3915087 - RNA, 20 nt, Human adenovirus C
gugccgcggggacaggagga

SEQ ID NO: 3915088 - RNA, 17 nt, Human adenovirus C
gugcuggacagggggcc

SEQ ID NO: 3915089 - RNA, 21 nt, Human adenovirus C
gugcuuguagguuaccucugc

SEQ ID NO: 3915090 - RNA, 16 nt, Human adenovirus C
guggaacuugagggug

SEQ ID NO: 3915091 - RNA, 15 nt, Human adenovirus C
guggacuaaacuuug

SEQ ID NO: 3915092 - RNA, 18 nt, Human adenovirus C
guggacuauucugcugca

SEQ ID NO: 3915093 - RNA, 15 nt, Human adenovirus C
guggagaggcagagc

SEQ ID NO: 3915094 - RNA, 12 nt, Human adenovirus C
guggagcucugc

SEQ ID NO: 3915095 - RNA, 17 nt, Human adenovirus C
guggauuacccauuuga

SEQ ID NO: 3915096 - RNA, 19 nt, Human adenovirus C
guggccuugcaggcgcaga

SEQ ID NO: 3915097 - RNA, 13 nt, Human adenovirus C
guggcuguugaug

SEQ ID NO: 3915098 - RNA, 16 nt, Human adenovirus C
gugggcucguggugcu

SEQ ID NO: 3915099 - RNA, 13 nt, Human adenovirus C
guggucccggcgc

SEQ ID NO: 3915100 - RNA, 16 nt, Human adenovirus C
guggucgcgaaagguc

SEQ ID NO: 3915101 - RNA, 16 nt, Human adenovirus C
gugguggaggaggcgc

SEQ ID NO: 3915102 - RNA, 23 nt, Human adenovirus C
gugguuuuguacagugaagaugu

SEQ ID NO: 3915103 - RNA, 17 nt, Human adenovirus C
guguccacgcucgguga

SEQ ID NO: 3915104 - RNA, 16 nt, Human adenovirus C
guuaacuccuccucca

SEQ ID NO: 3915105 - RNA, 21 nt, Human adenovirus C
guuaagagagcugcagcugcc

SEQ ID NO: 3915106 - RNA, 19 nt, Human adenovirus C
guuagcgccugauuucugc

SEQ ID NO: 3915107 - RNA, 20 nt, Human adenovirus C
guucaggaauucugcccgcc

SEQ ID NO: 3915108 - RNA, 16 nt, Human adenovirus C
guucaucccuguggac

SEQ ID NO: 3915109 - RNA, 19 nt, Human adenovirus C
guuccucacagaccuguau

SEQ ID NO: 3915110 - RNA, 19 nt, Human adenovirus C
guuccuggugcagauguug

SEQ ID NO: 3915111 - RNA, 18 nt, Human adenovirus C
guuccuuauagugcagca

SEQ ID NO: 3915112 - RNA, 22 nt, Human adenovirus C
guuccuuauagugcagcacagc

SEQ ID NO: 3915113 - RNA, 16 nt, Human adenovirus C
guucugacagggccca

SEQ ID NO: 3915114 - RNA, 20 nt, Human adenovirus C
guucugguuccggaugaaaa

SEQ ID NO: 3915115 - RNA, 20 nt, Human adenovirus C
guugaucuccugaaucuggc

SEQ ID NO: 3915116 - RNA, 14 nt, Human adenovirus C
guugcauguggaaa

SEQ ID NO: 3915117 - RNA, 16 nt, Human adenovirus C
guuggacgcuggaaga

SEQ ID NO: 3915118 - RNA, 16 nt, Human adenovirus C
guuuaaggaaccagcu

SEQ ID NO: 3915119 - RNA, 20 nt, Human adenovirus C
guuugagcacaacauacuga

SEQ ID NO: 3915120 - RNA, 14 nt, Human adenovirus C
guuugccuuauuau

SEQ ID NO: 3915121 - RNA, 18 nt, Human adenovirus C
guuuugcgacccggcacc

SEQ ID NO: 3915122 - RNA, 19 nt, Human adenovirus C
guuuuggacgaggaggagg

SEQ ID NO: 3915123 - RNA, 15 nt, Human adenovirus C
uaaaagagguaucuu

SEQ ID NO: 3915124 - RNA, 20 nt, Human adenovirus C
uaaacauuccagcaccuuca

SEQ ID NO: 3915125 - RNA, 20 nt, Human adenovirus C
uaaagcaaaacuugaaggac

SEQ ID NO: 3915126 - RNA, 17 nt, Human adenovirus C
uaaagcaaggccugccc

SEQ ID NO: 3915127 - RNA, 22 nt, Human adenovirus C
uaaagcccgugacacugcagca

SEQ ID NO: 3915128 - RNA, 23 nt, Human adenovirus C
uaaaguccacaaaaaacacccag

SEQ ID NO: 3915129 - RNA, 22 nt, Human adenovirus C
uaacaggagggggguguuccua

SEQ ID NO: 3915130 - RNA, 12 nt, Human adenovirus C
uaaccaccaccg

SEQ ID NO: 3915131 - RNA, 23 nt, Human adenovirus C
uaaccuaaaugccaaccuaugga

SEQ ID NO: 3915132 - RNA, 18 nt, Human adenovirus C
uaacugacaccuaucaag

SEQ ID NO: 3915133 - RNA, 18 nt, Human adenovirus C
uaagcauaacauggugug

SEQ ID NO: 3915134 - RNA, 16 nt, Human adenovirus C
uaaguuugccacacaa

SEQ ID NO: 3915135 - RNA, 22 nt, Human adenovirus C
uaauagcgcccuucacggacag

SEQ ID NO: 3915136 - RNA, 18 nt, Human adenovirus C
uaaugucguuucucagca

SEQ ID NO: 3915137 - RNA, 21 nt, Human adenovirus C
uacaaauaggaucagacaaug

SEQ ID NO: 3915138 - RNA, 14 nt, Human adenovirus C
uacaacaaacagag

SEQ ID NO: 3915139 - RNA, 20 nt, Human adenovirus C
uacaagcuacccacccagcg

SEQ ID NO: 3915140 - RNA, 15 nt, Human adenovirus C
uacaagcuccucccg

SEQ ID NO: 3915141 - RNA, 14 nt, Human adenovirus C
uacaauuaccucag

SEQ ID NO: 3915142 - RNA, 16 nt, Human adenovirus C
uacagaggaggcuagg

SEQ ID NO: 3915143 - RNA, 22 nt, Human adenovirus C
uacagcccgggggaggcaagca

SEQ ID NO: 3915144 - RNA, 15 nt, Human adenovirus C
uacauuccagaaagc

SEQ ID NO: 3915145 - RNA, 13 nt, Human adenovirus C
uaccaucacggcg

SEQ ID NO: 3915146 - RNA, 22 nt, Human adenovirus C
uacccaccaccaguagcacuag

SEQ ID NO: 3915147 - RNA, 19 nt, Human adenovirus C
uaccccuucgaugaugccg

SEQ ID NO: 3915148 - RNA, 20 nt, Human adenovirus C
uaccggcaaccgccucagcu

SEQ ID NO: 3915149 - RNA, 17 nt, Human adenovirus C
uaccggcacuucuucuu

SEQ ID NO: 3915150 - RNA, 17 nt, Human adenovirus C
uaccgugaaugcccucc

SEQ ID NO: 3915151 - RNA, 20 nt, Human adenovirus C
uaccuaggucacuugcugac

SEQ ID NO: 3915152 - RNA, 15 nt, Human adenovirus C
uaccugagccccggg

SEQ ID NO: 3915153 - RNA, 13 nt, Human adenovirus C
uaccugcugacca

SEQ ID NO: 3915154 - RNA, 20 nt, Human adenovirus C
uaccuguguggaagccugga

SEQ ID NO: 3915155 - RNA, 22 nt, Human adenovirus C
aacgcucaucagugauauuaau

SEQ ID NO: 3915156 - RNA, 14 nt, Human adenovirus C
aacgcugggggcaa

SEQ ID NO: 3915157 - RNA, 21 nt, Human adenovirus C
aacggacuaucgcaacaccac

SEQ ID NO: 3915158 - RNA, 23 nt, Human adenovirus C
aacggauguggcaucccugaacu

SEQ ID NO: 3915159 - RNA, 18 nt, Human adenovirus C
aacggccgcuacgugccc

SEQ ID NO: 3915160 - RNA, 17 nt, Human adenovirus C
aacuaaaauuggcucug

SEQ ID NO: 3915161 - RNA, 22 nt, Human adenovirus C
aacucaggucaaaaaagcauuu

SEQ ID NO: 3915162 - RNA, 18 nt, Human adenovirus C
aacucccuuagaaccaaa

SEQ ID NO: 3915163 - RNA, 18 nt, Human adenovirus C
aacucuuacaccuucucc

SEQ ID NO: 3915164 - RNA, 18 nt, Human adenovirus C
aagaacuauggcagcaag

SEQ ID NO: 3915165 - RNA, 21 nt, Human adenovirus C
aagaacuauggcagcaaggcc

SEQ ID NO: 3915166 - RNA, 15 nt, Human adenovirus C
aagacagaaacacag

SEQ ID NO: 3915167 - RNA, 14 nt, Human adenovirus C
aagacauauuuccu

SEQ ID NO: 3915168 - RNA, 14 nt, Human adenovirus C
aagacugggacagc

SEQ ID NO: 3915169 - RNA, 22 nt, Human adenovirus C
aagagcuucuacaacgaccagg

SEQ ID NO: 3915170 - RNA, 13 nt, Human adenovirus C
aagcaagaccagg

SEQ ID NO: 3915171 - RNA, 13 nt, Human adenovirus C
aagcaaugacagc

SEQ ID NO: 3915172 - RNA, 12 nt, Human adenovirus C
aagcagcuggcc

SEQ ID NO: 3915173 - RNA, 12 nt, Human adenovirus C
aagcagggcuuc

SEQ ID NO: 3915174 - RNA, 17 nt, Human adenovirus C
aagcagguuccugagca

SEQ ID NO: 3915175 - RNA, 12 nt, Human adenovirus C
aagcaugaugca

SEQ ID NO: 3915176 - RNA, 14 nt, Human adenovirus C
aagcccgccaagag

SEQ ID NO: 3915177 - RNA, 15 nt, Human adenovirus C
aagcccgucucuggg

SEQ ID NO: 3915178 - RNA, 21 nt, Human adenovirus C
aagccgcucauggcgcagcug

SEQ ID NO: 3915179 - RNA, 12 nt, Human adenovirus C
aagccuggaccg

SEQ ID NO: 3915180 - RNA, 13 nt, Human adenovirus C
aagcuaaaauaca

SEQ ID NO: 3915181 - RNA, 12 nt, Human adenovirus C
aagcuaaaccug

SEQ ID NO: 3915182 - RNA, 19 nt, Human adenovirus C
aagcuaaugauggccgcag

SEQ ID NO: 3915183 - RNA, 13 nt, Human adenovirus C
aagcugcagcugc

SEQ ID NO: 3915184 - RNA, 14 nt, Human adenovirus C
aagcugcagcugcc

SEQ ID NO: 3915185 - RNA, 18 nt, Human adenovirus C
aagcuggcgucugugaga

SEQ ID NO: 3915186 - RNA, 22 nt, Human adenovirus C
aagcuuccgaggccgaagaggu

SEQ ID NO: 3915187 - RNA, 15 nt, Human adenovirus C
aaggccucaaggcgc

SEQ ID NO: 3915188 - RNA, 21 nt, Human adenovirus C
aaggccuggccaguguuugag

SEQ ID NO: 3915189 - RNA, 14 nt, Human adenovirus C
aaggcuacaggggc

SEQ ID NO: 3915190 - RNA, 15 nt, Human adenovirus C
aaggggguggugugu

SEQ ID NO: 3915191 - RNA, 20 nt, Human adenovirus C
aaggugguagauggccuggc

SEQ ID NO: 3915192 - RNA, 13 nt, Human adenovirus C
aagucacugugga

SEQ ID NO: 3915193 - RNA, 16 nt, Human adenovirus C
aagucuaagcagccgc

SEQ ID NO: 3915194 - RNA, 14 nt, Human adenovirus C
aaguuugccacaca

SEQ ID NO: 3915195 - RNA, 18 nt, Human adenovirus C
aaguuugccacacaaccu

SEQ ID NO: 3915196 - RNA, 21 nt, Human adenovirus C
aauaagccacacccagccaac

SEQ ID NO: 3915197 - RNA, 21 nt, Human adenovirus C
aauaauuuucaucucgccacc

SEQ ID NO: 3915198 - RNA, 22 nt, Human adenovirus C
aauaccuguguggaagccugga

SEQ ID NO: 3915199 - RNA, 17 nt, Human adenovirus C
aauacuaaaaaacugga

SEQ ID NO: 3915200 - RNA, 17 nt, Human adenovirus C
aauacugcgcgcugacu

SEQ ID NO: 3915201 - RNA, 14 nt, Human adenovirus C
aauaggcaaaaccg

SEQ ID NO: 3915202 - RNA, 21 nt, Human adenovirus C
aauauugcgcuguaccugcca

SEQ ID NO: 3915203 - RNA, 13 nt, Human adenovirus C
aauauuggcuacc

SEQ ID NO: 3915204 - RNA, 13 nt, Human adenovirus C
aaucaaacucaca

SEQ ID NO: 3915205 - RNA, 23 nt, Human adenovirus C
aauccacagcggcggcagcagca

SEQ ID NO: 3915206 - RNA, 21 nt, Human adenovirus C
aauccaguggacuaaacuuug

SEQ ID NO: 3915207 - RNA, 23 nt, Human adenovirus C
aaucuaacuuuuagcuuaaugac

SEQ ID NO: 3915208 - RNA, 19 nt, Human adenovirus C
aaugaaaaaauucauagau

SEQ ID NO: 3915209 - RNA, 16 nt, Human adenovirus C
aaugcagaaacacaag

SEQ ID NO: 3915210 - RNA, 15 nt, Human adenovirus C
aaugcaucaaacaau

SEQ ID NO: 3915211 - RNA, 14 nt, Human adenovirus C
aaugccuguuugaa

SEQ ID NO: 3915212 - RNA, 20 nt, Human adenovirus C
aaugggcccacgggcggcgg

SEQ ID NO: 3915213 - RNA, 14 nt, Human adenovirus C
aauucaccaccucc

SEQ ID NO: 3915214 - RNA, 12 nt, Human adenovirus C
aauucccacgcc

SEQ ID NO: 3915215 - RNA, 14 nt, Human adenovirus C
acccgcuguuccuu

SEQ ID NO: 3915216 - RNA, 16 nt, Human adenovirus C
acccggcacugccgcc

SEQ ID NO: 3915217 - RNA, 17 nt, Human adenovirus C
acccggcgccagcaccu

SEQ ID NO: 3915218 - RNA, 22 nt, Human adenovirus C
acccggcggugcgggcggcgcu

SEQ ID NO: 3915219 - RNA, 21 nt, Human adenovirus C
acccugcgucgcaaccaggaa

SEQ ID NO: 3915220 - RNA, 11 nt, Human adenovirus C
accgcagaccc

SEQ ID NO: 3915221 - RNA, 15 nt, Human adenovirus C
accgcagacccugcu

SEQ ID NO: 3915222 - RNA, 14 nt, Human adenovirus C
accgcggaugcugg

SEQ ID NO: 3915223 - RNA, 16 nt, Human adenovirus C
accgcgucacgcacga

SEQ ID NO: 3915224 - RNA, 15 nt, Human adenovirus C
accgcgucaggaggg

SEQ ID NO: 3915225 - RNA, 20 nt, Human adenovirus C
accgcucccuggucugcaau

SEQ ID NO: 3915226 - RNA, 23 nt, Human adenovirus C
accggagugcugggccagcacac

SEQ ID NO: 3915227 - RNA, 16 nt, Human adenovirus C
accguaaaccugagcc

SEQ ID NO: 3915228 - RNA, 15 nt, Human adenovirus C
accgucuggcugcuc

SEQ ID NO: 3915229 - RNA, 22 nt, Human adenovirus C
accguggcgggcggcagcgggu

SEQ ID NO: 3915230 - RNA, 23 nt, Human adenovirus C
accguggcgggcggcagcgggug

SEQ ID NO: 3915231 - RNA, 17 nt, Human adenovirus C
accuagaugugggagac

SEQ ID NO: 3915232 - RNA, 22 nt, Human adenovirus C
accucagcgccucccaaaagac

SEQ ID NO: 3915233 - RNA, 21 nt, Human adenovirus C
accugcgcugggccccaagcc

SEQ ID NO: 3915234 - RNA, 14 nt, Human adenovirus C
accugcggggcgau

SEQ ID NO: 3915235 - RNA, 20 nt, Human adenovirus C
accugcuuuacggauuuguc

SEQ ID NO: 3915236 - RNA, 19 nt, Human adenovirus C
accuggccaaccaggcagu

SEQ ID NO: 3915237 - RNA, 13 nt, Human adenovirus C
accugugcugcca

SEQ ID NO: 3915238 - RNA, 19 nt, Human adenovirus C
accuguguggaagccugga

SEQ ID NO: 3915239 - RNA, 13 nt, Human adenovirus C
accuucaaaucaa

SEQ ID NO: 3915240 - RNA, 22 nt, Human adenovirus C
accuugagcgacgaccugggcg

SEQ ID NO: 3915241 - RNA, 21 nt, Human adenovirus C
acgaacccguaucgacccgcg

SEQ ID NO: 3915242 - RNA, 22 nt, Human adenovirus C
acgaaggaggcguaggagucgc

SEQ ID NO: 3915243 - RNA, 13 nt, Human adenovirus C
acgagcauacuuu

SEQ ID NO: 3915244 - RNA, 17 nt, Human adenovirus C
acgagcggccgccgcag

SEQ ID NO: 3915245 - RNA, 23 nt, Human adenovirus C
acgaggaggaauacugggacagu

SEQ ID NO: 3915246 - RNA, 13 nt, Human adenovirus C
acgcacgaaggag

SEQ ID NO: 3915247 - RNA, 11 nt, Human adenovirus C
acgccaagaaa

SEQ ID NO: 3915248 - RNA, 22 nt, Human adenovirus C
acgccaccguuuuuacccaccc

SEQ ID NO: 3915249 - RNA, 16 nt, Human adenovirus C
acgcccaacucgcgcc

SEQ ID NO: 3915250 - RNA, 15 nt, Human adenovirus C
acgcccacgccgcca

SEQ ID NO: 3915251 - RNA, 16 nt, Human adenovirus C
acgcccacgccgccac

SEQ ID NO: 3915252 - RNA, 17 nt, Human adenovirus C
acgcccuacauguggag

SEQ ID NO: 3915253 - RNA, 12 nt, Human adenovirus C
acgcccuucucg

SEQ ID NO: 3915254 - RNA, 20 nt, Human adenovirus C
acgccucggaguaccugagc

SEQ ID NO: 3915255 - RNA, 22 nt, Human adenovirus C
acgccugcuuaaaacccugcaa

SEQ ID NO: 3915256 - RNA, 13 nt, Human adenovirus C
acgcgacgagaaa

SEQ ID NO: 3915257 - RNA, 16 nt, Human adenovirus C
acgcgcccuggaggca

SEQ ID NO: 3915258 - RNA, 13 nt, Human adenovirus C
acgcgcgcgcagc

SEQ ID NO: 3915259 - RNA, 13 nt, Human adenovirus C
acgcggcggcaga

SEQ ID NO: 3915260 - RNA, 21 nt, Human adenovirus C
acgcgggcgcugaccugcgcu

SEQ ID NO: 3915261 - RNA, 19 nt, Human adenovirus C
acgcggguuuggcagggcg

SEQ ID NO: 3915262 - RNA, 19 nt, Human adenovirus C
acgcggugguggaggaggc

SEQ ID NO: 3915263 - RNA, 23 nt, Human adenovirus C
acgcuggaccugccuccccccgc

SEQ ID NO: 3915264 - RNA, 21 nt, Human adenovirus C
acgcugguggcuaccucuccg

SEQ ID NO: 3915265 - RNA, 22 nt, Human adenovirus C
acgcugguggcuaccucuccgc

SEQ ID NO: 3915266 - RNA, 17 nt, Human adenovirus C
acggaggauaggguggc

SEQ ID NO: 3915267 - RNA, 16 nt, Human adenovirus C
gaaugagcuccacagg

SEQ ID NO: 3915268 - RNA, 13 nt, Human adenovirus C
gaauucauucaga

SEQ ID NO: 3915269 - RNA, 14 nt, Human adenovirus C
gaauuguugcuaca

SEQ ID NO: 3915270 - RNA, 18 nt, Human adenovirus C
gaauuugaagagcuuuug

SEQ ID NO: 3915271 - RNA, 15 nt, Human adenovirus C
gacaaaagaacccac

SEQ ID NO: 3915272 - RNA, 18 nt, Human adenovirus C
gacaaagcccaagaaauc

SEQ ID NO: 3915273 - RNA, 17 nt, Human adenovirus C
gacacagaaaccgggcc

SEQ ID NO: 3915274 - RNA, 15 nt, Human adenovirus C
gacacaugucgcccu

SEQ ID NO: 3915275 - RNA, 16 nt, Human adenovirus C
gacaccuccgcaccac

SEQ ID NO: 3915276 - RNA, 22 nt, Human adenovirus C
gacacugcagcaggugcugccc

SEQ ID NO: 3915277 - RNA, 22 nt, Human adenovirus C
gacaugcagggcacccuccccu

SEQ ID NO: 3915278 - RNA, 13 nt, Human adenovirus C
gaccaaaacggug

SEQ ID NO: 3915279 - RNA, 16 nt, Human adenovirus C
gaccaaccggcggcag

SEQ ID NO: 3915280 - RNA, 20 nt, Human adenovirus C
gacccgccgggagagggggc

SEQ ID NO: 3915281 - RNA, 18 nt, Human adenovirus C
gacccuccuuugcacucc

SEQ ID NO: 3915282 - RNA, 17 nt, Human adenovirus C
gacccuggugcugccaa

SEQ ID NO: 3915283 - RNA, 17 nt, Human adenovirus C
gaccgauguaaggguuc

SEQ ID NO: 3915284 - RNA, 12 nt, Human adenovirus C
gaccgccugcuu

SEQ ID NO: 3915285 - RNA, 19 nt, Human adenovirus C
gaccgcgagcugaugcaca

SEQ ID NO: 3915286 - RNA, 12 nt, Human adenovirus C
gaccugcgcugg

SEQ ID NO: 3915287 - RNA, 14 nt, Human adenovirus C
gaccugcgcugggc

SEQ ID NO: 3915288 - RNA, 12 nt, Human adenovirus C
gaccugcuugag

SEQ ID NO: 3915289 - RNA, 16 nt, Human adenovirus C
gacgacuggcgccagg

SEQ ID NO: 3915290 - RNA, 15 nt, Human adenovirus C
gacgagcggccgccg

SEQ ID NO: 3915291 - RNA, 23 nt, Human adenovirus C
gacgaggaccugcuugagcaggc

SEQ ID NO: 3915292 - RNA, 18 nt, Human adenovirus C
gacgcgcccuggaggcag

SEQ ID NO: 3915293 - RNA, 21 nt, Human adenovirus C
gacgcgcccuggaggcagcug

SEQ ID NO: 3915294 - RNA, 22 nt, Human adenovirus C
gacgcggcgguugaucuccuga

SEQ ID NO: 3915295 - RNA, 18 nt, Human adenovirus C
gacgcguuccggcagcag

SEQ ID NO: 3915296 - RNA, 15 nt, Human adenovirus C
gacgcucggugcgag

SEQ ID NO: 3915297 - RNA, 19 nt, Human adenovirus C
gacggccugguaggcgcag

SEQ ID NO: 3915298 - RNA, 18 nt, Human adenovirus C
gacggcggccuggcgcaa

SEQ ID NO: 3915299 - RNA, 15 nt, Human adenovirus C
gacgugguaaaggug

SEQ ID NO: 3915300 - RNA, 19 nt, Human adenovirus C
gacucagggucgcaggggc

SEQ ID NO: 3915301 - RNA, 18 nt, Human adenovirus C
gacucggcagacgacagc

SEQ ID NO: 3915302 - RNA, 13 nt, Human adenovirus C
gacucugacaaag

SEQ ID NO: 3915303 - RNA, 20 nt, Human adenovirus C
gacugcagccuccgccgccg

SEQ ID NO: 3915304 - RNA, 18 nt, Human adenovirus C
gacugcgcguaacccuga

SEQ ID NO: 3915305 - RNA, 17 nt, Human adenovirus C
gacugggcgugcagacc

SEQ ID NO: 3915306 - RNA, 17 nt, Human adenovirus C
gacugguuccuggugca

SEQ ID NO: 3915307 - RNA, 22 nt, Human adenovirus C
gacugugguugcuucaugcuag

SEQ ID NO: 3915308 - RNA, 19 nt, Human adenovirus C
gacuugagaggccuguccu

SEQ ID NO: 3915309 - RNA, 15 nt, Human adenovirus C
gacuugcggcuggag

SEQ ID NO: 3915310 - RNA, 14 nt, Human adenovirus C
gacuuggaggagcg

SEQ ID NO: 3915311 - RNA, 13 nt, Human adenovirus C
gacuuggaggagg

SEQ ID NO: 3915312 - RNA, 19 nt, Human adenovirus C
gacuuugcuuuccugagcc

SEQ ID NO: 3915313 - RNA, 19 nt, Human adenovirus C
gacuuuguaagcgcgcugg

SEQ ID NO: 3915314 - RNA, 20 nt, Human adenovirus C
gagagcucgguguaccugag

SEQ ID NO: 3915315 - RNA, 15 nt, Human adenovirus C
gagagcugcagcugc

SEQ ID NO: 3915316 - RNA, 11 nt, Human adenovirus C
gagaggccugu

SEQ ID NO: 3915317 - RNA, 17 nt, Human adenovirus C
gagaguucgacagaauc

SEQ ID NO: 3915318 - RNA, 22 nt, Human adenovirus C
gagauacuacauggacaaaaga

SEQ ID NO: 3915319 - RNA, 15 nt, Human adenovirus C
gagauugagcuccac

SEQ ID NO: 3915320 - RNA, 13 nt, Human adenovirus C
gagcagacgguga

SEQ ID NO: 3915321 - RNA, 20 nt, Human adenovirus C
gagcauaguggugcaggagc

SEQ ID NO: 3915322 - RNA, 17 nt, Human adenovirus C
gagccaggugagcucug

SEQ ID NO: 3915323 - RNA, 12 nt, Human adenovirus C
gagcccacccuu

SEQ ID NO: 3915324 - RNA, 20 nt, Human adenovirus C
caccgggacugggcgugcag

SEQ ID NO: 3915325 - RNA, 15 nt, Human adenovirus C
caccgucacccagca

SEQ ID NO: 3915326 - RNA, 19 nt, Human adenovirus C
caccgucgcaugcgcggcg

SEQ ID NO: 3915327 - RNA, 13 nt, Human adenovirus C
caccuacagccug

SEQ ID NO: 3915328 - RNA, 19 nt, Human adenovirus C
caccuaugacaagcgcuuu

SEQ ID NO: 3915329 - RNA, 17 nt, Human adenovirus C
caccuauuaccggcugc

SEQ ID NO: 3915330 - RNA, 16 nt, Human adenovirus C
caccuccgcaccacuu

SEQ ID NO: 3915331 - RNA, 21 nt, Human adenovirus C
caccucuggggauggcgggcg

SEQ ID NO: 3915332 - RNA, 19 nt, Human adenovirus C
caccuguucucaccgcgcg

SEQ ID NO: 3915333 - RNA, 24 nt, Human adenovirus C
caccuucuuccccauggcccacaa

SEQ ID NO: 3915334 - RNA, 15 nt, Human adenovirus C
caccuuucgccaggg

SEQ ID NO: 3915335 - RNA, 22 nt, Human adenovirus C
caccuuuuguuccaccgcucug

SEQ ID NO: 3915336 - RNA, 21 nt, Human adenovirus C
cacgagccaggugagcucugg

SEQ ID NO: 3915337 - RNA, 21 nt, Human adenovirus C
cacgcacgaaggaggcguagg

SEQ ID NO: 3915338 - RNA, 22 nt, Human adenovirus C
cacgcagacacgaucggcaggc

SEQ ID NO: 3915339 - RNA, 15 nt, Human adenovirus C
cacgcagcaccuugc

SEQ ID NO: 3915340 - RNA, 13 nt, Human adenovirus C
cacgcccccuucg

SEQ ID NO: 3915341 - RNA, 19 nt, Human adenovirus C
cacgccgccaccagugucc

SEQ ID NO: 3915342 - RNA, 18 nt, Human adenovirus C
cacgcucaagggcgaggc

SEQ ID NO: 3915343 - RNA, 14 nt, Human adenovirus C
cacgcuggccagca

SEQ ID NO: 3915344 - RNA, 13 nt, Human adenovirus C
cacggacgaggag

SEQ ID NO: 3915345 - RNA, 16 nt, Human adenovirus C
cacggacgaggaggaa

SEQ ID NO: 3915346 - RNA, 19 nt, Human adenovirus C
cacggugaaggggugcgcu

SEQ ID NO: 3915347 - RNA, 12 nt, Human adenovirus C
ccggcaccaccg

SEQ ID NO: 3915348 - RNA, 13 nt, Human adenovirus C
ccggcccaggggc

SEQ ID NO: 3915349 - RNA, 15 nt, Human adenovirus C
ccggcccaggggcgu

SEQ ID NO: 3915350 - RNA, 19 nt, Human adenovirus C
ccggcccgaugaggccggc

SEQ ID NO: 3915351 - RNA, 20 nt, Human adenovirus C
ccggcccgaugaggccggcc

SEQ ID NO: 3915352 - RNA, 17 nt, Human adenovirus C
ccggccggacugcggcg

SEQ ID NO: 3915353 - RNA, 16 nt, Human adenovirus C
ccggccuuaacuccac

SEQ ID NO: 3915354 - RNA, 12 nt, Human adenovirus C
ccggcggcagaa

SEQ ID NO: 3915355 - RNA, 13 nt, Human adenovirus C
ccggcggcggugg

SEQ ID NO: 3915356 - RNA, 17 nt, Human adenovirus C
ccggcuaugcacugcag

SEQ ID NO: 3915357 - RNA, 18 nt, Human adenovirus C
ccggcucaccacccaggu

SEQ ID NO: 3915358 - RNA, 17 nt, Human adenovirus C
ccgggagagggggcagg

SEQ ID NO: 3915359 - RNA, 16 nt, Human adenovirus C
ccgggccuccaacugu

SEQ ID NO: 3915360 - RNA, 17 nt, Human adenovirus C
ccgggcgaagacggcgu

SEQ ID NO: 3915361 - RNA, 12 nt, Human adenovirus C
ccgggcugcgcg

SEQ ID NO: 3915362 - RNA, 23 nt, Human adenovirus C
ccggggaguaggcauccgcgccg

SEQ ID NO: 3915363 - RNA, 19 nt, Human adenovirus C
ccgggucagggcgcgggcu

SEQ ID NO: 3915364 - RNA, 22 nt, Human adenovirus C
ccguagaggagccuccaccggc

SEQ ID NO: 3915365 - RNA, 23 nt, Human adenovirus C
ccguaucgacccgcgagcuuaga

SEQ ID NO: 3915366 - RNA, 15 nt, Human adenovirus C
ccguccugcaggaau

SEQ ID NO: 3915367 - RNA, 17 nt, Human adenovirus C
ccgugcacgaccccugg

SEQ ID NO: 3915368 - RNA, 18 nt, Human adenovirus C
ccgugcacgaccccugga

SEQ ID NO: 3915369 - RNA, 16 nt, Human adenovirus C
ccgugcuuucacuuuc

SEQ ID NO: 3915370 - RNA, 11 nt, Human adenovirus C
ccguggagaca

SEQ ID NO: 3915371 - RNA, 20 nt, Human adenovirus C
ccguggagcuugagugcaug

SEQ ID NO: 3915372 - RNA, 15 nt, Human adenovirus C
ccguggucuggugga

SEQ ID NO: 3915373 - RNA, 22 nt, Human adenovirus C
ccguguucugacagggcccagu

SEQ ID NO: 3915374 - RNA, 22 nt, Human adenovirus C
ccguucaugggaaacuggcaag

SEQ ID NO: 3915375 - RNA, 17 nt, Human adenovirus C
ccguucgcacuggggcg

SEQ ID NO: 3915376 - RNA, 16 nt, Human adenovirus C
ccuaaaaaugucuuuc

SEQ ID NO: 3915377 - RNA, 12 nt, Human adenovirus C
ccuacugcaccg

SEQ ID NO: 3915378 - RNA, 23 nt, Human adenovirus C
ccuacuuucccagugcccgcugu

SEQ ID NO: 3915379 - RNA, 19 nt, Human adenovirus C
ccuauaccuuuuuaaugca

SEQ ID NO: 3915380 - RNA, 19 nt, Human adenovirus C
ccuaucagcagccgcgggc

SEQ ID NO: 3915381 - RNA, 16 nt, Human adenovirus C
ccucacccgcagcugc

SEQ ID NO: 3915382 - RNA, 15 nt, Human adenovirus C
ccucaggcgccgccg

SEQ ID NO: 3915383 - RNA, 22 nt, Human adenovirus C
ccuccgacugugguugcuucau

SEQ ID NO: 3915384 - RNA, 14 nt, Human adenovirus C
ccuccgcacccacu

SEQ ID NO: 3915385 - RNA, 18 nt, Human adenovirus C
ccuccgggcacagcagcg

SEQ ID NO: 3915386 - RNA, 16 nt, Human adenovirus C
ccuccucaccugccgg

SEQ ID NO: 3915387 - RNA, 15 nt, Human adenovirus C
ccuccucagcagcgg

SEQ ID NO: 3915388 - RNA, 19 nt, Human adenovirus C
ccuccuccugccaggcuca

SEQ ID NO: 3915389 - RNA, 12 nt, Human adenovirus C
ccuccugccagg

SEQ ID NO: 3915390 - RNA, 13 nt, Human adenovirus C
ccuccugccaggc

SEQ ID NO: 3915391 - RNA, 21 nt, Human adenovirus C
ccucgaccacugccgccgcca

SEQ ID NO: 3915392 - RNA, 21 nt, Human adenovirus C
ccucgcauagccgggucaggg

SEQ ID NO: 3915393 - RNA, 19 nt, Human adenovirus C
ccucggcgguggcagaugc

SEQ ID NO: 3915394 - RNA, 23 nt, Human adenovirus C
ccucgucagcguagucuggguca

SEQ ID NO: 3915395 - RNA, 19 nt, Human adenovirus C
ccugaacgggguguuugac

SEQ ID NO: 3915396 - RNA, 20 nt, Human adenovirus C
ccugaagcgccgacgaugcu

SEQ ID NO: 3915397 - RNA, 14 nt, Human adenovirus C
ccugacgggcggca

SEQ ID NO: 3915398 - RNA, 19 nt, Human adenovirus C
ccugagcaacuuguugggc

SEQ ID NO: 3915399 - RNA, 12 nt, Human adenovirus C
ccugagcagcug

SEQ ID NO: 3915400 - RNA, 13 nt, Human adenovirus C
ccugagcagcugc

SEQ ID NO: 3915401 - RNA, 18 nt, Human adenovirus C
ccugauuucugccagcgc

SEQ ID NO: 3915402 - RNA, 23 nt, Human adenovirus C
ccugcaaagggcccuggcuggca

SEQ ID NO: 3915403 - RNA, 21 nt, Human adenovirus C
ccugcacgucuagggcgcagu

SEQ ID NO: 3915404 - RNA, 12 nt, Human adenovirus C
ccugcacuuccc

SEQ ID NO: 3915405 - RNA, 21 nt, Human adenovirus C
ccugcgccguagcgccauugc

SEQ ID NO: 3915406 - RNA, 22 nt, Human adenovirus C
ccugcgucauuacccagggcca

SEQ ID NO: 3915407 - RNA, 14 nt, Human adenovirus C
ccugcugcaccugc

SEQ ID NO: 3915408 - RNA, 15 nt, Human adenovirus C
ccugcugcaccugcg

SEQ ID NO: 3915409 - RNA, 17 nt, Human adenovirus C
ccugcugugcgcuuccu

SEQ ID NO: 3915410 - RNA, 20 nt, Human adenovirus C
ccuggaacagcagcacaggc

SEQ ID NO: 3915411 - RNA, 20 nt, Human adenovirus C
ccuggcaaacggccaugggc

SEQ ID NO: 3915412 - RNA, 12 nt, Human adenovirus C
ccuggcgcggcu

SEQ ID NO: 3915413 - RNA, 23 nt, Human adenovirus C
ccugggcauagucucgccgcgcg

SEQ ID NO: 3915414 - RNA, 12 nt, Human adenovirus C
ccugucccuuuu

SEQ ID NO: 3915415 - RNA, 16 nt, Human adenovirus C
ccugucgucagcgcca

SEQ ID NO: 3915416 - RNA, 18 nt, Human adenovirus C
ccuuacuacaccuacucu

SEQ ID NO: 3915417 - RNA, 16 nt, Human adenovirus C
ccuuacuuuaucucaa

SEQ ID NO: 3915418 - RNA, 13 nt, Human adenovirus C
ccuucagcugggg

SEQ ID NO: 3915419 - RNA, 22 nt, Human adenovirus C
ccuuccccgucgaggcaccccc

SEQ ID NO: 3915420 - RNA, 19 nt, Human adenovirus C
ccuucgcagggccagcuga

SEQ ID NO: 3915421 - RNA, 16 nt, Human adenovirus C
ccuucugcagcuagcc

SEQ ID NO: 3915422 - RNA, 12 nt, Human adenovirus C
ccuugcaggcgc

SEQ ID NO: 3915423 - RNA, 16 nt, Human adenovirus C
ccuugcggcagucugc

SEQ ID NO: 3915424 - RNA, 23 nt, Human adenovirus C
ccuugcuagacugcuccuucagc

SEQ ID NO: 3915425 - RNA, 22 nt, Human adenovirus C
ccuuguccuccgggcacagcag

SEQ ID NO: 3915426 - RNA, 22 nt, Human adenovirus C
ccuuucuaccggcacuucuucu

SEQ ID NO: 3915427 - RNA, 15 nt, Human adenovirus C
ccuuuggacaccucc

SEQ ID NO: 3915428 - RNA, 13 nt, Human adenovirus C
ccuuuuacugcug

SEQ ID NO: 3915429 - RNA, 22 nt, Human adenovirus C
ccuuuucuggaccucccggcca

SEQ ID NO: 3915430 - RNA, 21 nt, Human adenovirus C
cgaaccuuuggacaccuccca

SEQ ID NO: 3915431 - RNA, 20 nt, Human adenovirus C
cgaaggcucgcguccaggcc

SEQ ID NO: 3915432 - RNA, 13 nt, Human adenovirus C
cgaaguaaguuug

SEQ ID NO: 3915433 - RNA, 15 nt, Human adenovirus C
cgaaugagcuccaca

SEQ ID NO: 3915434 - RNA, 14 nt, Human adenovirus C
cgaccacagcaacu

SEQ ID NO: 3915435 - RNA, 16 nt, Human adenovirus C
cgaccggcaaggcaau

SEQ ID NO: 3915436 - RNA, 22 nt, Human adenovirus C
cgacgggccgaacacucgugcu

SEQ ID NO: 3915437 - RNA, 18 nt, Human adenovirus C
cgacuacgguaccgcgcg

SEQ ID NO: 3915438 - RNA, 15 nt, Human adenovirus C
cgacuggcgccaggu

SEQ ID NO: 3915439 - RNA, 22 nt, Human adenovirus C
cgacuggcgccaggucauggac

SEQ ID NO: 3915440 - RNA, 15 nt, Human adenovirus C
cgagaaggaggacag

SEQ ID NO: 3915441 - RNA, 19 nt, Human adenovirus C
cgagacguacuucagccug

SEQ ID NO: 3915442 - RNA, 16 nt, Human adenovirus C
cgagcccaaaguccag

SEQ ID NO: 3915443 - RNA, 21 nt, Human adenovirus C
cgaggagcugaggcccgauca

SEQ ID NO: 3915444 - RNA, 19 nt, Human adenovirus C
cgaggaugaagaagaggaa

SEQ ID NO: 3915445 - RNA, 14 nt, Human adenovirus C
cgaggcagcggcag

SEQ ID NO: 3915446 - RNA, 16 nt, Human adenovirus C
cgaggcagcggcagaa

SEQ ID NO: 3915447 - RNA, 17 nt, Human adenovirus C
cgaggccguggcgcagc

SEQ ID NO: 3915448 - RNA, 21 nt, Human adenovirus C
cgagggacaggcuuaccccgc

SEQ ID NO: 3915449 - RNA, 12 nt, Human adenovirus C
cgagggccagcu

SEQ ID NO: 3915450 - RNA, 17 nt, Human adenovirus C
cgagguggaacugcugc

SEQ ID NO: 3915451 - RNA, 13 nt, Human adenovirus C
cggaggugcugcu

SEQ ID NO: 3915452 - RNA, 16 nt, Human adenovirus C
cggaggugcugcugau

SEQ ID NO: 3915453 - RNA, 22 nt, Human adenovirus C
cggauagcaagacucugacaaa

SEQ ID NO: 3915454 - RNA, 18 nt, Human adenovirus C
cggcagcggcagcaacag

SEQ ID NO: 3915455 - RNA, 21 nt, Human adenovirus C
cggcagucugcagcgcugcca

SEQ ID NO: 3915456 - RNA, 21 nt, Human adenovirus C
cggcaugcgucgugcgcacca

SEQ ID NO: 3915457 - RNA, 18 nt, Human adenovirus C
cggccaaucaagcaggug

SEQ ID NO: 3915458 - RNA, 13 nt, Human adenovirus C
cggccgcacuggg

SEQ ID NO: 3915459 - RNA, 16 nt, Human adenovirus C
cggccgccgcagcagc

SEQ ID NO: 3915460 - RNA, 21 nt, Human adenovirus C
cggccugguaggcgcagcauc

SEQ ID NO: 3915461 - RNA, 19 nt, Human adenovirus C
cggcgacaccuuugccaca

SEQ ID NO: 3915462 - RNA, 20 nt, Human adenovirus C
cggcgacaccuuugccacac

SEQ ID NO: 3915463 - RNA, 20 nt, Human adenovirus C
cggcgacagugucgcgcacc

SEQ ID NO: 3915464 - RNA, 18 nt, Human adenovirus C
cggcgacgacggcgcacc

SEQ ID NO: 3915465 - RNA, 14 nt, Human adenovirus C
cggcgccagcaccu

SEQ ID NO: 3915466 - RNA, 12 nt, Human adenovirus C
cggcgccagugg

SEQ ID NO: 3915467 - RNA, 14 nt, Human adenovirus C
cggcgcugcagagc

SEQ ID NO: 3915468 - RNA, 13 nt, Human adenovirus C
cggcggcagcagc

SEQ ID NO: 3915469 - RNA, 18 nt, Human adenovirus C
cggcgggcggugggccgc

SEQ ID NO: 3915470 - RNA, 16 nt, Human adenovirus C
cggcggugcgggcggc

SEQ ID NO: 3915471 - RNA, 20 nt, Human adenovirus C
cggcguaguuucgcaggcgc

SEQ ID NO: 3915472 - RNA, 17 nt, Human adenovirus C
cggcuaugcacugcagg

SEQ ID NO: 3915473 - RNA, 17 nt, Human adenovirus C
cggcucaccacccaggu

SEQ ID NO: 3915474 - RNA, 17 nt, Human adenovirus C
cggcugaagcagggcca

SEQ ID NO: 3915475 - RNA, 20 nt, Human adenovirus C
cggcugaagcagggccaggu

SEQ ID NO: 3915476 - RNA, 15 nt, Human adenovirus C
gagcccacccuucuu

SEQ ID NO: 3915477 - RNA, 14 nt, Human adenovirus C
gagccccgggcugg

SEQ ID NO: 3915478 - RNA, 19 nt, Human adenovirus C
gagcccgaggagaugcggg

SEQ ID NO: 3915479 - RNA, 15 nt, Human adenovirus C
gagcccguguucuga

SEQ ID NO: 3915480 - RNA, 12 nt, Human adenovirus C
gagccggcggcg

SEQ ID NO: 3915481 - RNA, 17 nt, Human adenovirus C
gagcgcaggguuugguu

SEQ ID NO: 3915482 - RNA, 21 nt, Human adenovirus C
gagcgcauccacaaggccgug

SEQ ID NO: 3915483 - RNA, 19 nt, Human adenovirus C
gagcgcuccuuuuggcuuc

SEQ ID NO: 3915484 - RNA, 15 nt, Human adenovirus C
gagcgguggcgccuu

SEQ ID NO: 3915485 - RNA, 13 nt, Human adenovirus C
gagcucaacuccc

SEQ ID NO: 3915486 - RNA, 21 nt, Human adenovirus C
gagcucggcgacagugucgcg

SEQ ID NO: 3915487 - RNA, 14 nt, Human adenovirus C
gagcuuagaaauag

SEQ ID NO: 3915488 - RNA, 16 nt, Human adenovirus C
gagcuugaucugcugg

SEQ ID NO: 3915489 - RNA, 17 nt, Human adenovirus C
gaggaagguccuccucc

SEQ ID NO: 3915490 - RNA, 21 nt, Human adenovirus C
gaggaagguccuccucccucc

SEQ ID NO: 3915491 - RNA, 23 nt, Human adenovirus C
gaggaccugcuugagcaggccaa

SEQ ID NO: 3915492 - RNA, 15 nt, Human adenovirus C
gaggagcucaaccca

SEQ ID NO: 3915493 - RNA, 16 nt, Human adenovirus C
gaggaggaauacuggg

SEQ ID NO: 3915494 - RNA, 19 nt, Human adenovirus C
gaggaggacuuugagcccg

SEQ ID NO: 3915495 - RNA, 16 nt, Human adenovirus C
gaggcauucagggaug

SEQ ID NO: 3915496 - RNA, 17 nt, Human adenovirus C
gaggccggccuggucua

SEQ ID NO: 3915497 - RNA, 20 nt, Human adenovirus C
gagggcaacccaacaccuag

SEQ ID NO: 3915498 - RNA, 16 nt, Human adenovirus C
gagggccgcuggcugc

SEQ ID NO: 3915499 - RNA, 21 nt, Human adenovirus C
gagggcuuuaggaucaccuac

SEQ ID NO: 3915500 - RNA, 15 nt, Human adenovirus C
gaguauaauaaauac

SEQ ID NO: 3915501 - RNA, 15 nt, Human adenovirus C
gagucggugagcucc

SEQ ID NO: 3915502 - RNA, 21 nt, Human adenovirus C
gagucuccagauaucaaccca

SEQ ID NO: 3915503 - RNA, 19 nt, Human adenovirus C
gagugggaauuugagcccc

SEQ ID NO: 3915504 - RNA, 17 nt, Human adenovirus C
gauacacuaacaguagu

SEQ ID NO: 3915505 - RNA, 13 nt, Human adenovirus C
gauagcggccggg

SEQ ID NO: 3915506 - RNA, 15 nt, Human adenovirus C
gaucaccucugggga

SEQ ID NO: 3915507 - RNA, 16 nt, Human adenovirus C
gaucaucuccccgcgg

SEQ ID NO: 3915508 - RNA, 20 nt, Human adenovirus C
gaucgcacccuuuggcgcau

SEQ ID NO: 3915509 - RNA, 20 nt, Human adenovirus C
gaucucuuccuccuggagau

SEQ ID NO: 3915510 - RNA, 14 nt, Human adenovirus C
gaucugcuggcgca

SEQ ID NO: 3915511 - RNA, 20 nt, Human adenovirus C
gaugaaaagaaaaugccuug

SEQ ID NO: 3915512 - RNA, 16 nt, Human adenovirus C
gaugaagaugaagaag

SEQ ID NO: 3915513 - RNA, 14 nt, Human adenovirus C
gaugcacagccugc

SEQ ID NO: 3915514 - RNA, 14 nt, Human adenovirus C
gaugcgccccccuc

SEQ ID NO: 3915515 - RNA, 17 nt, Human adenovirus C
gauggcaaugggcccac

SEQ ID NO: 3915516 - RNA, 22 nt, Human adenovirus C
gauggcaaugggcccacgggcg

SEQ ID NO: 3915517 - RNA, 15 nt, Human adenovirus C
gauggcgcaggcggc

SEQ ID NO: 3915518 - RNA, 16 nt, Human adenovirus C
gauguaaauauggaaa

SEQ ID NO: 3915519 - RNA, 21 nt, Human adenovirus C
gauguaauuaaaguaggcggu

SEQ ID NO: 3915520 - RNA, 14 nt, Human adenovirus C
gauguuaacauggu

SEQ ID NO: 3915521 - RNA, 14 nt, Human adenovirus C
gauguuguggccca

SEQ ID NO: 3915522 - RNA, 13 nt, Human adenovirus C
gauuaaacauggc

SEQ ID NO: 3915523 - RNA, 20 nt, Human adenovirus C
gauucaucaaacaacaugga

SEQ ID NO: 3915524 - RNA, 23 nt, Human adenovirus C
gauuucugccagcgccugcacug

SEQ ID NO: 3915525 - RNA, 13 nt, Human adenovirus C
gcaacaagaaaac

SEQ ID NO: 3915526 - RNA, 18 nt, Human adenovirus C
gcaacaucaacaacagcu

SEQ ID NO: 3915527 - RNA, 15 nt, Human adenovirus C
gcaaccaccgcuccu

SEQ ID NO: 3915528 - RNA, 23 nt, Human adenovirus C
agugguuuuguacagugaagaug

SEQ ID NO: 3915529 - RNA, 23 nt, Human adenovirus C
aguguaaaaagggccaaguacag

SEQ ID NO: 3915530 - RNA, 11 nt, Human adenovirus C
agugucacugu

SEQ ID NO: 3915531 - RNA, 23 nt, Human adenovirus C
agugucagccgcgcgcuggggca

SEQ ID NO: 3915532 - RNA, 14 nt, Human adenovirus C
agugucaugccaaa

SEQ ID NO: 3915533 - RNA, 15 nt, Human adenovirus C
aguuaagagagcugc

SEQ ID NO: 3915534 - RNA, 15 nt, Human adenovirus C
aguuaccagccacaa

SEQ ID NO: 3915535 - RNA, 23 nt, Human adenovirus C
aguucaugucgcuguccagcugc

SEQ ID NO: 3915536 - RNA, 17 nt, Human adenovirus C
aguucuugcaaggaagc

SEQ ID NO: 3915537 - RNA, 16 nt, Human adenovirus C
aguuggcccgcugccc

SEQ ID NO: 3915538 - RNA, 20 nt, Human adenovirus C
aguuguaguauauccacucu

SEQ ID NO: 3915539 - RNA, 20 nt, Human adenovirus C
aguuuaaaugggaugucaaa

SEQ ID NO: 3915540 - RNA, 17 nt, Human adenovirus C
auaaacacgcuggacau

SEQ ID NO: 3915541 - RNA, 17 nt, Human adenovirus C
auaaacauuccagcacc

SEQ ID NO: 3915542 - RNA, 15 nt, Human adenovirus C
auaaggugggggucu

SEQ ID NO: 3915543 - RNA, 23 nt, Human adenovirus C
auacaaccccaccaauguggaaa

SEQ ID NO: 3915544 - RNA, 16 nt, Human adenovirus C
auacacuuccucagga

SEQ ID NO: 3915545 - RNA, 16 nt, Human adenovirus C
auacagagacaggacu

SEQ ID NO: 3915546 - RNA, 11 nt, Human adenovirus C
auaccacugca

SEQ ID NO: 3915547 - RNA, 14 nt, Human adenovirus C
auaccacugcaaca

SEQ ID NO: 3915548 - RNA, 21 nt, Human adenovirus C
auaccuugacggaaccuucua

SEQ ID NO: 3915549 - RNA, 23 nt, Human adenovirus C
auacgcagauccuuccuaucaac

SEQ ID NO: 3915550 - RNA, 12 nt, Human adenovirus C
auacuaaauaca

SEQ ID NO: 3915551 - RNA, 12 nt, Human adenovirus C
auacugggacag

SEQ ID NO: 3915552 - RNA, 18 nt, Human adenovirus C
auagcggaugucagccuu

SEQ ID NO: 3915553 - RNA, 18 nt, Human adenovirus C
auaguggugcaggagcgc

SEQ ID NO: 3915554 - RNA, 14 nt, Human adenovirus C
auauccauaccuug

SEQ ID NO: 3915555 - RNA, 21 nt, Human adenovirus C
auaugcccuacauccuuccau

SEQ ID NO: 3915556 - RNA, 18 nt, Human adenovirus C
auauuaaugcaucucaua

SEQ ID NO: 3915557 - RNA, 15 nt, Human adenovirus C
aucaaacaauacuaa

SEQ ID NO: 3915558 - RNA, 18 nt, Human adenovirus C
aucaaagaagagaugcuc

SEQ ID NO: 3915559 - RNA, 13 nt, Human adenovirus C
aucaaucagccuc

SEQ ID NO: 3915560 - RNA, 17 nt, Human adenovirus C
aucaaucagccucgccc

SEQ ID NO: 3915561 - RNA, 18 nt, Human adenovirus C
aucaccgucacccagcac

SEQ ID NO: 3915562 - RNA, 20 nt, Human adenovirus C
aucaccuacgaugaccugga

SEQ ID NO: 3915563 - RNA, 15 nt, Human adenovirus C
aucacuuggugcugg

SEQ ID NO: 3915564 - RNA, 17 nt, Human adenovirus C
aucagccccccucucug

SEQ ID NO: 3915565 - RNA, 22 nt, Human adenovirus C
aucagccucgccccccuucucc

SEQ ID NO: 3915566 - RNA, 14 nt, Human adenovirus C
aucaggguccagag

SEQ ID NO: 3915567 - RNA, 20 nt, Human adenovirus C
auccaaaaccucaaaaugaa

SEQ ID NO: 3915568 - RNA, 13 nt, Human adenovirus C
auccacaaggccg

SEQ ID NO: 3915569 - RNA, 16 nt, Human adenovirus C
auccccccgccgccgc

SEQ ID NO: 3915570 - RNA, 15 nt, Human adenovirus C
auccgcaagcggcaa

SEQ ID NO: 3915571 - RNA, 22 nt, Human adenovirus C
aucgcuacaaccuccgcuccuc

SEQ ID NO: 3915572 - RNA, 15 nt, Human adenovirus C
aucuaugccaaacag

SEQ ID NO: 3915573 - RNA, 13 nt, Human adenovirus C
aucucagccgccu

SEQ ID NO: 3915574 - RNA, 12 nt, Human adenovirus C
aucucuuccucc

SEQ ID NO: 3915575 - RNA, 13 nt, Human adenovirus C
aucugcuccagag

SEQ ID NO: 3915576 - RNA, 16 nt, Human adenovirus C
aucuggcgccucugcg

SEQ ID NO: 3915577 - RNA, 14 nt, Human adenovirus C
augaagaagaggaa

SEQ ID NO: 3915578 - RNA, 18 nt, Human adenovirus C
augaagggcacgagcugc

SEQ ID NO: 3915579 - RNA, 21 nt, Human adenovirus C
augagcaaacaguacaaguug

SEQ ID NO: 3915580 - RNA, 13 nt, Human adenovirus C
augagcaaggaaa

SEQ ID NO: 3915581 - RNA, 13 nt, Human adenovirus C
augagcuccacag

SEQ ID NO: 3915582 - RNA, 16 nt, Human adenovirus C
augagcuccacagguc

SEQ ID NO: 3915583 - RNA, 19 nt, Human adenovirus C
augaggaagguccuccucc

SEQ ID NO: 3915584 - RNA, 16 nt, Human adenovirus C
augauuuugaggaggc

SEQ ID NO: 3915585 - RNA, 18 nt, Human adenovirus C
augcagaaacacaagcua

SEQ ID NO: 3915586 - RNA, 16 nt, Human adenovirus C
augccauagaugccau

SEQ ID NO: 3915587 - RNA, 17 nt, Human adenovirus C
augccaucuugaacccg

SEQ ID NO: 3915588 - RNA, 16 nt, Human adenovirus C
augccgcaguggucuu

SEQ ID NO: 3915589 - RNA, 19 nt, Human adenovirus C
augccugcgcggccuuccg

SEQ ID NO: 3915590 - RNA, 20 nt, Human adenovirus C
augcgccacuggcagggaca

SEQ ID NO: 3915591 - RNA, 17 nt, Human adenovirus C
augcgccccccuccuca

SEQ ID NO: 3915592 - RNA, 17 nt, Human adenovirus C
augcgcgagggacaggc

SEQ ID NO: 3915593 - RNA, 20 nt, Human adenovirus C
augcguccaugucgccgcca

SEQ ID NO: 3915594 - RNA, 21 nt, Human adenovirus C
augcuaaugcggcaggaggga

SEQ ID NO: 3915595 - RNA, 17 nt, Human adenovirus C
augcuucuaaauagcua

SEQ ID NO: 3915596 - RNA, 13 nt, Human adenovirus C
auggaaaccccag

SEQ ID NO: 3915597 - RNA, 17 nt, Human adenovirus C
auggaaaccccagacac

SEQ ID NO: 3915598 - RNA, 22 nt, Human adenovirus C
auggcacccaaaaagaagcugc

SEQ ID NO: 3915599 - RNA, 19 nt, Human adenovirus C
auggccggccacggccuga

SEQ ID NO: 3915600 - RNA, 14 nt, Human adenovirus C
augguucugcagag

SEQ ID NO: 3915601 - RNA, 21 nt, Human adenovirus C
augguugguggacgucgcgcc

SEQ ID NO: 3915602 - RNA, 17 nt, Human adenovirus C
auguagcuuagaaggaa

SEQ ID NO: 3915603 - RNA, 15 nt, Human adenovirus C
augucgcccucuucg

SEQ ID NO: 3915604 - RNA, 14 nt, Human adenovirus C
auguuacauuuaaa

SEQ ID NO: 3915605 - RNA, 22 nt, Human adenovirus C
auguucucuucuuuuacaguau

SEQ ID NO: 3915606 - RNA, 17 nt, Human adenovirus C
auguucuugucccuccg

SEQ ID NO: 3915607 - RNA, 22 nt, Human adenovirus C
auuaaaaaccuccuccuccugc

SEQ ID NO: 3915608 - RNA, 23 nt, Human adenovirus C
auuaccauguacaugagcaaaca

SEQ ID NO: 3915609 - RNA, 12 nt, Human adenovirus C
auuaccugggcg

SEQ ID NO: 3915610 - RNA, 21 nt, Human adenovirus C
auuacugacgccagacgccgc

SEQ ID NO: 3915611 - RNA, 19 nt, Human adenovirus C
auuagagaucuuauuccau

SEQ ID NO: 3915612 - RNA, 17 nt, Human adenovirus C
auuauucgccacaaaga

SEQ ID NO: 3915613 - RNA, 13 nt, Human adenovirus C
auucaccaccucc

SEQ ID NO: 3915614 - RNA, 14 nt, Human adenovirus C
auucagauaaugac

SEQ ID NO: 3915615 - RNA, 13 nt, Human adenovirus C
auucaucaaacaa

SEQ ID NO: 3915616 - RNA, 18 nt, Human adenovirus C
auucgcaccgcccgcagc

SEQ ID NO: 3915617 - RNA, 21 nt, Human adenovirus C
auugagcuccacgugccgggc

SEQ ID NO: 3915618 - RNA, 18 nt, Human adenovirus C
auugaggaguucgugccu

SEQ ID NO: 3915619 - RNA, 16 nt, Human adenovirus C
auugagguacugaaau

SEQ ID NO: 3915620 - RNA, 17 nt, Human adenovirus C
auugcauccguggccuu

SEQ ID NO: 3915621 - RNA, 14 nt, Human adenovirus C
auugcuucuucccc

SEQ ID NO: 3915622 - RNA, 15 nt, Human adenovirus C
auuggccggacaggc

SEQ ID NO: 3915623 - RNA, 13 nt, Human adenovirus C
auuggcucuggca

SEQ ID NO: 3915624 - RNA, 22 nt, Human adenovirus C
auuguuguguagguacuccgcc

SEQ ID NO: 3915625 - RNA, 20 nt, Human adenovirus C
auuuaccccccacccuugcc

SEQ ID NO: 3915626 - RNA, 15 nt, Human adenovirus C
auuucaacaaagcag

SEQ ID NO: 3915627 - RNA, 16 nt, Human adenovirus C
auuuccaggggcuggu

SEQ ID NO: 3915628 - RNA, 19 nt, Human adenovirus C
auuuccauuuuaugaaaug

SEQ ID NO: 3915629 - RNA, 21 nt, Human adenovirus C
auuuccgugcgcaggguggcu

SEQ ID NO: 3915630 - RNA, 12 nt, Human adenovirus C
auuuccugcaga

SEQ ID NO: 3915631 - RNA, 19 nt, Human adenovirus C
auuugagucacacuaagau

SEQ ID NO: 3915632 - RNA, 14 nt, Human adenovirus C
auuugucacccuua

SEQ ID NO: 3915633 - RNA, 17 nt, Human adenovirus C
caaaaucaaagaagaga

SEQ ID NO: 3915634 - RNA, 14 nt, Human adenovirus C
caaacagaucugcg

SEQ ID NO: 3915635 - RNA, 14 nt, Human adenovirus C
caaacauaaguuug

SEQ ID NO: 3915636 - RNA, 20 nt, Human adenovirus C
caaaccccugacagaggaca

SEQ ID NO: 3915637 - RNA, 14 nt, Human adenovirus C
caaacucacagaac

SEQ ID NO: 3915638 - RNA, 17 nt, Human adenovirus C
caaacucuacagccaaa

SEQ ID NO: 3915639 - RNA, 14 nt, Human adenovirus C
caaacuugcaagaa

SEQ ID NO: 3915640 - RNA, 16 nt, Human adenovirus C
caaacuuuccuggacg

SEQ ID NO: 3915641 - RNA, 23 nt, Human adenovirus C
caaagaucuugguugugggccau

SEQ ID NO: 3915642 - RNA, 19 nt, Human adenovirus C
caaagcaaaccucaccucc

SEQ ID NO: 3915643 - RNA, 15 nt, Human adenovirus C
caaagcccgccaaga

SEQ ID NO: 3915644 - RNA, 17 nt, Human adenovirus C
caaagcccgccaagagu

SEQ ID NO: 3915645 - RNA, 20 nt, Human adenovirus C
cccaaaauguaaccacuguu

SEQ ID NO: 3915646 - RNA, 24 nt, Human adenovirus C
cccacaacacggccuccacgcugg

SEQ ID NO: 3915647 - RNA, 14 nt, Human adenovirus C
cccacagcucgguc

SEQ ID NO: 3915648 - RNA, 13 nt, Human adenovirus C
cccacccccacug

SEQ ID NO: 3915649 - RNA, 17 nt, Human adenovirus C
cccacggacgaggagga

SEQ ID NO: 3915650 - RNA, 14 nt, Human adenovirus C
cccagaagacgagc

SEQ ID NO: 3915651 - RNA, 16 nt, Human adenovirus C
cccagacacacaucug

SEQ ID NO: 3915652 - RNA, 23 nt, Human adenovirus C
cccagcagaaaccugugcugcca

SEQ ID NO: 3915653 - RNA, 14 nt, Human adenovirus C
cccagcggucccau

SEQ ID NO: 3915654 - RNA, 17 nt, Human adenovirus C
cccaggacucguaacca

SEQ ID NO: 3915655 - RNA, 16 nt, Human adenovirus C
cccaggauggcaccca

SEQ ID NO: 3915656 - RNA, 21 nt, Human adenovirus C
cccaggcggcggguacagugg

SEQ ID NO: 3915657 - RNA, 12 nt, Human adenovirus C
cccagggccaca

SEQ ID NO: 3915658 - RNA, 15 nt, Human adenovirus C
cccagggccacaucc

SEQ ID NO: 3915659 - RNA, 20 nt, Human adenovirus C
cccaguccggcgaggagcuc

SEQ ID NO: 3915660 - RNA, 16 nt, Human adenovirus C
cccagugcccgcuguc

SEQ ID NO: 3915661 - RNA, 14 nt, Human adenovirus C
cccauuugaugcuc

SEQ ID NO: 3915662 - RNA, 13 nt, Human adenovirus C
ccccagguccagg

SEQ ID NO: 3915663 - RNA, 21 nt, Human adenovirus C
ccccaguccggcgaggagcuc

SEQ ID NO: 3915664 - RNA, 15 nt, Human adenovirus C
ccccauggcccacaa

SEQ ID NO: 3915665 - RNA, 19 nt, Human adenovirus C
ccccgcugacacccagcag

SEQ ID NO: 3915666 - RNA, 19 nt, Human adenovirus C
ccccggcuaucguggcuac

SEQ ID NO: 3915667 - RNA, 14 nt, Human adenovirus C
ccccguccugcccg

SEQ ID NO: 3915668 - RNA, 15 nt, Human adenovirus C
ccccuauccugccgu

SEQ ID NO: 3915669 - RNA, 13 nt, Human adenovirus C
ccccucgccggcg

SEQ ID NO: 3915670 - RNA, 18 nt, Human adenovirus C
ccccuuaguaugcagcgc

SEQ ID NO: 3915671 - RNA, 10 nt, Human adenovirus C
ccccuucccu

SEQ ID NO: 3915672 - RNA, 17 nt, Human adenovirus C
ccccuuugaguucgcca

SEQ ID NO: 3915673 - RNA, 20 nt, Human adenovirus C
cccgaauaaacuacaugagc

SEQ ID NO: 3915674 - RNA, 20 nt, Human adenovirus C
cccgaucacuuggugcuggc

SEQ ID NO: 3915675 - RNA, 21 nt, Human adenovirus C
cccgaugaggccggccugguc

SEQ ID NO: 3915676 - RNA, 16 nt, Human adenovirus C
cccgcgccugcugggc

SEQ ID NO: 3915677 - RNA, 15 nt, Human adenovirus C
cccgcuugaggagga

SEQ ID NO: 3915678 - RNA, 21 nt, Human adenovirus C
cccgcuugcaagcagugcagc

SEQ ID NO: 3915679 - RNA, 17 nt, Human adenovirus C
cccggagaugcagcgca

SEQ ID NO: 3915680 - RNA, 14 nt, Human adenovirus C
cccgggaccagcgg

SEQ ID NO: 3915681 - RNA, 18 nt, Human adenovirus C
cccgguuauggguuggcg

SEQ ID NO: 3915682 - RNA, 17 nt, Human adenovirus C
cccguagaggagccucc

SEQ ID NO: 3915683 - RNA, 14 nt, Human adenovirus C
cccguagccagugg

SEQ ID NO: 3915684 - RNA, 16 nt, Human adenovirus C
cccguauuugccgugc

SEQ ID NO: 3915685 - RNA, 19 nt, Human adenovirus C
cccguguucugacagggcc

SEQ ID NO: 3915686 - RNA, 21 nt, Human adenovirus C
cccuaucagcagccgcgggcc

SEQ ID NO: 3915687 - RNA, 15 nt, Human adenovirus C
cccuauccugccgug

SEQ ID NO: 3915688 - RNA, 17 nt, Human adenovirus C
cccucacccgcagcugc

SEQ ID NO: 3915689 - RNA, 19 nt, Human adenovirus C
cccucguuccagacgcggc

SEQ ID NO: 3915690 - RNA, 14 nt, Human adenovirus C
cccugcuaguggag

SEQ ID NO: 3915691 - RNA, 14 nt, Human adenovirus C
cccuggugcugcca

SEQ ID NO: 3915692 - RNA, 20 nt, Human adenovirus C
cccuucggcaucgcgggcgc

SEQ ID NO: 3915693 - RNA, 20 nt, Human adenovirus C
cccuugcggcagucugcagc

SEQ ID NO: 3915694 - RNA, 17 nt, Human adenovirus C
cccuuucuuaccccucc

SEQ ID NO: 3915695 - RNA, 21 nt, Human adenovirus C
ccgaacagcgccuacuagaaa

SEQ ID NO: 3915696 - RNA, 13 nt, Human adenovirus C
ccgaacagggcgg

SEQ ID NO: 3915697 - RNA, 18 nt, Human adenovirus C
ccgaccaacacccagugc

SEQ ID NO: 3915698 - RNA, 19 nt, Human adenovirus C
ccgacggaggagcaacagc

SEQ ID NO: 3915699 - RNA, 17 nt, Human adenovirus C
ccgacgggcggccaugc

SEQ ID NO: 3915700 - RNA, 18 nt, Human adenovirus C
ccgagagccggccuggac

SEQ ID NO: 3915701 - RNA, 18 nt, Human adenovirus C
ccgagcuguugcccgugc

SEQ ID NO: 3915702 - RNA, 18 nt, Human adenovirus C
ccgagggccgcuggcugc

SEQ ID NO: 3915703 - RNA, 23 nt, Human adenovirus C
ccgagguugcuacgggcgggcug

SEQ ID NO: 3915704 - RNA, 11 nt, Human adenovirus C
ccgcaccugcc

SEQ ID NO: 3915705 - RNA, 15 nt, Human adenovirus C
ccgcagccacagugc

SEQ ID NO: 3915706 - RNA, 15 nt, Human adenovirus C
ccgcaggccaaccgg

SEQ ID NO: 3915707 - RNA, 16 nt, Human adenovirus C
ccgcauccccgcggcg

SEQ ID NO: 3915708 - RNA, 22 nt, Human adenovirus C
ccgccaacgccaccaacgugcc

SEQ ID NO: 3915709 - RNA, 12 nt, Human adenovirus C
ccgccaccugcu

SEQ ID NO: 3915710 - RNA, 15 nt, Human adenovirus C
ccgccgcagcagccg

SEQ ID NO: 3915711 - RNA, 17 nt, Human adenovirus C
ccgccgcuuucuucucu

SEQ ID NO: 3915712 - RNA, 21 nt, Human adenovirus C
ccgccgucgccgucgccagcc

SEQ ID NO: 3915713 - RNA, 13 nt, Human adenovirus C
ccgcgaggccaua

SEQ ID NO: 3915714 - RNA, 17 nt, Human adenovirus C
ccgcgccgcaggccccg

SEQ ID NO: 3915715 - RNA, 16 nt, Human adenovirus C
ccgcgccugcugggcg

SEQ ID NO: 3915716 - RNA, 23 nt, Human adenovirus C
ccgcgcgcgcacacguggcggcc

SEQ ID NO: 3915717 - RNA, 14 nt, Human adenovirus C
ccgcgcgcgggcag

SEQ ID NO: 3915718 - RNA, 21 nt, Human adenovirus C
ccgcgcgcgggcaggagcugg

SEQ ID NO: 3915719 - RNA, 15 nt, Human adenovirus C
ccgcggcgugcugga

SEQ ID NO: 3915720 - RNA, 20 nt, Human adenovirus C
ccgcggugcaggcggccgcu

SEQ ID NO: 3915721 - RNA, 12 nt, Human adenovirus C
ccgcguacgagc

SEQ ID NO: 3915722 - RNA, 21 nt, Human adenovirus C
ccgcguccggcucgcuccacg

SEQ ID NO: 3915723 - RNA, 19 nt, Human adenovirus C
ccgcucauggcgcagcugu

SEQ ID NO: 3915724 - RNA, 12 nt, Human adenovirus C
ccgcugcagcca

SEQ ID NO: 3915725 - RNA, 17 nt, Human adenovirus C
ccgcugcgcaacagcau

SEQ ID NO: 3915726 - RNA, 12 nt, Human adenovirus C
ccgcuggcugcu

SEQ ID NO: 3915727 - RNA, 17 nt, Human adenovirus C
ccggaaaccucaccucc

SEQ ID NO: 3915728 - RNA, 18 nt, Human adenovirus C
ccggaaaccucaccuccc

SEQ ID NO: 3915729 - RNA, 13 nt, Human adenovirus C
ccggccugcugaa

SEQ ID NO: 3915730 - RNA, 12 nt, Human adenovirus C
ccggcgcacggc

SEQ ID NO: 3915731 - RNA, 16 nt, Human adenovirus C
ccggcgccagcaccug

SEQ ID NO: 3915732 - RNA, 18 nt, Human adenovirus C
ccgggacugggcgugcag

SEQ ID NO: 3915733 - RNA, 15 nt, Human adenovirus C
ccgggaggcggucga

SEQ ID NO: 3915734 - RNA, 16 nt, Human adenovirus C
ccgggcuggugcaguu

SEQ ID NO: 3915735 - RNA, 14 nt, Human adenovirus C
ccgggucagggcgc

SEQ ID NO: 3915736 - RNA, 12 nt, Human adenovirus C
ccguagaggagc

SEQ ID NO: 3915737 - RNA, 20 nt, Human adenovirus C
ccguaguuggcccgcugccc

SEQ ID NO: 3915738 - RNA, 19 nt, Human adenovirus C
ccgucaagaaaaacaccac

SEQ ID NO: 3915739 - RNA, 15 nt, Human adenovirus C
ccgugagcgugagcc

SEQ ID NO: 3915740 - RNA, 13 nt, Human adenovirus C
ccgugcuggcccc

SEQ ID NO: 3915741 - RNA, 20 nt, Human adenovirus C
ccguggagccugggcuggag

SEQ ID NO: 3915742 - RNA, 13 nt, Human adenovirus C
ccguguauccaua

SEQ ID NO: 3915743 - RNA, 22 nt, Human adenovirus C
ccgugugcuugauauggcuucc

SEQ ID NO: 3915744 - RNA, 11 nt, Human adenovirus C
ccguucccacg

SEQ ID NO: 3915745 - RNA, 17 nt, Human adenovirus C
ccguuuuuacccaccca

SEQ ID NO: 3915746 - RNA, 21 nt, Human adenovirus C
ccuaacuccugugagugggaa

SEQ ID NO: 3915747 - RNA, 21 nt, Human adenovirus C
ccuaauaagcaaugacagcac

SEQ ID NO: 3915748 - RNA, 22 nt, Human adenovirus C
ccuacacgguguaagcuucuau

SEQ ID NO: 3915749 - RNA, 13 nt, Human adenovirus C
ccuaccaccuucc

SEQ ID NO: 3915750 - RNA, 19 nt, Human adenovirus C
ccuacgaugaccuggaggg

SEQ ID NO: 3915751 - RNA, 14 nt, Human adenovirus C
ccuacugcaccggc

SEQ ID NO: 3915752 - RNA, 22 nt, Human adenovirus C
ccuacugcaccggcggcagcgg

SEQ ID NO: 3915753 - RNA, 16 nt, Human adenovirus C
ccuacuuccgcagcca

SEQ ID NO: 3915754 - RNA, 13 nt, Human adenovirus C
ccuaucacaucuu

SEQ ID NO: 3915755 - RNA, 21 nt, Human adenovirus C
ccuaucaccgucacccagcac

SEQ ID NO: 3915756 - RNA, 15 nt, Human adenovirus C
ccuaucgagccgcac

SEQ ID NO: 3915757 - RNA, 17 nt, Human adenovirus C
ccuaugacaagcgcuuu

SEQ ID NO: 3915758 - RNA, 13 nt, Human adenovirus C
ccucacucucuuc

SEQ ID NO: 3915759 - RNA, 11 nt, Human adenovirus C
ccucagcagcg

SEQ ID NO: 3915760 - RNA, 15 nt, Human adenovirus C
ccucaggcaccaucc

SEQ ID NO: 3915761 - RNA, 22 nt, Human adenovirus C
ccucaggcgccgccggcacugc

SEQ ID NO: 3915762 - RNA, 17 nt, Human adenovirus C
ucuuggccuugcuagac

SEQ ID NO: 3915763 - RNA, 14 nt, Human adenovirus C
ucuuguucccagcg

SEQ ID NO: 3915764 - RNA, 15 nt, Human adenovirus C
ucuuuaauuaugaaa

SEQ ID NO: 3915765 - RNA, 18 nt, Human adenovirus C
ucuuuccaguacucuugg

SEQ ID NO: 3915766 - RNA, 14 nt, Human adenovirus C
ucuuugugguucuu

SEQ ID NO: 3915767 - RNA, 17 nt, Human adenovirus C
ugaaaaguaucuuuccc

SEQ ID NO: 3915768 - RNA, 15 nt, Human adenovirus C
ugaaauccuguggug

SEQ ID NO: 3915769 - RNA, 21 nt, Human adenovirus C
ugaagacaugguuaaccuaca

SEQ ID NO: 3915770 - RNA, 21 nt, Human adenovirus C
ugacaaagagacgcucggugc

SEQ ID NO: 3915771 - RNA, 20 nt, Human adenovirus C
ugacaagcgcuuuccaggcu

SEQ ID NO: 3915772 - RNA, 21 nt, Human adenovirus C
ugacaagcgcuuuccaggcuu

SEQ ID NO: 3915773 - RNA, 21 nt, Human adenovirus C
ugacaaggucaacgcuggugg

SEQ ID NO: 3915774 - RNA, 13 nt, Human adenovirus C
ugacacccgcaac

SEQ ID NO: 3915775 - RNA, 22 nt, Human adenovirus C
ugacagcgacacccuuacugua

SEQ ID NO: 3915776 - RNA, 14 nt, Human adenovirus C
ugacagggcccagu

SEQ ID NO: 3915777 - RNA, 20 nt, Human adenovirus C
ugacaguggagagcccagga

SEQ ID NO: 3915778 - RNA, 14 nt, Human adenovirus C
ugaccaaggacugg

SEQ ID NO: 3915779 - RNA, 12 nt, Human adenovirus C
ugaccaugaaga

SEQ ID NO: 3915780 - RNA, 19 nt, Human adenovirus C
ugaccgaggagcugaggcc

SEQ ID NO: 3915781 - RNA, 17 nt, Human adenovirus C
ugaccguggagccuggg

SEQ ID NO: 3915782 - RNA, 16 nt, Human adenovirus C
ugaccugcgcugggcc

SEQ ID NO: 3915783 - RNA, 19 nt, Human adenovirus C
ugacgaccguucgcacugg

SEQ ID NO: 3915784 - RNA, 23 nt, Human adenovirus C
ugacgaggacgaugaguacgagc

SEQ ID NO: 3915785 - RNA, 22 nt, Human adenovirus C
ugacgcaaauagaugagccucc

SEQ ID NO: 3915786 - RNA, 18 nt, Human adenovirus C
ugacgcggcggcagaugg

SEQ ID NO: 3915787 - RNA, 21 nt, Human adenovirus C
ugacgcguuccggcagcagcc

SEQ ID NO: 3915788 - RNA, 20 nt, Human adenovirus C
ugacggggagggcuacaacg

SEQ ID NO: 3915789 - RNA, 22 nt, Human adenovirus C
ugacuaccuuuccgccgccaac

SEQ ID NO: 3915790 - RNA, 23 nt, Human adenovirus C
ugacuaccuuuccgccgccaaca

SEQ ID NO: 3915791 - RNA, 17 nt, Human adenovirus C
ugagacgaaggcucgcg

SEQ ID NO: 3915792 - RNA, 19 nt, Human adenovirus C
ugagcaggaacugaaagcc

SEQ ID NO: 3915793 - RNA, 15 nt, Human adenovirus C
ugagcgacgaccugg

SEQ ID NO: 3915794 - RNA, 21 nt, Human adenovirus C
ugagcgggggguaccugcugg

SEQ ID NO: 3915795 - RNA, 22 nt, Human adenovirus C
ugagcgggggguaccugcugga

SEQ ID NO: 3915796 - RNA, 22 nt, Human adenovirus C
ugagcuccacaggucacgggcc

SEQ ID NO: 3915797 - RNA, 18 nt, Human adenovirus C
ugagcuccucaggggagc

SEQ ID NO: 3915798 - RNA, 17 nt, Human adenovirus C
ugagcuugaucugcugg

SEQ ID NO: 3915799 - RNA, 21 nt, Human adenovirus C
ugaggccgaggcagcggcaga

SEQ ID NO: 3915800 - RNA, 21 nt, Human adenovirus C
ugaggguaacuccagggugcg

SEQ ID NO: 3915801 - RNA, 17 nt, Human adenovirus C
ugaugggcuccagcauu

SEQ ID NO: 3915802 - RNA, 21 nt, Human adenovirus C
ugauuauuuaccccccacccu

SEQ ID NO: 3915803 - RNA, 16 nt, Human adenovirus C
ugauuccauaggugau

SEQ ID NO: 3915804 - RNA, 20 nt, Human adenovirus C
ugauucuuugaaucuggguc

SEQ ID NO: 3915805 - RNA, 20 nt, Human adenovirus C
ugcaaacaucagccccccuc

SEQ ID NO: 3915806 - RNA, 18 nt, Human adenovirus C
ugcaaacggacccgugga

SEQ ID NO: 3915807 - RNA, 15 nt, Human adenovirus C
ugcaaauuccuccgg

SEQ ID NO: 3915808 - RNA, 22 nt, Human adenovirus C
ugcaagacagaaacacagagcu

SEQ ID NO: 3915809 - RNA, 23 nt, Human adenovirus C
ugcaaguagcacaaaacuccgau

SEQ ID NO: 3915810 - RNA, 23 nt, Human adenovirus C
ugcaagucuagcgccugcugcca

SEQ ID NO: 3915811 - RNA, 13 nt, Human adenovirus C
ugcaccacagaac

SEQ ID NO: 3915812 - RNA, 17 nt, Human adenovirus C
ugcaccggcggcagcgg

SEQ ID NO: 3915813 - RNA, 20 nt, Human adenovirus C
ugcaccguaggaggggcaug

SEQ ID NO: 3915814 - RNA, 15 nt, Human adenovirus C
ugcacgucuccugag

SEQ ID NO: 3915815 - RNA, 16 nt, Human adenovirus C
ugcacuacucuuauaa

SEQ ID NO: 3915816 - RNA, 14 nt, Human adenovirus C
ugcacugcagggaa

SEQ ID NO: 3915817 - RNA, 19 nt, Human adenovirus C
ugcagaccguaaaccugag

SEQ ID NO: 3915818 - RNA, 16 nt, Human adenovirus C
ugcagauucacucaaa

SEQ ID NO: 3915819 - RNA, 14 nt, Human adenovirus C
ugcagcacagcacc

SEQ ID NO: 3915820 - RNA, 15 nt, Human adenovirus C
ugcagcacagcaggg

SEQ ID NO: 3915821 - RNA, 12 nt, Human adenovirus C
ugcagcacugga

SEQ ID NO: 3915822 - RNA, 19 nt, Human adenovirus C
ugcagcagccgccgccaug

SEQ ID NO: 3915823 - RNA, 21 nt, Human adenovirus C
ugcagcugccgucaucccuga

SEQ ID NO: 3915824 - RNA, 23 nt, Human adenovirus C
ugcagcugccgucaucccugagc

SEQ ID NO: 3915825 - RNA, 21 nt, Human adenovirus C
ugcaggaauacaacauggcag

SEQ ID NO: 3915826 - RNA, 18 nt, Human adenovirus C
ugcagggcacccuccccu

SEQ ID NO: 3915827 - RNA, 17 nt, Human adenovirus C
ugcagguacgccugcag

SEQ ID NO: 3915828 - RNA, 21 nt, Human adenovirus C
ugcaguagaagguaagcgggu

SEQ ID NO: 3915829 - RNA, 16 nt, Human adenovirus C
ugcauguuuucccuga

SEQ ID NO: 3915830 - RNA, 14 nt, Human adenovirus C
ugccaaccuaugga

SEQ ID NO: 3915831 - RNA, 15 nt, Human adenovirus C
ugccaccucccuccc

SEQ ID NO: 3915832 - RNA, 18 nt, Human adenovirus C
ugccaucuugaacccgca

SEQ ID NO: 3915833 - RNA, 14 nt, Human adenovirus C
ugccaugcgcgggc

SEQ ID NO: 3915834 - RNA, 21 nt, Human adenovirus C
ugccauuaaaaaccuccuccu

SEQ ID NO: 3915835 - RNA, 11 nt, Human adenovirus C
ugcccaggcuc

SEQ ID NO: 3915836 - RNA, 17 nt, Human adenovirus C
ugcccuucucccacgca

SEQ ID NO: 3915837 - RNA, 14 nt, Human adenovirus C
ugcccuugauggag

SEQ ID NO: 3915838 - RNA, 16 nt, Human adenovirus C
ugcccuuggaggaggc

SEQ ID NO: 3915839 - RNA, 13 nt, Human adenovirus C
ugccgaggaugaa

SEQ ID NO: 3915840 - RNA, 21 nt, Human adenovirus C
ugccgccaacgcgccuaccac

SEQ ID NO: 3915841 - RNA, 14 nt, Human adenovirus C
ugccuaaccuucua

SEQ ID NO: 3915842 - RNA, 19 nt, Human adenovirus C
ugccuacggaaagcggcau

SEQ ID NO: 3915843 - RNA, 15 nt, Human adenovirus C
ugccucaaaccggcc

SEQ ID NO: 3915844 - RNA, 17 nt, Human adenovirus C
ugcgacccggcaccacc

SEQ ID NO: 3915845 - RNA, 22 nt, Human adenovirus C
ugcgacgucagacaacggggga

SEQ ID NO: 3915846 - RNA, 21 nt, Human adenovirus C
ugcgagccgaucgggaagaac

SEQ ID NO: 3915847 - RNA, 22 nt, Human adenovirus C
ugcgccagcagguuucugcccu

SEQ ID NO: 3915848 - RNA, 17 nt, Human adenovirus C
ugcgcgagauugagcuc

SEQ ID NO: 3915849 - RNA, 18 nt, Human adenovirus C
ugcgcgagauugagcucc

SEQ ID NO: 3915850 - RNA, 16 nt, Human adenovirus C
ugcgcgcuggccaggg

SEQ ID NO: 3915851 - RNA, 16 nt, Human adenovirus C
ugcgcuaugugcagca

SEQ ID NO: 3915852 - RNA, 23 nt, Human adenovirus C
ugcgcuuaaaaugggcagcgguc

SEQ ID NO: 3915853 - RNA, 15 nt, Human adenovirus C
ugcgcuuuucugugc

SEQ ID NO: 3915854 - RNA, 12 nt, Human adenovirus C
ugcggcugcugu

SEQ ID NO: 3915855 - RNA, 12 nt, Human adenovirus C
ugcgggccauga

SEQ ID NO: 3915856 - RNA, 18 nt, Human adenovirus C
ugcgggcgugacaaacag

SEQ ID NO: 3915857 - RNA, 23 nt, Human adenovirus C
ugcgggcucccacaggcgaccgc

SEQ ID NO: 3915858 - RNA, 18 nt, Human adenovirus C
ugcgucauuacccagggc

SEQ ID NO: 3915859 - RNA, 17 nt, Human adenovirus C
ugcuaccuucugcagcu

SEQ ID NO: 3915860 - RNA, 22 nt, Human adenovirus C
ugcucgaucucuuccuccugga

SEQ ID NO: 3915861 - RNA, 13 nt, Human adenovirus C
ugcugcagccgca

SEQ ID NO: 3915862 - RNA, 17 nt, Human adenovirus C
ugcugcgcgaggaggac

SEQ ID NO: 3915863 - RNA, 19 nt, Human adenovirus C
ugcuuaaaagccaccugag

SEQ ID NO: 3915864 - RNA, 13 nt, Human adenovirus C
ugcuucccaggau

SEQ ID NO: 3915865 - RNA, 16 nt, Human adenovirus C
uggaaaauacaccacu

SEQ ID NO: 3915866 - RNA, 14 nt, Human adenovirus C
uggaacaaugacag

SEQ ID NO: 3915867 - RNA, 16 nt, Human adenovirus C
uggaacauucccagcu

SEQ ID NO: 3915868 - RNA, 22 nt, Human adenovirus C
uggaagauuuuucugcugugcg

SEQ ID NO: 3915869 - RNA, 22 nt, Human adenovirus C
uggaaucaggcuguagacagcu

SEQ ID NO: 3915870 - RNA, 12 nt, Human adenovirus C
uggacaccuccc

SEQ ID NO: 3915871 - RNA, 20 nt, Human adenovirus C
uggacaugaccgcgcgcaac

SEQ ID NO: 3915872 - RNA, 14 nt, Human adenovirus C
uggaccuggccaac

SEQ ID NO: 3915873 - RNA, 16 nt, Human adenovirus C
uggacgucgcgccgca

SEQ ID NO: 3915874 - RNA, 18 nt, Human adenovirus C
uggagcucugcaaccugg

SEQ ID NO: 3915875 - RNA, 20 nt, Human adenovirus C
uggaguuaccagccacaaau

SEQ ID NO: 3915876 - RNA, 17 nt, Human adenovirus C
uggaucugcgccagcag

SEQ ID NO: 3915877 - RNA, 18 nt, Human adenovirus C
uggaucugcgccagcagg

SEQ ID NO: 3915878 - RNA, 21 nt, Human adenovirus C
aaaauucagguuccucacaga

SEQ ID NO: 3915879 - RNA, 20 nt, Human adenovirus C
aaacaauacuaaaaaacugg

SEQ ID NO: 3915880 - RNA, 15 nt, Human adenovirus C
aaacacaugucuaug

SEQ ID NO: 3915881 - RNA, 14 nt, Human adenovirus C
aaacaggucucugc

SEQ ID NO: 3915882 - RNA, 16 nt, Human adenovirus C
aaacauuacuggaacu

SEQ ID NO: 3915883 - RNA, 13 nt, Human adenovirus C
aaaccaugcuaug

SEQ ID NO: 3915884 - RNA, 17 nt, Human adenovirus C
aaaccgaauucuccucg

SEQ ID NO: 3915885 - RNA, 16 nt, Human adenovirus C
aaaccuauuaaaaaac

SEQ ID NO: 3915886 - RNA, 17 nt, Human adenovirus C
aaaccuauuaaaaaaca

SEQ ID NO: 3915887 - RNA, 20 nt, Human adenovirus C
aaaccuucucuacgccaacu

SEQ ID NO: 3915888 - RNA, 21 nt, Human adenovirus C
aaacgcggccgcacugggcgc

SEQ ID NO: 3915889 - RNA, 23 nt, Human adenovirus C
aaacguagaggggcucucugagu

SEQ ID NO: 3915890 - RNA, 23 nt, Human adenovirus C
aaacuaaaauuggcucuggcauu

SEQ ID NO: 3915891 - RNA, 21 nt, Human adenovirus C
aaacuuaccuacgaaaaaacc

SEQ ID NO: 3915892 - RNA, 20 nt, Human adenovirus C
aaacuuguaaauaucaggaa

SEQ ID NO: 3915893 - RNA, 15 nt, Human adenovirus C
aaagaaaaugccuug

SEQ ID NO: 3915894 - RNA, 14 nt, Human adenovirus C
aaagcaaggccugc

SEQ ID NO: 3915895 - RNA, 22 nt, Human adenovirus C
aaagcagguuccugagcagcug

SEQ ID NO: 3915896 - RNA, 13 nt, Human adenovirus C
aaagccaaaaaac

SEQ ID NO: 3915897 - RNA, 17 nt, Human adenovirus C
aaagcuacaaggaccgc

SEQ ID NO: 3915898 - RNA, 13 nt, Human adenovirus C
aaagcuagcccug

SEQ ID NO: 3915899 - RNA, 20 nt, Human adenovirus C
aaagguggcacuuaggccag

SEQ ID NO: 3915900 - RNA, 23 nt, Human adenovirus C
aaaggugguagauggccuggccu

SEQ ID NO: 3915901 - RNA, 13 nt, Human adenovirus C
aaagucaaacaua

SEQ ID NO: 3915902 - RNA, 21 nt, Human adenovirus C
aacaacauggaaauuaaaacg

SEQ ID NO: 3915903 - RNA, 12 nt, Human adenovirus C
aacaacucccau

SEQ ID NO: 3915904 - RNA, 20 nt, Human adenovirus C
aacaagcgagugguggcucc

SEQ ID NO: 3915905 - RNA, 18 nt, Human adenovirus C
aacaaguugcauguggaa

SEQ ID NO: 3915906 - RNA, 16 nt, Human adenovirus C
aacaaugacuacagcc

SEQ ID NO: 3915907 - RNA, 15 nt, Human adenovirus C
aacacaggcuggggc

SEQ ID NO: 3915908 - RNA, 18 nt, Human adenovirus C
aacacaggcuggggccug

SEQ ID NO: 3915909 - RNA, 19 nt, Human adenovirus C
aacagcgaaaaugaaaguc

SEQ ID NO: 3915910 - RNA, 16 nt, Human adenovirus C
aacagcgcgcuaccac

SEQ ID NO: 3915911 - RNA, 21 nt, Human adenovirus C
aacagcgcgcuaccaccccag

SEQ ID NO: 3915912 - RNA, 13 nt, Human adenovirus C
aacagguggagcu

SEQ ID NO: 3915913 - RNA, 21 nt, Human adenovirus C
aacaucgcgcagaugggagcu

SEQ ID NO: 3915914 - RNA, 21 nt, Human adenovirus C
aacauuaccucuuuuggcaug

SEQ ID NO: 3915915 - RNA, 15 nt, Human adenovirus C
aacauucccagcugc

SEQ ID NO: 3915916 - RNA, 22 nt, Human adenovirus C
aacauugucagucaaguuuacu

SEQ ID NO: 3915917 - RNA, 18 nt, Human adenovirus C
aaccagccugugaugcug

SEQ ID NO: 3915918 - RNA, 19 nt, Human adenovirus C
aaccauuaacgaggauggg

SEQ ID NO: 3915919 - RNA, 20 nt, Human adenovirus C
aaccccuuuucuggaccucc

SEQ ID NO: 3915920 - RNA, 22 nt, Human adenovirus C
aaccuccuccuccugccaggcu

SEQ ID NO: 3915921 - RNA, 11 nt, Human adenovirus C
aaccugaaaga

SEQ ID NO: 3915922 - RNA, 15 nt, Human adenovirus C
aaccugccaccuccc

SEQ ID NO: 3915923 - RNA, 14 nt, Human adenovirus C
aaccugugcugcca

SEQ ID NO: 3915924 - RNA, 12 nt, Human adenovirus C
aaccuguugcau

SEQ ID NO: 3915925 - RNA, 18 nt, Human adenovirus C
aaccuuuggacaccuccc

SEQ ID NO: 3915926 - RNA, 21 nt, Human adenovirus C
aacgaagccuuccauccagac

SEQ ID NO: 3915927 - RNA, 15 nt, Human adenovirus C
aacgccuuccugagu

SEQ ID NO: 3915928 - RNA, 17 nt, Human adenovirus C
aacgcgaucguggagca

SEQ ID NO: 3915929 - RNA, 11 nt, Human adenovirus C
aacgcgcggca

SEQ ID NO: 3915930 - RNA, 11 nt, Human adenovirus C
aacguggagcu

SEQ ID NO: 3915931 - RNA, 22 nt, Human adenovirus C
aacuauggcagcaaggccugga

SEQ ID NO: 3915932 - RNA, 17 nt, Human adenovirus C
aacucaacuaaugcaaa

SEQ ID NO: 3915933 - RNA, 20 nt, Human adenovirus C
aacucaccaaggccauggca

SEQ ID NO: 3915934 - RNA, 14 nt, Human adenovirus C
aacucaccugaaaa

SEQ ID NO: 3915935 - RNA, 16 nt, Human adenovirus C
aacucaggcacaacca

SEQ ID NO: 3915936 - RNA, 19 nt, Human adenovirus C
aacucaggggcgcagcuug

SEQ ID NO: 3915937 - RNA, 23 nt, Human adenovirus C
aacuccagggugcgccacaaugu

SEQ ID NO: 3915938 - RNA, 19 nt, Human adenovirus C
aagaaacccaucugagcgg

SEQ ID NO: 3915939 - RNA, 19 nt, Human adenovirus C
aagaaagcagguuccugag

SEQ ID NO: 3915940 - RNA, 15 nt, Human adenovirus C
aagaacaagagcuga

SEQ ID NO: 3915941 - RNA, 13 nt, Human adenovirus C
aagagacgcucgg

SEQ ID NO: 3915942 - RNA, 14 nt, Human adenovirus C
aagagaugcuccag

SEQ ID NO: 3915943 - RNA, 20 nt, Human adenovirus C
aagagguaguugaggguggu

SEQ ID NO: 3915944 - RNA, 21 nt, Human adenovirus C
aagauaucggcaccagcaaua

SEQ ID NO: 3915945 - RNA, 17 nt, Human adenovirus C
aagaugaagaagaggaa

SEQ ID NO: 3915946 - RNA, 21 nt, Human adenovirus C
aagauguugcacaauggcuuc

SEQ ID NO: 3915947 - RNA, 13 nt, Human adenovirus C
aagauuauccaaa

SEQ ID NO: 3915948 - RNA, 13 nt, Human adenovirus C
aagcaucugcagc

SEQ ID NO: 3915949 - RNA, 21 nt, Human adenovirus C
aagcgaaagcauuaaguggcu

SEQ ID NO: 3915950 - RNA, 13 nt, Human adenovirus C
aagcuacccaccc

SEQ ID NO: 3915951 - RNA, 15 nt, Human adenovirus C
aagggcgaggcgcgc

SEQ ID NO: 3915952 - RNA, 17 nt, Human adenovirus C
aaggggugcgcuccggg

SEQ ID NO: 3915953 - RNA, 12 nt, Human adenovirus C
aagggugggaaa

SEQ ID NO: 3915954 - RNA, 15 nt, Human adenovirus C
aaguccacaaaaaac

SEQ ID NO: 3915955 - RNA, 21 nt, Human adenovirus C
aagugcuuugcccgcggcucc

SEQ ID NO: 3915956 - RNA, 18 nt, Human adenovirus C
aauacaaccccaccaaug

SEQ ID NO: 3915957 - RNA, 16 nt, Human adenovirus C
aaucaaaauaaaaagu

SEQ ID NO: 3915958 - RNA, 15 nt, Human adenovirus C
aaucaaagaagagau

SEQ ID NO: 3915959 - RNA, 19 nt, Human adenovirus C
aaucagcguaaaucccaca

SEQ ID NO: 3915960 - RNA, 11 nt, Human adenovirus C
aaucuugguua

SEQ ID NO: 3915961 - RNA, 22 nt, Human adenovirus C
aaugaauguuguacagguggcu

SEQ ID NO: 3915962 - RNA, 13 nt, Human adenovirus C
aaugagacaugau

SEQ ID NO: 3915963 - RNA, 19 nt, Human adenovirus C
aaugagcuugaucugcugg

SEQ ID NO: 3915964 - RNA, 16 nt, Human adenovirus C
aaugcaauuugaguca

SEQ ID NO: 3915965 - RNA, 22 nt, Human adenovirus C
aaugcacuacucuuauaaaaug

SEQ ID NO: 3915966 - RNA, 14 nt, Human adenovirus C
aaugcaucaaacaa

SEQ ID NO: 3915967 - RNA, 20 nt, Human adenovirus C
aaugccauagaugccaugaa

SEQ ID NO: 3915968 - RNA, 12 nt, Human adenovirus C
aaugccaucuug

SEQ ID NO: 3915969 - RNA, 19 nt, Human adenovirus C
aaugggcccacgggcggcg

SEQ ID NO: 3915970 - RNA, 15 nt, Human adenovirus C
aauguacuaggagac

SEQ ID NO: 3915971 - RNA, 21 nt, Human adenovirus C
aaugucguuucucagcagcug

SEQ ID NO: 3915972 - RNA, 11 nt, Human adenovirus C
aauguggccuc

SEQ ID NO: 3915973 - RNA, 21 nt, Human adenovirus C
aaugugugggcguggcuuaag

SEQ ID NO: 3915974 - RNA, 22 nt, Human adenovirus C
aauuaaaacgggcgguggcaug

SEQ ID NO: 3915975 - RNA, 23 nt, Human adenovirus C
aauucccacgcccuacaugugga

SEQ ID NO: 3915976 - RNA, 22 nt, Human adenovirus C
aauuccuccggaaacagggacg

SEQ ID NO: 3915977 - RNA, 22 nt, Human adenovirus C
acaaagcgcgguucacccuggc

SEQ ID NO: 3915978 - RNA, 23 nt, Human adenovirus C
acaaaggucuuguugcuggugaa

SEQ ID NO: 3915979 - RNA, 20 nt, Human adenovirus C
acaaauaggaucagacaaug

SEQ ID NO: 3915980 - RNA, 15 nt, Human adenovirus C
acaacacggccucca

SEQ ID NO: 3915981 - RNA, 15 nt, Human adenovirus C
acaacagcugccgcc

SEQ ID NO: 3915982 - RNA, 10 nt, Human adenovirus C
acaaccccaa

SEQ ID NO: 3915983 - RNA, 16 nt, Human adenovirus C
acaacucgcugcugca

SEQ ID NO: 3915984 - RNA, 14 nt, Human adenovirus C
acaagcgcagguag

SEQ ID NO: 3915985 - RNA, 17 nt, Human adenovirus C
acaaggucaacgcuggu

SEQ ID NO: 3915986 - RNA, 15 nt, Human adenovirus C
acaauaccugugugg

SEQ ID NO: 3915987 - RNA, 15 nt, Human adenovirus C
acacaauaaauuacu

SEQ ID NO: 3915988 - RNA, 21 nt, Human adenovirus C
acacccagcagaaaccugugc

SEQ ID NO: 3915989 - RNA, 19 nt, Human adenovirus C
acaccggggcgcgcugcgg

SEQ ID NO: 3915990 - RNA, 22 nt, Human adenovirus C
acaccggggcgcgcugcggcug

SEQ ID NO: 3915991 - RNA, 14 nt, Human adenovirus C
acaccuacucuggc

SEQ ID NO: 3915992 - RNA, 23 nt, Human adenovirus C
acaccuacucuggcuccauacca

SEQ ID NO: 3915993 - RNA, 19 nt, Human adenovirus C
acacgggaggagcgggaag

SEQ ID NO: 3915994 - RNA, 19 nt, Human adenovirus C
cugacgccagacgccgcac

SEQ ID NO: 3915995 - RNA, 20 nt, Human adenovirus C
cugacgcguuccggcagcag

SEQ ID NO: 3915996 - RNA, 21 nt, Human adenovirus C
cugacgcguuccggcagcagc

SEQ ID NO: 3915997 - RNA, 19 nt, Human adenovirus C
cugagccccgggcuggugc

SEQ ID NO: 3915998 - RNA, 19 nt, Human adenovirus C
cugaggccgaggcagcggc

SEQ ID NO: 3915999 - RNA, 18 nt, Human adenovirus C
cugaguacacagcccgcc

SEQ ID NO: 3916000 - RNA, 13 nt, Human adenovirus C
cugagucuccaga

SEQ ID NO: 3916001 - RNA, 13 nt, Human adenovirus C
cugauaacaucca

SEQ ID NO: 3916002 - RNA, 12 nt, Human adenovirus C
cugcaaacauca

SEQ ID NO: 3916003 - RNA, 20 nt, Human adenovirus C
cugcaaagggcccuggcugg

SEQ ID NO: 3916004 - RNA, 14 nt, Human adenovirus C
cugcaaccuggucu

SEQ ID NO: 3916005 - RNA, 19 nt, Human adenovirus C
cugcaccacauuucggccc

SEQ ID NO: 3916006 - RNA, 22 nt, Human adenovirus C
cugcacgucuagggcgcaguag

SEQ ID NO: 3916007 - RNA, 13 nt, Human adenovirus C
cugcacugcaaau

SEQ ID NO: 3916008 - RNA, 14 nt, Human adenovirus C
cugcagaauuaagg

SEQ ID NO: 3916009 - RNA, 22 nt, Human adenovirus C
cugcagaccguaaaccugagcc

SEQ ID NO: 3916010 - RNA, 23 nt, Human adenovirus C
cugcagagcauaguggugcagga

SEQ ID NO: 3916011 - RNA, 13 nt, Human adenovirus C
cugcagagccagc

SEQ ID NO: 3916012 - RNA, 14 nt, Human adenovirus C
cugcagcacagcac

SEQ ID NO: 3916013 - RNA, 14 nt, Human adenovirus C
cugcagccuccgcc

SEQ ID NO: 3916014 - RNA, 14 nt, Human adenovirus C
cugcagcuagccaa

SEQ ID NO: 3916015 - RNA, 23 nt, Human adenovirus C
cugccagcgccugcacugcaaau

SEQ ID NO: 3916016 - RNA, 12 nt, Human adenovirus C
cugcccaagacu

SEQ ID NO: 3916017 - RNA, 20 nt, Human adenovirus C
cugcccgccaccugcugugc

SEQ ID NO: 3916018 - RNA, 13 nt, Human adenovirus C
cugccgcccccgc

SEQ ID NO: 3916019 - RNA, 21 nt, Human adenovirus C
cugccgcccccgcugcgcaac

SEQ ID NO: 3916020 - RNA, 14 nt, Human adenovirus C
cugcgacgggccga

SEQ ID NO: 3916021 - RNA, 19 nt, Human adenovirus C
cugcgacuuaccgcagccg

SEQ ID NO: 3916022 - RNA, 15 nt, Human adenovirus C
cugcgagggccagcu

SEQ ID NO: 3916023 - RNA, 13 nt, Human adenovirus C
cugcucccagagc

SEQ ID NO: 3916024 - RNA, 15 nt, Human adenovirus C
cugcuccucuucccg

SEQ ID NO: 3916025 - RNA, 15 nt, Human adenovirus C
cugcugcagccgcag

SEQ ID NO: 3916026 - RNA, 18 nt, Human adenovirus C
cugcugggcgaggaggag

SEQ ID NO: 3916027 - RNA, 17 nt, Human adenovirus C
cugcuuaaaagccaccu

SEQ ID NO: 3916028 - RNA, 22 nt, Human adenovirus C
cugcuuuacggauuugucaccc

SEQ ID NO: 3916029 - RNA, 14 nt, Human adenovirus C
cuggaacagcagca

SEQ ID NO: 3916030 - RNA, 10 nt, Human adenovirus C
cuggaccccc

SEQ ID NO: 3916031 - RNA, 17 nt, Human adenovirus C
cuggaccggcugguggg

SEQ ID NO: 3916032 - RNA, 16 nt, Human adenovirus C
cuggagcugcccaaga

SEQ ID NO: 3916033 - RNA, 20 nt, Human adenovirus C
cuggagcugcccaagacuac

SEQ ID NO: 3916034 - RNA, 13 nt, Human adenovirus C
cuggaggcagcug

SEQ ID NO: 3916035 - RNA, 23 nt, Human adenovirus C
cuggcaagauaucggcaccagca

SEQ ID NO: 3916036 - RNA, 10 nt, Human adenovirus C
cuggccaggg

SEQ ID NO: 3916037 - RNA, 15 nt, Human adenovirus C
cuggccccgcgacac

SEQ ID NO: 3916038 - RNA, 18 nt, Human adenovirus C
cuggccuuaaaaagcauc

SEQ ID NO: 3916039 - RNA, 17 nt, Human adenovirus C
cuggcggaggugcugcu

SEQ ID NO: 3916040 - RNA, 18 nt, Human adenovirus C
cuggcggguuuggcuggu

SEQ ID NO: 3916041 - RNA, 20 nt, Human adenovirus C
cuggcgguagaggggccagc

SEQ ID NO: 3916042 - RNA, 19 nt, Human adenovirus C
cugggacagucaggcagag

SEQ ID NO: 3916043 - RNA, 13 nt, Human adenovirus C
cuggggcgcgcac

SEQ ID NO: 3916044 - RNA, 13 nt, Human adenovirus C
cuggggugaugca

SEQ ID NO: 3916045 - RNA, 16 nt, Human adenovirus C
cugggguuugacccag

SEQ ID NO: 3916046 - RNA, 22 nt, Human adenovirus C
cugggugugcgcggcaccagcg

SEQ ID NO: 3916047 - RNA, 23 nt, Human adenovirus C
cugguacuuuaacggcucuucau

SEQ ID NO: 3916048 - RNA, 21 nt, Human adenovirus C
cuggucuugucaugccugggg

SEQ ID NO: 3916049 - RNA, 15 nt, Human adenovirus C
cugguguaccaggaa

SEQ ID NO: 3916050 - RNA, 15 nt, Human adenovirus C
cuggugugggaggac

SEQ ID NO: 3916051 - RNA, 20 nt, Human adenovirus C
cugguuauacgccaucaucu

SEQ ID NO: 3916052 - RNA, 15 nt, Human adenovirus C
cuguaacgcuggacc

SEQ ID NO: 3916053 - RNA, 17 nt, Human adenovirus C
cuguaacgcuggaccug

SEQ ID NO: 3916054 - RNA, 21 nt, Human adenovirus C
cugucaugguuuuuugcagua

SEQ ID NO: 3916055 - RNA, 16 nt, Human adenovirus C
cuguccauggucugga

SEQ ID NO: 3916056 - RNA, 17 nt, Human adenovirus C
cuguccauggucuggag

SEQ ID NO: 3916057 - RNA, 17 nt, Human adenovirus C
cugucgagccaaacgcu

SEQ ID NO: 3916058 - RNA, 15 nt, Human adenovirus C
cugucuuacaaaccu

SEQ ID NO: 3916059 - RNA, 20 nt, Human adenovirus C
cugugccuuuuacugcugcu

SEQ ID NO: 3916060 - RNA, 11 nt, Human adenovirus C
cugugcugcca

SEQ ID NO: 3916061 - RNA, 15 nt, Human adenovirus C
cugugcugccagggc

SEQ ID NO: 3916062 - RNA, 17 nt, Human adenovirus C
cuuacaauuaccucagg

SEQ ID NO: 3916063 - RNA, 17 nt, Human adenovirus C
cuuaccauuacacuuaa

SEQ ID NO: 3916064 - RNA, 18 nt, Human adenovirus C
cuuaccccuccauuuguu

SEQ ID NO: 3916065 - RNA, 14 nt, Human adenovirus C
cuuacucccaauga

SEQ ID NO: 3916066 - RNA, 22 nt, Human adenovirus C
cuuagaaccaaaguugcaggag

SEQ ID NO: 3916067 - RNA, 17 nt, Human adenovirus C
cuuagaguugacggggc

SEQ ID NO: 3916068 - RNA, 17 nt, Human adenovirus C
cuuauccucaucugcag

SEQ ID NO: 3916069 - RNA, 23 nt, Human adenovirus C
cuuaugccaggccuacaaauccu

SEQ ID NO: 3916070 - RNA, 13 nt, Human adenovirus C
cuuauuuguugcc

SEQ ID NO: 3916071 - RNA, 17 nt, Human adenovirus C
cuucaaccccuuuucug

SEQ ID NO: 3916072 - RNA, 22 nt, Human adenovirus C
cuucacgaucuuggccuugcua

SEQ ID NO: 3916073 - RNA, 14 nt, Human adenovirus C
cuucagcuggggcu

SEQ ID NO: 3916074 - RNA, 18 nt, Human adenovirus C
cuucauucagccgccgca

SEQ ID NO: 3916075 - RNA, 24 nt, Human adenovirus C
cuuccacuuggucaggcaguagcu

SEQ ID NO: 3916076 - RNA, 14 nt, Human adenovirus C
cuuccagcccauga

SEQ ID NO: 3916077 - RNA, 21 nt, Human adenovirus C
cuuccaggcgcggcggcugcu

SEQ ID NO: 3916078 - RNA, 20 nt, Human adenovirus C
cuuccauaagggccuccccu

SEQ ID NO: 3916079 - RNA, 18 nt, Human adenovirus C
cuucccccguaacauccu

SEQ ID NO: 3916080 - RNA, 19 nt, Human adenovirus C
cuuccuagcgacuuugugc

SEQ ID NO: 3916081 - RNA, 16 nt, Human adenovirus C
cuuccucccaacucug

SEQ ID NO: 3916082 - RNA, 18 nt, Human adenovirus C
cuuccuggagcgccacuc

SEQ ID NO: 3916083 - RNA, 17 nt, Human adenovirus C
cuuccuuuuccucuugc

SEQ ID NO: 3916084 - RNA, 20 nt, Human adenovirus C
cuucgaucucagcgcagcgg

SEQ ID NO: 3916085 - RNA, 18 nt, Human adenovirus C
cuucggcaucgcgggcgc

SEQ ID NO: 3916086 - RNA, 21 nt, Human adenovirus C
cuucuucaaucuccucuucca

SEQ ID NO: 3916087 - RNA, 18 nt, Human adenovirus C
cuugaaagugggcaggca

SEQ ID NO: 3916088 - RNA, 17 nt, Human adenovirus C
cuugaacccgcacuggc

SEQ ID NO: 3916089 - RNA, 15 nt, Human adenovirus C
cuugacauuggcugg

SEQ ID NO: 3916090 - RNA, 16 nt, Human adenovirus C
cuugaggaggaggaag

SEQ ID NO: 3916091 - RNA, 18 nt, Human adenovirus C
cuugaucugcuggcgcag

SEQ ID NO: 3916092 - RNA, 20 nt, Human adenovirus C
cuugcaagcagugcagcuuc

SEQ ID NO: 3916093 - RNA, 18 nt, Human adenovirus C
cuugcuggaacagagcuc

SEQ ID NO: 3916094 - RNA, 21 nt, Human adenovirus C
cuuggaaaaaaugaccgugga

SEQ ID NO: 3916095 - RNA, 19 nt, Human adenovirus C
cuuggccaauugcaagcca

SEQ ID NO: 3916096 - RNA, 14 nt, Human adenovirus C
cuuggcgcgcagcu

SEQ ID NO: 3916097 - RNA, 17 nt, Human adenovirus C
cuuggguccggccugcu

SEQ ID NO: 3916098 - RNA, 12 nt, Human adenovirus C
cuuguugaccag

SEQ ID NO: 3916099 - RNA, 20 nt, Human adenovirus C
cuuuccgccgccaacaugcu

SEQ ID NO: 3916100 - RNA, 14 nt, Human adenovirus C
cuuugcgucucugg

SEQ ID NO: 3916101 - RNA, 15 nt, Human adenovirus C
cuuuggggucacugc

SEQ ID NO: 3916102 - RNA, 17 nt, Human adenovirus C
cuuugguucuuacaaaa

SEQ ID NO: 3916103 - RNA, 21 nt, Human adenovirus C
gaaaagcuuauuauucgccac

SEQ ID NO: 3916104 - RNA, 17 nt, Human adenovirus C
gaaaaguccgcggcucc

SEQ ID NO: 3916105 - RNA, 18 nt, Human adenovirus C
gaaaaugccuugauuuuc

SEQ ID NO: 3916106 - RNA, 23 nt, Human adenovirus C
gaaacagagggcugccugcacuu

SEQ ID NO: 3916107 - RNA, 19 nt, Human adenovirus C
gaaaccccacgguggcacc

SEQ ID NO: 3916108 - RNA, 21 nt, Human adenovirus C
gaaaccgggccuccaacugug

SEQ ID NO: 3916109 - RNA, 20 nt, Human adenovirus C
gaaauccacagcggcggcag

SEQ ID NO: 3916110 - RNA, 15 nt, Human adenovirus C
gcccagucugcaaga

SEQ ID NO: 3916111 - RNA, 14 nt, Human adenovirus C
gcccaugagccggc

SEQ ID NO: 3916112 - RNA, 17 nt, Human adenovirus C
gccccaaucaaucagcc

SEQ ID NO: 3916113 - RNA, 15 nt, Human adenovirus C
gccccaggcugggga

SEQ ID NO: 3916114 - RNA, 17 nt, Human adenovirus C
gccccccggcgcccgcg

SEQ ID NO: 3916115 - RNA, 18 nt, Human adenovirus C
gccccccuucucccaccc

SEQ ID NO: 3916116 - RNA, 17 nt, Human adenovirus C
gccccgggcuggugcag

SEQ ID NO: 3916117 - RNA, 19 nt, Human adenovirus C
gccccgggcuggugcaguu

SEQ ID NO: 3916118 - RNA, 23 nt, Human adenovirus C
gccccuccgcggcguggcccuug

SEQ ID NO: 3916119 - RNA, 24 nt, Human adenovirus C
gccccucgccauagcggaugucag

SEQ ID NO: 3916120 - RNA, 20 nt, Human adenovirus C
gcccgagggcaacuacuccg

SEQ ID NO: 3916121 - RNA, 21 nt, Human adenovirus C
gcccgccggcuaugcacugca

SEQ ID NO: 3916122 - RNA, 21 nt, Human adenovirus C
gcccgcugucauaccacugca

SEQ ID NO: 3916123 - RNA, 17 nt, Human adenovirus C
gcccgggggaggcaagc

SEQ ID NO: 3916124 - RNA, 23 nt, Human adenovirus C
gcccguucaugggaaacuggcaa

SEQ ID NO: 3916125 - RNA, 21 nt, Human adenovirus C
gcccuaacaguggcaaccacc

SEQ ID NO: 3916126 - RNA, 19 nt, Human adenovirus C
gcccuaccugugcuuugcu

SEQ ID NO: 3916127 - RNA, 18 nt, Human adenovirus C
gcccuaucagcagccgcg

SEQ ID NO: 3916128 - RNA, 16 nt, Human adenovirus C
gcccuccaccuucagc

SEQ ID NO: 3916129 - RNA, 21 nt, Human adenovirus C
gcccugcgcgcgcgaguugcg

SEQ ID NO: 3916130 - RNA, 18 nt, Human adenovirus C
gcccugcgcgucggccag

SEQ ID NO: 3916131 - RNA, 22 nt, Human adenovirus C
gcccugcuuaaccgcgcacguc

SEQ ID NO: 3916132 - RNA, 15 nt, Human adenovirus C
gcccuggaggcagcu

SEQ ID NO: 3916133 - RNA, 21 nt, Human adenovirus C
gcccuggcuggcacgggcagc

SEQ ID NO: 3916134 - RNA, 20 nt, Human adenovirus C
gcccuuggaggaggcgccgc

SEQ ID NO: 3916135 - RNA, 15 nt, Human adenovirus C
gccgacuuggaggag

SEQ ID NO: 3916136 - RNA, 13 nt, Human adenovirus C
gccgagcuguugc

SEQ ID NO: 3916137 - RNA, 15 nt, Human adenovirus C
gccgaggaugaagaa

SEQ ID NO: 3916138 - RNA, 17 nt, Human adenovirus C
gccgcacgaggggcagu

SEQ ID NO: 3916139 - RNA, 16 nt, Human adenovirus C
gccgcaggccccgcag

SEQ ID NO: 3916140 - RNA, 21 nt, Human adenovirus C
gccgccgcuucagccgcugca

SEQ ID NO: 3916141 - RNA, 15 nt, Human adenovirus C
gccgccggcacugcc

SEQ ID NO: 3916142 - RNA, 18 nt, Human adenovirus C
gccgccguuagcccaaga

SEQ ID NO: 3916143 - RNA, 13 nt, Human adenovirus C
gccgccugcugca

SEQ ID NO: 3916144 - RNA, 13 nt, Human adenovirus C
gccgcgcaccugg

SEQ ID NO: 3916145 - RNA, 19 nt, Human adenovirus C
gccgcgcgcgggcaggagc

SEQ ID NO: 3916146 - RNA, 23 nt, Human adenovirus C
gccgcggugcaggcggccgcugc

SEQ ID NO: 3916147 - RNA, 18 nt, Human adenovirus C
gccggacugcggcgaacg

SEQ ID NO: 3916148 - RNA, 20 nt, Human adenovirus C
gccggagaucuauggccccc

SEQ ID NO: 3916149 - RNA, 14 nt, Human adenovirus C
gccggcgccccaga

SEQ ID NO: 3916150 - RNA, 17 nt, Human adenovirus C
gccgucaucccugagca

SEQ ID NO: 3916151 - RNA, 22 nt, Human adenovirus C
gccgucgccagcccgugcuggc

SEQ ID NO: 3916152 - RNA, 17 nt, Human adenovirus C
gccgugagcgugagccg

SEQ ID NO: 3916153 - RNA, 23 nt, Human adenovirus C
gccgugccagaggugcuugccac

SEQ ID NO: 3916154 - RNA, 20 nt, Human adenovirus C
gccgugcugaaacgcagcau

SEQ ID NO: 3916155 - RNA, 23 nt, Human adenovirus C
gccguugauguuguggcccacga

SEQ ID NO: 3916156 - RNA, 17 nt, Human adenovirus C
gccuccccuucuucuuc

SEQ ID NO: 3916157 - RNA, 20 nt, Human adenovirus C
gccucggaguaccugagccc

SEQ ID NO: 3916158 - RNA, 16 nt, Human adenovirus C
gccucggcgguggcag

SEQ ID NO: 3916159 - RNA, 16 nt, Human adenovirus C
gccucucagaugcuga

SEQ ID NO: 3916160 - RNA, 20 nt, Human adenovirus C
gccugaagauggcaugugag

SEQ ID NO: 3916161 - RNA, 20 nt, Human adenovirus C
gccugccgacuuggaggagc

SEQ ID NO: 3916162 - RNA, 20 nt, Human adenovirus C
gccugcugaaugcgcaggcg

SEQ ID NO: 3916163 - RNA, 22 nt, Human adenovirus C
gccugcugaaugcgcaggcggu

SEQ ID NO: 3916164 - RNA, 12 nt, Human adenovirus C
gccuggaggagc

SEQ ID NO: 3916165 - RNA, 20 nt, Human adenovirus C
gccuggcggguuuggcuggu

SEQ ID NO: 3916166 - RNA, 14 nt, Human adenovirus C
gccuguccucgagc

SEQ ID NO: 3916167 - RNA, 14 nt, Human adenovirus C
gccugugaugcugg

SEQ ID NO: 3916168 - RNA, 15 nt, Human adenovirus C
gccuguugcugcugc

SEQ ID NO: 3916169 - RNA, 17 nt, Human adenovirus C
gccuguuugaaaggugu

SEQ ID NO: 3916170 - RNA, 16 nt, Human adenovirus C
gccuuccggagcgagg

SEQ ID NO: 3916171 - RNA, 20 nt, Human adenovirus C
gccuugcaggcgcagagaca

SEQ ID NO: 3916172 - RNA, 19 nt, Human adenovirus C
gcgaaaagaaccugccucc

SEQ ID NO: 3916173 - RNA, 14 nt, Human adenovirus C
gcgaacggagucaa

SEQ ID NO: 3916174 - RNA, 18 nt, Human adenovirus C
gcgaaggaggcaggaccc

SEQ ID NO: 3916175 - RNA, 12 nt, Human adenovirus C
gcgaccgcgagg

SEQ ID NO: 3916176 - RNA, 20 nt, Human adenovirus C
gcgacgggguaacgcccagc

SEQ ID NO: 3916177 - RNA, 22 nt, Human adenovirus C
gcgagauugagcuccacgugcc

SEQ ID NO: 3916178 - RNA, 19 nt, Human adenovirus C
gcgaggccauaggucaggc

SEQ ID NO: 3916179 - RNA, 13 nt, Human adenovirus C
gcgagugguggcu

SEQ ID NO: 3916180 - RNA, 16 nt, Human adenovirus C
gcgcaaaaucaaagaa

SEQ ID NO: 3916181 - RNA, 20 nt, Human adenovirus C
gcgcaacauggaaccgggca

SEQ ID NO: 3916182 - RNA, 16 nt, Human adenovirus C
gcgcaacugggcagca

SEQ ID NO: 3916183 - RNA, 16 nt, Human adenovirus C
gcgcaccaccggcggc

SEQ ID NO: 3916184 - RNA, 22 nt, Human adenovirus C
gcgcacucacagaccugggcca

SEQ ID NO: 3916185 - RNA, 18 nt, Human adenovirus C
gcgccaaaaacuggugcu

SEQ ID NO: 3916186 - RNA, 15 nt, Human adenovirus C
gcgcccacaccuaca

SEQ ID NO: 3916187 - RNA, 13 nt, Human adenovirus C
gcgcccaggcggc

SEQ ID NO: 3916188 - RNA, 13 nt, Human adenovirus C
gcgccccccuccu

SEQ ID NO: 3916189 - RNA, 16 nt, Human adenovirus C
gcgcccuaccugugcu

SEQ ID NO: 3916190 - RNA, 13 nt, Human adenovirus C
gcgcccuggggcg

SEQ ID NO: 3916191 - RNA, 16 nt, Human adenovirus C
gcgcccuucacggaca

SEQ ID NO: 3916192 - RNA, 16 nt, Human adenovirus C
gcgccgcgcgcgggca

SEQ ID NO: 3916193 - RNA, 11 nt, Human adenovirus C
gcgccucccaa

SEQ ID NO: 3916194 - RNA, 13 nt, Human adenovirus C
gcgcgagggacag

SEQ ID NO: 3916195 - RNA, 16 nt, Human adenovirus C
gcgcgcaacgcaccgc

SEQ ID NO: 3916196 - RNA, 20 nt, Human adenovirus C
gcgcgcaacuacacgcccac

SEQ ID NO: 3916197 - RNA, 14 nt, Human adenovirus C
gcgcgcccgccagc

SEQ ID NO: 3916198 - RNA, 15 nt, Human adenovirus C
gcgcgcgcugcccgu

SEQ ID NO: 3916199 - RNA, 12 nt, Human adenovirus C
gcgcgcuggggc

SEQ ID NO: 3916200 - RNA, 16 nt, Human adenovirus C
gcgcgcuggucucugg

SEQ ID NO: 3916201 - RNA, 18 nt, Human adenovirus C
gcgcucguugguccagca

SEQ ID NO: 3916202 - RNA, 17 nt, Human adenovirus C
gcgcugcggccccgcgg

SEQ ID NO: 3916203 - RNA, 15 nt, Human adenovirus C
gcgcugcggcugcug

SEQ ID NO: 3916204 - RNA, 20 nt, Human adenovirus C
gcgcuggggcaggaggacac

SEQ ID NO: 3916205 - RNA, 17 nt, Human adenovirus C
gcgcuguaccugccaga

SEQ ID NO: 3916206 - RNA, 19 nt, Human adenovirus C
gcgcuuaccucccuugccg

SEQ ID NO: 3916207 - RNA, 15 nt, Human adenovirus C
gcgcuuuccaggcuu

SEQ ID NO: 3916208 - RNA, 19 nt, Human adenovirus C
gcggaggcucucuucagca

SEQ ID NO: 3916209 - RNA, 16 nt, Human adenovirus C
gcggagggugccagac

SEQ ID NO: 3916210 - RNA, 16 nt, Human adenovirus C
gcggaugcuggcgcgc

SEQ ID NO: 3916211 - RNA, 18 nt, Human adenovirus C
gcggaugucagccuugcc

SEQ ID NO: 3916212 - RNA, 14 nt, Human adenovirus C
gcggcaacccuucc

SEQ ID NO: 3916213 - RNA, 12 nt, Human adenovirus C
gcggcagcagca

SEQ ID NO: 3916214 - RNA, 15 nt, Human adenovirus C
gcggcagcggcagcg

SEQ ID NO: 3916215 - RNA, 23 nt, Human adenovirus C
gcggccauucagaccguggugcg

SEQ ID NO: 3916216 - RNA, 16 nt, Human adenovirus C
gcggccugggcgaaga

SEQ ID NO: 3916217 - RNA, 13 nt, Human adenovirus C
gcggcgacagguc

SEQ ID NO: 3916218 - RNA, 13 nt, Human adenovirus C
gcggcgaccugaa

SEQ ID NO: 3916219 - RNA, 13 nt, Human adenovirus C
gcggcggcagcag

SEQ ID NO: 3916220 - RNA, 16 nt, Human adenovirus C
gcggcggcggcaggag

SEQ ID NO: 3916221 - RNA, 13 nt, Human adenovirus C
gcggcggcggcgc

SEQ ID NO: 3916222 - RNA, 13 nt, Human adenovirus C
gcggcggcuggcg

SEQ ID NO: 3916223 - RNA, 15 nt, Human adenovirus C
gcggcggugggggag

SEQ ID NO: 3916224 - RNA, 15 nt, Human adenovirus C
gcggcugcuguugcu

SEQ ID NO: 3916225 - RNA, 14 nt, Human adenovirus C
gcgggagcuccugc

SEQ ID NO: 3916226 - RNA, 15 nt, Human adenovirus C
gcgggagcuccugca

SEQ ID NO: 3916227 - RNA, 14 nt, Human adenovirus C
accauuaagaacua

SEQ ID NO: 3916228 - RNA, 17 nt, Human adenovirus C
accauuacugacgccag

SEQ ID NO: 3916229 - RNA, 17 nt, Human adenovirus C
acccaagggugcagcug

SEQ ID NO: 3916230 - RNA, 18 nt, Human adenovirus C
acccacccaaagcagacc

SEQ ID NO: 3916231 - RNA, 20 nt, Human adenovirus C
acccaccgugcagcugaugg

SEQ ID NO: 3916232 - RNA, 14 nt, Human adenovirus C
acccccacugagau

SEQ ID NO: 3916233 - RNA, 17 nt, Human adenovirus C
accccgccaacgugccc

SEQ ID NO: 3916234 - RNA, 15 nt, Human adenovirus C
acccgcaacuucaga

SEQ ID NO: 3916235 - RNA, 13 nt, Human adenovirus C
acccgcaccuaca

SEQ ID NO: 3916236 - RNA, 15 nt, Human adenovirus C
acccggagaugcagc

SEQ ID NO: 3916237 - RNA, 19 nt, Human adenovirus C
acccggcggugcgggcggc

SEQ ID NO: 3916238 - RNA, 13 nt, Human adenovirus C
acccuggcugugg

SEQ ID NO: 3916239 - RNA, 14 nt, Human adenovirus C
acccuggugcugcc

SEQ ID NO: 3916240 - RNA, 16 nt, Human adenovirus C
acccuggugcugccaa

SEQ ID NO: 3916241 - RNA, 15 nt, Human adenovirus C
acccuuccaggaggg

SEQ ID NO: 3916242 - RNA, 12 nt, Human adenovirus C
accgcaaaguga

SEQ ID NO: 3916243 - RNA, 13 nt, Human adenovirus C
accgccgccgacc

SEQ ID NO: 3916244 - RNA, 12 nt, Human adenovirus C
accgccucagcu

SEQ ID NO: 3916245 - RNA, 14 nt, Human adenovirus C
accgccuccaccga

SEQ ID NO: 3916246 - RNA, 19 nt, Human adenovirus C
accgccuccaccgaugccg

SEQ ID NO: 3916247 - RNA, 14 nt, Human adenovirus C
accgcgcggcgggc

SEQ ID NO: 3916248 - RNA, 15 nt, Human adenovirus C
accggagugcugggc

SEQ ID NO: 3916249 - RNA, 21 nt, Human adenovirus C
accggcggcggcgcgcgucgc

SEQ ID NO: 3916250 - RNA, 15 nt, Human adenovirus C
accguagaugggaca

SEQ ID NO: 3916251 - RNA, 13 nt, Human adenovirus C
accgucacccagc

SEQ ID NO: 3916252 - RNA, 19 nt, Human adenovirus C
accgugaaugcccuccgcc

SEQ ID NO: 3916253 - RNA, 13 nt, Human adenovirus C
accgugcagcuga

SEQ ID NO: 3916254 - RNA, 13 nt, Human adenovirus C
caggaggacacgg

SEQ ID NO: 3916255 - RNA, 14 nt, Human adenovirus C
caggcgcugaaaga

SEQ ID NO: 3916256 - RNA, 12 nt, Human adenovirus C
caggcgggagcu

SEQ ID NO: 3916257 - RNA, 23 nt, Human adenovirus C
caggcuccuuugucuggagaaac

SEQ ID NO: 3916258 - RNA, 14 nt, Human adenovirus C
cagggccaggucgg

SEQ ID NO: 3916259 - RNA, 16 nt, Human adenovirus C
cagggcgaaggugaca

SEQ ID NO: 3916260 - RNA, 21 nt, Human adenovirus C
cagggcggggauggcgcaggc

SEQ ID NO: 3916261 - RNA, 21 nt, Human adenovirus C
cagggcuacgugcgccaggcc

SEQ ID NO: 3916262 - RNA, 13 nt, Human adenovirus C
caggugagcucug

SEQ ID NO: 3916263 - RNA, 12 nt, Human adenovirus C
cagguuccugag

SEQ ID NO: 3916264 - RNA, 23 nt, Human adenovirus C
cagguuggaauucuucaccagca

SEQ ID NO: 3916265 - RNA, 15 nt, Human adenovirus C
caguagacaaggccu

SEQ ID NO: 3916266 - RNA, 23 nt, Human adenovirus C
caguaguauagccccaccaccac

SEQ ID NO: 3916267 - RNA, 16 nt, Human adenovirus C
caguauuacccagaaa

SEQ ID NO: 3916268 - RNA, 18 nt, Human adenovirus C
cagucaggcagaggaggu

SEQ ID NO: 3916269 - RNA, 15 nt, Human adenovirus C
cagucguagcaggag

SEQ ID NO: 3916270 - RNA, 16 nt, Human adenovirus C
cagucguagcaggagc

SEQ ID NO: 3916271 - RNA, 20 nt, Human adenovirus C
cagugcaacaugaccaagga

SEQ ID NO: 3916272 - RNA, 16 nt, Human adenovirus C
cagugcccgcugucau

SEQ ID NO: 3916273 - RNA, 21 nt, Human adenovirus C
caguggaacgaagcugaugcu

SEQ ID NO: 3916274 - RNA, 14 nt, Human adenovirus C
caguggacgcggcc

SEQ ID NO: 3916275 - RNA, 19 nt, Human adenovirus C
caguggagaggcagagcga

SEQ ID NO: 3916276 - RNA, 18 nt, Human adenovirus C
caguggcaaccaccgcuc

SEQ ID NO: 3916277 - RNA, 17 nt, Human adenovirus C
caguggcaacuggcaaa

SEQ ID NO: 3916278 - RNA, 18 nt, Human adenovirus C
caguugccgaggaugaag

SEQ ID NO: 3916279 - RNA, 14 nt, Human adenovirus C
caguuuauucccaa

SEQ ID NO: 3916280 - RNA, 21 nt, Human adenovirus C
cauaaaguugcgugugaugcg

SEQ ID NO: 3916281 - RNA, 16 nt, Human adenovirus C
cauaaauaaaaaccag

SEQ ID NO: 3916282 - RNA, 17 nt, Human adenovirus C
cauaacuuggacauaaa

SEQ ID NO: 3916283 - RNA, 22 nt, Human adenovirus C
cauagaugccaugaaccacccu

SEQ ID NO: 3916284 - RNA, 20 nt, Human adenovirus C
cauagcggaugucagccuug

SEQ ID NO: 3916285 - RNA, 21 nt, Human adenovirus C
cauagcuauaaaugcaggaaa

SEQ ID NO: 3916286 - RNA, 17 nt, Human adenovirus C
cauaguccagccccucc

SEQ ID NO: 3916287 - RNA, 22 nt, Human adenovirus C
cauaucccagggaacaacccau

SEQ ID NO: 3916288 - RNA, 19 nt, Human adenovirus C
caucaaacaauacuaaaaa

SEQ ID NO: 3916289 - RNA, 23 nt, Human adenovirus C
caucaaacaauacuaaaaaacug

SEQ ID NO: 3916290 - RNA, 15 nt, Human adenovirus C
cauccaccaccaucc

SEQ ID NO: 3916291 - RNA, 13 nt, Human adenovirus C
cauccaugacagg

SEQ ID NO: 3916292 - RNA, 15 nt, Human adenovirus C
cauccccgcggcgcg

SEQ ID NO: 3916293 - RNA, 13 nt, Human adenovirus C
cauccgcccugcu

SEQ ID NO: 3916294 - RNA, 14 nt, Human adenovirus C
cauccggugcugcg

SEQ ID NO: 3916295 - RNA, 20 nt, Human adenovirus C
cauccguggccuugcaggcg

SEQ ID NO: 3916296 - RNA, 17 nt, Human adenovirus C
caucgaggucacccacu

SEQ ID NO: 3916297 - RNA, 10 nt, Human adenovirus C
caucgcgccu

SEQ ID NO: 3916298 - RNA, 21 nt, Human adenovirus C
caucgcuaugcgccacuggca

SEQ ID NO: 3916299 - RNA, 21 nt, Human adenovirus C
caugaaccacccuacuuuccc

SEQ ID NO: 3916300 - RNA, 14 nt, Human adenovirus C
caugaagaucugga

SEQ ID NO: 3916301 - RNA, 17 nt, Human adenovirus C
caugaagaucuggaagg

SEQ ID NO: 3916302 - RNA, 21 nt, Human adenovirus C
caugaccaugaagaucuggaa

SEQ ID NO: 3916303 - RNA, 16 nt, Human adenovirus C
caugcacgcagcaccu

SEQ ID NO: 3916304 - RNA, 19 nt, Human adenovirus C
caugcagggcacccucccc

SEQ ID NO: 3916305 - RNA, 12 nt, Human adenovirus C
agagacaggacu

SEQ ID NO: 3916306 - RNA, 23 nt, Human adenovirus C
agagcaaaauuuccaacaaaagg

SEQ ID NO: 3916307 - RNA, 18 nt, Human adenovirus C
agagcaacaacagcgcca

SEQ ID NO: 3916308 - RNA, 16 nt, Human adenovirus C
agagccuaguggacaa

SEQ ID NO: 3916309 - RNA, 14 nt, Human adenovirus C
agagcgacugcgcc

SEQ ID NO: 3916310 - RNA, 22 nt, Human adenovirus C
agagcguggugagcgcggcgcc

SEQ ID NO: 3916311 - RNA, 15 nt, Human adenovirus C
agaggaccucugcac

SEQ ID NO: 3916312 - RNA, 20 nt, Human adenovirus C
agaggagcugcugagccgcc

SEQ ID NO: 3916313 - RNA, 18 nt, Human adenovirus C
agaggccgaguccuacuu

SEQ ID NO: 3916314 - RNA, 20 nt, Human adenovirus C
agauaucggcaccagcaaua

SEQ ID NO: 3916315 - RNA, 21 nt, Human adenovirus C
agauauggcccucaccugccg

SEQ ID NO: 3916316 - RNA, 13 nt, Human adenovirus C
agaucagcuggga

SEQ ID NO: 3916317 - RNA, 14 nt, Human adenovirus C
agaucagcugggaa

SEQ ID NO: 3916318 - RNA, 12 nt, Human adenovirus C
agauccgcgucc

SEQ ID NO: 3916319 - RNA, 13 nt, Human adenovirus C
agaucggcggcgc

SEQ ID NO: 3916320 - RNA, 14 nt, Human adenovirus C
agaucuccgcgucc

SEQ ID NO: 3916321 - RNA, 13 nt, Human adenovirus C
agaucuuauucca

SEQ ID NO: 3916322 - RNA, 20 nt, Human adenovirus C
agaucuugguugugggccau

SEQ ID NO: 3916323 - RNA, 19 nt, Human adenovirus C
agaugacuaacucaggggc

SEQ ID NO: 3916324 - RNA, 21 nt, Human adenovirus C
agaugccgcggugcaggcggc

SEQ ID NO: 3916325 - RNA, 19 nt, Human adenovirus C
agaugcgggccaugagcug

SEQ ID NO: 3916326 - RNA, 12 nt, Human adenovirus C
agauggccuggc

SEQ ID NO: 3916327 - RNA, 21 nt, Human adenovirus C
agauugagguacugaaaugug

SEQ ID NO: 3916328 - RNA, 14 nt, Human adenovirus C
agcaacaacagcgc

SEQ ID NO: 3916329 - RNA, 12 nt, Human adenovirus C
agcaacagcagc

SEQ ID NO: 3916330 - RNA, 16 nt, Human adenovirus C
agcaacagcaggagga

SEQ ID NO: 3916331 - RNA, 22 nt, Human adenovirus C
agcaagccgcucauggcgcagc

SEQ ID NO: 3916332 - RNA, 14 nt, Human adenovirus C
agcaaggccugccc

SEQ ID NO: 3916333 - RNA, 14 nt, Human adenovirus C
agcaaggccuggaa

SEQ ID NO: 3916334 - RNA, 13 nt, Human adenovirus C
agcacagcaccac

SEQ ID NO: 3916335 - RNA, 23 nt, Human adenovirus C
agcagaaaccugugcugccaggg

SEQ ID NO: 3916336 - RNA, 17 nt, Human adenovirus C
agcagacggugaaccag

SEQ ID NO: 3916337 - RNA, 14 nt, Human adenovirus C
agcagagcgugagc

SEQ ID NO: 3916338 - RNA, 15 nt, Human adenovirus C
agcagcagggcaacc

SEQ ID NO: 3916339 - RNA, 15 nt, Human adenovirus C
agcagccgcggccau

SEQ ID NO: 3916340 - RNA, 18 nt, Human adenovirus C
agcaggaggaagccaggc

SEQ ID NO: 3916341 - RNA, 18 nt, Human adenovirus C
agcagggcaaccugggcu

SEQ ID NO: 3916342 - RNA, 21 nt, Human adenovirus C
agcagguuccugagcagcugc

SEQ ID NO: 3916343 - RNA, 23 nt, Human adenovirus C
agcagguuccugagcagcugcga

SEQ ID NO: 3916344 - RNA, 24 nt, Human adenovirus C
agcagguuccugagcagcugcgac

SEQ ID NO: 3916345 - RNA, 14 nt, Human adenovirus C
agcaucgcuacaac

SEQ ID NO: 3916346 - RNA, 22 nt, Human adenovirus C
agcaugaagggcacgagcugcu

SEQ ID NO: 3916347 - RNA, 20 nt, Human adenovirus C
agcaugauaaauauguggcc

SEQ ID NO: 3916348 - RNA, 12 nt, Human adenovirus C
agcaugaugcaa

SEQ ID NO: 3916349 - RNA, 20 nt, Human adenovirus C
agcauuaaguggcucgcucc

SEQ ID NO: 3916350 - RNA, 20 nt, Human adenovirus C
agccaaaaaacccacaacuu

SEQ ID NO: 3916351 - RNA, 16 nt, Human adenovirus C
agccagaucagcaacu

SEQ ID NO: 3916352 - RNA, 18 nt, Human adenovirus C
agccaguggcaacuggca

SEQ ID NO: 3916353 - RNA, 12 nt, Human adenovirus C
agcccacccugc

SEQ ID NO: 3916354 - RNA, 15 nt, Human adenovirus C
agccccaccaccaca

SEQ ID NO: 3916355 - RNA, 22 nt, Human adenovirus C
agcccgcuugcaagcagugcag

SEQ ID NO: 3916356 - RNA, 21 nt, Human adenovirus C
agcccgugacacugcagcagg

SEQ ID NO: 3916357 - RNA, 14 nt, Human adenovirus C
agcccgugcuggcc

SEQ ID NO: 3916358 - RNA, 21 nt, Human adenovirus C
agcccguguucugacagggcc

SEQ ID NO: 3916359 - RNA, 18 nt, Human adenovirus C
agcccuacuccggcacug

SEQ ID NO: 3916360 - RNA, 22 nt, Human adenovirus C
agcccuacuccggcacugccua

SEQ ID NO: 3916361 - RNA, 16 nt, Human adenovirus C
agcccuaucagcagcc

SEQ ID NO: 3916362 - RNA, 20 nt, Human adenovirus C
agccgacgcgcccuggaggc

SEQ ID NO: 3916363 - RNA, 16 nt, Human adenovirus C
agccgcgcgcuggggc

SEQ ID NO: 3916364 - RNA, 15 nt, Human adenovirus C
agccgcgcuccggag

SEQ ID NO: 3916365 - RNA, 13 nt, Human adenovirus C
agccggccuggac

SEQ ID NO: 3916366 - RNA, 13 nt, Human adenovirus C
agccggcggcgcg

SEQ ID NO: 3916367 - RNA, 21 nt, Human adenovirus C
agccuaaagcccgugacacug

SEQ ID NO: 3916368 - RNA, 19 nt, Human adenovirus C
agccugauucgggaguuua

SEQ ID NO: 3916369 - RNA, 22 nt, Human adenovirus C
agccuuucuaccggcacuucuu

SEQ ID NO: 3916370 - RNA, 22 nt, Human adenovirus C
agcgacacccaagggugcagcu

SEQ ID NO: 3916371 - RNA, 16 nt, Human adenovirus C
agcgacgaccugggcg

SEQ ID NO: 3916372 - RNA, 22 nt, Human adenovirus C
agcgaggaggagcgcaucuugc

SEQ ID NO: 3916373 - RNA, 20 nt, Human adenovirus C
agcgcaaccuaaaggagcug

SEQ ID NO: 3916374 - RNA, 19 nt, Human adenovirus C
agcgcacccugaucucacu

SEQ ID NO: 3916375 - RNA, 23 nt, Human adenovirus C
agcgcauccacaaggccgugagc

SEQ ID NO: 3916376 - RNA, 16 nt, Human adenovirus C
agcgccaaaaacuggu

SEQ ID NO: 3916377 - RNA, 21 nt, Human adenovirus C
agcgccaacucguuugaugga

SEQ ID NO: 3916378 - RNA, 14 nt, Human adenovirus C
agcgcccccugcua

SEQ ID NO: 3916379 - RNA, 13 nt, Human adenovirus C
agcgccucgggga

SEQ ID NO: 3916380 - RNA, 13 nt, Human adenovirus C
agcgccugcacug

SEQ ID NO: 3916381 - RNA, 19 nt, Human adenovirus C
agcgcgcgcucguaugggu

SEQ ID NO: 3916382 - RNA, 17 nt, Human adenovirus C
agcgcgcuaccacccca

SEQ ID NO: 3916383 - RNA, 14 nt, Human adenovirus C
agcgcgcugaggcc

SEQ ID NO: 3916384 - RNA, 15 nt, Human adenovirus C
agcgcggggugcccu

SEQ ID NO: 3916385 - RNA, 14 nt, Human adenovirus C
agcgcuccguggcc

SEQ ID NO: 3916386 - RNA, 13 nt, Human adenovirus C
agcggacaagcag

SEQ ID NO: 3916387 - RNA, 17 nt, Human adenovirus C
agcggcaacccuuccag

SEQ ID NO: 3916388 - RNA, 17 nt, Human adenovirus C
cuaagcagccgccgccg

SEQ ID NO: 3916389 - RNA, 23 nt, Human adenovirus C
cuaagcauugcuacuaaagggcc

SEQ ID NO: 3916390 - RNA, 18 nt, Human adenovirus C
cuaaugcggcaggaggga

SEQ ID NO: 3916391 - RNA, 23 nt, Human adenovirus C
cuaauggagaacuccucacuuaa

SEQ ID NO: 3916392 - RNA, 22 nt, Human adenovirus C
cuaauguauuauaacagcacug

SEQ ID NO: 3916393 - RNA, 14 nt, Human adenovirus C
cuacaacaaacaga

SEQ ID NO: 3916394 - RNA, 16 nt, Human adenovirus C
cuacaacguagcucag

SEQ ID NO: 3916395 - RNA, 17 nt, Human adenovirus C
cuaccgcgucaggaggg

SEQ ID NO: 3916396 - RNA, 19 nt, Human adenovirus C
cuaccuuaccaaugcaauu

SEQ ID NO: 3916397 - RNA, 14 nt, Human adenovirus C
cuacgacuacauga

SEQ ID NO: 3916398 - RNA, 16 nt, Human adenovirus C
cuacguccgcgacugc

SEQ ID NO: 3916399 - RNA, 15 nt, Human adenovirus C
gcguggucaaacucu

SEQ ID NO: 3916400 - RNA, 22 nt, Human adenovirus C
gcgugucgaacccaggugugcg

SEQ ID NO: 3916401 - RNA, 12 nt, Human adenovirus C
gcuaaccagcgu

SEQ ID NO: 3916402 - RNA, 19 nt, Human adenovirus C
gcuaauauggccugcugca

SEQ ID NO: 3916403 - RNA, 22 nt, Human adenovirus C
gcuacaacaaacagagcgauuu

SEQ ID NO: 3916404 - RNA, 17 nt, Human adenovirus C
gcuacaacguagcucag

SEQ ID NO: 3916405 - RNA, 23 nt, Human adenovirus C
gcuacaccuaccgccccagaaga

SEQ ID NO: 3916406 - RNA, 12 nt, Human adenovirus C
gcuaccagggcu

SEQ ID NO: 3916407 - RNA, 15 nt, Human adenovirus C
gcuacccacccagcg

SEQ ID NO: 3916408 - RNA, 14 nt, Human adenovirus C
gcuagacugcuccu

SEQ ID NO: 3916409 - RNA, 17 nt, Human adenovirus C
gcuaggagcgcccucuc

SEQ ID NO: 3916410 - RNA, 21 nt, Human adenovirus C
gcuaggucucgcgcggcgguc

SEQ ID NO: 3916411 - RNA, 16 nt, Human adenovirus C
gcuaugcacugcaggg

SEQ ID NO: 3916412 - RNA, 19 nt, Human adenovirus C
gcuauggaucuuaugccag

SEQ ID NO: 3916413 - RNA, 18 nt, Human adenovirus C
gcuaugugcagcagagcg

SEQ ID NO: 3916414 - RNA, 15 nt, Human adenovirus C
gcucaaaaacaugcu

SEQ ID NO: 3916415 - RNA, 22 nt, Human adenovirus C
gcucauggcgcagcuguuccuu

SEQ ID NO: 3916416 - RNA, 19 nt, Human adenovirus C
gcuccacuuaaacucaggc

SEQ ID NO: 3916417 - RNA, 23 nt, Human adenovirus C
gcuccgggcugcgcgcuggccag

SEQ ID NO: 3916418 - RNA, 18 nt, Human adenovirus C
gcuccuaacuccugugag

SEQ ID NO: 3916419 - RNA, 16 nt, Human adenovirus C
gcuccucaggcgccgc

SEQ ID NO: 3916420 - RNA, 21 nt, Human adenovirus C
gcuccucguuuagccaggucu

SEQ ID NO: 3916421 - RNA, 20 nt, Human adenovirus C
gcuccugucgccauccugug

SEQ ID NO: 3916422 - RNA, 23 nt, Human adenovirus C
gcucgcccuugcggcagucugca

SEQ ID NO: 3916423 - RNA, 14 nt, Human adenovirus C
gcucgccugcgcca

SEQ ID NO: 3916424 - RNA, 15 nt, Human adenovirus C
gcucgcgaaggaggc

SEQ ID NO: 3916425 - RNA, 20 nt, Human adenovirus C
gcucggaagacuaucugccu

SEQ ID NO: 3916426 - RNA, 16 nt, Human adenovirus C
gcucggucacgugcuc

SEQ ID NO: 3916427 - RNA, 16 nt, Human adenovirus C
gcucguugguccagca

SEQ ID NO: 3916428 - RNA, 18 nt, Human adenovirus C
gcucuugucggagaucag

SEQ ID NO: 3916429 - RNA, 15 nt, Human adenovirus C
gcugaaaauaaaaaa

SEQ ID NO: 3916430 - RNA, 17 nt, Human adenovirus C
gcugaccugcgcugggc

SEQ ID NO: 3916431 - RNA, 21 nt, Human adenovirus C
gcugcaaacuuucuccaaagu

SEQ ID NO: 3916432 - RNA, 14 nt, Human adenovirus C
gcugcaacccgcgg

SEQ ID NO: 3916433 - RNA, 12 nt, Human adenovirus C
gcugcagagcca

SEQ ID NO: 3916434 - RNA, 12 nt, Human adenovirus C
gcugcagcugcc

SEQ ID NO: 3916435 - RNA, 15 nt, Human adenovirus C
gcugccgccgccgcc

SEQ ID NO: 3916436 - RNA, 19 nt, Human adenovirus C
gcugccgucaucccugagc

SEQ ID NO: 3916437 - RNA, 12 nt, Human adenovirus C
gcugcgcaaccc

SEQ ID NO: 3916438 - RNA, 15 nt, Human adenovirus C
gcugcgcgaggagga

SEQ ID NO: 3916439 - RNA, 18 nt, Human adenovirus C
gcugcgcgcuggccaggg

SEQ ID NO: 3916440 - RNA, 21 nt, Human adenovirus C
gcugcggccccgcggucagau

SEQ ID NO: 3916441 - RNA, 23 nt, Human adenovirus C
gcugcggggugguguuguagaug

SEQ ID NO: 3916442 - RNA, 16 nt, Human adenovirus C
gcugcuccucuucccg

SEQ ID NO: 3916443 - RNA, 14 nt, Human adenovirus C
gcuggaacagagcu

SEQ ID NO: 3916444 - RNA, 17 nt, Human adenovirus C
gcuggaagccaugcuca

SEQ ID NO: 3916445 - RNA, 23 nt, Human adenovirus C
gcuggccgaaaacagggccaucc

SEQ ID NO: 3916446 - RNA, 15 nt, Human adenovirus C
gcuggcgcgcacgua

SEQ ID NO: 3916447 - RNA, 20 nt, Human adenovirus C
gcuggcgguagaggggccag

SEQ ID NO: 3916448 - RNA, 16 nt, Human adenovirus C
gcugggccagcacaca

SEQ ID NO: 3916449 - RNA, 17 nt, Human adenovirus C
gcuguaccugccagaca

SEQ ID NO: 3916450 - RNA, 17 nt, Human adenovirus C
gcugucauaccacugca

SEQ ID NO: 3916451 - RNA, 22 nt, Human adenovirus C
gcuguccauggucuggagcucc

SEQ ID NO: 3916452 - RNA, 23 nt, Human adenovirus C
gcuguccuaucaacucuugcuug

SEQ ID NO: 3916453 - RNA, 23 nt, Human adenovirus C
gcugugccuuuuacugcugcugg

SEQ ID NO: 3916454 - RNA, 19 nt, Human adenovirus C
gcugugcgcuuccuagcga

SEQ ID NO: 3916455 - RNA, 19 nt, Human adenovirus C
gcuuauguuuguuugccuu

SEQ ID NO: 3916456 - RNA, 17 nt, Human adenovirus C
gcuuauuacagcgcuug

SEQ ID NO: 3916457 - RNA, 17 nt, Human adenovirus C
gcuuccgcaggccaagc

SEQ ID NO: 3916458 - RNA, 14 nt, Human adenovirus C
gcuugagcaggcca

SEQ ID NO: 3916459 - RNA, 20 nt, Human adenovirus C
gcuugcuuugguauguaccu

SEQ ID NO: 3916460 - RNA, 14 nt, Human adenovirus C
ggaacauucccagc

SEQ ID NO: 3916461 - RNA, 17 nt, Human adenovirus C
ggaagacuaucugccug

SEQ ID NO: 3916462 - RNA, 12 nt, Human adenovirus C
ggaagccuggac

SEQ ID NO: 3916463 - RNA, 19 nt, Human adenovirus C
ggacaaguugaaagagcaa

SEQ ID NO: 3916464 - RNA, 14 nt, Human adenovirus C
ggacacgggcagcc

SEQ ID NO: 3916465 - RNA, 18 nt, Human adenovirus C
ggacacgggcagccugga

SEQ ID NO: 3916466 - RNA, 15 nt, Human adenovirus C
ggacaggcuuacccc

SEQ ID NO: 3916467 - RNA, 21 nt, Human adenovirus C
ggacaggcuuaccccgccaac

SEQ ID NO: 3916468 - RNA, 22 nt, Human adenovirus C
ggacagggccucucagaugcug

SEQ ID NO: 3916469 - RNA, 16 nt, Human adenovirus C
ggaccacagaacccac

SEQ ID NO: 3916470 - RNA, 16 nt, Human adenovirus C
ggaccugcuugagcag

SEQ ID NO: 3916471 - RNA, 19 nt, Human adenovirus C
ggaccugcuugagcaggcc

SEQ ID NO: 3916472 - RNA, 20 nt, Human adenovirus C
ggacgaugaguacgagccag

SEQ ID NO: 3916473 - RNA, 12 nt, Human adenovirus C
ggacgcuggaag

SEQ ID NO: 3916474 - RNA, 20 nt, Human adenovirus C
ggacguaaaggcuaaacccu

SEQ ID NO: 3916475 - RNA, 23 nt, Human adenovirus C
ggacgucgcgccgcaccgcgucc

SEQ ID NO: 3916476 - RNA, 16 nt, Human adenovirus C
ggacguuagcgccuga

SEQ ID NO: 3916477 - RNA, 15 nt, Human adenovirus C
ggagagcggugguga

SEQ ID NO: 3916478 - RNA, 14 nt, Human adenovirus C
ggagaggcagagcg

SEQ ID NO: 3916479 - RNA, 22 nt, Human adenovirus C
ggagcgaagaaacccaucugag

SEQ ID NO: 3916480 - RNA, 12 nt, Human adenovirus C
ggagcugaggcc

SEQ ID NO: 3916481 - RNA, 14 nt, Human adenovirus C
ggagcugcccaaga

SEQ ID NO: 3916482 - RNA, 18 nt, Human adenovirus C
ggagcugcugagccgccg

SEQ ID NO: 3916483 - RNA, 21 nt, Human adenovirus C
ggagcuggugcugcgcgcgga

SEQ ID NO: 3916484 - RNA, 18 nt, Human adenovirus C
ggagcuugagugcaugca

SEQ ID NO: 3916485 - RNA, 14 nt, Human adenovirus C
ggaggaagccaggc

SEQ ID NO: 3916486 - RNA, 16 nt, Human adenovirus C
ggaggacuuugagccc

SEQ ID NO: 3916487 - RNA, 19 nt, Human adenovirus C
ggaggagcaacagcaggag

SEQ ID NO: 3916488 - RNA, 15 nt, Human adenovirus C
ggaggcaagcacaca

SEQ ID NO: 3916489 - RNA, 12 nt, Human adenovirus C
ggaggggggaca

SEQ ID NO: 3916490 - RNA, 22 nt, Human adenovirus C
ggaguucacgcugcccgagggc

SEQ ID NO: 3916491 - RNA, 20 nt, Human adenovirus C
ggauagagagccuaguggac

SEQ ID NO: 3916492 - RNA, 12 nt, Human adenovirus C
ggaucagacaau

SEQ ID NO: 3916493 - RNA, 23 nt, Human adenovirus C
ggaucagacaaugcagaaacaca

SEQ ID NO: 3916494 - RNA, 14 nt, Human adenovirus C
ggaugauccuccag

SEQ ID NO: 3916495 - RNA, 18 nt, Human adenovirus C
ggauucauguugugcaga

SEQ ID NO: 3916496 - RNA, 15 nt, Human adenovirus C
ggcaacgugcagacc

SEQ ID NO: 3916497 - RNA, 14 nt, Human adenovirus C
ggcaagcgcgcgcu

SEQ ID NO: 3916498 - RNA, 14 nt, Human adenovirus C
ggcacaugcgagcc

SEQ ID NO: 3916499 - RNA, 22 nt, Human adenovirus C
ggcaccagcucaaucagucaca

SEQ ID NO: 3916500 - RNA, 14 nt, Human adenovirus C
ggcaccaggugcac

SEQ ID NO: 3916501 - RNA, 21 nt, Human adenovirus C
ggcacccaaaaagaagcugca

SEQ ID NO: 3916502 - RNA, 15 nt, Human adenovirus C
ggcacgagcugcuuc

SEQ ID NO: 3916503 - RNA, 13 nt, Human adenovirus C
ggcacuaccugga

SEQ ID NO: 3916504 - RNA, 21 nt, Human adenovirus C
ggcacugccuacaacgcucua

SEQ ID NO: 3916505 - RNA, 14 nt, Human adenovirus C
ggcacuuaggccag

SEQ ID NO: 3916506 - RNA, 13 nt, Human adenovirus C
ggcagaaacagag

SEQ ID NO: 3916507 - RNA, 18 nt, Human adenovirus C
ggcagacaugcagggcac

SEQ ID NO: 3916508 - RNA, 17 nt, Human adenovirus C
ggcagcagcaggaggag

SEQ ID NO: 3916509 - RNA, 24 nt, Human adenovirus C
ggcagccaggugacacuaacgacu

SEQ ID NO: 3916510 - RNA, 15 nt, Human adenovirus C
ggcagccuggaggca

SEQ ID NO: 3916511 - RNA, 21 nt, Human adenovirus C
ggcagccuggaggcaacccug

SEQ ID NO: 3916512 - RNA, 14 nt, Human adenovirus C
ggcagcggcagcaa

SEQ ID NO: 3916513 - RNA, 18 nt, Human adenovirus C
ggcagcggugcacgggcu

SEQ ID NO: 3916514 - RNA, 12 nt, Human adenovirus C
ggcaggagcaga

SEQ ID NO: 3916515 - RNA, 15 nt, Human adenovirus C
ggcaggagcuggugc

SEQ ID NO: 3916516 - RNA, 18 nt, Human adenovirus C
ggcagucugcagcgcugc

SEQ ID NO: 3916517 - RNA, 21 nt, Human adenovirus C
ggcaguugccgaggaugaaga

SEQ ID NO: 3916518 - RNA, 23 nt, Human adenovirus C
gcccugcgcgucggccagguagc

SEQ ID NO: 3916519 - RNA, 22 nt, Human adenovirus C
gcccugcucccagagcaaaaag

SEQ ID NO: 3916520 - RNA, 17 nt, Human adenovirus C
gcccuggaggcagcugg

SEQ ID NO: 3916521 - RNA, 21 nt, Human adenovirus C
gcccuggaggcagcuggggcc

SEQ ID NO: 3916522 - RNA, 15 nt, Human adenovirus C
gcccuggcuggcacg

SEQ ID NO: 3916523 - RNA, 17 nt, Human adenovirus C
gcccuucucggccggca

SEQ ID NO: 3916524 - RNA, 17 nt, Human adenovirus C
gcccuugauggagggca

SEQ ID NO: 3916525 - RNA, 21 nt, Human adenovirus C
gcccuuggaggaggcgccgca

SEQ ID NO: 3916526 - RNA, 16 nt, Human adenovirus C
gcccuuggcgcgcagc

SEQ ID NO: 3916527 - RNA, 23 nt, Human adenovirus C
gccgaagaggugucagacgaaac

SEQ ID NO: 3916528 - RNA, 18 nt, Human adenovirus C
gccgacgcgcccuggagg

SEQ ID NO: 3916529 - RNA, 16 nt, Human adenovirus C
gccgaggaugaagaag

SEQ ID NO: 3916530 - RNA, 20 nt, Human adenovirus C
gccgcacugggcgcaccacc

SEQ ID NO: 3916531 - RNA, 23 nt, Human adenovirus C
gccgcaggccaaccggcucuccg

SEQ ID NO: 3916532 - RNA, 14 nt, Human adenovirus C
gccgccaacaugcu

SEQ ID NO: 3916533 - RNA, 19 nt, Human adenovirus C
gccgccagcgguccgcgau

SEQ ID NO: 3916534 - RNA, 20 nt, Human adenovirus C
gccgccguuagcccaagagc

SEQ ID NO: 3916535 - RNA, 23 nt, Human adenovirus C
gccgccguuagcccaagagcaac

SEQ ID NO: 3916536 - RNA, 22 nt, Human adenovirus C
gccgcgauguuuagcugcacgu

SEQ ID NO: 3916537 - RNA, 19 nt, Human adenovirus C
gccgcgcaccuggcggaca

SEQ ID NO: 3916538 - RNA, 21 nt, Human adenovirus C
gccgcgcgcgggcaggagcug

SEQ ID NO: 3916539 - RNA, 15 nt, Human adenovirus C
gccgcgcgcuggggc

SEQ ID NO: 3916540 - RNA, 18 nt, Human adenovirus C
gccgcucauggcgcagcu

SEQ ID NO: 3916541 - RNA, 20 nt, Human adenovirus C
gccgcuggacgagggcaacc

SEQ ID NO: 3916542 - RNA, 22 nt, Human adenovirus C
gccgcuucagccgcugcagcca

SEQ ID NO: 3916543 - RNA, 21 nt, Human adenovirus C
gccgcuuuggggucacugcua

SEQ ID NO: 3916544 - RNA, 13 nt, Human adenovirus C
gccggccacggcc

SEQ ID NO: 3916545 - RNA, 15 nt, Human adenovirus C
gccggccacggccug

SEQ ID NO: 3916546 - RNA, 12 nt, Human adenovirus C
gccggcggcggu

SEQ ID NO: 3916547 - RNA, 17 nt, Human adenovirus C
gccgggagagggggcag

SEQ ID NO: 3916548 - RNA, 20 nt, Human adenovirus C
gccgggagagggggcagggg

SEQ ID NO: 3916549 - RNA, 15 nt, Human adenovirus C
gccggguggugcacg

SEQ ID NO: 3916550 - RNA, 17 nt, Human adenovirus C
gccguagcgccauugcu

SEQ ID NO: 3916551 - RNA, 15 nt, Human adenovirus C
gccgugcggcaggga

SEQ ID NO: 3916552 - RNA, 23 nt, Human adenovirus C
gccuaaagcgcgagucuggugac

SEQ ID NO: 3916553 - RNA, 18 nt, Human adenovirus C
gccucaacuucuaccccg

SEQ ID NO: 3916554 - RNA, 23 nt, Human adenovirus C
gccuccccccgcugacacccagc

SEQ ID NO: 3916555 - RNA, 20 nt, Human adenovirus C
gccuccgcgguaccugcggc

SEQ ID NO: 3916556 - RNA, 18 nt, Human adenovirus C
gccucggaguaccugagc

SEQ ID NO: 3916557 - RNA, 21 nt, Human adenovirus C
gccucggcgguggcagaugcc

SEQ ID NO: 3916558 - RNA, 21 nt, Human adenovirus C
gccugcgcggccuuccggagc

SEQ ID NO: 3916559 - RNA, 21 nt, Human adenovirus C
gccugcgucauuacccagggc

SEQ ID NO: 3916560 - RNA, 20 nt, Human adenovirus C
gccugcugcaccugcgugag

SEQ ID NO: 3916561 - RNA, 10 nt, Human adenovirus C
gccugcuggg

SEQ ID NO: 3916562 - RNA, 21 nt, Human adenovirus C
gccugcugggcgaggaggagu

SEQ ID NO: 3916563 - RNA, 15 nt, Human adenovirus C
gccugcuuaaaaccc

SEQ ID NO: 3916564 - RNA, 14 nt, Human adenovirus C
gccuggaacagcag

SEQ ID NO: 3916565 - RNA, 20 nt, Human adenovirus C
gccuggaacagcagcacagg

SEQ ID NO: 3916566 - RNA, 15 nt, Human adenovirus C
gccuggaggagcgca

SEQ ID NO: 3916567 - RNA, 21 nt, Human adenovirus C
gccuggcgcaaaaucuccugc

SEQ ID NO: 3916568 - RNA, 15 nt, Human adenovirus C
gccugugaugcugga

SEQ ID NO: 3916569 - RNA, 18 nt, Human adenovirus C
gccuuaggguugccgccu

SEQ ID NO: 3916570 - RNA, 22 nt, Human adenovirus C
gccuucacacgcuugaagacaa

SEQ ID NO: 3916571 - RNA, 14 nt, Human adenovirus C
gccuugcaggcgca

SEQ ID NO: 3916572 - RNA, 15 nt, Human adenovirus C
gcgacgaaugagcuc

SEQ ID NO: 3916573 - RNA, 19 nt, Human adenovirus C
gcgacgaaugagcuccaca

SEQ ID NO: 3916574 - RNA, 13 nt, Human adenovirus C
gcgagauugagcu

SEQ ID NO: 3916575 - RNA, 15 nt, Human adenovirus C
gcgagucuggugacu

SEQ ID NO: 3916576 - RNA, 14 nt, Human adenovirus C
gcgaucguggagca

SEQ ID NO: 3916577 - RNA, 15 nt, Human adenovirus C
gcgaucguggagcac

SEQ ID NO: 3916578 - RNA, 16 nt, Human adenovirus C
gcgaugagcagcuggc

SEQ ID NO: 3916579 - RNA, 16 nt, Human adenovirus C
gcgcaaaaucuccugc

SEQ ID NO: 3916580 - RNA, 21 nt, Human adenovirus C
gcgcaaaggugucccuaacca

SEQ ID NO: 3916581 - RNA, 21 nt, Human adenovirus C
gcgcacacguggcggccgccg

SEQ ID NO: 3916582 - RNA, 15 nt, Human adenovirus C
gcgcacgcuuguggc

SEQ ID NO: 3916583 - RNA, 16 nt, Human adenovirus C
gcgcagaugggagcug

SEQ ID NO: 3916584 - RNA, 16 nt, Human adenovirus C
gcgcagcuugcccuug

SEQ ID NO: 3916585 - RNA, 15 nt, Human adenovirus C
gcgcaggagcacagg

SEQ ID NO: 3916586 - RNA, 17 nt, Human adenovirus C
gcgcaggguggcucgcg

SEQ ID NO: 3916587 - RNA, 18 nt, Human adenovirus C
gcgccaacucguuugaug

SEQ ID NO: 3916588 - RNA, 18 nt, Human adenovirus C
gcgccaguggcggcggcg

SEQ ID NO: 3916589 - RNA, 15 nt, Human adenovirus C
gcgccauccaccacc

SEQ ID NO: 3916590 - RNA, 16 nt, Human adenovirus C
gcgcccuggaggcagc

SEQ ID NO: 3916591 - RNA, 14 nt, Human adenovirus C
gcgccgccggcacu

SEQ ID NO: 3916592 - RNA, 23 nt, Human adenovirus C
gcgccgcgcgcgggcaggagcug

SEQ ID NO: 3916593 - RNA, 21 nt, Human adenovirus C
gcgccugcugggcgaggagga

SEQ ID NO: 3916594 - RNA, 22 nt, Human adenovirus C
gcgcgaaaagaaccugccuccg

SEQ ID NO: 3916595 - RNA, 19 nt, Human adenovirus C
gcgcgaggccguggcgcag

SEQ ID NO: 3916596 - RNA, 14 nt, Human adenovirus C
gcgcgaggcguacg

SEQ ID NO: 3916597 - RNA, 15 nt, Human adenovirus C
gcgcgagggacaggc

SEQ ID NO: 3916598 - RNA, 14 nt, Human adenovirus C
gcgcgcgcaaaccc

SEQ ID NO: 3916599 - RNA, 14 nt, Human adenovirus C
gcgcgcgggcagga

SEQ ID NO: 3916600 - RNA, 18 nt, Human adenovirus C
gcgcgcuaccaccccagc

SEQ ID NO: 3916601 - RNA, 21 nt, Human adenovirus C
gcgcgcugaggccgaggcagc

SEQ ID NO: 3916602 - RNA, 12 nt, Human adenovirus C
gcgcgcuggcca

SEQ ID NO: 3916603 - RNA, 12 nt, Human adenovirus C
gcgcggccgccg

SEQ ID NO: 3916604 - RNA, 14 nt, Human adenovirus C
gcgcggcggcugcu

SEQ ID NO: 3916605 - RNA, 16 nt, Human adenovirus C
gcgcggcggcugcugc

SEQ ID NO: 3916606 - RNA, 13 nt, Human adenovirus C
gcgcgggcaggag

SEQ ID NO: 3916607 - RNA, 12 nt, Human adenovirus C
gcgcuccauggc

SEQ ID NO: 3916608 - RNA, 20 nt, Human adenovirus C
gcgcucccucacccgcagcu

SEQ ID NO: 3916609 - RNA, 21 nt, Human adenovirus C
gcgcuccgaccaacacccagu

SEQ ID NO: 3916610 - RNA, 19 nt, Human adenovirus C
gcgcucgucgggcaccagg

SEQ ID NO: 3916611 - RNA, 16 nt, Human adenovirus C
gcgcugcuccucuucc

SEQ ID NO: 3916612 - RNA, 15 nt, Human adenovirus C
gcggacaagcagcug

SEQ ID NO: 3916613 - RNA, 18 nt, Human adenovirus C
gcggacauuaucuucccc

SEQ ID NO: 3916614 - RNA, 15 nt, Human adenovirus C
gcggcagcggcagca

SEQ ID NO: 3916615 - RNA, 14 nt, Human adenovirus C
gcggcagggcgcug

SEQ ID NO: 3916616 - RNA, 16 nt, Human adenovirus C
gcggcauaaggacaug

SEQ ID NO: 3916617 - RNA, 13 nt, Human adenovirus C
gcggccgccgcag

SEQ ID NO: 3916618 - RNA, 12 nt, Human adenovirus C
gcggcggcagca

SEQ ID NO: 3916619 - RNA, 13 nt, Human adenovirus C
gcggcggcaggag

SEQ ID NO: 3916620 - RNA, 19 nt, Human adenovirus C
gcggcggucaccagaggcu

SEQ ID NO: 3916621 - RNA, 12 nt, Human adenovirus C
gcggcugcugcg

SEQ ID NO: 3916622 - RNA, 17 nt, Human adenovirus C
gcggcuggagcugccca

SEQ ID NO: 3916623 - RNA, 18 nt, Human adenovirus C
gcggcuguagaccacgcc

SEQ ID NO: 3916624 - RNA, 13 nt, Human adenovirus C
gcgggcaggagcu

SEQ ID NO: 3916625 - RNA, 17 nt, Human adenovirus C
gcgggcugcucugcucg

SEQ ID NO: 3916626 - RNA, 13 nt, Human adenovirus C
gcgggguggugga

SEQ ID NO: 3916627 - RNA, 22 nt, Human adenovirus C
gcgguacgguuuuccuggccaa

SEQ ID NO: 3916628 - RNA, 18 nt, Human adenovirus C
gcggucccauccaagguc

SEQ ID NO: 3916629 - RNA, 13 nt, Human adenovirus C
gcgguggcacccg

SEQ ID NO: 3916630 - RNA, 14 nt, Human adenovirus C
gcgguugugcaggg

SEQ ID NO: 3916631 - RNA, 16 nt, Human adenovirus C
gcgucagaaugugaug

SEQ ID NO: 3916632 - RNA, 15 nt, Human adenovirus C
gcgucauuacccagg

SEQ ID NO: 3916633 - RNA, 18 nt, Human adenovirus C
gcguccaugucgccgcca

SEQ ID NO: 3916634 - RNA, 22 nt, Human adenovirus C
gcguccaugucgccgccagagg

SEQ ID NO: 3916635 - RNA, 23 nt, Human adenovirus C
gcgucccugcgccgugccgccag

SEQ ID NO: 3916636 - RNA, 16 nt, Human adenovirus C
gcgucucuggccccgc

SEQ ID NO: 3916637 - RNA, 14 nt, Human adenovirus C
cgcgucggccaggu

SEQ ID NO: 3916638 - RNA, 13 nt, Human adenovirus C
cgcgugcccgugc

SEQ ID NO: 3916639 - RNA, 15 nt, Human adenovirus C
cgcgugucgaaccca

SEQ ID NO: 3916640 - RNA, 15 nt, Human adenovirus C
cgcguugcucagggc

SEQ ID NO: 3916641 - RNA, 16 nt, Human adenovirus C
cgcuaacuacugccac

SEQ ID NO: 3916642 - RNA, 20 nt, Human adenovirus C
cgcuccacgguggcggcgag

SEQ ID NO: 3916643 - RNA, 13 nt, Human adenovirus C
cgcuccagggugu

SEQ ID NO: 3916644 - RNA, 12 nt, Human adenovirus C
cgcucccucacc

SEQ ID NO: 3916645 - RNA, 23 nt, Human adenovirus C
cgcucgaucaucuccccgcggcg

SEQ ID NO: 3916646 - RNA, 21 nt, Human adenovirus C
cgcucgucgggcaccaggugc

SEQ ID NO: 3916647 - RNA, 18 nt, Human adenovirus C
cgcugaccugcgcugggc

SEQ ID NO: 3916648 - RNA, 21 nt, Human adenovirus C
cgcugcaaccuaugcaccccg

SEQ ID NO: 3916649 - RNA, 21 nt, Human adenovirus C
cgcugcccugguguaccagga

SEQ ID NO: 3916650 - RNA, 15 nt, Human adenovirus C
cgcugcggcugcugu

SEQ ID NO: 3916651 - RNA, 16 nt, Human adenovirus C
cgcugcggcugcuguu

SEQ ID NO: 3916652 - RNA, 21 nt, Human adenovirus C
cuccuucagcgcgcgcugccc

SEQ ID NO: 3916653 - RNA, 19 nt, Human adenovirus C
aguucgccaccaccgccuc

SEQ ID NO: 3916654 - RNA, 21 nt, Human adenovirus C
aguucgccaccaccgccucca

SEQ ID NO: 3916655 - RNA, 18 nt, Human adenovirus C
auaaaaugcaccacagaa

SEQ ID NO: 3916656 - RNA, 13 nt, Human adenovirus C
auaacaacucagg

SEQ ID NO: 3916657 - RNA, 22 nt, Human adenovirus C
auaagggccuccccuucuucuu

SEQ ID NO: 3916658 - RNA, 16 nt, Human adenovirus C
auacaaggaguaucag

SEQ ID NO: 3916659 - RNA, 22 nt, Human adenovirus C
auacacaggguugcagcacugg

SEQ ID NO: 3916660 - RNA, 14 nt, Human adenovirus C
auacagacuugaga

SEQ ID NO: 3916661 - RNA, 13 nt, Human adenovirus C
auacccaccacca

SEQ ID NO: 3916662 - RNA, 22 nt, Human adenovirus C
auacggccgccagagcuuccac

SEQ ID NO: 3916663 - RNA, 13 nt, Human adenovirus C
auacgucacuucc

SEQ ID NO: 3916664 - RNA, 19 nt, Human adenovirus C
auacuacauggacaaaaga

SEQ ID NO: 3916665 - RNA, 23 nt, Human adenovirus C
auacugggacagucaggcagagg

SEQ ID NO: 3916666 - RNA, 16 nt, Human adenovirus C
auacuuuccaggagau

SEQ ID NO: 3916667 - RNA, 14 nt, Human adenovirus C
auagcggccgggca

SEQ ID NO: 3916668 - RNA, 20 nt, Human adenovirus C
auauaggacuaaaaaaugac

SEQ ID NO: 3916669 - RNA, 16 nt, Human adenovirus C
auaucgcccagcaaua

SEQ ID NO: 3916670 - RNA, 15 nt, Human adenovirus C
auauggccugcugca

SEQ ID NO: 3916671 - RNA, 23 nt, Human adenovirus C
auauuggcuaccagggcuucuac

SEQ ID NO: 3916672 - RNA, 20 nt, Human adenovirus C
aucaacuuugcgucucuggc

SEQ ID NO: 3916673 - RNA, 19 nt, Human adenovirus C
aucaccgucacccagcacu

SEQ ID NO: 3916674 - RNA, 15 nt, Human adenovirus C
aucaccuacgaugac

SEQ ID NO: 3916675 - RNA, 13 nt, Human adenovirus C
aucagcacaguaa

SEQ ID NO: 3916676 - RNA, 13 nt, Human adenovirus C
aucaggcuacuaa

SEQ ID NO: 3916677 - RNA, 18 nt, Human adenovirus C
aucaggcuacuaagaaaa

SEQ ID NO: 3916678 - RNA, 18 nt, Human adenovirus C
aucaugauugcaaaaauu

SEQ ID NO: 3916679 - RNA, 14 nt, Human adenovirus C
auccagcggcggcg

SEQ ID NO: 3916680 - RNA, 13 nt, Human adenovirus C
aucccagggaaca

SEQ ID NO: 3916681 - RNA, 12 nt, Human adenovirus C
aucccuguggac

SEQ ID NO: 3916682 - RNA, 16 nt, Human adenovirus C
auccgcaauacagaga

SEQ ID NO: 3916683 - RNA, 20 nt, Human adenovirus C
auccgcucauggacccuccu

SEQ ID NO: 3916684 - RNA, 14 nt, Human adenovirus C
auccuacacggugu

SEQ ID NO: 3916685 - RNA, 17 nt, Human adenovirus C
aucgcaacaccacugcu

SEQ ID NO: 3916686 - RNA, 13 nt, Human adenovirus C
aucggcaccagca

SEQ ID NO: 3916687 - RNA, 14 nt, Human adenovirus C
aucuauaggccuau

SEQ ID NO: 3916688 - RNA, 18 nt, Human adenovirus C
aucuccagcggccacacc

SEQ ID NO: 3916689 - RNA, 15 nt, Human adenovirus C
aucuccccgcggcga

SEQ ID NO: 3916690 - RNA, 14 nt, Human adenovirus C
aucucgggccagga

SEQ ID NO: 3916691 - RNA, 13 nt, Human adenovirus C
aucugacaacccc

SEQ ID NO: 3916692 - RNA, 15 nt, Human adenovirus C
aucugcuggcgcaga

SEQ ID NO: 3916693 - RNA, 16 nt, Human adenovirus C
aucuggagaucuuuca

SEQ ID NO: 3916694 - RNA, 18 nt, Human adenovirus C
aucugggucaccaggcgc

SEQ ID NO: 3916695 - RNA, 23 nt, Human adenovirus C
aucuuccaccgcggaugcuggcg

SEQ ID NO: 3916696 - RNA, 17 nt, Human adenovirus C
aucuugguuacaucuga

SEQ ID NO: 3916697 - RNA, 12 nt, Human adenovirus C
augagcgcggga

SEQ ID NO: 3916698 - RNA, 15 nt, Human adenovirus C
augagcuugaucugc

SEQ ID NO: 3916699 - RNA, 14 nt, Human adenovirus C
augagguacaugau

SEQ ID NO: 3916700 - RNA, 14 nt, Human adenovirus C
augaguacgagcca

SEQ ID NO: 3916701 - RNA, 15 nt, Human adenovirus C
augcaccacagaaca

SEQ ID NO: 3916702 - RNA, 14 nt, Human adenovirus C
augcagccggugga

SEQ ID NO: 3916703 - RNA, 16 nt, Human adenovirus C
augcagcgcgcggcga

SEQ ID NO: 3916704 - RNA, 18 nt, Human adenovirus C
augccaugaaccacccua

SEQ ID NO: 3916705 - RNA, 24 nt, Human adenovirus C
augcccaggcuccuuugucuggag

SEQ ID NO: 3916706 - RNA, 17 nt, Human adenovirus C
augcgagccgaucggga

SEQ ID NO: 3916707 - RNA, 14 nt, Human adenovirus C
augcgccacuggca

SEQ ID NO: 3916708 - RNA, 18 nt, Human adenovirus C
augcgccacuggcaggga

SEQ ID NO: 3916709 - RNA, 14 nt, Human adenovirus C
augcgcgggcggca

SEQ ID NO: 3916710 - RNA, 13 nt, Human adenovirus C
augcgggccuccg

SEQ ID NO: 3916711 - RNA, 15 nt, Human adenovirus C
caaagcccaagaaau

SEQ ID NO: 3916712 - RNA, 20 nt, Human adenovirus C
caaaggcacgaccgucagcg

SEQ ID NO: 3916713 - RNA, 17 nt, Human adenovirus C
caaagggcccuggcugg

SEQ ID NO: 3916714 - RNA, 18 nt, Human adenovirus C
caaagggcccuggcuggc

SEQ ID NO: 3916715 - RNA, 16 nt, Human adenovirus C
caaagggguucugccg

SEQ ID NO: 3916716 - RNA, 15 nt, Human adenovirus C
caaagucaaacugcu

SEQ ID NO: 3916717 - RNA, 16 nt, Human adenovirus C
caaauagaugagccuc

SEQ ID NO: 3916718 - RNA, 23 nt, Human adenovirus C
caaauuccucauguucuuguccc

SEQ ID NO: 3916719 - RNA, 24 nt, Human adenovirus C
caacagcugccgccaugggcucca

SEQ ID NO: 3916720 - RNA, 19 nt, Human adenovirus C
caaccaggcagugcaaaau

SEQ ID NO: 3916721 - RNA, 13 nt, Human adenovirus C
caaccggcggcag

SEQ ID NO: 3916722 - RNA, 14 nt, Human adenovirus C
caaccguucccagc

SEQ ID NO: 3916723 - RNA, 15 nt, Human adenovirus C
caaccuccgcuccuc

SEQ ID NO: 3916724 - RNA, 13 nt, Human adenovirus C
caacgccacaaca

SEQ ID NO: 3916725 - RNA, 14 nt, Human adenovirus C
caacgcgcagcccg

SEQ ID NO: 3916726 - RNA, 20 nt, Human adenovirus C
caacgcgcgccuagccgugc

SEQ ID NO: 3916727 - RNA, 17 nt, Human adenovirus C
caacuaacauaaacaca

SEQ ID NO: 3916728 - RNA, 15 nt, Human adenovirus C
caacucgcugcugca

SEQ ID NO: 3916729 - RNA, 20 nt, Human adenovirus C
caacucggccgccuguggac

SEQ ID NO: 3916730 - RNA, 13 nt, Human adenovirus C
caacuggccccaa

SEQ ID NO: 3916731 - RNA, 21 nt, Human adenovirus C
caacuggccccaaacucccau

SEQ ID NO: 3916732 - RNA, 18 nt, Human adenovirus C
caacuguccuaacccugg

SEQ ID NO: 3916733 - RNA, 15 nt, Human adenovirus C
caacuucagacuggg

SEQ ID NO: 3916734 - RNA, 15 nt, Human adenovirus C
caacuugcgguugcu

SEQ ID NO: 3916735 - RNA, 17 nt, Human adenovirus C
caacuuugguagcugcc

SEQ ID NO: 3916736 - RNA, 18 nt, Human adenovirus C
caacuuugguagcugccu

SEQ ID NO: 3916737 - RNA, 15 nt, Human adenovirus C
caagaccaggacgac

SEQ ID NO: 3916738 - RNA, 14 nt, Human adenovirus C
caagcagguggcac

SEQ ID NO: 3916739 - RNA, 18 nt, Human adenovirus C
caagccccgaaagcuaaa

SEQ ID NO: 3916740 - RNA, 22 nt, Human adenovirus C
caagcggcaacccuuccaggag

SEQ ID NO: 3916741 - RNA, 20 nt, Human adenovirus C
caagcuaaugauggccgcag

SEQ ID NO: 3916742 - RNA, 15 nt, Human adenovirus C
caagcuacccaccca

SEQ ID NO: 3916743 - RNA, 23 nt, Human adenovirus C
caagcugauugccaggggcaggc

SEQ ID NO: 3916744 - RNA, 20 nt, Human adenovirus C
caaggacugguuccuggugc

SEQ ID NO: 3916745 - RNA, 21 nt, Human adenovirus C
caaggccuggaacagcagcac

SEQ ID NO: 3916746 - RNA, 15 nt, Human adenovirus C
caaguagcacaaaac

SEQ ID NO: 3916747 - RNA, 15 nt, Human adenovirus C
caagucauuuuucau

SEQ ID NO: 3916748 - RNA, 15 nt, Human adenovirus C
caauaaaaacuaaaa

SEQ ID NO: 3916749 - RNA, 16 nt, Human adenovirus C
caauaaaaacuaaaau

SEQ ID NO: 3916750 - RNA, 16 nt, Human adenovirus C
caaucuccucuuccau

SEQ ID NO: 3916751 - RNA, 22 nt, Human adenovirus C
caaugcagaaacacaagcuaaa

SEQ ID NO: 3916752 - RNA, 19 nt, Human adenovirus C
caauucuucucaaauacua

SEQ ID NO: 3916753 - RNA, 13 nt, Human adenovirus C
cacaacacggccu

SEQ ID NO: 3916754 - RNA, 16 nt, Human adenovirus C
cacaagccccacugac

SEQ ID NO: 3916755 - RNA, 12 nt, Human adenovirus C
cacaauguggcc

SEQ ID NO: 3916756 - RNA, 13 nt, Human adenovirus C
cacaauguggccu

SEQ ID NO: 3916757 - RNA, 15 nt, Human adenovirus C
cacagaccugggcca

SEQ ID NO: 3916758 - RNA, 16 nt, Human adenovirus C
cacaggcugcgcacca

SEQ ID NO: 3916759 - RNA, 18 nt, Human adenovirus C
cacaggcuggggccugcg

SEQ ID NO: 3916760 - RNA, 22 nt, Human adenovirus C
cacaguaacugcagcacagcac

SEQ ID NO: 3916761 - RNA, 17 nt, Human adenovirus C
cacaucucgggccagga

SEQ ID NO: 3916762 - RNA, 16 nt, Human adenovirus C
cacauuucggccccac

SEQ ID NO: 3916763 - RNA, 11 nt, Human adenovirus C
caccaaggcca

SEQ ID NO: 3916764 - RNA, 14 nt, Human adenovirus C
caccaccacccucc

SEQ ID NO: 3916765 - RNA, 14 nt, Human adenovirus C
caccacccuccuca

SEQ ID NO: 3916766 - RNA, 20 nt, Human adenovirus C
caccaccgccuccaccgaug

SEQ ID NO: 3916767 - RNA, 23 nt, Human adenovirus C
caccacugugguacuucccagag

SEQ ID NO: 3916768 - RNA, 17 nt, Human adenovirus C
cacccacagccgccuga

SEQ ID NO: 3916769 - RNA, 15 nt, Human adenovirus C
caccccgcaccgcuc

SEQ ID NO: 3916770 - RNA, 13 nt, Human adenovirus C
cacccgcagcugc

SEQ ID NO: 3916771 - RNA, 12 nt, Human adenovirus C
cacccgcccgcg

SEQ ID NO: 3916772 - RNA, 20 nt, Human adenovirus C
caccgaacagggcggggaug

SEQ ID NO: 3916773 - RNA, 14 nt, Human adenovirus C
caccgccagcgcac

SEQ ID NO: 3916774 - RNA, 14 nt, Human adenovirus C
caccgcccgcagca

SEQ ID NO: 3916775 - RNA, 14 nt, Human adenovirus C
caccgccuccaccg

SEQ ID NO: 3916776 - RNA, 13 nt, Human adenovirus C
caccgcucugcuu

SEQ ID NO: 3916777 - RNA, 15 nt, Human adenovirus C
ucuagcgccugcugc

SEQ ID NO: 3916778 - RNA, 16 nt, Human adenovirus C
ucuaugcccaggcucc

SEQ ID NO: 3916779 - RNA, 15 nt, Human adenovirus C
ucucaaaagcgggca

SEQ ID NO: 3916780 - RNA, 17 nt, Human adenovirus C
ucuccuucgcccgccgc

SEQ ID NO: 3916781 - RNA, 18 nt, Human adenovirus C
ucuccuucgcccgccgcu

SEQ ID NO: 3916782 - RNA, 15 nt, Human adenovirus C
ucucgcaaggccugg

SEQ ID NO: 3916783 - RNA, 21 nt, Human adenovirus C
ucucgcaaggccuggccagug

SEQ ID NO: 3916784 - RNA, 21 nt, Human adenovirus C
ucucgcauuccacgagccagg

SEQ ID NO: 3916785 - RNA, 20 nt, Human adenovirus C
ucugcagaauuaaggaggau

SEQ ID NO: 3916786 - RNA, 11 nt, Human adenovirus C
ucugcagagca

SEQ ID NO: 3916787 - RNA, 15 nt, Human adenovirus C
ucugcccgccaccug

SEQ ID NO: 3916788 - RNA, 19 nt, Human adenovirus C
ucugcuuaaaagccaccug

SEQ ID NO: 3916789 - RNA, 16 nt, Human adenovirus C
ucuggaaggugcugag

SEQ ID NO: 3916790 - RNA, 17 nt, Human adenovirus C
ucuggaaggugcugagg

SEQ ID NO: 3916791 - RNA, 15 nt, Human adenovirus C
ucuggggugaugcag

SEQ ID NO: 3916792 - RNA, 14 nt, Human adenovirus C
ucuuaaucacaccu

SEQ ID NO: 3916793 - RNA, 15 nt, Human adenovirus C
ucuuccauaagggcc

SEQ ID NO: 3916794 - RNA, 14 nt, Human adenovirus C
ucuucuucuucugg

SEQ ID NO: 3916795 - RNA, 15 nt, Human adenovirus C
ucuuguugcugguga

SEQ ID NO: 3916796 - RNA, 12 nt, Human adenovirus C
ugaaccaggaga

SEQ ID NO: 3916797 - RNA, 19 nt, Human adenovirus C
ugaacgcgcuccccuccgg

SEQ ID NO: 3916798 - RNA, 17 nt, Human adenovirus C
ugaagaagaggaagaag

SEQ ID NO: 3916799 - RNA, 22 nt, Human adenovirus C
ugaagacaaaggaaaccccuuc

SEQ ID NO: 3916800 - RNA, 14 nt, Human adenovirus C
ugaagaugaagaag

SEQ ID NO: 3916801 - RNA, 20 nt, Human adenovirus C
ugaaggggugcgcuccgggc

SEQ ID NO: 3916802 - RNA, 22 nt, Human adenovirus C
ugaaguuuucacuccacaggcu

SEQ ID NO: 3916803 - RNA, 20 nt, Human adenovirus C
ugaaucuccucuauaaacau

SEQ ID NO: 3916804 - RNA, 19 nt, Human adenovirus C
ugaaugaccaguggagagg

SEQ ID NO: 3916805 - RNA, 18 nt, Human adenovirus C
ugacagguggagaugacu

SEQ ID NO: 3916806 - RNA, 21 nt, Human adenovirus C
ugacaguggagagcccaggac

SEQ ID NO: 3916807 - RNA, 22 nt, Human adenovirus C
ugacauccgcggcgugcuggac

SEQ ID NO: 3916808 - RNA, 19 nt, Human adenovirus C
ugaccaagcaguuccaggc

SEQ ID NO: 3916809 - RNA, 18 nt, Human adenovirus C
ugaccagcucggcgguga

SEQ ID NO: 3916810 - RNA, 20 nt, Human adenovirus C
ugaccaguggagaggcagag

SEQ ID NO: 3916811 - RNA, 21 nt, Human adenovirus C
ugaccaugaagaucuggaagg

SEQ ID NO: 3916812 - RNA, 16 nt, Human adenovirus C
ugacccgcuguuccuu

SEQ ID NO: 3916813 - RNA, 16 nt, Human adenovirus C
ugaccgaggagcugag

SEQ ID NO: 3916814 - RNA, 19 nt, Human adenovirus C
ugaccuccgagauuuucca

SEQ ID NO: 3916815 - RNA, 13 nt, Human adenovirus C
ugaccugcacguc

SEQ ID NO: 3916816 - RNA, 19 nt, Human adenovirus C
ugacuaccuuuccgccgcc

SEQ ID NO: 3916817 - RNA, 21 nt, Human adenovirus C
ugacucuucuguuagcuggcc

SEQ ID NO: 3916818 - RNA, 14 nt, Human adenovirus C
ugacugcgcguaac

SEQ ID NO: 3916819 - RNA, 15 nt, Human adenovirus C
ugagauuagcuacuu

SEQ ID NO: 3916820 - RNA, 14 nt, Human adenovirus C
ugagccccgggcug

SEQ ID NO: 3916821 - RNA, 16 nt, Human adenovirus C
ugagccccgggcuggu

SEQ ID NO: 3916822 - RNA, 17 nt, Human adenovirus C
ugagccccucgccuggc

SEQ ID NO: 3916823 - RNA, 23 nt, Human adenovirus C
ugagcgcgcgcagcagcagggca

SEQ ID NO: 3916824 - RNA, 23 nt, Human adenovirus C
ugagcuccacaggucacgggcca

SEQ ID NO: 3916825 - RNA, 14 nt, Human adenovirus C
ugagcuccucaggg

SEQ ID NO: 3916826 - RNA, 23 nt, Human adenovirus C
ugagcuugaucugcuggcgcaga

SEQ ID NO: 3916827 - RNA, 17 nt, Human adenovirus C
ugaggcugguccugcug

SEQ ID NO: 3916828 - RNA, 18 nt, Human adenovirus C
cagaccaaagcaaaccuc

SEQ ID NO: 3916829 - RNA, 22 nt, Human adenovirus C
cagacccaucuccuaacugcag

SEQ ID NO: 3916830 - RNA, 18 nt, Human adenovirus C
cagaccguaaaccugagc

SEQ ID NO: 3916831 - RNA, 21 nt, Human adenovirus C
cagaccguaaaccugagccag

SEQ ID NO: 3916832 - RNA, 23 nt, Human adenovirus C
cagaccgucugaagacaccuuca

SEQ ID NO: 3916833 - RNA, 13 nt, Human adenovirus C
cagacgacagcag

SEQ ID NO: 3916834 - RNA, 14 nt, Human adenovirus C
cagacgggccaggg

SEQ ID NO: 3916835 - RNA, 19 nt, Human adenovirus C
cagacuauuuuuuccagac

SEQ ID NO: 3916836 - RNA, 16 nt, Human adenovirus C
cagagacgcccaggcc

SEQ ID NO: 3916837 - RNA, 16 nt, Human adenovirus C
cagagcauaguggugc

SEQ ID NO: 3916838 - RNA, 23 nt, Human adenovirus C
cagaggagguuuuggacgaggag

SEQ ID NO: 3916839 - RNA, 15 nt, Human adenovirus C
cagagggcauggaga

SEQ ID NO: 3916840 - RNA, 18 nt, Human adenovirus C
cagaugccgcggugcagg

SEQ ID NO: 3916841 - RNA, 21 nt, Human adenovirus C
cagcaacuuuccggugguggg

SEQ ID NO: 3916842 - RNA, 16 nt, Human adenovirus C
cagcaauaacacaggc

SEQ ID NO: 3916843 - RNA, 22 nt, Human adenovirus C
cagcaauaacacaggcuggggc

SEQ ID NO: 3916844 - RNA, 23 nt, Human adenovirus C
cagcaauaacacaggcuggggcc

SEQ ID NO: 3916845 - RNA, 19 nt, Human adenovirus C
cagcaauaugagcgguggc

SEQ ID NO: 3916846 - RNA, 13 nt, Human adenovirus C
cagcacagcaggg

SEQ ID NO: 3916847 - RNA, 17 nt, Human adenovirus C
cagcacaguaacugcag

SEQ ID NO: 3916848 - RNA, 14 nt, Human adenovirus C
cagcacuggcaaca

SEQ ID NO: 3916849 - RNA, 15 nt, Human adenovirus C
cagcagcaggaggag

SEQ ID NO: 3916850 - RNA, 23 nt, Human adenovirus C
cagcagcgcgcgaauaaacugcu

SEQ ID NO: 3916851 - RNA, 21 nt, Human adenovirus C
cagcagcggaugauccuccag

SEQ ID NO: 3916852 - RNA, 19 nt, Human adenovirus C
cagcaggaggaagccaggc

SEQ ID NO: 3916853 - RNA, 12 nt, Human adenovirus C
cagcaggaggag

SEQ ID NO: 3916854 - RNA, 23 nt, Human adenovirus C
cagcagguuucugcccugaaggc

SEQ ID NO: 3916855 - RNA, 21 nt, Human adenovirus C
cagcaucguuuaaaagccggu

SEQ ID NO: 3916856 - RNA, 17 nt, Human adenovirus C
cagcauugauggucgcc

SEQ ID NO: 3916857 - RNA, 17 nt, Human adenovirus C
cagccacaacgcgcagc

SEQ ID NO: 3916858 - RNA, 18 nt, Human adenovirus C
cagccauaucccuccggg

SEQ ID NO: 3916859 - RNA, 19 nt, Human adenovirus C
cagcccgugcuggccccga

SEQ ID NO: 3916860 - RNA, 13 nt, Human adenovirus C
cagcccuaucagc

SEQ ID NO: 3916861 - RNA, 16 nt, Human adenovirus C
cagcccuaucagcagc

SEQ ID NO: 3916862 - RNA, 16 nt, Human adenovirus C
cagccgcaccgcggcg

SEQ ID NO: 3916863 - RNA, 15 nt, Human adenovirus C
cagccgcaggccaac

SEQ ID NO: 3916864 - RNA, 17 nt, Human adenovirus C
cagccgcgcgcuggggc

SEQ ID NO: 3916865 - RNA, 14 nt, Human adenovirus C
cagccuaaccgccc

SEQ ID NO: 3916866 - RNA, 14 nt, Human adenovirus C
cagccuccgccgcc

SEQ ID NO: 3916867 - RNA, 21 nt, Human adenovirus C
cagccugcaaagggcccuggc

SEQ ID NO: 3916868 - RNA, 14 nt, Human adenovirus C
cagccuggaggcaa

SEQ ID NO: 3916869 - RNA, 14 nt, Human adenovirus C
cagcgaugugcccc

SEQ ID NO: 3916870 - RNA, 15 nt, Human adenovirus C
cagcgcacuacugcc

SEQ ID NO: 3916871 - RNA, 15 nt, Human adenovirus C
cagcgccagugcgcc

SEQ ID NO: 3916872 - RNA, 14 nt, Human adenovirus C
cagcgccugcauga

SEQ ID NO: 3916873 - RNA, 16 nt, Human adenovirus C
cagcgcgagcaggcag

SEQ ID NO: 3916874 - RNA, 17 nt, Human adenovirus C
cagcgcgagcaggcaga

SEQ ID NO: 3916875 - RNA, 18 nt, Human adenovirus C
cagcgcgagcaggcagag

SEQ ID NO: 3916876 - RNA, 16 nt, Human adenovirus C
cagcgcgcuaccaccc

SEQ ID NO: 3916877 - RNA, 14 nt, Human adenovirus C
cagcggcagcaaca

SEQ ID NO: 3916878 - RNA, 15 nt, Human adenovirus C
cagcggcagcggcag

SEQ ID NO: 3916879 - RNA, 18 nt, Human adenovirus C
cagcggcagcggcagcaa

SEQ ID NO: 3916880 - RNA, 14 nt, Human adenovirus C
cagcggccacaccc

SEQ ID NO: 3916881 - RNA, 12 nt, Human adenovirus C
cagcggcggcag

SEQ ID NO: 3916882 - RNA, 13 nt, Human adenovirus C
cagcggcggcagc

SEQ ID NO: 3916883 - RNA, 22 nt, Human adenovirus C
cagcggguuuaucaccgugcuu

SEQ ID NO: 3916884 - RNA, 23 nt, Human adenovirus C
cagcguaaaucccacacugcagg

SEQ ID NO: 3916885 - RNA, 15 nt, Human adenovirus C
cagcguagucugggu

SEQ ID NO: 3916886 - RNA, 22 nt, Human adenovirus C
cagcgugagcgcgcgcagcagc

SEQ ID NO: 3916887 - RNA, 24 nt, Human adenovirus C
cagcgugagcgcgcgcagcagcag

SEQ ID NO: 3916888 - RNA, 23 nt, Human adenovirus C
cagcuagccaacuaccuugccua

SEQ ID NO: 3916889 - RNA, 14 nt, Human adenovirus C
cagcucggcgguga

SEQ ID NO: 3916890 - RNA, 19 nt, Human adenovirus C
cagcucggucacgugcucu

SEQ ID NO: 3916891 - RNA, 23 nt, Human adenovirus C
cagcugaccacuuacuggcugca

SEQ ID NO: 3916892 - RNA, 16 nt, Human adenovirus C
cagcugcuacaacaaa

SEQ ID NO: 3916893 - RNA, 20 nt, Human adenovirus C
cagcuuccuggagcgccacu

SEQ ID NO: 3916894 - RNA, 19 nt, Human adenovirus C
cagcuugagccuggcugac

SEQ ID NO: 3916895 - RNA, 17 nt, Human adenovirus C
cagcuuguugaccagcu

SEQ ID NO: 3916896 - RNA, 15 nt, Human adenovirus C
caggaauuguugcua

SEQ ID NO: 3916897 - RNA, 19 nt, Human adenovirus C
caggacccuggugcugcca

SEQ ID NO: 3916898 - RNA, 17 nt, Human adenovirus C
caggacgacgcagaggc

SEQ ID NO: 3916899 - RNA, 18 nt, Human adenovirus C
caggacgacgcagaggca

SEQ ID NO: 3916900 - RNA, 21 nt, Human adenovirus C
caggagcacagggaugugccc

SEQ ID NO: 3916901 - RNA, 12 nt, Human adenovirus C
ugcuucuucccc

SEQ ID NO: 3916902 - RNA, 12 nt, Human adenovirus C
ugcuugcuugca

SEQ ID NO: 3916903 - RNA, 19 nt, Human adenovirus C
ugcuuguauuccccuggac

SEQ ID NO: 3916904 - RNA, 13 nt, Human adenovirus C
uggaacucuacaa

SEQ ID NO: 3916905 - RNA, 13 nt, Human adenovirus C
uggaagccaugcu

SEQ ID NO: 3916906 - RNA, 20 nt, Human adenovirus C
uggaagcgacgaaugagcuc

SEQ ID NO: 3916907 - RNA, 15 nt, Human adenovirus C
uggaaggggguggug

SEQ ID NO: 3916908 - RNA, 14 nt, Human adenovirus C
uggacaccucccac

SEQ ID NO: 3916909 - RNA, 18 nt, Human adenovirus C
uggacuuggaggagggcg

SEQ ID NO: 3916910 - RNA, 16 nt, Human adenovirus C
uggagccugggcugga

SEQ ID NO: 3916911 - RNA, 20 nt, Human adenovirus C
uggaggagcgacgcaagcua

SEQ ID NO: 3916912 - RNA, 16 nt, Human adenovirus C
uggaggaggcgccgca

SEQ ID NO: 3916913 - RNA, 18 nt, Human adenovirus C
uggaggaguggcuguuga

SEQ ID NO: 3916914 - RNA, 14 nt, Human adenovirus C
uggaggcagcuggg

SEQ ID NO: 3916915 - RNA, 20 nt, Human adenovirus C
uggagucagucgagaaggag

SEQ ID NO: 3916916 - RNA, 14 nt, Human adenovirus C
uggagugcuggugg

SEQ ID NO: 3916917 - RNA, 15 nt, Human adenovirus C
uggaucugcgccagc

SEQ ID NO: 3916918 - RNA, 22 nt, Human adenovirus C
uggcaaccaccgcuccucugau

SEQ ID NO: 3916919 - RNA, 21 nt, Human adenovirus C
uggcaaugggcccacgggcgg

SEQ ID NO: 3916920 - RNA, 22 nt, Human adenovirus C
uggcaccuuuuguuccaccgcu

SEQ ID NO: 3916921 - RNA, 23 nt, Human adenovirus C
uggcaccuuuuguuccaccgcuc

SEQ ID NO: 3916922 - RNA, 20 nt, Human adenovirus C
uggcagcggugcacgggcug

SEQ ID NO: 3916923 - RNA, 15 nt, Human adenovirus C
uggccagggugcgcu

SEQ ID NO: 3916924 - RNA, 22 nt, Human adenovirus C
uggcccacaacacggccuccac

SEQ ID NO: 3916925 - RNA, 19 nt, Human adenovirus C
uggcccuuggcgcgcagcu

SEQ ID NO: 3916926 - RNA, 20 nt, Human adenovirus C
uggccgcgauguuuagcugc

SEQ ID NO: 3916927 - RNA, 17 nt, Human adenovirus C
uggccgcguccaucugg

SEQ ID NO: 3916928 - RNA, 17 nt, Human adenovirus C
uggccuugcaggcgcag

SEQ ID NO: 3916929 - RNA, 19 nt, Human adenovirus C
uggccuuuagauguagcau

SEQ ID NO: 3916930 - RNA, 13 nt, Human adenovirus C
uggccuuugccug

SEQ ID NO: 3916931 - RNA, 21 nt, Human adenovirus C
uggcgaaaagcguccgcggcc

SEQ ID NO: 3916932 - RNA, 16 nt, Human adenovirus C
uggcgaugagcagcug

SEQ ID NO: 3916933 - RNA, 15 nt, Human adenovirus C
uggcgauggagcgca

SEQ ID NO: 3916934 - RNA, 20 nt, Human adenovirus C
uggcgcaucccauucuccag

SEQ ID NO: 3916935 - RNA, 20 nt, Human adenovirus C
uggcgcgcccgccagccccc

SEQ ID NO: 3916936 - RNA, 18 nt, Human adenovirus C
uggcggaggugcugcuga

SEQ ID NO: 3916937 - RNA, 9 nt, Human adenovirus C
uggcggcgg

SEQ ID NO: 3916938 - RNA, 18 nt, Human adenovirus C
uggcuccauaccauaccu

SEQ ID NO: 3916939 - RNA, 21 nt, Human adenovirus C
uggcuccauaccauaccuuga

SEQ ID NO: 3916940 - RNA, 15 nt, Human adenovirus C
uggcugcucgagggg

SEQ ID NO: 3916941 - RNA, 14 nt, Human adenovirus C
ugggaaacggccgc

SEQ ID NO: 3916942 - RNA, 22 nt, Human adenovirus C
ugggaauuugaagagcuuuuga

SEQ ID NO: 3916943 - RNA, 18 nt, Human adenovirus C
ugggacaccacuggaacc

SEQ ID NO: 3916944 - RNA, 12 nt, Human adenovirus C
cugccaccuccc

SEQ ID NO: 3916945 - RNA, 16 nt, Human adenovirus C
cugccaggaugcgggg

SEQ ID NO: 3916946 - RNA, 12 nt, Human adenovirus C
cugccaggcuca

SEQ ID NO: 3916947 - RNA, 21 nt, Human adenovirus C
cugcccuaaauuuaccccaag

SEQ ID NO: 3916948 - RNA, 16 nt, Human adenovirus C
cugccgccgccgccac

SEQ ID NO: 3916949 - RNA, 15 nt, Human adenovirus C
cugccgucaucccug

SEQ ID NO: 3916950 - RNA, 20 nt, Human adenovirus C
cugccuccccccgcugacac

SEQ ID NO: 3916951 - RNA, 13 nt, Human adenovirus C
cugcgcccacacc

SEQ ID NO: 3916952 - RNA, 15 nt, Human adenovirus C
cugcgccgugccgcc

SEQ ID NO: 3916953 - RNA, 20 nt, Human adenovirus C
cugcgccgugccgccagcgg

SEQ ID NO: 3916954 - RNA, 16 nt, Human adenovirus C
cugcgcgcuggccagg

SEQ ID NO: 3916955 - RNA, 17 nt, Human adenovirus C
cugcgcgcuggccaggg

SEQ ID NO: 3916956 - RNA, 17 nt, Human adenovirus C
cugcgcgucggccaggu

SEQ ID NO: 3916957 - RNA, 22 nt, Human adenovirus C
cugcgcuagcuuuuuuggccac

SEQ ID NO: 3916958 - RNA, 23 nt, Human adenovirus C
cugcgcucccucacccgcagcug

SEQ ID NO: 3916959 - RNA, 17 nt, Human adenovirus C
cugcggcugcuguugcu

SEQ ID NO: 3916960 - RNA, 20 nt, Human adenovirus C
cugcuagaguugcaacagcg

SEQ ID NO: 3916961 - RNA, 23 nt, Human adenovirus C
cugcucggacggcaacugucacu

SEQ ID NO: 3916962 - RNA, 14 nt, Human adenovirus C
cugcugcagccgca

SEQ ID NO: 3916963 - RNA, 14 nt, Human adenovirus C
cugcugccaugcgc

SEQ ID NO: 3916964 - RNA, 22 nt, Human adenovirus C
cugcugcuaauagcgcccuuca

SEQ ID NO: 3916965 - RNA, 15 nt, Human adenovirus C
cugcuuaaccgcgca

SEQ ID NO: 3916966 - RNA, 16 nt, Human adenovirus C
cugcuugagcaggcca

SEQ ID NO: 3916967 - RNA, 17 nt, Human adenovirus C
cuggaaggugcugaggu

SEQ ID NO: 3916968 - RNA, 21 nt, Human adenovirus C
cuggacaauuuacucuaugug

SEQ ID NO: 3916969 - RNA, 12 nt, Human adenovirus C
cuggaccucccg

SEQ ID NO: 3916970 - RNA, 19 nt, Human adenovirus C
cuggagaaacaauuacaaa

SEQ ID NO: 3916971 - RNA, 18 nt, Human adenovirus C
cuggagcugcccaagacu

SEQ ID NO: 3916972 - RNA, 13 nt, Human adenovirus C
cuggaggcaaccc

SEQ ID NO: 3916973 - RNA, 15 nt, Human adenovirus C
cuggagugucacugu

SEQ ID NO: 3916974 - RNA, 19 nt, Human adenovirus C
cuggcaaagcacacugaac

SEQ ID NO: 3916975 - RNA, 14 nt, Human adenovirus C
cuggcacgggcagc

SEQ ID NO: 3916976 - RNA, 14 nt, Human adenovirus C
cuggccaaccaggc

SEQ ID NO: 3916977 - RNA, 19 nt, Human adenovirus C
cuggccaaccaggcagugc

SEQ ID NO: 3916978 - RNA, 14 nt, Human adenovirus C
cuggcccgcgguga

SEQ ID NO: 3916979 - RNA, 22 nt, Human adenovirus C
cuggcgaucguaaacgcgcugg

SEQ ID NO: 3916980 - RNA, 18 nt, Human adenovirus C
cuggcgcaaaaucuccug

SEQ ID NO: 3916981 - RNA, 13 nt, Human adenovirus C
cuggcgcagaagu

SEQ ID NO: 3916982 - RNA, 13 nt, Human adenovirus C
cuggcgcgcuggc

SEQ ID NO: 3916983 - RNA, 20 nt, Human adenovirus C
cuggcgcggcuaggagcgcc

SEQ ID NO: 3916984 - RNA, 18 nt, Human adenovirus C
cuggcggaggugcugcug

SEQ ID NO: 3916985 - RNA, 16 nt, Human adenovirus C
cuggcgguagaggggc

SEQ ID NO: 3916986 - RNA, 18 nt, Human adenovirus C
cuggcgguagaggggcca

SEQ ID NO: 3916987 - RNA, 18 nt, Human adenovirus C
cuggcuggcacgggcagc

SEQ ID NO: 3916988 - RNA, 22 nt, Human adenovirus C
cugggaacggggccgaggugga

SEQ ID NO: 3916989 - RNA, 14 nt, Human adenovirus C
cugggaagaaagca

SEQ ID NO: 3916990 - RNA, 14 nt, Human adenovirus C
cugggacagccuag

SEQ ID NO: 3916991 - RNA, 22 nt, Human adenovirus C
cugggacagucaggcagaggag

SEQ ID NO: 3916992 - RNA, 16 nt, Human adenovirus C
cugggaguugcgcgcc

SEQ ID NO: 3916993 - RNA, 16 nt, Human adenovirus C
cugggccagcacacac

SEQ ID NO: 3916994 - RNA, 15 nt, Human adenovirus C
cugggcuggagcccg

SEQ ID NO: 3916995 - RNA, 18 nt, Human adenovirus C
cugggcuggagcccgagg

SEQ ID NO: 3916996 - RNA, 23 nt, Human adenovirus C
cuggggcaggaggacacgggcag

SEQ ID NO: 3916997 - RNA, 17 nt, Human adenovirus C
cugggggcguacacugg

SEQ ID NO: 3916998 - RNA, 12 nt, Human adenovirus C
cuggugcugcca

SEQ ID NO: 3916999 - RNA, 16 nt, Human adenovirus C
cugguggaacuugagg

SEQ ID NO: 3917000 - RNA, 14 nt, Human adenovirus C
cuggugugggagga

SEQ ID NO: 3917001 - RNA, 15 nt, Human adenovirus C
cuguagucaucgccu

SEQ ID NO: 3917002 - RNA, 20 nt, Human adenovirus C
cugucuuacaaaccuggaaa

SEQ ID NO: 3917003 - RNA, 15 nt, Human adenovirus C
cugugcuacaccugg

SEQ ID NO: 3917004 - RNA, 16 nt, Human adenovirus C
cugugcuacaccuggc

SEQ ID NO: 3917005 - RNA, 22 nt, Human adenovirus C
cugugcugccagggccguccgc

SEQ ID NO: 3917006 - RNA, 22 nt, Human adenovirus C
cugugguugcuucaugcuagug

SEQ ID NO: 3917007 - RNA, 20 nt, Human adenovirus C
cuguugauguggugaaagua

SEQ ID NO: 3917008 - RNA, 21 nt, Human adenovirus C
cuguuggaucugcgccagcag

SEQ ID NO: 3917009 - RNA, 14 nt, Human adenovirus C
cuuaaccugaugcg

SEQ ID NO: 3917010 - RNA, 17 nt, Human adenovirus C
cuuagauuugaccaaaa

SEQ ID NO: 3917011 - RNA, 22 nt, Human adenovirus C
cuuaggguugccgccugcugca

SEQ ID NO: 3917012 - RNA, 12 nt, Human adenovirus C
cuuaugccaggc

SEQ ID NO: 3917013 - RNA, 15 nt, Human adenovirus C
cuucacggacagugg

SEQ ID NO: 3917014 - RNA, 17 nt, Human adenovirus C
cuucagaaacuuccagc

SEQ ID NO: 3917015 - RNA, 16 nt, Human adenovirus C
cuucagcgcgcgcugc

SEQ ID NO: 3917016 - RNA, 13 nt, Human adenovirus C
cuucagcuggggc

SEQ ID NO: 3917017 - RNA, 19 nt, Human adenovirus C
cuucagcuugccugcucca

SEQ ID NO: 3917018 - RNA, 19 nt, Human adenovirus C
cuucauuuguaauuuacaa

SEQ ID NO: 3917019 - RNA, 13 nt, Human adenovirus C
cuuccaaggugaa

SEQ ID NO: 3917020 - RNA, 17 nt, Human adenovirus C
cuuccauaagggccucc

SEQ ID NO: 3917021 - RNA, 13 nt, Human adenovirus C
cuuccgcaggcca

SEQ ID NO: 3917022 - RNA, 16 nt, Human adenovirus C
cuucgcggucuuucca

SEQ ID NO: 3917023 - RNA, 16 nt, Human adenovirus C
cuucggcgcacgcugg

SEQ ID NO: 3917024 - RNA, 21 nt, Human adenovirus C
cuucuccuacauugcccagga

SEQ ID NO: 3917025 - RNA, 21 nt, Human adenovirus C
cuugaccgucuggcugcucga

SEQ ID NO: 3917026 - RNA, 14 nt, Human adenovirus C
cuugagaggccugu

SEQ ID NO: 3917027 - RNA, 22 nt, Human adenovirus C
cuugagcaggccaacgagcgcc

SEQ ID NO: 3917028 - RNA, 18 nt, Human adenovirus C
cuugauccccgcccuccc

SEQ ID NO: 3917029 - RNA, 14 nt, Human adenovirus C
cuugaucugcuggc

SEQ ID NO: 3917030 - RNA, 21 nt, Human adenovirus C
cuugaugacaacaucgcgcag

SEQ ID NO: 3917031 - RNA, 16 nt, Human adenovirus C
cuugccgucugcgccg

SEQ ID NO: 3917032 - RNA, 13 nt, Human adenovirus C
cuugccuaccacu

SEQ ID NO: 3917033 - RNA, 19 nt, Human adenovirus C
cuugcggcuggagcugccc

SEQ ID NO: 3917034 - RNA, 17 nt, Human adenovirus C
cuugggcgcgagaaaua

SEQ ID NO: 3917035 - RNA, 17 nt, Human adenovirus C
cuuguaauucuguuuau

SEQ ID NO: 3917036 - RNA, 20 nt, Human adenovirus C
cuuuaacggcucuucauuug

SEQ ID NO: 3917037 - RNA, 14 nt, Human adenovirus C
cuuucacaguuuac

SEQ ID NO: 3917038 - RNA, 23 nt, Human adenovirus C
cuuucacuuuccgcuucacugga

SEQ ID NO: 3917039 - RNA, 13 nt, Human adenovirus C
cuuuccacgggcg

SEQ ID NO: 3917040 - RNA, 16 nt, Human adenovirus C
cuuuccuuccucccaa

SEQ ID NO: 3917041 - RNA, 20 nt, Human adenovirus C
cuuugccacacgggcggagg

SEQ ID NO: 3917042 - RNA, 19 nt, Human adenovirus C
cuuugcgucucuggccccg

SEQ ID NO: 3917043 - RNA, 16 nt, Human adenovirus C
cuuuggcgcaucccau

SEQ ID NO: 3917044 - RNA, 23 nt, Human adenovirus C
cuuuuguaaaaacgugcgcagua

SEQ ID NO: 3917045 - RNA, 15 nt, Human adenovirus C
gaaaagcgcggccua

SEQ ID NO: 3917046 - RNA, 22 nt, Human adenovirus C
gaaaaucagagggcgagguauu

SEQ ID NO: 3917047 - RNA, 14 nt, Human adenovirus C
gaaaccccuucccu

SEQ ID NO: 3917048 - RNA, 18 nt, Human adenovirus C
gaaaccucaccucccaaa

SEQ ID NO: 3917049 - RNA, 21 nt, Human adenovirus C
gaaacuagcgagguaagcacu

SEQ ID NO: 3917050 - RNA, 17 nt, Human adenovirus C
gaaagcuuccgcaggcc

SEQ ID NO: 3917051 - RNA, 19 nt, Human adenovirus C
gaaauuaaccuaaaugcca

SEQ ID NO: 3917052 - RNA, 21 nt, Human adenovirus C
gaaauuagaaucuacuggggc

SEQ ID NO: 3917053 - RNA, 18 nt, Human adenovirus C
gaacaaaacucccuuaga

SEQ ID NO: 3917054 - RNA, 20 nt, Human adenovirus C
gaacaagcgagugguggcuc

SEQ ID NO: 3917055 - RNA, 14 nt, Human adenovirus C
gaacagcagcacag

SEQ ID NO: 3917056 - RNA, 19 nt, Human adenovirus C
gaacagcagcacaggccag

SEQ ID NO: 3917057 - RNA, 22 nt, Human adenovirus C
gaacuauggcagcaaggccugg

SEQ ID NO: 3917058 - RNA, 16 nt, Human adenovirus C
gaacugguugacggcc

SEQ ID NO: 3917059 - RNA, 18 nt, Human adenovirus C
gaacugguugacggccug

SEQ ID NO: 3917060 - RNA, 19 nt, Human adenovirus C
gaacuugcaggggcugugg

SEQ ID NO: 3917061 - RNA, 17 nt, Human adenovirus C
ccaggggcugguuggug

SEQ ID NO: 3917062 - RNA, 14 nt, Human adenovirus C
ccaguuggaggagu

SEQ ID NO: 3917063 - RNA, 23 nt, Human adenovirus C
ccauaaugauggcaaugggccca

SEQ ID NO: 3917064 - RNA, 13 nt, Human adenovirus C
ccauauauccaua

SEQ ID NO: 3917065 - RNA, 20 nt, Human adenovirus C
ccaucaacgcgcgcgcagcc

SEQ ID NO: 3917066 - RNA, 16 nt, Human adenovirus C
ccaucauaccacaagc

SEQ ID NO: 3917067 - RNA, 13 nt, Human adenovirus C
ccauccaccacca

SEQ ID NO: 3917068 - RNA, 20 nt, Human adenovirus C
ccauccgcaauacagagaca

SEQ ID NO: 3917069 - RNA, 22 nt, Human adenovirus C
ccaucgcgcaacugggcagcau

SEQ ID NO: 3917070 - RNA, 21 nt, Human adenovirus C
ccaugcgcgagggacaggcuu

SEQ ID NO: 3917071 - RNA, 23 nt, Human adenovirus C
ccauggaucacaaccccaccaug

SEQ ID NO: 3917072 - RNA, 20 nt, Human adenovirus C
ccaugggcgcacucacagac

SEQ ID NO: 3917073 - RNA, 14 nt, Human adenovirus C
ccaugggcuccagu

SEQ ID NO: 3917074 - RNA, 20 nt, Human adenovirus C
ccauuaagaacuauggcagc

SEQ ID NO: 3917075 - RNA, 18 nt, Human adenovirus C
ccauuaugagcaaggaaa

SEQ ID NO: 3917076 - RNA, 15 nt, Human adenovirus C
ccauucagaccgugg

SEQ ID NO: 3917077 - RNA, 15 nt, Human adenovirus C
ccauuuuaaaaaaac

SEQ ID NO: 3917078 - RNA, 18 nt, Human adenovirus C
cccaaaaagggugcaugc

SEQ ID NO: 3917079 - RNA, 20 nt, Human adenovirus C
cccaaaagcagggcuucaau

SEQ ID NO: 3917080 - RNA, 13 nt, Human adenovirus C
cccaacuccaugc

SEQ ID NO: 3917081 - RNA, 19 nt, Human adenovirus C
cccaauccccccgccgccg

SEQ ID NO: 3917082 - RNA, 20 nt, Human adenovirus C
cccaauuacauugcuuucag

SEQ ID NO: 3917083 - RNA, 12 nt, Human adenovirus C
cccaccacugug

SEQ ID NO: 3917084 - RNA, 22 nt, Human adenovirus C
cccaccaugcgcgagggacagg

SEQ ID NO: 3917085 - RNA, 16 nt, Human adenovirus C
cccaccgugcagcuga

SEQ ID NO: 3917086 - RNA, 12 nt, Human adenovirus C
cccacgccgcca

SEQ ID NO: 3917087 - RNA, 13 nt, Human adenovirus C
cccaggcugggga

SEQ ID NO: 3917088 - RNA, 16 nt, Human adenovirus C
cccaggcuggggagaa

SEQ ID NO: 3917089 - RNA, 15 nt, Human adenovirus C
cccaguaccgcagcu

SEQ ID NO: 3917090 - RNA, 13 nt, Human adenovirus C
cccauacccgcca

SEQ ID NO: 3917091 - RNA, 17 nt, Human adenovirus C
cccaugaaaccaugcua

SEQ ID NO: 3917092 - RNA, 15 nt, Human adenovirus C
cccauuacaguguca

SEQ ID NO: 3917093 - RNA, 16 nt, Human adenovirus C
cccauuuccaagcuug

SEQ ID NO: 3917094 - RNA, 17 nt, Human adenovirus C
ccccaaacucccaugga

SEQ ID NO: 3917095 - RNA, 17 nt, Human adenovirus C
ccccaccaauguggaaa

SEQ ID NO: 3917096 - RNA, 24 nt, Human adenovirus C
ccccgccaacgugcccuacccacu

SEQ ID NO: 3917097 - RNA, 13 nt, Human adenovirus C
ccccgcggcgccg

SEQ ID NO: 3917098 - RNA, 17 nt, Human adenovirus C
ccccggcgcccgcgccg

SEQ ID NO: 3917099 - RNA, 17 nt, Human adenovirus C
ccccgucgaggcacccc

SEQ ID NO: 3917100 - RNA, 16 nt, Human adenovirus C
ccccuucgaugcuccc

SEQ ID NO: 3917101 - RNA, 22 nt, Human adenovirus C
cccgaguauuucaccaaugcca

SEQ ID NO: 3917102 - RNA, 21 nt, Human adenovirus C
cccgcaacuucagacuggggu

SEQ ID NO: 3917103 - RNA, 16 nt, Human adenovirus C
cccgccaacgccacca

SEQ ID NO: 3917104 - RNA, 14 nt, Human adenovirus C
cccgccaggaacca

SEQ ID NO: 3917105 - RNA, 19 nt, Human adenovirus C
cccgcccgcgccugcuggg

SEQ ID NO: 3917106 - RNA, 13 nt, Human adenovirus C
cccgcgccacguc

SEQ ID NO: 3917107 - RNA, 13 nt, Human adenovirus C
cccgcgccacugg

SEQ ID NO: 3917108 - RNA, 20 nt, Human adenovirus C
cccgcggcgacaggucaggc

SEQ ID NO: 3917109 - RNA, 18 nt, Human adenovirus C
cccgcuuuccaagauggc

SEQ ID NO: 3917110 - RNA, 22 nt, Human adenovirus C
cccggcuaucguggcuacaccu

SEQ ID NO: 3917111 - RNA, 15 nt, Human adenovirus C
cccgggcuggugcag

SEQ ID NO: 3917112 - RNA, 16 nt, Human adenovirus C
cccgggcuggugcagu

SEQ ID NO: 3917113 - RNA, 16 nt, Human adenovirus C
cccuauccugccgugc

SEQ ID NO: 3917114 - RNA, 18 nt, Human adenovirus C
cccuccgcacccacuauc

SEQ ID NO: 3917115 - RNA, 20 nt, Human adenovirus C
cccucgccggcgccccagaa

SEQ ID NO: 3917116 - RNA, 14 nt, Human adenovirus C
cccucgccuggcgg

SEQ ID NO: 3917117 - RNA, 15 nt, Human adenovirus C
cccucguuccagacg

SEQ ID NO: 3917118 - RNA, 19 nt, Human adenovirus C
cccucucaaaagcgggcau

SEQ ID NO: 3917119 - RNA, 13 nt, Human adenovirus C
cccugcgacgggc

SEQ ID NO: 3917120 - RNA, 22 nt, Human adenovirus C
cccugcgccgugccgccagcgg

SEQ ID NO: 3917121 - RNA, 20 nt, Human adenovirus C
cccuggaggcagcuggggcc

SEQ ID NO: 3917122 - RNA, 21 nt, Human adenovirus C
cccuugcggcagucugcagcg

SEQ ID NO: 3917123 - RNA, 23 nt, Human adenovirus C
ccgaaccuuuggacaccucccac

SEQ ID NO: 3917124 - RNA, 18 nt, Human adenovirus C
ccgaagaaaagcgcggcc

SEQ ID NO: 3917125 - RNA, 15 nt, Human adenovirus C
ccgagaccaugacca

SEQ ID NO: 3917126 - RNA, 19 nt, Human adenovirus C
ccgagcggacaagcagcug

SEQ ID NO: 3917127 - RNA, 20 nt, Human adenovirus C
ccgagcggacaagcagcugg

SEQ ID NO: 3917128 - RNA, 21 nt, Human adenovirus C
ccgagcggacaagcagcuggc

SEQ ID NO: 3917129 - RNA, 15 nt, Human adenovirus C
ccgaggagcugaggc

SEQ ID NO: 3917130 - RNA, 19 nt, Human adenovirus C
ccgaggcagcggcagaagc

SEQ ID NO: 3917131 - RNA, 18 nt, Human adenovirus C
ccgaggccgaagaggugu

SEQ ID NO: 3917132 - RNA, 16 nt, Human adenovirus C
ccgagggccgcuggcu

SEQ ID NO: 3917133 - RNA, 15 nt, Human adenovirus C
ccgcaacuucagacu

SEQ ID NO: 3917134 - RNA, 13 nt, Human adenovirus C
ccgcaccgcuccc

SEQ ID NO: 3917135 - RNA, 18 nt, Human adenovirus C
ccgcagccggugggcccg

SEQ ID NO: 3917136 - RNA, 18 nt, Human adenovirus C
ccgcaggccaagcagcuu

SEQ ID NO: 3917137 - RNA, 15 nt, Human adenovirus C
ccgcaguggucuuac

SEQ ID NO: 3917138 - RNA, 23 nt, Human adenovirus C
ccgcaguuggcgaugagcagcug

SEQ ID NO: 3917139 - RNA, 15 nt, Human adenovirus C
ccgccaaaugcggag

SEQ ID NO: 3917140 - RNA, 12 nt, Human adenovirus C
ccgccaacgugc

SEQ ID NO: 3917141 - RNA, 13 nt, Human adenovirus C
ccgccaacgugcc

SEQ ID NO: 3917142 - RNA, 20 nt, Human adenovirus C
ccgccaagaguuucugcuac

SEQ ID NO: 3917143 - RNA, 20 nt, Human adenovirus C
ccgccagaggagcugcugag

SEQ ID NO: 3917144 - RNA, 16 nt, Human adenovirus C
ccgcccuagccgcgcg

SEQ ID NO: 3917145 - RNA, 17 nt, Human adenovirus C
ccgcccuagccgcgcgu

SEQ ID NO: 3917146 - RNA, 14 nt, Human adenovirus C
ccgcccugcuccca

SEQ ID NO: 3917147 - RNA, 14 nt, Human adenovirus C
ccgccgcaccgugc

SEQ ID NO: 3917148 - RNA, 13 nt, Human adenovirus C
ccgccgcagcagc

SEQ ID NO: 3917149 - RNA, 17 nt, Human adenovirus C
ccgccgccacccacgga

SEQ ID NO: 3917150 - RNA, 18 nt, Human adenovirus C
ccgccgccacccacggac

SEQ ID NO: 3917151 - RNA, 16 nt, Human adenovirus C
ccgccgccgccaccca

SEQ ID NO: 3917152 - RNA, 16 nt, Human adenovirus C
ccgccgccgcuccguc

SEQ ID NO: 3917153 - RNA, 13 nt, Human adenovirus C
ccgccucagccgc

SEQ ID NO: 3917154 - RNA, 13 nt, Human adenovirus C
ccgccucagcuac

SEQ ID NO: 3917155 - RNA, 21 nt, Human adenovirus C
ccgccucgggcaaaacgugcu

SEQ ID NO: 3917156 - RNA, 23 nt, Human adenovirus C
ccgccuguggacuauucugcugc

SEQ ID NO: 3917157 - RNA, 19 nt, Human adenovirus C
ccgcgcacgucgcaccggc

SEQ ID NO: 3917158 - RNA, 17 nt, Human adenovirus C
ccgcgcccaggcggcgg

SEQ ID NO: 3917159 - RNA, 17 nt, Human adenovirus C
ccgcgcgcccuggggcg

SEQ ID NO: 3917160 - RNA, 12 nt, Human adenovirus C
ccgcgcgcggcg

SEQ ID NO: 3917161 - RNA, 15 nt, Human adenovirus C
ccgcgcgcgggcagg

SEQ ID NO: 3917162 - RNA, 17 nt, Human adenovirus C
ccgcggcgacaggucag

SEQ ID NO: 3917163 - RNA, 17 nt, Human adenovirus C
ccgcggcgauuggcgcc

SEQ ID NO: 3917164 - RNA, 21 nt, Human adenovirus C
ccgcggcugacgcggcggcag

SEQ ID NO: 3917165 - RNA, 15 nt, Human adenovirus C
ccgcgggcugggugu

SEQ ID NO: 3917166 - RNA, 23 nt, Human adenovirus C
ccgcgggcugggugugcgcggca

SEQ ID NO: 3917167 - RNA, 14 nt, Human adenovirus C
ccgcgguccuccuc

SEQ ID NO: 3917168 - RNA, 23 nt, Human adenovirus C
ccgcggugaugccuuugagggug

SEQ ID NO: 3917169 - RNA, 22 nt, Human adenovirus C
ccgcgucagaaccauaucccag

SEQ ID NO: 3917170 - RNA, 18 nt, Human adenovirus C
ccgcgucaugcacgcagc

SEQ ID NO: 3917171 - RNA, 15 nt, Human adenovirus C
ccgcguccaaaaccu

SEQ ID NO: 3917172 - RNA, 14 nt, Human adenovirus C
ccgcucccaccacu

SEQ ID NO: 3917173 - RNA, 14 nt, Human adenovirus C
ccgcugcagccacc

SEQ ID NO: 3917174 - RNA, 16 nt, Human adenovirus C
ccgcugcagccaccgc

SEQ ID NO: 3917175 - RNA, 23 nt, Human adenovirus C
ccgcugcccugguguaccaggaa

SEQ ID NO: 3917176 - RNA, 19 nt, Human adenovirus C
ccggacuaacaucugcccu

SEQ ID NO: 3917177 - RNA, 15 nt, Human adenovirus C
gcagggucccucgcc

SEQ ID NO: 3917178 - RNA, 15 nt, Human adenovirus C
gcaggucgggcgccg

SEQ ID NO: 3917179 - RNA, 21 nt, Human adenovirus C
gcaggucugcacggaccagcg

SEQ ID NO: 3917180 - RNA, 17 nt, Human adenovirus C
gcagguuccugagcagc

SEQ ID NO: 3917181 - RNA, 16 nt, Human adenovirus C
gcagucugcagcgcug

SEQ ID NO: 3917182 - RNA, 19 nt, Human adenovirus C
gcaucccuuuucuacgggu

SEQ ID NO: 3917183 - RNA, 17 nt, Human adenovirus C
gcauccgcccugcuccc

SEQ ID NO: 3917184 - RNA, 14 nt, Human adenovirus C
gcauccgcgccgca

SEQ ID NO: 3917185 - RNA, 22 nt, Human adenovirus C
gcaucuaucgcuacggcggcgg

SEQ ID NO: 3917186 - RNA, 14 nt, Human adenovirus C
gcaucuuggacugu

SEQ ID NO: 3917187 - RNA, 16 nt, Human adenovirus C
gcaugaaagccuugau

SEQ ID NO: 3917188 - RNA, 11 nt, Human adenovirus C
gcaugaugcaa

SEQ ID NO: 3917189 - RNA, 20 nt, Human adenovirus C
gcauggucucggugacggcg

SEQ ID NO: 3917190 - RNA, 17 nt, Human adenovirus C
gcauuggaacucuacaa

SEQ ID NO: 3917191 - RNA, 16 nt, Human adenovirus C
gccaacgcgccuacca

SEQ ID NO: 3917192 - RNA, 15 nt, Human adenovirus C
gccaagcagcuuguc

SEQ ID NO: 3917193 - RNA, 21 nt, Human adenovirus C
gccacaacauaaaagaagcaa

SEQ ID NO: 3917194 - RNA, 18 nt, Human adenovirus C
gccacacgggcggaggag

SEQ ID NO: 3917195 - RNA, 16 nt, Human adenovirus C
gccacagagggcaugg

SEQ ID NO: 3917196 - RNA, 15 nt, Human adenovirus C
gccacaucuucucuu

SEQ ID NO: 3917197 - RNA, 17 nt, Human adenovirus C
gccaccaguuggaggag

SEQ ID NO: 3917198 - RNA, 14 nt, Human adenovirus C
gccagaaggcgcuc

SEQ ID NO: 3917199 - RNA, 21 nt, Human adenovirus C
gccagacaugaugcaagaccc

SEQ ID NO: 3917200 - RNA, 15 nt, Human adenovirus C
gccaguggcaacugg

SEQ ID NO: 3917201 - RNA, 15 nt, Human adenovirus C
gccaucaucucuguc

SEQ ID NO: 3917202 - RNA, 22 nt, Human adenovirus C
gcccagcaauaacacaggcugg

SEQ ID NO: 3917203 - RNA, 17 nt, Human adenovirus C
gcccagcguggcgcugg

SEQ ID NO: 3917204 - RNA, 21 nt, Human adenovirus C
gcccaggcggcggguacagug

SEQ ID NO: 3917205 - RNA, 17 nt, Human adenovirus C
gcccaucuccaucccau

SEQ ID NO: 3917206 - RNA, 17 nt, Human adenovirus C
gccccguccugcccgca

SEQ ID NO: 3917207 - RNA, 18 nt, Human adenovirus C
gccccguccugcccgcaa

SEQ ID NO: 3917208 - RNA, 20 nt, Human adenovirus C
gccccuacguuuacaaggcc

SEQ ID NO: 3917209 - RNA, 13 nt, Human adenovirus C
gcccgagggcaac

SEQ ID NO: 3917210 - RNA, 16 nt, Human adenovirus C
gcccgagggccgcugg

SEQ ID NO: 3917211 - RNA, 20 nt, Human adenovirus C
gcccgaucacuuggugcugg

SEQ ID NO: 3917212 - RNA, 13 nt, Human adenovirus C
gcccgccaccugc

SEQ ID NO: 3917213 - RNA, 14 nt, Human adenovirus C
gcccggcgcacggc

SEQ ID NO: 3917214 - RNA, 13 nt, Human adenovirus C
gcccgugcacucc

SEQ ID NO: 3917215 - RNA, 15 nt, Human adenovirus C
gcccgugcacuccaa

SEQ ID NO: 3917216 - RNA, 16 nt, Human adenovirus C
gcccuacuuccgcagc

SEQ ID NO: 3917217 - RNA, 15 nt, Human adenovirus C
gcccucaccugccgc

SEQ ID NO: 3917218 - RNA, 16 nt, Human adenovirus C
gcccugcucccagagc

SEQ ID NO: 3917219 - RNA, 11 nt, Human adenovirus C
gcccuggggcg

SEQ ID NO: 3917220 - RNA, 15 nt, Human adenovirus C
gcccuugcuucccag

SEQ ID NO: 3917221 - RNA, 13 nt, Human adenovirus C
gcccuuggaggag

SEQ ID NO: 3917222 - RNA, 19 nt, Human adenovirus C
gcccuuucuuaccccucca

SEQ ID NO: 3917223 - RNA, 16 nt, Human adenovirus C
gcccuuuggcuuuucu

SEQ ID NO: 3917224 - RNA, 20 nt, Human adenovirus C
gccgcaccgugcgcuuaccu

SEQ ID NO: 3917225 - RNA, 13 nt, Human adenovirus C
gccgcaggccaac

SEQ ID NO: 3917226 - RNA, 15 nt, Human adenovirus C
gccgcauccccgcgg

SEQ ID NO: 3917227 - RNA, 13 nt, Human adenovirus C
gccgccgcaccgu

SEQ ID NO: 3917228 - RNA, 14 nt, Human adenovirus C
gccgccgcagcccu

SEQ ID NO: 3917229 - RNA, 16 nt, Human adenovirus C
gccgccgccgucgccg

SEQ ID NO: 3917230 - RNA, 17 nt, Human adenovirus C
gccgccuuuuagcugca

SEQ ID NO: 3917231 - RNA, 16 nt, Human adenovirus C
gccgcgcgcuggggca

SEQ ID NO: 3917232 - RNA, 19 nt, Human adenovirus C
gccgcggcgauuggcgccg

SEQ ID NO: 3917233 - RNA, 15 nt, Human adenovirus C
gccgcggucgcucac

SEQ ID NO: 3917234 - RNA, 12 nt, Human adenovirus C
gccgcggugcag

SEQ ID NO: 3917235 - RNA, 21 nt, Human adenovirus C
gccgcgucaugcacgcagcac

SEQ ID NO: 3917236 - RNA, 16 nt, Human adenovirus C
gccgcuggacgagggc

SEQ ID NO: 3917237 - RNA, 15 nt, Human adenovirus C
gccgggucagggcgc

SEQ ID NO: 3917238 - RNA, 20 nt, Human adenovirus C
gccgggucagggcgcgggcu

SEQ ID NO: 3917239 - RNA, 13 nt, Human adenovirus C
gccggguggugca

SEQ ID NO: 3917240 - RNA, 12 nt, Human adenovirus C
gccgugaacccc

SEQ ID NO: 3917241 - RNA, 19 nt, Human adenovirus C
gccgugcgcccgcuuucca

SEQ ID NO: 3917242 - RNA, 20 nt, Human adenovirus C
gccguuggagacugcagccu

SEQ ID NO: 3917243 - RNA, 16 nt, Human adenovirus C
gccuaccggggggaga

SEQ ID NO: 3917244 - RNA, 19 nt, Human adenovirus C
gccuaccggggggagaaac

SEQ ID NO: 3917245 - RNA, 20 nt, Human adenovirus C
gccuagacgaagcuuccgag

SEQ ID NO: 3917246 - RNA, 12 nt, Human adenovirus C
gccucagccgcu

SEQ ID NO: 3917247 - RNA, 23 nt, Human adenovirus C
gccuccgaacgguaagagccuag

SEQ ID NO: 3917248 - RNA, 17 nt, Human adenovirus C
gccugcaaagggcccug

SEQ ID NO: 3917249 - RNA, 16 nt, Human adenovirus C
gccugccgacuuggag

SEQ ID NO: 3917250 - RNA, 19 nt, Human adenovirus C
gccugcgucauuacccagg

SEQ ID NO: 3917251 - RNA, 12 nt, Human adenovirus C
gccuggaggcaa

SEQ ID NO: 3917252 - RNA, 22 nt, Human adenovirus C
gccuggcgcaaaaucuccugca

SEQ ID NO: 3917253 - RNA, 13 nt, Human adenovirus C
gccuggcgcggcu

SEQ ID NO: 3917254 - RNA, 14 nt, Human adenovirus C
gccuggcugacaag

SEQ ID NO: 3917255 - RNA, 15 nt, Human adenovirus C
gccuguccucgagcg

SEQ ID NO: 3917256 - RNA, 21 nt, Human adenovirus C
gccuguccucgagcgguguuc

SEQ ID NO: 3917257 - RNA, 13 nt, Human adenovirus C
gccuguugcugcu

SEQ ID NO: 3917258 - RNA, 14 nt, Human adenovirus C
gccuguugcugcug

SEQ ID NO: 3917259 - RNA, 21 nt, Human adenovirus C
gccuucccccguaacauccug

SEQ ID NO: 3917260 - RNA, 22 nt, Human adenovirus C
gccuugcaggcgcagagacacu

SEQ ID NO: 3917261 - RNA, 23 nt, Human adenovirus C
gccuugccuacgaacgccaccug

SEQ ID NO: 3917262 - RNA, 18 nt, Human adenovirus C
gccuuuuacugcugcugg

SEQ ID NO: 3917263 - RNA, 22 nt, Human adenovirus C
gcgacaggucaggcgggagcuc

SEQ ID NO: 3917264 - RNA, 21 nt, Human adenovirus C
gcgacgagcggccgccgcagc

SEQ ID NO: 3917265 - RNA, 15 nt, Human adenovirus C
gcgagauugagcucc

SEQ ID NO: 3917266 - RNA, 16 nt, Human adenovirus C
gcgagcaggcagaggc

SEQ ID NO: 3917267 - RNA, 16 nt, Human adenovirus C
gcgaggaugcgagccg

SEQ ID NO: 3917268 - RNA, 14 nt, Human adenovirus C
gcgagggagcgagg

SEQ ID NO: 3917269 - RNA, 14 nt, Human adenovirus C
gcgagggccagcug

SEQ ID NO: 3917270 - RNA, 17 nt, Human adenovirus C
gcgcaacuagauugcaa

SEQ ID NO: 3917271 - RNA, 17 nt, Human adenovirus C
gcgcacccgccccccgc

SEQ ID NO: 3917272 - RNA, 17 nt, Human adenovirus C
gcgcagacgcgccagac

SEQ ID NO: 3917273 - RNA, 19 nt, Human adenovirus C
gcgcagacgcgccagaccc

SEQ ID NO: 3917274 - RNA, 14 nt, Human adenovirus C
gcgcagaugggagc

SEQ ID NO: 3917275 - RNA, 15 nt, Human adenovirus C
gcgcagaugggagcu

SEQ ID NO: 3917276 - RNA, 16 nt, Human adenovirus C
gcgcagcggcaaaaag

SEQ ID NO: 3917277 - RNA, 15 nt, Human adenovirus C
gcgcaggcggcggca

SEQ ID NO: 3917278 - RNA, 14 nt, Human adenovirus C
gcgcaggguggcuc

SEQ ID NO: 3917279 - RNA, 14 nt, Human adenovirus C
gcgcaguuggaaga

SEQ ID NO: 3917280 - RNA, 19 nt, Human adenovirus C
gcgccagaccccccaucua

SEQ ID NO: 3917281 - RNA, 11 nt, Human adenovirus C
gcgccagcacc

SEQ ID NO: 3917282 - RNA, 12 nt, Human adenovirus C
gcgccagcaccu

SEQ ID NO: 3917283 - RNA, 13 nt, Human adenovirus C
gcgcccauggcua

SEQ ID NO: 3917284 - RNA, 15 nt, Human adenovirus C
gcgcccguguugaug

SEQ ID NO: 3917285 - RNA, 17 nt, Human adenovirus C
gcgccgggcccggcacu

SEQ ID NO: 3917286 - RNA, 18 nt, Human adenovirus C
gcgccugauuucugccag

SEQ ID NO: 3917287 - RNA, 13 nt, Human adenovirus C
gcgccugcugcca

SEQ ID NO: 3917288 - RNA, 23 nt, Human adenovirus C
gcgcgagcucagcgaccgcgagc

SEQ ID NO: 3917289 - RNA, 15 nt, Human adenovirus C
gcgcgcccuggggcg

SEQ ID NO: 3917290 - RNA, 13 nt, Human adenovirus C
gcgcgcgcagccu

SEQ ID NO: 3917291 - RNA, 14 nt, Human adenovirus C
gcgcgcuggagcaa

SEQ ID NO: 3917292 - RNA, 13 nt, Human adenovirus C
gcgcgcuggcaac

SEQ ID NO: 3917293 - RNA, 12 nt, Human adenovirus C
gcgcggcggcug

SEQ ID NO: 3917294 - RNA, 23 nt, Human adenovirus C
gcgcggcggucaccagaggcuca

SEQ ID NO: 3917295 - RNA, 15 nt, Human adenovirus C
gcgcgggcaggagcu

SEQ ID NO: 3917296 - RNA, 22 nt, Human adenovirus C
gcgcggggaggcggcggcgacg

SEQ ID NO: 3917297 - RNA, 14 nt, Human adenovirus C
cucgaucucuuccu

SEQ ID NO: 3917298 - RNA, 21 nt, Human adenovirus C
cucgcuccagggugugaagac

SEQ ID NO: 3917299 - RNA, 16 nt, Human adenovirus C
cucggaguaccugagc

SEQ ID NO: 3917300 - RNA, 17 nt, Human adenovirus C
cucggaguaccugagcc

SEQ ID NO: 3917301 - RNA, 15 nt, Human adenovirus C
cucggcgguggcaga

SEQ ID NO: 3917302 - RNA, 22 nt, Human adenovirus C
cucggcuaauauggccugcugc

SEQ ID NO: 3917303 - RNA, 18 nt, Human adenovirus C
cucguacgaggaggcacu

SEQ ID NO: 3917304 - RNA, 21 nt, Human adenovirus C
cucuauaaacauuccagcacc

SEQ ID NO: 3917305 - RNA, 17 nt, Human adenovirus C
cucugauuaaacauggc

SEQ ID NO: 3917306 - RNA, 16 nt, Human adenovirus C
cucugcucggaagacu

SEQ ID NO: 3917307 - RNA, 18 nt, Human adenovirus C
cucuggacuacauggaca

SEQ ID NO: 3917308 - RNA, 18 nt, Human adenovirus C
cucugguaucucagccgc

SEQ ID NO: 3917309 - RNA, 15 nt, Human adenovirus C
cucuuccuccuggag

SEQ ID NO: 3917310 - RNA, 14 nt, Human adenovirus C
cugaaacccaccau

SEQ ID NO: 3917311 - RNA, 13 nt, Human adenovirus C
cugaagcagggcc

SEQ ID NO: 3917312 - RNA, 22 nt, Human adenovirus C
cugacaaccccaacaccuacga

SEQ ID NO: 3917313 - RNA, 13 nt, Human adenovirus C
cugacaccuauca

SEQ ID NO: 3917314 - RNA, 14 nt, Human adenovirus C
cugacagggcccag

SEQ ID NO: 3917315 - RNA, 21 nt, Human adenovirus C
cugaccgugcaagacuccaaa

SEQ ID NO: 3917316 - RNA, 12 nt, Human adenovirus C
cugagcagcugc

SEQ ID NO: 3917317 - RNA, 15 nt, Human adenovirus C
cugagcagcugcgac

SEQ ID NO: 3917318 - RNA, 15 nt, Human adenovirus C
cugagccccgggcug

SEQ ID NO: 3917319 - RNA, 23 nt, Human adenovirus C
cugagcgggggguaccugcugga

SEQ ID NO: 3917320 - RNA, 13 nt, Human adenovirus C
cugaggacuacca

SEQ ID NO: 3917321 - RNA, 12 nt, Human adenovirus C
cugaggccgagg

SEQ ID NO: 3917322 - RNA, 20 nt, Human adenovirus C
cugaggccgaggcagcggca

SEQ ID NO: 3917323 - RNA, 15 nt, Human adenovirus C
cugaguuggcacccc

SEQ ID NO: 3917324 - RNA, 16 nt, Human adenovirus C
cugaucagaugaugca

SEQ ID NO: 3917325 - RNA, 19 nt, Human adenovirus C
cugcaacagguuauugccc

SEQ ID NO: 3917326 - RNA, 22 nt, Human adenovirus C
cugcaccacauuucggccccac

SEQ ID NO: 3917327 - RNA, 16 nt, Human adenovirus C
cugcagagcucucugg

SEQ ID NO: 3917328 - RNA, 19 nt, Human adenovirus C
cugcagagcucucugggaa

SEQ ID NO: 3917329 - RNA, 18 nt, Human adenovirus C
cugcagauucacucaaau

SEQ ID NO: 3917330 - RNA, 12 nt, Human adenovirus C
cugcagcacagc

SEQ ID NO: 3917331 - RNA, 13 nt, Human adenovirus C
cugcagcacagca

SEQ ID NO: 3917332 - RNA, 11 nt, Human adenovirus C
cugcagcagcg

SEQ ID NO: 3917333 - RNA, 13 nt, Human adenovirus C
cugcagcagcgcg

SEQ ID NO: 3917334 - RNA, 22 nt, Human adenovirus C
cugcagcagcgcgcgaauaaac

SEQ ID NO: 3917335 - RNA, 15 nt, Human adenovirus C
cugcagcgccagugc

SEQ ID NO: 3917336 - RNA, 16 nt, Human adenovirus C
cugcagcuagccaacu

SEQ ID NO: 3917337 - RNA, 18 nt, Human adenovirus C
cugcagcugccgccgccg

SEQ ID NO: 3917338 - RNA, 23 nt, Human adenovirus C
cugcagggaaccgggacuggaac

SEQ ID NO: 3917339 - RNA, 19 nt, Human adenovirus C
cugcagguacgccugcagg

SEQ ID NO: 3917340 - RNA, 15 nt, Human adenovirus C
cugcauaccaacaug

SEQ ID NO: 3917341 - RNA, 13 nt, Human adenovirus C
cugccaccucccu

SEQ ID NO: 3917342 - RNA, 20 nt, Human adenovirus C
cugccagcgccugcacugca

SEQ ID NO: 3917343 - RNA, 18 nt, Human adenovirus C
cugcccaagacuacucaa

SEQ ID NO: 3917344 - RNA, 13 nt, Human adenovirus C
cugcccaccaccc

SEQ ID NO: 3917345 - RNA, 21 nt, Human adenovirus C
cugccccuacguuuacaaggc

SEQ ID NO: 3917346 - RNA, 15 nt, Human adenovirus C
cugcccgccaccugc

SEQ ID NO: 3917347 - RNA, 17 nt, Human adenovirus C
cugccgucaucccugag

SEQ ID NO: 3917348 - RNA, 22 nt, Human adenovirus C
cugccgucaucccugagcaggg

SEQ ID NO: 3917349 - RNA, 17 nt, Human adenovirus C
cugccgugcggcaggga

SEQ ID NO: 3917350 - RNA, 16 nt, Human adenovirus C
cugcgcacgcccuucu

SEQ ID NO: 3917351 - RNA, 17 nt, Human adenovirus C
cugcgcccacaccuaca

SEQ ID NO: 3917352 - RNA, 19 nt, Human adenovirus C
cugcgcgagauugagcucc

SEQ ID NO: 3917353 - RNA, 16 nt, Human adenovirus C
cugcgcgucggccagg

SEQ ID NO: 3917354 - RNA, 21 nt, Human adenovirus C
cugcgcgugcccgugcgcacc

SEQ ID NO: 3917355 - RNA, 21 nt, Human adenovirus C
cugcgguucaucccuguggac

SEQ ID NO: 3917356 - RNA, 14 nt, Human adenovirus C
cugcgucuggcgcc

SEQ ID NO: 3917357 - RNA, 22 nt, Human adenovirus C
cugcuccucuucccgacuggcc

SEQ ID NO: 3917358 - RNA, 22 nt, Human adenovirus C
cugcucgaucucuuccuccugg

SEQ ID NO: 3917359 - RNA, 14 nt, Human adenovirus C
cugcucucacagau

SEQ ID NO: 3917360 - RNA, 17 nt, Human adenovirus C
cugcucugcucggaaga

SEQ ID NO: 3917361 - RNA, 20 nt, Human adenovirus C
cugcugagccgccgugcgcc

SEQ ID NO: 3917362 - RNA, 14 nt, Human adenovirus C
cugcugcuggaagg

SEQ ID NO: 3917363 - RNA, 14 nt, Human adenovirus C
cugcugggcgagga

SEQ ID NO: 3917364 - RNA, 22 nt, Human adenovirus C
cugcugugcgcuuccuagcgac

SEQ ID NO: 3917365 - RNA, 23 nt, Human adenovirus C
cugcugugcguaacuugcuggaa

SEQ ID NO: 3917366 - RNA, 24 nt, Human adenovirus C
cugcuuauuacagcgcuugcuuug

SEQ ID NO: 3917367 - RNA, 18 nt, Human adenovirus C
cuggaaaaguccacccaa

SEQ ID NO: 3917368 - RNA, 22 nt, Human adenovirus C
cuggaaaaguccacccaaagcg

SEQ ID NO: 3917369 - RNA, 14 nt, Human adenovirus C
cuggaacagagcuc

SEQ ID NO: 3917370 - RNA, 20 nt, Human adenovirus C
cuggaagacgcggaggcucu

SEQ ID NO: 3917371 - RNA, 20 nt, Human adenovirus C
cuggaagccaugcucagaaa

SEQ ID NO: 3917372 - RNA, 16 nt, Human adenovirus C
cuggacauaaacauua

SEQ ID NO: 3917373 - RNA, 18 nt, Human adenovirus C
gcguagcacgucgccacc

SEQ ID NO: 3917374 - RNA, 21 nt, Human adenovirus C
gcguggcccuuggcgcgcagc

SEQ ID NO: 3917375 - RNA, 13 nt, Human adenovirus C
gcguucaggaauu

SEQ ID NO: 3917376 - RNA, 14 nt, Human adenovirus C
gcguuccggcagca

SEQ ID NO: 3917377 - RNA, 24 nt, Human adenovirus C
gcguuucagccccccggcgcccgc

SEQ ID NO: 3917378 - RNA, 21 nt, Human adenovirus C
gcuaacgugucguauguguca

SEQ ID NO: 3917379 - RNA, 23 nt, Human adenovirus C
gcuaaugagcuugaucugcuggc

SEQ ID NO: 3917380 - RNA, 19 nt, Human adenovirus C
gcuaauggcaauggcucag

SEQ ID NO: 3917381 - RNA, 17 nt, Human adenovirus C
gcuacaacaaacagagc

SEQ ID NO: 3917382 - RNA, 20 nt, Human adenovirus C
gcuacaccuaccgccccaga

SEQ ID NO: 3917383 - RNA, 14 nt, Human adenovirus C
gcuacagaggaggc

SEQ ID NO: 3917384 - RNA, 20 nt, Human adenovirus C
gcuacaggggccucuucuuc

SEQ ID NO: 3917385 - RNA, 14 nt, Human adenovirus C
gcuaccaccccagc

SEQ ID NO: 3917386 - RNA, 12 nt, Human adenovirus C
gcuaccucuccg

SEQ ID NO: 3917387 - RNA, 15 nt, Human adenovirus C
gcuaccuucugcagc

SEQ ID NO: 3917388 - RNA, 15 nt, Human adenovirus C
gcuacuaagaaaaca

SEQ ID NO: 3917389 - RNA, 12 nt, Human adenovirus C
gcuagcauuaag

SEQ ID NO: 3917390 - RNA, 20 nt, Human adenovirus C
gcuagccaacuaccuugccu

SEQ ID NO: 3917391 - RNA, 22 nt, Human adenovirus C
gcuagcuuuuuuggccacuggc

SEQ ID NO: 3917392 - RNA, 13 nt, Human adenovirus C
gcuagguccaggu

SEQ ID NO: 3917393 - RNA, 21 nt, Human adenovirus C
gcucaaaggcuacaggggccu

SEQ ID NO: 3917394 - RNA, 19 nt, Human adenovirus C
gcuccacaggucacgggcc

SEQ ID NO: 3917395 - RNA, 17 nt, Human adenovirus C
gcuccccuggacccgcc

SEQ ID NO: 3917396 - RNA, 19 nt, Human adenovirus C
gcucccgggcuuguagacu

SEQ ID NO: 3917397 - RNA, 23 nt, Human adenovirus C
gcucccucacccgcagcugccug

SEQ ID NO: 3917398 - RNA, 21 nt, Human adenovirus C
gcuccuucagcgcgcgcugcc

SEQ ID NO: 3917399 - RNA, 18 nt, Human adenovirus C
gcuccuuuuggcuuccuu

SEQ ID NO: 3917400 - RNA, 14 nt, Human adenovirus C
gcucgaaggcuggc

SEQ ID NO: 3917401 - RNA, 16 nt, Human adenovirus C
gcucgagaucaggcua

SEQ ID NO: 3917402 - RNA, 18 nt, Human adenovirus C
gcucgccuucgaucucag

SEQ ID NO: 3917403 - RNA, 15 nt, Human adenovirus C
gcucgcguccaggcc

SEQ ID NO: 3917404 - RNA, 19 nt, Human adenovirus C
gcucggcggugaccugcac

SEQ ID NO: 3917405 - RNA, 20 nt, Human adenovirus C
gcucuccgcaauucuggaag

SEQ ID NO: 3917406 - RNA, 17 nt, Human adenovirus C
gcucugcaacaagaaaa

SEQ ID NO: 3917407 - RNA, 20 nt, Human adenovirus C
gcucuggccguucgggguca

SEQ ID NO: 3917408 - RNA, 15 nt, Human adenovirus C
gcugaagcagggcca

SEQ ID NO: 3917409 - RNA, 15 nt, Human adenovirus C
gcugaagcgcugccg

SEQ ID NO: 3917410 - RNA, 20 nt, Human adenovirus C
gcugacacuguaccgcgagg

SEQ ID NO: 3917411 - RNA, 20 nt, Human adenovirus C
gcugagguacgaugagaccc

SEQ ID NO: 3917412 - RNA, 14 nt, Human adenovirus C
gcugaugcacagcc

SEQ ID NO: 3917413 - RNA, 21 nt, Human adenovirus C
gcugauugccaggggcaggcc

SEQ ID NO: 3917414 - RNA, 13 nt, Human adenovirus C
gcugcaaacuuuc

SEQ ID NO: 3917415 - RNA, 12 nt, Human adenovirus C
gcugccagggcc

SEQ ID NO: 3917416 - RNA, 14 nt, Human adenovirus C
gcugccagggccgu

SEQ ID NO: 3917417 - RNA, 17 nt, Human adenovirus C
gcugccgccaugggcuc

SEQ ID NO: 3917418 - RNA, 13 nt, Human adenovirus C
gcugccuucccaa

SEQ ID NO: 3917419 - RNA, 16 nt, Human adenovirus C
gcugcgcgcuggccag

SEQ ID NO: 3917420 - RNA, 23 nt, Human adenovirus C
gcugcgcuagcuuuuuuggccac

SEQ ID NO: 3917421 - RNA, 21 nt, Human adenovirus C
gcugcuaaacauaguagagcc

SEQ ID NO: 3917422 - RNA, 12 nt, Human adenovirus C
gcugcuggaagg

SEQ ID NO: 3917423 - RNA, 21 nt, Human adenovirus C
gcuggaaaaguccacccaaag

SEQ ID NO: 3917424 - RNA, 20 nt, Human adenovirus C
gcuggaagccaugcucagaa

SEQ ID NO: 3917425 - RNA, 20 nt, Human adenovirus C
gcuggcaacgucggcggcgu

SEQ ID NO: 3917426 - RNA, 15 nt, Human adenovirus C
gcugggaugggugca

SEQ ID NO: 3917427 - RNA, 23 nt, Human adenovirus C
gcuggggcaggaggacacgggca

SEQ ID NO: 3917428 - RNA, 13 nt, Human adenovirus C
gcugggggcaaca

SEQ ID NO: 3917429 - RNA, 23 nt, Human adenovirus C
gcuggugcaguuugcccgcgcca

SEQ ID NO: 3917430 - RNA, 18 nt, Human adenovirus C
gcuggugggggaugugcg

SEQ ID NO: 3917431 - RNA, 19 nt, Human adenovirus C
gcuguacauccugcacgag

SEQ ID NO: 3917432 - RNA, 15 nt, Human adenovirus C
gcuguauccaaagcu

SEQ ID NO: 3917433 - RNA, 17 nt, Human adenovirus C
gcuuaacaguccccagg

SEQ ID NO: 3917434 - RNA, 12 nt, Human adenovirus C
gcuucaauccaa

SEQ ID NO: 3917435 - RNA, 18 nt, Human adenovirus C
gcuucagccgcugcagcc

SEQ ID NO: 3917436 - RNA, 21 nt, Human adenovirus C
gcuucagcuugccugcuccag

SEQ ID NO: 3917437 - RNA, 17 nt, Human adenovirus C
gcuuccuuccaggcgcg

SEQ ID NO: 3917438 - RNA, 23 nt, Human adenovirus C
gcuucuaaauagcuaacgugucg

SEQ ID NO: 3917439 - RNA, 23 nt, Human adenovirus C
gcuugagacgcgcgagccugccg

SEQ ID NO: 3917440 - RNA, 22 nt, Human adenovirus C
gcuugaucugcuggcgcagaag

SEQ ID NO: 3917441 - RNA, 16 nt, Human adenovirus C
gcuuucagggacaauu

SEQ ID NO: 3917442 - RNA, 21 nt, Human adenovirus C
ggaaacagggacgagccccuu

SEQ ID NO: 3917443 - RNA, 12 nt, Human adenovirus C
ggaaacuggcaa

SEQ ID NO: 3917444 - RNA, 20 nt, Human adenovirus C
ggaaccgggacuggaacaau

SEQ ID NO: 3917445 - RNA, 17 nt, Human adenovirus C
ggaacgaagcugaugcu

SEQ ID NO: 3917446 - RNA, 15 nt, Human adenovirus C
ggaagaagaagagca

SEQ ID NO: 3917447 - RNA, 20 nt, Human adenovirus C
ggaagacguaugcgcaggag

SEQ ID NO: 3917448 - RNA, 20 nt, Human adenovirus C
ggaagcagagugggaauuug

SEQ ID NO: 3917449 - RNA, 12 nt, Human adenovirus C
ggaagcgguggu

SEQ ID NO: 3917450 - RNA, 16 nt, Human adenovirus C
ggaauuugagccccuc

SEQ ID NO: 3917451 - RNA, 13 nt, Human adenovirus C
ggacaagcagcug

SEQ ID NO: 3917452 - RNA, 15 nt, Human adenovirus C
ggacaagcagcuggc

SEQ ID NO: 3917453 - RNA, 14 nt, Human adenovirus C
ggacagcaagaaac

SEQ ID NO: 3917454 - RNA, 13 nt, Human adenovirus C
ugacggcgcggcc

SEQ ID NO: 3917455 - RNA, 18 nt, Human adenovirus C
ugacuacagcccggggga

SEQ ID NO: 3917456 - RNA, 14 nt, Human adenovirus C
ugacucggcagacg

SEQ ID NO: 3917457 - RNA, 21 nt, Human adenovirus C
ugacugacuuugcuuuccuga

SEQ ID NO: 3917458 - RNA, 16 nt, Human adenovirus C
ugacuuugagguacug

SEQ ID NO: 3917459 - RNA, 13 nt, Human adenovirus C
ugagacacaagaa

SEQ ID NO: 3917460 - RNA, 22 nt, Human adenovirus C
ugagacccgcaccaggugcaga

SEQ ID NO: 3917461 - RNA, 19 nt, Human adenovirus C
ugagcagcuggcgcgcugg

SEQ ID NO: 3917462 - RNA, 15 nt, Human adenovirus C
ugagccccgggcugg

SEQ ID NO: 3917463 - RNA, 13 nt, Human adenovirus C
ugagccuggcuga

SEQ ID NO: 3917464 - RNA, 17 nt, Human adenovirus C
ugagcgcgcgcagcagc

SEQ ID NO: 3917465 - RNA, 17 nt, Human adenovirus C
ugagcucaacucccgga

SEQ ID NO: 3917466 - RNA, 21 nt, Human adenovirus C
ugagcugcagggucccucgcc

SEQ ID NO: 3917467 - RNA, 15 nt, Human adenovirus C
ugagcugcgagaagg

SEQ ID NO: 3917468 - RNA, 16 nt, Human adenovirus C
ugaggacuaccacgcc

SEQ ID NO: 3917469 - RNA, 15 nt, Human adenovirus C
ugaggcuacagagga

SEQ ID NO: 3917470 - RNA, 14 nt, Human adenovirus C
ugaggguccugugu

SEQ ID NO: 3917471 - RNA, 14 nt, Human adenovirus C
ugaggguuggaagc

SEQ ID NO: 3917472 - RNA, 12 nt, Human adenovirus C
ugagguacauga

SEQ ID NO: 3917473 - RNA, 19 nt, Human adenovirus C
ugagguggaucccauggac

SEQ ID NO: 3917474 - RNA, 15 nt, Human adenovirus C
ugaguacgagccaga

SEQ ID NO: 3917475 - RNA, 15 nt, Human adenovirus C
ugaguucgccaccac

SEQ ID NO: 3917476 - RNA, 12 nt, Human adenovirus C
ugauacaaacac

SEQ ID NO: 3917477 - RNA, 16 nt, Human adenovirus C
ugaucagaugaugcaa

SEQ ID NO: 3917478 - RNA, 13 nt, Human adenovirus C
ugauccuccagua

SEQ ID NO: 3917479 - RNA, 11 nt, Human adenovirus C
ugaugacaaac

SEQ ID NO: 3917480 - RNA, 20 nt, Human adenovirus C
ugaugccuuugaggguggcc

SEQ ID NO: 3917481 - RNA, 15 nt, Human adenovirus C
ugauggaagcauugu

SEQ ID NO: 3917482 - RNA, 14 nt, Human adenovirus C
ugaugggcuccagc

SEQ ID NO: 3917483 - RNA, 19 nt, Human adenovirus C
ugaugggcuccagcauuga

SEQ ID NO: 3917484 - RNA, 24 nt, Human adenovirus C
ugaugguacccaagcgccagcgac

SEQ ID NO: 3917485 - RNA, 15 nt, Human adenovirus C
ugauuaucgagcagg

SEQ ID NO: 3917486 - RNA, 14 nt, Human adenovirus C
ugcaaacggacccg

SEQ ID NO: 3917487 - RNA, 20 nt, Human adenovirus C
ugcaacccgcggugcuccuc

SEQ ID NO: 3917488 - RNA, 23 nt, Human adenovirus C
ugcaagaggccgcauccccgcgg

SEQ ID NO: 3917489 - RNA, 22 nt, Human adenovirus C
ugcaaguccgcaccagguacug

SEQ ID NO: 3917490 - RNA, 15 nt, Human adenovirus C
ugcaaucccugaagc

SEQ ID NO: 3917491 - RNA, 21 nt, Human adenovirus C
ugcaauucuucucaaauacua

SEQ ID NO: 3917492 - RNA, 13 nt, Human adenovirus C
ugcacgcagcacc

SEQ ID NO: 3917493 - RNA, 14 nt, Human adenovirus C
ugcacgcagcaccu

SEQ ID NO: 3917494 - RNA, 14 nt, Human adenovirus C
ugcacgucuccuga

SEQ ID NO: 3917495 - RNA, 16 nt, Human adenovirus C
ugcagaaacacaagcu

SEQ ID NO: 3917496 - RNA, 22 nt, Human adenovirus C
ugcagaccguaaaccugagcca

SEQ ID NO: 3917497 - RNA, 12 nt, Human adenovirus C
ugcagagccagc

SEQ ID NO: 3917498 - RNA, 20 nt, Human adenovirus C
ugcagagcuucaugcugcgg

SEQ ID NO: 3917499 - RNA, 16 nt, Human adenovirus C
ugcaggaauacaacau

SEQ ID NO: 3917500 - RNA, 17 nt, Human adenovirus C
ugcagguuuaccucgca

SEQ ID NO: 3917501 - RNA, 20 nt, Human adenovirus C
ugcaucaaacaauacuaaaa

SEQ ID NO: 3917502 - RNA, 16 nt, Human adenovirus C
ugcaucuaaaagcggu

SEQ ID NO: 3917503 - RNA, 13 nt, Human adenovirus C
ugcaucuguggga

SEQ ID NO: 3917504 - RNA, 14 nt, Human adenovirus C
ugcauguggaaaaa

SEQ ID NO: 3917505 - RNA, 17 nt, Human adenovirus C
ugccaccucccucccaa

SEQ ID NO: 3917506 - RNA, 18 nt, Human adenovirus C
ugccaggaugcggggugg

SEQ ID NO: 3917507 - RNA, 16 nt, Human adenovirus C
ugccaugaaccacccu

SEQ ID NO: 3917508 - RNA, 18 nt, Human adenovirus C
ugcccaucuccaucccau

SEQ ID NO: 3917509 - RNA, 19 nt, Human adenovirus C
ugcccuacauccuuccauc

SEQ ID NO: 3917510 - RNA, 21 nt, Human adenovirus C
ugccgcggugcaggcggccgc

SEQ ID NO: 3917511 - RNA, 22 nt, Human adenovirus C
ugccuccgcgguaccugcggcc

SEQ ID NO: 3917512 - RNA, 14 nt, Human adenovirus C
ugccugaagauggc

SEQ ID NO: 3917513 - RNA, 16 nt, Human adenovirus C
ugccugcuccagagau

SEQ ID NO: 3917514 - RNA, 16 nt, Human adenovirus C
ugccuuuuacugcugc

SEQ ID NO: 3917515 - RNA, 15 nt, Human adenovirus C
ugcgauacacagggu

SEQ ID NO: 3917516 - RNA, 20 nt, Human adenovirus C
ugcgcaggagcacagggaug

SEQ ID NO: 3917517 - RNA, 17 nt, Human adenovirus C
ugcgccccccuccucag

SEQ ID NO: 3917518 - RNA, 23 nt, Human adenovirus C
ugcgccccccuccucagcagcgg

SEQ ID NO: 3917519 - RNA, 21 nt, Human adenovirus C
ugcgccgugccgccagcgguc

SEQ ID NO: 3917520 - RNA, 23 nt, Human adenovirus C
ugcgcgacucgguuagcggccug

SEQ ID NO: 3917521 - RNA, 16 nt, Human adenovirus C
ugcgcgagggacaggc

SEQ ID NO: 3917522 - RNA, 15 nt, Human adenovirus C
ugcgcgcuggccagg

SEQ ID NO: 3917523 - RNA, 16 nt, Human adenovirus C
ugcgcgucggccaggu

SEQ ID NO: 3917524 - RNA, 19 nt, Human adenovirus C
ugcgcgucggccagguagc

SEQ ID NO: 3917525 - RNA, 12 nt, Human adenovirus C
ugcgcuccgggc

SEQ ID NO: 3917526 - RNA, 15 nt, Human adenovirus C
ugcgcuccgggcugc

SEQ ID NO: 3917527 - RNA, 21 nt, Human adenovirus C
ugcgcuuuuuggaacgcgggu

SEQ ID NO: 3917528 - RNA, 18 nt, Human adenovirus C
ugcggccuaccgggggga

SEQ ID NO: 3917529 - RNA, 21 nt, Human adenovirus C
ugcgggcggcgcugcagagcc

SEQ ID NO: 3917530 - RNA, 21 nt, Human adenovirus C
ugcgguucaucccuguggacc

SEQ ID NO: 3917531 - RNA, 20 nt, Human adenovirus C
ugcuaaccagcguagccccu

SEQ ID NO: 3917532 - RNA, 15 nt, Human adenovirus C
ugcuacaacaaacag

SEQ ID NO: 3917533 - RNA, 18 nt, Human adenovirus C
ugcuaccuucugcagcua

SEQ ID NO: 3917534 - RNA, 14 nt, Human adenovirus C
ugcuccucuucccg

SEQ ID NO: 3917535 - RNA, 22 nt, Human adenovirus C
ugcucguccagacgggccaggg

SEQ ID NO: 3917536 - RNA, 23 nt, Human adenovirus C
ugcugacccggagaugcagcgca

SEQ ID NO: 3917537 - RNA, 16 nt, Human adenovirus C
ugcugagccacaggcu

SEQ ID NO: 3917538 - RNA, 22 nt, Human adenovirus C
ugcugcacgcacguuuguaccu

SEQ ID NO: 3917539 - RNA, 13 nt, Human adenovirus C
ugcugcagcagcg

SEQ ID NO: 3917540 - RNA, 17 nt, Human adenovirus C
ugcugccaggaugcggg

SEQ ID NO: 3917541 - RNA, 19 nt, Human adenovirus C
ugcuggauuuucuggccau

SEQ ID NO: 3917542 - RNA, 13 nt, Human adenovirus C
ugcuggcgcgcac

SEQ ID NO: 3917543 - RNA, 12 nt, Human adenovirus C
ugcugggccagc

SEQ ID NO: 3917544 - RNA, 13 nt, Human adenovirus C
ugcuuacucccaa

SEQ ID NO: 3917545 - RNA, 13 nt, Human adenovirus C
ugcuugcuugcaa

SEQ ID NO: 3917546 - RNA, 16 nt, Human adenovirus C
ugcuugcuugcaagac

SEQ ID NO: 3917547 - RNA, 23 nt, Human adenovirus C
ugcuuguagguuaccucugcaaa

SEQ ID NO: 3917548 - RNA, 13 nt, Human adenovirus C
ugcuuuccugagc

SEQ ID NO: 3917549 - RNA, 19 nt, Human adenovirus C
uggaagacugggacagccu

SEQ ID NO: 3917550 - RNA, 18 nt, Human adenovirus C
uggaauucuucaccagca

SEQ ID NO: 3917551 - RNA, 22 nt, Human adenovirus C
uggacaaccccagacccaucuc

SEQ ID NO: 3917552 - RNA, 13 nt, Human adenovirus C
uggacauaaacau

SEQ ID NO: 3917553 - RNA, 21 nt, Human adenovirus C
uggacauaaacuauaacagag

SEQ ID NO: 3917554 - RNA, 21 nt, Human adenovirus C
uggacauguggugguuuucca

SEQ ID NO: 3917555 - RNA, 15 nt, Human adenovirus C
uggacgcuggaagac

SEQ ID NO: 3917556 - RNA, 16 nt, Human adenovirus C
uggacuaaacuuugau

SEQ ID NO: 3917557 - RNA, 22 nt, Human adenovirus C
uggacuguauuuuuagguuggc

SEQ ID NO: 3917558 - RNA, 15 nt, Human adenovirus C
uggagagcgguggug

SEQ ID NO: 3917559 - RNA, 15 nt, Human adenovirus C
uggagccugggcugg

SEQ ID NO: 3917560 - RNA, 13 nt, Human adenovirus C
uggaggcagcugg

SEQ ID NO: 3917561 - RNA, 22 nt, Human adenovirus C
acuaccuuuccgccgccaacau

SEQ ID NO: 3917562 - RNA, 17 nt, Human adenovirus C
acuagauugcaagaaaa

SEQ ID NO: 3917563 - RNA, 15 nt, Human adenovirus C
acuaguauugccacu

SEQ ID NO: 3917564 - RNA, 15 nt, Human adenovirus C
acucagggucgcagg

SEQ ID NO: 3917565 - RNA, 18 nt, Human adenovirus C
acucgagacgccgccuca

SEQ ID NO: 3917566 - RNA, 21 nt, Human adenovirus C
acucgcgccuguugcugcugc

SEQ ID NO: 3917567 - RNA, 12 nt, Human adenovirus C
acucgcugcugc

SEQ ID NO: 3917568 - RNA, 18 nt, Human adenovirus C
acucucgcaaggccuggc

SEQ ID NO: 3917569 - RNA, 13 nt, Human adenovirus C
acucugcagaccu

SEQ ID NO: 3917570 - RNA, 20 nt, Human adenovirus C
acucuguaugcuauauuuca

SEQ ID NO: 3917571 - RNA, 14 nt, Human adenovirus C
acugacaccuauca

SEQ ID NO: 3917572 - RNA, 18 nt, Human adenovirus C
acugacccgcuguuccuu

SEQ ID NO: 3917573 - RNA, 18 nt, Human adenovirus C
acugccacggguagcuug

SEQ ID NO: 3917574 - RNA, 19 nt, Human adenovirus C
acugcccucacguccaagu

SEQ ID NO: 3917575 - RNA, 14 nt, Human adenovirus C
acugccgccgccac

SEQ ID NO: 3917576 - RNA, 18 nt, Human adenovirus C
acugccuguucgccgacc

SEQ ID NO: 3917577 - RNA, 20 nt, Human adenovirus C
acugcuaccuucugcagcua

SEQ ID NO: 3917578 - RNA, 16 nt, Human adenovirus C
acugcuccuucagcgc

SEQ ID NO: 3917579 - RNA, 21 nt, Human adenovirus C
acugcucgaucucuuccuccu

SEQ ID NO: 3917580 - RNA, 22 nt, Human adenovirus C
acugcucgaucucuuccuccug

SEQ ID NO: 3917581 - RNA, 10 nt, Human adenovirus C
acugcugcug

SEQ ID NO: 3917582 - RNA, 11 nt, Human adenovirus C
acugcugcugg

SEQ ID NO: 3917583 - RNA, 14 nt, Human adenovirus C
acuggacucuuccu

SEQ ID NO: 3917584 - RNA, 17 nt, Human adenovirus C
acuggauggccuuugcc

SEQ ID NO: 3917585 - RNA, 14 nt, Human adenovirus C
acuggccccaaacu

SEQ ID NO: 3917586 - RNA, 16 nt, Human adenovirus C
acugggacagucaggc

SEQ ID NO: 3917587 - RNA, 16 nt, Human adenovirus C
acuggggcagggaccc

SEQ ID NO: 3917588 - RNA, 20 nt, Human adenovirus C
acugguuccuggugcagaug

SEQ ID NO: 3917589 - RNA, 17 nt, Human adenovirus C
acuguuacucagccacu

SEQ ID NO: 3917590 - RNA, 13 nt, Human adenovirus C
acuuaaacucagg

SEQ ID NO: 3917591 - RNA, 16 nt, Human adenovirus C
acuucaggaaggaugu

SEQ ID NO: 3917592 - RNA, 21 nt, Human adenovirus C
acuucuucuucuccuuccucu

SEQ ID NO: 3917593 - RNA, 19 nt, Human adenovirus C
acuugaaaaacauguaaaa

SEQ ID NO: 3917594 - RNA, 23 nt, Human adenovirus C
acuugcggcuggagcugcccaag

SEQ ID NO: 3917595 - RNA, 14 nt, Human adenovirus C
acuuggaggagcga

SEQ ID NO: 3917596 - RNA, 14 nt, Human adenovirus C
acuuggaggagggc

SEQ ID NO: 3917597 - RNA, 20 nt, Human adenovirus C
acuuuccgcuucacuggacu

SEQ ID NO: 3917598 - RNA, 15 nt, Human adenovirus C
acuuugguucuuaca

SEQ ID NO: 3917599 - RNA, 22 nt, Human adenovirus C
acuuuugcuaccaacucuuaca

SEQ ID NO: 3917600 - RNA, 17 nt, Human adenovirus C
agaaaccugugcugcca

SEQ ID NO: 3917601 - RNA, 21 nt, Human adenovirus C
agaaacgaaagccaaaaaacc

SEQ ID NO: 3917602 - RNA, 12 nt, Human adenovirus C
agaaaugccugu

SEQ ID NO: 3917603 - RNA, 13 nt, Human adenovirus C
agaacaagagcug

SEQ ID NO: 3917604 - RNA, 19 nt, Human adenovirus C
agaacaugccgcaagacuu

SEQ ID NO: 3917605 - RNA, 21 nt, Human adenovirus C
agaaccagauauuuuucuaug

SEQ ID NO: 3917606 - RNA, 17 nt, Human adenovirus C
agaacuauggcagcaag

SEQ ID NO: 3917607 - RNA, 11 nt, Human adenovirus C
agaacugagac

SEQ ID NO: 3917608 - RNA, 19 nt, Human adenovirus C
agaagacggaugagcucgg

SEQ ID NO: 3917609 - RNA, 18 nt, Human adenovirus C
agaagcaccauguccuug

SEQ ID NO: 3917610 - RNA, 13 nt, Human adenovirus C
agacaagcuaaaa

SEQ ID NO: 3917611 - RNA, 18 nt, Human adenovirus C
agacaccguccugagugu

SEQ ID NO: 3917612 - RNA, 15 nt, Human adenovirus C
agacagugucuccag

SEQ ID NO: 3917613 - RNA, 20 nt, Human adenovirus C
agacaugaugcaagaccccg

SEQ ID NO: 3917614 - RNA, 22 nt, Human adenovirus C
agaccaguagacaaggccugca

SEQ ID NO: 3917615 - RNA, 23 nt, Human adenovirus C
agaccgucugaagacaccuucaa

SEQ ID NO: 3917616 - RNA, 15 nt, Human adenovirus C
agaccuaccgcguca

SEQ ID NO: 3917617 - RNA, 22 nt, Human adenovirus C
agaccugggccaaaaccuucuc

SEQ ID NO: 3917618 - RNA, 22 nt, Human adenovirus C
agacgaaggcucgcguccaggc

SEQ ID NO: 3917619 - RNA, 18 nt, Human adenovirus C
agacguaugcgcaggagc

SEQ ID NO: 3917620 - RNA, 19 nt, Human adenovirus C
agacguaugcgcaggagca

SEQ ID NO: 3917621 - RNA, 22 nt, Human adenovirus C
agacucggcggacggcuacgac

SEQ ID NO: 3917622 - RNA, 20 nt, Human adenovirus C
agacucuguuuggauuuuga

SEQ ID NO: 3917623 - RNA, 19 nt, Human adenovirus C
agacugggguuugacccag

SEQ ID NO: 3917624 - RNA, 17 nt, Human adenovirus C
agagagcugcagcugcc

SEQ ID NO: 3917625 - RNA, 17 nt, Human adenovirus C
agagcaacaacagcgcc

SEQ ID NO: 3917626 - RNA, 15 nt, Human adenovirus C
agagcaagagcagcg

SEQ ID NO: 3917627 - RNA, 21 nt, Human adenovirus C
agagcccgagggccgcuggcu

SEQ ID NO: 3917628 - RNA, 16 nt, Human adenovirus C
agagcuugggcgcgag

SEQ ID NO: 3917629 - RNA, 13 nt, Human adenovirus C
agaggaggcuagg

SEQ ID NO: 3917630 - RNA, 21 nt, Human adenovirus C
agaggccgcauccccgcggcg

SEQ ID NO: 3917631 - RNA, 19 nt, Human adenovirus C
agaguugcaacagcgcgag

SEQ ID NO: 3917632 - RNA, 20 nt, Human adenovirus C
agauauuuuucuauguggaa

SEQ ID NO: 3917633 - RNA, 18 nt, Human adenovirus C
agauccgcguccaggucc

SEQ ID NO: 3917634 - RNA, 19 nt, Human adenovirus C
agaucuuucauccaugaca

SEQ ID NO: 3917635 - RNA, 15 nt, Human adenovirus C
agaugaagaagagga

SEQ ID NO: 3917636 - RNA, 15 nt, Human adenovirus C
agaugccaugaacca

SEQ ID NO: 3917637 - RNA, 22 nt, Human adenovirus C
agaugccgcggugcaggcggcc

SEQ ID NO: 3917638 - RNA, 16 nt, Human adenovirus C
agaugcugagggacaa

SEQ ID NO: 3917639 - RNA, 22 nt, Human adenovirus C
agauguuagaaucauugaaaac

SEQ ID NO: 3917640 - RNA, 16 nt, Human adenovirus C
agauguuuggcggggc

SEQ ID NO: 3917641 - RNA, 20 nt, Human adenovirus C
agauuagguucuacgaagac

SEQ ID NO: 3917642 - RNA, 15 nt, Human adenovirus C
agauuauacccacaa

SEQ ID NO: 3917643 - RNA, 22 nt, Human adenovirus C
agauuauccaaaaccucaaaau

SEQ ID NO: 3917644 - RNA, 20 nt, Human adenovirus C
agauugagcuccacgugccg

SEQ ID NO: 3917645 - RNA, 18 nt, Human adenovirus C
agauugcaagaaaaaacu

SEQ ID NO: 3917646 - RNA, 15 nt, Human adenovirus C
agauuuuucugcugu

SEQ ID NO: 3917647 - RNA, 17 nt, Human adenovirus C
agauuuuucugcugugc

SEQ ID NO: 3917648 - RNA, 13 nt, Human adenovirus C
agcaacagcagcg

SEQ ID NO: 3917649 - RNA, 19 nt, Human adenovirus C
agcaacaucaacaacagcu

SEQ ID NO: 3917650 - RNA, 17 nt, Human adenovirus C
agcaagacucugacaaa

SEQ ID NO: 3917651 - RNA, 14 nt, Human adenovirus C
agcaagagcagcgg

SEQ ID NO: 3917652 - RNA, 16 nt, Human adenovirus C
agcaaugacagcaccu

SEQ ID NO: 3917653 - RNA, 12 nt, Human adenovirus C
agcacaggccag

SEQ ID NO: 3917654 - RNA, 15 nt, Human adenovirus C
agcaccuucaaccau

SEQ ID NO: 3917655 - RNA, 23 nt, Human adenovirus C
agcacgaaggaggcuaaguggga

SEQ ID NO: 3917656 - RNA, 21 nt, Human adenovirus C
agcacucggcagaaacagagg

SEQ ID NO: 3917657 - RNA, 13 nt, Human adenovirus C
agcagcacaggcc

SEQ ID NO: 3917658 - RNA, 12 nt, Human adenovirus C
agcaggacccag

SEQ ID NO: 3917659 - RNA, 17 nt, Human adenovirus C
agcaggagcgcugggcg

SEQ ID NO: 3917660 - RNA, 15 nt, Human adenovirus C
agcagggcaaccugg

SEQ ID NO: 3917661 - RNA, 18 nt, Human adenovirus C
agcagguuccugagcagc

SEQ ID NO: 3917662 - RNA, 20 nt, Human adenovirus C
agcagguuccugagcagcug

SEQ ID NO: 3917663 - RNA, 18 nt, Human adenovirus C
agcauacuuuccaggaga

SEQ ID NO: 3917664 - RNA, 21 nt, Human adenovirus C
agccaaacgcucaucagugau

SEQ ID NO: 3917665 - RNA, 19 nt, Human adenovirus C
agccacaggcugcugucca

SEQ ID NO: 3917666 - RNA, 17 nt, Human adenovirus C
agccacucucgcaaggc

SEQ ID NO: 3917667 - RNA, 17 nt, Human adenovirus C
agccacuuaaaaaaaca

SEQ ID NO: 3917668 - RNA, 24 nt, Human adenovirus C
agccacuuaaaaaaacaaagucaa

SEQ ID NO: 3917669 - RNA, 16 nt, Human adenovirus C
agcccaacccgcgccu

SEQ ID NO: 3917670 - RNA, 17 nt, Human adenovirus C
agccccccucucuggca

SEQ ID NO: 3917671 - RNA, 12 nt, Human adenovirus C
agcccgaggaga

SEQ ID NO: 3917672 - RNA, 17 nt, Human adenovirus C
agcccgagggccgcugg

SEQ ID NO: 3917673 - RNA, 19 nt, Human adenovirus C
agcccgagggccgcuggcu

SEQ ID NO: 3917674 - RNA, 17 nt, Human adenovirus C
agcccgccaacgugccg

SEQ ID NO: 3917675 - RNA, 18 nt, Human adenovirus C
agcccgccaagaguuucu

SEQ ID NO: 3917676 - RNA, 17 nt, Human adenovirus C
agcccgugacacugcag

SEQ ID NO: 3917677 - RNA, 17 nt, Human adenovirus C
cagaaacuuccagccca

SEQ ID NO: 3917678 - RNA, 17 nt, Human adenovirus C
cagaaagcuacaaggac

SEQ ID NO: 3917679 - RNA, 15 nt, Human adenovirus C
cagaacgaccacagc

SEQ ID NO: 3917680 - RNA, 23 nt, Human adenovirus C
cagaagcuaaugaaugcacuacu

SEQ ID NO: 3917681 - RNA, 23 nt, Human adenovirus C
cagaccguaaaccugagccaggc

SEQ ID NO: 3917682 - RNA, 15 nt, Human adenovirus C
cagacgacagcagcg

SEQ ID NO: 3917683 - RNA, 21 nt, Human adenovirus C
cagacuauuuuuuccagacca

SEQ ID NO: 3917684 - RNA, 22 nt, Human adenovirus C
cagacuauuuuuuccagaccag

SEQ ID NO: 3917685 - RNA, 18 nt, Human adenovirus C
cagagaugaccggcucaa

SEQ ID NO: 3917686 - RNA, 21 nt, Human adenovirus C
cagagcauaguggugcaggag

SEQ ID NO: 3917687 - RNA, 21 nt, Human adenovirus C
cagagcgauuugucagaagcc

SEQ ID NO: 3917688 - RNA, 16 nt, Human adenovirus C
cagagcuguccuauca

SEQ ID NO: 3917689 - RNA, 22 nt, Human adenovirus C
cagaggagguuuuggacgagga

SEQ ID NO: 3917690 - RNA, 19 nt, Human adenovirus C
cagagggcauggagacaca

SEQ ID NO: 3917691 - RNA, 22 nt, Human adenovirus C
cagaggggcguggcgaaaagcg

SEQ ID NO: 3917692 - RNA, 18 nt, Human adenovirus C
cagauaaugacugcaaau

SEQ ID NO: 3917693 - RNA, 16 nt, Human adenovirus C
cagauacccaccacca

SEQ ID NO: 3917694 - RNA, 14 nt, Human adenovirus C
cagauauggcccuc

SEQ ID NO: 3917695 - RNA, 19 nt, Human adenovirus C
cagaugccgcggugcaggc

SEQ ID NO: 3917696 - RNA, 21 nt, Human adenovirus C
cagaugcgccccccuccucag

SEQ ID NO: 3917697 - RNA, 21 nt, Human adenovirus C
cagauggugauuacgaacccc

SEQ ID NO: 3917698 - RNA, 15 nt, Human adenovirus C
cagcaacagcagcgg

SEQ ID NO: 3917699 - RNA, 17 nt, Human adenovirus C
cagcaauaacacaggcu

SEQ ID NO: 3917700 - RNA, 22 nt, Human adenovirus C
cagcaauaugagcgguggcgcc

SEQ ID NO: 3917701 - RNA, 16 nt, Human adenovirus C
cagcaaugccuggagg

SEQ ID NO: 3917702 - RNA, 16 nt, Human adenovirus C
cagcacgaaggaggcu

SEQ ID NO: 3917703 - RNA, 20 nt, Human adenovirus C
cagcagaaaccugugcugcc

SEQ ID NO: 3917704 - RNA, 13 nt, Human adenovirus C
cagcagcacaggc

SEQ ID NO: 3917705 - RNA, 14 nt, Human adenovirus C
cagcagcacaggcc

SEQ ID NO: 3917706 - RNA, 17 nt, Human adenovirus C
cagcagcaggaggagga

SEQ ID NO: 3917707 - RNA, 13 nt, Human adenovirus C
cagcagcagggca

SEQ ID NO: 3917708 - RNA, 22 nt, Human adenovirus C
cagcagcagggcaaccugggcu

SEQ ID NO: 3917709 - RNA, 14 nt, Human adenovirus C
cagcagccgcaggc

SEQ ID NO: 3917710 - RNA, 12 nt, Human adenovirus C
cagcagcuguug

SEQ ID NO: 3917711 - RNA, 12 nt, Human adenovirus C
cagcaggaggaa

SEQ ID NO: 3917712 - RNA, 20 nt, Human adenovirus C
cagcagggcaaccugggcuc

SEQ ID NO: 3917713 - RNA, 15 nt, Human adenovirus C
cagcaggugcugccc

SEQ ID NO: 3917714 - RNA, 16 nt, Human adenovirus C
cagcaggugcugccca

SEQ ID NO: 3917715 - RNA, 13 nt, Human adenovirus C
cagcaucaccucc

SEQ ID NO: 3917716 - RNA, 23 nt, Human adenovirus C
cagcaugaagggcacgagcugcu

SEQ ID NO: 3917717 - RNA, 23 nt, Human adenovirus C
cagcauuugucuuuacgccaccu

SEQ ID NO: 3917718 - RNA, 15 nt, Human adenovirus C
cagccacuuaaaaaa

SEQ ID NO: 3917719 - RNA, 12 nt, Human adenovirus C
cagccaggugac

SEQ ID NO: 3917720 - RNA, 12 nt, Human adenovirus C
cagcccacccug

SEQ ID NO: 3917721 - RNA, 17 nt, Human adenovirus C
cagcccgggggaggcaa

SEQ ID NO: 3917722 - RNA, 19 nt, Human adenovirus C
cagcccgggggaggcaagc

SEQ ID NO: 3917723 - RNA, 21 nt, Human adenovirus C
cagcccgggggaggcaagcac

SEQ ID NO: 3917724 - RNA, 15 nt, Human adenovirus C
cagcccgugcuggcc

SEQ ID NO: 3917725 - RNA, 13 nt, Human adenovirus C
cagcccgugggcu

SEQ ID NO: 3917726 - RNA, 13 nt, Human adenovirus C
cagccgccgcacc

SEQ ID NO: 3917727 - RNA, 20 nt, Human adenovirus C
cagccgccuuuuagcugcaa

SEQ ID NO: 3917728 - RNA, 19 nt, Human adenovirus C
cagccgguggaggacauga

SEQ ID NO: 3917729 - RNA, 14 nt, Human adenovirus C
cagccggugggccc

SEQ ID NO: 3917730 - RNA, 15 nt, Human adenovirus C
cagccggugggcccg

SEQ ID NO: 3917731 - RNA, 17 nt, Human adenovirus C
cagccuccgccgccgcu

SEQ ID NO: 3917732 - RNA, 15 nt, Human adenovirus C
cagcgaugugccccu

SEQ ID NO: 3917733 - RNA, 15 nt, Human adenovirus C
cagcgccaaaaacug

SEQ ID NO: 3917734 - RNA, 13 nt, Human adenovirus C
cagcgccaaggcu

SEQ ID NO: 3917735 - RNA, 12 nt, Human adenovirus C
cagcgccagugc

SEQ ID NO: 3917736 - RNA, 17 nt, Human adenovirus C
cagcgccauuaugagca

SEQ ID NO: 3917737 - RNA, 13 nt, Human adenovirus C
cagcgccucccaa

SEQ ID NO: 3917738 - RNA, 17 nt, Human adenovirus C
cagcgccugcacugcaa

SEQ ID NO: 3917739 - RNA, 20 nt, Human adenovirus C
cagcgcgagcaggcagaggc

SEQ ID NO: 3917740 - RNA, 17 nt, Human adenovirus C
cagcggcaacgugcaga

SEQ ID NO: 3917741 - RNA, 20 nt, Human adenovirus C
cagcggcagaagcugccgcc

SEQ ID NO: 3917742 - RNA, 12 nt, Human adenovirus C
cagcggcagcaa

SEQ ID NO: 3917743 - RNA, 18 nt, Human adenovirus C
cagcggucacacagaagc

SEQ ID NO: 3917744 - RNA, 13 nt, Human adenovirus C
cagcggugcagcc

SEQ ID NO: 3917745 - RNA, 18 nt, Human adenovirus C
cagcguagucugggucac

SEQ ID NO: 3917746 - RNA, 23 nt, Human adenovirus C
cagcgugagcgcgcgcagcagca

SEQ ID NO: 3917747 - RNA, 19 nt, Human adenovirus C
cagcucggcggugaccugc

SEQ ID NO: 3917748 - RNA, 16 nt, Human adenovirus C
cagcucuacagcuucc

SEQ ID NO: 3917749 - RNA, 12 nt, Human adenovirus C
cagcugccgcca

SEQ ID NO: 3917750 - RNA, 23 nt, Human adenovirus C
cagcuguuccuuauagugcagca

SEQ ID NO: 3917751 - RNA, 15 nt, Human adenovirus C
caggacgacgcagag

SEQ ID NO: 3917752 - RNA, 23 nt, Human adenovirus C
caggagauuacaagugucagccg

SEQ ID NO: 3917753 - RNA, 16 nt, Human adenovirus C
caggaggaagccaggc

SEQ ID NO: 3917754 - RNA, 16 nt, Human adenovirus C
caggcagaggcggcgc

SEQ ID NO: 3917755 - RNA, 17 nt, Human adenovirus C
caggccagaugcugagg

SEQ ID NO: 3917756 - RNA, 16 nt, Human adenovirus C
caggcgauaauggaga

SEQ ID NO: 3917757 - RNA, 14 nt, Human adenovirus C
caggcgccgccggc

SEQ ID NO: 3917758 - RNA, 20 nt, Human adenovirus C
caggcgcggcggcugcugcg

SEQ ID NO: 3917759 - RNA, 20 nt, Human adenovirus C
caggcgcuuuuccaagagaa

SEQ ID NO: 3917760 - RNA, 18 nt, Human adenovirus C
caggcggccgcugcggcc

SEQ ID NO: 3917761 - RNA, 13 nt, Human adenovirus C
caggcgggagcuc

SEQ ID NO: 3917762 - RNA, 18 nt, Human adenovirus C
caggcgggagcuccugca

SEQ ID NO: 3917763 - RNA, 18 nt, Human adenovirus C
caggcuacuaagaaaaca

SEQ ID NO: 3917764 - RNA, 14 nt, Human adenovirus C
caggcugcgcacca

SEQ ID NO: 3917765 - RNA, 21 nt, Human adenovirus C
caggcuucguuuugacaucgg

SEQ ID NO: 3917766 - RNA, 19 nt, Human adenovirus C
caggcuuuguuucuccaca

SEQ ID NO: 3917767 - RNA, 15 nt, Human adenovirus C
cagggaugcgcugcu

SEQ ID NO: 3917768 - RNA, 15 nt, Human adenovirus C
cagggcaaccugggc

SEQ ID NO: 3917769 - RNA, 17 nt, Human adenovirus C
cagggcuucaauuaaga

SEQ ID NO: 3917770 - RNA, 16 nt, Human adenovirus C
caggggaugauuuuga

SEQ ID NO: 3917771 - RNA, 21 nt, Human adenovirus C
caggggcgcagcuugcgggcg

SEQ ID NO: 3917772 - RNA, 18 nt, Human adenovirus C
cagggucaugucuuucca

SEQ ID NO: 3917773 - RNA, 15 nt, Human adenovirus C
caggguccagaggac

SEQ ID NO: 3917774 - RNA, 22 nt, Human adenovirus C
cagggugcgcuugaggcugguc

SEQ ID NO: 3917775 - RNA, 18 nt, Human adenovirus C
cagguacagcccacccug

SEQ ID NO: 3917776 - RNA, 18 nt, Human adenovirus C
cagguacgccugcaggaa

SEQ ID NO: 3917777 - RNA, 14 nt, Human adenovirus C
caggucucugcgcu

SEQ ID NO: 3917778 - RNA, 12 nt, Human adenovirus C
caguaacugcag

SEQ ID NO: 3917779 - RNA, 20 nt, Human adenovirus C
caguaacugcagcacagcac

SEQ ID NO: 3917780 - RNA, 22 nt, Human adenovirus C
caguaacuuuauguccaugggc

SEQ ID NO: 3917781 - RNA, 21 nt, Human adenovirus C
caguacaaguuguggccccca

SEQ ID NO: 3917782 - RNA, 22 nt, Human adenovirus C
caguacaaguuguggcccccac

SEQ ID NO: 3917783 - RNA, 15 nt, Human adenovirus C
caguacuggcagcgg

SEQ ID NO: 3917784 - RNA, 20 nt, Human adenovirus C
caguaugauuaaaugagaca

SEQ ID NO: 3917785 - RNA, 12 nt, Human adenovirus C
cagucaggcaga

SEQ ID NO: 3917786 - RNA, 16 nt, Human adenovirus C
cagucaggcagaggag

SEQ ID NO: 3917787 - RNA, 13 nt, Human adenovirus C
caguccgggccag

SEQ ID NO: 3917788 - RNA, 14 nt, Human adenovirus C
cagugagcaggaac

SEQ ID NO: 3917789 - RNA, 17 nt, Human adenovirus C
cagugagcaggaacuga

SEQ ID NO: 3917790 - RNA, 22 nt, Human adenovirus C
cagugcuuguuaccguggagcu

SEQ ID NO: 3917791 - RNA, 16 nt, Human adenovirus C
caguggacgcggccau

SEQ ID NO: 3917792 - RNA, 13 nt, Human adenovirus C
caguggacuaaac

SEQ ID NO: 3917793 - RNA, 16 nt, Human adenovirus C
caguggcggcggcgcu

SEQ ID NO: 3917794 - RNA, 18 nt, Human adenovirus C
gguacccaacuccaugcu

SEQ ID NO: 3917795 - RNA, 18 nt, Human adenovirus C
gguagcgcguaugccugc

SEQ ID NO: 3917796 - RNA, 18 nt, Human adenovirus C
gguagcugccuucccaaa

SEQ ID NO: 3917797 - RNA, 20 nt, Human adenovirus C
gguauuagagaucuuauucc

SEQ ID NO: 3917798 - RNA, 22 nt, Human adenovirus C
gguccagaggaccucugcacuc

SEQ ID NO: 3917799 - RNA, 12 nt, Human adenovirus C
gguccagcagag

SEQ ID NO: 3917800 - RNA, 21 nt, Human adenovirus C
gguccgugugcaccagccgca

SEQ ID NO: 3917801 - RNA, 14 nt, Human adenovirus C
gguccugcuggugc

SEQ ID NO: 3917802 - RNA, 14 nt, Human adenovirus C
ggucucgcauucca

SEQ ID NO: 3917803 - RNA, 23 nt, Human adenovirus C
ggucucgcauuccacgagccagg

SEQ ID NO: 3917804 - RNA, 21 nt, Human adenovirus C
ggugaaaaucguaaaacuuuu

SEQ ID NO: 3917805 - RNA, 15 nt, Human adenovirus C
ggugaaggggugcgc

SEQ ID NO: 3917806 - RNA, 16 nt, Human adenovirus C
ggugaaggggugcgcu

SEQ ID NO: 3917807 - RNA, 17 nt, Human adenovirus C
ggugaaggucagcugca

SEQ ID NO: 3917808 - RNA, 16 nt, Human adenovirus C
ggugacaaccgugugc

SEQ ID NO: 3917809 - RNA, 21 nt, Human adenovirus C
ggugacgcgggcgggcccccg

SEQ ID NO: 3917810 - RNA, 20 nt, Human adenovirus C
ggugacggccuacuggagug

SEQ ID NO: 3917811 - RNA, 17 nt, Human adenovirus C
ggugagcgcggaggcgu

SEQ ID NO: 3917812 - RNA, 16 nt, Human adenovirus C
ggugagcgcggcgcca

SEQ ID NO: 3917813 - RNA, 23 nt, Human adenovirus C
ggugcagauguuggccaacuaca

SEQ ID NO: 3917814 - RNA, 19 nt, Human adenovirus C
ggugcaguuugcccgcgcc

SEQ ID NO: 3917815 - RNA, 17 nt, Human adenovirus C
ggugcaugcccaggcuu

SEQ ID NO: 3917816 - RNA, 15 nt, Human adenovirus C
ggugccucuuccaaa

SEQ ID NO: 3917817 - RNA, 13 nt, Human adenovirus C
ggugcgcuugagg

SEQ ID NO: 3917818 - RNA, 15 nt, Human adenovirus C
ggugcgcuugaggcu

SEQ ID NO: 3917819 - RNA, 19 nt, Human adenovirus C
ggugcugcgcgcggagguu

SEQ ID NO: 3917820 - RNA, 15 nt, Human adenovirus C
ggugcugcggcagau

SEQ ID NO: 3917821 - RNA, 18 nt, Human adenovirus C
gguggaggaggcgcgcaa

SEQ ID NO: 3917822 - RNA, 21 nt, Human adenovirus C
gguggaucccauggacgagcc

SEQ ID NO: 3917823 - RNA, 17 nt, Human adenovirus C
gguggcaccgggacugg

SEQ ID NO: 3917824 - RNA, 16 nt, Human adenovirus C
gguggcucccgggcuu

SEQ ID NO: 3917825 - RNA, 21 nt, Human adenovirus C
gguggcugaacuguuuccaga

SEQ ID NO: 3917826 - RNA, 14 nt, Human adenovirus C
ggugguggcggugu

SEQ ID NO: 3917827 - RNA, 15 nt, Human adenovirus C
gguggugggcgccga

SEQ ID NO: 3917828 - RNA, 15 nt, Human adenovirus C
ggugucauaguccag

SEQ ID NO: 3917829 - RNA, 15 nt, Human adenovirus C
gguucacccuggcug

SEQ ID NO: 3917830 - RNA, 11 nt, Human adenovirus C
gguuccagaug

SEQ ID NO: 3917831 - RNA, 20 nt, Human adenovirus C
gguuccugagcagcugcgac

SEQ ID NO: 3917832 - RNA, 17 nt, Human adenovirus C
gguucggggcugugccu

SEQ ID NO: 3917833 - RNA, 15 nt, Human adenovirus C
gguucugcagagcuc

SEQ ID NO: 3917834 - RNA, 16 nt, Human adenovirus C
gguugccgccugcugc

SEQ ID NO: 3917835 - RNA, 22 nt, Human adenovirus C
gguuguuaauuaccugggcggc

SEQ ID NO: 3917836 - RNA, 18 nt, Human adenovirus C
gguuguuucuggcggagg

SEQ ID NO: 3917837 - RNA, 16 nt, Human adenovirus C
guaaaccugagccagg

SEQ ID NO: 3917838 - RNA, 19 nt, Human adenovirus C
guaaagaccccgggcagca

SEQ ID NO: 3917839 - RNA, 21 nt, Human adenovirus C
guaagcgguuaggcuggaaag

SEQ ID NO: 3917840 - RNA, 22 nt, Human adenovirus C
guaagucuaagcagccgccgcc

SEQ ID NO: 3917841 - RNA, 13 nt, Human adenovirus C
guacaguggaaag

SEQ ID NO: 3917842 - RNA, 14 nt, Human adenovirus C
guacauccugcacg

SEQ ID NO: 3917843 - RNA, 19 nt, Human adenovirus C
guacauccugcacgagguu

SEQ ID NO: 3917844 - RNA, 13 nt, Human adenovirus C
guacaugauuuua

SEQ ID NO: 3917845 - RNA, 12 nt, Human adenovirus C
guacuuugacau

SEQ ID NO: 3917846 - RNA, 18 nt, Human adenovirus C
guagaccacgcccccuuc

SEQ ID NO: 3917847 - RNA, 18 nt, Human adenovirus C
guagagcuugggcgcgag

SEQ ID NO: 3917848 - RNA, 19 nt, Human adenovirus C
guagagggcguuggacagc

SEQ ID NO: 3917849 - RNA, 19 nt, Human adenovirus C
guagauggccuggccucug

SEQ ID NO: 3917850 - RNA, 22 nt, Human adenovirus C
guagcacgucgccaccgccgcc

SEQ ID NO: 3917851 - RNA, 15 nt, Human adenovirus C
guaggaggggcaugg

SEQ ID NO: 3917852 - RNA, 23 nt, Human adenovirus C
guaguuuuuacgcccggugagcg

SEQ ID NO: 3917853 - RNA, 17 nt, Human adenovirus C
guauacagacuugagag

SEQ ID NO: 3917854 - RNA, 14 nt, Human adenovirus C
guauccggugcacu

SEQ ID NO: 3917855 - RNA, 19 nt, Human adenovirus C
guauccggugcacuuggga

SEQ ID NO: 3917856 - RNA, 23 nt, Human adenovirus C
guaucuuuuguguggucaagcag

SEQ ID NO: 3917857 - RNA, 17 nt, Human adenovirus C
guaugcgcaggagcaca

SEQ ID NO: 3917858 - RNA, 20 nt, Human adenovirus C
guauucaaccugccaccucc

SEQ ID NO: 3917859 - RNA, 15 nt, Human adenovirus C
gucaauacggccggu

SEQ ID NO: 3917860 - RNA, 11 nt, Human adenovirus C
gucacccagca

SEQ ID NO: 3917861 - RNA, 19 nt, Human adenovirus C
gucacugcuaccuucugca

SEQ ID NO: 3917862 - RNA, 14 nt, Human adenovirus C
gucacuugcugaca

SEQ ID NO: 3917863 - RNA, 16 nt, Human adenovirus C
gucaggcgggagcucc

SEQ ID NO: 3917864 - RNA, 22 nt, Human adenovirus C
gucauaccacugcaacagguua

SEQ ID NO: 3917865 - RNA, 19 nt, Human adenovirus C
gucaugcaagaccccgcuu

SEQ ID NO: 3917866 - RNA, 21 nt, Human adenovirus C
guccacgguaaagaccccggg

SEQ ID NO: 3917867 - RNA, 16 nt, Human adenovirus C
guccacuagggggucc

SEQ ID NO: 3917868 - RNA, 15 nt, Human adenovirus C
guccagacgggccag

SEQ ID NO: 3917869 - RNA, 14 nt, Human adenovirus C
guccagcagaggcg

SEQ ID NO: 3917870 - RNA, 20 nt, Human adenovirus C
guccagcagaggcggccgcc

SEQ ID NO: 3917871 - RNA, 15 nt, Human adenovirus C
guccagcuuauucag

SEQ ID NO: 3917872 - RNA, 19 nt, Human adenovirus C
guccagcuuauucagcauc

SEQ ID NO: 3917873 - RNA, 17 nt, Human adenovirus C
guccaggguuuccuuga

SEQ ID NO: 3917874 - RNA, 17 nt, Human adenovirus C
guccauggucuggagcu

SEQ ID NO: 3917875 - RNA, 22 nt, Human adenovirus C
gucccagcguuugacgcugcgg

SEQ ID NO: 3917876 - RNA, 14 nt, Human adenovirus C
gucccgcucccacc

SEQ ID NO: 3917877 - RNA, 18 nt, Human adenovirus C
gucccuaaccaugacuuu

SEQ ID NO: 3917878 - RNA, 20 nt, Human adenovirus C
gucccuaaccaugacuuuga

SEQ ID NO: 3917879 - RNA, 16 nt, Human adenovirus C
gucccuccgcacccac

SEQ ID NO: 3917880 - RNA, 19 nt, Human adenovirus C
guccggcucaccacccagg

SEQ ID NO: 3917881 - RNA, 20 nt, Human adenovirus C
guccggcucaccacccaggu

SEQ ID NO: 3917882 - RNA, 17 nt, Human adenovirus C
guccgugugcaccagcc

SEQ ID NO: 3917883 - RNA, 22 nt, Human adenovirus C
guccuuggguccggccugcuga

SEQ ID NO: 3917884 - RNA, 22 nt, Human adenovirus C
gucgaagccguugauguugugg

SEQ ID NO: 3917885 - RNA, 13 nt, Human adenovirus C
gucgcaggggcaa

SEQ ID NO: 3917886 - RNA, 18 nt, Human adenovirus C
gucgccgucgccagcccg

SEQ ID NO: 3917887 - RNA, 16 nt, Human adenovirus C
gucgcuguccagcugc

SEQ ID NO: 3917888 - RNA, 15 nt, Human adenovirus C
gucgggcaccaggug

SEQ ID NO: 3917889 - RNA, 17 nt, Human adenovirus C
gucgggguuguuucugg

SEQ ID NO: 3917890 - RNA, 21 nt, Human adenovirus C
gucgugcgcaccaccggcggc

SEQ ID NO: 3917891 - RNA, 17 nt, Human adenovirus C
gucuaugcccaggcucc

SEQ ID NO: 3917892 - RNA, 13 nt, Human adenovirus C
gucuccagagggg

SEQ ID NO: 3917893 - RNA, 18 nt, Human adenovirus C
gucucgcauuccacgagc

SEQ ID NO: 3917894 - RNA, 23 nt, Human adenovirus C
gucugaagacaccuucaaccccg

SEQ ID NO: 3917895 - RNA, 22 nt, Human adenovirus C
gucugaggguaacuccagggug

SEQ ID NO: 3917896 - RNA, 14 nt, Human adenovirus C
gucuuacaaaccug

SEQ ID NO: 3917897 - RNA, 23 nt, Human adenovirus C
gucuucgcccugcgcgucggcca

SEQ ID NO: 3917898 - RNA, 13 nt, Human adenovirus C
gugaaccaggaga

SEQ ID NO: 3917899 - RNA, 18 nt, Human adenovirus C
gugacccggcugcgagag

SEQ ID NO: 3917900 - RNA, 14 nt, Human adenovirus C
gugacgaaaaggcu

SEQ ID NO: 3917901 - RNA, 14 nt, Human adenovirus C
gugacugacuuugc

SEQ ID NO: 3917902 - RNA, 19 nt, Human adenovirus C
gugagcgugagccggcggc

SEQ ID NO: 3917903 - RNA, 13 nt, Human adenovirus C
gugaugccuuuga

SEQ ID NO: 3917904 - RNA, 13 nt, Human adenovirus C
gugcagcagagcg

SEQ ID NO: 3917905 - RNA, 19 nt, Human adenovirus C
gugccaaccgcagccgagc

SEQ ID NO: 3917906 - RNA, 14 nt, Human adenovirus C
gugcccgcugucau

SEQ ID NO: 3917907 - RNA, 14 nt, Human adenovirus C
gugcccuugaugga

SEQ ID NO: 3917908 - RNA, 22 nt, Human adenovirus C
gugccgggauuccgaggaagaa

SEQ ID NO: 3917909 - RNA, 14 nt, Human adenovirus C
gugcgcggagcccg

SEQ ID NO: 3917910 - RNA, 23 nt, Human adenovirus C
uggauguggacgccuaccaggca

SEQ ID NO: 3917911 - RNA, 22 nt, Human adenovirus C
uggcacccgcgcgcgcuggcaa

SEQ ID NO: 3917912 - RNA, 23 nt, Human adenovirus C
uggcauuagcggggugguggacc

SEQ ID NO: 3917913 - RNA, 17 nt, Human adenovirus C
uggccaaccaggcagug

SEQ ID NO: 3917914 - RNA, 13 nt, Human adenovirus C
uggcccgcgguga

SEQ ID NO: 3917915 - RNA, 19 nt, Human adenovirus C
uggccgaaaacagggccau

SEQ ID NO: 3917916 - RNA, 22 nt, Human adenovirus C
uggccgcgauguuuagcugcac

SEQ ID NO: 3917917 - RNA, 14 nt, Human adenovirus C
uggccgcgggcugg

SEQ ID NO: 3917918 - RNA, 16 nt, Human adenovirus C
uggccggggcuccggg

SEQ ID NO: 3917919 - RNA, 13 nt, Human adenovirus C
uggccucuggcau

SEQ ID NO: 3917920 - RNA, 18 nt, Human adenovirus C
uggcgcagcgugagcgcg

SEQ ID NO: 3917921 - RNA, 17 nt, Human adenovirus C
uggcgccuucagcuggg

SEQ ID NO: 3917922 - RNA, 15 nt, Human adenovirus C
uggcggcggcgcugg

SEQ ID NO: 3917923 - RNA, 22 nt, Human adenovirus C
uggcgguagugggucuagcugc

SEQ ID NO: 3917924 - RNA, 18 nt, Human adenovirus C
uggcgguggcacccgcgc

SEQ ID NO: 3917925 - RNA, 17 nt, Human adenovirus C
uggcuaccccuucgaug

SEQ ID NO: 3917926 - RNA, 17 nt, Human adenovirus C
uggcuugagacgcgcga

SEQ ID NO: 3917927 - RNA, 17 nt, Human adenovirus C
ugggauaugcuccaggc

SEQ ID NO: 3917928 - RNA, 13 nt, Human adenovirus C
ugggcaggcagaa

SEQ ID NO: 3917929 - RNA, 13 nt, Human adenovirus C
ugggcgaggagga

SEQ ID NO: 3917930 - RNA, 16 nt, Human adenovirus C
ugggcuaaucuugguu

SEQ ID NO: 3917931 - RNA, 13 nt, Human adenovirus C
uggggcaggagga

SEQ ID NO: 3917932 - RNA, 16 nt, Human adenovirus C
uggggcggcgaccuga

SEQ ID NO: 3917933 - RNA, 22 nt, Human adenovirus C
uggggcucgcuguggagcggca

SEQ ID NO: 3917934 - RNA, 24 nt, Human adenovirus C
ugggggugcaaucccugaagcgcc

SEQ ID NO: 3917935 - RNA, 16 nt, Human adenovirus C
uggggugggugagcgc

SEQ ID NO: 3917936 - RNA, 12 nt, Human adenovirus C
ugggugagcgca

SEQ ID NO: 3917937 - RNA, 19 nt, Human adenovirus C
uggucccggcgcgcgcaaa

SEQ ID NO: 3917938 - RNA, 16 nt, Human adenovirus C
uggugcaggagcgcag

SEQ ID NO: 3917939 - RNA, 22 nt, Human adenovirus C
uggugcaguuugcccgcgccac

SEQ ID NO: 3917940 - RNA, 14 nt, Human adenovirus C
ugguggaccuggcc

SEQ ID NO: 3917941 - RNA, 15 nt, Human adenovirus C
ugguuccuggugcag

SEQ ID NO: 3917942 - RNA, 15 nt, Human adenovirus C
ugguucuugcagaua

SEQ ID NO: 3917943 - RNA, 13 nt, Human adenovirus C
uguaccugcgcac

SEQ ID NO: 3917944 - RNA, 17 nt, Human adenovirus C
uguccagcuuauucagc

SEQ ID NO: 3917945 - RNA, 22 nt, Human adenovirus C
uguccaucaacgcgcgcgcagc

SEQ ID NO: 3917946 - RNA, 16 nt, Human adenovirus C
ugugacgagucuucuu

SEQ ID NO: 3917947 - RNA, 13 nt, Human adenovirus C
ugugcagcagagc

SEQ ID NO: 3917948 - RNA, 12 nt, Human adenovirus C
ugugcgcgaggc

SEQ ID NO: 3917949 - RNA, 22 nt, Human adenovirus C
ugugcuugauauggcuuccacg

SEQ ID NO: 3917950 - RNA, 16 nt, Human adenovirus C
uguggccgggggugcu

SEQ ID NO: 3917951 - RNA, 18 nt, Human adenovirus C
uguggcgcgcgaggaggu

SEQ ID NO: 3917952 - RNA, 17 nt, Human adenovirus C
uguggugagcuguuuga

SEQ ID NO: 3917953 - RNA, 17 nt, Human adenovirus C
uguucugacagggccca

SEQ ID NO: 3917954 - RNA, 19 nt, Human adenovirus C
uguugcgcuuuucugugcg

SEQ ID NO: 3917955 - RNA, 16 nt, Human adenovirus C
uguuggcguugccgcu

SEQ ID NO: 3917956 - RNA, 17 nt, Human adenovirus C
uguugggaaacggccgc

SEQ ID NO: 3917957 - RNA, 18 nt, Human adenovirus C
uuaaacagcgaggaggag

SEQ ID NO: 3917958 - RNA, 20 nt, Human adenovirus C
uuaacaauaccuguguggaa

SEQ ID NO: 3917959 - RNA, 18 nt, Human adenovirus C
uuaagagagcugcagcug

SEQ ID NO: 3917960 - RNA, 17 nt, Human adenovirus C
uuaagcccuacuccggc

SEQ ID NO: 3917961 - RNA, 21 nt, Human adenovirus C
uuaaguauaugagcaauucaa

SEQ ID NO: 3917962 - RNA, 22 nt, Human adenovirus C
uuaaguucaugucgcuguccag

SEQ ID NO: 3917963 - RNA, 18 nt, Human adenovirus C
uuaaucaaacucacagaa

SEQ ID NO: 3917964 - RNA, 16 nt, Human adenovirus C
uuaaugcaucucauaa

SEQ ID NO: 3917965 - RNA, 19 nt, Human adenovirus C
uuacaacagcggcaacgug

SEQ ID NO: 3917966 - RNA, 14 nt, Human adenovirus C
uuacugcugcugga

SEQ ID NO: 3917967 - RNA, 17 nt, Human adenovirus C
uuacugcugcuggaagg

SEQ ID NO: 3917968 - RNA, 15 nt, Human adenovirus C
uuaggguauaugcaa

SEQ ID NO: 3917969 - RNA, 21 nt, Human adenovirus C
uuagugcuccacuuaaacuca

SEQ ID NO: 3917970 - RNA, 16 nt, Human adenovirus C
uuauacccacaaccuu

SEQ ID NO: 3917971 - RNA, 21 nt, Human adenovirus C
uuaucucaaauacaaaagcag

SEQ ID NO: 3917972 - RNA, 17 nt, Human adenovirus C
uucagccugaauaacaa

SEQ ID NO: 3917973 - RNA, 21 nt, Human adenovirus C
uucaucaaacaacauggaaau

SEQ ID NO: 3917974 - RNA, 18 nt, Human adenovirus C
uuccaaaaacgaggagga

SEQ ID NO: 3917975 - RNA, 17 nt, Human adenovirus C
uuccaaaacugcaagau

SEQ ID NO: 3917976 - RNA, 23 nt, Human adenovirus C
uuccagaccaguagacaaggccu

SEQ ID NO: 3917977 - RNA, 18 nt, Human adenovirus C
uuccaggaaguacggcac

SEQ ID NO: 3917978 - RNA, 16 nt, Human adenovirus C
uucccaggauggcacc

SEQ ID NO: 3917979 - RNA, 20 nt, Human adenovirus C
uucccagugcccgcugucau

SEQ ID NO: 3917980 - RNA, 19 nt, Human adenovirus C
uucccgcacuguuggaugu

SEQ ID NO: 3917981 - RNA, 14 nt, Human adenovirus C
uucgcacuggggcg

SEQ ID NO: 3917982 - RNA, 16 nt, Human adenovirus C
uucgcgguugggccuu

SEQ ID NO: 3917983 - RNA, 23 nt, Human adenovirus C
uucgguuccaccauuaagaacua

SEQ ID NO: 3917984 - RNA, 21 nt, Human adenovirus C
uucuaccccguauuugccgug

SEQ ID NO: 3917985 - RNA, 22 nt, Human adenovirus C
uucugaucagaugaugcaagac

SEQ ID NO: 3917986 - RNA, 17 nt, Human adenovirus C
uucuuauauuauugacc

SEQ ID NO: 3917987 - RNA, 13 nt, Human adenovirus C
uugaacaaaacuc

SEQ ID NO: 3917988 - RNA, 13 nt, Human adenovirus C
uugacaugaccau

SEQ ID NO: 3917989 - RNA, 14 nt, Human adenovirus C
uugagccuggcuga

SEQ ID NO: 3917990 - RNA, 17 nt, Human adenovirus C
uugagccuggcugacaa

SEQ ID NO: 3917991 - RNA, 23 nt, Human adenovirus C
uugcaagaacaaaccgaggaggg

SEQ ID NO: 3917992 - RNA, 15 nt, Human adenovirus C
uugcaagcagugcag

SEQ ID NO: 3917993 - RNA, 21 nt, Human adenovirus C
uugcauguuuucccugaccaa

SEQ ID NO: 3917994 - RNA, 22 nt, Human adenovirus C
uugcauuuggguaacaggaggg

SEQ ID NO: 3917995 - RNA, 17 nt, Human adenovirus C
uugcccuuggaggaggc

SEQ ID NO: 3917996 - RNA, 16 nt, Human adenovirus C
uugcgauacacagggu

SEQ ID NO: 3917997 - RNA, 17 nt, Human adenovirus C
uugcgcuaugugcagca

SEQ ID NO: 3917998 - RNA, 22 nt, Human adenovirus C
uugcgcuaugugcagcagagcg

SEQ ID NO: 3917999 - RNA, 20 nt, Human adenovirus C
uugcugacacuguaccgcga

SEQ ID NO: 3918000 - RNA, 19 nt, Human adenovirus C
uuggagaugcgggccauga

SEQ ID NO: 3918001 - RNA, 19 nt, Human adenovirus C
uuuaggcuugcucgcccuu

SEQ ID NO: 3918002 - RNA, 23 nt, Human adenovirus C
uuuccaggggcugguugguggcg

SEQ ID NO: 3918003 - RNA, 16 nt, Human adenovirus C
uuucgcguuucagccc

SEQ ID NO: 3918004 - RNA, 22 nt, Human adenovirus C
uuucuggcggaggugcugcuga

SEQ ID NO: 3918005 - RNA, 14 nt, Human adenovirus C
uuugaagagcuuuu

SEQ ID NO: 3918006 - RNA, 21 nt, Human adenovirus C
uuugagguacugguauuugaa

SEQ ID NO: 3918007 - RNA, 17 nt, Human adenovirus C
uuugauauucaccuggc

SEQ ID NO: 3918008 - RNA, 16 nt, Human adenovirus C
uuugccacacaaccuu

SEQ ID NO: 3918009 - RNA, 13 nt, Human adenovirus C
uuuguaauuuaca

SEQ ID NO: 3918010 - RNA, 19 nt, Human adenovirus C
uuuguacagugaagaugua

SEQ ID NO: 3918011 - RNA, 20 nt, Human adenovirus C
uuuuacccacccaaagcaga

SEQ ID NO: 3918012 - RNA, 17 nt, Human adenovirus C
uuuuggacgaggaggag

SEQ ID NO: 3918013 - RNA, 20 nt, Human adenovirus D
aaaaaucacucuuuccagca

SEQ ID NO: 3918014 - RNA, 10 nt, Human adenovirus D
aaaacacaca

SEQ ID NO: 3918015 - RNA, 14 nt, Human adenovirus D
aaaacagaaagcau

SEQ ID NO: 3918016 - RNA, 13 nt, Human adenovirus D
aaaaccacauuug

SEQ ID NO: 3918017 - RNA, 19 nt, Human adenovirus D
aaaaccaguuuucccccgu

SEQ ID NO: 3918018 - RNA, 13 nt, Human adenovirus D
aaaacccaugaaa

SEQ ID NO: 3918019 - RNA, 15 nt, Human adenovirus D
aaaagcguccgcagu

SEQ ID NO: 3918020 - RNA, 14 nt, Human adenovirus D
aaaccccgccaaaa

SEQ ID NO: 3918021 - RNA, 14 nt, Human adenovirus D
aaaccuuaguuggg

SEQ ID NO: 3918022 - RNA, 18 nt, Human adenovirus D
aaagcaguucacuagccu

SEQ ID NO: 3918023 - RNA, 16 nt, Human adenovirus D
aaagccagcagcacau

SEQ ID NO: 3918024 - RNA, 15 nt, Human adenovirus D
aaagcugaggauggc

SEQ ID NO: 3918025 - RNA, 22 nt, Human adenovirus D
aaagugcuggaggguugaaaga

SEQ ID NO: 3918026 - RNA, 22 nt, Human adenovirus D
cgaccucgccgucuacucccag

SEQ ID NO: 3918027 - RNA, 21 nt, Human adenovirus D
cgaccugggcguguaccgcaa

SEQ ID NO: 3918028 - RNA, 22 nt, Human adenovirus D
cgaccuugcaaaagcgccagga

SEQ ID NO: 3918029 - RNA, 20 nt, Human adenovirus D
cgacgaggauuucgagccga

SEQ ID NO: 3918030 - RNA, 15 nt, Human adenovirus D
cgacguggacagcgc

SEQ ID NO: 3918031 - RNA, 14 nt, Human adenovirus D
cgacucgcugcugc

SEQ ID NO: 3918032 - RNA, 14 nt, Human adenovirus D
cgagaccagaggca

SEQ ID NO: 3918033 - RNA, 15 nt, Human adenovirus D
cgagaccgugagcuc

SEQ ID NO: 3918034 - RNA, 19 nt, Human adenovirus D
cgagaccugcgcaaggucg

SEQ ID NO: 3918035 - RNA, 17 nt, Human adenovirus D
cgagaggcgagcagcug

SEQ ID NO: 3918036 - RNA, 19 nt, Human adenovirus D
cgagaucguccucccccga

SEQ ID NO: 3918037 - RNA, 22 nt, Human adenovirus D
cgagcaacccaaaaucgagcag

SEQ ID NO: 3918038 - RNA, 18 nt, Human adenovirus D
cgagcaagacgcaggcca

SEQ ID NO: 3918039 - RNA, 21 nt, Human adenovirus D
cgagcaagggcgaccagcucu

SEQ ID NO: 3918040 - RNA, 22 nt, Human adenovirus D
cgagcacagcaccgcauccuga

SEQ ID NO: 3918041 - RNA, 14 nt, Human adenovirus D
cgagcacucgugcu

SEQ ID NO: 3918042 - RNA, 23 nt, Human adenovirus D
cgagcagacggugaagcaggagc

SEQ ID NO: 3918043 - RNA, 16 nt, Human adenovirus D
cgagcagcgcauccug

SEQ ID NO: 3918044 - RNA, 17 nt, Human adenovirus D
cgagcaggaccugggcu

SEQ ID NO: 3918045 - RNA, 17 nt, Human adenovirus D
cgagcaugaggcggugg

SEQ ID NO: 3918046 - RNA, 13 nt, Human adenovirus D
cgagccaggugag

SEQ ID NO: 3918047 - RNA, 16 nt, Human adenovirus D
cgagccaggugagcuc

SEQ ID NO: 3918048 - RNA, 19 nt, Human adenovirus D
cgagccauugaccaccagg

SEQ ID NO: 3918049 - RNA, 21 nt, Human adenovirus D
cgagcccgcgcgggagccagg

SEQ ID NO: 3918050 - RNA, 13 nt, Human adenovirus D
cgagcgccagcug

SEQ ID NO: 3918051 - RNA, 14 nt, Human adenovirus D
cgagcgccagcugu

SEQ ID NO: 3918052 - RNA, 22 nt, Human adenovirus D
cgagcuacaugcccagcagcag

SEQ ID NO: 3918053 - RNA, 17 nt, Human adenovirus D
cgagcuggaagcccuga

SEQ ID NO: 3918054 - RNA, 21 nt, Human adenovirus D
cgaggagcugagaccagacca

SEQ ID NO: 3918055 - RNA, 23 nt, Human adenovirus D
cgaggauuucgagccgaacgagc

SEQ ID NO: 3918056 - RNA, 18 nt, Human adenovirus D
cgaggccaugcugcgccg

SEQ ID NO: 3918057 - RNA, 15 nt, Human adenovirus D
cgagggccugggcuc

SEQ ID NO: 3918058 - RNA, 15 nt, Human adenovirus D
cgagggcgcgcaguu

SEQ ID NO: 3918059 - RNA, 17 nt, Human adenovirus D
cgagggucgcuggcugc

SEQ ID NO: 3918060 - RNA, 19 nt, Human adenovirus D
cgagggucugcgagaggag

SEQ ID NO: 3918061 - RNA, 15 nt, Human adenovirus D
cgauagccgccagga

SEQ ID NO: 3918062 - RNA, 15 nt, Human adenovirus D
cgauccugacgcgcc

SEQ ID NO: 3918063 - RNA, 22 nt, Human adenovirus D
cgaugagaucaacuacaaggac

SEQ ID NO: 3918064 - RNA, 21 nt, Human adenovirus D
cgaugccaucaacauccacca

SEQ ID NO: 3918065 - RNA, 17 nt, Human adenovirus D
cgaugccuucuccaggg

SEQ ID NO: 3918066 - RNA, 19 nt, Human adenovirus D
cgaugguggcgcgcaccuc

SEQ ID NO: 3918067 - RNA, 15 nt, Human adenovirus D
cgauguaacaucacc

SEQ ID NO: 3918068 - RNA, 16 nt, Human adenovirus D
cgauguaacaucacca

SEQ ID NO: 3918069 - RNA, 18 nt, Human adenovirus D
cgcaaccaggaggagcuc

SEQ ID NO: 3918070 - RNA, 17 nt, Human adenovirus D
cgcaaugcgggccugcg

SEQ ID NO: 3918071 - RNA, 17 nt, Human adenovirus D
cgcacccguccuccucg

SEQ ID NO: 3918072 - RNA, 11 nt, Human adenovirus D
cgcaccucgcg

SEQ ID NO: 3918073 - RNA, 12 nt, Human adenovirus D
cgcaccucgcgc

SEQ ID NO: 3918074 - RNA, 13 nt, Human adenovirus D
cgcacgggccgcc

SEQ ID NO: 3918075 - RNA, 22 nt, Human adenovirus D
cgcagacgagcggccgccgccg

SEQ ID NO: 3918076 - RNA, 15 nt, Human adenovirus D
cgcaggcgcccagcc

SEQ ID NO: 3918077 - RNA, 20 nt, Human adenovirus D
cgcaggcgggacagaggagg

SEQ ID NO: 3918078 - RNA, 20 nt, Human adenovirus D
cgcaguccgccaagcuccuc

SEQ ID NO: 3918079 - RNA, 15 nt, Human adenovirus D
cgcaucauggcccug

SEQ ID NO: 3918080 - RNA, 23 nt, Human adenovirus D
cgcauguacaacaugcugacugc

SEQ ID NO: 3918081 - RNA, 14 nt, Human adenovirus D
cgcauguacuccuu

SEQ ID NO: 3918082 - RNA, 18 nt, Human adenovirus D
cgccaaccggcugaugcc

SEQ ID NO: 3918083 - RNA, 21 nt, Human adenovirus D
cgccaacucggcccacgcgcu

SEQ ID NO: 3918084 - RNA, 15 nt, Human adenovirus D
cgccaagggcagccc

SEQ ID NO: 3918085 - RNA, 12 nt, Human adenovirus D
cgccaccugcaa

SEQ ID NO: 3918086 - RNA, 22 nt, Human adenovirus D
cgccaccuucuuccccauggcg

SEQ ID NO: 3918087 - RNA, 18 nt, Human adenovirus D
cgccagacgcacgggccg

SEQ ID NO: 3918088 - RNA, 24 nt, Human adenovirus D
cgccagccgcgguuaugcagggug

SEQ ID NO: 3918089 - RNA, 17 nt, Human adenovirus D
cgccaggaggcggugcg

SEQ ID NO: 3918090 - RNA, 20 nt, Human adenovirus D
cgccauugucaacacggccg

SEQ ID NO: 3918091 - RNA, 21 nt, Human adenovirus D
cgcccagcaauaacaccggcu

SEQ ID NO: 3918092 - RNA, 14 nt, Human adenovirus D
cgcccagcaugucc

SEQ ID NO: 3918093 - RNA, 19 nt, Human adenovirus D
cgcccagcgagaggagcuc

SEQ ID NO: 3918094 - RNA, 13 nt, Human adenovirus D
cgcccgcagcacg

SEQ ID NO: 3918095 - RNA, 16 nt, Human adenovirus D
cgcccgccgccaggcc

SEQ ID NO: 3918096 - RNA, 13 nt, Human adenovirus D
cgcccgcgcccac

SEQ ID NO: 3918097 - RNA, 17 nt, Human adenovirus D
cgcccguagucuggaga

SEQ ID NO: 3918098 - RNA, 15 nt, Human adenovirus D
cgcccgucgccgcac

SEQ ID NO: 3918099 - RNA, 16 nt, Human adenovirus D
cgcccugacccagcag

SEQ ID NO: 3918100 - RNA, 18 nt, Human adenovirus D
cgcccugagagcgcuggc

SEQ ID NO: 3918101 - RNA, 15 nt, Human adenovirus D
cgcccugcuggagcg

SEQ ID NO: 3918102 - RNA, 18 nt, Human adenovirus D
cgccgaagcgccguggcc

SEQ ID NO: 3918103 - RNA, 22 nt, Human adenovirus D
cgccgacgcgcuccucgcucug

SEQ ID NO: 3918104 - RNA, 20 nt, Human adenovirus D
cgccgauuuaaagacccaca

SEQ ID NO: 3918105 - RNA, 13 nt, Human adenovirus D
cgccgccgcggcc

SEQ ID NO: 3918106 - RNA, 16 nt, Human adenovirus D
cgccggcggcgggcca

SEQ ID NO: 3918107 - RNA, 22 nt, Human adenovirus D
cgccgggccaugaugcgagccg

SEQ ID NO: 3918108 - RNA, 17 nt, Human adenovirus D
cgccgucaaccucccgc

SEQ ID NO: 3918109 - RNA, 13 nt, Human adenovirus D
cgccuccacccug

SEQ ID NO: 3918110 - RNA, 14 nt, Human adenovirus D
cgccuggggcagac

SEQ ID NO: 3918111 - RNA, 22 nt, Human adenovirus D
cgccuggggcagacagugcucc

SEQ ID NO: 3918112 - RNA, 15 nt, Human adenovirus D
cgcgaaccaggcagu

SEQ ID NO: 3918113 - RNA, 15 nt, Human adenovirus D
cgcgacccccaggcc

SEQ ID NO: 3918114 - RNA, 20 nt, Human adenovirus D
cgcgagcgagggcgcggugg

SEQ ID NO: 3918115 - RNA, 20 nt, Human adenovirus D
cgcgaguucgcuccgcggcg

SEQ ID NO: 3918116 - RNA, 18 nt, Human adenovirus D
cgcgcccguagucuggag

SEQ ID NO: 3918117 - RNA, 22 nt, Human adenovirus D
cgcgcgcaugaccaccugcgcg

SEQ ID NO: 3918118 - RNA, 16 nt, Human adenovirus D
cgcgcgcgguaggccc

SEQ ID NO: 3918119 - RNA, 15 nt, Human adenovirus D
cgcgcgggagccagg

SEQ ID NO: 3918120 - RNA, 12 nt, Human adenovirus D
cgcgcgggcagg

SEQ ID NO: 3918121 - RNA, 13 nt, Human adenovirus D
cgcgcgggcagga

SEQ ID NO: 3918122 - RNA, 18 nt, Human adenovirus D
cgcgcuugcugggcgagg

SEQ ID NO: 3918123 - RNA, 16 nt, Human adenovirus D
cgcggacggccgcggc

SEQ ID NO: 3918124 - RNA, 17 nt, Human adenovirus D
cgcggccgcccacggug

SEQ ID NO: 3918125 - RNA, 20 nt, Human adenovirus D
cgcggccguucaugggcacc

SEQ ID NO: 3918126 - RNA, 18 nt, Human adenovirus D
cgcggcguccuggaccgc

SEQ ID NO: 3918127 - RNA, 15 nt, Human adenovirus D
cgcgguccuccucgu

SEQ ID NO: 3918128 - RNA, 19 nt, Human adenovirus D
cgcggugggucggagcccc

SEQ ID NO: 3918129 - RNA, 22 nt, Human adenovirus D
cgcguaaauuggaaggggcgca

SEQ ID NO: 3918130 - RNA, 14 nt, Human adenovirus D
cgcguccaucgugc

SEQ ID NO: 3918131 - RNA, 18 nt, Human adenovirus D
cgcgucgcuguccacgag

SEQ ID NO: 3918132 - RNA, 19 nt, Human adenovirus D
cgcguguugcggcccggca

SEQ ID NO: 3918133 - RNA, 17 nt, Human adenovirus D
cgcuacgugcccuucca

SEQ ID NO: 3918134 - RNA, 17 nt, Human adenovirus D
cgcuagccagccacagc

SEQ ID NO: 3918135 - RNA, 12 nt, Human adenovirus D
cgcucaggacca

SEQ ID NO: 3918136 - RNA, 18 nt, Human adenovirus D
cgcuccaccgaaggcagc

SEQ ID NO: 3918137 - RNA, 14 nt, Human adenovirus D
cgcuccguggggcg

SEQ ID NO: 3918138 - RNA, 16 nt, Human adenovirus D
cgcucucguuccagac

SEQ ID NO: 3918139 - RNA, 19 nt, Human adenovirus D
cgcugaaaggcgggcugcc

SEQ ID NO: 3918140 - RNA, 21 nt, Human adenovirus D
cgcugagcgacgaccugggcg

SEQ ID NO: 3918141 - RNA, 20 nt, Human adenovirus D
cgcugcacgggcuguaccuc

SEQ ID NO: 3918142 - RNA, 23 nt, Human adenovirus D
acggggaucagccccgcgcgcgc

SEQ ID NO: 3918143 - RNA, 18 nt, Human adenovirus D
acggugaagcaggagcgc

SEQ ID NO: 3918144 - RNA, 19 nt, Human adenovirus D
acggugaaggggugggccc

SEQ ID NO: 3918145 - RNA, 12 nt, Human adenovirus D
acguacuucagc

SEQ ID NO: 3918146 - RNA, 15 nt, Human adenovirus D
acguagcagcccugu

SEQ ID NO: 3918147 - RNA, 22 nt, Human adenovirus D
acguagucguugcaggugcgca

SEQ ID NO: 3918148 - RNA, 16 nt, Human adenovirus D
acgucaccugcggcgc

SEQ ID NO: 3918149 - RNA, 22 nt, Human adenovirus D
acgucgcccgaguuguccuggu

SEQ ID NO: 3918150 - RNA, 19 nt, Human adenovirus D
acgugcccaucuccauccc

SEQ ID NO: 3918151 - RNA, 19 nt, Human adenovirus D
acguguugcauccuuccau

SEQ ID NO: 3918152 - RNA, 21 nt, Human adenovirus D
acuacagcugacaauucagag

SEQ ID NO: 3918153 - RNA, 18 nt, Human adenovirus D
acuacauggacaagauau

SEQ ID NO: 3918154 - RNA, 21 nt, Human adenovirus D
acuaccugcaucgcgcggcgu

SEQ ID NO: 3918155 - RNA, 20 nt, Human adenovirus D
acuacuaauucucaaagugu

SEQ ID NO: 3918156 - RNA, 18 nt, Human adenovirus D
acuagccggagccgggag

SEQ ID NO: 3918157 - RNA, 15 nt, Human adenovirus D
acuagcgcccuggua

SEQ ID NO: 3918158 - RNA, 16 nt, Human adenovirus D
acuagcgugagccgcg

SEQ ID NO: 3918159 - RNA, 22 nt, Human adenovirus D
acuagcgugagccgcgcgcugg

SEQ ID NO: 3918160 - RNA, 15 nt, Human adenovirus D
acuaggcccagcagc

SEQ ID NO: 3918161 - RNA, 18 nt, Human adenovirus D
acuaugaucccaacagcc

SEQ ID NO: 3918162 - RNA, 22 nt, Human adenovirus D
acuccccuuacuuucgcuccca

SEQ ID NO: 3918163 - RNA, 21 nt, Human adenovirus D
acucccgucucgacccgagcc

SEQ ID NO: 3918164 - RNA, 16 nt, Human adenovirus D
acucccucccucggcu

SEQ ID NO: 3918165 - RNA, 23 nt, Human adenovirus D
acucgcagacgagcggccgccgc

SEQ ID NO: 3918166 - RNA, 16 nt, Human adenovirus D
acucgcggcugcugcu

SEQ ID NO: 3918167 - RNA, 14 nt, Human adenovirus D
acucgcugcugcag

SEQ ID NO: 3918168 - RNA, 13 nt, Human adenovirus D
acucgggcacggc

SEQ ID NO: 3918169 - RNA, 16 nt, Human adenovirus D
acucguaccuggguca

SEQ ID NO: 3918170 - RNA, 21 nt, Human adenovirus D
acucgugcgaggggccaagaa

SEQ ID NO: 3918171 - RNA, 17 nt, Human adenovirus D
acugaaagaacuuggua

SEQ ID NO: 3918172 - RNA, 18 nt, Human adenovirus D
acugacuacccacugacu

SEQ ID NO: 3918173 - RNA, 21 nt, Human adenovirus D
acugcaccccccgcaggcagg

SEQ ID NO: 3918174 - RNA, 13 nt, Human adenovirus D
acugccacugcca

SEQ ID NO: 3918175 - RNA, 21 nt, Human adenovirus D
acugccgcugcaaccugugcu

SEQ ID NO: 3918176 - RNA, 14 nt, Human adenovirus D
acugcgacucgggg

SEQ ID NO: 3918177 - RNA, 15 nt, Human adenovirus D
acugcuaccucuugc

SEQ ID NO: 3918178 - RNA, 15 nt, Human adenovirus D
acugcuggcccugcu

SEQ ID NO: 3918179 - RNA, 13 nt, Human adenovirus D
agcggggccuggu

SEQ ID NO: 3918180 - RNA, 20 nt, Human adenovirus D
agcgguccucggucaggagc

SEQ ID NO: 3918181 - RNA, 19 nt, Human adenovirus D
agcggugguaggccccugu

SEQ ID NO: 3918182 - RNA, 20 nt, Human adenovirus D
agcguagcuaugacgaggug

SEQ ID NO: 3918183 - RNA, 15 nt, Human adenovirus D
agcgucgaggagcug

SEQ ID NO: 3918184 - RNA, 19 nt, Human adenovirus D
agcgugcguucucuuccuu

SEQ ID NO: 3918185 - RNA, 15 nt, Human adenovirus D
agcgugggacuggca

SEQ ID NO: 3918186 - RNA, 20 nt, Human adenovirus D
agcuaagaaaaaaucagagu

SEQ ID NO: 3918187 - RNA, 14 nt, Human adenovirus D
agcuaauggacuac

SEQ ID NO: 3918188 - RNA, 23 nt, Human adenovirus D
agcucagcccgcuuaccaguaga

SEQ ID NO: 3918189 - RNA, 19 nt, Human adenovirus D
agcuccgcgaacagcagca

SEQ ID NO: 3918190 - RNA, 17 nt, Human adenovirus D
agcuccugagcgagacc

SEQ ID NO: 3918191 - RNA, 16 nt, Human adenovirus D
agcucgccgaggaggc

SEQ ID NO: 3918192 - RNA, 22 nt, Human adenovirus D
agcucguaguugagggccucgg

SEQ ID NO: 3918193 - RNA, 20 nt, Human adenovirus D
agcucguguccaacggcaaa

SEQ ID NO: 3918194 - RNA, 13 nt, Human adenovirus D
agcucugcugcgc

SEQ ID NO: 3918195 - RNA, 23 nt, Human adenovirus D
agcugcgagaaggcgcccaggcc

SEQ ID NO: 3918196 - RNA, 15 nt, Human adenovirus D
agcugcgcgagggcc

SEQ ID NO: 3918197 - RNA, 23 nt, Human adenovirus D
agcuggaagcccugagccgccag

SEQ ID NO: 3918198 - RNA, 12 nt, Human adenovirus D
agcuggcuccgu

SEQ ID NO: 3918199 - RNA, 14 nt, Human adenovirus D
agcugggcugggac

SEQ ID NO: 3918200 - RNA, 18 nt, Human adenovirus D
agcuucgaguacgaggcc

SEQ ID NO: 3918201 - RNA, 12 nt, Human adenovirus D
agcuugcccuug

SEQ ID NO: 3918202 - RNA, 14 nt, Human adenovirus D
agcuugugcggccu

SEQ ID NO: 3918203 - RNA, 14 nt, Human adenovirus D
aggaaccagcacac

SEQ ID NO: 3918204 - RNA, 14 nt, Human adenovirus D
aggaaccaugaagg

SEQ ID NO: 3918205 - RNA, 14 nt, Human adenovirus D
aggaagcccagagc

SEQ ID NO: 3918206 - RNA, 22 nt, Human adenovirus D
aggaagcccagagcucgcgggc

SEQ ID NO: 3918207 - RNA, 14 nt, Human adenovirus D
aggacacccggccc

SEQ ID NO: 3918208 - RNA, 16 nt, Human adenovirus D
aggacauggauuaaaa

SEQ ID NO: 3918209 - RNA, 14 nt, Human adenovirus D
aggaccugggcuuc

SEQ ID NO: 3918210 - RNA, 19 nt, Human adenovirus D
aggacgguguagcccgugc

SEQ ID NO: 3918211 - RNA, 21 nt, Human adenovirus D
aggacucgcagacgagcggcc

SEQ ID NO: 3918212 - RNA, 21 nt, Human adenovirus D
aggacuuggaugaggaagagg

SEQ ID NO: 3918213 - RNA, 20 nt, Human adenovirus D
aggagaacugcuggcccugc

SEQ ID NO: 3918214 - RNA, 20 nt, Human adenovirus D
aggagaggaggaugugcugc

SEQ ID NO: 3918215 - RNA, 21 nt, Human adenovirus D
aggagaggcauggcaggcagc

SEQ ID NO: 3918216 - RNA, 13 nt, Human adenovirus D
aggagcaggagga

SEQ ID NO: 3918217 - RNA, 22 nt, Human adenovirus D
aggagccauagagggcguugga

SEQ ID NO: 3918218 - RNA, 20 nt, Human adenovirus D
aggagcugaucucgcugccg

SEQ ID NO: 3918219 - RNA, 15 nt, Human adenovirus D
aggaggaccaggucc

SEQ ID NO: 3918220 - RNA, 21 nt, Human adenovirus D
aggaggacuuaaccacccacg

SEQ ID NO: 3918221 - RNA, 13 nt, Human adenovirus D
aggaggagacuga

SEQ ID NO: 3918222 - RNA, 20 nt, Human adenovirus D
aggaggcccaucuacaggcc

SEQ ID NO: 3918223 - RNA, 14 nt, Human adenovirus D
aggaggggggccac

SEQ ID NO: 3918224 - RNA, 17 nt, Human adenovirus D
aggaucauaucccaggg

SEQ ID NO: 3918225 - RNA, 16 nt, Human adenovirus D
aggaugaacaggagca

SEQ ID NO: 3918226 - RNA, 15 nt, Human adenovirus D
aggcacacagcucaa

SEQ ID NO: 3918227 - RNA, 12 nt, Human adenovirus D
aggcagaggcac

SEQ ID NO: 3918228 - RNA, 18 nt, Human adenovirus D
aggcauauaaaaaugcag

SEQ ID NO: 3918229 - RNA, 20 nt, Human adenovirus D
aggcaucggaacccuccagu

SEQ ID NO: 3918230 - RNA, 16 nt, Human adenovirus D
aggcauucacauacac

SEQ ID NO: 3918231 - RNA, 16 nt, Human adenovirus D
aggcccuggagcagcg

SEQ ID NO: 3918232 - RNA, 22 nt, Human adenovirus D
aggccgccuacgguccagagga

SEQ ID NO: 3918233 - RNA, 23 nt, Human adenovirus D
aggccgcucucguuccagacgcg

SEQ ID NO: 3918234 - RNA, 14 nt, Human adenovirus D
aggccggcaugccc

SEQ ID NO: 3918235 - RNA, 22 nt, Human adenovirus D
aggccggggccgaaauuggugc

SEQ ID NO: 3918236 - RNA, 16 nt, Human adenovirus D
aggccgugagcgcgag

SEQ ID NO: 3918237 - RNA, 14 nt, Human adenovirus D
aggccuggcccuga

SEQ ID NO: 3918238 - RNA, 12 nt, Human adenovirus D
aggcgagcagcu

SEQ ID NO: 3918239 - RNA, 17 nt, Human adenovirus D
aggcgcgcccacccgga

SEQ ID NO: 3918240 - RNA, 18 nt, Human adenovirus D
aggcgcgcguccacgcca

SEQ ID NO: 3918241 - RNA, 19 nt, Human adenovirus D
aggcgggaauuaccucauc

SEQ ID NO: 3918242 - RNA, 18 nt, Human adenovirus D
aggcggugcugcugccga

SEQ ID NO: 3918243 - RNA, 18 nt, Human adenovirus D
aggcuagcacgcagacga

SEQ ID NO: 3918244 - RNA, 14 nt, Human adenovirus D
aggcuggagccgcg

SEQ ID NO: 3918245 - RNA, 16 nt, Human adenovirus D
aggcuggagccgcgac

SEQ ID NO: 3918246 - RNA, 14 nt, Human adenovirus D
agggaaugcgugga

SEQ ID NO: 3918247 - RNA, 17 nt, Human adenovirus D
agggacagcagcccuuc

SEQ ID NO: 3918248 - RNA, 15 nt, Human adenovirus D
agggcgaaggugucc

SEQ ID NO: 3918249 - RNA, 13 nt, Human adenovirus D
agggcgcgguggg

SEQ ID NO: 3918250 - RNA, 19 nt, Human adenovirus D
agggcgcucccaaucccag

SEQ ID NO: 3918251 - RNA, 21 nt, Human adenovirus D
agggcugcacggaugagcgca

SEQ ID NO: 3918252 - RNA, 17 nt, Human adenovirus D
agggcuuuuccugaugc

SEQ ID NO: 3918253 - RNA, 14 nt, Human adenovirus D
aggggaugaacagu

SEQ ID NO: 3918254 - RNA, 12 nt, Human adenovirus D
aggggccaagaa

SEQ ID NO: 3918255 - RNA, 14 nt, Human adenovirus D
aggggcggacccca

SEQ ID NO: 3918256 - RNA, 20 nt, Human adenovirus D
aggggcugcuagagugccac

SEQ ID NO: 3918257 - RNA, 16 nt, Human adenovirus D
aggggucuaucuggac

SEQ ID NO: 3918258 - RNA, 18 nt, Human adenovirus D
agggguugaggggcggac

SEQ ID NO: 3918259 - RNA, 14 nt, Human adenovirus D
aggguaaagccagc

SEQ ID NO: 3918260 - RNA, 18 nt, Human adenovirus D
aggguccgcgugagggug

SEQ ID NO: 3918261 - RNA, 22 nt, Human adenovirus D
agggucgcuggcugcuggagcu

SEQ ID NO: 3918262 - RNA, 14 nt, Human adenovirus D
aggguguccuggaa

SEQ ID NO: 3918263 - RNA, 18 nt, Human adenovirus D
agguauuuguugagggag

SEQ ID NO: 3918264 - RNA, 19 nt, Human adenovirus D
aggucagcagcaagagcuc

SEQ ID NO: 3918265 - RNA, 18 nt, Human adenovirus D
aggugcgccccaucaagc

SEQ ID NO: 3918266 - RNA, 20 nt, Human adenovirus D
aggugcgccccaucaagcag

SEQ ID NO: 3918267 - RNA, 22 nt, Human adenovirus D
aggugcugacauccauggccag

SEQ ID NO: 3918268 - RNA, 21 nt, Human adenovirus D
aggugcugccccaggcggugc

SEQ ID NO: 3918269 - RNA, 16 nt, Human adenovirus D
agguggcccugggccu

SEQ ID NO: 3918270 - RNA, 19 nt, Human adenovirus D
aggugguggacggccuggc

SEQ ID NO: 3918271 - RNA, 21 nt, Human adenovirus D
agguguuggcaaagcgguuga

SEQ ID NO: 3918272 - RNA, 22 nt, Human adenovirus D
agguuucucaacagcugggacu

SEQ ID NO: 3918273 - RNA, 17 nt, Human adenovirus D
agguuugaguagugggc

SEQ ID NO: 3918274 - RNA, 19 nt, Human adenovirus D
agguuugaguagugggcgu

SEQ ID NO: 3918275 - RNA, 13 nt, Human adenovirus D
aguaccugagccc

SEQ ID NO: 3918276 - RNA, 19 nt, Human adenovirus D
aguacgacaugcccgaccc

SEQ ID NO: 3918277 - RNA, 18 nt, Human adenovirus D
aguacuuggaaagcaaga

SEQ ID NO: 3918278 - RNA, 16 nt, Human adenovirus D
aguagaguuugugcgc

SEQ ID NO: 3918279 - RNA, 16 nt, Human adenovirus D
aguaggaaccagcaca

SEQ ID NO: 3918280 - RNA, 18 nt, Human adenovirus D
aguauggugaucagccau

SEQ ID NO: 3918281 - RNA, 22 nt, Human adenovirus D
agucaaaagaaaacuaaugaca

SEQ ID NO: 3918282 - RNA, 21 nt, Human adenovirus D
agucacuaggaccccagggac

SEQ ID NO: 3918283 - RNA, 20 nt, Human adenovirus D
agucacuuaaguccugggcc

SEQ ID NO: 3918284 - RNA, 11 nt, Human adenovirus D
agucaggagca

SEQ ID NO: 3918285 - RNA, 23 nt, Human adenovirus D
aguccccucgaaucaggcuggag

SEQ ID NO: 3918286 - RNA, 15 nt, Human adenovirus D
agucccuuuuccagg

SEQ ID NO: 3918287 - RNA, 20 nt, Human adenovirus D
aguccuguaaauaagucacu

SEQ ID NO: 3918288 - RNA, 18 nt, Human adenovirus D
agucugaagcgccgccga

SEQ ID NO: 3918289 - RNA, 14 nt, Human adenovirus D
agugacaauuuaac

SEQ ID NO: 3918290 - RNA, 14 nt, Human adenovirus D
agugaccgucacug

SEQ ID NO: 3918291 - RNA, 16 nt, Human adenovirus D
agugauuggggaaccu

SEQ ID NO: 3918292 - RNA, 18 nt, Human adenovirus D
agugcaacuuuagccaga

SEQ ID NO: 3918293 - RNA, 19 nt, Human adenovirus D
agugcaguuggccaugagc

SEQ ID NO: 3918294 - RNA, 14 nt, Human adenovirus D
agugccacaugcac

SEQ ID NO: 3918295 - RNA, 13 nt, Human adenovirus D
aguggaagaagag

SEQ ID NO: 3918296 - RNA, 17 nt, Human adenovirus D
aguggaagaagagcagc

SEQ ID NO: 3918297 - RNA, 18 nt, Human adenovirus D
aguuacgggagcgagccc

SEQ ID NO: 3918298 - RNA, 20 nt, Human adenovirus D
acugggcguugcgggccgag

SEQ ID NO: 3918299 - RNA, 21 nt, Human adenovirus D
acuggucaaaaacaaagugac

SEQ ID NO: 3918300 - RNA, 13 nt, Human adenovirus D
acuguaaagccac

SEQ ID NO: 3918301 - RNA, 17 nt, Human adenovirus D
acuguugcagagagaug

SEQ ID NO: 3918302 - RNA, 14 nt, Human adenovirus D
acuuacuuugcaag

SEQ ID NO: 3918303 - RNA, 16 nt, Human adenovirus D
acuuccccccuggggu

SEQ ID NO: 3918304 - RNA, 18 nt, Human adenovirus D
acuuggaugaggaagagg

SEQ ID NO: 3918305 - RNA, 15 nt, Human adenovirus D
acuuuaaugcuccaa

SEQ ID NO: 3918306 - RNA, 18 nt, Human adenovirus D
acuuugucugcuguaaag

SEQ ID NO: 3918307 - RNA, 13 nt, Human adenovirus D
acuuuucuguugc

SEQ ID NO: 3918308 - RNA, 15 nt, Human adenovirus D
agaaagcaguucacu

SEQ ID NO: 3918309 - RNA, 24 nt, Human adenovirus D
agaaaugggcccuugaacagcaua

SEQ ID NO: 3918310 - RNA, 19 nt, Human adenovirus D
agaaccaugaauacaguga

SEQ ID NO: 3918311 - RNA, 14 nt, Human adenovirus D
agaaccgccugggg

SEQ ID NO: 3918312 - RNA, 17 nt, Human adenovirus D
agaacgagggccugggc

SEQ ID NO: 3918313 - RNA, 20 nt, Human adenovirus D
agaacugcuggcccugcugg

SEQ ID NO: 3918314 - RNA, 22 nt, Human adenovirus D
agaacuuguuauugagcccauc

SEQ ID NO: 3918315 - RNA, 21 nt, Human adenovirus D
agaagcaaccuuuccaagagg

SEQ ID NO: 3918316 - RNA, 13 nt, Human adenovirus D
agaaggccggggc

SEQ ID NO: 3918317 - RNA, 16 nt, Human adenovirus D
agaaggcgcccaggcc

SEQ ID NO: 3918318 - RNA, 18 nt, Human adenovirus D
agaagugacaauuuaacu

SEQ ID NO: 3918319 - RNA, 15 nt, Human adenovirus D
agaauauaaagcaga

SEQ ID NO: 3918320 - RNA, 19 nt, Human adenovirus D
agaaucuugccugcucgcg

SEQ ID NO: 3918321 - RNA, 16 nt, Human adenovirus D
agacaaaggaggccac

SEQ ID NO: 3918322 - RNA, 18 nt, Human adenovirus D
agacaaaggaggccacgu

SEQ ID NO: 3918323 - RNA, 14 nt, Human adenovirus D
agacagccagguca

SEQ ID NO: 3918324 - RNA, 16 nt, Human adenovirus D
agacauggccagcacg

SEQ ID NO: 3918325 - RNA, 20 nt, Human adenovirus D
agaccagaacuuccagcaga

SEQ ID NO: 3918326 - RNA, 19 nt, Human adenovirus D
agaccaugugagccugggu

SEQ ID NO: 3918327 - RNA, 16 nt, Human adenovirus D
agaccgugcaggggcc

SEQ ID NO: 3918328 - RNA, 13 nt, Human adenovirus D
agaccuucaaccu

SEQ ID NO: 3918329 - RNA, 15 nt, Human adenovirus D
agaccuuccaggaga

SEQ ID NO: 3918330 - RNA, 19 nt, Human adenovirus D
agacgaugggcguccagcg

SEQ ID NO: 3918331 - RNA, 19 nt, Human adenovirus D
agacgcugaaaggcgggcu

SEQ ID NO: 3918332 - RNA, 23 nt, Human adenovirus D
agacggacuugauuggccugucc

SEQ ID NO: 3918333 - RNA, 18 nt, Human adenovirus D
agacggugaagcaggagc

SEQ ID NO: 3918334 - RNA, 19 nt, Human adenovirus D
agacggugaagcaggagcg

SEQ ID NO: 3918335 - RNA, 15 nt, Human adenovirus D
agacguuucuggggu

SEQ ID NO: 3918336 - RNA, 20 nt, Human adenovirus D
agacucauccugcuggugcu

SEQ ID NO: 3918337 - RNA, 23 nt, Human adenovirus D
agacugauggccacggggagccc

SEQ ID NO: 3918338 - RNA, 20 nt, Human adenovirus D
agagagguugaaaaggcagc

SEQ ID NO: 3918339 - RNA, 15 nt, Human adenovirus D
agagagucuggugga

SEQ ID NO: 3918340 - RNA, 13 nt, Human adenovirus D
agagcgagauguc

SEQ ID NO: 3918341 - RNA, 18 nt, Human adenovirus D
agagcgugauggcgcagg

SEQ ID NO: 3918342 - RNA, 16 nt, Human adenovirus D
agaggaaggaggacac

SEQ ID NO: 3918343 - RNA, 16 nt, Human adenovirus D
agaggcgagcagcugu

SEQ ID NO: 3918344 - RNA, 21 nt, Human adenovirus D
agagguugaaaaggcagcuga

SEQ ID NO: 3918345 - RNA, 16 nt, Human adenovirus D
agagugaggcacugcu

SEQ ID NO: 3918346 - RNA, 12 nt, Human adenovirus D
agauacuucagc

SEQ ID NO: 3918347 - RNA, 14 nt, Human adenovirus D
agaucaucauaaga

SEQ ID NO: 3918348 - RNA, 17 nt, Human adenovirus D
agaucauggugcccaag

SEQ ID NO: 3918349 - RNA, 22 nt, Human adenovirus D
agauccugagauacgaugagac

SEQ ID NO: 3918350 - RNA, 15 nt, Human adenovirus D
agaugaugugcaguu

SEQ ID NO: 3918351 - RNA, 11 nt, Human adenovirus D
agaugcagcaa

SEQ ID NO: 3918352 - RNA, 21 nt, Human adenovirus D
agaugcagcaagccccggacc

SEQ ID NO: 3918353 - RNA, 19 nt, Human adenovirus D
agaugccccagcagaagca

SEQ ID NO: 3918354 - RNA, 19 nt, Human adenovirus D
agaugcgacccaugagcug

SEQ ID NO: 3918355 - RNA, 15 nt, Human adenovirus D
agauggaagaagaau

SEQ ID NO: 3918356 - RNA, 14 nt, Human adenovirus D
agauggugggccgu

SEQ ID NO: 3918357 - RNA, 21 nt, Human adenovirus D
agauguaaccuugcaagaggc

SEQ ID NO: 3918358 - RNA, 19 nt, Human adenovirus D
agauuuaauuggcaaacuu

SEQ ID NO: 3918359 - RNA, 16 nt, Human adenovirus D
agcaagacgcaggcca

SEQ ID NO: 3918360 - RNA, 22 nt, Human adenovirus D
agcaaggugcugacauccaugg

SEQ ID NO: 3918361 - RNA, 21 nt, Human adenovirus D
agcacaaacgugcaguccaac

SEQ ID NO: 3918362 - RNA, 12 nt, Human adenovirus D
agcacagcaccg

SEQ ID NO: 3918363 - RNA, 20 nt, Human adenovirus D
agcaccccaacggcccugca

SEQ ID NO: 3918364 - RNA, 20 nt, Human adenovirus D
agcacgagcaagacgcaggc

SEQ ID NO: 3918365 - RNA, 18 nt, Human adenovirus D
agcacugcaaauuuaacu

SEQ ID NO: 3918366 - RNA, 20 nt, Human adenovirus D
agcacuggauugcaauuuug

SEQ ID NO: 3918367 - RNA, 22 nt, Human adenovirus D
agcacuuuuauuuuacaugcac

SEQ ID NO: 3918368 - RNA, 17 nt, Human adenovirus D
agcagaagaagacgaau

SEQ ID NO: 3918369 - RNA, 18 nt, Human adenovirus D
agcagagucugccgcccu

SEQ ID NO: 3918370 - RNA, 11 nt, Human adenovirus D
agcagcacagu

SEQ ID NO: 3918371 - RNA, 19 nt, Human adenovirus D
caggggaugaacaguggca

SEQ ID NO: 3918372 - RNA, 21 nt, Human adenovirus D
caggggcucguuaguccagca

SEQ ID NO: 3918373 - RNA, 17 nt, Human adenovirus D
caggguaaagccagcag

SEQ ID NO: 3918374 - RNA, 19 nt, Human adenovirus D
caggguaaagccagcagca

SEQ ID NO: 3918375 - RNA, 23 nt, Human adenovirus D
caggguagcggggcacaggcaca

SEQ ID NO: 3918376 - RNA, 15 nt, Human adenovirus D
cagggugcuccagcc

SEQ ID NO: 3918377 - RNA, 16 nt, Human adenovirus D
cagggugcuccagcca

SEQ ID NO: 3918378 - RNA, 18 nt, Human adenovirus D
caggguugagucgcggca

SEQ ID NO: 3918379 - RNA, 14 nt, Human adenovirus D
caggucaaaaccca

SEQ ID NO: 3918380 - RNA, 23 nt, Human adenovirus D
cagguccacgcugguggccaccu

SEQ ID NO: 3918381 - RNA, 20 nt, Human adenovirus D
caggugagcucgggcugcuc

SEQ ID NO: 3918382 - RNA, 18 nt, Human adenovirus D
caggugaugccggcagcg

SEQ ID NO: 3918383 - RNA, 18 nt, Human adenovirus D
caggugcugcccacccuc

SEQ ID NO: 3918384 - RNA, 18 nt, Human adenovirus D
caguagacaaagagcaca

SEQ ID NO: 3918385 - RNA, 17 nt, Human adenovirus D
cagucagugaagcccug

SEQ ID NO: 3918386 - RNA, 20 nt, Human adenovirus D
cagugcaacuuuagccagac

SEQ ID NO: 3918387 - RNA, 12 nt, Human adenovirus D
cagugcacgggc

SEQ ID NO: 3918388 - RNA, 12 nt, Human adenovirus D
caguggcccugg

SEQ ID NO: 3918389 - RNA, 18 nt, Human adenovirus D
caguggggaggacacaga

SEQ ID NO: 3918390 - RNA, 21 nt, Human adenovirus D
caguuaagaauccacagauca

SEQ ID NO: 3918391 - RNA, 12 nt, Human adenovirus D
caguuaguuggu

SEQ ID NO: 3918392 - RNA, 14 nt, Human adenovirus D
caguuugggcacug

SEQ ID NO: 3918393 - RNA, 16 nt, Human adenovirus D
cauaauagaaacagau

SEQ ID NO: 3918394 - RNA, 20 nt, Human adenovirus D
cauaaucaccauguuauuca

SEQ ID NO: 3918395 - RNA, 11 nt, Human adenovirus D
cauacaaucau

SEQ ID NO: 3918396 - RNA, 14 nt, Human adenovirus D
cgaaccaggcagug

SEQ ID NO: 3918397 - RNA, 15 nt, Human adenovirus D
cgaacuuucuccaca

SEQ ID NO: 3918398 - RNA, 16 nt, Human adenovirus D
cgaagauggggccccg

SEQ ID NO: 3918399 - RNA, 17 nt, Human adenovirus D
cgaaugggaagaagaga

SEQ ID NO: 3918400 - RNA, 16 nt, Human adenovirus D
cgacaccaacgaccag

SEQ ID NO: 3918401 - RNA, 16 nt, Human adenovirus D
cgacacugcagggagc

SEQ ID NO: 3918402 - RNA, 14 nt, Human adenovirus D
cgacagcagcacag

SEQ ID NO: 3918403 - RNA, 24 nt, Human adenovirus D
cgaccaguugacggucugcaggcc

SEQ ID NO: 3918404 - RNA, 17 nt, Human adenovirus D
cgacccaugagcugcga

SEQ ID NO: 3918405 - RNA, 12 nt, Human adenovirus D
cgacccccaggc

SEQ ID NO: 3918406 - RNA, 16 nt, Human adenovirus D
cgacccccaggcccug

SEQ ID NO: 3918407 - RNA, 14 nt, Human adenovirus D
cgaccccuggcucc

SEQ ID NO: 3918408 - RNA, 18 nt, Human adenovirus D
cgacgaacucggcgguga

SEQ ID NO: 3918409 - RNA, 21 nt, Human adenovirus D
cgacgacauccuggaccaggc

SEQ ID NO: 3918410 - RNA, 21 nt, Human adenovirus D
cgacgaguuggugagcucuuc

SEQ ID NO: 3918411 - RNA, 22 nt, Human adenovirus D
cgacgaguuggugagcucuuca

SEQ ID NO: 3918412 - RNA, 20 nt, Human adenovirus D
cgacugucuagggccuuucc

SEQ ID NO: 3918413 - RNA, 19 nt, Human adenovirus D
cgacuucaugagccagagc

SEQ ID NO: 3918414 - RNA, 16 nt, Human adenovirus D
cgagaaccgccugggg

SEQ ID NO: 3918415 - RNA, 17 nt, Human adenovirus D
cgagaaccgccuggggc

SEQ ID NO: 3918416 - RNA, 18 nt, Human adenovirus D
cgagaggcgagcagcugu

SEQ ID NO: 3918417 - RNA, 14 nt, Human adenovirus D
cgagcacagcaccg

SEQ ID NO: 3918418 - RNA, 16 nt, Human adenovirus D
cgagcaggaccugggc

SEQ ID NO: 3918419 - RNA, 24 nt, Human adenovirus D
cgagcccgagggucgcuggcugcu

SEQ ID NO: 3918420 - RNA, 22 nt, Human adenovirus D
cgagccggcggcgcgagcugag

SEQ ID NO: 3918421 - RNA, 16 nt, Human adenovirus D
cgagcgcaccgucgcc

SEQ ID NO: 3918422 - RNA, 14 nt, Human adenovirus D
cgagcucugcugcg

SEQ ID NO: 3918423 - RNA, 16 nt, Human adenovirus D
cgaggacuaccacgcc

SEQ ID NO: 3918424 - RNA, 16 nt, Human adenovirus D
cgaggagcugagacca

SEQ ID NO: 3918425 - RNA, 18 nt, Human adenovirus D
cgaggaggauuugauguu

SEQ ID NO: 3918426 - RNA, 20 nt, Human adenovirus D
cgaggaggccgugaaggccg

SEQ ID NO: 3918427 - RNA, 19 nt, Human adenovirus D
cgaggucagcagcaagagc

SEQ ID NO: 3918428 - RNA, 16 nt, Human adenovirus D
cgagucgucgcagccg

SEQ ID NO: 3918429 - RNA, 17 nt, Human adenovirus D
cgaguuggaggagaugg

SEQ ID NO: 3918430 - RNA, 21 nt, Human adenovirus D
cgauaaagugcaagucacgca

SEQ ID NO: 3918431 - RNA, 12 nt, Human adenovirus D
cgauccagcaga

SEQ ID NO: 3918432 - RNA, 17 nt, Human adenovirus D
cgauccugacgcgccag

SEQ ID NO: 3918433 - RNA, 19 nt, Human adenovirus D
cgaugaaagucaggagcag

SEQ ID NO: 3918434 - RNA, 14 nt, Human adenovirus D
cgaugggcccgugg

SEQ ID NO: 3918435 - RNA, 12 nt, Human adenovirus D
cgauguagaguu

SEQ ID NO: 3918436 - RNA, 15 nt, Human adenovirus D
cgaugugcucgguga

SEQ ID NO: 3918437 - RNA, 20 nt, Human adenovirus D
cgcaaaaccuguucagggac

SEQ ID NO: 3918438 - RNA, 13 nt, Human adenovirus D
cgcaagcucaugc

SEQ ID NO: 3918439 - RNA, 20 nt, Human adenovirus D
cgcaaggucgaggagaccug

SEQ ID NO: 3918440 - RNA, 20 nt, Human adenovirus D
cgcacgguaagagcccagca

SEQ ID NO: 3918441 - RNA, 13 nt, Human adenovirus D
cgcagaaaucagu

SEQ ID NO: 3918442 - RNA, 17 nt, Human adenovirus D
cgcagaaaucaguuucc

SEQ ID NO: 3918443 - RNA, 16 nt, Human adenovirus D
cgcagacgagcggccg

SEQ ID NO: 3918444 - RNA, 21 nt, Human adenovirus D
cgcagcgugaagacgccgccg

SEQ ID NO: 3918445 - RNA, 20 nt, Human adenovirus D
cgcagcuacaccucccucac

SEQ ID NO: 3918446 - RNA, 20 nt, Human adenovirus D
cgcagcucuucccgcugaac

SEQ ID NO: 3918447 - RNA, 16 nt, Human adenovirus D
cgcaggaguccaccgc

SEQ ID NO: 3918448 - RNA, 22 nt, Human adenovirus D
cgcaggaguccaccgcuccgcu

SEQ ID NO: 3918449 - RNA, 19 nt, Human adenovirus D
cgcaguugggagcugucca

SEQ ID NO: 3918450 - RNA, 17 nt, Human adenovirus D
cgcauccugcaacugcg

SEQ ID NO: 3918451 - RNA, 13 nt, Human adenovirus D
cgcaugaccaccu

SEQ ID NO: 3918452 - RNA, 23 nt, Human adenovirus D
cgccaaaaaaacacacacgcccu

SEQ ID NO: 3918453 - RNA, 13 nt, Human adenovirus D
cgccaacagcagc

SEQ ID NO: 3918454 - RNA, 23 nt, Human adenovirus D
cgccaagacaaaggaggccacgu

SEQ ID NO: 3918455 - RNA, 13 nt, Human adenovirus D
cgccacaggugcu

SEQ ID NO: 3918456 - RNA, 23 nt, Human adenovirus D
cgccacaggugcugcccacccuc

SEQ ID NO: 3918457 - RNA, 13 nt, Human adenovirus D
cgccacuggccac

SEQ ID NO: 3918458 - RNA, 19 nt, Human adenovirus D
cgccagacgcacgggccgc

SEQ ID NO: 3918459 - RNA, 16 nt, Human adenovirus D
cgccauggggcgccgc

SEQ ID NO: 3918460 - RNA, 21 nt, Human adenovirus D
cgcccaacucgcggcugcugc

SEQ ID NO: 3918461 - RNA, 13 nt, Human adenovirus D
cgcccagccagca

SEQ ID NO: 3918462 - RNA, 14 nt, Human adenovirus D
cgcccggcgagcgg

SEQ ID NO: 3918463 - RNA, 16 nt, Human adenovirus D
cgcccggcguacgugc

SEQ ID NO: 3918464 - RNA, 16 nt, Human adenovirus D
cgcccugagagcgcug

SEQ ID NO: 3918465 - RNA, 16 nt, Human adenovirus D
cgcccugcuggagcgc

SEQ ID NO: 3918466 - RNA, 12 nt, Human adenovirus D
cgcccugggugu

SEQ ID NO: 3918467 - RNA, 15 nt, Human adenovirus D
cgccgacccguggcc

SEQ ID NO: 3918468 - RNA, 13 nt, Human adenovirus D
cgccgagccugaa

SEQ ID NO: 3918469 - RNA, 17 nt, Human adenovirus D
cgccgauggccuccagc

SEQ ID NO: 3918470 - RNA, 23 nt, Human adenovirus D
cgccgauuuaaagacccacagcc

SEQ ID NO: 3918471 - RNA, 17 nt, Human adenovirus D
cgccgccgugcgcacca

SEQ ID NO: 3918472 - RNA, 16 nt, Human adenovirus D
cgccgcgccagacgca

SEQ ID NO: 3918473 - RNA, 22 nt, Human adenovirus D
cgccgcguaaccaacgcgccgg

SEQ ID NO: 3918474 - RNA, 13 nt, Human adenovirus D
cgccgcuaucugc

SEQ ID NO: 3918475 - RNA, 15 nt, Human adenovirus D
cgccggcucaucugc

SEQ ID NO: 3918476 - RNA, 15 nt, Human adenovirus D
cgccgggccugggcg

SEQ ID NO: 3918477 - RNA, 20 nt, Human adenovirus D
cgccgggccugggcgugcag

SEQ ID NO: 3918478 - RNA, 14 nt, Human adenovirus D
cgccuuccuggcga

SEQ ID NO: 3918479 - RNA, 16 nt, Human adenovirus D
cgccuuggaggccgcc

SEQ ID NO: 3918480 - RNA, 13 nt, Human adenovirus D
cgcgaacagcagc

SEQ ID NO: 3918481 - RNA, 17 nt, Human adenovirus D
cgcgaagauggccaccc

SEQ ID NO: 3918482 - RNA, 18 nt, Human adenovirus D
cgcgacccccaggcccug

SEQ ID NO: 3918483 - RNA, 20 nt, Human adenovirus D
cgcgaccgcggccguagcag

SEQ ID NO: 3918484 - RNA, 14 nt, Human adenovirus D
cgcgagcugaugcu

SEQ ID NO: 3918485 - RNA, 19 nt, Human adenovirus D
cgcgagcugaugcugagcc

SEQ ID NO: 3918486 - RNA, 19 nt, Human adenovirus D
cgcgaggccauaggccagg

SEQ ID NO: 3918487 - RNA, 13 nt, Human adenovirus D
cgcgagggccugg

SEQ ID NO: 3918488 - RNA, 15 nt, Human adenovirus D
cgcgccacuggccac

SEQ ID NO: 3918489 - RNA, 16 nt, Human adenovirus D
cgcgcccgcagcacgc

SEQ ID NO: 3918490 - RNA, 14 nt, Human adenovirus D
cgcgcccggggcca

SEQ ID NO: 3918491 - RNA, 17 nt, Human adenovirus D
cgcgcgaagauggccac

SEQ ID NO: 3918492 - RNA, 13 nt, Human adenovirus D
cgcgcgcuggggc

SEQ ID NO: 3918493 - RNA, 17 nt, Human adenovirus D
cgcgcucgcgcaccugc

SEQ ID NO: 3918494 - RNA, 20 nt, Human adenovirus D
cgcgcuggacaugaccgcgc

SEQ ID NO: 3918495 - RNA, 21 nt, Human adenovirus D
cgcgcugucggccgaggagga

SEQ ID NO: 3918496 - RNA, 16 nt, Human adenovirus D
cgcggacgcgcucccg

SEQ ID NO: 3918497 - RNA, 13 nt, Human adenovirus D
cgcggacggccgc

SEQ ID NO: 3918498 - RNA, 14 nt, Human adenovirus D
cgcggcgaacgagc

SEQ ID NO: 3918499 - RNA, 13 nt, Human adenovirus D
cgcggcgacagcg

SEQ ID NO: 3918500 - RNA, 16 nt, Human adenovirus D
cgcgguauauggcucc

SEQ ID NO: 3918501 - RNA, 14 nt, Human adenovirus D
cgcguacauccagc

SEQ ID NO: 3918502 - RNA, 13 nt, Human adenovirus D
cgcguccgcggcc

SEQ ID NO: 3918503 - RNA, 16 nt, Human adenovirus D
cgcguccgucagcagc

SEQ ID NO: 3918504 - RNA, 19 nt, Human adenovirus D
cgcgucgcuguccacgagc

SEQ ID NO: 3918505 - RNA, 21 nt, Human adenovirus D
cucuccgcaccgcuccugguc

SEQ ID NO: 3918506 - RNA, 14 nt, Human adenovirus D
cucugaaaagucau

SEQ ID NO: 3918507 - RNA, 12 nt, Human adenovirus D
cucugacacacc

SEQ ID NO: 3918508 - RNA, 15 nt, Human adenovirus D
cucugcaucugauga

SEQ ID NO: 3918509 - RNA, 19 nt, Human adenovirus D
cucugccacacauggcaag

SEQ ID NO: 3918510 - RNA, 15 nt, Human adenovirus D
cucugcugcgccgcg

SEQ ID NO: 3918511 - RNA, 22 nt, Human adenovirus D
cucuguaggccauccccaucca

SEQ ID NO: 3918512 - RNA, 13 nt, Human adenovirus D
cucuugcagcugg

SEQ ID NO: 3918513 - RNA, 13 nt, Human adenovirus D
cucuuugcccugc

SEQ ID NO: 3918514 - RNA, 16 nt, Human adenovirus D
cugaaaauuugcaaaa

SEQ ID NO: 3918515 - RNA, 12 nt, Human adenovirus D
cugaaagcaugg

SEQ ID NO: 3918516 - RNA, 16 nt, Human adenovirus D
cugaaccgcuggaaga

SEQ ID NO: 3918517 - RNA, 19 nt, Human adenovirus D
cugaacgacucgcugcugc

SEQ ID NO: 3918518 - RNA, 19 nt, Human adenovirus D
cugaacgggggcgccuuca

SEQ ID NO: 3918519 - RNA, 21 nt, Human adenovirus D
cugaagauguaaccuugcaag

SEQ ID NO: 3918520 - RNA, 17 nt, Human adenovirus D
cugaaggaaaaaucacu

SEQ ID NO: 3918521 - RNA, 16 nt, Human adenovirus D
cugaaggagcuggaca

SEQ ID NO: 3918522 - RNA, 16 nt, Human adenovirus D
cugacaauucagagcc

SEQ ID NO: 3918523 - RNA, 22 nt, Human adenovirus D
cugacaauucagagccagggcu

SEQ ID NO: 3918524 - RNA, 15 nt, Human adenovirus D
cugacauccauggcc

SEQ ID NO: 3918525 - RNA, 17 nt, Human adenovirus D
cugaccuugcagagcag

SEQ ID NO: 3918526 - RNA, 15 nt, Human adenovirus D
cugacgcugagcgac

SEQ ID NO: 3918527 - RNA, 18 nt, Human adenovirus D
cugacgggggugcccaac

SEQ ID NO: 3918528 - RNA, 15 nt, Human adenovirus D
cugacuacccacuga

SEQ ID NO: 3918529 - RNA, 20 nt, Human adenovirus D
cugacugccgccggccauug

SEQ ID NO: 3918530 - RNA, 18 nt, Human adenovirus D
cugagauaugugcagcag

SEQ ID NO: 3918531 - RNA, 15 nt, Human adenovirus D
cugagccgccagcug

SEQ ID NO: 3918532 - RNA, 14 nt, Human adenovirus D
cugagccugcgccg

SEQ ID NO: 3918533 - RNA, 13 nt, Human adenovirus D
cugaggcagacgc

SEQ ID NO: 3918534 - RNA, 17 nt, Human adenovirus D
cugaguuuaauaaaagc

SEQ ID NO: 3918535 - RNA, 21 nt, Human adenovirus D
cugauauugcuucccuggaag

SEQ ID NO: 3918536 - RNA, 17 nt, Human adenovirus D
cugaugaacaacgccau

SEQ ID NO: 3918537 - RNA, 22 nt, Human adenovirus D
cugaugaaucgcaagcgcccag

SEQ ID NO: 3918538 - RNA, 15 nt, Human adenovirus D
cugauggccacgggg

SEQ ID NO: 3918539 - RNA, 12 nt, Human adenovirus D
cugauguugauu

SEQ ID NO: 3918540 - RNA, 23 nt, Human adenovirus D
cugcaacccccagcuccugagcg

SEQ ID NO: 3918541 - RNA, 14 nt, Human adenovirus D
cugcaaccugugcu

SEQ ID NO: 3918542 - RNA, 21 nt, Human adenovirus D
cugcaacgccuuccccuccga

SEQ ID NO: 3918543 - RNA, 23 nt, Human adenovirus D
cugcacgagaaccgccuggggca

SEQ ID NO: 3918544 - RNA, 23 nt, Human adenovirus D
cugcagaccgggggacaaauaca

SEQ ID NO: 3918545 - RNA, 20 nt, Human adenovirus D
cugcagcauugucugccugg

SEQ ID NO: 3918546 - RNA, 20 nt, Human adenovirus D
cacuccccccuuugucuccu

SEQ ID NO: 3918547 - RNA, 16 nt, Human adenovirus D
cacucgacgagccagg

SEQ ID NO: 3918548 - RNA, 17 nt, Human adenovirus D
cacucgcgggcggccau

SEQ ID NO: 3918549 - RNA, 20 nt, Human adenovirus D
cacugaaaaugucaaccuug

SEQ ID NO: 3918550 - RNA, 17 nt, Human adenovirus D
cacugaaaauuugcaaa

SEQ ID NO: 3918551 - RNA, 18 nt, Human adenovirus D
cacugaaaauuugcaaaa

SEQ ID NO: 3918552 - RNA, 19 nt, Human adenovirus D
cacugcagggagccagggg

SEQ ID NO: 3918553 - RNA, 15 nt, Human adenovirus D
cacuggagcacagac

SEQ ID NO: 3918554 - RNA, 16 nt, Human adenovirus D
cacuggagcacagacc

SEQ ID NO: 3918555 - RNA, 19 nt, Human adenovirus D
cacuggcccgaccgaccca

SEQ ID NO: 3918556 - RNA, 22 nt, Human adenovirus D
cacuggcuuccgccgccggggu

SEQ ID NO: 3918557 - RNA, 15 nt, Human adenovirus D
cacuggguggcccuu

SEQ ID NO: 3918558 - RNA, 16 nt, Human adenovirus D
cagaaccaugaauaca

SEQ ID NO: 3918559 - RNA, 15 nt, Human adenovirus D
cagaacuggcagagc

SEQ ID NO: 3918560 - RNA, 16 nt, Human adenovirus D
cagaaggacgugcgcc

SEQ ID NO: 3918561 - RNA, 20 nt, Human adenovirus D
cagaaggacgugcgcccggc

SEQ ID NO: 3918562 - RNA, 21 nt, Human adenovirus D
cagaaggugguggacggccug

SEQ ID NO: 3918563 - RNA, 23 nt, Human adenovirus D
cagaaguaaauuugacacagcag

SEQ ID NO: 3918564 - RNA, 19 nt, Human adenovirus D
cagaaguucaccugcaugg

SEQ ID NO: 3918565 - RNA, 20 nt, Human adenovirus D
cagaaguucaccugcauggu

SEQ ID NO: 3918566 - RNA, 23 nt, Human adenovirus D
cagacaaacauccauguuggagg

SEQ ID NO: 3918567 - RNA, 14 nt, Human adenovirus D
cagacaugcugcua

SEQ ID NO: 3918568 - RNA, 15 nt, Human adenovirus D
cagaccaagcugcug

SEQ ID NO: 3918569 - RNA, 13 nt, Human adenovirus D
cagaccgugcagg

SEQ ID NO: 3918570 - RNA, 15 nt, Human adenovirus D
cagacgaagaauaua

SEQ ID NO: 3918571 - RNA, 21 nt, Human adenovirus D
cagacgcacgggccgccgggc

SEQ ID NO: 3918572 - RNA, 14 nt, Human adenovirus D
cagacggugaagca

SEQ ID NO: 3918573 - RNA, 15 nt, Human adenovirus D
cagacggugaagcag

SEQ ID NO: 3918574 - RNA, 14 nt, Human adenovirus D
cagacucugcucau

SEQ ID NO: 3918575 - RNA, 12 nt, Human adenovirus D
cagacuggucaa

SEQ ID NO: 3918576 - RNA, 15 nt, Human adenovirus D
cagacuggucaaaaa

SEQ ID NO: 3918577 - RNA, 19 nt, Human adenovirus D
cagagagauggcucucacu

SEQ ID NO: 3918578 - RNA, 19 nt, Human adenovirus D
cagagagccgccugagcaa

SEQ ID NO: 3918579 - RNA, 21 nt, Human adenovirus D
cagagauggacuuggaagagg

SEQ ID NO: 3918580 - RNA, 13 nt, Human adenovirus D
cugcaggccgggc

SEQ ID NO: 3918581 - RNA, 16 nt, Human adenovirus D
cugcaggccgggcugc

SEQ ID NO: 3918582 - RNA, 12 nt, Human adenovirus D
cugcagggcgcc

SEQ ID NO: 3918583 - RNA, 20 nt, Human adenovirus D
cugcagguggacgagccgcc

SEQ ID NO: 3918584 - RNA, 16 nt, Human adenovirus D
cugccacacauggcaa

SEQ ID NO: 3918585 - RNA, 13 nt, Human adenovirus D
cugccacucgcgg

SEQ ID NO: 3918586 - RNA, 12 nt, Human adenovirus D
cugccagcagaa

SEQ ID NO: 3918587 - RNA, 13 nt, Human adenovirus D
cugccccaggcgg

SEQ ID NO: 3918588 - RNA, 18 nt, Human adenovirus D
cugccccaggcggugcug

SEQ ID NO: 3918589 - RNA, 22 nt, Human adenovirus D
cugccccaggcggugcugcugc

SEQ ID NO: 3918590 - RNA, 19 nt, Human adenovirus D
cugcccuccgcccugagcu

SEQ ID NO: 3918591 - RNA, 13 nt, Human adenovirus D
cugccgcugcaac

SEQ ID NO: 3918592 - RNA, 20 nt, Human adenovirus D
cugccgcugcaaccugugcu

SEQ ID NO: 3918593 - RNA, 23 nt, Human adenovirus D
cugccgguuucgggcgggcaggg

SEQ ID NO: 3918594 - RNA, 12 nt, Human adenovirus D
cugccuggucaa

SEQ ID NO: 3918595 - RNA, 15 nt, Human adenovirus D
cugcgauauggauga

SEQ ID NO: 3918596 - RNA, 12 nt, Human adenovirus D
cugcgcaacgac

SEQ ID NO: 3918597 - RNA, 22 nt, Human adenovirus D
cugcgccaaaugcgucccaccc

SEQ ID NO: 3918598 - RNA, 15 nt, Human adenovirus D
cugcgcgagguugag

SEQ ID NO: 3918599 - RNA, 19 nt, Human adenovirus D
cugcgcgagguugagcucc

SEQ ID NO: 3918600 - RNA, 20 nt, Human adenovirus D
cugcgcguccgucagcagca

SEQ ID NO: 3918601 - RNA, 22 nt, Human adenovirus D
cugcgcugcuucgcccgggaga

SEQ ID NO: 3918602 - RNA, 20 nt, Human adenovirus D
cugcuaccucuugcagcugg

SEQ ID NO: 3918603 - RNA, 13 nt, Human adenovirus D
cugcuccugcacu

SEQ ID NO: 3918604 - RNA, 14 nt, Human adenovirus D
cugcucuucccugg

SEQ ID NO: 3918605 - RNA, 14 nt, Human adenovirus D
cugcugccgagccg

SEQ ID NO: 3918606 - RNA, 15 nt, Human adenovirus D
cugcugccgagccgc

SEQ ID NO: 3918607 - RNA, 13 nt, Human adenovirus D
cugcuggagcuga

SEQ ID NO: 3918608 - RNA, 11 nt, Human adenovirus D
cugcuggaugg

SEQ ID NO: 3918609 - RNA, 17 nt, Human adenovirus D
cugcuucugccugguga

SEQ ID NO: 3918610 - RNA, 12 nt, Human adenovirus D
cuggaacaccau

SEQ ID NO: 3918611 - RNA, 23 nt, Human adenovirus D
cuggaacgagaucggcaccagcc

SEQ ID NO: 3918612 - RNA, 14 nt, Human adenovirus D
cuggacccccagac

SEQ ID NO: 3918613 - RNA, 14 nt, Human adenovirus D
cuggacccgcggcc

SEQ ID NO: 3918614 - RNA, 16 nt, Human adenovirus D
cuggaccggcugguga

SEQ ID NO: 3918615 - RNA, 18 nt, Human adenovirus D
cuggaccucgagauggac

SEQ ID NO: 3918616 - RNA, 14 nt, Human adenovirus D
cuggacgagagcaa

SEQ ID NO: 3918617 - RNA, 22 nt, Human adenovirus D
cuggacgggagcaauccuccag

SEQ ID NO: 3918618 - RNA, 23 nt, Human adenovirus D
cuggacgggagcaauccuccagg

SEQ ID NO: 3918619 - RNA, 20 nt, Human adenovirus D
cuggagaagcaucgccaggg

SEQ ID NO: 3918620 - RNA, 19 nt, Human adenovirus D
cuggagacgggcugcuucu

SEQ ID NO: 3918621 - RNA, 11 nt, Human adenovirus D
cuggagcagcg

SEQ ID NO: 3918622 - RNA, 19 nt, Human adenovirus D
cuggagcgcguaggccgcu

SEQ ID NO: 3918623 - RNA, 14 nt, Human adenovirus D
cuggaucgaaauca

SEQ ID NO: 3918624 - RNA, 21 nt, Human adenovirus D
cuggcgagacugggggcgccu

SEQ ID NO: 3918625 - RNA, 19 nt, Human adenovirus D
cuggcggagaacaaggcca

SEQ ID NO: 3918626 - RNA, 18 nt, Human adenovirus D
cuggcgguagagcggcca

SEQ ID NO: 3918627 - RNA, 18 nt, Human adenovirus D
cugggcacuggagcacag

SEQ ID NO: 3918628 - RNA, 13 nt, Human adenovirus D
cuggggagggcca

SEQ ID NO: 3918629 - RNA, 22 nt, Human adenovirus D
cugggguauuacuaggcccagc

SEQ ID NO: 3918630 - RNA, 13 nt, Human adenovirus D
cuggucaaaaaca

SEQ ID NO: 3918631 - RNA, 17 nt, Human adenovirus D
cuggucacccucgagcu

SEQ ID NO: 3918632 - RNA, 13 nt, Human adenovirus D
cuggucaucaccu

SEQ ID NO: 3918633 - RNA, 21 nt, Human adenovirus D
cuggucaucaccuuccugcag

SEQ ID NO: 3918634 - RNA, 23 nt, Human adenovirus D
cugguggaaacagacagccaggu

SEQ ID NO: 3918635 - RNA, 22 nt, Human adenovirus D
cugguguaguuguucagcagca

SEQ ID NO: 3918636 - RNA, 20 nt, Human adenovirus D
cugguugacaaauggagcca

SEQ ID NO: 3918637 - RNA, 15 nt, Human adenovirus D
cuguaccgcagcugg

SEQ ID NO: 3918638 - RNA, 19 nt, Human adenovirus D
cuguaccucauccacgaga

SEQ ID NO: 3918639 - RNA, 22 nt, Human adenovirus D
cuguacuuugucugcuguaaag

SEQ ID NO: 3918640 - RNA, 19 nt, Human adenovirus D
cuguaggccauccccaucc

SEQ ID NO: 3918641 - RNA, 22 nt, Human adenovirus D
cuguauuaccuuccuugcugga

SEQ ID NO: 3918642 - RNA, 22 nt, Human adenovirus D
cugucaugccacgaacagccac

SEQ ID NO: 3918643 - RNA, 14 nt, Human adenovirus D
cugucggccgagga

SEQ ID NO: 3918644 - RNA, 23 nt, Human adenovirus D
cugugacaugcaaaaucuuacac

SEQ ID NO: 3918645 - RNA, 16 nt, Human adenovirus D
cugugcuaaguguggu

SEQ ID NO: 3918646 - RNA, 14 nt, Human adenovirus D
cuuaaccacccacg

SEQ ID NO: 3918647 - RNA, 22 nt, Human adenovirus D
cuuaaccacccacgagcaaccc

SEQ ID NO: 3918648 - RNA, 18 nt, Human adenovirus D
cuuaaggaaucuucuuuu

SEQ ID NO: 3918649 - RNA, 13 nt, Human adenovirus D
gcgugcaggcgcc

SEQ ID NO: 3918650 - RNA, 17 nt, Human adenovirus D
gcgugcuggagagcgau

SEQ ID NO: 3918651 - RNA, 12 nt, Human adenovirus D
gcguguggcagc

SEQ ID NO: 3918652 - RNA, 17 nt, Human adenovirus D
gcuacaaucgccacagg

SEQ ID NO: 3918653 - RNA, 14 nt, Human adenovirus D
gcuacaauuacuuc

SEQ ID NO: 3918654 - RNA, 15 nt, Human adenovirus D
gcuaccgcggcaccc

SEQ ID NO: 3918655 - RNA, 17 nt, Human adenovirus D
gcuaccugggaggagag

SEQ ID NO: 3918656 - RNA, 17 nt, Human adenovirus D
gcuaccuugcacccacc

SEQ ID NO: 3918657 - RNA, 17 nt, Human adenovirus D
gcuagaaaacacccaca

SEQ ID NO: 3918658 - RNA, 14 nt, Human adenovirus D
gcuagacaccacag

SEQ ID NO: 3918659 - RNA, 15 nt, Human adenovirus D
gcuagacaccacagu

SEQ ID NO: 3918660 - RNA, 13 nt, Human adenovirus D
gcuagcccuuccu

SEQ ID NO: 3918661 - RNA, 17 nt, Human adenovirus D
gcuauaauaagcagagu

SEQ ID NO: 3918662 - RNA, 17 nt, Human adenovirus D
gcucaaagaccagaacu

SEQ ID NO: 3918663 - RNA, 14 nt, Human adenovirus D
gcucaaccucuucu

SEQ ID NO: 3918664 - RNA, 17 nt, Human adenovirus D
gcucacucuuaaagacu

SEQ ID NO: 3918665 - RNA, 21 nt, Human adenovirus D
gcucaggaccauagggagccu

SEQ ID NO: 3918666 - RNA, 23 nt, Human adenovirus D
gcucaucugcagggcgcccagca

SEQ ID NO: 3918667 - RNA, 13 nt, Human adenovirus D
gcuccagccaaag

SEQ ID NO: 3918668 - RNA, 13 nt, Human adenovirus D
gcucccacagugc

SEQ ID NO: 3918669 - RNA, 17 nt, Human adenovirus D
gcucccaccgcgccgcc

SEQ ID NO: 3918670 - RNA, 18 nt, Human adenovirus D
gcucccggcggcagcggc

SEQ ID NO: 3918671 - RNA, 19 nt, Human adenovirus D
gcuccgcccacaaucgggu

SEQ ID NO: 3918672 - RNA, 14 nt, Human adenovirus D
gcuccguggggcgc

SEQ ID NO: 3918673 - RNA, 17 nt, Human adenovirus D
gcuccucgcucuggggc

SEQ ID NO: 3918674 - RNA, 13 nt, Human adenovirus D
gcuccucucgugc

SEQ ID NO: 3918675 - RNA, 17 nt, Human adenovirus D
gcucgaaaucggugcgc

SEQ ID NO: 3918676 - RNA, 15 nt, Human adenovirus D
gcucgacgcuccgga

SEQ ID NO: 3918677 - RNA, 22 nt, Human adenovirus D
gcucgaucuccuccuccuggag

SEQ ID NO: 3918678 - RNA, 17 nt, Human adenovirus D
gcucgcgcaccugcuac

SEQ ID NO: 3918679 - RNA, 17 nt, Human adenovirus D
gcucggccaugccccag

SEQ ID NO: 3918680 - RNA, 22 nt, Human adenovirus D
gcucggccaugccccaggccug

SEQ ID NO: 3918681 - RNA, 13 nt, Human adenovirus D
gcucgggcugcuc

SEQ ID NO: 3918682 - RNA, 17 nt, Human adenovirus D
gcucggucgggacgaga

SEQ ID NO: 3918683 - RNA, 14 nt, Human adenovirus D
gcucgguugaggca

SEQ ID NO: 3918684 - RNA, 16 nt, Human adenovirus D
gcucgguugaggcacc

SEQ ID NO: 3918685 - RNA, 20 nt, Human adenovirus D
gcucguacccgcucaccauc

SEQ ID NO: 3918686 - RNA, 20 nt, Human adenovirus D
gcucgucuuccaggagccug

SEQ ID NO: 3918687 - RNA, 22 nt, Human adenovirus D
gcucguguccaacggcaaacag

SEQ ID NO: 3918688 - RNA, 16 nt, Human adenovirus D
gcucguuaguccagca

SEQ ID NO: 3918689 - RNA, 16 nt, Human adenovirus D
gcucuaucgcuuccuc

SEQ ID NO: 3918690 - RNA, 15 nt, Human adenovirus D
gcucuucccuggaga

SEQ ID NO: 3918691 - RNA, 15 nt, Human adenovirus D
gcugaaacaccugca

SEQ ID NO: 3918692 - RNA, 17 nt, Human adenovirus D
gcugaccaacuggucuc

SEQ ID NO: 3918693 - RNA, 14 nt, Human adenovirus D
gcugacgcugagcg

SEQ ID NO: 3918694 - RNA, 22 nt, Human adenovirus D
gcugagccugcgccgggcgcug

SEQ ID NO: 3918695 - RNA, 18 nt, Human adenovirus D
gcugagcgaccgcgagcu

SEQ ID NO: 3918696 - RNA, 18 nt, Human adenovirus D
gcugagcgacgaccuggg

SEQ ID NO: 3918697 - RNA, 23 nt, Human adenovirus D
gcugaucaacaucuugcagagca

SEQ ID NO: 3918698 - RNA, 18 nt, Human adenovirus D
gcugauugcucuggccug

SEQ ID NO: 3918699 - RNA, 22 nt, Human adenovirus D
gcugcacgagcgccaggucggc

SEQ ID NO: 3918700 - RNA, 17 nt, Human adenovirus D
gcugccaugggaggaag

SEQ ID NO: 3918701 - RNA, 15 nt, Human adenovirus D
gcugcccgccaccug

SEQ ID NO: 3918702 - RNA, 21 nt, Human adenovirus D
gcugccgucgucccggaggag

SEQ ID NO: 3918703 - RNA, 14 nt, Human adenovirus D
gcugcgcggggcca

SEQ ID NO: 3918704 - RNA, 19 nt, Human adenovirus D
gcugcgcggggccacgacc

SEQ ID NO: 3918705 - RNA, 21 nt, Human adenovirus D
gcugcuaaacaucgccgagcc

SEQ ID NO: 3918706 - RNA, 19 nt, Human adenovirus D
gcugcugaaacaccugcag

SEQ ID NO: 3918707 - RNA, 14 nt, Human adenovirus D
gcugcugccgagcc

SEQ ID NO: 3918708 - RNA, 14 nt, Human adenovirus D
gcugcuggaugggc

SEQ ID NO: 3918709 - RNA, 20 nt, Human adenovirus D
gcugcuucgcccgggagagc

SEQ ID NO: 3918710 - RNA, 22 nt, Human adenovirus D
gcuggaagaccuacgcucagga

SEQ ID NO: 3918711 - RNA, 13 nt, Human adenovirus D
gcuggacgagagc

SEQ ID NO: 3918712 - RNA, 17 nt, Human adenovirus D
gcuggaugauguccuug

SEQ ID NO: 3918713 - RNA, 14 nt, Human adenovirus D
gcuggccagcacgc

SEQ ID NO: 3918714 - RNA, 19 nt, Human adenovirus D
gcuggccagcacgcucuug

SEQ ID NO: 3918715 - RNA, 15 nt, Human adenovirus D
gcuggcccacggcca

SEQ ID NO: 3918716 - RNA, 16 nt, Human adenovirus D
gcuggcccacggccau

SEQ ID NO: 3918717 - RNA, 17 nt, Human adenovirus D
gcuggcgagacuggggg

SEQ ID NO: 3918718 - RNA, 20 nt, Human adenovirus D
gcuggcggagaacaaggcca

SEQ ID NO: 3918719 - RNA, 21 nt, Human adenovirus D
gcuggcggagaacaaggccau

SEQ ID NO: 3918720 - RNA, 22 nt, Human adenovirus D
gcuggcggagaacaaggccauc

SEQ ID NO: 3918721 - RNA, 16 nt, Human adenovirus D
gcuggcugcuggagcu

SEQ ID NO: 3918722 - RNA, 18 nt, Human adenovirus D
gcuggcugcuggagcuga

SEQ ID NO: 3918723 - RNA, 12 nt, Human adenovirus D
gcuggggcagaa

SEQ ID NO: 3918724 - RNA, 13 nt, Human adenovirus D
gcuggggcugcuc

SEQ ID NO: 3918725 - RNA, 19 nt, Human adenovirus D
gcugguagggggcgccgcc

SEQ ID NO: 3918726 - RNA, 23 nt, Human adenovirus D
gcuggucacauccaucuccacca

SEQ ID NO: 3918727 - RNA, 14 nt, Human adenovirus D
gcugguggccaccu

SEQ ID NO: 3918728 - RNA, 19 nt, Human adenovirus D
gcuguaccgcagcugguac

SEQ ID NO: 3918729 - RNA, 14 nt, Human adenovirus D
gcuguccacgggga

SEQ ID NO: 3918730 - RNA, 18 nt, Human adenovirus D
gcugucuuaccagcucuu

SEQ ID NO: 3918731 - RNA, 13 nt, Human adenovirus D
gcugugcuggugg

SEQ ID NO: 3918732 - RNA, 19 nt, Human adenovirus D
gcugugcugguggaaacag

SEQ ID NO: 3918733 - RNA, 20 nt, Human adenovirus D
gcuuacaacagccuugcccc

SEQ ID NO: 3918734 - RNA, 16 nt, Human adenovirus D
gcuucccuggaagagu

SEQ ID NO: 3918735 - RNA, 14 nt, Human adenovirus D
gcuucuacagccag

SEQ ID NO: 3918736 - RNA, 17 nt, Human adenovirus D
gcuucuuaccucgcguc

SEQ ID NO: 3918737 - RNA, 17 nt, Human adenovirus D
gcuugaaacgucccagg

SEQ ID NO: 3918738 - RNA, 17 nt, Human adenovirus D
gcuugcgcgcuggcuug

SEQ ID NO: 3918739 - RNA, 20 nt, Human adenovirus D
ggaaacuaggcgcagcugcg

SEQ ID NO: 3918740 - RNA, 20 nt, Human adenovirus D
ggaaacucuuggagcagggu

SEQ ID NO: 3918741 - RNA, 19 nt, Human adenovirus D
ggaacaccaucagacuggg

SEQ ID NO: 3918742 - RNA, 16 nt, Human adenovirus D
ggaaccuaccacugcc

SEQ ID NO: 3918743 - RNA, 21 nt, Human adenovirus D
ggaacgagaagaacgcacaga

SEQ ID NO: 3918744 - RNA, 14 nt, Human adenovirus D
ggaacggggcagag

SEQ ID NO: 3918745 - RNA, 15 nt, Human adenovirus D
ggaagaagagcagca

SEQ ID NO: 3918746 - RNA, 14 nt, Human adenovirus D
ggaagacccggagc

SEQ ID NO: 3918747 - RNA, 16 nt, Human adenovirus D
ggaagagauggaagaa

SEQ ID NO: 3918748 - RNA, 12 nt, Human adenovirus D
ggaauccugcac

SEQ ID NO: 3918749 - RNA, 16 nt, Human adenovirus D
ggaauccugcacgaga

SEQ ID NO: 3918750 - RNA, 22 nt, Human adenovirus D
ggaaucggaucuuccccacucu

SEQ ID NO: 3918751 - RNA, 17 nt, Human adenovirus D
ggacagcaagccucuga

SEQ ID NO: 3918752 - RNA, 17 nt, Human adenovirus D
ggacaucgcgaaccagg

SEQ ID NO: 3918753 - RNA, 16 nt, Human adenovirus D
ggaccaccaggacggu

SEQ ID NO: 3918754 - RNA, 15 nt, Human adenovirus D
ggaccaggcggcaga

SEQ ID NO: 3918755 - RNA, 15 nt, Human adenovirus D
ggaccgagucgcgga

SEQ ID NO: 3918756 - RNA, 15 nt, Human adenovirus D
ggaccggucccagcg

SEQ ID NO: 3918757 - RNA, 17 nt, Human adenovirus D
ggaccuggcggaggcca

SEQ ID NO: 3918758 - RNA, 16 nt, Human adenovirus D
ggacgacguggacagc

SEQ ID NO: 3918759 - RNA, 15 nt, Human adenovirus D
ggacgaguggcuguu

SEQ ID NO: 3918760 - RNA, 15 nt, Human adenovirus D
ggacgaugguuuccc

SEQ ID NO: 3918761 - RNA, 20 nt, Human adenovirus D
ggacgcgcucccggcggcag

SEQ ID NO: 3918762 - RNA, 22 nt, Human adenovirus D
ggacgcuaccgcugcgcagcag

SEQ ID NO: 3918763 - RNA, 16 nt, Human adenovirus D
ggacggaucgcccagg

SEQ ID NO: 3918764 - RNA, 13 nt, Human adenovirus D
ggacggccaggcc

SEQ ID NO: 3918765 - RNA, 21 nt, Human adenovirus D
ggacggccgcggcgagcggga

SEQ ID NO: 3918766 - RNA, 17 nt, Human adenovirus D
ggacguggugcugcugc

SEQ ID NO: 3918767 - RNA, 15 nt, Human adenovirus D
ggacuuaaccaccca

SEQ ID NO: 3918768 - RNA, 22 nt, Human adenovirus D
ggacuuuucuguugcauguucu

SEQ ID NO: 3918769 - RNA, 16 nt, Human adenovirus D
ggagccagaacaccca

SEQ ID NO: 3918770 - RNA, 20 nt, Human adenovirus D
ggagccgcuaguggaagaga

SEQ ID NO: 3918771 - RNA, 21 nt, Human adenovirus D
ggagcuugcccuuggaagagc

SEQ ID NO: 3918772 - RNA, 20 nt, Human adenovirus D
ggaggacuuaaccacccacg

SEQ ID NO: 3918773 - RNA, 22 nt, Human adenovirus D
ggaggagaccgacgcugggcuc

SEQ ID NO: 3918774 - RNA, 12 nt, Human adenovirus D
ggaggagcagcc

SEQ ID NO: 3918775 - RNA, 14 nt, Human adenovirus D
ggaggaugugcugc

SEQ ID NO: 3918776 - RNA, 14 nt, Human adenovirus D
ggaggcaccaccua

SEQ ID NO: 3918777 - RNA, 14 nt, Human adenovirus D
ggaggcggugcgca

SEQ ID NO: 3918778 - RNA, 14 nt, Human adenovirus D
ggagggauugcagg

SEQ ID NO: 3918779 - RNA, 18 nt, Human adenovirus D
ggagguagcaccacugca

SEQ ID NO: 3918780 - RNA, 23 nt, Human adenovirus D
ggagguagcaccacugcauggcc

SEQ ID NO: 3918781 - RNA, 17 nt, Human adenovirus D
ggaguucgucagaaugu

SEQ ID NO: 3918782 - RNA, 18 nt, Human adenovirus D
ggaucgacgguggacggg

SEQ ID NO: 3918783 - RNA, 16 nt, Human adenovirus D
ggaucgcgaggacacc

SEQ ID NO: 3918784 - RNA, 14 nt, Human adenovirus D
ggaugagguggacg

SEQ ID NO: 3918785 - RNA, 15 nt, Human adenovirus D
ggaugcaugcggggg

SEQ ID NO: 3918786 - RNA, 13 nt, Human adenovirus D
ggcaaagcgguug

SEQ ID NO: 3918787 - RNA, 12 nt, Human adenovirus D
ggcaaaggagcc

SEQ ID NO: 3918788 - RNA, 23 nt, Human adenovirus D
ggcaacaccugggcacuggagca

SEQ ID NO: 3918789 - RNA, 22 nt, Human adenovirus D
ggcaacagcaaaagauacagag

SEQ ID NO: 3918790 - RNA, 22 nt, Human adenovirus D
ggcaacauccccgcccugcugg

SEQ ID NO: 3918791 - RNA, 23 nt, Human adenovirus D
ggcaacgaccggcugcucacgcc

SEQ ID NO: 3918792 - RNA, 13 nt, Human adenovirus D
ggcaacggccgcu

SEQ ID NO: 3918793 - RNA, 19 nt, Human adenovirus D
ggcaaugcuagagugaggc

SEQ ID NO: 3918794 - RNA, 12 nt, Human adenovirus D
ggcaccagccag

SEQ ID NO: 3918795 - RNA, 14 nt, Human adenovirus D
ggcaccagccagcu

SEQ ID NO: 3918796 - RNA, 21 nt, Human adenovirus D
ggcaccaucacaggaggcaca

SEQ ID NO: 3918797 - RNA, 23 nt, Human adenovirus D
ggcaccaucacaggaggcacaga

SEQ ID NO: 3918798 - RNA, 15 nt, Human adenovirus D
ggcacccacgacaca

SEQ ID NO: 3918799 - RNA, 18 nt, Human adenovirus D
ggcaccuagaccacugcc

SEQ ID NO: 3918800 - RNA, 15 nt, Human adenovirus D
ggcacgcucugaggc

SEQ ID NO: 3918801 - RNA, 18 nt, Human adenovirus D
ggcacggcacgcggccgu

SEQ ID NO: 3918802 - RNA, 17 nt, Human adenovirus D
ggcacuggagcacagac

SEQ ID NO: 3918803 - RNA, 16 nt, Human adenovirus D
ggcagagguggucauu

SEQ ID NO: 3918804 - RNA, 13 nt, Human adenovirus D
ggcagcggggccu

SEQ ID NO: 3918805 - RNA, 20 nt, Human adenovirus D
ggcagcggugguggaggcgc

SEQ ID NO: 3918806 - RNA, 20 nt, Human adenovirus D
ggcaggccauggacgagaac

SEQ ID NO: 3918807 - RNA, 14 nt, Human adenovirus D
ggcagggugagccg

SEQ ID NO: 3918808 - RNA, 20 nt, Human adenovirus D
ggcagguggucgaugagauc

SEQ ID NO: 3918809 - RNA, 12 nt, Human adenovirus D
ggcauccugcac

SEQ ID NO: 3918810 - RNA, 16 nt, Human adenovirus D
ggccaaccuguggaag

SEQ ID NO: 3918811 - RNA, 18 nt, Human adenovirus D
ggccaaccuguggaagag

SEQ ID NO: 3918812 - RNA, 19 nt, Human adenovirus D
ggccaagaaggccggggcc

SEQ ID NO: 3918813 - RNA, 22 nt, Human adenovirus D
ggccaauguuacgcugcccgcc

SEQ ID NO: 3918814 - RNA, 17 nt, Human adenovirus D
ggccacgaccgugccgc

SEQ ID NO: 3918815 - RNA, 18 nt, Human adenovirus D
ggccacggggagccccuu

SEQ ID NO: 3918816 - RNA, 16 nt, Human adenovirus D
ggccacucccagcgcc

SEQ ID NO: 3918817 - RNA, 17 nt, Human adenovirus D
ggccagaugcggaggag

SEQ ID NO: 3918818 - RNA, 13 nt, Human adenovirus D
ggccagcacgcuc

SEQ ID NO: 3918819 - RNA, 14 nt, Human adenovirus D
ggccagcacgcucu

SEQ ID NO: 3918820 - RNA, 19 nt, Human adenovirus D
ggccagcgcuggguggccg

SEQ ID NO: 3918821 - RNA, 15 nt, Human adenovirus D
ggccaggaggagacc

SEQ ID NO: 3918822 - RNA, 21 nt, Human adenovirus D
ggccagugauuggggaaccuc

SEQ ID NO: 3918823 - RNA, 16 nt, Human adenovirus D
ggccaucgugcagaac

SEQ ID NO: 3918824 - RNA, 21 nt, Human adenovirus D
ggccaucgugcagaacccgga

SEQ ID NO: 3918825 - RNA, 19 nt, Human adenovirus D
ggccaugagggucuggagc

SEQ ID NO: 3918826 - RNA, 12 nt, Human adenovirus D
ggccaugcugcg

SEQ ID NO: 3918827 - RNA, 14 nt, Human adenovirus D
ggccaugcugcgcc

SEQ ID NO: 3918828 - RNA, 13 nt, Human adenovirus D
ggccauggacgag

SEQ ID NO: 3918829 - RNA, 16 nt, Human adenovirus D
ggccauugcucgcucg

SEQ ID NO: 3918830 - RNA, 16 nt, Human adenovirus D
ggccccuggcugggcg

SEQ ID NO: 3918831 - RNA, 22 nt, Human adenovirus D
ggcccggcaacgaccggcugcu

SEQ ID NO: 3918832 - RNA, 21 nt, Human adenovirus D
ggcccggcacggcgguggugu

SEQ ID NO: 3918833 - RNA, 17 nt, Human adenovirus D
ggcccuggagcagcggc

SEQ ID NO: 3918834 - RNA, 17 nt, Human adenovirus D
ggcccugggccugaugc

SEQ ID NO: 3918835 - RNA, 17 nt, Human adenovirus D
ggccgaaaaccccgccg

SEQ ID NO: 3918836 - RNA, 19 nt, Human adenovirus D
ggccgaaaaccccgccggg

SEQ ID NO: 3918837 - RNA, 22 nt, Human adenovirus D
ggccgaaaaccccgccggguag

SEQ ID NO: 3918838 - RNA, 14 nt, Human adenovirus D
ggccgagaccguga

SEQ ID NO: 3918839 - RNA, 18 nt, Human adenovirus D
ggccgagaccgugagcuc

SEQ ID NO: 3918840 - RNA, 13 nt, Human adenovirus D
ggccgagcuggaa

SEQ ID NO: 3918841 - RNA, 16 nt, Human adenovirus D
ggccgccaacaugcuc

SEQ ID NO: 3918842 - RNA, 18 nt, Human adenovirus D
ggccgcccacgguggugg

SEQ ID NO: 3918843 - RNA, 22 nt, Human adenovirus D
ggccgcggccagaugcggagga

SEQ ID NO: 3918844 - RNA, 22 nt, Human adenovirus D
ggccgcucgcucguucugccca

SEQ ID NO: 3918845 - RNA, 17 nt, Human adenovirus D
ggccggcaugcccacca

SEQ ID NO: 3918846 - RNA, 20 nt, Human adenovirus D
ggccggcaugcccaccacgc

SEQ ID NO: 3918847 - RNA, 14 nt, Human adenovirus D
ggccgggcugcacg

SEQ ID NO: 3918848 - RNA, 18 nt, Human adenovirus D
ggccguagcaggcgccgg

SEQ ID NO: 3918849 - RNA, 17 nt, Human adenovirus D
ggccgucacccugcccu

SEQ ID NO: 3918850 - RNA, 19 nt, Human adenovirus D
ggccgugagcgcgagccgg

SEQ ID NO: 3918851 - RNA, 17 nt, Human adenovirus D
ggccguucaugggcacc

SEQ ID NO: 3918852 - RNA, 22 nt, Human adenovirus D
ggccuacuuuuugggcacccac

SEQ ID NO: 3918853 - RNA, 14 nt, Human adenovirus D
ggccucuacccgga

SEQ ID NO: 3918854 - RNA, 15 nt, Human adenovirus D
ggccugaugcaggau

SEQ ID NO: 3918855 - RNA, 18 nt, Human adenovirus D
ggccugcgucaucaccca

SEQ ID NO: 3918856 - RNA, 21 nt, Human adenovirus D
ggccuggaauaguagcacggg

SEQ ID NO: 3918857 - RNA, 13 nt, Human adenovirus D
ggccuggagcaga

SEQ ID NO: 3918858 - RNA, 17 nt, Human adenovirus D
ggccugggagugaaaag

SEQ ID NO: 3918859 - RNA, 23 nt, Human adenovirus D
ggccuguccugcaggggcguccc

SEQ ID NO: 3918860 - RNA, 23 nt, Human adenovirus D
ggcgaacgugccgcgcgggcagg

SEQ ID NO: 3918861 - RNA, 16 nt, Human adenovirus D
ggcgaagggcuggcga

SEQ ID NO: 3918862 - RNA, 12 nt, Human adenovirus D
ggcgacccagga

SEQ ID NO: 3918863 - RNA, 22 nt, Human adenovirus D
ggcgaccggucgacggugagca

SEQ ID NO: 3918864 - RNA, 19 nt, Human adenovirus D
ggcgacgacgcgcucggcg

SEQ ID NO: 3918865 - RNA, 15 nt, Human adenovirus D
ggcgacgcaccggga

SEQ ID NO: 3918866 - RNA, 20 nt, Human adenovirus D
ggcgagaagcggccgcggcc

SEQ ID NO: 3918867 - RNA, 16 nt, Human adenovirus D
ggcgagauagcaguug

SEQ ID NO: 3918868 - RNA, 21 nt, Human adenovirus D
ggcgagcgggacuuggucacc

SEQ ID NO: 3918869 - RNA, 24 nt, Human adenovirus D
ggcgauaugccagacgcaagagcc

SEQ ID NO: 3918870 - RNA, 16 nt, Human adenovirus D
ggcgccaucuugccca

SEQ ID NO: 3918871 - RNA, 17 nt, Human adenovirus D
ggcgccauucggagcac

SEQ ID NO: 3918872 - RNA, 20 nt, Human adenovirus D
ggcgccgccggcggcgagga

SEQ ID NO: 3918873 - RNA, 17 nt, Human adenovirus D
ggcgcgauccucgccca

SEQ ID NO: 3918874 - RNA, 19 nt, Human adenovirus D
ggcgcgccuuggaggccgc

SEQ ID NO: 3918875 - RNA, 20 nt, Human adenovirus D
ggcgcgccuuggaggccgcc

SEQ ID NO: 3918876 - RNA, 14 nt, Human adenovirus D
ggcgcguggaggaa

SEQ ID NO: 3918877 - RNA, 19 nt, Human adenovirus D
ggcgcugcaaagccagccg

SEQ ID NO: 3918878 - RNA, 21 nt, Human adenovirus D
ggcgcugggcguggugcugga

SEQ ID NO: 3918879 - RNA, 16 nt, Human adenovirus D
ggcggauagcgcgccg

SEQ ID NO: 3918880 - RNA, 12 nt, Human adenovirus D
ggcggcagagcg

SEQ ID NO: 3918881 - RNA, 14 nt, Human adenovirus D
ggcggcggccaacc

SEQ ID NO: 3918882 - RNA, 16 nt, Human adenovirus D
ggcggcuuucugcccg

SEQ ID NO: 3918883 - RNA, 14 nt, Human adenovirus D
ggcgggcagggagc

SEQ ID NO: 3918884 - RNA, 15 nt, Human adenovirus D
ggcgggcagggagcu

SEQ ID NO: 3918885 - RNA, 17 nt, Human adenovirus D
ggcgggcagggagcugc

SEQ ID NO: 3918886 - RNA, 13 nt, Human adenovirus D
ggcgggcugcccg

SEQ ID NO: 3918887 - RNA, 19 nt, Human adenovirus D
ggcgggggugaugagcugc

SEQ ID NO: 3918888 - RNA, 19 nt, Human adenovirus D
ggcgguagagcggccagcg

SEQ ID NO: 3918889 - RNA, 18 nt, Human adenovirus D
ggcgguccccgcccagcg

SEQ ID NO: 3918890 - RNA, 15 nt, Human adenovirus D
ggcguacgugccugc

SEQ ID NO: 3918891 - RNA, 19 nt, Human adenovirus D
ggcgugcacuggcucgccu

SEQ ID NO: 3918892 - RNA, 19 nt, Human adenovirus D
ggcgugcgcgacgacgcgg

SEQ ID NO: 3918893 - RNA, 20 nt, Human adenovirus D
ggcguggcccuuggcgcgga

SEQ ID NO: 3918894 - RNA, 20 nt, Human adenovirus D
ggcuaccgcggcacccggua

SEQ ID NO: 3918895 - RNA, 13 nt, Human adenovirus D
ggcucagcugcca

SEQ ID NO: 3918896 - RNA, 21 nt, Human adenovirus D
ggcucccagccuccaccgcua

SEQ ID NO: 3918897 - RNA, 19 nt, Human adenovirus D
ggcucgccuucggcuggaa

SEQ ID NO: 3918898 - RNA, 24 nt, Human adenovirus D
ggcugacgagcccgcgcgggagcc

SEQ ID NO: 3918899 - RNA, 15 nt, Human adenovirus D
ggcugauggugaccg

SEQ ID NO: 3918900 - RNA, 13 nt, Human adenovirus D
ggcugcuggagcu

SEQ ID NO: 3918901 - RNA, 14 nt, Human adenovirus D
ggcugcuggagcug

SEQ ID NO: 3918902 - RNA, 14 nt, Human adenovirus D
ggcugcuucugccu

SEQ ID NO: 3918903 - RNA, 12 nt, Human adenovirus D
ggcuggagccgc

SEQ ID NO: 3918904 - RNA, 11 nt, Human adenovirus D
ggcuggccgug

SEQ ID NO: 3918905 - RNA, 21 nt, Human adenovirus D
ggcuggucaguugcaccacgc

SEQ ID NO: 3918906 - RNA, 22 nt, Human adenovirus D
ggcuggucaguugcaccacgcu

SEQ ID NO: 3918907 - RNA, 15 nt, Human adenovirus D
ggcuucagagacaac

SEQ ID NO: 3918908 - RNA, 20 nt, Human adenovirus D
gggaaccucagccacuccaa

SEQ ID NO: 3918909 - RNA, 14 nt, Human adenovirus D
gggacagaguuucu

SEQ ID NO: 3918910 - RNA, 23 nt, Human adenovirus D
gggacccugagaacggggugcag

SEQ ID NO: 3918911 - RNA, 16 nt, Human adenovirus D
gggaccggcggggccu

SEQ ID NO: 3918912 - RNA, 14 nt, Human adenovirus D
gggacgugagcgcg

SEQ ID NO: 3918913 - RNA, 23 nt, Human adenovirus D
gggacucacccuggggcuccucg

SEQ ID NO: 3918914 - RNA, 17 nt, Human adenovirus D
gggagcaauccuccagg

SEQ ID NO: 3918915 - RNA, 16 nt, Human adenovirus D
gggagccagguccaga

SEQ ID NO: 3918916 - RNA, 12 nt, Human adenovirus D
gggagcgguggg

SEQ ID NO: 3918917 - RNA, 12 nt, Human adenovirus D
gggaggcgcugc

SEQ ID NO: 3918918 - RNA, 21 nt, Human adenovirus D
gggaguuugcauagcuugccg

SEQ ID NO: 3918919 - RNA, 15 nt, Human adenovirus D
gggcaccuuccagcc

SEQ ID NO: 3918920 - RNA, 14 nt, Human adenovirus D
gggcacuggagcac

SEQ ID NO: 3918921 - RNA, 16 nt, Human adenovirus D
gggcagacacaccagg

SEQ ID NO: 3918922 - RNA, 14 nt, Human adenovirus D
gggcagaggugguc

SEQ ID NO: 3918923 - RNA, 15 nt, Human adenovirus D
gggcagcgagagggc

SEQ ID NO: 3918924 - RNA, 13 nt, Human adenovirus D
gggcagggagcug

SEQ ID NO: 3918925 - RNA, 14 nt, Human adenovirus D
gggcaggggcggca

SEQ ID NO: 3918926 - RNA, 20 nt, Human adenovirus D
gggcauuaacgggguggugg

SEQ ID NO: 3918927 - RNA, 21 nt, Human adenovirus D
gggcauuaacgggguggugga

SEQ ID NO: 3918928 - RNA, 18 nt, Human adenovirus D
gggccacuacagcugaca

SEQ ID NO: 3918929 - RNA, 19 nt, Human adenovirus D
gggccuacgagcucaaccu

SEQ ID NO: 3918930 - RNA, 12 nt, Human adenovirus D
gggccugggcuc

SEQ ID NO: 3918931 - RNA, 18 nt, Human adenovirus D
gggcgccgccggcggcga

SEQ ID NO: 3918932 - RNA, 18 nt, Human adenovirus D
gggcgccuuccccggagc

SEQ ID NO: 3918933 - RNA, 23 nt, Human adenovirus D
gggcgcuugcaagggugcgcuug

SEQ ID NO: 3918934 - RNA, 16 nt, Human adenovirus D
gggcguugcgggccga

SEQ ID NO: 3918935 - RNA, 17 nt, Human adenovirus D
gggcucgcugguggcgc

SEQ ID NO: 3918936 - RNA, 11 nt, Human adenovirus D
gggcuucaccg

SEQ ID NO: 3918937 - RNA, 17 nt, Human adenovirus D
gggcuucgaagagccgg

SEQ ID NO: 3918938 - RNA, 15 nt, Human adenovirus D
ggggaacggggcaga

SEQ ID NO: 3918939 - RNA, 13 nt, Human adenovirus D
ggggacgagcugc

SEQ ID NO: 3918940 - RNA, 14 nt, Human adenovirus D
ggggaggagcccga

SEQ ID NO: 3918941 - RNA, 16 nt, Human adenovirus D
ugcgcgagcagaacgg

SEQ ID NO: 3918942 - RNA, 18 nt, Human adenovirus D
ugcgcgaguucgcuccgc

SEQ ID NO: 3918943 - RNA, 19 nt, Human adenovirus D
ugcgcguccgucagcagca

SEQ ID NO: 3918944 - RNA, 21 nt, Human adenovirus D
ugcggcagcuuuuugagcucc

SEQ ID NO: 3918945 - RNA, 16 nt, Human adenovirus D
ugcggcugcugcaaau

SEQ ID NO: 3918946 - RNA, 23 nt, Human adenovirus D
ugcguaccuugucguacuucugc

SEQ ID NO: 3918947 - RNA, 18 nt, Human adenovirus D
ugcgucaucacccagggc

SEQ ID NO: 3918948 - RNA, 19 nt, Human adenovirus D
ugcuaaacaucgccgagcc

SEQ ID NO: 3918949 - RNA, 17 nt, Human adenovirus D
ugcuccaaagcuagcac

SEQ ID NO: 3918950 - RNA, 23 nt, Human adenovirus D
ugcuccaggucgucgccccggag

SEQ ID NO: 3918951 - RNA, 16 nt, Human adenovirus D
ugcucuaccccauccc

SEQ ID NO: 3918952 - RNA, 21 nt, Human adenovirus D
ugcugacauccauggccaggg

SEQ ID NO: 3918953 - RNA, 18 nt, Human adenovirus D
ugcugacgggggugccca

SEQ ID NO: 3918954 - RNA, 17 nt, Human adenovirus D
ugcugaucaagugccac

SEQ ID NO: 3918955 - RNA, 22 nt, Human adenovirus D
ugcugcuacaucucggggaacg

SEQ ID NO: 3918956 - RNA, 21 nt, Human adenovirus D
ugcugcuccaccaccugcagc

SEQ ID NO: 3918957 - RNA, 13 nt, Human adenovirus D
ugcuuccacacuu

SEQ ID NO: 3918958 - RNA, 12 nt, Human adenovirus D
ugcuuccagcaa

SEQ ID NO: 3918959 - RNA, 17 nt, Human adenovirus D
ugcuugagaugcagaug

SEQ ID NO: 3918960 - RNA, 16 nt, Human adenovirus D
ugcuuguaccacaaaa

SEQ ID NO: 3918961 - RNA, 19 nt, Human adenovirus D
uggaacaccaucagacugg

SEQ ID NO: 3918962 - RNA, 22 nt, Human adenovirus D
uggaacccgcgcucgcgcaccu

SEQ ID NO: 3918963 - RNA, 17 nt, Human adenovirus D
uggaccccauggacaac

SEQ ID NO: 3918964 - RNA, 21 nt, Human adenovirus D
uggacccuccgucggaagagg

SEQ ID NO: 3918965 - RNA, 15 nt, Human adenovirus D
uggaccggcugguga

SEQ ID NO: 3918966 - RNA, 12 nt, Human adenovirus D
uggacgagccgc

SEQ ID NO: 3918967 - RNA, 20 nt, Human adenovirus D
uggacuucacagagagccgc

SEQ ID NO: 3918968 - RNA, 15 nt, Human adenovirus D
uggacuucgcagcca

SEQ ID NO: 3918969 - RNA, 20 nt, Human adenovirus D
uggagcaggcggcggucacc

SEQ ID NO: 3918970 - RNA, 22 nt, Human adenovirus D
uggagcagugucuggagcgggc

SEQ ID NO: 3918971 - RNA, 21 nt, Human adenovirus D
uggagcucgucgcgaaagagg

SEQ ID NO: 3918972 - RNA, 13 nt, Human adenovirus D
uggagggcugucc

SEQ ID NO: 3918973 - RNA, 20 nt, Human adenovirus D
uggaucgcgaggacaccagu

SEQ ID NO: 3918974 - RNA, 14 nt, Human adenovirus D
uggaugugcccaag

SEQ ID NO: 3918975 - RNA, 22 nt, Human adenovirus D
uggcaaagcgguugagcuggga

SEQ ID NO: 3918976 - RNA, 19 nt, Human adenovirus D
uggcaagagucugaagccu

SEQ ID NO: 3918977 - RNA, 23 nt, Human adenovirus D
uggccaacagccacaugacccug

SEQ ID NO: 3918978 - RNA, 18 nt, Human adenovirus D
uggccgcccugacccagc

SEQ ID NO: 3918979 - RNA, 20 nt, Human adenovirus D
uggccgcccugacccagcag

SEQ ID NO: 3918980 - RNA, 20 nt, Human adenovirus D
uggccuccagccuuuccaug

SEQ ID NO: 3918981 - RNA, 13 nt, Human adenovirus D
uggccugcgccau

SEQ ID NO: 3918982 - RNA, 19 nt, Human adenovirus D
uggccuguccugcaggggc

SEQ ID NO: 3918983 - RNA, 17 nt, Human adenovirus D
uggcgacccaggaaugg

SEQ ID NO: 3918984 - RNA, 21 nt, Human adenovirus D
uggcgaccgccgugcgccgcg

SEQ ID NO: 3918985 - RNA, 21 nt, Human adenovirus D
uggcgacgaacucggcgguga

SEQ ID NO: 3918986 - RNA, 19 nt, Human adenovirus D
uggcggcccuggcuggugg

SEQ ID NO: 3918987 - RNA, 21 nt, Human adenovirus D
uggcggcggccaaccugguga

SEQ ID NO: 3918988 - RNA, 14 nt, Human adenovirus D
uggcgugcuggaga

SEQ ID NO: 3918989 - RNA, 20 nt, Human adenovirus D
uggcuccuacggagggcaga

SEQ ID NO: 3918990 - RNA, 15 nt, Human adenovirus D
uggcuucuacagcca

SEQ ID NO: 3918991 - RNA, 13 nt, Human adenovirus D
ugggacagccagc

SEQ ID NO: 3918992 - RNA, 16 nt, Human adenovirus D
ucggugcggcugcugc

SEQ ID NO: 3918993 - RNA, 15 nt, Human adenovirus D
ucguacgagagcgug

SEQ ID NO: 3918994 - RNA, 14 nt, Human adenovirus D
ucuaccgucgccac

SEQ ID NO: 3918995 - RNA, 18 nt, Human adenovirus D
ucuaugaaagcauacaga

SEQ ID NO: 3918996 - RNA, 11 nt, Human adenovirus D
ucucaaagugu

SEQ ID NO: 3918997 - RNA, 13 nt, Human adenovirus D
ucucaacaucaca

SEQ ID NO: 3918998 - RNA, 18 nt, Human adenovirus D
ucucagaugucaaagagg

SEQ ID NO: 3918999 - RNA, 20 nt, Human adenovirus D
ucucccaggcuuucaucucg

SEQ ID NO: 3919000 - RNA, 13 nt, Human adenovirus D
ucucgauccagca

SEQ ID NO: 3919001 - RNA, 17 nt, Human adenovirus D
ucucggccaaucagcag

SEQ ID NO: 3919002 - RNA, 20 nt, Human adenovirus D
ucucugccauguucucacag

SEQ ID NO: 3919003 - RNA, 15 nt, Human adenovirus D
ucucuucuuguaacu

SEQ ID NO: 3919004 - RNA, 22 nt, Human adenovirus D
ucugauuagcauagucacacuu

SEQ ID NO: 3919005 - RNA, 19 nt, Human adenovirus D
ucugcaacccccagcuccu

SEQ ID NO: 3919006 - RNA, 12 nt, Human adenovirus D
ucugcucuucca

SEQ ID NO: 3919007 - RNA, 22 nt, Human adenovirus D
ucuuccccagcgguucuggguc

SEQ ID NO: 3919008 - RNA, 14 nt, Human adenovirus D
ucuuccccauggcg

SEQ ID NO: 3919009 - RNA, 20 nt, Human adenovirus D
ucuuccuccguagccuggcg

SEQ ID NO: 3919010 - RNA, 22 nt, Human adenovirus D
ucuucuuguaacuuuuagucag

SEQ ID NO: 3919011 - RNA, 17 nt, Human adenovirus D
ucuuguaacuuuuaguc

SEQ ID NO: 3919012 - RNA, 14 nt, Human adenovirus D
ucuuuaucugcugg

SEQ ID NO: 3919013 - RNA, 15 nt, Human adenovirus D
ucuuuauucuugugg

SEQ ID NO: 3919014 - RNA, 13 nt, Human adenovirus D
ugaaacaccugca

SEQ ID NO: 3919015 - RNA, 15 nt, Human adenovirus D
ugaaagcauacagag

SEQ ID NO: 3919016 - RNA, 15 nt, Human adenovirus D
ugaaaucugaaagua

SEQ ID NO: 3919017 - RNA, 14 nt, Human adenovirus D
ugaacugauguuga

SEQ ID NO: 3919018 - RNA, 22 nt, Human adenovirus D
ugaagagaaucuugccugcucg

SEQ ID NO: 3919019 - RNA, 14 nt, Human adenovirus D
ugaagagggagagg

SEQ ID NO: 3919020 - RNA, 14 nt, Human adenovirus D
ugaagggcacagcc

SEQ ID NO: 3919021 - RNA, 20 nt, Human adenovirus D
ugaagggcacagccucucug

SEQ ID NO: 3919022 - RNA, 19 nt, Human adenovirus D
ugaauaucagacaugcugc

SEQ ID NO: 3919023 - RNA, 13 nt, Human adenovirus D
ugaaucucggcca

SEQ ID NO: 3919024 - RNA, 14 nt, Human adenovirus D
ugaauggcacuggc

SEQ ID NO: 3919025 - RNA, 17 nt, Human adenovirus D
ugacaaauggagccaga

SEQ ID NO: 3919026 - RNA, 19 nt, Human adenovirus D
ugacaacccgccugccagg

SEQ ID NO: 3919027 - RNA, 23 nt, Human adenovirus D
ugacaauaauugaacugccuaca

SEQ ID NO: 3919028 - RNA, 19 nt, Human adenovirus D
ugacacaccuggaggcacc

SEQ ID NO: 3919029 - RNA, 18 nt, Human adenovirus D
ugacaguucagaaguaaa

SEQ ID NO: 3919030 - RNA, 15 nt, Human adenovirus D
ugacauacaucuuuu

SEQ ID NO: 3919031 - RNA, 15 nt, Human adenovirus D
ugaccaagcugguga

SEQ ID NO: 3919032 - RNA, 16 nt, Human adenovirus D
ugaccagacccaggcg

SEQ ID NO: 3919033 - RNA, 21 nt, Human adenovirus D
ugaccagguccacgcuggugg

SEQ ID NO: 3919034 - RNA, 18 nt, Human adenovirus D
ugacccaaucaccauagc

SEQ ID NO: 3919035 - RNA, 11 nt, Human adenovirus D
ugacccugcau

SEQ ID NO: 3919036 - RNA, 15 nt, Human adenovirus D
ugaccugcagcaggu

SEQ ID NO: 3919037 - RNA, 16 nt, Human adenovirus D
ugaccuugcagagcag

SEQ ID NO: 3919038 - RNA, 20 nt, Human adenovirus D
ugacgagcccgcgcgggagc

SEQ ID NO: 3919039 - RNA, 14 nt, Human adenovirus D
ugacgcaugcaagg

SEQ ID NO: 3919040 - RNA, 14 nt, Human adenovirus D
ugacggcgggcuga

SEQ ID NO: 3919041 - RNA, 15 nt, Human adenovirus D
ugacgucauugaaga

SEQ ID NO: 3919042 - RNA, 22 nt, Human adenovirus D
ugacuucaaccccgucuacccc

SEQ ID NO: 3919043 - RNA, 17 nt, Human adenovirus D
ugagaacggggugcagu

SEQ ID NO: 3919044 - RNA, 17 nt, Human adenovirus D
ugagaauaacaugcuga

SEQ ID NO: 3919045 - RNA, 18 nt, Human adenovirus D
ugagacucauccugcugg

SEQ ID NO: 3919046 - RNA, 21 nt, Human adenovirus D
ugagacucauccugcuggugc

SEQ ID NO: 3919047 - RNA, 13 nt, Human adenovirus D
ugagagcgcuggc

SEQ ID NO: 3919048 - RNA, 20 nt, Human adenovirus D
ugagagucugaaaaacagaa

SEQ ID NO: 3919049 - RNA, 20 nt, Human adenovirus D
ugagaugccccagcagaagc

SEQ ID NO: 3919050 - RNA, 15 nt, Human adenovirus D
ugagcagcuugcuga

SEQ ID NO: 3919051 - RNA, 16 nt, Human adenovirus D
ugagcucgucuuccag

SEQ ID NO: 3919052 - RNA, 14 nt, Human adenovirus D
ucccggccaaggcc

SEQ ID NO: 3919053 - RNA, 18 nt, Human adenovirus D
ucccucgggccccggggc

SEQ ID NO: 3919054 - RNA, 12 nt, Human adenovirus D
uccgcaacuucc

SEQ ID NO: 3919055 - RNA, 14 nt, Human adenovirus D
uccgcaacuuccag

SEQ ID NO: 3919056 - RNA, 19 nt, Human adenovirus D
uccgcacgguaagagccca

SEQ ID NO: 3919057 - RNA, 22 nt, Human adenovirus D
uccgcacgguaagagcccagca

SEQ ID NO: 3919058 - RNA, 23 nt, Human adenovirus D
uccgcacgguaagagcccagcau

SEQ ID NO: 3919059 - RNA, 18 nt, Human adenovirus D
uccgcagcuacaccuccc

SEQ ID NO: 3919060 - RNA, 17 nt, Human adenovirus D
uccgcaggcgggacaga

SEQ ID NO: 3919061 - RNA, 22 nt, Human adenovirus D
uccgcccgcgcccaccaucacc

SEQ ID NO: 3919062 - RNA, 12 nt, Human adenovirus D
uccuccaggacu

SEQ ID NO: 3919063 - RNA, 15 nt, Human adenovirus D
uccuccguagccugg

SEQ ID NO: 3919064 - RNA, 23 nt, Human adenovirus D
uccugaaccacacggccagcagg

SEQ ID NO: 3919065 - RNA, 20 nt, Human adenovirus D
uccugagcgagacccagguc

SEQ ID NO: 3919066 - RNA, 17 nt, Human adenovirus D
uccugcaccauccccag

SEQ ID NO: 3919067 - RNA, 18 nt, Human adenovirus D
uccuucaacgacuaccuc

SEQ ID NO: 3919068 - RNA, 17 nt, Human adenovirus D
ucgaagccguugauguu

SEQ ID NO: 3919069 - RNA, 23 nt, Human adenovirus D
ucgaccguggcuucgagcagugg

SEQ ID NO: 3919070 - RNA, 15 nt, Human adenovirus D
ucgacgagccaggug

SEQ ID NO: 3919071 - RNA, 13 nt, Human adenovirus D
ucgagagcgggca

SEQ ID NO: 3919072 - RNA, 15 nt, Human adenovirus D
ucgagagcgggcaug

SEQ ID NO: 3919073 - RNA, 18 nt, Human adenovirus D
ucgaggagaccugcacua

SEQ ID NO: 3919074 - RNA, 14 nt, Human adenovirus D
ucgauccagcagac

SEQ ID NO: 3919075 - RNA, 19 nt, Human adenovirus D
ucgaugaaagucaggagca

SEQ ID NO: 3919076 - RNA, 22 nt, Human adenovirus D
ucgaugaaagucaggagcagcg

SEQ ID NO: 3919077 - RNA, 17 nt, Human adenovirus D
ucgauggugaagaugcc

SEQ ID NO: 3919078 - RNA, 18 nt, Human adenovirus D
ucgcaagcgcccagagcg

SEQ ID NO: 3919079 - RNA, 18 nt, Human adenovirus D
ucgcagacgagcggccgc

SEQ ID NO: 3919080 - RNA, 21 nt, Human adenovirus D
ucgcagcgcugcacgggcugu

SEQ ID NO: 3919081 - RNA, 20 nt, Human adenovirus D
ucgccacaggugcugcccac

SEQ ID NO: 3919082 - RNA, 16 nt, Human adenovirus D
ucgcccgggagagcug

SEQ ID NO: 3919083 - RNA, 14 nt, Human adenovirus D
ucgccggaggaggc

SEQ ID NO: 3919084 - RNA, 23 nt, Human adenovirus D
ucgccuucggcuggaacccgcgc

SEQ ID NO: 3919085 - RNA, 17 nt, Human adenovirus D
ucgcgaaccaggcagug

SEQ ID NO: 3919086 - RNA, 15 nt, Human adenovirus D
ucgcgcaggccgcug

SEQ ID NO: 3919087 - RNA, 16 nt, Human adenovirus D
ucgcgccacuggccac

SEQ ID NO: 3919088 - RNA, 23 nt, Human adenovirus D
ucgcgccucaaugucagcugcaa

SEQ ID NO: 3919089 - RNA, 17 nt, Human adenovirus D
ucgcggcgaacgagcca

SEQ ID NO: 3919090 - RNA, 22 nt, Human adenovirus D
ucgcggcugcugcugcugcuga

SEQ ID NO: 3919091 - RNA, 15 nt, Human adenovirus D
ucgcucuuaucccau

SEQ ID NO: 3919092 - RNA, 19 nt, Human adenovirus D
ucgcugaaaaacaggccgc

SEQ ID NO: 3919093 - RNA, 13 nt, Human adenovirus D
ucgcuggacccca

SEQ ID NO: 3919094 - RNA, 18 nt, Human adenovirus D
ucgcuggcugcuggagcu

SEQ ID NO: 3919095 - RNA, 19 nt, Human adenovirus D
ucgcuguccacgagcgcca

SEQ ID NO: 3919096 - RNA, 15 nt, Human adenovirus D
ucggacaugaacugc

SEQ ID NO: 3919097 - RNA, 15 nt, Human adenovirus D
ucggacgacugggag

SEQ ID NO: 3919098 - RNA, 12 nt, Human adenovirus D
ucggacuggguu

SEQ ID NO: 3919099 - RNA, 15 nt, Human adenovirus D
ucggagcuggcuccg

SEQ ID NO: 3919100 - RNA, 18 nt, Human adenovirus D
ucgggaucgccaggccuc

SEQ ID NO: 3919101 - RNA, 15 nt, Human adenovirus D
ucgggccccggggcg

SEQ ID NO: 3919102 - RNA, 18 nt, Human adenovirus D
ucggucagcuggcccggc

SEQ ID NO: 3919103 - RNA, 24 nt, Human adenovirus D
gaggaggacuuaaccacccacgag

SEQ ID NO: 3919104 - RNA, 22 nt, Human adenovirus D
gaggaugcacccgcugcggggu

SEQ ID NO: 3919105 - RNA, 12 nt, Human adenovirus D
gaggcaggccau

SEQ ID NO: 3919106 - RNA, 16 nt, Human adenovirus D
gaggcauggcaggcag

SEQ ID NO: 3919107 - RNA, 22 nt, Human adenovirus D
gaggccaucuaaacuaaagcca

SEQ ID NO: 3919108 - RNA, 13 nt, Human adenovirus D
gaggccaugcugc

SEQ ID NO: 3919109 - RNA, 14 nt, Human adenovirus D
gaggcgagcagcug

SEQ ID NO: 3919110 - RNA, 21 nt, Human adenovirus D
gaggcguucagggaggcgcug

SEQ ID NO: 3919111 - RNA, 19 nt, Human adenovirus D
gagggcaugggucaggcag

SEQ ID NO: 3919112 - RNA, 13 nt, Human adenovirus D
gagggccugggcu

SEQ ID NO: 3919113 - RNA, 14 nt, Human adenovirus D
gaggggcagcaacc

SEQ ID NO: 3919114 - RNA, 16 nt, Human adenovirus D
gaggggggccaccucg

SEQ ID NO: 3919115 - RNA, 21 nt, Human adenovirus D
gagggucacacuagcgcccug

SEQ ID NO: 3919116 - RNA, 17 nt, Human adenovirus D
gagggucgcuggcugcu

SEQ ID NO: 3919117 - RNA, 21 nt, Human adenovirus D
gagggugccagauugggggac

SEQ ID NO: 3919118 - RNA, 12 nt, Human adenovirus D
gaggguguccug

SEQ ID NO: 3919119 - RNA, 18 nt, Human adenovirus D
gagguacaugggcaugag

SEQ ID NO: 3919120 - RNA, 23 nt, Human adenovirus D
gaguccuuuagacaacagccgca

SEQ ID NO: 3919121 - RNA, 17 nt, Human adenovirus D
gaguggcggcccuggcu

SEQ ID NO: 3919122 - RNA, 15 nt, Human adenovirus D
gagugucccccgccg

SEQ ID NO: 3919123 - RNA, 22 nt, Human adenovirus D
gaguuccugauggaugugugga

SEQ ID NO: 3919124 - RNA, 17 nt, Human adenovirus D
gaguuggugagcucuuc

SEQ ID NO: 3919125 - RNA, 18 nt, Human adenovirus D
gauaaagcgugguaguuu

SEQ ID NO: 3919126 - RNA, 17 nt, Human adenovirus D
gggcgaaggugucccug

SEQ ID NO: 3919127 - RNA, 15 nt, Human adenovirus D
gggcgaagugcucaa

SEQ ID NO: 3919128 - RNA, 14 nt, Human adenovirus D
gggcgccuucaccg

SEQ ID NO: 3919129 - RNA, 18 nt, Human adenovirus D
gggcgcucccaaucccag

SEQ ID NO: 3919130 - RNA, 13 nt, Human adenovirus D
gggcggagagcga

SEQ ID NO: 3919131 - RNA, 14 nt, Human adenovirus D
gggcgggcagggag

SEQ ID NO: 3919132 - RNA, 14 nt, Human adenovirus D
gggcgugcagaccg

SEQ ID NO: 3919133 - RNA, 22 nt, Human adenovirus D
gggcucuuccuccguagccugg

SEQ ID NO: 3919134 - RNA, 23 nt, Human adenovirus D
gggcucuuccuccguagccuggc

SEQ ID NO: 3919135 - RNA, 15 nt, Human adenovirus D
gggcugcuagagugc

SEQ ID NO: 3919136 - RNA, 16 nt, Human adenovirus D
gggcuggcgagacugg

SEQ ID NO: 3919137 - RNA, 15 nt, Human adenovirus D
ggggacgagcugcuu

SEQ ID NO: 3919138 - RNA, 21 nt, Human adenovirus D
ggggcagacacaccaggaugc

SEQ ID NO: 3919139 - RNA, 14 nt, Human adenovirus D
ggggcggcagaggc

SEQ ID NO: 3919140 - RNA, 15 nt, Human adenovirus D
ggggcgggucugugc

SEQ ID NO: 3919141 - RNA, 17 nt, Human adenovirus D
ggggcucguuaguccag

SEQ ID NO: 3919142 - RNA, 20 nt, Human adenovirus D
gggguauuacuaggcccagc

SEQ ID NO: 3919143 - RNA, 23 nt, Human adenovirus D
cgcggacgcgcucccggcggcag

SEQ ID NO: 3919144 - RNA, 19 nt, Human adenovirus D
cgcggaugaagugcgcgua

SEQ ID NO: 3919145 - RNA, 12 nt, Human adenovirus D
cgcggcagaacc

SEQ ID NO: 3919146 - RNA, 13 nt, Human adenovirus D
cgcggccgcccac

SEQ ID NO: 3919147 - RNA, 17 nt, Human adenovirus D
cgcggcgaaacgcucug

SEQ ID NO: 3919148 - RNA, 19 nt, Human adenovirus D
cgcggcggcgauaugccag

SEQ ID NO: 3919149 - RNA, 12 nt, Human adenovirus D
cgcgggaagagc

SEQ ID NO: 3919150 - RNA, 16 nt, Human adenovirus D
cgcgggcggccauugc

SEQ ID NO: 3919151 - RNA, 20 nt, Human adenovirus D
cgcgguaacguuccaucagc

SEQ ID NO: 3919152 - RNA, 19 nt, Human adenovirus D
cgcgguucauugacagcgu

SEQ ID NO: 3919153 - RNA, 18 nt, Human adenovirus D
cgcguaagcaggagcagg

SEQ ID NO: 3919154 - RNA, 17 nt, Human adenovirus D
cgcuaccgcuccaugcu

SEQ ID NO: 3919155 - RNA, 13 nt, Human adenovirus D
cgcuagccagcca

SEQ ID NO: 3919156 - RNA, 14 nt, Human adenovirus D
cgcuccgcugaaac

SEQ ID NO: 3919157 - RNA, 19 nt, Human adenovirus D
cgcuccucgcucuggggcc

SEQ ID NO: 3919158 - RNA, 23 nt, Human adenovirus D
cgcucgaucaucuccccgcggcg

SEQ ID NO: 3919159 - RNA, 21 nt, Human adenovirus D
cgcucggugacaaacaggcug

SEQ ID NO: 3919160 - RNA, 14 nt, Human adenovirus D
cgcucguucugccc

SEQ ID NO: 3919161 - RNA, 16 nt, Human adenovirus D
cgcucuggggcccggc

SEQ ID NO: 3919162 - RNA, 20 nt, Human adenovirus D
cgcugagcgacgaccugggc

SEQ ID NO: 3919163 - RNA, 16 nt, Human adenovirus D
cgcugcaaagccagcc

SEQ ID NO: 3919164 - RNA, 17 nt, Human adenovirus D
cgcugcaaagccagccg

SEQ ID NO: 3919165 - RNA, 16 nt, Human adenovirus D
cgcugcugcagccgcc

SEQ ID NO: 3919166 - RNA, 18 nt, Human adenovirus D
cgcugcugccgcucaguc

SEQ ID NO: 3919167 - RNA, 19 nt, Human adenovirus D
cgcugcugccgcucaguca

SEQ ID NO: 3919168 - RNA, 19 nt, Human adenovirus D
cgcuggucacauccaucuc

SEQ ID NO: 3919169 - RNA, 13 nt, Human adenovirus D
cgcuguggagcca

SEQ ID NO: 3919170 - RNA, 20 nt, Human adenovirus D
cgcuuggugggcagaggagg

SEQ ID NO: 3919171 - RNA, 18 nt, Human adenovirus D
cggacauauggaauuucu

SEQ ID NO: 3919172 - RNA, 14 nt, Human adenovirus D
cggaccggucccag

SEQ ID NO: 3919173 - RNA, 16 nt, Human adenovirus D
cggaccggucccagcg

SEQ ID NO: 3919174 - RNA, 16 nt, Human adenovirus D
cggacgugcgcgaagc

SEQ ID NO: 3919175 - RNA, 21 nt, Human adenovirus D
cggagcaagucuacuggucgc

SEQ ID NO: 3919176 - RNA, 13 nt, Human adenovirus D
cggagcuggcucc

SEQ ID NO: 3919177 - RNA, 15 nt, Human adenovirus D
cggaguaccugagcc

SEQ ID NO: 3919178 - RNA, 16 nt, Human adenovirus D
cggaguaccugagccg

SEQ ID NO: 3919179 - RNA, 14 nt, Human adenovirus D
cggcaaaaaucaca

SEQ ID NO: 3919180 - RNA, 15 nt, Human adenovirus D
cggcaccagccagcu

SEQ ID NO: 3919181 - RNA, 21 nt, Human adenovirus D
cggcaccugcgagcccaaccc

SEQ ID NO: 3919182 - RNA, 23 nt, Human adenovirus D
cggcacgcggccguucaugggca

SEQ ID NO: 3919183 - RNA, 21 nt, Human adenovirus D
cggcacggucuggccggugag

SEQ ID NO: 3919184 - RNA, 19 nt, Human adenovirus D
cggcagcggggccuggugu

SEQ ID NO: 3919185 - RNA, 17 nt, Human adenovirus D
cggcaguauaucaggug

SEQ ID NO: 3919186 - RNA, 17 nt, Human adenovirus D
cggcaucuuugacaugg

SEQ ID NO: 3919187 - RNA, 15 nt, Human adenovirus D
cggccagcagggugc

SEQ ID NO: 3919188 - RNA, 23 nt, Human adenovirus D
cggccagcgucauguccuuccag

SEQ ID NO: 3919189 - RNA, 17 nt, Human adenovirus D
cggccaugccccaggcc

SEQ ID NO: 3919190 - RNA, 17 nt, Human adenovirus D
aggacgcagcgugaaga

SEQ ID NO: 3919191 - RNA, 17 nt, Human adenovirus D
aggacuacaaggccguc

SEQ ID NO: 3919192 - RNA, 15 nt, Human adenovirus D
aggagaacugcuggc

SEQ ID NO: 3919193 - RNA, 19 nt, Human adenovirus D
aggagaacugcuggcccug

SEQ ID NO: 3919194 - RNA, 22 nt, Human adenovirus D
aggagaacugcuggcccugcug

SEQ ID NO: 3919195 - RNA, 13 nt, Human adenovirus D
aggagaccugcac

SEQ ID NO: 3919196 - RNA, 14 nt, Human adenovirus D
aggagcaggaggag

SEQ ID NO: 3919197 - RNA, 16 nt, Human adenovirus D
aggagcgaugggggca

SEQ ID NO: 3919198 - RNA, 22 nt, Human adenovirus D
aggaggacuuaaccacccacga

SEQ ID NO: 3919199 - RNA, 16 nt, Human adenovirus D
aggaggaugugcugcu

SEQ ID NO: 3919200 - RNA, 23 nt, Human adenovirus D
aggaggauuugauguuggcuugc

SEQ ID NO: 3919201 - RNA, 15 nt, Human adenovirus D
aggagggauugcagg

SEQ ID NO: 3919202 - RNA, 17 nt, Human adenovirus D
aggagggauugcagggc

SEQ ID NO: 3919203 - RNA, 16 nt, Human adenovirus D
aggaggggggccaccu

SEQ ID NO: 3919204 - RNA, 17 nt, Human adenovirus D
aggauaaauauggccug

SEQ ID NO: 3919205 - RNA, 22 nt, Human adenovirus D
aggauacgcgggaagagcccuu

SEQ ID NO: 3919206 - RNA, 20 nt, Human adenovirus D
aggauggucaucacccucag

SEQ ID NO: 3919207 - RNA, 17 nt, Human adenovirus D
aggcaaagaucaccuac

SEQ ID NO: 3919208 - RNA, 13 nt, Human adenovirus D
aggcaaugagagg

SEQ ID NO: 3919209 - RNA, 15 nt, Human adenovirus D
aggcaggacucgcag

SEQ ID NO: 3919210 - RNA, 12 nt, Human adenovirus D
aggcccagaacu

SEQ ID NO: 3919211 - RNA, 23 nt, Human adenovirus D
aggccgggcugcacgaccucgga

SEQ ID NO: 3919212 - RNA, 17 nt, Human adenovirus D
aggccgucacccugccc

SEQ ID NO: 3919213 - RNA, 18 nt, Human adenovirus D
aggccgugaaggccggca

SEQ ID NO: 3919214 - RNA, 18 nt, Human adenovirus D
aggccgugcugcucgagc

SEQ ID NO: 3919215 - RNA, 13 nt, Human adenovirus D
aggccuggcccug

SEQ ID NO: 3919216 - RNA, 17 nt, Human adenovirus D
aggcgcaaccaggagga

SEQ ID NO: 3919217 - RNA, 17 nt, Human adenovirus D
aggcgcccagccagcaa

SEQ ID NO: 3919218 - RNA, 23 nt, Human adenovirus D
aggcgcgcguccacgccaagaca

SEQ ID NO: 3919219 - RNA, 19 nt, Human adenovirus D
aggcggcggucaccucaac

SEQ ID NO: 3919220 - RNA, 19 nt, Human adenovirus D
aggcgggacagaggaggga

SEQ ID NO: 3919221 - RNA, 12 nt, Human adenovirus D
aggcgugcacug

SEQ ID NO: 3919222 - RNA, 21 nt, Human adenovirus D
agggaaaagcucaaagaccag

SEQ ID NO: 3919223 - RNA, 13 nt, Human adenovirus D
agggacagcagcc

SEQ ID NO: 3919224 - RNA, 12 nt, Human adenovirus D
agggagccaggg

SEQ ID NO: 3919225 - RNA, 22 nt, Human adenovirus D
agggaugaguugggccugaugc

SEQ ID NO: 3919226 - RNA, 21 nt, Human adenovirus D
agggcacagccucucugaagc

SEQ ID NO: 3919227 - RNA, 22 nt, Human adenovirus D
agggcaucuucugccuggucaa

SEQ ID NO: 3919228 - RNA, 17 nt, Human adenovirus D
agggcgaccagcucugg

SEQ ID NO: 3919229 - RNA, 15 nt, Human adenovirus D
agggcgaggcgcggc

SEQ ID NO: 3919230 - RNA, 17 nt, Human adenovirus D
agggcguagagcuuggg

SEQ ID NO: 3919231 - RNA, 20 nt, Human adenovirus D
agggcuuccacgugcccgag

SEQ ID NO: 3919232 - RNA, 13 nt, Human adenovirus D
aggggacgugagc

SEQ ID NO: 3919233 - RNA, 15 nt, Human adenovirus D
aggggagugaagagg

SEQ ID NO: 3919234 - RNA, 21 nt, Human adenovirus D
aggggauguugaucagucagu

SEQ ID NO: 3919235 - RNA, 21 nt, Human adenovirus D
agggggacuuacuuugcaaga

SEQ ID NO: 3919236 - RNA, 14 nt, Human adenovirus D
agggggcgggucug

SEQ ID NO: 3919237 - RNA, 14 nt, Human adenovirus D
aggguugaaagauu

SEQ ID NO: 3919238 - RNA, 13 nt, Human adenovirus D
agguacaugggca

SEQ ID NO: 3919239 - RNA, 16 nt, Human adenovirus D
aggucaaaacccacuc

SEQ ID NO: 3919240 - RNA, 17 nt, Human adenovirus D
aggucagcagcaagagc

SEQ ID NO: 3919241 - RNA, 21 nt, Human adenovirus D
aggucccgguguugcgcccug

SEQ ID NO: 3919242 - RNA, 19 nt, Human adenovirus D
aggucuaaaaaccccgcca

SEQ ID NO: 3919243 - RNA, 14 nt, Human adenovirus D
aggucucgcuccac

SEQ ID NO: 3919244 - RNA, 14 nt, Human adenovirus D
aggucugcugguag

SEQ ID NO: 3919245 - RNA, 13 nt, Human adenovirus D
aggucuggggcgc

SEQ ID NO: 3919246 - RNA, 21 nt, Human adenovirus D
aggugacaaagagccgcuccg

SEQ ID NO: 3919247 - RNA, 14 nt, Human adenovirus D
aggugagcucgggc

SEQ ID NO: 3919248 - RNA, 21 nt, Human adenovirus D
aggugagcucgggcugcucgg

SEQ ID NO: 3919249 - RNA, 11 nt, Human adenovirus D
aggugcugccc

SEQ ID NO: 3919250 - RNA, 13 nt, Human adenovirus D
aggugcugcccca

SEQ ID NO: 3919251 - RNA, 13 nt, Human adenovirus D
aggugcuggcgau

SEQ ID NO: 3919252 - RNA, 15 nt, Human adenovirus D
agguggacgagcaga

SEQ ID NO: 3919253 - RNA, 18 nt, Human adenovirus D
agguggacgagcagaccu

SEQ ID NO: 3919254 - RNA, 17 nt, Human adenovirus D
agguggacgagccgccu

SEQ ID NO: 3919255 - RNA, 24 nt, Human adenovirus D
agguggacgagggggcaguagagu

SEQ ID NO: 3919256 - RNA, 14 nt, Human adenovirus D
agguggcuauuuuc

SEQ ID NO: 3919257 - RNA, 15 nt, Human adenovirus D
agguguaggccacgu

SEQ ID NO: 3919258 - RNA, 14 nt, Human adenovirus D
aggugucccugacc

SEQ ID NO: 3919259 - RNA, 15 nt, Human adenovirus D
agguguuggcaaagc

SEQ ID NO: 3919260 - RNA, 22 nt, Human adenovirus D
aguacaagcgccaacagcagcg

SEQ ID NO: 3919261 - RNA, 18 nt, Human adenovirus D
aguacauagugaccaaga

SEQ ID NO: 3919262 - RNA, 16 nt, Human adenovirus D
aguacauguucaccag

SEQ ID NO: 3919263 - RNA, 23 nt, Human adenovirus D
aguacgacaugcccgaccccaac

SEQ ID NO: 3919264 - RNA, 13 nt, Human adenovirus D
aguacgaggccau

SEQ ID NO: 3919265 - RNA, 20 nt, Human adenovirus D
aguaggacauggauuaaaaa

SEQ ID NO: 3919266 - RNA, 20 nt, Human adenovirus D
aguaugccaagauagcccug

SEQ ID NO: 3919267 - RNA, 20 nt, Human adenovirus D
aguaugucccuggcauggua

SEQ ID NO: 3919268 - RNA, 17 nt, Human adenovirus D
aguauugugggccuggg

SEQ ID NO: 3919269 - RNA, 22 nt, Human adenovirus D
agucaaucucccaccaccagcc

SEQ ID NO: 3919270 - RNA, 13 nt, Human adenovirus D
agucaggagcagc

SEQ ID NO: 3919271 - RNA, 11 nt, Human adenovirus D
agucaggcagg

SEQ ID NO: 3919272 - RNA, 14 nt, Human adenovirus D
aguccaccgcuccg

SEQ ID NO: 3919273 - RNA, 17 nt, Human adenovirus D
aguccagcagagucugc

SEQ ID NO: 3919274 - RNA, 19 nt, Human adenovirus D
agucugagggccacccuga

SEQ ID NO: 3919275 - RNA, 22 nt, Human adenovirus D
agugcuuacucuauaacauuug

SEQ ID NO: 3919276 - RNA, 18 nt, Human adenovirus D
aguggcaacaccugggca

SEQ ID NO: 3919277 - RNA, 16 nt, Human adenovirus D
aguucagcuccagugg

SEQ ID NO: 3919278 - RNA, 22 nt, Human adenovirus D
aguugacggucugcaggccggg

SEQ ID NO: 3919279 - RNA, 13 nt, Human adenovirus D
aguuggaggagau

SEQ ID NO: 3919280 - RNA, 18 nt, Human adenovirus D
aguugggccuccaggaau

SEQ ID NO: 3919281 - RNA, 13 nt, Human adenovirus D
aguugguccagau

SEQ ID NO: 3919282 - RNA, 16 nt, Human adenovirus D
aguuggugagcucuuc

SEQ ID NO: 3919283 - RNA, 16 nt, Human adenovirus D
aguuguaaugaucaaa

SEQ ID NO: 3919284 - RNA, 22 nt, Human adenovirus D
aguuucaaacccuacucgggca

SEQ ID NO: 3919285 - RNA, 23 nt, Human adenovirus D
aguuugcauagcuugccgggcuc

SEQ ID NO: 3919286 - RNA, 17 nt, Human adenovirus D
aguuuuucauccagaau

SEQ ID NO: 3919287 - RNA, 15 nt, Human adenovirus D
auaaagaauaugcca

SEQ ID NO: 3919288 - RNA, 19 nt, Human adenovirus D
auaaaguuuuucauccaga

SEQ ID NO: 3919289 - RNA, 14 nt, Human adenovirus D
auaagguucugccc

SEQ ID NO: 3919290 - RNA, 22 nt, Human adenovirus D
auaaguuaggguguaaguguga

SEQ ID NO: 3919291 - RNA, 12 nt, Human adenovirus D
auacaagccagg

SEQ ID NO: 3919292 - RNA, 20 nt, Human adenovirus D
auacagaugguagcagcaga

SEQ ID NO: 3919293 - RNA, 17 nt, Human adenovirus D
auagcaggggcgcuggg

SEQ ID NO: 3919294 - RNA, 13 nt, Human adenovirus D
auaguaaagaaac

SEQ ID NO: 3919295 - RNA, 17 nt, Human adenovirus D
aucaaaacgaccacagc

SEQ ID NO: 3919296 - RNA, 23 nt, Human adenovirus D
cgccccugcaagugcacagaccc

SEQ ID NO: 3919297 - RNA, 16 nt, Human adenovirus D
cgcccgacacugcagg

SEQ ID NO: 3919298 - RNA, 16 nt, Human adenovirus D
cgcccgagcucugcug

SEQ ID NO: 3919299 - RNA, 15 nt, Human adenovirus D
cgcccgccgccaggc

SEQ ID NO: 3919300 - RNA, 13 nt, Human adenovirus D
cgcccgcgccgcg

SEQ ID NO: 3919301 - RNA, 13 nt, Human adenovirus D
cgcccggggccag

SEQ ID NO: 3919302 - RNA, 15 nt, Human adenovirus D
cgcccucagcagucu

SEQ ID NO: 3919303 - RNA, 12 nt, Human adenovirus D
cgcccugagagc

SEQ ID NO: 3919304 - RNA, 20 nt, Human adenovirus D
cgccgaggagaacugcuggc

SEQ ID NO: 3919305 - RNA, 22 nt, Human adenovirus D
cgccgauuuaaagacccacagc

SEQ ID NO: 3919306 - RNA, 15 nt, Human adenovirus D
cgccgcaccauccgc

SEQ ID NO: 3919307 - RNA, 13 nt, Human adenovirus D
cgccgcaccuguc

SEQ ID NO: 3919308 - RNA, 16 nt, Human adenovirus D
cgccgccacugcaccc

SEQ ID NO: 3919309 - RNA, 14 nt, Human adenovirus D
cgccgccaggccca

SEQ ID NO: 3919310 - RNA, 14 nt, Human adenovirus D
cgccgccgccgcac

SEQ ID NO: 3919311 - RNA, 17 nt, Human adenovirus D
cgccgcgccgccacugc

SEQ ID NO: 3919312 - RNA, 15 nt, Human adenovirus D
cgccgcggccaucuc

SEQ ID NO: 3919313 - RNA, 17 nt, Human adenovirus D
cgccgcuaucugcucuu

SEQ ID NO: 3919314 - RNA, 19 nt, Human adenovirus D
cgccgcuguggagccacug

SEQ ID NO: 3919315 - RNA, 20 nt, Human adenovirus D
cgccgcuguggagccacugc

SEQ ID NO: 3919316 - RNA, 22 nt, Human adenovirus D
cgccggcgcuagccagccacag

SEQ ID NO: 3919317 - RNA, 22 nt, Human adenovirus D
cgccggcggcgggccaugcgca

SEQ ID NO: 3919318 - RNA, 14 nt, Human adenovirus D
cgccggcucaagca

SEQ ID NO: 3919319 - RNA, 15 nt, Human adenovirus D
cgccuccacccugga

SEQ ID NO: 3919320 - RNA, 16 nt, Human adenovirus D
cgccucggaccuggcc

SEQ ID NO: 3919321 - RNA, 18 nt, Human adenovirus D
cgccugaggcagacgcug

SEQ ID NO: 3919322 - RNA, 14 nt, Human adenovirus D
cgccugcuugcaag

SEQ ID NO: 3919323 - RNA, 19 nt, Human adenovirus D
cgccuucaccgaccugggu

SEQ ID NO: 3919324 - RNA, 16 nt, Human adenovirus D
cgcgaacagcagcagc

SEQ ID NO: 3919325 - RNA, 14 nt, Human adenovirus D
cgcgacccccaggc

SEQ ID NO: 3919326 - RNA, 20 nt, Human adenovirus D
cgcgagcaagggcgaccagc

SEQ ID NO: 3919327 - RNA, 21 nt, Human adenovirus D
cgcgagcugaugcugagccug

SEQ ID NO: 3919328 - RNA, 17 nt, Human adenovirus D
cgcgaggacaccaguac

SEQ ID NO: 3919329 - RNA, 15 nt, Human adenovirus D
cgcgaggacgcagcg

SEQ ID NO: 3919330 - RNA, 18 nt, Human adenovirus D
cgcgaggagguggcccug

SEQ ID NO: 3919331 - RNA, 22 nt, Human adenovirus D
cgcgaggagguggcccugggcc

SEQ ID NO: 3919332 - RNA, 17 nt, Human adenovirus D
cgcgaggccauaggcca

SEQ ID NO: 3919333 - RNA, 21 nt, Human adenovirus D
cgcgagggccuggaccgccag

SEQ ID NO: 3919334 - RNA, 17 nt, Human adenovirus D
cgcgauguugagcugga

SEQ ID NO: 3919335 - RNA, 16 nt, Human adenovirus D
cgcgcaacugggccgc

SEQ ID NO: 3919336 - RNA, 23 nt, Human adenovirus D
cgcgcaucaucgcgccacuggcc

SEQ ID NO: 3919337 - RNA, 17 nt, Human adenovirus D
cgcgcaugaccaccugc

SEQ ID NO: 3919338 - RNA, 12 nt, Human adenovirus D
cgcgccacuccc

SEQ ID NO: 3919339 - RNA, 14 nt, Human adenovirus D
cgcgcccacccgga

SEQ ID NO: 3919340 - RNA, 14 nt, Human adenovirus D
cgcgcccgcagcac

SEQ ID NO: 3919341 - RNA, 17 nt, Human adenovirus D
cgcgcccggggccaggu

SEQ ID NO: 3919342 - RNA, 21 nt, Human adenovirus D
cgcgcccuucaccgacagugg

SEQ ID NO: 3919343 - RNA, 12 nt, Human adenovirus D
cgcgccgcggcg

SEQ ID NO: 3919344 - RNA, 14 nt, Human adenovirus D
cgcgcgccgcgccg

SEQ ID NO: 3919345 - RNA, 13 nt, Human adenovirus D
cgcgcgcugcccg

SEQ ID NO: 3919346 - RNA, 18 nt, Human adenovirus D
cgcgcgguaggcccuggu

SEQ ID NO: 3919347 - RNA, 14 nt, Human adenovirus D
cgcgcuccacggug

SEQ ID NO: 3919348 - RNA, 16 nt, Human adenovirus D
cgcgcuccacgguggc

SEQ ID NO: 3919349 - RNA, 18 nt, Human adenovirus D
cgcgcuggggagggccac

SEQ ID NO: 3919350 - RNA, 16 nt, Human adenovirus D
cgcgcuugcugggcga

SEQ ID NO: 3919351 - RNA, 17 nt, Human adenovirus D
cgcggaucucacggccu

SEQ ID NO: 3919352 - RNA, 15 nt, Human adenovirus D
cgcggcacggcacgc

SEQ ID NO: 3919353 - RNA, 19 nt, Human adenovirus D
cgcggccagcgucaugucc

SEQ ID NO: 3919354 - RNA, 20 nt, Human adenovirus D
cgcggcgggggcggagagcg

SEQ ID NO: 3919355 - RNA, 12 nt, Human adenovirus D
cgcggcugcugc

SEQ ID NO: 3919356 - RNA, 13 nt, Human adenovirus D
cgcggcugcugcu

SEQ ID NO: 3919357 - RNA, 16 nt, Human adenovirus D
cgcgggaagagcccuu

SEQ ID NO: 3919358 - RNA, 17 nt, Human adenovirus D
cgcgggcggacugccac

SEQ ID NO: 3919359 - RNA, 21 nt, Human adenovirus D
cgcgggcuguggggcgugcag

SEQ ID NO: 3919360 - RNA, 24 nt, Human adenovirus D
cgcguaaauuggaaggggcgcagg

SEQ ID NO: 3919361 - RNA, 18 nt, Human adenovirus D
cgcgucauggcuggucag

SEQ ID NO: 3919362 - RNA, 15 nt, Human adenovirus D
cgcgugacgcacugg

SEQ ID NO: 3919363 - RNA, 16 nt, Human adenovirus D
cgcgugacgcacuggc

SEQ ID NO: 3919364 - RNA, 13 nt, Human adenovirus D
cgcguggaggaag

SEQ ID NO: 3919365 - RNA, 21 nt, Human adenovirus D
cgcguggaggaagugcuggac

SEQ ID NO: 3919366 - RNA, 17 nt, Human adenovirus D
cgcguucucacuuccuc

SEQ ID NO: 3919367 - RNA, 12 nt, Human adenovirus D
cgcuagccagcc

SEQ ID NO: 3919368 - RNA, 24 nt, Human adenovirus D
cgcucaggaccauagggagccugc

SEQ ID NO: 3919369 - RNA, 17 nt, Human adenovirus D
cgcuccaccgaaggcag

SEQ ID NO: 3919370 - RNA, 23 nt, Human adenovirus D
cgcuccgugcgaggaugagagcc

SEQ ID NO: 3919371 - RNA, 16 nt, Human adenovirus D
cgcucgggcagguccc

SEQ ID NO: 3919372 - RNA, 16 nt, Human adenovirus D
cgcugagcuaccgcga

SEQ ID NO: 3919373 - RNA, 16 nt, Human adenovirus D
cgcugccggaccucau

SEQ ID NO: 3919374 - RNA, 15 nt, Human adenovirus D
cgcugcugcagccgc

SEQ ID NO: 3919375 - RNA, 12 nt, Human adenovirus D
cgcuggccagca

SEQ ID NO: 3919376 - RNA, 14 nt, Human adenovirus D
cgcuggccagcacg

SEQ ID NO: 3919377 - RNA, 13 nt, Human adenovirus D
cgcuggggcagaa

SEQ ID NO: 3919378 - RNA, 14 nt, Human adenovirus D
cgcuggggcugcuc

SEQ ID NO: 3919379 - RNA, 20 nt, Human adenovirus D
cgcugguagggggcgccgcc

SEQ ID NO: 3919380 - RNA, 17 nt, Human adenovirus D
cgcuucuuaccucgcgu

SEQ ID NO: 3919381 - RNA, 19 nt, Human adenovirus D
cgcuuggugggcagaggag

SEQ ID NO: 3919382 - RNA, 12 nt, Human adenovirus D
cggaaaacagga

SEQ ID NO: 3919383 - RNA, 17 nt, Human adenovirus D
cggaaacgccaccaccu

SEQ ID NO: 3919384 - RNA, 16 nt, Human adenovirus D
cggaccccgccauaag

SEQ ID NO: 3919385 - RNA, 23 nt, Human adenovirus D
cggaccugcauuggcagccgagc

SEQ ID NO: 3919386 - RNA, 17 nt, Human adenovirus D
cggacgacugggaggcu

SEQ ID NO: 3919387 - RNA, 17 nt, Human adenovirus D
cggacguggugcugcug

SEQ ID NO: 3919388 - RNA, 18 nt, Human adenovirus D
cggacguggugcugcugc

SEQ ID NO: 3919389 - RNA, 15 nt, Human adenovirus D
cggacugccaccgcc

SEQ ID NO: 3919390 - RNA, 20 nt, Human adenovirus D
cggaggccaucgugcagaac

SEQ ID NO: 3919391 - RNA, 13 nt, Human adenovirus D
cggaggcuggcug

SEQ ID NO: 3919392 - RNA, 14 nt, Human adenovirus D
cggagggcagaaac

SEQ ID NO: 3919393 - RNA, 16 nt, Human adenovirus D
cggaguggccucucgc

SEQ ID NO: 3919394 - RNA, 20 nt, Human adenovirus D
cggcaaaauggcgugcugga

SEQ ID NO: 3919395 - RNA, 22 nt, Human adenovirus D
cggcaaaauggcgugcuggaga

SEQ ID NO: 3919396 - RNA, 22 nt, Human adenovirus D
cggcaaucaacuacucggugcu

SEQ ID NO: 3919397 - RNA, 11 nt, Human adenovirus D
cggcaccugcg

SEQ ID NO: 3919398 - RNA, 20 nt, Human adenovirus D
cggcagggugagccggccgc

SEQ ID NO: 3919399 - RNA, 15 nt, Human adenovirus D
cggccaaggccacca

SEQ ID NO: 3919400 - RNA, 19 nt, Human adenovirus D
cggccaaucagcaguagcc

SEQ ID NO: 3919401 - RNA, 20 nt, Human adenovirus D
cggccaauguuacgcugccc

SEQ ID NO: 3919402 - RNA, 13 nt, Human adenovirus D
cggccaccagucc

SEQ ID NO: 3919403 - RNA, 17 nt, Human adenovirus D
cggccauucuggaggcg

SEQ ID NO: 3919404 - RNA, 21 nt, Human adenovirus D
cggccauucuggaggcggugg

SEQ ID NO: 3919405 - RNA, 19 nt, Human adenovirus D
cggcccggcacggcggugg

SEQ ID NO: 3919406 - RNA, 16 nt, Human adenovirus D
cggccgaaaaccccgc

SEQ ID NO: 3919407 - RNA, 17 nt, Human adenovirus D
cggccgaggaggagcgc

SEQ ID NO: 3919408 - RNA, 17 nt, Human adenovirus D
  misc_feature (8)..(8): n is a, c, g or u
cggccgangggagucgc

SEQ ID NO: 3919409 - RNA, 12 nt, Human adenovirus D
cggccgccgccg

SEQ ID NO: 3919410 - RNA, 16 nt, Human adenovirus D
cggccgcggcgagcgg

SEQ ID NO: 3919411 - RNA, 17 nt, Human adenovirus D
cggccguucaugggcac

SEQ ID NO: 3919412 - RNA, 17 nt, Human adenovirus D
cggccugaaccgccgcc

SEQ ID NO: 3919413 - RNA, 22 nt, Human adenovirus D
cggccugcgucaucacccaggg

SEQ ID NO: 3919414 - RNA, 21 nt, Human adenovirus D
cggccuuguagggacagcagc

SEQ ID NO: 3919415 - RNA, 22 nt, Human adenovirus D
cggcgaugacugaccaccaccu

SEQ ID NO: 3919416 - RNA, 13 nt, Human adenovirus D
cggcgcaggggca

SEQ ID NO: 3919417 - RNA, 20 nt, Human adenovirus D
cggcgcgcccggggccaggu

SEQ ID NO: 3919418 - RNA, 12 nt, Human adenovirus D
cggcgcggagca

SEQ ID NO: 3919419 - RNA, 21 nt, Human adenovirus D
cggcgcuuggugggcagagga

SEQ ID NO: 3919420 - RNA, 22 nt, Human adenovirus D
cggcgcuuggugggcagaggag

SEQ ID NO: 3919421 - RNA, 15 nt, Human adenovirus D
cggcggcgcuucccg

SEQ ID NO: 3919422 - RNA, 20 nt, Human adenovirus D
cggcguggcgcucgggcagg

SEQ ID NO: 3919423 - RNA, 11 nt, Human adenovirus D
cggcugcugcu

SEQ ID NO: 3919424 - RNA, 17 nt, Human adenovirus D
cggcuuacaacagccuu

SEQ ID NO: 3919425 - RNA, 14 nt, Human adenovirus D
cgggaucaagcgcg

SEQ ID NO: 3919426 - RNA, 16 nt, Human adenovirus D
cgggccccggggcgaa

SEQ ID NO: 3919427 - RNA, 19 nt, Human adenovirus D
cgggccugggcgugcagac

SEQ ID NO: 3919428 - RNA, 19 nt, Human adenovirus D
cgggcgccucccaggacua

SEQ ID NO: 3919429 - RNA, 22 nt, Human adenovirus D
cgggcggcgaacuuucuccaca

SEQ ID NO: 3919430 - RNA, 14 nt, Human adenovirus D
cgggcuaccgcggc

SEQ ID NO: 3919431 - RNA, 21 nt, Human adenovirus D
cgggcugcuucugccugguga

SEQ ID NO: 3919432 - RNA, 19 nt, Human adenovirus D
cggggaaggucucgcucca

SEQ ID NO: 3919433 - RNA, 18 nt, Human adenovirus D
cggggccacgaccgugcc

SEQ ID NO: 3919434 - RNA, 21 nt, Human adenovirus D
cggggccuucgaaggggggcu

SEQ ID NO: 3919435 - RNA, 22 nt, Human adenovirus D
cggggcucggugcggcugcugc

SEQ ID NO: 3919436 - RNA, 15 nt, Human adenovirus D
cgggggcagacacac

SEQ ID NO: 3919437 - RNA, 22 nt, Human adenovirus D
cggggguucauguugugcagga

SEQ ID NO: 3919438 - RNA, 23 nt, Human adenovirus D
cggggguucauguugugcaggac

SEQ ID NO: 3919439 - RNA, 16 nt, Human adenovirus D
cgggguugcagcacug

SEQ ID NO: 3919440 - RNA, 21 nt, Human adenovirus D
cggguauaaaaacccugguga

SEQ ID NO: 3919441 - RNA, 22 nt, Human adenovirus D
cggguauaaaaacccuggugau

SEQ ID NO: 3919442 - RNA, 15 nt, Human adenovirus D
cgggugagggcgugc

SEQ ID NO: 3919443 - RNA, 15 nt, Human adenovirus D
cgggugaugguggcu

SEQ ID NO: 3919444 - RNA, 21 nt, Human adenovirus D
cgggugcuagacauggccagc

SEQ ID NO: 3919445 - RNA, 22 nt, Human adenovirus D
cgguacacgggguugcagcacu

SEQ ID NO: 3919446 - RNA, 15 nt, Human adenovirus D
cggucaggagcaagc

SEQ ID NO: 3919447 - RNA, 13 nt, Human adenovirus D
cgguccccgaggc

SEQ ID NO: 3919448 - RNA, 21 nt, Human adenovirus D
cgguggauuuuuuccaagacc

SEQ ID NO: 3919449 - RNA, 15 nt, Human adenovirus D
cgguugugcagcccc

SEQ ID NO: 3919450 - RNA, 14 nt, Human adenovirus D
cguaagcaggagca

SEQ ID NO: 3919451 - RNA, 17 nt, Human adenovirus D
cguaagcaggagcagga

SEQ ID NO: 3919452 - RNA, 23 nt, Human adenovirus D
cgucaaccucccgcccaagguca

SEQ ID NO: 3919453 - RNA, 20 nt, Human adenovirus D
cgucacccugcccuuccagc

SEQ ID NO: 3919454 - RNA, 21 nt, Human adenovirus D
cgucacggugaaggggugggc

SEQ ID NO: 3919455 - RNA, 15 nt, Human adenovirus D
cgucaggcaggcaug

SEQ ID NO: 3919456 - RNA, 15 nt, Human adenovirus D
cgucaucacccaggg

SEQ ID NO: 3919457 - RNA, 11 nt, Human adenovirus D
cgucccagcag

SEQ ID NO: 3919458 - RNA, 14 nt, Human adenovirus D
cgucccagcagcac

SEQ ID NO: 3919459 - RNA, 13 nt, Human adenovirus D
cgucccaggaaac

SEQ ID NO: 3919460 - RNA, 15 nt, Human adenovirus D
cgucccgacgaggcc

SEQ ID NO: 3919461 - RNA, 13 nt, Human adenovirus D
cguccgcggccac

SEQ ID NO: 3919462 - RNA, 14 nt, Human adenovirus D
cguccgucagcagc

SEQ ID NO: 3919463 - RNA, 13 nt, Human adenovirus D
cguccuggaccgc

SEQ ID NO: 3919464 - RNA, 16 nt, Human adenovirus D
cgucgacggcgccucc

SEQ ID NO: 3919465 - RNA, 15 nt, Human adenovirus D
cgucgagcacagcac

SEQ ID NO: 3919466 - RNA, 17 nt, Human adenovirus D
cgucgcuguccacgagc

SEQ ID NO: 3919467 - RNA, 15 nt, Human adenovirus D
cgucgcuugacagca

SEQ ID NO: 3919468 - RNA, 12 nt, Human adenovirus D
cgucggaagagg

SEQ ID NO: 3919469 - RNA, 13 nt, Human adenovirus D
cgucggaagagga

SEQ ID NO: 3919470 - RNA, 15 nt, Human adenovirus D
cgucggaagaggagu

SEQ ID NO: 3919471 - RNA, 15 nt, Human adenovirus D
cgucggccaugggca

SEQ ID NO: 3919472 - RNA, 23 nt, Human adenovirus D
cgucuacacagacaaacauccau

SEQ ID NO: 3919473 - RNA, 14 nt, Human adenovirus D
cgucuacucccagc

SEQ ID NO: 3919474 - RNA, 17 nt, Human adenovirus D
cgucugaaaaccaagga

SEQ ID NO: 3919475 - RNA, 20 nt, Human adenovirus D
cgucugacugccgccggcca

SEQ ID NO: 3919476 - RNA, 15 nt, Human adenovirus D
cgugaacgcgcuggc

SEQ ID NO: 3919477 - RNA, 19 nt, Human adenovirus D
cgugaccugcagcaggugc

SEQ ID NO: 3919478 - RNA, 12 nt, Human adenovirus D
cgugcaggcgcc

SEQ ID NO: 3919479 - RNA, 20 nt, Human adenovirus D
cgugccauccgucacccaga

SEQ ID NO: 3919480 - RNA, 12 nt, Human adenovirus D
cgugccugcucu

SEQ ID NO: 3919481 - RNA, 17 nt, Human adenovirus D
cgugcgcgaccugggcu

SEQ ID NO: 3919482 - RNA, 21 nt, Human adenovirus D
cguggacgcugcucaccaccc

SEQ ID NO: 3919483 - RNA, 21 nt, Human adenovirus D
cguggccucuucgcccgaccg

SEQ ID NO: 3919484 - RNA, 14 nt, Human adenovirus D
cguggugcugcugc

SEQ ID NO: 3919485 - RNA, 15 nt, Human adenovirus D
cguggugcuggauga

SEQ ID NO: 3919486 - RNA, 16 nt, Human adenovirus D
cguguaccgcaacgac

SEQ ID NO: 3919487 - RNA, 16 nt, Human adenovirus D
cguuccaucagcacgu

SEQ ID NO: 3919488 - RNA, 16 nt, Human adenovirus D
cuaacuuauacuacca

SEQ ID NO: 3919489 - RNA, 21 nt, Human adenovirus D
cuaaugacaaacaaaagccau

SEQ ID NO: 3919490 - RNA, 12 nt, Human adenovirus D
cuacaaggccgu

SEQ ID NO: 3919491 - RNA, 20 nt, Human adenovirus D
cuacaaucgccacaggugcu

SEQ ID NO: 3919492 - RNA, 13 nt, Human adenovirus D
cuacagaaacauc

SEQ ID NO: 3919493 - RNA, 16 nt, Human adenovirus D
cuacagccagcagcuc

SEQ ID NO: 3919494 - RNA, 17 nt, Human adenovirus D
cuacaugcccagcagca

SEQ ID NO: 3919495 - RNA, 13 nt, Human adenovirus D
cuacauucuggac

SEQ ID NO: 3919496 - RNA, 15 nt, Human adenovirus D
cuaccacgcccauga

SEQ ID NO: 3919497 - RNA, 16 nt, Human adenovirus D
cuaccagggcuuccac

SEQ ID NO: 3919498 - RNA, 19 nt, Human adenovirus D
cuacccacugacuuagcuc

SEQ ID NO: 3919499 - RNA, 16 nt, Human adenovirus D
cuaccgggacccugag

SEQ ID NO: 3919500 - RNA, 12 nt, Human adenovirus D
cuaccugggagg

SEQ ID NO: 3919501 - RNA, 15 nt, Human adenovirus D
cuaccugggaggaga

SEQ ID NO: 3919502 - RNA, 15 nt, Human adenovirus D
cuacggagggcagaa

SEQ ID NO: 3919503 - RNA, 20 nt, Human adenovirus D
cuacggagggcagaaacagc

SEQ ID NO: 3919504 - RNA, 21 nt, Human adenovirus D
cuacggcaucucgauccagca

SEQ ID NO: 3919505 - RNA, 22 nt, Human adenovirus D
cuacggcaucucgauccagcag

SEQ ID NO: 3919506 - RNA, 20 nt, Human adenovirus D
cuacugcaucuguccaaccc

SEQ ID NO: 3919507 - RNA, 19 nt, Human adenovirus D
cuagacauggccagcacgu

SEQ ID NO: 3919508 - RNA, 22 nt, Human adenovirus D
cuaggaagugcggcggcggcug

SEQ ID NO: 3919509 - RNA, 17 nt, Human adenovirus D
cuauaaaaacaacaaaa

SEQ ID NO: 3919510 - RNA, 19 nt, Human adenovirus D
cuauacgggcgaguacgac

SEQ ID NO: 3919511 - RNA, 15 nt, Human adenovirus D
cuaucuaugaaagca

SEQ ID NO: 3919512 - RNA, 18 nt, Human adenovirus D
cuaugagaugccccagca

SEQ ID NO: 3919513 - RNA, 19 nt, Human adenovirus D
cuaugagaugccccagcag

SEQ ID NO: 3919514 - RNA, 14 nt, Human adenovirus D
cuauuacugccacu

SEQ ID NO: 3919515 - RNA, 16 nt, Human adenovirus D
cucaaagaccagaacu

SEQ ID NO: 3919516 - RNA, 22 nt, Human adenovirus D
cucaaagaccagaacuuccagc

SEQ ID NO: 3919517 - RNA, 12 nt, Human adenovirus D
cucaacaucaca

SEQ ID NO: 3919518 - RNA, 21 nt, Human adenovirus D
cucaacaucacauucaaaaac

SEQ ID NO: 3919519 - RNA, 16 nt, Human adenovirus D
cucaacgcccaggcaa

SEQ ID NO: 3919520 - RNA, 18 nt, Human adenovirus D
cucaauaaacagcacuuu

SEQ ID NO: 3919521 - RNA, 19 nt, Human adenovirus D
cucacaguaagugcagcac

SEQ ID NO: 3919522 - RNA, 21 nt, Human adenovirus D
cucacaguaagugcagcacau

SEQ ID NO: 3919523 - RNA, 18 nt, Human adenovirus D
cucacaguccaggucaca

SEQ ID NO: 3919524 - RNA, 14 nt, Human adenovirus D
cucacccuggggcu

SEQ ID NO: 3919525 - RNA, 22 nt, Human adenovirus D
cucacccuggggcuccucgagg

SEQ ID NO: 3919526 - RNA, 17 nt, Human adenovirus D
cucagcagucucugccg

SEQ ID NO: 3919527 - RNA, 20 nt, Human adenovirus D
cucagcgucgaggagcugug

SEQ ID NO: 3919528 - RNA, 18 nt, Human adenovirus D
cuccaccgaaggcagcuc

SEQ ID NO: 3919529 - RNA, 16 nt, Human adenovirus D
cuccacgugccgcgcg

SEQ ID NO: 3919530 - RNA, 15 nt, Human adenovirus D
cuccacucgacccug

SEQ ID NO: 3919531 - RNA, 21 nt, Human adenovirus D
cucccaacucugguacuccag

SEQ ID NO: 3919532 - RNA, 13 nt, Human adenovirus D
cucccaaguucaa

SEQ ID NO: 3919533 - RNA, 15 nt, Human adenovirus D
cucccaccaccagcc

SEQ ID NO: 3919534 - RNA, 15 nt, Human adenovirus D
cucccucguacgaga

SEQ ID NO: 3919535 - RNA, 23 nt, Human adenovirus D
auccagaauucaaccacaccugu

SEQ ID NO: 3919536 - RNA, 19 nt, Human adenovirus D
auccagcggcgcaggggca

SEQ ID NO: 3919537 - RNA, 18 nt, Human adenovirus D
auccaguuaaugcugccu

SEQ ID NO: 3919538 - RNA, 14 nt, Human adenovirus D
aucccaacagccuu

SEQ ID NO: 3919539 - RNA, 14 nt, Human adenovirus D
aucccgccgcagga

SEQ ID NO: 3919540 - RNA, 15 nt, Human adenovirus D
aucccggccaaggcc

SEQ ID NO: 3919541 - RNA, 18 nt, Human adenovirus D
auccgcagcuacaccucc

SEQ ID NO: 3919542 - RNA, 21 nt, Human adenovirus D
auccgcagcuacaccucccuc

SEQ ID NO: 3919543 - RNA, 13 nt, Human adenovirus D
auccgugugcugu

SEQ ID NO: 3919544 - RNA, 17 nt, Human adenovirus D
auccugaucucugccau

SEQ ID NO: 3919545 - RNA, 19 nt, Human adenovirus D
auccugaucucugccaugu

SEQ ID NO: 3919546 - RNA, 12 nt, Human adenovirus D
aucgccgagccc

SEQ ID NO: 3919547 - RNA, 14 nt, Human adenovirus D
aucgcgcaggaggc

SEQ ID NO: 3919548 - RNA, 22 nt, Human adenovirus D
aucgcggcggccaucggcacga

SEQ ID NO: 3919549 - RNA, 19 nt, Human adenovirus D
aucgcgggcuuuguaacuc

SEQ ID NO: 3919550 - RNA, 21 nt, Human adenovirus D
aucgcgggcuuuguaacucua

SEQ ID NO: 3919551 - RNA, 17 nt, Human adenovirus D
aucucccaccaccagcc

SEQ ID NO: 3919552 - RNA, 17 nt, Human adenovirus D
aucuccuccuccuggag

SEQ ID NO: 3919553 - RNA, 12 nt, Human adenovirus D
aucucuagcaug

SEQ ID NO: 3919554 - RNA, 19 nt, Human adenovirus D
aucucuagcaugaccagac

SEQ ID NO: 3919555 - RNA, 15 nt, Human adenovirus D
aucuuuaucugcugg

SEQ ID NO: 3919556 - RNA, 18 nt, Human adenovirus D
augaagguagaagaccau

SEQ ID NO: 3919557 - RNA, 13 nt, Human adenovirus D
augaaucgcgggc

SEQ ID NO: 3919558 - RNA, 13 nt, Human adenovirus D
augaauuccauga

SEQ ID NO: 3919559 - RNA, 18 nt, Human adenovirus D
augaauuuugggcggagg

SEQ ID NO: 3919560 - RNA, 14 nt, Human adenovirus D
augacucaugggcg

SEQ ID NO: 3919561 - RNA, 12 nt, Human adenovirus D
augagggucugg

SEQ ID NO: 3919562 - RNA, 21 nt, Human adenovirus D
augauccagcggcgcaggggc

SEQ ID NO: 3919563 - RNA, 13 nt, Human adenovirus D
augaucccaacag

SEQ ID NO: 3919564 - RNA, 15 nt, Human adenovirus D
augcaaaaucuuaca

SEQ ID NO: 3919565 - RNA, 17 nt, Human adenovirus D
augcacaucgccgggca

SEQ ID NO: 3919566 - RNA, 15 nt, Human adenovirus D
augcacccgcugcgg

SEQ ID NO: 3919567 - RNA, 24 nt, Human adenovirus D
augcacccguaaaugacucuccug

SEQ ID NO: 3919568 - RNA, 20 nt, Human adenovirus D
augcaccugggcgccagaag

SEQ ID NO: 3919569 - RNA, 18 nt, Human adenovirus D
augcaccuguggagggca

SEQ ID NO: 3919570 - RNA, 20 nt, Human adenovirus D
augcaccugugggaccuggc

SEQ ID NO: 3919571 - RNA, 19 nt, Human adenovirus D
augcagacacuugagcugg

SEQ ID NO: 3919572 - RNA, 21 nt, Human adenovirus D
augcaggauaaauauggccug

SEQ ID NO: 3919573 - RNA, 21 nt, Human adenovirus D
augcauggccagccuuacuca

SEQ ID NO: 3919574 - RNA, 17 nt, Human adenovirus D
augccaucaacauccac

SEQ ID NO: 3919575 - RNA, 23 nt, Human adenovirus D
augccgaagaagaacaggagccg

SEQ ID NO: 3919576 - RNA, 21 nt, Human adenovirus D
augccuucgugcacuggcccg

SEQ ID NO: 3919577 - RNA, 22 nt, Human adenovirus D
augcggagccgcucggccaugc

SEQ ID NO: 3919578 - RNA, 19 nt, Human adenovirus D
augcuguggucgacuugca

SEQ ID NO: 3919579 - RNA, 18 nt, Human adenovirus D
auggaacccaaaguauga

SEQ ID NO: 3919580 - RNA, 17 nt, Human adenovirus D
auggacgggaaccccac

SEQ ID NO: 3919581 - RNA, 14 nt, Human adenovirus D
auggcaggcagcgg

SEQ ID NO: 3919582 - RNA, 19 nt, Human adenovirus D
auggcccugacgacccgca

SEQ ID NO: 3919583 - RNA, 13 nt, Human adenovirus D
auggccuggagca

SEQ ID NO: 3919584 - RNA, 20 nt, Human adenovirus D
auggcgcaggcgacccugga

SEQ ID NO: 3919585 - RNA, 14 nt, Human adenovirus D
auggcgugcuggag

SEQ ID NO: 3919586 - RNA, 15 nt, Human adenovirus D
auggcugcuggaugg

SEQ ID NO: 3919587 - RNA, 18 nt, Human adenovirus D
augggaaugagagccgga

SEQ ID NO: 3919588 - RNA, 16 nt, Human adenovirus D
augggccuggccgcgg

SEQ ID NO: 3919589 - RNA, 23 nt, Human adenovirus D
augggccuggccgcgggcgccuc

SEQ ID NO: 3919590 - RNA, 16 nt, Human adenovirus D
auguacuacaacagua

SEQ ID NO: 3919591 - RNA, 19 nt, Human adenovirus D
auguccaccugcggggcga

SEQ ID NO: 3919592 - RNA, 19 nt, Human adenovirus D
augucgacgaagcgguggu

SEQ ID NO: 3919593 - RNA, 22 nt, Human adenovirus D
augugcaguuuggccuggaucu

SEQ ID NO: 3919594 - RNA, 14 nt, Human adenovirus D
auuaaaaagcagca

SEQ ID NO: 3919595 - RNA, 19 nt, Human adenovirus D
auuacuaggcccagcagca

SEQ ID NO: 3919596 - RNA, 22 nt, Human adenovirus D
auuacucgcaaaaauaaaucau

SEQ ID NO: 3919597 - RNA, 19 nt, Human adenovirus D
auuagcuaaugugucuuug

SEQ ID NO: 3919598 - RNA, 13 nt, Human adenovirus D
auuaugcuccugg

SEQ ID NO: 3919599 - RNA, 20 nt, Human adenovirus D
auuccugcaccauccccagg

SEQ ID NO: 3919600 - RNA, 23 nt, Human adenovirus D
auugaaauacccaacaaccuuac

SEQ ID NO: 3919601 - RNA, 21 nt, Human adenovirus D
auugauuuuuacaccagcgcg

SEQ ID NO: 3919602 - RNA, 19 nt, Human adenovirus D
auugucaagcuugguggca

SEQ ID NO: 3919603 - RNA, 16 nt, Human adenovirus D
auuucagaaccaugaa

SEQ ID NO: 3919604 - RNA, 13 nt, Human adenovirus D
auuucuuccucug

SEQ ID NO: 3919605 - RNA, 13 nt, Human adenovirus D
auuugaaaccacu

SEQ ID NO: 3919606 - RNA, 22 nt, Human adenovirus D
auuuucauugucuucccucuca

SEQ ID NO: 3919607 - RNA, 15 nt, Human adenovirus D
auuuuuuccaagacc

SEQ ID NO: 3919608 - RNA, 19 nt, Human adenovirus D
caaaaacagacuggucaaa

SEQ ID NO: 3919609 - RNA, 24 nt, Human adenovirus D
caaaaaugaagcccugcuauggcu

SEQ ID NO: 3919610 - RNA, 15 nt, Human adenovirus D
caaaacgaccacagc

SEQ ID NO: 3919611 - RNA, 14 nt, Human adenovirus D
caaaagaaaacuaa

SEQ ID NO: 3919612 - RNA, 21 nt, Human adenovirus D
caaaaucgagcaggaccuggg

SEQ ID NO: 3919613 - RNA, 23 nt, Human adenovirus D
caaaaucgagcaggaccugggcu

SEQ ID NO: 3919614 - RNA, 21 nt, Human adenovirus D
caaacaggcugucgguguccc

SEQ ID NO: 3919615 - RNA, 17 nt, Human adenovirus D
caaacuagcagacaggg

SEQ ID NO: 3919616 - RNA, 21 nt, Human adenovirus D
caaagaccagaacuuccagca

SEQ ID NO: 3919617 - RNA, 13 nt, Human adenovirus D
caaagagccgcuc

SEQ ID NO: 3919618 - RNA, 18 nt, Human adenovirus D
caaagcgguugagcuggg

SEQ ID NO: 3919619 - RNA, 18 nt, Human adenovirus D
caaaguaaaaaaccgguc

SEQ ID NO: 3919620 - RNA, 11 nt, Human adenovirus D
caaauuacuuu

SEQ ID NO: 3919621 - RNA, 23 nt, Human adenovirus D
caaauucauuuuugaagucaugu

SEQ ID NO: 3919622 - RNA, 16 nt, Human adenovirus D
caacagauuuaagcaa

SEQ ID NO: 3919623 - RNA, 15 nt, Human adenovirus D
caacagccacaugac

SEQ ID NO: 3919624 - RNA, 16 nt, Human adenovirus D
caacagccacaugacc

SEQ ID NO: 3919625 - RNA, 16 nt, Human adenovirus D
caacaguacuggcaac

SEQ ID NO: 3919626 - RNA, 17 nt, Human adenovirus D
caacaucugugcugccu

SEQ ID NO: 3919627 - RNA, 21 nt, Human adenovirus D
caacaucugugcugccuuugc

SEQ ID NO: 3919628 - RNA, 20 nt, Human adenovirus D
caacaugaccaaggacuggu

SEQ ID NO: 3919629 - RNA, 22 nt, Human adenovirus D
caaccaugugcgcacccugauc

SEQ ID NO: 3919630 - RNA, 15 nt, Human adenovirus D
caacccuuccugguc

SEQ ID NO: 3919631 - RNA, 23 nt, Human adenovirus D
caaccgggugcuagacauggcca

SEQ ID NO: 3919632 - RNA, 18 nt, Human adenovirus D
caaccuccaggccaaccu

SEQ ID NO: 3919633 - RNA, 20 nt, Human adenovirus D
caaccuggaccggcugguga

SEQ ID NO: 3919634 - RNA, 15 nt, Human adenovirus D
caacgcgcgcugccc

SEQ ID NO: 3919635 - RNA, 17 nt, Human adenovirus D
caacuacacagucaacu

SEQ ID NO: 3919636 - RNA, 16 nt, Human adenovirus D
caacuagccggagccg

SEQ ID NO: 3919637 - RNA, 16 nt, Human adenovirus D
caacucgcggcugcug

SEQ ID NO: 3919638 - RNA, 13 nt, Human adenovirus D
caacucgggcuuc

SEQ ID NO: 3919639 - RNA, 20 nt, Human adenovirus D
caacuggucuccugccuggg

SEQ ID NO: 3919640 - RNA, 21 nt, Human adenovirus D
caagacugcggggggaacauc

SEQ ID NO: 3919641 - RNA, 14 nt, Human adenovirus D
caagagcgagaugu

SEQ ID NO: 3919642 - RNA, 17 nt, Human adenovirus D
caagcucaugcuggccg

SEQ ID NO: 3919643 - RNA, 17 nt, Human adenovirus D
caagcuggccugcgcca

SEQ ID NO: 3919644 - RNA, 11 nt, Human adenovirus D
caagcugguga

SEQ ID NO: 3919645 - RNA, 15 nt, Human adenovirus D
caaggugcugacauc

SEQ ID NO: 3919646 - RNA, 18 nt, Human adenovirus D
caaggugcugacauccau

SEQ ID NO: 3919647 - RNA, 20 nt, Human adenovirus D
caaguaggugaagaaaacug

SEQ ID NO: 3919648 - RNA, 20 nt, Human adenovirus D
caagugccacaugcaccugg

SEQ ID NO: 3919649 - RNA, 12 nt, Human adenovirus D
caaguggaugga

SEQ ID NO: 3919650 - RNA, 20 nt, Human adenovirus D
caaucgccacaggugcugcc

SEQ ID NO: 3919651 - RNA, 15 nt, Human adenovirus D
gucugaagcgccgcc

SEQ ID NO: 3919652 - RNA, 12 nt, Human adenovirus D
gucugagggcca

SEQ ID NO: 3919653 - RNA, 18 nt, Human adenovirus D
gucugcaggccgggcugc

SEQ ID NO: 3919654 - RNA, 16 nt, Human adenovirus D
gucugcuccugcacuu

SEQ ID NO: 3919655 - RNA, 22 nt, Human adenovirus D
gucuggcacaucuuuuggaaga

SEQ ID NO: 3919656 - RNA, 12 nt, Human adenovirus D
gucugugccucu

SEQ ID NO: 3919657 - RNA, 20 nt, Human adenovirus D
gugaagaugccgggacagag

SEQ ID NO: 3919658 - RNA, 19 nt, Human adenovirus D
gugacggccuacgagcaga

SEQ ID NO: 3919659 - RNA, 14 nt, Human adenovirus D
gugacggcgcgacc

SEQ ID NO: 3919660 - RNA, 15 nt, Human adenovirus D
gugaggguguccugg

SEQ ID NO: 3919661 - RNA, 13 nt, Human adenovirus D
gugaucugcuuga

SEQ ID NO: 3919662 - RNA, 17 nt, Human adenovirus D
gugaugucucacucaag

SEQ ID NO: 3919663 - RNA, 21 nt, Human adenovirus D
gugcacuggcccgaccgaccc

SEQ ID NO: 3919664 - RNA, 16 nt, Human adenovirus D
gugcagaccguggaca

SEQ ID NO: 3919665 - RNA, 15 nt, Human adenovirus D
gugcagcugcagaag

SEQ ID NO: 3919666 - RNA, 23 nt, Human adenovirus D
gugcagggaugaguugggccuga

SEQ ID NO: 3919667 - RNA, 21 nt, Human adenovirus D
gugcaguuugcccgcgccacc

SEQ ID NO: 3919668 - RNA, 21 nt, Human adenovirus D
gugcccaaguacuuggaaagc

SEQ ID NO: 3919669 - RNA, 18 nt, Human adenovirus D
gugccuuaccgccagaga

SEQ ID NO: 3919670 - RNA, 17 nt, Human adenovirus D
gugcgaggaugagagcc

SEQ ID NO: 3919671 - RNA, 18 nt, Human adenovirus D
gugcgcgaccugggcugc

SEQ ID NO: 3919672 - RNA, 16 nt, Human adenovirus D
gugcggccuugcggag

SEQ ID NO: 3919673 - RNA, 23 nt, Human adenovirus D
auaugaccaugcagacucugcuc

SEQ ID NO: 3919674 - RNA, 19 nt, Human adenovirus D
aucaaaacgaccacagcaa

SEQ ID NO: 3919675 - RNA, 18 nt, Human adenovirus D
aucaaaucgccaagggca

SEQ ID NO: 3919676 - RNA, 22 nt, Human adenovirus D
aucaacaucuugcagagcaucg

SEQ ID NO: 3919677 - RNA, 12 nt, Human adenovirus D
aucacacugcau

SEQ ID NO: 3919678 - RNA, 19 nt, Human adenovirus D
aucacaucggacuggguua

SEQ ID NO: 3919679 - RNA, 13 nt, Human adenovirus D
aucacccagcagu

SEQ ID NO: 3919680 - RNA, 17 nt, Human adenovirus D
aucacucuuuccagcag

SEQ ID NO: 3919681 - RNA, 15 nt, Human adenovirus D
aucacuggcggaggc

SEQ ID NO: 3919682 - RNA, 20 nt, Human adenovirus D
aucacuuacuugaaaucuga

SEQ ID NO: 3919683 - RNA, 22 nt, Human adenovirus D
aucagaauauccccuuccucac

SEQ ID NO: 3919684 - RNA, 20 nt, Human adenovirus D
aucagcacugcaaauuuaac

SEQ ID NO: 3919685 - RNA, 13 nt, Human adenovirus D
aucagccaggacu

SEQ ID NO: 3919686 - RNA, 22 nt, Human adenovirus D
aucagccccagaugggccuggc

SEQ ID NO: 3919687 - RNA, 15 nt, Human adenovirus D
aucagcgcgcugcgg

SEQ ID NO: 3919688 - RNA, 14 nt, Human adenovirus D
aucagcugcagcgc

SEQ ID NO: 3919689 - RNA, 15 nt, Human adenovirus D
aucagcugcagcgca

SEQ ID NO: 3919690 - RNA, 16 nt, Human adenovirus D
aucagguauccagccu

SEQ ID NO: 3919691 - RNA, 16 nt, Human adenovirus D
aucauaucccagggga

SEQ ID NO: 3919692 - RNA, 12 nt, Human adenovirus D
auccacaaacua

SEQ ID NO: 3919693 - RNA, 20 nt, Human adenovirus D
auccagccuguacccagagc

SEQ ID NO: 3919694 - RNA, 19 nt, Human adenovirus D
auccagucauagcaggggc

SEQ ID NO: 3919695 - RNA, 16 nt, Human adenovirus D
aucccaacagccuuca

SEQ ID NO: 3919696 - RNA, 18 nt, Human adenovirus D
auccccgucuccugccgc

SEQ ID NO: 3919697 - RNA, 16 nt, Human adenovirus D
auccgcgccgcagccc

SEQ ID NO: 3919698 - RNA, 21 nt, Human adenovirus D
auccuuuuguagagggaaccu

SEQ ID NO: 3919699 - RNA, 20 nt, Human adenovirus D
aucgccacaggugcugccca

SEQ ID NO: 3919700 - RNA, 14 nt, Human adenovirus D
aucgccgaggagaa

SEQ ID NO: 3919701 - RNA, 23 nt, Human adenovirus D
aucggacgacugggaggcugcga

SEQ ID NO: 3919702 - RNA, 16 nt, Human adenovirus D
aucggcuaccagggcu

SEQ ID NO: 3919703 - RNA, 20 nt, Human adenovirus D
aucgugcgcgaccugggcug

SEQ ID NO: 3919704 - RNA, 13 nt, Human adenovirus D
aucgugcugcucu

SEQ ID NO: 3919705 - RNA, 19 nt, Human adenovirus D
aucgugguaaacgggcccu

SEQ ID NO: 3919706 - RNA, 14 nt, Human adenovirus D
aucucauggucuga

SEQ ID NO: 3919707 - RNA, 13 nt, Human adenovirus D
aucugugcugccu

SEQ ID NO: 3919708 - RNA, 13 nt, Human adenovirus D
aucuuccuggggc

SEQ ID NO: 3919709 - RNA, 22 nt, Human adenovirus D
augaaagcauacagagauucag

SEQ ID NO: 3919710 - RNA, 15 nt, Human adenovirus D
augaaagucaggagc

SEQ ID NO: 3919711 - RNA, 13 nt, Human adenovirus D
augaauaugaauu

SEQ ID NO: 3919712 - RNA, 19 nt, Human adenovirus D
augaccaugcagacucugc

SEQ ID NO: 3919713 - RNA, 12 nt, Human adenovirus D
augaccucggca

SEQ ID NO: 3919714 - RNA, 14 nt, Human adenovirus D
augaccugggcggc

SEQ ID NO: 3919715 - RNA, 16 nt, Human adenovirus D
augagagucugaaaaa

SEQ ID NO: 3919716 - RNA, 22 nt, Human adenovirus D
augagcccguagcugcgcgggg

SEQ ID NO: 3919717 - RNA, 12 nt, Human adenovirus D
augagcugcgag

SEQ ID NO: 3919718 - RNA, 14 nt, Human adenovirus D
augaggagaaggaa

SEQ ID NO: 3919719 - RNA, 20 nt, Human adenovirus D
augaggagaaggaaaaauug

SEQ ID NO: 3919720 - RNA, 17 nt, Human adenovirus D
augcaaaaucuuacacu

SEQ ID NO: 3919721 - RNA, 19 nt, Human adenovirus D
augcaaaaucuuacacugu

SEQ ID NO: 3919722 - RNA, 20 nt, Human adenovirus D
augcaacaugaccaaggacu

SEQ ID NO: 3919723 - RNA, 18 nt, Human adenovirus D
augcacccguaaaugacu

SEQ ID NO: 3919724 - RNA, 14 nt, Human adenovirus D
augcaccuguggag

SEQ ID NO: 3919725 - RNA, 16 nt, Human adenovirus D
augcacucauccauga

SEQ ID NO: 3919726 - RNA, 23 nt, Human adenovirus D
augcagccaguggcccuggaugu

SEQ ID NO: 3919727 - RNA, 12 nt, Human adenovirus D
augcaggagggg

SEQ ID NO: 3919728 - RNA, 14 nt, Human adenovirus D
augccaagauagcc

SEQ ID NO: 3919729 - RNA, 18 nt, Human adenovirus D
augccaagauagcccugc

SEQ ID NO: 3919730 - RNA, 19 nt, Human adenovirus D
augccaagauagcccugcg

SEQ ID NO: 3919731 - RNA, 23 nt, Human adenovirus D
augccaagauagcccugcgccca

SEQ ID NO: 3919732 - RNA, 18 nt, Human adenovirus D
augccccagcagaagcag

SEQ ID NO: 3919733 - RNA, 14 nt, Human adenovirus D
augccccaggccug

SEQ ID NO: 3919734 - RNA, 22 nt, Human adenovirus D
augccgaagaagaacaggagcc

SEQ ID NO: 3919735 - RNA, 17 nt, Human adenovirus D
augccgauguugguggg

SEQ ID NO: 3919736 - RNA, 17 nt, Human adenovirus D
augccuucgugcacugg

SEQ ID NO: 3919737 - RNA, 19 nt, Human adenovirus D
augcgcuucuuaccucgcg

SEQ ID NO: 3919738 - RNA, 17 nt, Human adenovirus D
augcgugagggcggagg

SEQ ID NO: 3919739 - RNA, 13 nt, Human adenovirus D
augcuccaaagcu

SEQ ID NO: 3919740 - RNA, 21 nt, Human adenovirus D
augcucgucagggggguccgc

SEQ ID NO: 3919741 - RNA, 23 nt, Human adenovirus D
augcuggccgugguccuggucac

SEQ ID NO: 3919742 - RNA, 23 nt, Human adenovirus D
augcuuggucuuucuggcuugcu

SEQ ID NO: 3919743 - RNA, 20 nt, Human adenovirus D
auggaacccaaaguaugaca

SEQ ID NO: 3919744 - RNA, 16 nt, Human adenovirus D
auggauuaaaaauauu

SEQ ID NO: 3919745 - RNA, 15 nt, Human adenovirus D
auggauucaaaaacu

SEQ ID NO: 3919746 - RNA, 15 nt, Human adenovirus D
auggcaagcugccau

SEQ ID NO: 3919747 - RNA, 12 nt, Human adenovirus D
auggcaggcagc

SEQ ID NO: 3919748 - RNA, 18 nt, Human adenovirus D
auggccucgugcucuggg

SEQ ID NO: 3919749 - RNA, 17 nt, Human adenovirus D
auggccuggagcagaua

SEQ ID NO: 3919750 - RNA, 18 nt, Human adenovirus D
auggcuaccugggaggag

SEQ ID NO: 3919751 - RNA, 16 nt, Human adenovirus D
auggcucagcugccau

SEQ ID NO: 3919752 - RNA, 13 nt, Human adenovirus D
augggcaccugga

SEQ ID NO: 3919753 - RNA, 17 nt, Human adenovirus D
augggcccgugggcugc

SEQ ID NO: 3919754 - RNA, 18 nt, Human adenovirus D
augggccuggccgcgggc

SEQ ID NO: 3919755 - RNA, 15 nt, Human adenovirus D
augggucaggcagcg

SEQ ID NO: 3919756 - RNA, 12 nt, Human adenovirus D
augggugugcug

SEQ ID NO: 3919757 - RNA, 18 nt, Human adenovirus D
auguccuuccagggucuc

SEQ ID NO: 3919758 - RNA, 23 nt, Human adenovirus D
augucucgguguacaagauccug

SEQ ID NO: 3919759 - RNA, 23 nt, Human adenovirus D
augugaccucccaccccagaaag

SEQ ID NO: 3919760 - RNA, 18 nt, Human adenovirus D
augugcaguuuggccugg

SEQ ID NO: 3919761 - RNA, 21 nt, Human adenovirus D
auguguggacuauccuugcag

SEQ ID NO: 3919762 - RNA, 19 nt, Human adenovirus D
auguuacugcauacaaaug

SEQ ID NO: 3919763 - RNA, 23 nt, Human adenovirus D
auguucucacaguaagugcagca

SEQ ID NO: 3919764 - RNA, 12 nt, Human adenovirus D
auuaaaaaauua

SEQ ID NO: 3919765 - RNA, 18 nt, Human adenovirus D
auuaauguuaaugucacu

SEQ ID NO: 3919766 - RNA, 15 nt, Human adenovirus D
auuacugccacugcc

SEQ ID NO: 3919767 - RNA, 20 nt, Human adenovirus D
auuaugagcaucaaaaauua

SEQ ID NO: 3919768 - RNA, 18 nt, Human adenovirus D
auucaaauuacuuuucug

SEQ ID NO: 3919769 - RNA, 19 nt, Human adenovirus D
auucaaggccauaaaucug

SEQ ID NO: 3919770 - RNA, 16 nt, Human adenovirus D
auucauaccaucaaug

SEQ ID NO: 3919771 - RNA, 21 nt, Human adenovirus D
auugaaugggacuuauccaca

SEQ ID NO: 3919772 - RNA, 20 nt, Human adenovirus D
auugcaggccgugcugcucg

SEQ ID NO: 3919773 - RNA, 18 nt, Human adenovirus D
auugcuucccuggaagag

SEQ ID NO: 3919774 - RNA, 17 nt, Human adenovirus D
auuggagaaugcugcua

SEQ ID NO: 3919775 - RNA, 17 nt, Human adenovirus D
auuggugcgcuggggcu

SEQ ID NO: 3919776 - RNA, 18 nt, Human adenovirus D
auugucaagcuugguggc

SEQ ID NO: 3919777 - RNA, 14 nt, Human adenovirus D
auuuaauuggcaaa

SEQ ID NO: 3919778 - RNA, 22 nt, Human adenovirus D
auuucaaauuuuauguaucuuu

SEQ ID NO: 3919779 - RNA, 16 nt, Human adenovirus D
auuucuuagacugcua

SEQ ID NO: 3919780 - RNA, 18 nt, Human adenovirus D
auuuuuguuguacucugu

SEQ ID NO: 3919781 - RNA, 16 nt, Human adenovirus D
caaaaaaaacaaucag

SEQ ID NO: 3919782 - RNA, 15 nt, Human adenovirus D
caaaacaacaagauu

SEQ ID NO: 3919783 - RNA, 15 nt, Human adenovirus D
caaaacccacucuau

SEQ ID NO: 3919784 - RNA, 20 nt, Human adenovirus D
caaaacccacucuauuuuca

SEQ ID NO: 3919785 - RNA, 20 nt, Human adenovirus D
caaaacuaauuacagucacu

SEQ ID NO: 3919786 - RNA, 21 nt, Human adenovirus D
caaaagaguuucaacaaccau

SEQ ID NO: 3919787 - RNA, 19 nt, Human adenovirus D
caaaagcguccgcuccgca

SEQ ID NO: 3919788 - RNA, 13 nt, Human adenovirus D
caaacgccagccc

SEQ ID NO: 3919789 - RNA, 13 nt, Human adenovirus D
ccagccuccaccg

SEQ ID NO: 3919790 - RNA, 18 nt, Human adenovirus D
ccagcgagugaccgucac

SEQ ID NO: 3919791 - RNA, 13 nt, Human adenovirus D
ccagcuggccgcc

SEQ ID NO: 3919792 - RNA, 22 nt, Human adenovirus D
ccaggaaacuaggcgcagcugc

SEQ ID NO: 3919793 - RNA, 21 nt, Human adenovirus D
ccaggaggcggugcgcacgcc

SEQ ID NO: 3919794 - RNA, 18 nt, Human adenovirus D
ccaggaugcagccagugg

SEQ ID NO: 3919795 - RNA, 14 nt, Human adenovirus D
ccaggggagugaag

SEQ ID NO: 3919796 - RNA, 20 nt, Human adenovirus D
ccaggggaugaacaguggca

SEQ ID NO: 3919797 - RNA, 19 nt, Human adenovirus D
ccaggguugagucgcggca

SEQ ID NO: 3919798 - RNA, 18 nt, Human adenovirus D
ccaggucgucgccccgga

SEQ ID NO: 3919799 - RNA, 21 nt, Human adenovirus D
ccagucccuuuuccaggaaag

SEQ ID NO: 3919800 - RNA, 14 nt, Human adenovirus D
ccauagcucagccc

SEQ ID NO: 3919801 - RNA, 20 nt, Human adenovirus D
ccauagucaucacccagcag

SEQ ID NO: 3919802 - RNA, 19 nt, Human adenovirus D
ccaucagcgcccucagcag

SEQ ID NO: 3919803 - RNA, 16 nt, Human adenovirus D
ccauccgcgccgcagc

SEQ ID NO: 3919804 - RNA, 19 nt, Human adenovirus D
ccaugaaggggcucuugcu

SEQ ID NO: 3919805 - RNA, 22 nt, Human adenovirus D
ccaugagucuguguccgcgcuc

SEQ ID NO: 3919806 - RNA, 17 nt, Human adenovirus D
ccaugcgaauuccccuc

SEQ ID NO: 3919807 - RNA, 20 nt, Human adenovirus D
ccaugcgaauuccccucauc

SEQ ID NO: 3919808 - RNA, 15 nt, Human adenovirus D
ccaugcgccaagggc

SEQ ID NO: 3919809 - RNA, 19 nt, Human adenovirus D
ccauggacaacgucaaccc

SEQ ID NO: 3919810 - RNA, 23 nt, Human adenovirus D
ccauggccaggggagugaagagg

SEQ ID NO: 3919811 - RNA, 16 nt, Human adenovirus D
ccauggggcgccgccc

SEQ ID NO: 3919812 - RNA, 14 nt, Human adenovirus D
ccaugugcgcaccc

SEQ ID NO: 3919813 - RNA, 20 nt, Human adenovirus D
ccauugguugaacccagaug

SEQ ID NO: 3919814 - RNA, 21 nt, Human adenovirus D
ccauugucaacacggccggcc

SEQ ID NO: 3919815 - RNA, 13 nt, Human adenovirus D
cccaacaauaaaa

SEQ ID NO: 3919816 - RNA, 16 nt, Human adenovirus D
cccaacggcaccugcg

SEQ ID NO: 3919817 - RNA, 13 nt, Human adenovirus D
cccaacggcaugc

SEQ ID NO: 3919818 - RNA, 20 nt, Human adenovirus D
cccaacucgcggcugcugcu

SEQ ID NO: 3919819 - RNA, 16 nt, Human adenovirus D
cccaaugcaacaugac

SEQ ID NO: 3919820 - RNA, 17 nt, Human adenovirus D
cccacaggaugaacagg

SEQ ID NO: 3919821 - RNA, 12 nt, Human adenovirus D
cccagaacuggc

SEQ ID NO: 3919822 - RNA, 24 nt, Human adenovirus D
cccagaacuggcagagcacgcugc

SEQ ID NO: 3919823 - RNA, 15 nt, Human adenovirus D
cccagcaagucagca

SEQ ID NO: 3919824 - RNA, 23 nt, Human adenovirus D
cccaggaaacuaggcgcagcugc

SEQ ID NO: 3919825 - RNA, 20 nt, Human adenovirus D
cccaggaauggcacgcucug

SEQ ID NO: 3919826 - RNA, 18 nt, Human adenovirus D
cccaggcccuggagcagc

SEQ ID NO: 3919827 - RNA, 17 nt, Human adenovirus D
cccaggcggaccagaaa

SEQ ID NO: 3919828 - RNA, 23 nt, Human adenovirus D
cccaggcggugcugcugccgagc

SEQ ID NO: 3919829 - RNA, 20 nt, Human adenovirus D
cccaguuucaaacccuacuc

SEQ ID NO: 3919830 - RNA, 21 nt, Human adenovirus D
cccauggacgggaaccccacc

SEQ ID NO: 3919831 - RNA, 14 nt, Human adenovirus D
ccccaggcggugcu

SEQ ID NO: 3919832 - RNA, 18 nt, Human adenovirus D
ccccagggaccacaaugu

SEQ ID NO: 3919833 - RNA, 20 nt, Human adenovirus D
ccccauagucaucacccagc

SEQ ID NO: 3919834 - RNA, 18 nt, Human adenovirus D
ccccauggcgcacaacac

SEQ ID NO: 3919835 - RNA, 18 nt, Human adenovirus D
ccccgacccccuuccacu

SEQ ID NO: 3919836 - RNA, 16 nt, Human adenovirus D
ccccgagcgccugagg

SEQ ID NO: 3919837 - RNA, 14 nt, Human adenovirus D
ccccgcaggcagga

SEQ ID NO: 3919838 - RNA, 19 nt, Human adenovirus D
ccccgccgaggcuagcacg

SEQ ID NO: 3919839 - RNA, 12 nt, Human adenovirus D
ccccgcgggcag

SEQ ID NO: 3919840 - RNA, 22 nt, Human adenovirus D
ccccgcgggcaggggcggcaga

SEQ ID NO: 3919841 - RNA, 15 nt, Human adenovirus D
ccccgcgugcagcug

SEQ ID NO: 3919842 - RNA, 20 nt, Human adenovirus D
ccccgcgugcagcugcagaa

SEQ ID NO: 3919843 - RNA, 18 nt, Human adenovirus D
ccccuuugucuccuccga

SEQ ID NO: 3919844 - RNA, 22 nt, Human adenovirus D
cccgagaccugcgcaaggucga

SEQ ID NO: 3919845 - RNA, 11 nt, Human adenovirus D
cccgaggcccu

SEQ ID NO: 3919846 - RNA, 22 nt, Human adenovirus D
cccgagggucgcuggcugcugg

SEQ ID NO: 3919847 - RNA, 16 nt, Human adenovirus D
cccgauggucgcugga

SEQ ID NO: 3919848 - RNA, 12 nt, Human adenovirus D
cccgcacccggc

SEQ ID NO: 3919849 - RNA, 21 nt, Human adenovirus D
cccgcccagguuuuccaugca

SEQ ID NO: 3919850 - RNA, 14 nt, Human adenovirus D
cccgcccugcugga

SEQ ID NO: 3919851 - RNA, 20 nt, Human adenovirus D
cccgccgaggcuagcacgca

SEQ ID NO: 3919852 - RNA, 21 nt, Human adenovirus D
cccgcguaauuggcccuccac

SEQ ID NO: 3919853 - RNA, 20 nt, Human adenovirus D
cccgcgugcagcugcagaag

SEQ ID NO: 3919854 - RNA, 20 nt, Human adenovirus D
cccgcucaccaucugagcuc

SEQ ID NO: 3919855 - RNA, 19 nt, Human adenovirus D
cccgcucaucggccagaca

SEQ ID NO: 3919856 - RNA, 13 nt, Human adenovirus D
cccggaggagggg

SEQ ID NO: 3919857 - RNA, 20 nt, Human adenovirus D
cccggcaacgaccggcugcu

SEQ ID NO: 3919858 - RNA, 23 nt, Human adenovirus D
cccggcauccugcacgcagcagc

SEQ ID NO: 3919859 - RNA, 16 nt, Human adenovirus D
cccgugaccugcagca

SEQ ID NO: 3919860 - RNA, 22 nt, Human adenovirus D
cccguggucagcgaugagcagc

SEQ ID NO: 3919861 - RNA, 21 nt, Human adenovirus D
cccucagcgucgaggagcugu

SEQ ID NO: 3919862 - RNA, 18 nt, Human adenovirus D
cccuccacuuucauaauc

SEQ ID NO: 3919863 - RNA, 19 nt, Human adenovirus D
cccuccccgacccccuucc

SEQ ID NO: 3919864 - RNA, 11 nt, Human adenovirus D
cccucgcuggu

SEQ ID NO: 3919865 - RNA, 17 nt, Human adenovirus D
cccugagccgccagcug

SEQ ID NO: 3919866 - RNA, 19 nt, Human adenovirus D
cccugagccgccagcuggc

SEQ ID NO: 3919867 - RNA, 17 nt, Human adenovirus D
cccugcccuuccagcac

SEQ ID NO: 3919868 - RNA, 18 nt, Human adenovirus D
cccugcccuuccagcaca

SEQ ID NO: 3919869 - RNA, 13 nt, Human adenovirus D
cccuuccucacuc

SEQ ID NO: 3919870 - RNA, 13 nt, Human adenovirus D
cccuucuccagca

SEQ ID NO: 3919871 - RNA, 17 nt, Human adenovirus D
cccuucuccagcaacuu

SEQ ID NO: 3919872 - RNA, 15 nt, Human adenovirus D
cccuugaccugccuc

SEQ ID NO: 3919873 - RNA, 20 nt, Human adenovirus D
ccgaagaagaacaggagccg

SEQ ID NO: 3919874 - RNA, 19 nt, Human adenovirus D
ccgacgcgcuccucgcucu

SEQ ID NO: 3919875 - RNA, 20 nt, Human adenovirus D
ccgacuaggaagugcggcgg

SEQ ID NO: 3919876 - RNA, 18 nt, Human adenovirus D
ccgagcacucgugcugau

SEQ ID NO: 3919877 - RNA, 13 nt, Human adenovirus D
ccgagccugaagc

SEQ ID NO: 3919878 - RNA, 18 nt, Human adenovirus D
ccgagcugacggccaguc

SEQ ID NO: 3919879 - RNA, 15 nt, Human adenovirus D
ccgaggacacccggc

SEQ ID NO: 3919880 - RNA, 21 nt, Human adenovirus D
ccgaggacuaccacgcccaug

SEQ ID NO: 3919881 - RNA, 22 nt, Human adenovirus D
ccgaggagaugcgcgacugccg

SEQ ID NO: 3919882 - RNA, 18 nt, Human adenovirus D
ccgaggugccccagagcg

SEQ ID NO: 3919883 - RNA, 17 nt, Human adenovirus D
ccgagucgcggaugaag

SEQ ID NO: 3919884 - RNA, 18 nt, Human adenovirus D
ccgagucgucgcagccgc

SEQ ID NO: 3919885 - RNA, 15 nt, Human adenovirus D
ccgagucucaccugg

SEQ ID NO: 3919886 - RNA, 22 nt, Human adenovirus D
ccgaucauugagagugcggugg

SEQ ID NO: 3919887 - RNA, 20 nt, Human adenovirus D
ccgaugcuauugagagagag

SEQ ID NO: 3919888 - RNA, 19 nt, Human adenovirus D
ccgcaacucguaccugggu

SEQ ID NO: 3919889 - RNA, 23 nt, Human adenovirus D
ccgcaccgcuccuggucugcaac

SEQ ID NO: 3919890 - RNA, 20 nt, Human adenovirus D
ccgcacgguaagagcccagc

SEQ ID NO: 3919891 - RNA, 21 nt, Human adenovirus D
ccgcagccgcggcagccgcag

SEQ ID NO: 3919892 - RNA, 13 nt, Human adenovirus D
ccgcagcucuucc

SEQ ID NO: 3919893 - RNA, 18 nt, Human adenovirus D
ccgcaggaguccaccgcu

SEQ ID NO: 3919894 - RNA, 15 nt, Human adenovirus D
ccgcaggcgcccagc

SEQ ID NO: 3919895 - RNA, 13 nt, Human adenovirus D
ccgccaacaccaa

SEQ ID NO: 3919896 - RNA, 14 nt, Human adenovirus D
ccgccaagcuccuc

SEQ ID NO: 3919897 - RNA, 20 nt, Human adenovirus D
ccgccaaggagcuccucgau

SEQ ID NO: 3919898 - RNA, 12 nt, Human adenovirus D
ccgccaccugca

SEQ ID NO: 3919899 - RNA, 20 nt, Human adenovirus D
ccgccauggggcgccgcccg

SEQ ID NO: 3919900 - RNA, 13 nt, Human adenovirus D
ccgcccugagcuc

SEQ ID NO: 3919901 - RNA, 14 nt, Human adenovirus D
ccgccgaggcuagc

SEQ ID NO: 3919902 - RNA, 14 nt, Human adenovirus D
ccgccgcaggagag

SEQ ID NO: 3919903 - RNA, 15 nt, Human adenovirus D
ccgccgccgccgugc

SEQ ID NO: 3919904 - RNA, 21 nt, Human adenovirus D
ccgccgcuguggagccacugc

SEQ ID NO: 3919905 - RNA, 17 nt, Human adenovirus D
ggcaucuuccuggggca

SEQ ID NO: 3919906 - RNA, 16 nt, Human adenovirus D
ggcauggcaggcagcg

SEQ ID NO: 3919907 - RNA, 16 nt, Human adenovirus D
ggcaugggucaggcag

SEQ ID NO: 3919908 - RNA, 20 nt, Human adenovirus D
ggcaugggucaggcagcggg

SEQ ID NO: 3919909 - RNA, 20 nt, Human adenovirus D
ggccacgugcgagggguagc

SEQ ID NO: 3919910 - RNA, 17 nt, Human adenovirus D
ggccaggccuccgagca

SEQ ID NO: 3919911 - RNA, 12 nt, Human adenovirus D
ggccaggggagu

SEQ ID NO: 3919912 - RNA, 15 nt, Human adenovirus D
ggccauucuggaggc

SEQ ID NO: 3919913 - RNA, 17 nt, Human adenovirus D
ggccauucuggaggcgg

SEQ ID NO: 3919914 - RNA, 17 nt, Human adenovirus D
ggcccacggccaucuuu

SEQ ID NO: 3919915 - RNA, 16 nt, Human adenovirus D
ggcccagaacuggcag

SEQ ID NO: 3919916 - RNA, 20 nt, Human adenovirus D
ggcccagaacuggcagagca

SEQ ID NO: 3919917 - RNA, 21 nt, Human adenovirus D
ggccccggggcggaguggccu

SEQ ID NO: 3919918 - RNA, 14 nt, Human adenovirus D
ggcccgacuccgcc

SEQ ID NO: 3919919 - RNA, 21 nt, Human adenovirus D
ggcccucgaugaaagucagga

SEQ ID NO: 3919920 - RNA, 18 nt, Human adenovirus D
ggcccugcuggccgagcu

SEQ ID NO: 3919921 - RNA, 16 nt, Human adenovirus D
ggcccuggcugguggu

SEQ ID NO: 3919922 - RNA, 16 nt, Human adenovirus D
ggccgagaccgugagc

SEQ ID NO: 3919923 - RNA, 21 nt, Human adenovirus D
ggccgagaucguccucccccg

SEQ ID NO: 3919924 - RNA, 16 nt, Human adenovirus D
ggccgaggaggagcgc

SEQ ID NO: 3919925 - RNA, 15 nt, Human adenovirus D
ggccgcccugaccca

SEQ ID NO: 3919926 - RNA, 13 nt, Human adenovirus D
ggccgccgggcca

SEQ ID NO: 3919927 - RNA, 17 nt, Human adenovirus D
ggccgcgauguugagcu

SEQ ID NO: 3919928 - RNA, 19 nt, Human adenovirus D
ggccggcaugcccaccacg

SEQ ID NO: 3919929 - RNA, 18 nt, Human adenovirus D
ggccuccaggaauuccag

SEQ ID NO: 3919930 - RNA, 18 nt, Human adenovirus D
ggccucgugcucuggggu

SEQ ID NO: 3919931 - RNA, 11 nt, Human adenovirus D
ggccuggagca

SEQ ID NO: 3919932 - RNA, 12 nt, Human adenovirus D
ggccuggagcag

SEQ ID NO: 3919933 - RNA, 21 nt, Human adenovirus D
ggccuggagcagauaaaaacc

SEQ ID NO: 3919934 - RNA, 15 nt, Human adenovirus D
ggccugggcucgcug

SEQ ID NO: 3919935 - RNA, 20 nt, Human adenovirus D
ggccugggcucgcugguggc

SEQ ID NO: 3919936 - RNA, 23 nt, Human adenovirus D
ggccugugcaaugucaggucugc

SEQ ID NO: 3919937 - RNA, 21 nt, Human adenovirus D
ggccuuaaauaaggaaauguu

SEQ ID NO: 3919938 - RNA, 20 nt, Human adenovirus D
ggcgaacgugccgcgcgggc

SEQ ID NO: 3919939 - RNA, 23 nt, Human adenovirus D
ggcgaaguugaaaaacugggcgu

SEQ ID NO: 3919940 - RNA, 14 nt, Human adenovirus D
ggcgaccagcucug

SEQ ID NO: 3919941 - RNA, 23 nt, Human adenovirus D
ggcgaccggucgacggugagcag

SEQ ID NO: 3919942 - RNA, 20 nt, Human adenovirus D
ggcgacgacgacauccugga

SEQ ID NO: 3919943 - RNA, 23 nt, Human adenovirus D
ggcgacgacgcgcucggcgagga

SEQ ID NO: 3919944 - RNA, 16 nt, Human adenovirus D
ggcgacgcaccgggag

SEQ ID NO: 3919945 - RNA, 19 nt, Human adenovirus D
ggcgagaggcgagcagcug

SEQ ID NO: 3919946 - RNA, 21 nt, Human adenovirus D
ggcgaguuugccuacgggaag

SEQ ID NO: 3919947 - RNA, 13 nt, Human adenovirus D
ggcgcaaccagga

SEQ ID NO: 3919948 - RNA, 14 nt, Human adenovirus D
ggcgcaaccaggag

SEQ ID NO: 3919949 - RNA, 15 nt, Human adenovirus D
ggcgcaaccaggagg

SEQ ID NO: 3919950 - RNA, 15 nt, Human adenovirus D
ggcgcaagcucaugc

SEQ ID NO: 3919951 - RNA, 17 nt, Human adenovirus D
ggcgcacgucugacugc

SEQ ID NO: 3919952 - RNA, 22 nt, Human adenovirus D
ggcgcacgucugacugccgccg

SEQ ID NO: 3919953 - RNA, 15 nt, Human adenovirus D
ggcgcaggcgacccu

SEQ ID NO: 3919954 - RNA, 21 nt, Human adenovirus D
ggcgcaggcgacccuggaggu

SEQ ID NO: 3919955 - RNA, 11 nt, Human adenovirus D
ggcgcccagca

SEQ ID NO: 3919956 - RNA, 11 nt, Human adenovirus D
ggcgcccagcc

SEQ ID NO: 3919957 - RNA, 16 nt, Human adenovirus D
ggcgccggcgcuagcc

SEQ ID NO: 3919958 - RNA, 16 nt, Human adenovirus D
ggcgcgagcugagcga

SEQ ID NO: 3919959 - RNA, 18 nt, Human adenovirus D
ggcgcgcccggggccagg

SEQ ID NO: 3919960 - RNA, 16 nt, Human adenovirus D
ggcgcgccuuggaggc

SEQ ID NO: 3919961 - RNA, 15 nt, Human adenovirus D
ggcgcggagcuugcc

SEQ ID NO: 3919962 - RNA, 20 nt, Human adenovirus D
ggcgcggcgggggcggagag

SEQ ID NO: 3919963 - RNA, 13 nt, Human adenovirus D
ggcgcuagccagc

SEQ ID NO: 3919964 - RNA, 21 nt, Human adenovirus D
ggcgcucaaggugcugacgcu

SEQ ID NO: 3919965 - RNA, 13 nt, Human adenovirus D
ggcgcuggaagag

SEQ ID NO: 3919966 - RNA, 14 nt, Human adenovirus D
ggcgcuggaagagg

SEQ ID NO: 3919967 - RNA, 14 nt, Human adenovirus D
ggcgcuugcaaggg

SEQ ID NO: 3919968 - RNA, 17 nt, Human adenovirus D
ggcgcuuggugggcaga

SEQ ID NO: 3919969 - RNA, 15 nt, Human adenovirus D
ggcggcagaggcacg

SEQ ID NO: 3919970 - RNA, 13 nt, Human adenovirus D
ggcggccauugcu

SEQ ID NO: 3919971 - RNA, 14 nt, Human adenovirus D
ggcggcgcugcaaa

SEQ ID NO: 3919972 - RNA, 18 nt, Human adenovirus D
ggcggcuuucugcccgcg

SEQ ID NO: 3919973 - RNA, 12 nt, Human adenovirus D
ggcgggacagag

SEQ ID NO: 3919974 - RNA, 14 nt, Human adenovirus D
ggcgggggcggaga

SEQ ID NO: 3919975 - RNA, 22 nt, Human adenovirus D
ggcggguccccguugggcagcg

SEQ ID NO: 3919976 - RNA, 13 nt, Human adenovirus D
ggcgucccgcggu

SEQ ID NO: 3919977 - RNA, 13 nt, Human adenovirus D
ggcgugcagaccg

SEQ ID NO: 3919978 - RNA, 19 nt, Human adenovirus D
ggcgugcagaccguggaca

SEQ ID NO: 3919979 - RNA, 23 nt, Human adenovirus D
ggcgugcgcgugcccgugcgcac

SEQ ID NO: 3919980 - RNA, 15 nt, Human adenovirus D
ggcgugcuggagagc

SEQ ID NO: 3919981 - RNA, 18 nt, Human adenovirus D
ggcguggcuaaggugacu

SEQ ID NO: 3919982 - RNA, 17 nt, Human adenovirus D
ggcguggugcuggauga

SEQ ID NO: 3919983 - RNA, 20 nt, Human adenovirus D
ggcguucagggaggcgcugc

SEQ ID NO: 3919984 - RNA, 20 nt, Human adenovirus D
ggcuacgcgcggaaucagaa

SEQ ID NO: 3919985 - RNA, 15 nt, Human adenovirus D
ggcucggugcggcug

SEQ ID NO: 3919986 - RNA, 18 nt, Human adenovirus D
ggcugcauccacugcucc

SEQ ID NO: 3919987 - RNA, 16 nt, Human adenovirus D
ggcugcuggagcugau

SEQ ID NO: 3919988 - RNA, 13 nt, Human adenovirus D
ggcugcuggaugg

SEQ ID NO: 3919989 - RNA, 18 nt, Human adenovirus D
ggcugcuggaugggcgug

SEQ ID NO: 3919990 - RNA, 16 nt, Human adenovirus D
ggcuucuacagccagc

SEQ ID NO: 3919991 - RNA, 17 nt, Human adenovirus D
ggcuuucuuugacacac

SEQ ID NO: 3919992 - RNA, 17 nt, Human adenovirus D
gggaccggggaggcacc

SEQ ID NO: 3919993 - RNA, 12 nt, Human adenovirus D
gggacgugagcg

SEQ ID NO: 3919994 - RNA, 13 nt, Human adenovirus D
gggacuggcaagc

SEQ ID NO: 3919995 - RNA, 20 nt, Human adenovirus D
gggacuuggucaccccgccg

SEQ ID NO: 3919996 - RNA, 12 nt, Human adenovirus D
gggagcgagccc

SEQ ID NO: 3919997 - RNA, 19 nt, Human adenovirus D
gggagcugcgcgagggccu

SEQ ID NO: 3919998 - RNA, 21 nt, Human adenovirus D
gggagcugcgcgagggccugg

SEQ ID NO: 3919999 - RNA, 13 nt, Human adenovirus D
gggaucaccaguu

SEQ ID NO: 3920000 - RNA, 18 nt, Human adenovirus D
gggaugucaaauuccugg

SEQ ID NO: 3920001 - RNA, 11 nt, Human adenovirus D
gggcacccacg

SEQ ID NO: 3920002 - RNA, 12 nt, Human adenovirus D
gggcagggagcu

SEQ ID NO: 3920003 - RNA, 17 nt, Human adenovirus D
gggcaucuucugccugg

SEQ ID NO: 3920004 - RNA, 22 nt, Human adenovirus D
gggcaugaccucggcacucagg

SEQ ID NO: 3920005 - RNA, 15 nt, Human adenovirus D
gggccgccgggccau

SEQ ID NO: 3920006 - RNA, 23 nt, Human adenovirus D
gggccugcaaacggugaaccuga

SEQ ID NO: 3920007 - RNA, 19 nt, Human adenovirus D
gggccugcgcuaccgcucc

SEQ ID NO: 3920008 - RNA, 14 nt, Human adenovirus D
gggcgccucccagg

SEQ ID NO: 3920009 - RNA, 16 nt, Human adenovirus D
gggcgccucccaggac

SEQ ID NO: 3920010 - RNA, 20 nt, Human adenovirus D
gggcgcucccaaucccaguc

SEQ ID NO: 3920011 - RNA, 19 nt, Human adenovirus D
gggcggcaaaauggcgugc

SEQ ID NO: 3920012 - RNA, 12 nt, Human adenovirus D
gggcgguggugg

SEQ ID NO: 3920013 - RNA, 22 nt, Human adenovirus D
gggcgucccgcgguccuccucg

SEQ ID NO: 3920014 - RNA, 20 nt, Human adenovirus D
gggcgugcagaccguggaca

SEQ ID NO: 3920015 - RNA, 18 nt, Human adenovirus D
gggcguggugcuggauga

SEQ ID NO: 3920016 - RNA, 22 nt, Human adenovirus D
gggcguguaccgcaacgaccgc

SEQ ID NO: 3920017 - RNA, 17 nt, Human adenovirus D
gggcuccgagaagaugc

SEQ ID NO: 3920018 - RNA, 14 nt, Human adenovirus D
gggcucgagcaugg

SEQ ID NO: 3920019 - RNA, 14 nt, Human adenovirus D
gggcugggacccug

SEQ ID NO: 3920020 - RNA, 13 nt, Human adenovirus D
ggggaagauggag

SEQ ID NO: 3920021 - RNA, 14 nt, Human adenovirus D
ggggacgugagcgc

SEQ ID NO: 3920022 - RNA, 15 nt, Human adenovirus D
ucgucauccuuccag

SEQ ID NO: 3920023 - RNA, 12 nt, Human adenovirus D
ucgugcgagggg

SEQ ID NO: 3920024 - RNA, 12 nt, Human adenovirus D
ucuacaaggccc

SEQ ID NO: 3920025 - RNA, 13 nt, Human adenovirus D
ucuaccugcgcac

SEQ ID NO: 3920026 - RNA, 16 nt, Human adenovirus D
ucuaccuuggucacau

SEQ ID NO: 3920027 - RNA, 18 nt, Human adenovirus D
ucuacgcguacauccagc

SEQ ID NO: 3920028 - RNA, 13 nt, Human adenovirus D
ucuacucccagcu

SEQ ID NO: 3920029 - RNA, 14 nt, Human adenovirus D
ucuauuuucaaggu

SEQ ID NO: 3920030 - RNA, 18 nt, Human adenovirus D
ucucaauaaacagcacuu

SEQ ID NO: 3920031 - RNA, 15 nt, Human adenovirus D
ucucacucaaggugg

SEQ ID NO: 3920032 - RNA, 15 nt, Human adenovirus D
ucucgauccagcaga

SEQ ID NO: 3920033 - RNA, 22 nt, Human adenovirus D
ucucuagcaugaccagacccag

SEQ ID NO: 3920034 - RNA, 23 nt, Human adenovirus D
ucucugcgcucgcucacccgcag

SEQ ID NO: 3920035 - RNA, 17 nt, Human adenovirus D
ucugaaaagucauccaa

SEQ ID NO: 3920036 - RNA, 20 nt, Human adenovirus D
ucugccauguucucacagua

SEQ ID NO: 3920037 - RNA, 17 nt, Human adenovirus D
ucugcccgcgcucaucc

SEQ ID NO: 3920038 - RNA, 18 nt, Human adenovirus D
ucugcccgcgcucauccc

SEQ ID NO: 3920039 - RNA, 16 nt, Human adenovirus D
ucugcucauacugcua

SEQ ID NO: 3920040 - RNA, 13 nt, Human adenovirus D
ucugcugcgccgc

SEQ ID NO: 3920041 - RNA, 13 nt, Human adenovirus D
ucuggacccgcgg

SEQ ID NO: 3920042 - RNA, 20 nt, Human adenovirus D
ucuggaggcgguggucccuu

SEQ ID NO: 3920043 - RNA, 16 nt, Human adenovirus D
ucuucaaccgcuuccc

SEQ ID NO: 3920044 - RNA, 20 nt, Human adenovirus D
ucuuccgcaacuuccagccc

SEQ ID NO: 3920045 - RNA, 21 nt, Human adenovirus D
ucuuccgcaacuuccagccca

SEQ ID NO: 3920046 - RNA, 17 nt, Human adenovirus D
ucuuccuccguagccug

SEQ ID NO: 3920047 - RNA, 17 nt, Human adenovirus D
ucuuuaugaacaugaag

SEQ ID NO: 3920048 - RNA, 14 nt, Human adenovirus D
ucuuugacacaccu

SEQ ID NO: 3920049 - RNA, 16 nt, Human adenovirus D
ugaaaaaauugaggac

SEQ ID NO: 3920050 - RNA, 17 nt, Human adenovirus D
ugaaaguaugucucugg

SEQ ID NO: 3920051 - RNA, 15 nt, Human adenovirus D
ugaaagucaggagca

SEQ ID NO: 3920052 - RNA, 16 nt, Human adenovirus D
ugaaauugcgggugau

SEQ ID NO: 3920053 - RNA, 20 nt, Human adenovirus D
ugaaccacacggccagcagg

SEQ ID NO: 3920054 - RNA, 16 nt, Human adenovirus D
ugaacccgcacuggcu

SEQ ID NO: 3920055 - RNA, 14 nt, Human adenovirus D
ugaaccgccgccgg

SEQ ID NO: 3920056 - RNA, 18 nt, Human adenovirus D
ugaacgacucgcugcugc

SEQ ID NO: 3920057 - RNA, 16 nt, Human adenovirus D
ugaacgcgcuggcgga

SEQ ID NO: 3920058 - RNA, 23 nt, Human adenovirus D
ugaacuacuggcuucuacagcca

SEQ ID NO: 3920059 - RNA, 18 nt, Human adenovirus D
ugaacugccuacaaccaa

SEQ ID NO: 3920060 - RNA, 23 nt, Human adenovirus D
ugaagacgccgccggucaucucc

SEQ ID NO: 3920061 - RNA, 21 nt, Human adenovirus D
ugaagauguaaccuugcaaga

SEQ ID NO: 3920062 - RNA, 21 nt, Human adenovirus D
ugaagcccgugaccugcagca

SEQ ID NO: 3920063 - RNA, 19 nt, Human adenovirus D
ugaagcccugcuauggcuc

SEQ ID NO: 3920064 - RNA, 14 nt, Human adenovirus D
ugaagcccugguuu

SEQ ID NO: 3920065 - RNA, 19 nt, Human adenovirus D
ugaaggccggcaugcccac

SEQ ID NO: 3920066 - RNA, 13 nt, Human adenovirus D
ugaaggggacgag

SEQ ID NO: 3920067 - RNA, 17 nt, Human adenovirus D
ugaagguuaguugcaga

SEQ ID NO: 3920068 - RNA, 17 nt, Human adenovirus D
ugaauaucagacaugcu

SEQ ID NO: 3920069 - RNA, 18 nt, Human adenovirus D
ugacagcgacgagacugg

SEQ ID NO: 3920070 - RNA, 22 nt, Human adenovirus D
ugacagcgacgagacuggccuc

SEQ ID NO: 3920071 - RNA, 23 nt, Human adenovirus D
ugacauggguggggaugaaccuu

SEQ ID NO: 3920072 - RNA, 14 nt, Human adenovirus D
ugaccaacuggucu

SEQ ID NO: 3920073 - RNA, 12 nt, Human adenovirus D
ugaccaagcugg

SEQ ID NO: 3920074 - RNA, 15 nt, Human adenovirus D
ugaccaauagacagc

SEQ ID NO: 3920075 - RNA, 18 nt, Human adenovirus D
ugaccacgguggugcaga

SEQ ID NO: 3920076 - RNA, 23 nt, Human adenovirus D
ugaccgagcugacggccagucug

SEQ ID NO: 3920077 - RNA, 16 nt, Human adenovirus D
ugaccgaggagcugag

SEQ ID NO: 3920078 - RNA, 20 nt, Human adenovirus D
ugaccuacgcgaccgugggg

SEQ ID NO: 3920079 - RNA, 16 nt, Human adenovirus D
ugaccugccuccacca

SEQ ID NO: 3920080 - RNA, 17 nt, Human adenovirus D
ugagaccaaguccaggg

SEQ ID NO: 3920081 - RNA, 19 nt, Human adenovirus D
ugagccagagcauguugca

SEQ ID NO: 3920082 - RNA, 14 nt, Human adenovirus D
ugagccgccagcug

SEQ ID NO: 3920083 - RNA, 15 nt, Human adenovirus D
ugagccgcgcgcugg

SEQ ID NO: 3920084 - RNA, 16 nt, Human adenovirus D
ugagcgacgaccuggg

SEQ ID NO: 3920085 - RNA, 15 nt, Human adenovirus D
ugagcgcgagccggc

SEQ ID NO: 3920086 - RNA, 16 nt, Human adenovirus D
ugaggggcggacccca

SEQ ID NO: 3920087 - RNA, 22 nt, Human adenovirus D
ugagguacaugggcaugagccc

SEQ ID NO: 3920088 - RNA, 14 nt, Human adenovirus D
ugagguggacgagg

SEQ ID NO: 3920089 - RNA, 20 nt, Human adenovirus D
ugagguuggcgauguugcca

SEQ ID NO: 3920090 - RNA, 16 nt, Human adenovirus D
ugaguagugggcgugg

SEQ ID NO: 3920091 - RNA, 17 nt, Human adenovirus D
ugaguccgucggccaug

SEQ ID NO: 3920092 - RNA, 12 nt, Human adenovirus D
ugaucucugcca

SEQ ID NO: 3920093 - RNA, 21 nt, Human adenovirus D
ugaucuuuaugaacaugaagu

SEQ ID NO: 3920094 - RNA, 20 nt, Human adenovirus D
ugauggccuguaccgggacc

SEQ ID NO: 3920095 - RNA, 22 nt, Human adenovirus D
ugcaaaaagucacuuaaguccu

SEQ ID NO: 3920096 - RNA, 17 nt, Human adenovirus D
ugcaacaugaccaagga

SEQ ID NO: 3920097 - RNA, 21 nt, Human adenovirus D
ugcaacaugaccaaggacugg

SEQ ID NO: 3920098 - RNA, 20 nt, Human adenovirus D
ugcaacccccagcuccugag

SEQ ID NO: 3920099 - RNA, 17 nt, Human adenovirus D
ugcaagaggcgacccau

SEQ ID NO: 3920100 - RNA, 22 nt, Human adenovirus D
ugcaagggugcgcuugagacuc

SEQ ID NO: 3920101 - RNA, 17 nt, Human adenovirus D
ugcaaguggggcggcaa

SEQ ID NO: 3920102 - RNA, 21 nt, Human adenovirus D
ugcacaguauugugggccugg

SEQ ID NO: 3920103 - RNA, 19 nt, Human adenovirus D
ugcaccacgcuucuucccc

SEQ ID NO: 3920104 - RNA, 19 nt, Human adenovirus D
ugcaccagccgcaccgcgg

SEQ ID NO: 3920105 - RNA, 19 nt, Human adenovirus D
ugcaccugggcgccagaag

SEQ ID NO: 3920106 - RNA, 23 nt, Human adenovirus D
ugcaccugggcgccagaaggggc

SEQ ID NO: 3920107 - RNA, 22 nt, Human adenovirus D
ugcacgagaaccgccuggggca

SEQ ID NO: 3920108 - RNA, 18 nt, Human adenovirus D
ugcacgcgggugagggug

SEQ ID NO: 3920109 - RNA, 22 nt, Human adenovirus D
ugcacuggcccgaccgacccau

SEQ ID NO: 3920110 - RNA, 22 nt, Human adenovirus D
ugcagaccgaccccuggcuccc

SEQ ID NO: 3920111 - RNA, 21 nt, Human adenovirus D
ugcagaccgcgggccuccucg

SEQ ID NO: 3920112 - RNA, 14 nt, Human adenovirus D
ugcagacucugcuc

SEQ ID NO: 3920113 - RNA, 17 nt, Human adenovirus D
ugcagcaggugcugccc

SEQ ID NO: 3920114 - RNA, 21 nt, Human adenovirus D
ugcagcaggugcugccccagg

SEQ ID NO: 3920115 - RNA, 14 nt, Human adenovirus D
ugcagccaguggcc

SEQ ID NO: 3920116 - RNA, 23 nt, Human adenovirus D
ugcagccgugaucccacagggca

SEQ ID NO: 3920117 - RNA, 19 nt, Human adenovirus D
ugcaggauaaauauggccu

SEQ ID NO: 3920118 - RNA, 22 nt, Human adenovirus D
ugcaggauaaauauggccugga

SEQ ID NO: 3920119 - RNA, 14 nt, Human adenovirus D
ugcaggccgggcug

SEQ ID NO: 3920120 - RNA, 14 nt, Human adenovirus D
ugcagggagccagg

SEQ ID NO: 3920121 - RNA, 15 nt, Human adenovirus D
ugcagggagccaggg

SEQ ID NO: 3920122 - RNA, 18 nt, Human adenovirus D
ugcaguccaaccuggacc

SEQ ID NO: 3920123 - RNA, 13 nt, Human adenovirus D
ugcaucucccagg

SEQ ID NO: 3920124 - RNA, 15 nt, Human adenovirus D
ugcauggccagccuu

SEQ ID NO: 3920125 - RNA, 22 nt, Human adenovirus D
ugccacucgcgggcggccauug

SEQ ID NO: 3920126 - RNA, 19 nt, Human adenovirus D
ugccauuuuucagcagagu

SEQ ID NO: 3920127 - RNA, 12 nt, Human adenovirus D
ugcccagcagca

SEQ ID NO: 3920128 - RNA, 21 nt, Human adenovirus D
ugccccaaaaguucuuugcca

SEQ ID NO: 3920129 - RNA, 20 nt, Human adenovirus D
ugccccaggcggugcugcug

SEQ ID NO: 3920130 - RNA, 21 nt, Human adenovirus D
ugcccgacuucaugagccaga

SEQ ID NO: 3920131 - RNA, 15 nt, Human adenovirus D
ugcccgccaccugca

SEQ ID NO: 3920132 - RNA, 15 nt, Human adenovirus D
ugccgcgcgggcagg

SEQ ID NO: 3920133 - RNA, 16 nt, Human adenovirus D
ugccgcgcgggcagga

SEQ ID NO: 3920134 - RNA, 18 nt, Human adenovirus D
ugccugggaauccugcac

SEQ ID NO: 3920135 - RNA, 19 nt, Human adenovirus D
ugccuggucaaacaggcaa

SEQ ID NO: 3920136 - RNA, 13 nt, Human adenovirus D
ugccuuccaaaau

SEQ ID NO: 3920137 - RNA, 16 nt, Human adenovirus D
ugccuuuaucagcacu

SEQ ID NO: 3920138 - RNA, 13 nt, Human adenovirus D
gaugcugagccug

SEQ ID NO: 3920139 - RNA, 23 nt, Human adenovirus D
gaugcugcccgccaccugcaacg

SEQ ID NO: 3920140 - RNA, 16 nt, Human adenovirus D
gauggaaaggucacuu

SEQ ID NO: 3920141 - RNA, 14 nt, Human adenovirus D
gauggaggagcagc

SEQ ID NO: 3920142 - RNA, 21 nt, Human adenovirus D
gauggccacggggagccccuu

SEQ ID NO: 3920143 - RNA, 21 nt, Human adenovirus D
gauggccuguaccgggaccga

SEQ ID NO: 3920144 - RNA, 14 nt, Human adenovirus D
gauggggccccgcc

SEQ ID NO: 3920145 - RNA, 14 nt, Human adenovirus D
gaugguagcagcag

SEQ ID NO: 3920146 - RNA, 23 nt, Human adenovirus D
gaugguggcgcgcaccucgcgcu

SEQ ID NO: 3920147 - RNA, 13 nt, Human adenovirus D
gaugucugugaag

SEQ ID NO: 3920148 - RNA, 18 nt, Human adenovirus D
gaugugcaguuuggccug

SEQ ID NO: 3920149 - RNA, 14 nt, Human adenovirus D
gaugugcggcagcu

SEQ ID NO: 3920150 - RNA, 16 nt, Human adenovirus D
gauguuggcuugcccu

SEQ ID NO: 3920151 - RNA, 22 nt, Human adenovirus D
gauuagagguagguuugaguag

SEQ ID NO: 3920152 - RNA, 20 nt, Human adenovirus D
gauuauccuuucccuggugg

SEQ ID NO: 3920153 - RNA, 17 nt, Human adenovirus D
gcaaaagcgccaggagg

SEQ ID NO: 3920154 - RNA, 19 nt, Human adenovirus D
gcaaaguuuuucaggggcu

SEQ ID NO: 3920155 - RNA, 16 nt, Human adenovirus D
gcaacaccugggcacu

SEQ ID NO: 3920156 - RNA, 12 nt, Human adenovirus D
gcaacagcaaaa

SEQ ID NO: 3920157 - RNA, 20 nt, Human adenovirus D
gcaacucguaccugggucac

SEQ ID NO: 3920158 - RNA, 21 nt, Human adenovirus D
gcaacugcgcguccgucagca

SEQ ID NO: 3920159 - RNA, 21 nt, Human adenovirus D
gcaagagcucaaaguaaaaaa

SEQ ID NO: 3920160 - RNA, 21 nt, Human adenovirus D
gcaagggcgaccagcucuggg

SEQ ID NO: 3920161 - RNA, 20 nt, Human adenovirus D
gcaagguccgcaggagucca

SEQ ID NO: 3920162 - RNA, 22 nt, Human adenovirus D
gcaaggucgaggagaccugcac

SEQ ID NO: 3920163 - RNA, 17 nt, Human adenovirus D
gcaaguacauagugacc

SEQ ID NO: 3920164 - RNA, 14 nt, Human adenovirus D
gcaagugcacagac

SEQ ID NO: 3920165 - RNA, 16 nt, Human adenovirus D
gcaauaccaccccaug

SEQ ID NO: 3920166 - RNA, 14 nt, Human adenovirus D
gcaaugcgggccug

SEQ ID NO: 3920167 - RNA, 20 nt, Human adenovirus D
gcaaugcuuuuuaggagacu

SEQ ID NO: 3920168 - RNA, 20 nt, Human adenovirus D
gcacaacaccgccuccaccc

SEQ ID NO: 3920169 - RNA, 18 nt, Human adenovirus D
gcacagacaccgucgccg

SEQ ID NO: 3920170 - RNA, 17 nt, Human adenovirus D
gcacaggcacacugaca

SEQ ID NO: 3920171 - RNA, 20 nt, Human adenovirus D
gcacaggcacacugacauac

SEQ ID NO: 3920172 - RNA, 20 nt, Human adenovirus D
gcacaguauugugggccugg

SEQ ID NO: 3920173 - RNA, 16 nt, Human adenovirus D
gcacaguuggcgaccc

SEQ ID NO: 3920174 - RNA, 18 nt, Human adenovirus D
gcacauaaucaccauguu

SEQ ID NO: 3920175 - RNA, 14 nt, Human adenovirus D
gcaccacugcaugg

SEQ ID NO: 3920176 - RNA, 16 nt, Human adenovirus D
gcaccagccgcaccgc

SEQ ID NO: 3920177 - RNA, 15 nt, Human adenovirus D
gcacccaccacaguu

SEQ ID NO: 3920178 - RNA, 20 nt, Human adenovirus D
gcacccgcugcgggguacug

SEQ ID NO: 3920179 - RNA, 22 nt, Human adenovirus D
gcacccgguacuacgccagccg

SEQ ID NO: 3920180 - RNA, 22 nt, Human adenovirus D
gcaccgucgccucggaccuggc

SEQ ID NO: 3920181 - RNA, 20 nt, Human adenovirus D
gcaccucgguacccuccucc

SEQ ID NO: 3920182 - RNA, 18 nt, Human adenovirus D
gcaccugugggaccuggc

SEQ ID NO: 3920183 - RNA, 21 nt, Human adenovirus D
gcacgagaaccgccuggggca

SEQ ID NO: 3920184 - RNA, 14 nt, Human adenovirus D
gcacgauccugacg

SEQ ID NO: 3920185 - RNA, 14 nt, Human adenovirus D
gcacgcagcagcgc

SEQ ID NO: 3920186 - RNA, 15 nt, Human adenovirus D
gcacgcucugaggcu

SEQ ID NO: 3920187 - RNA, 18 nt, Human adenovirus D
gcacggcuuacaacagcc

SEQ ID NO: 3920188 - RNA, 14 nt, Human adenovirus D
gcacgucgcccgag

SEQ ID NO: 3920189 - RNA, 23 nt, Human adenovirus D
gcacguggcggcggccaaccugg

SEQ ID NO: 3920190 - RNA, 20 nt, Human adenovirus D
gcacguuucgucaggcaggc

SEQ ID NO: 3920191 - RNA, 14 nt, Human adenovirus D
gcacuacagccggg

SEQ ID NO: 3920192 - RNA, 18 nt, Human adenovirus D
gcagaacuacacggucac

SEQ ID NO: 3920193 - RNA, 24 nt, Human adenovirus D
gcagaagaucccggcgcaguacgc

SEQ ID NO: 3920194 - RNA, 13 nt, Human adenovirus D
gcagacagggccu

SEQ ID NO: 3920195 - RNA, 15 nt, Human adenovirus D
gcagacagggccugc

SEQ ID NO: 3920196 - RNA, 19 nt, Human adenovirus D
gcagacggugaagcaggag

SEQ ID NO: 3920197 - RNA, 23 nt, Human adenovirus D
gcagacuuccucguuucgggggu

SEQ ID NO: 3920198 - RNA, 16 nt, Human adenovirus D
gcagagcacgcugcac

SEQ ID NO: 3920199 - RNA, 13 nt, Human adenovirus D
gcagaggaagagg

SEQ ID NO: 3920200 - RNA, 14 nt, Human adenovirus D
gcagcacaguaagu

SEQ ID NO: 3920201 - RNA, 20 nt, Human adenovirus D
gcagcacaucaagcagaugc

SEQ ID NO: 3920202 - RNA, 14 nt, Human adenovirus D
gcagcacuggaaca

SEQ ID NO: 3920203 - RNA, 19 nt, Human adenovirus D
gcagcacuggaacaccauc

SEQ ID NO: 3920204 - RNA, 15 nt, Human adenovirus D
gcagcagcaguagcc

SEQ ID NO: 3920205 - RNA, 18 nt, Human adenovirus D
gcagcaggguacccacug

SEQ ID NO: 3920206 - RNA, 13 nt, Human adenovirus D
gcagcccuucucc

SEQ ID NO: 3920207 - RNA, 18 nt, Human adenovirus D
gcagcccuucuccacggg

SEQ ID NO: 3920208 - RNA, 15 nt, Human adenovirus D
gcagccgcggcagcc

SEQ ID NO: 3920209 - RNA, 18 nt, Human adenovirus D
gcagccgcggcagccgca

SEQ ID NO: 3920210 - RNA, 22 nt, Human adenovirus D
gcagccgugaucccacagggca

SEQ ID NO: 3920211 - RNA, 12 nt, Human adenovirus D
gcagccugagcu

SEQ ID NO: 3920212 - RNA, 20 nt, Human adenovirus D
gcagcgccagucccucaucc

SEQ ID NO: 3920213 - RNA, 17 nt, Human adenovirus D
gcagcgccccgaggaca

SEQ ID NO: 3920214 - RNA, 17 nt, Human adenovirus D
gcagcgcugcacgggcu

SEQ ID NO: 3920215 - RNA, 20 nt, Human adenovirus D
gcagcggggaggagcccgag

SEQ ID NO: 3920216 - RNA, 19 nt, Human adenovirus D
gcagcucaucgacuggugc

SEQ ID NO: 3920217 - RNA, 22 nt, Human adenovirus D
gcagcuccgguugugcagcccc

SEQ ID NO: 3920218 - RNA, 20 nt, Human adenovirus D
gcagcucuucccgcugaacu

SEQ ID NO: 3920219 - RNA, 15 nt, Human adenovirus D
gcagcuugcugacgc

SEQ ID NO: 3920220 - RNA, 16 nt, Human adenovirus D
gcaggaguccaccgcu

SEQ ID NO: 3920221 - RNA, 19 nt, Human adenovirus D
gcaggaguccaccgcuccg

SEQ ID NO: 3920222 - RNA, 23 nt, Human adenovirus D
gcaggauaaauauggccuggagc

SEQ ID NO: 3920223 - RNA, 16 nt, Human adenovirus D
gcaggccauggacgag

SEQ ID NO: 3920224 - RNA, 22 nt, Human adenovirus D
gcaggccgugcugcucgagcgc

SEQ ID NO: 3920225 - RNA, 13 nt, Human adenovirus D
gcaggcgcccagc

SEQ ID NO: 3920226 - RNA, 15 nt, Human adenovirus D
gcaggcgggacagag

SEQ ID NO: 3920227 - RNA, 16 nt, Human adenovirus D
gcaggcgucgcagcgc

SEQ ID NO: 3920228 - RNA, 16 nt, Human adenovirus D
gcagggcgcccagcau

SEQ ID NO: 3920229 - RNA, 18 nt, Human adenovirus D
gcagggugaccaggucca

SEQ ID NO: 3920230 - RNA, 22 nt, Human adenovirus D
gcagggugaccagguccacgcu

SEQ ID NO: 3920231 - RNA, 17 nt, Human adenovirus D
gcagguggacgagccgc

SEQ ID NO: 3920232 - RNA, 13 nt, Human adenovirus D
gcagguggcgccg

SEQ ID NO: 3920233 - RNA, 14 nt, Human adenovirus D
gcagguggcgccgg

SEQ ID NO: 3920234 - RNA, 19 nt, Human adenovirus D
gcagguggcgccgggccug

SEQ ID NO: 3920235 - RNA, 16 nt, Human adenovirus D
gcagguguccgagcuc

SEQ ID NO: 3920236 - RNA, 21 nt, Human adenovirus D
gcaguagccccucugugccca

SEQ ID NO: 3920237 - RNA, 23 nt, Human adenovirus D
gcaguccaugcccaacaggccua

SEQ ID NO: 3920238 - RNA, 19 nt, Human adenovirus D
gcaguccgccaagcuccuc

SEQ ID NO: 3920239 - RNA, 14 nt, Human adenovirus D
gcagugggcgcaga

SEQ ID NO: 3920240 - RNA, 16 nt, Human adenovirus D
gcaguugaccaugagc

SEQ ID NO: 3920241 - RNA, 21 nt, Human adenovirus D
gcauaauauggugaagggcug

SEQ ID NO: 3920242 - RNA, 16 nt, Human adenovirus D
gcauccacaaggccgu

SEQ ID NO: 3920243 - RNA, 22 nt, Human adenovirus D
gcauccuuuaauccgugugcug

SEQ ID NO: 3920244 - RNA, 18 nt, Human adenovirus D
gcaugcccaccacgcgca

SEQ ID NO: 3920245 - RNA, 14 nt, Human adenovirus D
gcaugcggggggag

SEQ ID NO: 3920246 - RNA, 14 nt, Human adenovirus D
gcauggccucgugc

SEQ ID NO: 3920247 - RNA, 16 nt, Human adenovirus D
gcauguacggaggagc

SEQ ID NO: 3920248 - RNA, 18 nt, Human adenovirus D
gcauguacggaggagcca

SEQ ID NO: 3920249 - RNA, 23 nt, Human adenovirus D
gcauuacuauuacugccacugcc

SEQ ID NO: 3920250 - RNA, 17 nt, Human adenovirus D
gcauuggcagccgagcc

SEQ ID NO: 3920251 - RNA, 15 nt, Human adenovirus D
gcauugucugccugg

SEQ ID NO: 3920252 - RNA, 20 nt, Human adenovirus D
gccaacauuacuucuggcac

SEQ ID NO: 3920253 - RNA, 17 nt, Human adenovirus D
gccaaccgcacccgcgc

SEQ ID NO: 3920254 - RNA, 19 nt, Human adenovirus D
gccaauaacgggauagaga

SEQ ID NO: 3920255 - RNA, 19 nt, Human adenovirus D
gccacaugacccugcaugg

SEQ ID NO: 3920256 - RNA, 22 nt, Human adenovirus D
gacagugcuccacucgacccug

SEQ ID NO: 3920257 - RNA, 14 nt, Human adenovirus D
gacaguggcagcgu

SEQ ID NO: 3920258 - RNA, 15 nt, Human adenovirus D
gacauacaaaaaucg

SEQ ID NO: 3920259 - RNA, 19 nt, Human adenovirus D
gacaucgcgaaccaggcag

SEQ ID NO: 3920260 - RNA, 19 nt, Human adenovirus D
gacaucgcuucccugaacu

SEQ ID NO: 3920261 - RNA, 22 nt, Human adenovirus D
gacaugaccgcgcgcaacaugg

SEQ ID NO: 3920262 - RNA, 15 nt, Human adenovirus D
gacauggccagcacg

SEQ ID NO: 3920263 - RNA, 15 nt, Human adenovirus D
gacaugggggcggac

SEQ ID NO: 3920264 - RNA, 19 nt, Human adenovirus D
gacaugggggcggaccugc

SEQ ID NO: 3920265 - RNA, 15 nt, Human adenovirus D
gacauuuuaaugaau

SEQ ID NO: 3920266 - RNA, 21 nt, Human adenovirus D
gaccaaucgcgcccgcagcac

SEQ ID NO: 3920267 - RNA, 14 nt, Human adenovirus D
gaccaccaccugga

SEQ ID NO: 3920268 - RNA, 16 nt, Human adenovirus D
gaccaccugcgcgagg

SEQ ID NO: 3920269 - RNA, 14 nt, Human adenovirus D
gaccacgguggugc

SEQ ID NO: 3920270 - RNA, 19 nt, Human adenovirus D
gaccacgguggugcagaac

SEQ ID NO: 3920271 - RNA, 22 nt, Human adenovirus D
gaccacugccgccgccugcgcu

SEQ ID NO: 3920272 - RNA, 17 nt, Human adenovirus D
gaccagaacuuccagca

SEQ ID NO: 3920273 - RNA, 22 nt, Human adenovirus D
gaccagaccaccuggugauggc

SEQ ID NO: 3920274 - RNA, 12 nt, Human adenovirus D
gaccaugagcuc

SEQ ID NO: 3920275 - RNA, 22 nt, Human adenovirus D
gacccaguggcgagaggcgagc

SEQ ID NO: 3920276 - RNA, 17 nt, Human adenovirus D
gacccaugagcugcgag

SEQ ID NO: 3920277 - RNA, 11 nt, Human adenovirus D
gacccccuucc

SEQ ID NO: 3920278 - RNA, 18 nt, Human adenovirus D
gaccgaguucagcuccag

SEQ ID NO: 3920279 - RNA, 23 nt, Human adenovirus D
gaccgcauccacaaggccgugag

SEQ ID NO: 3920280 - RNA, 16 nt, Human adenovirus D
gaccgcgagcugaugc

SEQ ID NO: 3920281 - RNA, 22 nt, Human adenovirus D
gaccgcggccguagcaggcgcc

SEQ ID NO: 3920282 - RNA, 17 nt, Human adenovirus D
gaccgcugucucagccu

SEQ ID NO: 3920283 - RNA, 16 nt, Human adenovirus D
gaccggucgacgguga

SEQ ID NO: 3920284 - RNA, 18 nt, Human adenovirus D
gaccgugccgcggugcgc

SEQ ID NO: 3920285 - RNA, 16 nt, Human adenovirus D
gaccuaccaaugaaaa

SEQ ID NO: 3920286 - RNA, 18 nt, Human adenovirus D
gaccucccaccccagaaa

SEQ ID NO: 3920287 - RNA, 21 nt, Human adenovirus D
gaccugcagcaggugcugccc

SEQ ID NO: 3920288 - RNA, 17 nt, Human adenovirus D
gaccugccuccaccacc

SEQ ID NO: 3920289 - RNA, 22 nt, Human adenovirus D
gaccugcgcgucgacggcgccu

SEQ ID NO: 3920290 - RNA, 14 nt, Human adenovirus D
gaccuggcggaggc

SEQ ID NO: 3920291 - RNA, 23 nt, Human adenovirus D
gaccuucauaauagaaacagauc

SEQ ID NO: 3920292 - RNA, 14 nt, Human adenovirus D
gaccuuccaggaga

SEQ ID NO: 3920293 - RNA, 17 nt, Human adenovirus D
gaccuugcagagcagcu

SEQ ID NO: 3920294 - RNA, 21 nt, Human adenovirus D
gaccuugcagagcagcucuuc

SEQ ID NO: 3920295 - RNA, 13 nt, Human adenovirus D
gacgacggcgacg

SEQ ID NO: 3920296 - RNA, 17 nt, Human adenovirus D
gacgagaaccugaagga

SEQ ID NO: 3920297 - RNA, 16 nt, Human adenovirus D
gacgagacgcgcgcgg

SEQ ID NO: 3920298 - RNA, 14 nt, Human adenovirus D
gacgagacuggccu

SEQ ID NO: 3920299 - RNA, 14 nt, Human adenovirus D
gacgcacuggccga

SEQ ID NO: 3920300 - RNA, 14 nt, Human adenovirus D
gacgcccuggccga

SEQ ID NO: 3920301 - RNA, 15 nt, Human adenovirus D
gacgccgaggcucug

SEQ ID NO: 3920302 - RNA, 14 nt, Human adenovirus D
gacgcgcucccggc

SEQ ID NO: 3920303 - RNA, 20 nt, Human adenovirus D
gacgcugagcgacgaccugg

SEQ ID NO: 3920304 - RNA, 19 nt, Human adenovirus D
gacgcugcgcuuugugccc

SEQ ID NO: 3920305 - RNA, 19 nt, Human adenovirus D
gacgguaagcacgagcggc

SEQ ID NO: 3920306 - RNA, 16 nt, Human adenovirus D
gacggucugcaggccg

SEQ ID NO: 3920307 - RNA, 18 nt, Human adenovirus D
gacuaucuaugaaagcau

SEQ ID NO: 3920308 - RNA, 21 nt, Human adenovirus D
gacucaggggguugcgcacgu

SEQ ID NO: 3920309 - RNA, 18 nt, Human adenovirus D
gacucauccugcuggugc

SEQ ID NO: 3920310 - RNA, 14 nt, Human adenovirus D
gacuccgucacggg

SEQ ID NO: 3920311 - RNA, 18 nt, Human adenovirus D
gacucgcagacgagcggc

SEQ ID NO: 3920312 - RNA, 20 nt, Human adenovirus D
gacugauggccacggggagc

SEQ ID NO: 3920313 - RNA, 15 nt, Human adenovirus D
gacugggaggcugcg

SEQ ID NO: 3920314 - RNA, 21 nt, Human adenovirus D
gacuggguuaguaugucccug

SEQ ID NO: 3920315 - RNA, 18 nt, Human adenovirus D
gacuucaugagccagagc

SEQ ID NO: 3920316 - RNA, 22 nt, Human adenovirus D
gagaauuuuuguuguacucugu

SEQ ID NO: 3920317 - RNA, 18 nt, Human adenovirus D
gagaccaacggcugcauc

SEQ ID NO: 3920318 - RNA, 15 nt, Human adenovirus D
gagacccaggucauc

SEQ ID NO: 3920319 - RNA, 24 nt, Human adenovirus D
gagacccaggucaucgguaccuuc

SEQ ID NO: 3920320 - RNA, 17 nt, Human adenovirus D
gagaccgacgcugggcu

SEQ ID NO: 3920321 - RNA, 20 nt, Human adenovirus D
gagaccggaggcgugcacug

SEQ ID NO: 3920322 - RNA, 12 nt, Human adenovirus D
gagaccugcacu

SEQ ID NO: 3920323 - RNA, 14 nt, Human adenovirus D
gagagaacaaaacc

SEQ ID NO: 3920324 - RNA, 14 nt, Human adenovirus D
gagagcgcuggcgu

SEQ ID NO: 3920325 - RNA, 18 nt, Human adenovirus D
gagagcgugauggcgcag

SEQ ID NO: 3920326 - RNA, 22 nt, Human adenovirus D
gagagguugaaaaggcagcuga

SEQ ID NO: 3920327 - RNA, 19 nt, Human adenovirus D
gagauagcaguugaccaug

SEQ ID NO: 3920328 - RNA, 23 nt, Human adenovirus D
gagauagcaguugaccaugagcu

SEQ ID NO: 3920329 - RNA, 19 nt, Human adenovirus D
gagauaugugcagcagagc

SEQ ID NO: 3920330 - RNA, 22 nt, Human adenovirus D
gagaucaacuacaaggacuaca

SEQ ID NO: 3920331 - RNA, 15 nt, Human adenovirus D
gagaucggcaccagc

SEQ ID NO: 3920332 - RNA, 17 nt, Human adenovirus D
gagaucguccuucacuc

SEQ ID NO: 3920333 - RNA, 21 nt, Human adenovirus D
gagaugccccagcagaagcag

SEQ ID NO: 3920334 - RNA, 19 nt, Human adenovirus D
gagaugcgacccaugagcu

SEQ ID NO: 3920335 - RNA, 22 nt, Human adenovirus D
gagauggugggccguuggaaga

SEQ ID NO: 3920336 - RNA, 16 nt, Human adenovirus D
gagcaaccuccugggc

SEQ ID NO: 3920337 - RNA, 19 nt, Human adenovirus D
gagcaaucccacgccgagc

SEQ ID NO: 3920338 - RNA, 17 nt, Human adenovirus D
gagcacagcaguacaag

SEQ ID NO: 3920339 - RNA, 19 nt, Human adenovirus D
gagcaccccaacggcccug

SEQ ID NO: 3920340 - RNA, 22 nt, Human adenovirus D
gagcacgcccgccauggggcgc

SEQ ID NO: 3920341 - RNA, 19 nt, Human adenovirus D
gagcagaccuuccaggaga

SEQ ID NO: 3920342 - RNA, 16 nt, Human adenovirus D
gagcaggaccugggcu

SEQ ID NO: 3920343 - RNA, 19 nt, Human adenovirus D
gagcaggguaaagccagca

SEQ ID NO: 3920344 - RNA, 15 nt, Human adenovirus D
gagccacugcuaccu

SEQ ID NO: 3920345 - RNA, 12 nt, Human adenovirus D
gagccauagagg

SEQ ID NO: 3920346 - RNA, 21 nt, Human adenovirus D
gagccauugaccaccagggag

SEQ ID NO: 3920347 - RNA, 16 nt, Human adenovirus D
gagccgccagcuggcc

SEQ ID NO: 3920348 - RNA, 23 nt, Human adenovirus D
gagccgcgcgcuggggcagaacg

SEQ ID NO: 3920349 - RNA, 14 nt, Human adenovirus D
gagccggcucgucu

SEQ ID NO: 3920350 - RNA, 16 nt, Human adenovirus D
gagccucccaggaggc

SEQ ID NO: 3920351 - RNA, 15 nt, Human adenovirus D
gagccugcgcccgcg

SEQ ID NO: 3920352 - RNA, 18 nt, Human adenovirus D
gagcgugauggcgcaggc

SEQ ID NO: 3920353 - RNA, 18 nt, Human adenovirus D
gagcucgaaugcaugcga

SEQ ID NO: 3920354 - RNA, 13 nt, Human adenovirus D
gagcucuugcagg

SEQ ID NO: 3920355 - RNA, 14 nt, Human adenovirus D
gagcugacggccag

SEQ ID NO: 3920356 - RNA, 23 nt, Human adenovirus D
gagcugagaccagaccaccuggu

SEQ ID NO: 3920357 - RNA, 22 nt, Human adenovirus D
gagcugaucucgcugccgcugg

SEQ ID NO: 3920358 - RNA, 18 nt, Human adenovirus D
gagcugaugcugagccug

SEQ ID NO: 3920359 - RNA, 16 nt, Human adenovirus D
gagcugcgcgagggcc

SEQ ID NO: 3920360 - RNA, 17 nt, Human adenovirus D
gagcugcgcgagggccu

SEQ ID NO: 3920361 - RNA, 19 nt, Human adenovirus D
gagcugcgcgagggccugg

SEQ ID NO: 3920362 - RNA, 15 nt, Human adenovirus D
gagcugggagggaug

SEQ ID NO: 3920363 - RNA, 20 nt, Human adenovirus D
gagcuguccauggugucgcg

SEQ ID NO: 3920364 - RNA, 22 nt, Human adenovirus D
gagcuuaacuuguaugugccuu

SEQ ID NO: 3920365 - RNA, 18 nt, Human adenovirus D
gagcuugcccuuggaaga

SEQ ID NO: 3920366 - RNA, 16 nt, Human adenovirus D
gaggacgaguaccuga

SEQ ID NO: 3920367 - RNA, 22 nt, Human adenovirus D
gaggacuuaaccacccacgagc

SEQ ID NO: 3920368 - RNA, 15 nt, Human adenovirus D
gaggagaccugcacu

SEQ ID NO: 3920369 - RNA, 19 nt, Human adenovirus D
gaggagcgcauccugagau

SEQ ID NO: 3920370 - RNA, 23 nt, Human adenovirus D
gaggagcugugucgggccuacga

SEQ ID NO: 3920371 - RNA, 16 nt, Human adenovirus D
gaggaggggggccacc

SEQ ID NO: 3920372 - RNA, 12 nt, Human adenovirus D
gaggcauggcag

SEQ ID NO: 3920373 - RNA, 21 nt, Human adenovirus D
gaggcauuggagaaugcugcu

SEQ ID NO: 3920374 - RNA, 20 nt, Human adenovirus D
gaggccauaggccaggcgca

SEQ ID NO: 3920375 - RNA, 20 nt, Human adenovirus D
gaggcccaucuacaggccag

SEQ ID NO: 3920376 - RNA, 18 nt, Human adenovirus D
gaggcgagcagcuguuga

SEQ ID NO: 3920377 - RNA, 22 nt, Human adenovirus D
gaggcgguccccgcccagcgag

SEQ ID NO: 3920378 - RNA, 15 nt, Human adenovirus D
gaggcuauuaagaag

SEQ ID NO: 3920379 - RNA, 20 nt, Human adenovirus D
gagggcaaugcuagagugag

SEQ ID NO: 3920380 - RNA, 17 nt, Human adenovirus D
gagggcaugggucaggc

SEQ ID NO: 3920381 - RNA, 21 nt, Human adenovirus D
gagggcaugggucaggcagcg

SEQ ID NO: 3920382 - RNA, 13 nt, Human adenovirus D
gaggggcuccucu

SEQ ID NO: 3920383 - RNA, 15 nt, Human adenovirus D
gaggggggccaccuc

SEQ ID NO: 3920384 - RNA, 16 nt, Human adenovirus D
gagggucuggagcucg

SEQ ID NO: 3920385 - RNA, 19 nt, Human adenovirus D
gagguacaugggcaugagc

SEQ ID NO: 3920386 - RNA, 13 nt, Human adenovirus D
gaggugcagaccg

SEQ ID NO: 3920387 - RNA, 20 nt, Human adenovirus D
gaggugccccagagcgaggu

SEQ ID NO: 3920388 - RNA, 22 nt, Human adenovirus D
gagguggacgagggggcaguag

SEQ ID NO: 3920389 - RNA, 15 nt, Human adenovirus D
gagguugagcuccac

SEQ ID NO: 3920390 - RNA, 22 nt, Human adenovirus D
gaguccuuuagacaacagccgc

SEQ ID NO: 3920391 - RNA, 17 nt, Human adenovirus D
gagucgaggucagcagc

SEQ ID NO: 3920392 - RNA, 15 nt, Human adenovirus D
gagucgcggaugaag

SEQ ID NO: 3920393 - RNA, 16 nt, Human adenovirus D
gagucgcggcagaacc

SEQ ID NO: 3920394 - RNA, 22 nt, Human adenovirus D
gagucugaaaaacagaaagcau

SEQ ID NO: 3920395 - RNA, 15 nt, Human adenovirus D
gagugaggcacugcu

SEQ ID NO: 3920396 - RNA, 18 nt, Human adenovirus D
gaguggccucucgcucca

SEQ ID NO: 3920397 - RNA, 13 nt, Human adenovirus D
gaguggcggcccu

SEQ ID NO: 3920398 - RNA, 21 nt, Human adenovirus D
gaguucgcuccgcggcggcgc

SEQ ID NO: 3920399 - RNA, 15 nt, Human adenovirus D
gauaaauauggccug

SEQ ID NO: 3920400 - RNA, 18 nt, Human adenovirus D
gauaaauauggccuggag

SEQ ID NO: 3920401 - RNA, 14 nt, Human adenovirus D
gaucaagugccaca

SEQ ID NO: 3920402 - RNA, 22 nt, Human adenovirus D
gauccagucauagcaggggcgc

SEQ ID NO: 3920403 - RNA, 20 nt, Human adenovirus D
gaucccagcguaagcgcgcg

SEQ ID NO: 3920404 - RNA, 14 nt, Human adenovirus D
gaucccgcuguggc

SEQ ID NO: 3920405 - RNA, 13 nt, Human adenovirus D
gauccugcugcuc

SEQ ID NO: 3920406 - RNA, 19 nt, Human adenovirus D
gaucgacgguggacgggcg

SEQ ID NO: 3920407 - RNA, 17 nt, Human adenovirus D
gaucgccgcgacccgcg

SEQ ID NO: 3920408 - RNA, 15 nt, Human adenovirus D
gaucgcgaggacacc

SEQ ID NO: 3920409 - RNA, 21 nt, Human adenovirus D
gaucgugguaaacgggcccug

SEQ ID NO: 3920410 - RNA, 18 nt, Human adenovirus D
gaucuccuccuccuggag

SEQ ID NO: 3920411 - RNA, 20 nt, Human adenovirus D
gaucuccuccuccuggagau

SEQ ID NO: 3920412 - RNA, 22 nt, Human adenovirus D
gaugaaagucaggagcagcgcc

SEQ ID NO: 3920413 - RNA, 23 nt, Human adenovirus D
gaugaacaacgccaucuuggaaa

SEQ ID NO: 3920414 - RNA, 13 nt, Human adenovirus D
gaugagcugcgag

SEQ ID NO: 3920415 - RNA, 17 nt, Human adenovirus D
gaugaggauugggagga

SEQ ID NO: 3920416 - RNA, 15 nt, Human adenovirus D
gaugaugaccgagcu

SEQ ID NO: 3920417 - RNA, 18 nt, Human adenovirus D
gaugauguccuugaggag

SEQ ID NO: 3920418 - RNA, 20 nt, Human adenovirus D
gaugccggcagcgguggugg

SEQ ID NO: 3920419 - RNA, 21 nt, Human adenovirus D
gccaccagucccuuuuccagg

SEQ ID NO: 3920420 - RNA, 18 nt, Human adenovirus D
gccaccucgccgcgcagg

SEQ ID NO: 3920421 - RNA, 14 nt, Human adenovirus D
gccacuacagcuga

SEQ ID NO: 3920422 - RNA, 19 nt, Human adenovirus D
gccacugcaccccccgcag

SEQ ID NO: 3920423 - RNA, 22 nt, Human adenovirus D
gccacuuccgcgcuccgugggg

SEQ ID NO: 3920424 - RNA, 19 nt, Human adenovirus D
gccagacagccgugccauc

SEQ ID NO: 3920425 - RNA, 22 nt, Human adenovirus D
gccagacgcacgggccgccggg

SEQ ID NO: 3920426 - RNA, 21 nt, Human adenovirus D
gccagaugcaucccguccugc

SEQ ID NO: 3920427 - RNA, 13 nt, Human adenovirus D
gccagcacguacu

SEQ ID NO: 3920428 - RNA, 18 nt, Human adenovirus D
gccagccgacuucuccag

SEQ ID NO: 3920429 - RNA, 18 nt, Human adenovirus D
gccagcgcgugcugcgcg

SEQ ID NO: 3920430 - RNA, 21 nt, Human adenovirus D
gccagcuggccgcccugaccc

SEQ ID NO: 3920431 - RNA, 12 nt, Human adenovirus D
gccaggaggcgg

SEQ ID NO: 3920432 - RNA, 17 nt, Human adenovirus D
gccaggugagcucgggc

SEQ ID NO: 3920433 - RNA, 20 nt, Human adenovirus D
gccaucaagaaccugcuccu

SEQ ID NO: 3920434 - RNA, 14 nt, Human adenovirus D
gccaugacagcgac

SEQ ID NO: 3920435 - RNA, 16 nt, Human adenovirus D
gccauggggcgccgcc

SEQ ID NO: 3920436 - RNA, 17 nt, Human adenovirus D
gcccaacggcaccugcg

SEQ ID NO: 3920437 - RNA, 20 nt, Human adenovirus D
gcccaacucgcggcugcugc

SEQ ID NO: 3920438 - RNA, 15 nt, Human adenovirus D
gcccacguccaaaau

SEQ ID NO: 3920439 - RNA, 22 nt, Human adenovirus D
gcccagcagcauguacggagga

SEQ ID NO: 3920440 - RNA, 14 nt, Human adenovirus D
gcccaggccgcucu

SEQ ID NO: 3920441 - RNA, 18 nt, Human adenovirus D
gcccagguuuuccaugca

SEQ ID NO: 3920442 - RNA, 17 nt, Human adenovirus D
gcccagugcuuccagca

SEQ ID NO: 3920443 - RNA, 23 nt, Human adenovirus D
gcccauaauucagggugcuccag

SEQ ID NO: 3920444 - RNA, 16 nt, Human adenovirus D
gcccauuccuggagau

SEQ ID NO: 3920445 - RNA, 21 nt, Human adenovirus D
gcccauuucacaguguacacg

SEQ ID NO: 3920446 - RNA, 18 nt, Human adenovirus D
gccccacaucgaggcccu

SEQ ID NO: 3920447 - RNA, 21 nt, Human adenovirus D
gccccagaugggccuggccgc

SEQ ID NO: 3920448 - RNA, 14 nt, Human adenovirus D
gccccccgcccgcg

SEQ ID NO: 3920449 - RNA, 16 nt, Human adenovirus D
gccccgcgggcagggg

SEQ ID NO: 3920450 - RNA, 20 nt, Human adenovirus D
gccccucaugaacacacugc

SEQ ID NO: 3920451 - RNA, 17 nt, Human adenovirus D
gccccugcaagugcaca

SEQ ID NO: 3920452 - RNA, 20 nt, Human adenovirus D
gcccgagggucgcuggcugc

SEQ ID NO: 3920453 - RNA, 23 nt, Human adenovirus D
gcccgagggucgcuggcugcugg

SEQ ID NO: 3920454 - RNA, 20 nt, Human adenovirus D
gcccgaguuguccugguagg

SEQ ID NO: 3920455 - RNA, 18 nt, Human adenovirus D
gcccgauagccgccagga

SEQ ID NO: 3920456 - RNA, 17 nt, Human adenovirus D
gcccgccauggggcgcc

SEQ ID NO: 3920457 - RNA, 20 nt, Human adenovirus D
gcccgccauggggcgccgcc

SEQ ID NO: 3920458 - RNA, 19 nt, Human adenovirus D
gcccgggacggaggcucgg

SEQ ID NO: 3920459 - RNA, 20 nt, Human adenovirus D
gcccgucgccgcaccugucc

SEQ ID NO: 3920460 - RNA, 18 nt, Human adenovirus D
gcccgugaccugcagcag

SEQ ID NO: 3920461 - RNA, 17 nt, Human adenovirus D
gcccgugggcugcggcu

SEQ ID NO: 3920462 - RNA, 19 nt, Human adenovirus D
gcccguucucgcuggucac

SEQ ID NO: 3920463 - RNA, 22 nt, Human adenovirus D
gcccucgaugaaagucaggagc

SEQ ID NO: 3920464 - RNA, 16 nt, Human adenovirus D
gcccugcucaccugca

SEQ ID NO: 3920465 - RNA, 17 nt, Human adenovirus D
gcccugcucaccugcac

SEQ ID NO: 3920466 - RNA, 18 nt, Human adenovirus D
gcccugcuggaugugccc

SEQ ID NO: 3920467 - RNA, 14 nt, Human adenovirus D
gcccugcuggccga

SEQ ID NO: 3920468 - RNA, 19 nt, Human adenovirus D
gcccuguggacgcuguuag

SEQ ID NO: 3920469 - RNA, 12 nt, Human adenovirus D
gcccuuccagca

SEQ ID NO: 3920470 - RNA, 14 nt, Human adenovirus D
gcccuuccagcaca

SEQ ID NO: 3920471 - RNA, 13 nt, Human adenovirus D
gcccuugccaccu

SEQ ID NO: 3920472 - RNA, 14 nt, Human adenovirus D
gcccuugccaccua

SEQ ID NO: 3920473 - RNA, 18 nt, Human adenovirus D
gcccuuuuugccggccga

SEQ ID NO: 3920474 - RNA, 23 nt, Human adenovirus D
gccgaaauuggugcgcuggggcu

SEQ ID NO: 3920475 - RNA, 14 nt, Human adenovirus D
gccgaggcuagcac

SEQ ID NO: 3920476 - RNA, 13 nt, Human adenovirus D
gccgcagcucuuc

SEQ ID NO: 3920477 - RNA, 11 nt, Human adenovirus D
gccgccaggcc

SEQ ID NO: 3920478 - RNA, 20 nt, Human adenovirus D
gccgccaucgaacacgccac

SEQ ID NO: 3920479 - RNA, 14 nt, Human adenovirus D
gccgccgccugcgc

SEQ ID NO: 3920480 - RNA, 16 nt, Human adenovirus D
gccgccgcggccaucu

SEQ ID NO: 3920481 - RNA, 15 nt, Human adenovirus D
gccgccgucugcccc

SEQ ID NO: 3920482 - RNA, 20 nt, Human adenovirus D
gccgcgggcgccucccagga

SEQ ID NO: 3920483 - RNA, 17 nt, Human adenovirus D
gccgcgguuaugcaggg

SEQ ID NO: 3920484 - RNA, 18 nt, Human adenovirus D
gccgcguaagcaggagca

SEQ ID NO: 3920485 - RNA, 19 nt, Human adenovirus D
gccgcguccccgcccgccg

SEQ ID NO: 3920486 - RNA, 18 nt, Human adenovirus D
gccgcgugguagcccccu

SEQ ID NO: 3920487 - RNA, 18 nt, Human adenovirus D
gccgcugcaaccugugcu

SEQ ID NO: 3920488 - RNA, 23 nt, Human adenovirus D
gccgcugcaaccugugcucuccg

SEQ ID NO: 3920489 - RNA, 16 nt, Human adenovirus D
gccggcgcuagccagc

SEQ ID NO: 3920490 - RNA, 14 nt, Human adenovirus D
gccggcggcgagga

SEQ ID NO: 3920491 - RNA, 14 nt, Human adenovirus D
gccggcggcgcgag

SEQ ID NO: 3920492 - RNA, 13 nt, Human adenovirus D
gccggcucaagca

SEQ ID NO: 3920493 - RNA, 22 nt, Human adenovirus D
gccgggccaugaugcgagccgc

SEQ ID NO: 3920494 - RNA, 21 nt, Human adenovirus D
gccguccuuucgcugcugccg

SEQ ID NO: 3920495 - RNA, 17 nt, Human adenovirus D
gccgugagcgcgagccg

SEQ ID NO: 3920496 - RNA, 23 nt, Human adenovirus D
gccguguccacgcauugcaugag

SEQ ID NO: 3920497 - RNA, 16 nt, Human adenovirus D
gccucccaggaggcga

SEQ ID NO: 3920498 - RNA, 19 nt, Human adenovirus D
gccuccccgcagaaaucag

SEQ ID NO: 3920499 - RNA, 19 nt, Human adenovirus D
gccucccgcccgacacugc

SEQ ID NO: 3920500 - RNA, 21 nt, Human adenovirus D
gccucgagcuacaugcccagc

SEQ ID NO: 3920501 - RNA, 15 nt, Human adenovirus D
gccucggaccuggcc

SEQ ID NO: 3920502 - RNA, 13 nt, Human adenovirus D
gccucuccaucag

SEQ ID NO: 3920503 - RNA, 22 nt, Human adenovirus D
gccucuccaucagcgcccucag

SEQ ID NO: 3920504 - RNA, 21 nt, Human adenovirus D
gccucugcgugaagaccacug

SEQ ID NO: 3920505 - RNA, 15 nt, Human adenovirus D
gccugccccucauga

SEQ ID NO: 3920506 - RNA, 23 nt, Human adenovirus D
gccugcgcccgcgccgcggcgac

SEQ ID NO: 3920507 - RNA, 14 nt, Human adenovirus D
gccuguacccagag

SEQ ID NO: 3920508 - RNA, 15 nt, Human adenovirus D
gccuguacccagagc

SEQ ID NO: 3920509 - RNA, 13 nt, Human adenovirus D
gccuuccccuccg

SEQ ID NO: 3920510 - RNA, 14 nt, Human adenovirus D
gccuucgugcacug

SEQ ID NO: 3920511 - RNA, 18 nt, Human adenovirus D
gccuucuauggaggcaga

SEQ ID NO: 3920512 - RNA, 21 nt, Human adenovirus D
gccuucuauggaggcagagcu

SEQ ID NO: 3920513 - RNA, 16 nt, Human adenovirus D
gccuuguaccugcccg

SEQ ID NO: 3920514 - RNA, 14 nt, Human adenovirus D
gccuuguagggaca

SEQ ID NO: 3920515 - RNA, 11 nt, Human adenovirus D
gcgaacagcag

SEQ ID NO: 3920516 - RNA, 14 nt, Human adenovirus D
gcgaaccaggcagu

SEQ ID NO: 3920517 - RNA, 19 nt, Human adenovirus D
gcgaaggugucccugacca

SEQ ID NO: 3920518 - RNA, 13 nt, Human adenovirus D
gcgacccaugagc

SEQ ID NO: 3920519 - RNA, 18 nt, Human adenovirus D
gcgacccaugauggugcu

SEQ ID NO: 3920520 - RNA, 18 nt, Human adenovirus D
gcgaccccguucgcgagg

SEQ ID NO: 3920521 - RNA, 19 nt, Human adenovirus D
gcgaccgcgagcugaugcu

SEQ ID NO: 3920522 - RNA, 18 nt, Human adenovirus D
gcgacgacgacauccugg

SEQ ID NO: 3920523 - RNA, 19 nt, Human adenovirus D
gcgacgcuuuuucagcgac

SEQ ID NO: 3920524 - RNA, 16 nt, Human adenovirus D
gcgagaaggcgcccag

SEQ ID NO: 3920525 - RNA, 15 nt, Human adenovirus D
gcgagaaggcgcgcg

SEQ ID NO: 3920526 - RNA, 12 nt, Human adenovirus D
gcgagacccagg

SEQ ID NO: 3920527 - RNA, 21 nt, Human adenovirus D
gcgagcagaacgggggcagca

SEQ ID NO: 3920528 - RNA, 15 nt, Human adenovirus D
gcgagccggcggcgc

SEQ ID NO: 3920529 - RNA, 16 nt, Human adenovirus D
gcgaggaugagagccg

SEQ ID NO: 3920530 - RNA, 15 nt, Human adenovirus D
gcgaggucauucgag

SEQ ID NO: 3920531 - RNA, 22 nt, Human adenovirus D
gcgagugcgggggcagacacac

SEQ ID NO: 3920532 - RNA, 16 nt, Human adenovirus D
gcgauauuggagucaa

SEQ ID NO: 3920533 - RNA, 17 nt, Human adenovirus D
gcgauccucgcccaauu

SEQ ID NO: 3920534 - RNA, 14 nt, Human adenovirus D
gcgauguugccacc

SEQ ID NO: 3920535 - RNA, 15 nt, Human adenovirus D
gcgauguugccaccc

SEQ ID NO: 3920536 - RNA, 19 nt, Human adenovirus D
gcgauguugccacccagau

SEQ ID NO: 3920537 - RNA, 14 nt, Human adenovirus D
gcgcaaccaggagg

SEQ ID NO: 3920538 - RNA, 18 nt, Human adenovirus D
ccugcaagugcacagacc

SEQ ID NO: 3920539 - RNA, 22 nt, Human adenovirus D
ccugcacgagaaccgccugggg

SEQ ID NO: 3920540 - RNA, 16 nt, Human adenovirus D
ccugcaggggcguccc

SEQ ID NO: 3920541 - RNA, 13 nt, Human adenovirus D
ccugcccuuccag

SEQ ID NO: 3920542 - RNA, 20 nt, Human adenovirus D
ccugccugggaauccugcac

SEQ ID NO: 3920543 - RNA, 12 nt, Human adenovirus D
ccugcgccgggc

SEQ ID NO: 3920544 - RNA, 17 nt, Human adenovirus D
ccugcgucaucacccag

SEQ ID NO: 3920545 - RNA, 16 nt, Human adenovirus D
ccugcuccugcucccg

SEQ ID NO: 3920546 - RNA, 17 nt, Human adenovirus D
ccuggagacgggcugcu

SEQ ID NO: 3920547 - RNA, 14 nt, Human adenovirus D
ccuggcgacgcagc

SEQ ID NO: 3920548 - RNA, 16 nt, Human adenovirus D
ccuggcggaggccauc

SEQ ID NO: 3920549 - RNA, 19 nt, Human adenovirus D
ccuggcuccgcggcacggc

SEQ ID NO: 3920550 - RNA, 12 nt, Human adenovirus D
ccugggaggaga

SEQ ID NO: 3920551 - RNA, 17 nt, Human adenovirus D
ccugggcacuggagcac

SEQ ID NO: 3920552 - RNA, 21 nt, Human adenovirus D
ccugggcacuggagcacagac

SEQ ID NO: 3920553 - RNA, 16 nt, Human adenovirus D
ccugggccugaugcac

SEQ ID NO: 3920554 - RNA, 18 nt, Human adenovirus D
ccugggcgugcagaccgu

SEQ ID NO: 3920555 - RNA, 16 nt, Human adenovirus D
ccugguacgagcuaca

SEQ ID NO: 3920556 - RNA, 22 nt, Human adenovirus D
ccugguacgagcuacagcagga

SEQ ID NO: 3920557 - RNA, 19 nt, Human adenovirus D
ccuggucacccucgagcuc

SEQ ID NO: 3920558 - RNA, 13 nt, Human adenovirus D
ccuggucaucacc

SEQ ID NO: 3920559 - RNA, 20 nt, Human adenovirus D
ccuggugguacagcacagca

SEQ ID NO: 3920560 - RNA, 22 nt, Human adenovirus D
ccugguuagguucuucacccag

SEQ ID NO: 3920561 - RNA, 15 nt, Human adenovirus D
ccugugggaccuggc

SEQ ID NO: 3920562 - RNA, 19 nt, Human adenovirus D
ccuucaacagaaccggagg

SEQ ID NO: 3920563 - RNA, 14 nt, Human adenovirus D
ccuucaaccaccac

SEQ ID NO: 3920564 - RNA, 18 nt, Human adenovirus D
ccuucagcaucagucucc

SEQ ID NO: 3920565 - RNA, 12 nt, Human adenovirus D
ccuuccugcagc

SEQ ID NO: 3920566 - RNA, 21 nt, Human adenovirus D
ccuucgugcacuggcccgacc

SEQ ID NO: 3920567 - RNA, 18 nt, Human adenovirus D
ccuucuccacggggaggg

SEQ ID NO: 3920568 - RNA, 14 nt, Human adenovirus D
ccuugaggaggaga

SEQ ID NO: 3920569 - RNA, 21 nt, Human adenovirus D
ccuugcaaaagcgccaggagg

SEQ ID NO: 3920570 - RNA, 14 nt, Human adenovirus D
ccuugcagagcagc

SEQ ID NO: 3920571 - RNA, 12 nt, Human adenovirus D
ccuugccuuccu

SEQ ID NO: 3920572 - RNA, 23 nt, Human adenovirus D
ccuugucguacuucugccagcag

SEQ ID NO: 3920573 - RNA, 15 nt, Human adenovirus D
ccuuucgcugcugcc

SEQ ID NO: 3920574 - RNA, 19 nt, Human adenovirus D
cgaaauuggugcgcugggg

SEQ ID NO: 3920575 - RNA, 16 nt, Human adenovirus D
cgaacaguccacccag

SEQ ID NO: 3920576 - RNA, 18 nt, Human adenovirus D
cgaacuuucuccacaccu

SEQ ID NO: 3920577 - RNA, 19 nt, Human adenovirus D
cgaagaagaacaggagccg

SEQ ID NO: 3920578 - RNA, 17 nt, Human adenovirus D
cgaagccguggcgcagc

SEQ ID NO: 3920579 - RNA, 20 nt, Human adenovirus D
cgacacguacuucagccugg

SEQ ID NO: 3920580 - RNA, 15 nt, Human adenovirus D
cgacagucugagggc

SEQ ID NO: 3920581 - RNA, 16 nt, Human adenovirus D
cgacaugcccgacccc

SEQ ID NO: 3920582 - RNA, 20 nt, Human adenovirus D
cgaccacagcaacuuccuga

SEQ ID NO: 3920583 - RNA, 17 nt, Human adenovirus D
cgacccaugauggugcu

SEQ ID NO: 3920584 - RNA, 13 nt, Human adenovirus D
cgacccccuucca

SEQ ID NO: 3920585 - RNA, 16 nt, Human adenovirus D
cgaccgacccauggac

SEQ ID NO: 3920586 - RNA, 23 nt, Human adenovirus D
cgaccgcauccacaaggccguga

SEQ ID NO: 3920587 - RNA, 13 nt, Human adenovirus D
cgaccgccgugcg

SEQ ID NO: 3920588 - RNA, 23 nt, Human adenovirus D
cgaccuugcaaaagcgccaggag

SEQ ID NO: 3920589 - RNA, 15 nt, Human adenovirus D
cgacgagccagguga

SEQ ID NO: 3920590 - RNA, 16 nt, Human adenovirus D
cgacgaggccgggcua

SEQ ID NO: 3920591 - RNA, 20 nt, Human adenovirus D
cgacugacuacccacugacu

SEQ ID NO: 3920592 - RNA, 12 nt, Human adenovirus D
cgacuguagggc

SEQ ID NO: 3920593 - RNA, 18 nt, Human adenovirus D
cgagaagcggccgcggcc

SEQ ID NO: 3920594 - RNA, 15 nt, Human adenovirus D
cgagaccagaggcag

SEQ ID NO: 3920595 - RNA, 16 nt, Human adenovirus D
cgagaucggcaccagc

SEQ ID NO: 3920596 - RNA, 12 nt, Human adenovirus D
cgagcacagcac

SEQ ID NO: 3920597 - RNA, 21 nt, Human adenovirus D
cgagcagaacgggggcagcac

SEQ ID NO: 3920598 - RNA, 17 nt, Human adenovirus D
cgagccauugaccacca

SEQ ID NO: 3920599 - RNA, 20 nt, Human adenovirus D
cgagcccgagggucgcuggc

SEQ ID NO: 3920600 - RNA, 23 nt, Human adenovirus D
cgagccgcgcgccgcgccgccac

SEQ ID NO: 3920601 - RNA, 13 nt, Human adenovirus D
cgagcgcaccguc

SEQ ID NO: 3920602 - RNA, 21 nt, Human adenovirus D
cgagcgggaccggggaggcac

SEQ ID NO: 3920603 - RNA, 22 nt, Human adenovirus D
cgagcucaugcccuuccgcgcc

SEQ ID NO: 3920604 - RNA, 18 nt, Human adenovirus D
cgagcuggaagcccugag

SEQ ID NO: 3920605 - RNA, 17 nt, Human adenovirus D
cgaggaccaaucgcgcc

SEQ ID NO: 3920606 - RNA, 19 nt, Human adenovirus D
cgaggagcaccccaacggc

SEQ ID NO: 3920607 - RNA, 13 nt, Human adenovirus D
cgaggaggagcgc

SEQ ID NO: 3920608 - RNA, 19 nt, Human adenovirus D
cgaggaggagcgcauccug

SEQ ID NO: 3920609 - RNA, 13 nt, Human adenovirus D
cgaggcagaggca

SEQ ID NO: 3920610 - RNA, 15 nt, Human adenovirus D
cgaggcagaggcaca

SEQ ID NO: 3920611 - RNA, 22 nt, Human adenovirus D
cgaggccgucuaccugcgcacg

SEQ ID NO: 3920612 - RNA, 21 nt, Human adenovirus D
cgagggcaaugcuagagugag

SEQ ID NO: 3920613 - RNA, 23 nt, Human adenovirus D
cgagggccugggcucgcuggugg

SEQ ID NO: 3920614 - RNA, 14 nt, Human adenovirus D
cgaggugcagaccg

SEQ ID NO: 3920615 - RNA, 19 nt, Human adenovirus D
cgaggugcagaccgacccc

SEQ ID NO: 3920616 - RNA, 12 nt, Human adenovirus D
cgagucucaccu

SEQ ID NO: 3920617 - RNA, 17 nt, Human adenovirus D
cgauaucgcgcauccug

SEQ ID NO: 3920618 - RNA, 19 nt, Human adenovirus D
cgauccugacgcgccagcc

SEQ ID NO: 3920619 - RNA, 17 nt, Human adenovirus D
cgaugaaagucaggagc

SEQ ID NO: 3920620 - RNA, 22 nt, Human adenovirus D
cgaugggcccgugggcugcggc

SEQ ID NO: 3920621 - RNA, 17 nt, Human adenovirus D
cgcaacuuccagcccau

SEQ ID NO: 3920622 - RNA, 22 nt, Human adenovirus D
cgcacccggcauccugcacgca

SEQ ID NO: 3920623 - RNA, 14 nt, Human adenovirus D
cgcaccgcuccugg

SEQ ID NO: 3920624 - RNA, 17 nt, Human adenovirus D
cgcaccgcuccuggucu

SEQ ID NO: 3920625 - RNA, 14 nt, Human adenovirus D
cgcaccgucgccuc

SEQ ID NO: 3920626 - RNA, 17 nt, Human adenovirus D
cgcacgggccgccgggc

SEQ ID NO: 3920627 - RNA, 22 nt, Human adenovirus D
cgcagaucugcaucucccaggc

SEQ ID NO: 3920628 - RNA, 13 nt, Human adenovirus D
cgcagccgcggca

SEQ ID NO: 3920629 - RNA, 19 nt, Human adenovirus D
cgcagccgcggcagccgca

SEQ ID NO: 3920630 - RNA, 17 nt, Human adenovirus D
cgcagcgcugcacgggc

SEQ ID NO: 3920631 - RNA, 16 nt, Human adenovirus D
cgcagcggcaggaaau

SEQ ID NO: 3920632 - RNA, 12 nt, Human adenovirus D
cgcaggccagga

SEQ ID NO: 3920633 - RNA, 16 nt, Human adenovirus D
cgcaggccaggaggag

SEQ ID NO: 3920634 - RNA, 14 nt, Human adenovirus D
cgcaggcgacccug

SEQ ID NO: 3920635 - RNA, 20 nt, Human adenovirus D
cgcaggcgcccagccagcaa

SEQ ID NO: 3920636 - RNA, 23 nt, Human adenovirus D
cgcaggggcucguuaguccagca

SEQ ID NO: 3920637 - RNA, 20 nt, Human adenovirus D
cgcagguggacgagcagacc

SEQ ID NO: 3920638 - RNA, 20 nt, Human adenovirus D
cgcaguacucgcagcgcugc

SEQ ID NO: 3920639 - RNA, 20 nt, Human adenovirus D
cgcagucuccaacgccugcg

SEQ ID NO: 3920640 - RNA, 19 nt, Human adenovirus D
cgcagugagagaagcggug

SEQ ID NO: 3920641 - RNA, 23 nt, Human adenovirus D
cgcagugcacgggcaucagcauc

SEQ ID NO: 3920642 - RNA, 15 nt, Human adenovirus D
cgcagugggcgcaga

SEQ ID NO: 3920643 - RNA, 21 nt, Human adenovirus D
cgcagugggcguacaugcaca

SEQ ID NO: 3920644 - RNA, 19 nt, Human adenovirus D
cgcauccugaucucugcca

SEQ ID NO: 3920645 - RNA, 16 nt, Human adenovirus D
cgcaugguuucgguga

SEQ ID NO: 3920646 - RNA, 15 nt, Human adenovirus D
cgccaaaaaaacaca

SEQ ID NO: 3920647 - RNA, 17 nt, Human adenovirus D
cgccaaccgcacccgcg

SEQ ID NO: 3920648 - RNA, 22 nt, Human adenovirus D
cgccaccacccacaccgccucc

SEQ ID NO: 3920649 - RNA, 16 nt, Human adenovirus D
cgccaccaugagcaag

SEQ ID NO: 3920650 - RNA, 20 nt, Human adenovirus D
cgccagccgcaggcgcccag

SEQ ID NO: 3920651 - RNA, 16 nt, Human adenovirus D
cgccaggaggcggugc

SEQ ID NO: 3920652 - RNA, 20 nt, Human adenovirus D
cgccauaagggcggcgcugc

SEQ ID NO: 3920653 - RNA, 18 nt, Human adenovirus D
cgccaucuugcccacguc

SEQ ID NO: 3920654 - RNA, 18 nt, Human adenovirus D
cgcccagguuuuccaugc

SEQ ID NO: 3920655 - RNA, 16 nt, Human adenovirus D
cgcccauuccuggaga

SEQ ID NO: 3920656 - RNA, 22 nt, Human adenovirus D
guccaucgugcgcgaccugggc

SEQ ID NO: 3920657 - RNA, 13 nt, Human adenovirus D
guccccgaggccc

SEQ ID NO: 3920658 - RNA, 17 nt, Human adenovirus D
gucccgcugagcuaccg

SEQ ID NO: 3920659 - RNA, 18 nt, Human adenovirus D
gucccgcuugcuggaugc

SEQ ID NO: 3920660 - RNA, 15 nt, Human adenovirus D
gucccuggcuccgcg

SEQ ID NO: 3920661 - RNA, 21 nt, Human adenovirus D
guccgcaugacuaacucaggu

SEQ ID NO: 3920662 - RNA, 14 nt, Human adenovirus D
guccgcuccgcagu

SEQ ID NO: 3920663 - RNA, 15 nt, Human adenovirus D
guccgucggccaugg

SEQ ID NO: 3920664 - RNA, 16 nt, Human adenovirus D
guccgugugauuaaaa

SEQ ID NO: 3920665 - RNA, 15 nt, Human adenovirus D
guccugucacucaaa

SEQ ID NO: 3920666 - RNA, 15 nt, Human adenovirus D
gucgaggagaccugc

SEQ ID NO: 3920667 - RNA, 19 nt, Human adenovirus D
gucgcccgaguuguccugg

SEQ ID NO: 3920668 - RNA, 15 nt, Human adenovirus D
gucgcuggcugcugg

SEQ ID NO: 3920669 - RNA, 17 nt, Human adenovirus D
gucgcuggcugcuggag

SEQ ID NO: 3920670 - RNA, 20 nt, Human adenovirus D
gucuacuggucgcugccgga

SEQ ID NO: 3920671 - RNA, 20 nt, Human adenovirus D
gucucgcacucgacgagcca

SEQ ID NO: 3920672 - RNA, 21 nt, Human adenovirus D
gucucugguguaguuguucag

SEQ ID NO: 3920673 - RNA, 13 nt, Human adenovirus D
gucugcuccugca

SEQ ID NO: 3920674 - RNA, 20 nt, Human adenovirus D
gucugcuccugcacuuucuu

SEQ ID NO: 3920675 - RNA, 17 nt, Human adenovirus D
gucugcuguaaagccag

SEQ ID NO: 3920676 - RNA, 14 nt, Human adenovirus D
gucugugccucucc

SEQ ID NO: 3920677 - RNA, 22 nt, Human adenovirus D
gucuuucucuuucucugccaca

SEQ ID NO: 3920678 - RNA, 13 nt, Human adenovirus D
gugaaaacgugcc

SEQ ID NO: 3920679 - RNA, 15 nt, Human adenovirus D
gugaagauagacagc

SEQ ID NO: 3920680 - RNA, 22 nt, Human adenovirus D
gugaaggccggcaugcccacca

SEQ ID NO: 3920681 - RNA, 20 nt, Human adenovirus D
gugaagguuaguugcagacc

SEQ ID NO: 3920682 - RNA, 18 nt, Human adenovirus D
gugaccagguccacgcug

SEQ ID NO: 3920683 - RNA, 16 nt, Human adenovirus D
gugaccaucguaccag

SEQ ID NO: 3920684 - RNA, 14 nt, Human adenovirus D
gugagcgcgagccg

SEQ ID NO: 3920685 - RNA, 15 nt, Human adenovirus D
gugagcucgggcugc

SEQ ID NO: 3920686 - RNA, 15 nt, Human adenovirus D
gugaggaucauaucc

SEQ ID NO: 3920687 - RNA, 12 nt, Human adenovirus D
gugaggcacugc

SEQ ID NO: 3920688 - RNA, 19 nt, Human adenovirus D
gugauacgaggcagaggca

SEQ ID NO: 3920689 - RNA, 21 nt, Human adenovirus D
gugauacgaggcagaggcaca

SEQ ID NO: 3920690 - RNA, 22 nt, Human adenovirus D
gugaucccacagggcacugccg

SEQ ID NO: 3920691 - RNA, 23 nt, Human adenovirus D
gugauccguaucgugcugcucuc

SEQ ID NO: 3920692 - RNA, 21 nt, Human adenovirus D
gugauggcgcaggcgacccug

SEQ ID NO: 3920693 - RNA, 21 nt, Human adenovirus D
gugcaacuuuagccagaccaa

SEQ ID NO: 3920694 - RNA, 21 nt, Human adenovirus D
gugcaaugucaggucugcugg

SEQ ID NO: 3920695 - RNA, 13 nt, Human adenovirus D
gugcagcagagcg

SEQ ID NO: 3920696 - RNA, 21 nt, Human adenovirus D
gugcagccgugaucccacagg

SEQ ID NO: 3920697 - RNA, 16 nt, Human adenovirus D
gugcaggaccaccagg

SEQ ID NO: 3920698 - RNA, 18 nt, Human adenovirus D
gugcaggaccaccaggac

SEQ ID NO: 3920699 - RNA, 16 nt, Human adenovirus D
gugcagucguggacgc

SEQ ID NO: 3920700 - RNA, 20 nt, Human adenovirus D
gugcaguuggccaugagcga

SEQ ID NO: 3920701 - RNA, 15 nt, Human adenovirus D
gugcgcuggggcugc

SEQ ID NO: 3920702 - RNA, 12 nt, Human adenovirus D
gugcgguggugu

SEQ ID NO: 3920703 - RNA, 15 nt, Human adenovirus D
gugcuaaagcucuuc

SEQ ID NO: 3920704 - RNA, 19 nt, Human adenovirus D
gugcuagacauggccagca

SEQ ID NO: 3920705 - RNA, 17 nt, Human adenovirus D
gugcugacgcugagcga

SEQ ID NO: 3920706 - RNA, 19 nt, Human adenovirus D
gugcuggaggguugaaaga

SEQ ID NO: 3920707 - RNA, 15 nt, Human adenovirus D
guggaagagauggaa

SEQ ID NO: 3920708 - RNA, 22 nt, Human adenovirus D
guggacgcgguucauugacagc

SEQ ID NO: 3920709 - RNA, 16 nt, Human adenovirus D
guggacuucacagaga

SEQ ID NO: 3920710 - RNA, 22 nt, Human adenovirus D
guggccaccucgccgcgcaggg

SEQ ID NO: 3920711 - RNA, 21 nt, Human adenovirus D
guggcgagaggcgagcagcug

SEQ ID NO: 3920712 - RNA, 15 nt, Human adenovirus D
guggcgccgggccug

SEQ ID NO: 3920713 - RNA, 14 nt, Human adenovirus D
guggcggggcccga

SEQ ID NO: 3920714 - RNA, 16 nt, Human adenovirus D
guggcuguugauguga

SEQ ID NO: 3920715 - RNA, 15 nt, Human adenovirus D
gugggcguggggcaa

SEQ ID NO: 3920716 - RNA, 17 nt, Human adenovirus D
guggguuggcuugcaug

SEQ ID NO: 3920717 - RNA, 15 nt, Human adenovirus D
gugguaguucaagga

SEQ ID NO: 3920718 - RNA, 17 nt, Human adenovirus D
guggugcuggaugaugu

SEQ ID NO: 3920719 - RNA, 14 nt, Human adenovirus D
guggugucuuccuc

SEQ ID NO: 3920720 - RNA, 19 nt, Human adenovirus D
guguaccagucgggcccgg

SEQ ID NO: 3920721 - RNA, 18 nt, Human adenovirus D
guguaguuguucagcagc

SEQ ID NO: 3920722 - RNA, 15 nt, Human adenovirus D
guguugcggcccggc

SEQ ID NO: 3920723 - RNA, 22 nt, Human adenovirus D
guuacuguaaagccacaaccag

SEQ ID NO: 3920724 - RNA, 14 nt, Human adenovirus D
guuagagaugaggc

SEQ ID NO: 3920725 - RNA, 13 nt, Human adenovirus D
guuaucgaggacg

SEQ ID NO: 3920726 - RNA, 22 nt, Human adenovirus D
guucagggaccgcagcggggag

SEQ ID NO: 3920727 - RNA, 19 nt, Human adenovirus D
guuccaugaaucgcgggcg

SEQ ID NO: 3920728 - RNA, 15 nt, Human adenovirus D
guucuggagacacug

SEQ ID NO: 3920729 - RNA, 13 nt, Human adenovirus D
guucuucacccag

SEQ ID NO: 3920730 - RNA, 19 nt, Human adenovirus D
guugacaaauggagccaga

SEQ ID NO: 3920731 - RNA, 17 nt, Human adenovirus D
guugacggucugcaggc

SEQ ID NO: 3920732 - RNA, 23 nt, Human adenovirus D
guugaggcaccuagaccacugcc

SEQ ID NO: 3920733 - RNA, 19 nt, Human adenovirus D
guugagucgcggcagaacc

SEQ ID NO: 3920734 - RNA, 13 nt, Human adenovirus D
guuggugagcucu

SEQ ID NO: 3920735 - RNA, 16 nt, Human adenovirus D
guugguuuaaucagga

SEQ ID NO: 3920736 - RNA, 17 nt, Human adenovirus D
uaaaaaccccgccaaaa

SEQ ID NO: 3920737 - RNA, 22 nt, Human adenovirus D
uaaacguguuuuuuauuucaaa

SEQ ID NO: 3920738 - RNA, 13 nt, Human adenovirus D
uaaagaaacagaa

SEQ ID NO: 3920739 - RNA, 17 nt, Human adenovirus D
uaaagaauaugccaggg

SEQ ID NO: 3920740 - RNA, 13 nt, Human adenovirus D
uaaagccagcagc

SEQ ID NO: 3920741 - RNA, 14 nt, Human adenovirus D
uaaagccagcagca

SEQ ID NO: 3920742 - RNA, 19 nt, Human adenovirus D
uaaaggcaccuuacacuga

SEQ ID NO: 3920743 - RNA, 22 nt, Human adenovirus D
uaaagugcaagucacgcaggug

SEQ ID NO: 3920744 - RNA, 13 nt, Human adenovirus D
uaaauaagucacu

SEQ ID NO: 3920745 - RNA, 23 nt, Human adenovirus D
caugcaagaccccgucaccuucc

SEQ ID NO: 3920746 - RNA, 15 nt, Human adenovirus D
caugcaagguguggu

SEQ ID NO: 3920747 - RNA, 22 nt, Human adenovirus D
caugccccaggccuggcccuga

SEQ ID NO: 3920748 - RNA, 18 nt, Human adenovirus D
caugcccucucaacauca

SEQ ID NO: 3920749 - RNA, 21 nt, Human adenovirus D
caugccgaagaagaacaggag

SEQ ID NO: 3920750 - RNA, 20 nt, Human adenovirus D
caugccuucgugcacuggcc

SEQ ID NO: 3920751 - RNA, 14 nt, Human adenovirus D
caugcuggccgugg

SEQ ID NO: 3920752 - RNA, 14 nt, Human adenovirus D
cauggaaccuagca

SEQ ID NO: 3920753 - RNA, 16 nt, Human adenovirus D
cauggccaacagccac

SEQ ID NO: 3920754 - RNA, 13 nt, Human adenovirus D
cauggcccugacg

SEQ ID NO: 3920755 - RNA, 23 nt, Human adenovirus D
cauggcuaccugggaggagagga

SEQ ID NO: 3920756 - RNA, 15 nt, Human adenovirus D
cauguucgacuccuc

SEQ ID NO: 3920757 - RNA, 15 nt, Human adenovirus D
cauguugaaaagcuc

SEQ ID NO: 3920758 - RNA, 23 nt, Human adenovirus D
cauguugugcaggaccaccagga

SEQ ID NO: 3920759 - RNA, 21 nt, Human adenovirus D
cauuacuauuacugccacugc

SEQ ID NO: 3920760 - RNA, 21 nt, Human adenovirus D
cauucacauacacacuagaaa

SEQ ID NO: 3920761 - RNA, 19 nt, Human adenovirus D
cauucuggacuucgcagcc

SEQ ID NO: 3920762 - RNA, 21 nt, Human adenovirus D
cauugaccaccagggagcuga

SEQ ID NO: 3920763 - RNA, 15 nt, Human adenovirus D
cauugcaaggcagaa

SEQ ID NO: 3920764 - RNA, 16 nt, Human adenovirus D
cauuucagaaccauga

SEQ ID NO: 3920765 - RNA, 13 nt, Human adenovirus D
cauuuuuccagcc

SEQ ID NO: 3920766 - RNA, 14 nt, Human adenovirus D
cauuuuuccagccu

SEQ ID NO: 3920767 - RNA, 13 nt, Human adenovirus D
ccaacagccacau

SEQ ID NO: 3920768 - RNA, 15 nt, Human adenovirus D
ccaacaugcucuacc

SEQ ID NO: 3920769 - RNA, 20 nt, Human adenovirus D
ccaacaugcucuaccccauc

SEQ ID NO: 3920770 - RNA, 15 nt, Human adenovirus D
ccaaccggcugaugc

SEQ ID NO: 3920771 - RNA, 15 nt, Human adenovirus D
ccaacgccugcgcca

SEQ ID NO: 3920772 - RNA, 14 nt, Human adenovirus D
ccaacgcgccgggg

SEQ ID NO: 3920773 - RNA, 14 nt, Human adenovirus D
ccaacggcugcauc

SEQ ID NO: 3920774 - RNA, 15 nt, Human adenovirus D
ccaacggcugcaucc

SEQ ID NO: 3920775 - RNA, 21 nt, Human adenovirus D
ccaacggcugcauccacugcu

SEQ ID NO: 3920776 - RNA, 17 nt, Human adenovirus D
ccaagaaacgucccagc

SEQ ID NO: 3920777 - RNA, 18 nt, Human adenovirus D
ccaagaaacgucccagca

SEQ ID NO: 3920778 - RNA, 16 nt, Human adenovirus D
ccaagaucaggggaug

SEQ ID NO: 3920779 - RNA, 19 nt, Human adenovirus D
ccaaggcacccaccacagu

SEQ ID NO: 3920780 - RNA, 15 nt, Human adenovirus D
ccaaguccagggugc

SEQ ID NO: 3920781 - RNA, 18 nt, Human adenovirus D
ccacacauggcaagcugc

SEQ ID NO: 3920782 - RNA, 15 nt, Human adenovirus D
ccacacggccagcag

SEQ ID NO: 3920783 - RNA, 22 nt, Human adenovirus D
ccacagccuugauuuuuccagc

SEQ ID NO: 3920784 - RNA, 12 nt, Human adenovirus D
ccaccaacgugc

SEQ ID NO: 3920785 - RNA, 14 nt, Human adenovirus D
ccaccgacacguac

SEQ ID NO: 3920786 - RNA, 18 nt, Human adenovirus D
ccaccgagucucaccugg

SEQ ID NO: 3920787 - RNA, 12 nt, Human adenovirus D
ccaccgccgccg

SEQ ID NO: 3920788 - RNA, 14 nt, Human adenovirus D
ccaccuacuccucu

SEQ ID NO: 3920789 - RNA, 12 nt, Human adenovirus D
ccacgacacagc

SEQ ID NO: 3920790 - RNA, 20 nt, Human adenovirus D
ccacgaugugaccacggacc

SEQ ID NO: 3920791 - RNA, 18 nt, Human adenovirus D
ccacgcuucuuccccagc

SEQ ID NO: 3920792 - RNA, 18 nt, Human adenovirus D
ccacggaccggucccagc

SEQ ID NO: 3920793 - RNA, 22 nt, Human adenovirus D
ccacggguguaaugaaacccgc

SEQ ID NO: 3920794 - RNA, 14 nt, Human adenovirus D
ccacgguggugcag

SEQ ID NO: 3920795 - RNA, 20 nt, Human adenovirus D
ccacuacucacacuacacag

SEQ ID NO: 3920796 - RNA, 24 nt, Human adenovirus D
ccacuacucacacuacacagcuag

SEQ ID NO: 3920797 - RNA, 13 nt, Human adenovirus D
ccacucugagaca

SEQ ID NO: 3920798 - RNA, 18 nt, Human adenovirus D
ccacugccgccgccugcg

SEQ ID NO: 3920799 - RNA, 21 nt, Human adenovirus D
ccacugcuccugcgaaagccc

SEQ ID NO: 3920800 - RNA, 15 nt, Human adenovirus D
ccacuggccacgggu

SEQ ID NO: 3920801 - RNA, 14 nt, Human adenovirus D
ccagaacuuccagc

SEQ ID NO: 3920802 - RNA, 17 nt, Human adenovirus D
ccagaacuuccagcaga

SEQ ID NO: 3920803 - RNA, 15 nt, Human adenovirus D
ccagaaggggcaccu

SEQ ID NO: 3920804 - RNA, 14 nt, Human adenovirus D
ccagacccaggcgc

SEQ ID NO: 3920805 - RNA, 20 nt, Human adenovirus D
ccagacgcaagagccggcgg

SEQ ID NO: 3920806 - RNA, 14 nt, Human adenovirus D
ccagacgcacgggc

SEQ ID NO: 3920807 - RNA, 16 nt, Human adenovirus D
ccagacgcggcuguag

SEQ ID NO: 3920808 - RNA, 17 nt, Human adenovirus D
ccagaggcagacucagg

SEQ ID NO: 3920809 - RNA, 19 nt, Human adenovirus D
ccagaucucggcgcggcgg

SEQ ID NO: 3920810 - RNA, 16 nt, Human adenovirus D
ccagaugcucucccac

SEQ ID NO: 3920811 - RNA, 23 nt, Human adenovirus D
ccagcaaauuccucgaccaugac

SEQ ID NO: 3920812 - RNA, 15 nt, Human adenovirus D
ccagcaacccuuccu

SEQ ID NO: 3920813 - RNA, 22 nt, Human adenovirus D
ccagcacaacaacucgggcuuc

SEQ ID NO: 3920814 - RNA, 12 nt, Human adenovirus D
ccagcagcacau

SEQ ID NO: 3920815 - RNA, 11 nt, Human adenovirus D
ccagcagcagg

SEQ ID NO: 3920816 - RNA, 22 nt, Human adenovirus D
ccagcagucgggcgagaccaac

SEQ ID NO: 3920817 - RNA, 19 nt, Human adenovirus D
ccagcaucgaggugcagac

SEQ ID NO: 3920818 - RNA, 17 nt, Human adenovirus D
ccagccgcaggcgccca

SEQ ID NO: 3920819 - RNA, 21 nt, Human adenovirus D
ccagccgcaggcgcccagcca

SEQ ID NO: 3920820 - RNA, 22 nt, Human adenovirus D
ccagcgaaagagagcucgcguc

SEQ ID NO: 3920821 - RNA, 21 nt, Human adenovirus D
ccagcgcucguacccgcucac

SEQ ID NO: 3920822 - RNA, 19 nt, Human adenovirus D
ccagcguaagcgcgcggcu

SEQ ID NO: 3920823 - RNA, 22 nt, Human adenovirus D
ccagcugaacgggggcgccuuc

SEQ ID NO: 3920824 - RNA, 16 nt, Human adenovirus D
ccagcuggccgcccug

SEQ ID NO: 3920825 - RNA, 22 nt, Human adenovirus D
ccaggaggagaccgacgcuggg

SEQ ID NO: 3920826 - RNA, 23 nt, Human adenovirus D
ccaggaggagaccgacgcugggc

SEQ ID NO: 3920827 - RNA, 23 nt, Human adenovirus D
ccaggauacgcgggaagagcccu

SEQ ID NO: 3920828 - RNA, 15 nt, Human adenovirus D
ccaggaugcagccag

SEQ ID NO: 3920829 - RNA, 23 nt, Human adenovirus D
ccaggaugcagccaguggcccug

SEQ ID NO: 3920830 - RNA, 14 nt, Human adenovirus D
ccaggccaaccugu

SEQ ID NO: 3920831 - RNA, 13 nt, Human adenovirus D
ccaggcccagaac

SEQ ID NO: 3920832 - RNA, 14 nt, Human adenovirus D
ccaggcccuggagc

SEQ ID NO: 3920833 - RNA, 15 nt, Human adenovirus D
ccaggccuggcccug

SEQ ID NO: 3920834 - RNA, 16 nt, Human adenovirus D
ccaggccuggcccuga

SEQ ID NO: 3920835 - RNA, 14 nt, Human adenovirus D
ccaggcggcagagc

SEQ ID NO: 3920836 - RNA, 15 nt, Human adenovirus D
ccaggcuggccgugc

SEQ ID NO: 3920837 - RNA, 16 nt, Human adenovirus D
ccaggcuggccgugcu

SEQ ID NO: 3920838 - RNA, 20 nt, Human adenovirus D
ccaggguugagucgcggcag

SEQ ID NO: 3920839 - RNA, 23 nt, Human adenovirus D
ccagugauuggggaaccucagcc

SEQ ID NO: 3920840 - RNA, 23 nt, Human adenovirus D
ccagugcaacuuuagccagacca

SEQ ID NO: 3920841 - RNA, 14 nt, Human adenovirus D
ccagugcuuccagc

SEQ ID NO: 3920842 - RNA, 16 nt, Human adenovirus D
ccagugcuuccagcaa

SEQ ID NO: 3920843 - RNA, 17 nt, Human adenovirus D
ccaguuugggcacuggg

SEQ ID NO: 3920844 - RNA, 15 nt, Human adenovirus D
ccauaaaucugcccu

SEQ ID NO: 3920845 - RNA, 22 nt, Human adenovirus D
ccauagcgugcguucucuuccu

SEQ ID NO: 3920846 - RNA, 15 nt, Human adenovirus D
ccauaggccaggcgc

SEQ ID NO: 3920847 - RNA, 13 nt, Human adenovirus D
ccauagggagccu

SEQ ID NO: 3920848 - RNA, 12 nt, Human adenovirus D
ccaucaccaccg

SEQ ID NO: 3920849 - RNA, 12 nt, Human adenovirus D
ccaucauguucg

SEQ ID NO: 3920850 - RNA, 13 nt, Human adenovirus D
ccaugacagcgac

SEQ ID NO: 3920851 - RNA, 18 nt, Human adenovirus D
ccaugagggucuggagcu

SEQ ID NO: 3920852 - RNA, 17 nt, Human adenovirus D
ccaugcagacucugcuc

SEQ ID NO: 3920853 - RNA, 20 nt, Human adenovirus D
ccaugcccuuuucccaggac

SEQ ID NO: 3920854 - RNA, 13 nt, Human adenovirus D
ccauggcgcagua

SEQ ID NO: 3920855 - RNA, 12 nt, Human adenovirus D
ccauggggcgcc

SEQ ID NO: 3920856 - RNA, 16 nt, Human adenovirus D
ccaugugaccucccac

SEQ ID NO: 3920857 - RNA, 17 nt, Human adenovirus D
ccauguuauucagcagc

SEQ ID NO: 3920858 - RNA, 20 nt, Human adenovirus D
ccauucggagcacgcccgcc

SEQ ID NO: 3920859 - RNA, 16 nt, Human adenovirus D
ccauugaauggcacug

SEQ ID NO: 3920860 - RNA, 15 nt, Human adenovirus D
cccaacggcaccugc

SEQ ID NO: 3920861 - RNA, 16 nt, Human adenovirus D
cccaacucgcggcugc

SEQ ID NO: 3920862 - RNA, 14 nt, Human adenovirus D
cccacagccagccg

SEQ ID NO: 3920863 - RNA, 16 nt, Human adenovirus D
cccacaucgaggcccu

SEQ ID NO: 3920864 - RNA, 16 nt, Human adenovirus D
cagcacaaacgugcag

SEQ ID NO: 3920865 - RNA, 13 nt, Human adenovirus D
cagcacacucacu

SEQ ID NO: 3920866 - RNA, 18 nt, Human adenovirus D
cagcaccgccgcagccgc

SEQ ID NO: 3920867 - RNA, 13 nt, Human adenovirus D
cagcacugcaaau

SEQ ID NO: 3920868 - RNA, 17 nt, Human adenovirus D
cagcagaaaugggcccu

SEQ ID NO: 3920869 - RNA, 20 nt, Human adenovirus D
cagcagaagaucccggcgca

SEQ ID NO: 3920870 - RNA, 15 nt, Human adenovirus D
cagcagaggaagagg

SEQ ID NO: 3920871 - RNA, 12 nt, Human adenovirus D
cagcagcacagc

SEQ ID NO: 3920872 - RNA, 12 nt, Human adenovirus D
cagcagcccaua

SEQ ID NO: 3920873 - RNA, 19 nt, Human adenovirus D
cagcaggagcgugccgcca

SEQ ID NO: 3920874 - RNA, 15 nt, Human adenovirus D
cagcagggugccucc

SEQ ID NO: 3920875 - RNA, 16 nt, Human adenovirus D
cagcaucagucuccug

SEQ ID NO: 3920876 - RNA, 16 nt, Human adenovirus D
cagcaucgaggugcag

SEQ ID NO: 3920877 - RNA, 19 nt, Human adenovirus D
cagcaucgaggugcagacc

SEQ ID NO: 3920878 - RNA, 14 nt, Human adenovirus D
cagcaucgccucac

SEQ ID NO: 3920879 - RNA, 23 nt, Human adenovirus D
cagcaugaaggggacgagcugcu

SEQ ID NO: 3920880 - RNA, 22 nt, Human adenovirus D
cagcauguacggaggagccaag

SEQ ID NO: 3920881 - RNA, 24 nt, Human adenovirus D
cagcauguacggaggagccaagaa

SEQ ID NO: 3920882 - RNA, 15 nt, Human adenovirus D
cagccaaagcucaug

SEQ ID NO: 3920883 - RNA, 11 nt, Human adenovirus D
cagccagaacc

SEQ ID NO: 3920884 - RNA, 14 nt, Human adenovirus D
cagccagcaaacgc

SEQ ID NO: 3920885 - RNA, 17 nt, Human adenovirus D
cagcccaaacuggggcg

SEQ ID NO: 3920886 - RNA, 13 nt, Human adenovirus D
cagcccagggcgc

SEQ ID NO: 3920887 - RNA, 12 nt, Human adenovirus D
cagccgagccgg

SEQ ID NO: 3920888 - RNA, 16 nt, Human adenovirus D
cagccgcaccgcggcg

SEQ ID NO: 3920889 - RNA, 15 nt, Human adenovirus D
cagccgcaggccaac

SEQ ID NO: 3920890 - RNA, 18 nt, Human adenovirus D
cagccgcguaagcaggag

SEQ ID NO: 3920891 - RNA, 13 nt, Human adenovirus D
cagccggcgaacg

SEQ ID NO: 3920892 - RNA, 18 nt, Human adenovirus D
cagccuccaccgcuaccg

SEQ ID NO: 3920893 - RNA, 22 nt, Human adenovirus D
cagccugagcuuggccgagaag

SEQ ID NO: 3920894 - RNA, 13 nt, Human adenovirus D
cagccugggcaac

SEQ ID NO: 3920895 - RNA, 21 nt, Human adenovirus D
cagccuugauuuuuccagccc

SEQ ID NO: 3920896 - RNA, 14 nt, Human adenovirus D
cagccuugccccca

SEQ ID NO: 3920897 - RNA, 13 nt, Human adenovirus D
cagcgaaagagag

SEQ ID NO: 3920898 - RNA, 16 nt, Human adenovirus D
cagcgaaagagagcuc

SEQ ID NO: 3920899 - RNA, 14 nt, Human adenovirus D
cagcgcccucagca

SEQ ID NO: 3920900 - RNA, 19 nt, Human adenovirus D
cagcggcagggugagccgg

SEQ ID NO: 3920901 - RNA, 20 nt, Human adenovirus D
cagcggcgcaagcucaugcu

SEQ ID NO: 3920902 - RNA, 16 nt, Human adenovirus D
cagcgucgaggagcug

SEQ ID NO: 3920903 - RNA, 16 nt, Human adenovirus D
cagcuacaccucccuc

SEQ ID NO: 3920904 - RNA, 23 nt, Human adenovirus D
cagcucaacgacgaguuggugag

SEQ ID NO: 3920905 - RNA, 21 nt, Human adenovirus D
cagcucaucgacuggugcugc

SEQ ID NO: 3920906 - RNA, 12 nt, Human adenovirus D
cagcugcagaag

SEQ ID NO: 3920907 - RNA, 13 nt, Human adenovirus D
cagcuggcccggc

SEQ ID NO: 3920908 - RNA, 15 nt, Human adenovirus D
cagcuguuccuggug

SEQ ID NO: 3920909 - RNA, 17 nt, Human adenovirus D
cagcuugcgcgcuggcu

SEQ ID NO: 3920910 - RNA, 12 nt, Human adenovirus D
caggaccugggc

SEQ ID NO: 3920911 - RNA, 17 nt, Human adenovirus D
caggagcgcagccugag

SEQ ID NO: 3920912 - RNA, 13 nt, Human adenovirus D
caggaggcacaga

SEQ ID NO: 3920913 - RNA, 14 nt, Human adenovirus D
caggaggcggugcg

SEQ ID NO: 3920914 - RNA, 12 nt, Human adenovirus D
caggaugcagcc

SEQ ID NO: 3920915 - RNA, 22 nt, Human adenovirus D
caggaugggucugugccucucc

SEQ ID NO: 3920916 - RNA, 15 nt, Human adenovirus D
caggcagugcagcgc

SEQ ID NO: 3920917 - RNA, 14 nt, Human adenovirus D
caggccaggaggag

SEQ ID NO: 3920918 - RNA, 17 nt, Human adenovirus D
caggcccagaacuggca

SEQ ID NO: 3920919 - RNA, 18 nt, Human adenovirus D
caggcccagaacuggcag

SEQ ID NO: 3920920 - RNA, 20 nt, Human adenovirus D
caggcccagaacuggcagag

SEQ ID NO: 3920921 - RNA, 16 nt, Human adenovirus D
caggccuccgagcagc

SEQ ID NO: 3920922 - RNA, 16 nt, Human adenovirus D
caggccuggcccugac

SEQ ID NO: 3920923 - RNA, 16 nt, Human adenovirus D
caggcgcaaccaggag

SEQ ID NO: 3920924 - RNA, 18 nt, Human adenovirus D
caggcgccauucggagca

SEQ ID NO: 3920925 - RNA, 19 nt, Human adenovirus D
caggcgcuggaagagguag

SEQ ID NO: 3920926 - RNA, 21 nt, Human adenovirus D
caggcggcagagcgggcgggc

SEQ ID NO: 3920927 - RNA, 18 nt, Human adenovirus D
caggcugucggugucccc

SEQ ID NO: 3920928 - RNA, 15 nt, Human adenovirus D
cagggaacugaaaga

SEQ ID NO: 3920929 - RNA, 15 nt, Human adenovirus D
cagggagccagggga

SEQ ID NO: 3920930 - RNA, 14 nt, Human adenovirus D
cagggagcugagga

SEQ ID NO: 3920931 - RNA, 23 nt, Human adenovirus D
cagggaugaguugggccugaugc

SEQ ID NO: 3920932 - RNA, 20 nt, Human adenovirus D
cagggcgcgauccucgccca

SEQ ID NO: 3920933 - RNA, 16 nt, Human adenovirus D
caggggcggcagaggc

SEQ ID NO: 3920934 - RNA, 18 nt, Human adenovirus D
caggggcgucccgcgguc

SEQ ID NO: 3920935 - RNA, 14 nt, Human adenovirus D
caggggguagaagc

SEQ ID NO: 3920936 - RNA, 20 nt, Human adenovirus D
caggguacccacuggguggc

SEQ ID NO: 3920937 - RNA, 15 nt, Human adenovirus D
cagguccgggggcag

SEQ ID NO: 3920938 - RNA, 17 nt, Human adenovirus D
cagguccgggggcaggg

SEQ ID NO: 3920939 - RNA, 17 nt, Human adenovirus D
caggucgucgccccgga

SEQ ID NO: 3920940 - RNA, 19 nt, Human adenovirus D
caggugagcucgggcugcu

SEQ ID NO: 3920941 - RNA, 16 nt, Human adenovirus D
caggugcugccccagg

SEQ ID NO: 3920942 - RNA, 15 nt, Human adenovirus D
cagguggacgagccg

SEQ ID NO: 3920943 - RNA, 18 nt, Human adenovirus D
caguacuggcaacauggg

SEQ ID NO: 3920944 - RNA, 19 nt, Human adenovirus D
caguauaucaggugccugc

SEQ ID NO: 3920945 - RNA, 17 nt, Human adenovirus D
cagucauagcaggggcg

SEQ ID NO: 3920946 - RNA, 15 nt, Human adenovirus D
caguccgccaagcuc

SEQ ID NO: 3920947 - RNA, 17 nt, Human adenovirus D
cagucguggacgcugcu

SEQ ID NO: 3920948 - RNA, 21 nt, Human adenovirus D
cagucuccaacgccugcgcca

SEQ ID NO: 3920949 - RNA, 13 nt, Human adenovirus D
cagucugaugaau

SEQ ID NO: 3920950 - RNA, 17 nt, Human adenovirus D
caguguguguuugagaa

SEQ ID NO: 3920951 - RNA, 16 nt, Human adenovirus D
caguuaaugcugccuu

SEQ ID NO: 3920952 - RNA, 23 nt, Human adenovirus D
caguugcuuguaccacaaaaacg

SEQ ID NO: 3920953 - RNA, 17 nt, Human adenovirus D
cauaauagaaacagauc

SEQ ID NO: 3920954 - RNA, 16 nt, Human adenovirus D
cauaaucaccauguua

SEQ ID NO: 3920955 - RNA, 13 nt, Human adenovirus D
cauaaucaggcag

SEQ ID NO: 3920956 - RNA, 18 nt, Human adenovirus D
cauagucaucacccagca

SEQ ID NO: 3920957 - RNA, 14 nt, Human adenovirus D
cauaucccagggga

SEQ ID NO: 3920958 - RNA, 17 nt, Human adenovirus D
caucacaucagccagga

SEQ ID NO: 3920959 - RNA, 17 nt, Human adenovirus D
caucagcgcccucagca

SEQ ID NO: 3920960 - RNA, 13 nt, Human adenovirus D
caucaucgcgcca

SEQ ID NO: 3920961 - RNA, 21 nt, Human adenovirus D
cauccagcauaagaaucacau

SEQ ID NO: 3920962 - RNA, 19 nt, Human adenovirus D
cauccauggccaggggagu

SEQ ID NO: 3920963 - RNA, 21 nt, Human adenovirus D
cauccccgcccugcuggaugu

SEQ ID NO: 3920964 - RNA, 19 nt, Human adenovirus D
cauccugagauaugugcag

SEQ ID NO: 3920965 - RNA, 14 nt, Human adenovirus D
cauccugaucucug

SEQ ID NO: 3920966 - RNA, 15 nt, Human adenovirus D
cauccuggaccaggc

SEQ ID NO: 3920967 - RNA, 18 nt, Human adenovirus D
cauccuggaccaggcggc

SEQ ID NO: 3920968 - RNA, 14 nt, Human adenovirus D
caucgaaaccagau

SEQ ID NO: 3920969 - RNA, 17 nt, Human adenovirus D
caucgcgaaccaggcag

SEQ ID NO: 3920970 - RNA, 22 nt, Human adenovirus D
caucgcgaaccaggcagugcag

SEQ ID NO: 3920971 - RNA, 15 nt, Human adenovirus D
caucgcgcaggccgc

SEQ ID NO: 3920972 - RNA, 19 nt, Human adenovirus D
caucggcuaccagggcuuc

SEQ ID NO: 3920973 - RNA, 13 nt, Human adenovirus D
caucgugcagaac

SEQ ID NO: 3920974 - RNA, 23 nt, Human adenovirus D
caucgugcagaacccggacagca

SEQ ID NO: 3920975 - RNA, 21 nt, Human adenovirus D
caucgugcgcgaccugggcug

SEQ ID NO: 3920976 - RNA, 14 nt, Human adenovirus D
caucuccaccacgu

SEQ ID NO: 3920977 - RNA, 17 nt, Human adenovirus D
caucucgauccagcaga

SEQ ID NO: 3920978 - RNA, 17 nt, Human adenovirus D
caucuguccaaccccga

SEQ ID NO: 3920979 - RNA, 18 nt, Human adenovirus D
caugaaggggcucuugcu

SEQ ID NO: 3920980 - RNA, 13 nt, Human adenovirus D
caugacccugcau

SEQ ID NO: 3920981 - RNA, 14 nt, Human adenovirus D
caugaccgcgcgca

SEQ ID NO: 3920982 - RNA, 17 nt, Human adenovirus D
caugagcggcuccagcg

SEQ ID NO: 3920983 - RNA, 23 nt, Human adenovirus D
caugagcucguaguugagggccu

SEQ ID NO: 3920984 - RNA, 17 nt, Human adenovirus D
ucccgaggagcacccca

SEQ ID NO: 3920985 - RNA, 22 nt, Human adenovirus D
ucccgccgcaggagaggcaugg

SEQ ID NO: 3920986 - RNA, 22 nt, Human adenovirus D
ucccgucuuugcgguccccgag

SEQ ID NO: 3920987 - RNA, 15 nt, Human adenovirus D
ucccucucgagagcg

SEQ ID NO: 3920988 - RNA, 12 nt, Human adenovirus D
ucccuggcuccg

SEQ ID NO: 3920989 - RNA, 22 nt, Human adenovirus D
uccgacuuugucccgcugagcu

SEQ ID NO: 3920990 - RNA, 11 nt, Human adenovirus D
uccgagcagcg

SEQ ID NO: 3920991 - RNA, 16 nt, Human adenovirus D
uccgcgaacagcagca

SEQ ID NO: 3920992 - RNA, 21 nt, Human adenovirus D
uccgcgaccuccuccccauga

SEQ ID NO: 3920993 - RNA, 17 nt, Human adenovirus D
uccgcggaguccagcga

SEQ ID NO: 3920994 - RNA, 19 nt, Human adenovirus D
uccgcgguauauggcuccu

SEQ ID NO: 3920995 - RNA, 16 nt, Human adenovirus D
uccgcugugcuggugg

SEQ ID NO: 3920996 - RNA, 14 nt, Human adenovirus D
uccggucuagcauc

SEQ ID NO: 3920997 - RNA, 17 nt, Human adenovirus D
uccggugaugccuucca

SEQ ID NO: 3920998 - RNA, 14 nt, Human adenovirus D
uccguccgcuucga

SEQ ID NO: 3920999 - RNA, 22 nt, Human adenovirus D
uccugagauaugugcagcagag

SEQ ID NO: 3921000 - RNA, 15 nt, Human adenovirus D
uccugaucucugcca

SEQ ID NO: 3921001 - RNA, 23 nt, Human adenovirus D
uccugccugggaauccugcacga

SEQ ID NO: 3921002 - RNA, 19 nt, Human adenovirus D
uccugcugcuccaccaccu

SEQ ID NO: 3921003 - RNA, 15 nt, Human adenovirus D
uccuggaccaggcgg

SEQ ID NO: 3921004 - RNA, 21 nt, Human adenovirus D
uccuggaccgcggucccaguu

SEQ ID NO: 3921005 - RNA, 15 nt, Human adenovirus D
uccuuucccuggugg

SEQ ID NO: 3921006 - RNA, 13 nt, Human adenovirus D
ucgacggugagca

SEQ ID NO: 3921007 - RNA, 16 nt, Human adenovirus D
ucgacuugcaagacag

SEQ ID NO: 3921008 - RNA, 21 nt, Human adenovirus D
ucgagcauggcuaccugggag

SEQ ID NO: 3921009 - RNA, 12 nt, Human adenovirus D
ucgagcugcaag

SEQ ID NO: 3921010 - RNA, 17 nt, Human adenovirus D
ucgaggacgugagcggc

SEQ ID NO: 3921011 - RNA, 12 nt, Human adenovirus D
ucgaucaucucc

SEQ ID NO: 3921012 - RNA, 14 nt, Human adenovirus D
ucgaugaucucacg

SEQ ID NO: 3921013 - RNA, 20 nt, Human adenovirus D
ucgcagucuccaacgccugc

SEQ ID NO: 3921014 - RNA, 19 nt, Human adenovirus D
ucgccacaggugcugccca

SEQ ID NO: 3921015 - RNA, 22 nt, Human adenovirus D
ucgccacggucaccgagccucc

SEQ ID NO: 3921016 - RNA, 17 nt, Human adenovirus D
ucgccgaggagaacugc

SEQ ID NO: 3921017 - RNA, 17 nt, Human adenovirus D
ucgcgccacuggccacg

SEQ ID NO: 3921018 - RNA, 14 nt, Human adenovirus D
ucgcggacggccgc

SEQ ID NO: 3921019 - RNA, 15 nt, Human adenovirus D
ucgcggcugcugcug

SEQ ID NO: 3921020 - RNA, 13 nt, Human adenovirus D
ucgcucuggggcc

SEQ ID NO: 3921021 - RNA, 17 nt, Human adenovirus D
ucgcucuggggcccggc

SEQ ID NO: 3921022 - RNA, 11 nt, Human adenovirus D
ucgcugcugcc

SEQ ID NO: 3921023 - RNA, 13 nt, Human adenovirus D
ucgcuggucacau

SEQ ID NO: 3921024 - RNA, 17 nt, Human adenovirus D
ucggcccacgcgcucga

SEQ ID NO: 3921025 - RNA, 17 nt, Human adenovirus D
ucggcggcguggcccuu

SEQ ID NO: 3921026 - RNA, 16 nt, Human adenovirus D
ucgggccccggggcga

SEQ ID NO: 3921027 - RNA, 22 nt, Human adenovirus D
ucgguacccuccucccaacucu

SEQ ID NO: 3921028 - RNA, 20 nt, Human adenovirus D
ucguaccagaugcggcagua

SEQ ID NO: 3921029 - RNA, 17 nt, Human adenovirus D
ucguagaggcgggugag

SEQ ID NO: 3921030 - RNA, 16 nt, Human adenovirus D
ucgucccggaggaggg

SEQ ID NO: 3921031 - RNA, 13 nt, Human adenovirus D
ucgucgccccgga

SEQ ID NO: 3921032 - RNA, 14 nt, Human adenovirus D
ucgucgccccggag

SEQ ID NO: 3921033 - RNA, 21 nt, Human adenovirus D
ucguugugcgccgcgcugggg

SEQ ID NO: 3921034 - RNA, 14 nt, Human adenovirus D
ucuaaccuucuuuu

SEQ ID NO: 3921035 - RNA, 14 nt, Human adenovirus D
ucuacagccagcag

SEQ ID NO: 3921036 - RNA, 16 nt, Human adenovirus D
ucuacgccaccuucuu

SEQ ID NO: 3921037 - RNA, 21 nt, Human adenovirus D
ucuacgcguacauccagcaua

SEQ ID NO: 3921038 - RNA, 19 nt, Human adenovirus D
ucuacucccagcucauccg

SEQ ID NO: 3921039 - RNA, 13 nt, Human adenovirus D
ucucaacagcugg

SEQ ID NO: 3921040 - RNA, 18 nt, Human adenovirus D
ucucagcacgguggccuu

SEQ ID NO: 3921041 - RNA, 22 nt, Human adenovirus D
ucuccaucauguucgacuccuc

SEQ ID NO: 3921042 - RNA, 17 nt, Human adenovirus D
ucucccaccaccagccc

SEQ ID NO: 3921043 - RNA, 23 nt, Human adenovirus D
ucuccggugaugccuuccaaaau

SEQ ID NO: 3921044 - RNA, 17 nt, Human adenovirus D
ucucggaccaaccccac

SEQ ID NO: 3921045 - RNA, 19 nt, Human adenovirus D
ucucgguguacaagauccu

SEQ ID NO: 3921046 - RNA, 23 nt, Human adenovirus D
ucucugccgccggggcucggugc

SEQ ID NO: 3921047 - RNA, 19 nt, Human adenovirus D
ucugaaagaaacagcagag

SEQ ID NO: 3921048 - RNA, 21 nt, Human adenovirus D
ucugauuagcauagucacacu

SEQ ID NO: 3921049 - RNA, 13 nt, Human adenovirus D
ucugccagcagaa

SEQ ID NO: 3921050 - RNA, 19 nt, Human adenovirus D
ucugcccaccgugcgcuac

SEQ ID NO: 3921051 - RNA, 14 nt, Human adenovirus D
ucugcccuccgccc

SEQ ID NO: 3921052 - RNA, 12 nt, Human adenovirus D
ucugcgagagga

SEQ ID NO: 3921053 - RNA, 19 nt, Human adenovirus D
ucuggacuucgcagccaug

SEQ ID NO: 3921054 - RNA, 18 nt, Human adenovirus D
ucuggcgguaccagggga

SEQ ID NO: 3921055 - RNA, 21 nt, Human adenovirus D
ucuggggcgcuuccaagauca

SEQ ID NO: 3921056 - RNA, 20 nt, Human adenovirus D
ucugguugacaaauggagcc

SEQ ID NO: 3921057 - RNA, 12 nt, Human adenovirus D
ucugugcugccu

SEQ ID NO: 3921058 - RNA, 15 nt, Human adenovirus D
ucuucaacaucugug

SEQ ID NO: 3921059 - RNA, 19 nt, Human adenovirus D
ucuucaacaucugugcugc

SEQ ID NO: 3921060 - RNA, 18 nt, Human adenovirus D
ucuuccucuccuccuccc

SEQ ID NO: 3921061 - RNA, 14 nt, Human adenovirus D
ucuugcaugccuuc

SEQ ID NO: 3921062 - RNA, 23 nt, Human adenovirus D
ucuugcaugccuucgugcacugg

SEQ ID NO: 3921063 - RNA, 21 nt, Human adenovirus D
ucuugcuagauucucugggug

SEQ ID NO: 3921064 - RNA, 16 nt, Human adenovirus D
ucuuggcgagggucug

SEQ ID NO: 3921065 - RNA, 15 nt, Human adenovirus D
ucuuugcccugcuca

SEQ ID NO: 3921066 - RNA, 17 nt, Human adenovirus D
ugaaaacgugccugcuc

SEQ ID NO: 3921067 - RNA, 15 nt, Human adenovirus D
ugaaagaacauacau

SEQ ID NO: 3921068 - RNA, 21 nt, Human adenovirus D
ugaaaugaagccguccucuga

SEQ ID NO: 3921069 - RNA, 14 nt, Human adenovirus D
ugaacccagaugag

SEQ ID NO: 3921070 - RNA, 13 nt, Human adenovirus D
ugaaccuuuggac

SEQ ID NO: 3921071 - RNA, 13 nt, Human adenovirus D
ugaacucggggau

SEQ ID NO: 3921072 - RNA, 22 nt, Human adenovirus D
ugaagaacauccaugugaccuc

SEQ ID NO: 3921073 - RNA, 20 nt, Human adenovirus D
ugaagauucuggaaauuaug

SEQ ID NO: 3921074 - RNA, 15 nt, Human adenovirus D
ugaaggaaaaaucac

SEQ ID NO: 3921075 - RNA, 15 nt, Human adenovirus D
ugaaguacauccauu

SEQ ID NO: 3921076 - RNA, 22 nt, Human adenovirus D
ugaauaugaauuccaugaucuu

SEQ ID NO: 3921077 - RNA, 19 nt, Human adenovirus D
ugaaucagguauccagccu

SEQ ID NO: 3921078 - RNA, 23 nt, Human adenovirus D
ugacaacccgccugccaggaugg

SEQ ID NO: 3921079 - RNA, 13 nt, Human adenovirus D
ugacaaucaaaac

SEQ ID NO: 3921080 - RNA, 23 nt, Human adenovirus D
ugacacagcaguccaugcccaac

SEQ ID NO: 3921081 - RNA, 13 nt, Human adenovirus D
ugacacgcgcaca

SEQ ID NO: 3921082 - RNA, 14 nt, Human adenovirus D
ugaccaccagggag

SEQ ID NO: 3921083 - RNA, 18 nt, Human adenovirus D
ugaccauaagcagggugg

SEQ ID NO: 3921084 - RNA, 21 nt, Human adenovirus D
ugaccugccuccaccacccac

SEQ ID NO: 3921085 - RNA, 15 nt, Human adenovirus D
ugacgucauuugcau

SEQ ID NO: 3921086 - RNA, 15 nt, Human adenovirus D
ugacucggcugagcu

SEQ ID NO: 3921087 - RNA, 19 nt, Human adenovirus D
ugacuuugaaccugaaaga

SEQ ID NO: 3921088 - RNA, 15 nt, Human adenovirus D
ugagaauaacaugcu

SEQ ID NO: 3921089 - RNA, 20 nt, Human adenovirus D
ugagcagcuugcgcgcuggc

SEQ ID NO: 3921090 - RNA, 15 nt, Human adenovirus D
ugagcccgucccggg

SEQ ID NO: 3921091 - RNA, 20 nt, Human adenovirus D
ugaggacuuguuacaugaca

SEQ ID NO: 3921092 - RNA, 15 nt, Human adenovirus D
ugaggcaggccaugg

SEQ ID NO: 3921093 - RNA, 16 nt, Human adenovirus D
ugaggcaggccaugga

SEQ ID NO: 3921094 - RNA, 17 nt, Human adenovirus D
ugagguacaugggcaug

SEQ ID NO: 3921095 - RNA, 22 nt, Human adenovirus D
ugauaaggagaaggauucaaaa

SEQ ID NO: 3921096 - RNA, 20 nt, Human adenovirus D
ugauccguaucgugcugcuc

SEQ ID NO: 3921097 - RNA, 19 nt, Human adenovirus D
ugauccuuguccagauccu

SEQ ID NO: 3921098 - RNA, 15 nt, Human adenovirus D
ugauucaaacagcaa

SEQ ID NO: 3921099 - RNA, 13 nt, Human adenovirus D
ugauuuuuccagc

SEQ ID NO: 3921100 - RNA, 14 nt, Human adenovirus D
ugcaacccccagcu

SEQ ID NO: 3921101 - RNA, 12 nt, Human adenovirus D
ugcaagaaggaa

SEQ ID NO: 3921102 - RNA, 18 nt, Human adenovirus D
ugcaagucacgcagguga

SEQ ID NO: 3921103 - RNA, 16 nt, Human adenovirus D
auaugguagacccacu

SEQ ID NO: 3921104 - RNA, 16 nt, Human adenovirus D
aucaacuacaaggacu

SEQ ID NO: 3921105 - RNA, 15 nt, Human adenovirus D
aucaagacaaaauuc

SEQ ID NO: 3921106 - RNA, 15 nt, Human adenovirus D
aucacaucagccagg

SEQ ID NO: 3921107 - RNA, 19 nt, Human adenovirus D
aucacucuuuccagcagca

SEQ ID NO: 3921108 - RNA, 13 nt, Human adenovirus D
aucagcacugcaa

SEQ ID NO: 3921109 - RNA, 22 nt, Human adenovirus D
auccaacugaaguacauccauu

SEQ ID NO: 3921110 - RNA, 21 nt, Human adenovirus D
uaaaucauuggaacuaaucau

SEQ ID NO: 3921111 - RNA, 17 nt, Human adenovirus D
uaacacuccuaaaaccg

SEQ ID NO: 3921112 - RNA, 17 nt, Human adenovirus D
uaacuaugaucccaaca

SEQ ID NO: 3921113 - RNA, 12 nt, Human adenovirus D
uaagcaggagca

SEQ ID NO: 3921114 - RNA, 15 nt, Human adenovirus D
uaaguggcaacaccu

SEQ ID NO: 3921115 - RNA, 22 nt, Human adenovirus D
uaaucaccauguuauucagcag

SEQ ID NO: 3921116 - RNA, 16 nt, Human adenovirus D
uaaucauuuaauaaag

SEQ ID NO: 3921117 - RNA, 17 nt, Human adenovirus D
uaaugguccugcaagag

SEQ ID NO: 3921118 - RNA, 15 nt, Human adenovirus D
uacaaagcugaaagc

SEQ ID NO: 3921119 - RNA, 16 nt, Human adenovirus D
uacaacgcccugcugg

SEQ ID NO: 3921120 - RNA, 24 nt, Human adenovirus D
uacaaucgccacaggugcugccca

SEQ ID NO: 3921121 - RNA, 16 nt, Human adenovirus D
uacacgggguugcagc

SEQ ID NO: 3921122 - RNA, 20 nt, Human adenovirus D
uacagaugguagcagcagag

SEQ ID NO: 3921123 - RNA, 22 nt, Human adenovirus D
uacaguuaagaauccacagauc

SEQ ID NO: 3921124 - RNA, 21 nt, Human adenovirus D
uacauagaccacgcuacaaau

SEQ ID NO: 3921125 - RNA, 23 nt, Human adenovirus D
uacaucucggggaacggggcaga

SEQ ID NO: 3921126 - RNA, 13 nt, Human adenovirus D
uacaugcacugga

SEQ ID NO: 3921127 - RNA, 15 nt, Human adenovirus D
uacaugcccagcagc

SEQ ID NO: 3921128 - RNA, 18 nt, Human adenovirus D
uacauggugggcuaauau

SEQ ID NO: 3921129 - RNA, 21 nt, Human adenovirus D
uaccagucgggcccggacuac

SEQ ID NO: 3921130 - RNA, 21 nt, Human adenovirus D
uacgccaacucggcccacgcg

SEQ ID NO: 3921131 - RNA, 14 nt, Human adenovirus D
uacgcuggccagca

SEQ ID NO: 3921132 - RNA, 16 nt, Human adenovirus D
uacucuaaaugcaaau

SEQ ID NO: 3921133 - RNA, 17 nt, Human adenovirus D
uacugccacugccaaca

SEQ ID NO: 3921134 - RNA, 14 nt, Human adenovirus D
uacuguaaagccac

SEQ ID NO: 3921135 - RNA, 11 nt, Human adenovirus D
uagaaacagau

SEQ ID NO: 3921136 - RNA, 13 nt, Human adenovirus D
uagacauggccag

SEQ ID NO: 3921137 - RNA, 20 nt, Human adenovirus D
uagagugccacugccgcugc

SEQ ID NO: 3921138 - RNA, 17 nt, Human adenovirus D
uagccagaccaagcugc

SEQ ID NO: 3921139 - RNA, 19 nt, Human adenovirus D
uagcuuagggaguuugcau

SEQ ID NO: 3921140 - RNA, 15 nt, Human adenovirus D
uaggaccccagggac

SEQ ID NO: 3921141 - RNA, 14 nt, Human adenovirus D
uagggacagcagcc

SEQ ID NO: 3921142 - RNA, 23 nt, Human adenovirus D
uagggcgccaucuugcccacguc

SEQ ID NO: 3921143 - RNA, 18 nt, Human adenovirus D
uagucaaucucccaccac

SEQ ID NO: 3921144 - RNA, 14 nt, Human adenovirus D
uagugaccaagacc

SEQ ID NO: 3921145 - RNA, 18 nt, Human adenovirus D
uaguugggccuccaggaa

SEQ ID NO: 3921146 - RNA, 14 nt, Human adenovirus D
uauaaaaacaacaa

SEQ ID NO: 3921147 - RNA, 20 nt, Human adenovirus D
uauagucuaugggaacauau

SEQ ID NO: 3921148 - RNA, 19 nt, Human adenovirus D
uaucaugcaacuuggaagg

SEQ ID NO: 3921149 - RNA, 18 nt, Human adenovirus D
uaugauaaucugcaugau

SEQ ID NO: 3921150 - RNA, 17 nt, Human adenovirus D
uaugcuccugggugaga

SEQ ID NO: 3921151 - RNA, 23 nt, Human adenovirus D
uaugggagagaacaaaaccuuag

SEQ ID NO: 3921152 - RNA, 18 nt, Human adenovirus D
uauuacuaggcccagcag

SEQ ID NO: 3921153 - RNA, 21 nt, Human adenovirus D
uauuuaaaggcaccuuacacu

SEQ ID NO: 3921154 - RNA, 13 nt, Human adenovirus D
ucaaacaggcaaa

SEQ ID NO: 3921155 - RNA, 15 nt, Human adenovirus D
ucaacagcugugcua

SEQ ID NO: 3921156 - RNA, 12 nt, Human adenovirus D
ucaaccacaccu

SEQ ID NO: 3921157 - RNA, 21 nt, Human adenovirus D
ucaaccucaccaaccagacug

SEQ ID NO: 3921158 - RNA, 13 nt, Human adenovirus D
ucaaccuccaggc

SEQ ID NO: 3921159 - RNA, 14 nt, Human adenovirus D
ucaaccuccaggcc

SEQ ID NO: 3921160 - RNA, 16 nt, Human adenovirus D
ucaagcugggcuggga

SEQ ID NO: 3921161 - RNA, 16 nt, Human adenovirus D
ucaauacauagaccac

SEQ ID NO: 3921162 - RNA, 17 nt, Human adenovirus D
ucaaugucagcugcaaa

SEQ ID NO: 3921163 - RNA, 18 nt, Human adenovirus D
ucacacuacacagcuaga

SEQ ID NO: 3921164 - RNA, 21 nt, Human adenovirus D
ucacagcuaagaaaaaaucag

SEQ ID NO: 3921165 - RNA, 14 nt, Human adenovirus D
ucacauacacacua

SEQ ID NO: 3921166 - RNA, 18 nt, Human adenovirus D
ucacauacacacuagaaa

SEQ ID NO: 3921167 - RNA, 18 nt, Human adenovirus D
ucacauccaucuccacca

SEQ ID NO: 3921168 - RNA, 15 nt, Human adenovirus D
ucaccaaggccauag

SEQ ID NO: 3921169 - RNA, 16 nt, Human adenovirus D
ucaccaguuugggcac

SEQ ID NO: 3921170 - RNA, 22 nt, Human adenovirus D
ucacccagaaaagucuccucug

SEQ ID NO: 3921171 - RNA, 22 nt, Human adenovirus D
ucacccggacguggugcugcug

SEQ ID NO: 3921172 - RNA, 23 nt, Human adenovirus D
ucacccggacguggugcugcugc

SEQ ID NO: 3921173 - RNA, 13 nt, Human adenovirus D
ucacccucgagcu

SEQ ID NO: 3921174 - RNA, 16 nt, Human adenovirus D
ucacccugcccuucca

SEQ ID NO: 3921175 - RNA, 13 nt, Human adenovirus D
ucacccuggggcu

SEQ ID NO: 3921176 - RNA, 17 nt, Human adenovirus D
ucaccgagccucccagg

SEQ ID NO: 3921177 - RNA, 21 nt, Human adenovirus D
ucaccguagagggcaccaccg

SEQ ID NO: 3921178 - RNA, 23 nt, Human adenovirus D
ucaccuuggcuuugcuggguugc

SEQ ID NO: 3921179 - RNA, 18 nt, Human adenovirus D
ucacggcaucuuccuggg

SEQ ID NO: 3921180 - RNA, 20 nt, Human adenovirus D
ucacucuuuccagcagcagg

SEQ ID NO: 3921181 - RNA, 18 nt, Human adenovirus D
ucagaauauccccuuccu

SEQ ID NO: 3921182 - RNA, 18 nt, Human adenovirus D
ucagacgggugcuccggg

SEQ ID NO: 3921183 - RNA, 19 nt, Human adenovirus D
ucagacgggugcuccgggu

SEQ ID NO: 3921184 - RNA, 22 nt, Human adenovirus D
ucagagccagggcuaagcgugg

SEQ ID NO: 3921185 - RNA, 16 nt, Human adenovirus D
ucagcaacuaccccgu

SEQ ID NO: 3921186 - RNA, 14 nt, Human adenovirus D
ucagcagucucugc

SEQ ID NO: 3921187 - RNA, 16 nt, Human adenovirus D
ucagccccuuccccua

SEQ ID NO: 3921188 - RNA, 22 nt, Human adenovirus D
ucagccccuuccccuaucccaa

SEQ ID NO: 3921189 - RNA, 21 nt, Human adenovirus D
ucagcccgcuuaccaguagac

SEQ ID NO: 3921190 - RNA, 16 nt, Human adenovirus D
ucagcgaugagcagcu

SEQ ID NO: 3921191 - RNA, 18 nt, Human adenovirus D
ucagcugcagcgcacucu

SEQ ID NO: 3921192 - RNA, 22 nt, Human adenovirus D
ucaggaccauagggagccugcg

SEQ ID NO: 3921193 - RNA, 14 nt, Human adenovirus D
ucaggagcagcgcc

SEQ ID NO: 3921194 - RNA, 23 nt, Human adenovirus D
ucaggaguggcggcccuggcugg

SEQ ID NO: 3921195 - RNA, 23 nt, Human adenovirus D
ucagggcgaaggugucccugacc

SEQ ID NO: 3921196 - RNA, 22 nt, Human adenovirus D
ucaggguccgcgugaggguggu

SEQ ID NO: 3921197 - RNA, 15 nt, Human adenovirus D
ucagggugcuccagc

SEQ ID NO: 3921198 - RNA, 19 nt, Human adenovirus D
ucagguuacauuccugcac

SEQ ID NO: 3921199 - RNA, 14 nt, Human adenovirus D
ucaguuucccauga

SEQ ID NO: 3921200 - RNA, 22 nt, Human adenovirus D
ucauaucccaggggacuggaaa

SEQ ID NO: 3921201 - RNA, 19 nt, Human adenovirus D
ucauccagaauucaaccac

SEQ ID NO: 3921202 - RNA, 22 nt, Human adenovirus D
ucauccaugaugauggcgaugg

SEQ ID NO: 3921203 - RNA, 14 nt, Human adenovirus D
ucaucuugcacagu

SEQ ID NO: 3921204 - RNA, 14 nt, Human adenovirus D
ucaugaccagcaug

SEQ ID NO: 3921205 - RNA, 18 nt, Human adenovirus D
ucaugccacgaacagcca

SEQ ID NO: 3921206 - RNA, 13 nt, Human adenovirus D
ucauguccaccug

SEQ ID NO: 3921207 - RNA, 11 nt, Human adenovirus D
ucauucaaggc

SEQ ID NO: 3921208 - RNA, 14 nt, Human adenovirus D
ucauuuuuccagcc

SEQ ID NO: 3921209 - RNA, 15 nt, Human adenovirus D
uccaaacuagcagac

SEQ ID NO: 3921210 - RNA, 18 nt, Human adenovirus D
uccaacggcaaacagcau

SEQ ID NO: 3921211 - RNA, 20 nt, Human adenovirus D
uccaaggccaucugccacuc

SEQ ID NO: 3921212 - RNA, 15 nt, Human adenovirus D
uccaccacccacgcc

SEQ ID NO: 3921213 - RNA, 21 nt, Human adenovirus D
uccaccgugugcagacacaug

SEQ ID NO: 3921214 - RNA, 14 nt, Human adenovirus D
uccaccucucccga

SEQ ID NO: 3921215 - RNA, 18 nt, Human adenovirus D
uccacgguggcggcgagg

SEQ ID NO: 3921216 - RNA, 19 nt, Human adenovirus D
uccacugcuccugcgaaag

SEQ ID NO: 3921217 - RNA, 23 nt, Human adenovirus D
uccacuuucauaaucaggcagac

SEQ ID NO: 3921218 - RNA, 15 nt, Human adenovirus D
uccagcgcggccagc

SEQ ID NO: 3921219 - RNA, 17 nt, Human adenovirus D
uccaucaacuacugugg

SEQ ID NO: 3921220 - RNA, 20 nt, Human adenovirus D
uccaucagcgcccucagcag

SEQ ID NO: 3921221 - RNA, 14 nt, Human adenovirus D
uccaugcgggugac

SEQ ID NO: 3921222 - RNA, 15 nt, Human adenovirus D
ucccaccccagaaag

SEQ ID NO: 3921223 - RNA, 13 nt, Human adenovirus D
ucccacuacaaca

SEQ ID NO: 3921224 - RNA, 15 nt, Human adenovirus D
ucccagccuccaccg

SEQ ID NO: 3921225 - RNA, 15 nt, Human adenovirus D
uccccaccuacuccu

SEQ ID NO: 3921226 - RNA, 18 nt, Human adenovirus D
uccccgcccagcgagagg

SEQ ID NO: 3921227 - RNA, 15 nt, Human adenovirus D
uccccgcccgccgcc

SEQ ID NO: 3921228 - RNA, 12 nt, Human adenovirus D
agcgcauccuga

SEQ ID NO: 3921229 - RNA, 19 nt, Human adenovirus D
agcgcauguacaacaugcu

SEQ ID NO: 3921230 - RNA, 16 nt, Human adenovirus D
agcgccaacagcagcg

SEQ ID NO: 3921231 - RNA, 13 nt, Human adenovirus D
agcgccaggaggc

SEQ ID NO: 3921232 - RNA, 20 nt, Human adenovirus D
agcgccagucccucauccuc

SEQ ID NO: 3921233 - RNA, 17 nt, Human adenovirus D
agcgcccauuccuggag

SEQ ID NO: 3921234 - RNA, 22 nt, Human adenovirus D
agcgccuuaccugguacgagcu

SEQ ID NO: 3921235 - RNA, 16 nt, Human adenovirus D
agcggccgcggccaga

SEQ ID NO: 3921236 - RNA, 19 nt, Human adenovirus D
agcgggaccggggaggcac

SEQ ID NO: 3921237 - RNA, 19 nt, Human adenovirus D
agcgggaucaucgccugcu

SEQ ID NO: 3921238 - RNA, 22 nt, Human adenovirus D
agcgggaucaucgccugcuugc

SEQ ID NO: 3921239 - RNA, 18 nt, Human adenovirus D
agcgggcucuuccuccgu

SEQ ID NO: 3921240 - RNA, 22 nt, Human adenovirus D
agcgguucaagaacgagggccu

SEQ ID NO: 3921241 - RNA, 23 nt, Human adenovirus D
agcgguucugggucaccuuggcu

SEQ ID NO: 3921242 - RNA, 23 nt, Human adenovirus D
agcgguugagcgggcucuuccuc

SEQ ID NO: 3921243 - RNA, 17 nt, Human adenovirus D
agcgguugagcugggag

SEQ ID NO: 3921244 - RNA, 21 nt, Human adenovirus D
agcguagggcuuuuccugaug

SEQ ID NO: 3921245 - RNA, 17 nt, Human adenovirus D
agcgugggacuggcaag

SEQ ID NO: 3921246 - RNA, 23 nt, Human adenovirus D
agcuagacaccacagugcagaau

SEQ ID NO: 3921247 - RNA, 14 nt, Human adenovirus D
agcucaugcuggcc

SEQ ID NO: 3921248 - RNA, 19 nt, Human adenovirus D
agcucgucuuccaggagcc

SEQ ID NO: 3921249 - RNA, 22 nt, Human adenovirus D
agcucgucuuccaggagccuga

SEQ ID NO: 3921250 - RNA, 21 nt, Human adenovirus D
agcugccaugggaggaagcaa

SEQ ID NO: 3921251 - RNA, 18 nt, Human adenovirus D
agcugcgcgagggccugg

SEQ ID NO: 3921252 - RNA, 22 nt, Human adenovirus D
agcugcuugccgaaggacccca

SEQ ID NO: 3921253 - RNA, 14 nt, Human adenovirus D
agcuggaagcccug

SEQ ID NO: 3921254 - RNA, 19 nt, Human adenovirus D
agcuggacaagcuucuugc

SEQ ID NO: 3921255 - RNA, 23 nt, Human adenovirus D
agcuggcccggcaacgaccggcu

SEQ ID NO: 3921256 - RNA, 19 nt, Human adenovirus D
agcuuguugggccuuggcc

SEQ ID NO: 3921257 - RNA, 11 nt, Human adenovirus D
aggaaccccac

SEQ ID NO: 3921258 - RNA, 20 nt, Human adenovirus D
aggaauguggaaagauucag

SEQ ID NO: 3921259 - RNA, 17 nt, Human adenovirus D
aggaccauagggagccu

SEQ ID NO: 3921260 - RNA, 12 nt, Human adenovirus D
aggaccugggcu

SEQ ID NO: 3921261 - RNA, 16 nt, Human adenovirus D
aggacgagaaccugaa

SEQ ID NO: 3921262 - RNA, 22 nt, Human adenovirus D
aggagacgauccugcaggugga

SEQ ID NO: 3921263 - RNA, 15 nt, Human adenovirus D
aggagcaggaggagg

SEQ ID NO: 3921264 - RNA, 20 nt, Human adenovirus D
aggagccgcuaguggaagag

SEQ ID NO: 3921265 - RNA, 15 nt, Human adenovirus D
aggagcgugccgcca

SEQ ID NO: 3921266 - RNA, 15 nt, Human adenovirus D
aggagcugagaccag

SEQ ID NO: 3921267 - RNA, 15 nt, Human adenovirus D
aggaggacacuaaag

SEQ ID NO: 3921268 - RNA, 20 nt, Human adenovirus D
aggaggcuauuaagaaguau

SEQ ID NO: 3921269 - RNA, 22 nt, Human adenovirus D
aggagggauugcagggcguaga

SEQ ID NO: 3921270 - RNA, 17 nt, Human adenovirus D
aggagucgccggaggag

SEQ ID NO: 3921271 - RNA, 15 nt, Human adenovirus D
aggaugaacaggagc

SEQ ID NO: 3921272 - RNA, 19 nt, Human adenovirus D
aggcaccaucacaggaggc

SEQ ID NO: 3921273 - RNA, 21 nt, Human adenovirus D
aggcaccaucacaggaggcac

SEQ ID NO: 3921274 - RNA, 13 nt, Human adenovirus D
aggcacugcucuu

SEQ ID NO: 3921275 - RNA, 14 nt, Human adenovirus D
aggcagacucaggg

SEQ ID NO: 3921276 - RNA, 21 nt, Human adenovirus D
aggcagcuccgguugugcagc

SEQ ID NO: 3921277 - RNA, 22 nt, Human adenovirus D
aggcagcuccgguugugcagcc

SEQ ID NO: 3921278 - RNA, 14 nt, Human adenovirus D
aggccaacagacuc

SEQ ID NO: 3921279 - RNA, 15 nt, Human adenovirus D
aggccaggaggagac

SEQ ID NO: 3921280 - RNA, 15 nt, Human adenovirus D
aggccauaggccagg

SEQ ID NO: 3921281 - RNA, 12 nt, Human adenovirus D
aggcccagcagc

SEQ ID NO: 3921282 - RNA, 18 nt, Human adenovirus D
aggccgccuacgguccag

SEQ ID NO: 3921283 - RNA, 17 nt, Human adenovirus D
aggccgugaaggccggc

SEQ ID NO: 3921284 - RNA, 21 nt, Human adenovirus D
aggccuacuacuccugaucag

SEQ ID NO: 3921285 - RNA, 21 nt, Human adenovirus D
aggcgaagauggggccccgcc

SEQ ID NO: 3921286 - RNA, 22 nt, Human adenovirus D
aggcgaagauggggccccgcca

SEQ ID NO: 3921287 - RNA, 17 nt, Human adenovirus D
aggcgacaacgccaggc

SEQ ID NO: 3921288 - RNA, 14 nt, Human adenovirus D
aggcgagcagcugu

SEQ ID NO: 3921289 - RNA, 12 nt, Human adenovirus D
aggcgcagcugc

SEQ ID NO: 3921290 - RNA, 16 nt, Human adenovirus D
aggcgcccagccagca

SEQ ID NO: 3921291 - RNA, 13 nt, Human adenovirus D
aggcgcccaggcc

SEQ ID NO: 3921292 - RNA, 19 nt, Human adenovirus D
aggcgcgcuucacucuggc

SEQ ID NO: 3921293 - RNA, 17 nt, Human adenovirus D
aggcggacaagcuaaau

SEQ ID NO: 3921294 - RNA, 15 nt, Human adenovirus D
aggcgggugagggcg

SEQ ID NO: 3921295 - RNA, 13 nt, Human adenovirus D
aggcggugcugcu

SEQ ID NO: 3921296 - RNA, 16 nt, Human adenovirus D
aggcuggcccuccauc

SEQ ID NO: 3921297 - RNA, 17 nt, Human adenovirus D
aggcuuucacagcuugc

SEQ ID NO: 3921298 - RNA, 22 nt, Human adenovirus D
agggaaaagcucaaagaccaga

SEQ ID NO: 3921299 - RNA, 19 nt, Human adenovirus D
agggcaccaccgagucuca

SEQ ID NO: 3921300 - RNA, 16 nt, Human adenovirus D
agggcagcccuacccc

SEQ ID NO: 3921301 - RNA, 17 nt, Human adenovirus D
agggcaugggucaggca

SEQ ID NO: 3921302 - RNA, 16 nt, Human adenovirus D
agggccuggaccgcca

SEQ ID NO: 3921303 - RNA, 20 nt, Human adenovirus D
agggcgcgcaguugggagcu

SEQ ID NO: 3921304 - RNA, 20 nt, Human adenovirus D
aggggagugaagagggagag

SEQ ID NO: 3921305 - RNA, 14 nt, Human adenovirus D
aggggcggcagagg

SEQ ID NO: 3921306 - RNA, 20 nt, Human adenovirus D
agguacaugggcaugagccc

SEQ ID NO: 3921307 - RNA, 21 nt, Human adenovirus D
aggucagcagcaagagcucaa

SEQ ID NO: 3921308 - RNA, 17 nt, Human adenovirus D
aggucgaggagaccugc

SEQ ID NO: 3921309 - RNA, 13 nt, Human adenovirus D
aggugcugacgcu

SEQ ID NO: 3921310 - RNA, 16 nt, Human adenovirus D
agguggacgagccgcc

SEQ ID NO: 3921311 - RNA, 15 nt, Human adenovirus D
agguggcccugggcc

SEQ ID NO: 3921312 - RNA, 15 nt, Human adenovirus D
aguaaagaaacagaa

SEQ ID NO: 3921313 - RNA, 18 nt, Human adenovirus D
aguaaauuugacacagca

SEQ ID NO: 3921314 - RNA, 14 nt, Human adenovirus D
aguaaguuccuguc

SEQ ID NO: 3921315 - RNA, 17 nt, Human adenovirus D
aguacaagcgccaacag

SEQ ID NO: 3921316 - RNA, 18 nt, Human adenovirus D
aguacauguucaccagca

SEQ ID NO: 3921317 - RNA, 17 nt, Human adenovirus D
aguaccugagccgcgag

SEQ ID NO: 3921318 - RNA, 15 nt, Human adenovirus D
aguagucaucaaaug

SEQ ID NO: 3921319 - RNA, 17 nt, Human adenovirus D
aguaugccaagauagcc

SEQ ID NO: 3921320 - RNA, 21 nt, Human adenovirus D
agucaaauauuagcuaaugug

SEQ ID NO: 3921321 - RNA, 22 nt, Human adenovirus D
agucacacuuaguucagcugca

SEQ ID NO: 3921322 - RNA, 20 nt, Human adenovirus D
agucacuaggaccccaggga

SEQ ID NO: 3921323 - RNA, 12 nt, Human adenovirus D
aguccaccgcuc

SEQ ID NO: 3921324 - RNA, 11 nt, Human adenovirus D
aguccagcaga

SEQ ID NO: 3921325 - RNA, 17 nt, Human adenovirus D
aguccaugcccaacagg

SEQ ID NO: 3921326 - RNA, 16 nt, Human adenovirus D
agucucaccugguuag

SEQ ID NO: 3921327 - RNA, 13 nt, Human adenovirus D
agugaccaagacc

SEQ ID NO: 3921328 - RNA, 21 nt, Human adenovirus D
agugccuuuaucagcacugca

SEQ ID NO: 3921329 - RNA, 16 nt, Human adenovirus D
aguggaagaagagcag

SEQ ID NO: 3921330 - RNA, 23 nt, Human adenovirus D
aguggcaaugcaggauccagcgc

SEQ ID NO: 3921331 - RNA, 22 nt, Human adenovirus D
aguggcgagaggcgagcagcug

SEQ ID NO: 3921332 - RNA, 12 nt, Human adenovirus D
aguucaggagcg

SEQ ID NO: 3921333 - RNA, 12 nt, Human adenovirus D
aguugagggccu

SEQ ID NO: 3921334 - RNA, 17 nt, Human adenovirus D
aguuggcgacccaggaa

SEQ ID NO: 3921335 - RNA, 13 nt, Human adenovirus D
aguugguggccgu

SEQ ID NO: 3921336 - RNA, 15 nt, Human adenovirus D
aguuguucagcagca

SEQ ID NO: 3921337 - RNA, 15 nt, Human adenovirus D
aguuuuauggcugcu

SEQ ID NO: 3921338 - RNA, 13 nt, Human adenovirus D
auaaacuuaguuu

SEQ ID NO: 3921339 - RNA, 21 nt, Human adenovirus D
auaaaucugcccugauaucca

SEQ ID NO: 3921340 - RNA, 20 nt, Human adenovirus D
auaagacauuuuaaugaauu

SEQ ID NO: 3921341 - RNA, 15 nt, Human adenovirus D
auaauagaaacagau

SEQ ID NO: 3921342 - RNA, 17 nt, Human adenovirus D
auacaaagcugaaagcu

SEQ ID NO: 3921343 - RNA, 20 nt, Human adenovirus D
auacaacucgugcgaggggc

SEQ ID NO: 3921344 - RNA, 13 nt, Human adenovirus D
auacaagccagga

SEQ ID NO: 3921345 - RNA, 18 nt, Human adenovirus D
auacagagauucagccau

SEQ ID NO: 3921346 - RNA, 17 nt, Human adenovirus D
auaugcuacaucugcug

SEQ ID NO: 3921347 - RNA, 21 nt, Human adenovirus D
acgugcaguccaaccuggacc

SEQ ID NO: 3921348 - RNA, 21 nt, Human adenovirus D
acgugcccauagacaaggagg

SEQ ID NO: 3921349 - RNA, 20 nt, Human adenovirus D
acguggccuuguaccugccc

SEQ ID NO: 3921350 - RNA, 14 nt, Human adenovirus D
acguggugcugcug

SEQ ID NO: 3921351 - RNA, 16 nt, Human adenovirus D
acguggugcugcugcc

SEQ ID NO: 3921352 - RNA, 22 nt, Human adenovirus D
acguuucuggggucagagacau

SEQ ID NO: 3921353 - RNA, 19 nt, Human adenovirus D
acuaaacuuuaugagggag

SEQ ID NO: 3921354 - RNA, 14 nt, Human adenovirus D
acuagcgcccuggu

SEQ ID NO: 3921355 - RNA, 14 nt, Human adenovirus D
acucaccaaggcca

SEQ ID NO: 3921356 - RNA, 14 nt, Human adenovirus D
acucacgccggggu

SEQ ID NO: 3921357 - RNA, 22 nt, Human adenovirus D
acucccagcgccgcgcuggaca

SEQ ID NO: 3921358 - RNA, 16 nt, Human adenovirus D
acuccgcgaccuccuc

SEQ ID NO: 3921359 - RNA, 15 nt, Human adenovirus D
acucgacgagccagg

SEQ ID NO: 3921360 - RNA, 15 nt, Human adenovirus D
acucgcggcugcugc

SEQ ID NO: 3921361 - RNA, 17 nt, Human adenovirus D
acucgcggcugcugcug

SEQ ID NO: 3921362 - RNA, 14 nt, Human adenovirus D
acucgcgggcggcc

SEQ ID NO: 3921363 - RNA, 18 nt, Human adenovirus D
acucgcgggcggccauug

SEQ ID NO: 3921364 - RNA, 21 nt, Human adenovirus D
acucggugcuuagccugggca

SEQ ID NO: 3921365 - RNA, 15 nt, Human adenovirus D
acugaaaauuugcaa

SEQ ID NO: 3921366 - RNA, 16 nt, Human adenovirus D
acugaccaccaccugg

SEQ ID NO: 3921367 - RNA, 17 nt, Human adenovirus D
acugccaccgccgccgc

SEQ ID NO: 3921368 - RNA, 21 nt, Human adenovirus D
acugcgcguccgucagcagca

SEQ ID NO: 3921369 - RNA, 21 nt, Human adenovirus D
acugcuaucaggagaaaauug

SEQ ID NO: 3921370 - RNA, 23 nt, Human adenovirus D
acugcuaucaggagaaaauugau

SEQ ID NO: 3921371 - RNA, 16 nt, Human adenovirus D
acugcucgaucuccuc

SEQ ID NO: 3921372 - RNA, 18 nt, Human adenovirus D
acugcucuucccuggaga

SEQ ID NO: 3921373 - RNA, 19 nt, Human adenovirus D
acuggaaacucuuggagca

SEQ ID NO: 3921374 - RNA, 23 nt, Human adenovirus D
acuggagcacagaccuucaggga

SEQ ID NO: 3921375 - RNA, 22 nt, Human adenovirus D
acuggcugacccaaucaccaua

SEQ ID NO: 3921376 - RNA, 14 nt, Human adenovirus D
acuggguggcccuu

SEQ ID NO: 3921377 - RNA, 20 nt, Human adenovirus D
acugguacuugggcugccac

SEQ ID NO: 3921378 - RNA, 16 nt, Human adenovirus D
acuggucaaaaacaaa

SEQ ID NO: 3921379 - RNA, 14 nt, Human adenovirus D
acuucagccugggc

SEQ ID NO: 3921380 - RNA, 19 nt, Human adenovirus D
acuuccgcguaccugcgca

SEQ ID NO: 3921381 - RNA, 15 nt, Human adenovirus D
acuucugccagcaga

SEQ ID NO: 3921382 - RNA, 15 nt, Human adenovirus D
acuugauuggccugu

SEQ ID NO: 3921383 - RNA, 15 nt, Human adenovirus D
agaaaugaggcaggc

SEQ ID NO: 3921384 - RNA, 12 nt, Human adenovirus D
agaacaaggcca

SEQ ID NO: 3921385 - RNA, 12 nt, Human adenovirus D
agaacaggagcc

SEQ ID NO: 3921386 - RNA, 17 nt, Human adenovirus D
agaacauguucuacgcc

SEQ ID NO: 3921387 - RNA, 13 nt, Human adenovirus D
agaaccaugaagg

SEQ ID NO: 3921388 - RNA, 20 nt, Human adenovirus D
agaaccauuuuuauuccaaa

SEQ ID NO: 3921389 - RNA, 17 nt, Human adenovirus D
agaaccggaggcuggcu

SEQ ID NO: 3921390 - RNA, 22 nt, Human adenovirus D
agaaccugaaggagcuggacaa

SEQ ID NO: 3921391 - RNA, 15 nt, Human adenovirus D
agaacggggugcagu

SEQ ID NO: 3921392 - RNA, 15 nt, Human adenovirus D
agaagagcagcacag

SEQ ID NO: 3921393 - RNA, 19 nt, Human adenovirus D
agaaggugagggggucccg

SEQ ID NO: 3921394 - RNA, 22 nt, Human adenovirus D
agaaggugguggacggccuggc

SEQ ID NO: 3921395 - RNA, 15 nt, Human adenovirus D
agaauauccccuucc

SEQ ID NO: 3921396 - RNA, 15 nt, Human adenovirus D
agaauccacagauca

SEQ ID NO: 3921397 - RNA, 12 nt, Human adenovirus D
agaaugcugcua

SEQ ID NO: 3921398 - RNA, 15 nt, Human adenovirus D
agacaccacagugca

SEQ ID NO: 3921399 - RNA, 13 nt, Human adenovirus D
agacagcagaaga

SEQ ID NO: 3921400 - RNA, 23 nt, Human adenovirus D
agaccaugaccauagaccugaug

SEQ ID NO: 3921401 - RNA, 15 nt, Human adenovirus D
agacgagcggccgcc

SEQ ID NO: 3921402 - RNA, 18 nt, Human adenovirus D
agacgcaggccaggagga

SEQ ID NO: 3921403 - RNA, 21 nt, Human adenovirus D
agacuaagcuaguacucuaca

SEQ ID NO: 3921404 - RNA, 14 nt, Human adenovirus D
agagacagaagaag

SEQ ID NO: 3921405 - RNA, 16 nt, Human adenovirus D
agagaugagagucuga

SEQ ID NO: 3921406 - RNA, 13 nt, Human adenovirus D
agagcccccuccc

SEQ ID NO: 3921407 - RNA, 15 nt, Human adenovirus D
agagcucaaaguaaa

SEQ ID NO: 3921408 - RNA, 13 nt, Human adenovirus D
agagcuugggcgc

SEQ ID NO: 3921409 - RNA, 21 nt, Human adenovirus D
agaggagcugaucucgcugcc

SEQ ID NO: 3921410 - RNA, 19 nt, Human adenovirus D
agaggcggaacugcuggcc

SEQ ID NO: 3921411 - RNA, 16 nt, Human adenovirus D
agagggagaggagcga

SEQ ID NO: 3921412 - RNA, 18 nt, Human adenovirus D
agagucugaaaaacagaa

SEQ ID NO: 3921413 - RNA, 20 nt, Human adenovirus D
agauagugcuuacucuauaa

SEQ ID NO: 3921414 - RNA, 20 nt, Human adenovirus D
agaucagcugcagcgcacuc

SEQ ID NO: 3921415 - RNA, 13 nt, Human adenovirus D
agaucgccgcgac

SEQ ID NO: 3921416 - RNA, 23 nt, Human adenovirus D
agaugcgacccaugagcugcgag

SEQ ID NO: 3921417 - RNA, 13 nt, Human adenovirus D
agauggccacccc

SEQ ID NO: 3921418 - RNA, 15 nt, Human adenovirus D
agcaagccccggacc

SEQ ID NO: 3921419 - RNA, 19 nt, Human adenovirus D
agcaccgccgcagccgcgg

SEQ ID NO: 3921420 - RNA, 19 nt, Human adenovirus D
agcaccucgguacccuccu

SEQ ID NO: 3921421 - RNA, 19 nt, Human adenovirus D
agcacgcggaucucacggc

SEQ ID NO: 3921422 - RNA, 20 nt, Human adenovirus D
agcacugcaaauuuaacuuc

SEQ ID NO: 3921423 - RNA, 22 nt, Human adenovirus D
agcagaaauuucaagcugggcu

SEQ ID NO: 3921424 - RNA, 19 nt, Human adenovirus D
agcagaaguucaccugcau

SEQ ID NO: 3921425 - RNA, 16 nt, Human adenovirus D
agcagacagggccugc

SEQ ID NO: 3921426 - RNA, 21 nt, Human adenovirus D
agcagacggugaagcaggagc

SEQ ID NO: 3921427 - RNA, 21 nt, Human adenovirus D
agcagaggaagagggucacac

SEQ ID NO: 3921428 - RNA, 11 nt, Human adenovirus D
agcagcagggu

SEQ ID NO: 3921429 - RNA, 19 nt, Human adenovirus D
agcagcaggguacccacug

SEQ ID NO: 3921430 - RNA, 22 nt, Human adenovirus D
agcagcaggguacccacugggu

SEQ ID NO: 3921431 - RNA, 21 nt, Human adenovirus D
agcagcauguacggaggagcc

SEQ ID NO: 3921432 - RNA, 19 nt, Human adenovirus D
agcagcccuguggacgcug

SEQ ID NO: 3921433 - RNA, 13 nt, Human adenovirus D
agcaggcaggugg

SEQ ID NO: 3921434 - RNA, 17 nt, Human adenovirus D
agcaggggcgcugggcg

SEQ ID NO: 3921435 - RNA, 18 nt, Human adenovirus D
agcaggggcgcugggcgu

SEQ ID NO: 3921436 - RNA, 21 nt, Human adenovirus D
agcaggguacccacugggugg

SEQ ID NO: 3921437 - RNA, 22 nt, Human adenovirus D
agcaggguacccacuggguggc

SEQ ID NO: 3921438 - RNA, 20 nt, Human adenovirus D
agcauaauauggugaagggc

SEQ ID NO: 3921439 - RNA, 15 nt, Human adenovirus D
agcauauaccccucc

SEQ ID NO: 3921440 - RNA, 14 nt, Human adenovirus D
agcaucgcgcaggc

SEQ ID NO: 3921441 - RNA, 23 nt, Human adenovirus D
agcaugagcggcuccagcgaaag

SEQ ID NO: 3921442 - RNA, 18 nt, Human adenovirus D
agcaugccgaagaagaac

SEQ ID NO: 3921443 - RNA, 17 nt, Human adenovirus D
agcauggcuaccuggga

SEQ ID NO: 3921444 - RNA, 18 nt, Human adenovirus D
agcauggcuaccugggag

SEQ ID NO: 3921445 - RNA, 20 nt, Human adenovirus D
agcauggcuaccugggagga

SEQ ID NO: 3921446 - RNA, 14 nt, Human adenovirus D
agccagccacagcc

SEQ ID NO: 3921447 - RNA, 16 nt, Human adenovirus D
agccaggugagcucgg

SEQ ID NO: 3921448 - RNA, 21 nt, Human adenovirus D
agccaggugagcucgggcugc

SEQ ID NO: 3921449 - RNA, 20 nt, Human adenovirus D
agcccaacggcaccugcgag

SEQ ID NO: 3921450 - RNA, 19 nt, Human adenovirus D
agcccgcgcgggagccagg

SEQ ID NO: 3921451 - RNA, 20 nt, Human adenovirus D
agcccgugaccugcagcagg

SEQ ID NO: 3921452 - RNA, 18 nt, Human adenovirus D
agccgcgcgccgcgccgc

SEQ ID NO: 3921453 - RNA, 19 nt, Human adenovirus D
agccgcgcgcuggggcaga

SEQ ID NO: 3921454 - RNA, 17 nt, Human adenovirus D
agccgcuaguggaagag

SEQ ID NO: 3921455 - RNA, 22 nt, Human adenovirus D
agccgcuccgugcgaggaugag

SEQ ID NO: 3921456 - RNA, 18 nt, Human adenovirus D
agccggcgaacgugccgc

SEQ ID NO: 3921457 - RNA, 19 nt, Human adenovirus D
agccggcucgucuagaacc

SEQ ID NO: 3921458 - RNA, 17 nt, Human adenovirus D
agccguacaccaggccu

SEQ ID NO: 3921459 - RNA, 13 nt, Human adenovirus D
agccguaccagug

SEQ ID NO: 3921460 - RNA, 14 nt, Human adenovirus D
agccguggcgcagc

SEQ ID NO: 3921461 - RNA, 12 nt, Human adenovirus D
agccuacccaaa

SEQ ID NO: 3921462 - RNA, 15 nt, Human adenovirus D
agcgaucugggaugc

SEQ ID NO: 3921463 - RNA, 20 nt, Human adenovirus D
agcgaucugggaugcugccc

SEQ ID NO: 3921464 - RNA, 15 nt, Human adenovirus D
agcgaugagcagcuu

SEQ ID NO: 3921465 - RNA, 13 nt, Human adenovirus D
cccacccccccgg

SEQ ID NO: 3921466 - RNA, 20 nt, Human adenovirus D
cccacgaugugaccacggac

SEQ ID NO: 3921467 - RNA, 20 nt, Human adenovirus D
cccacgugguauacaagcca

SEQ ID NO: 3921468 - RNA, 12 nt, Human adenovirus D
cccacugggugg

SEQ ID NO: 3921469 - RNA, 20 nt, Human adenovirus D
cccagagcucgcgggccaug

SEQ ID NO: 3921470 - RNA, 21 nt, Human adenovirus D
cccagcaauaacaccggcugg

SEQ ID NO: 3921471 - RNA, 23 nt, Human adenovirus D
cccagcagaagcagaaguucacc

SEQ ID NO: 3921472 - RNA, 21 nt, Human adenovirus D
cccagccagcaaacgccgccg

SEQ ID NO: 3921473 - RNA, 21 nt, Human adenovirus D
cccagcgucugacgcugcgcu

SEQ ID NO: 3921474 - RNA, 18 nt, Human adenovirus D
cccagcucauccgcagcu

SEQ ID NO: 3921475 - RNA, 17 nt, Human adenovirus D
cccaggcccuggagcag

SEQ ID NO: 3921476 - RNA, 18 nt, Human adenovirus D
cccaggcggugcugcugc

SEQ ID NO: 3921477 - RNA, 19 nt, Human adenovirus D
cccaggcggugcugcugcc

SEQ ID NO: 3921478 - RNA, 18 nt, Human adenovirus D
cccaguuucaaacccuac

SEQ ID NO: 3921479 - RNA, 22 nt, Human adenovirus D
cccauaauucagggugcuccag

SEQ ID NO: 3921480 - RNA, 19 nt, Human adenovirus D
cccauggacgggaacccca

SEQ ID NO: 3921481 - RNA, 17 nt, Human adenovirus D
ccccaaacgccagccca

SEQ ID NO: 3921482 - RNA, 13 nt, Human adenovirus D
ccccagacaccca

SEQ ID NO: 3921483 - RNA, 15 nt, Human adenovirus D
ccccagacacccacg

SEQ ID NO: 3921484 - RNA, 12 nt, Human adenovirus D
ccccaggccugg

SEQ ID NO: 3921485 - RNA, 13 nt, Human adenovirus D
ccccaggcggugc

SEQ ID NO: 3921486 - RNA, 20 nt, Human adenovirus D
ccccaucccggccaaggcca

SEQ ID NO: 3921487 - RNA, 16 nt, Human adenovirus D
ccccauggcgcacaac

SEQ ID NO: 3921488 - RNA, 19 nt, Human adenovirus D
cccccaggcccuggagcag

SEQ ID NO: 3921489 - RNA, 18 nt, Human adenovirus D
ccccccgcggaugcuggc

SEQ ID NO: 3921490 - RNA, 12 nt, Human adenovirus D
cccccgagcgcc

SEQ ID NO: 3921491 - RNA, 16 nt, Human adenovirus D
ccccgcgccgcgcugc

SEQ ID NO: 3921492 - RNA, 14 nt, Human adenovirus D
ccccgcggcggcga

SEQ ID NO: 3921493 - RNA, 17 nt, Human adenovirus D
ccccguugggcagcgag

SEQ ID NO: 3921494 - RNA, 15 nt, Human adenovirus D
ccccuccgcugugcu

SEQ ID NO: 3921495 - RNA, 22 nt, Human adenovirus D
ccccugcaagugcacagaccca

SEQ ID NO: 3921496 - RNA, 18 nt, Human adenovirus D
ccccuggcucccagccuc

SEQ ID NO: 3921497 - RNA, 13 nt, Human adenovirus D
ccccuuccacugu

SEQ ID NO: 3921498 - RNA, 17 nt, Human adenovirus D
cccgagcucugcugcgc

SEQ ID NO: 3921499 - RNA, 18 nt, Human adenovirus D
cccgagggcuacaaggac

SEQ ID NO: 3921500 - RNA, 20 nt, Human adenovirus D
cccgagggucgcuggcugcu

SEQ ID NO: 3921501 - RNA, 22 nt, Human adenovirus D
cccgaugacggguugcaggugg

SEQ ID NO: 3921502 - RNA, 22 nt, Human adenovirus D
cccgccgcuguggagccacugc

SEQ ID NO: 3921503 - RNA, 20 nt, Human adenovirus D
cccggacguggugcugcugc

SEQ ID NO: 3921504 - RNA, 21 nt, Human adenovirus D
cccggacguggugcugcugcc

SEQ ID NO: 3921505 - RNA, 22 nt, Human adenovirus D
cccggacguggugcugcugccg

SEQ ID NO: 3921506 - RNA, 13 nt, Human adenovirus D
cccggccaaggcc

SEQ ID NO: 3921507 - RNA, 17 nt, Human adenovirus D
cccgggggccucguccu

SEQ ID NO: 3921508 - RNA, 17 nt, Human adenovirus D
cccgggucuggugcagu

SEQ ID NO: 3921509 - RNA, 16 nt, Human adenovirus D
cccguggucggcgccg

SEQ ID NO: 3921510 - RNA, 19 nt, Human adenovirus D
cccuacgucuacaaggccc

SEQ ID NO: 3921511 - RNA, 16 nt, Human adenovirus D
cccuauuuaaaggcac

SEQ ID NO: 3921512 - RNA, 18 nt, Human adenovirus D
cccucaucacaucagcca

SEQ ID NO: 3921513 - RNA, 21 nt, Human adenovirus D
cccucaucacaucagccagga

SEQ ID NO: 3921514 - RNA, 23 nt, Human adenovirus D
cccucaucacaucagccaggacu

SEQ ID NO: 3921515 - RNA, 18 nt, Human adenovirus D
cccucgggccccggggcg

SEQ ID NO: 3921516 - RNA, 14 nt, Human adenovirus D
cccugacccagcag

SEQ ID NO: 3921517 - RNA, 17 nt, Human adenovirus D
cccugagcucgcgccuc

SEQ ID NO: 3921518 - RNA, 19 nt, Human adenovirus D
cccugcccgagggcaacuu

SEQ ID NO: 3921519 - RNA, 18 nt, Human adenovirus D
cccugcucaccugcaccu

SEQ ID NO: 3921520 - RNA, 18 nt, Human adenovirus D
cccugcuggccgagcugg

SEQ ID NO: 3921521 - RNA, 12 nt, Human adenovirus D
cccuggaagagu

SEQ ID NO: 3921522 - RNA, 14 nt, Human adenovirus D
cccuggcucccagc

SEQ ID NO: 3921523 - RNA, 20 nt, Human adenovirus D
cccuggcucccagccuccac

SEQ ID NO: 3921524 - RNA, 12 nt, Human adenovirus D
cccuggcuccgc

SEQ ID NO: 3921525 - RNA, 17 nt, Human adenovirus D
cccugugaccaagcugg

SEQ ID NO: 3921526 - RNA, 23 nt, Human adenovirus D
cccuucaccgacaguggcagcgu

SEQ ID NO: 3921527 - RNA, 18 nt, Human adenovirus D
cccuugaacagcauauac

SEQ ID NO: 3921528 - RNA, 16 nt, Human adenovirus D
ccgaagggcgagaagc

SEQ ID NO: 3921529 - RNA, 22 nt, Human adenovirus D
ccgacacugcagggagccaggg

SEQ ID NO: 3921530 - RNA, 20 nt, Human adenovirus D
ccgacgccccugagcggcug

SEQ ID NO: 3921531 - RNA, 14 nt, Human adenovirus D
ccgacgcgcuccuc

SEQ ID NO: 3921532 - RNA, 17 nt, Human adenovirus D
ccgacuucaugagccag

SEQ ID NO: 3921533 - RNA, 14 nt, Human adenovirus D
ccgagccucccagg

SEQ ID NO: 3921534 - RNA, 12 nt, Human adenovirus D
ccgagcucugcu

SEQ ID NO: 3921535 - RNA, 15 nt, Human adenovirus D
ccgagcucugcugcg

SEQ ID NO: 3921536 - RNA, 16 nt, Human adenovirus D
ccgagcugacggccag

SEQ ID NO: 3921537 - RNA, 18 nt, Human adenovirus D
ccgaggagaacugcuggc

SEQ ID NO: 3921538 - RNA, 20 nt, Human adenovirus D
ccgaggagaacugcuggccc

SEQ ID NO: 3921539 - RNA, 20 nt, Human adenovirus D
ccgagggucgcuggcugcug

SEQ ID NO: 3921540 - RNA, 21 nt, Human adenovirus D
ccgaggugccccagagcgagg

SEQ ID NO: 3921541 - RNA, 20 nt, Human adenovirus D
ccgcacuggcuuccgccgcc

SEQ ID NO: 3921542 - RNA, 21 nt, Human adenovirus D
ccgcacuggcuuccgccgccg

SEQ ID NO: 3921543 - RNA, 16 nt, Human adenovirus D
ccgcaggccaacagac

SEQ ID NO: 3921544 - RNA, 18 nt, Human adenovirus D
ccgcaggcgggacagagg

SEQ ID NO: 3921545 - RNA, 17 nt, Human adenovirus D
ccgcauccacaaggccg

SEQ ID NO: 3921546 - RNA, 14 nt, Human adenovirus D
ccgccaaggagcuc

SEQ ID NO: 3921547 - RNA, 12 nt, Human adenovirus D
ccgccagcuggc

SEQ ID NO: 3921548 - RNA, 21 nt, Human adenovirus D
ccgccauaagggcggcgcugc

SEQ ID NO: 3921549 - RNA, 21 nt, Human adenovirus D
ccgccauggggcgccgcccga

SEQ ID NO: 3921550 - RNA, 18 nt, Human adenovirus D
ccgcccgagcucugcugc

SEQ ID NO: 3921551 - RNA, 13 nt, Human adenovirus D
ccgccgccgcacc

SEQ ID NO: 3921552 - RNA, 12 nt, Human adenovirus D
ccgccgccgccg

SEQ ID NO: 3921553 - RNA, 14 nt, Human adenovirus D
ccgccgccgccgcc

SEQ ID NO: 3921554 - RNA, 13 nt, Human adenovirus D
ccgccgcggccau

SEQ ID NO: 3921555 - RNA, 14 nt, Human adenovirus D
ccgccgcggccauc

SEQ ID NO: 3921556 - RNA, 17 nt, Human adenovirus D
ccgccgcuaucugcucu

SEQ ID NO: 3921557 - RNA, 21 nt, Human adenovirus D
ccgccgcuaucugcucuucca

SEQ ID NO: 3921558 - RNA, 20 nt, Human adenovirus D
ccgccggaaacgccaccacc

SEQ ID NO: 3921559 - RNA, 14 nt, Human adenovirus D
ccgccggcucaagc

SEQ ID NO: 3921560 - RNA, 12 nt, Human adenovirus D
ccgccugccagg

SEQ ID NO: 3921561 - RNA, 23 nt, Human adenovirus D
ccgccugcgcauccccguuccga

SEQ ID NO: 3921562 - RNA, 12 nt, Human adenovirus D
ccgccuggggca

SEQ ID NO: 3921563 - RNA, 20 nt, Human adenovirus D
ccgcgagcugaugcugagcc

SEQ ID NO: 3921564 - RNA, 19 nt, Human adenovirus D
ccgcgauguugagcuggac

SEQ ID NO: 3921565 - RNA, 12 nt, Human adenovirus D
ccgcgcgccgcg

SEQ ID NO: 3921566 - RNA, 18 nt, Human adenovirus D
ccgcgcgccgcgccgcca

SEQ ID NO: 3921567 - RNA, 12 nt, Human adenovirus D
ccgcgcugggga

SEQ ID NO: 3921568 - RNA, 17 nt, Human adenovirus D
ccgcgcuugcugggcga

SEQ ID NO: 3921569 - RNA, 13 nt, Human adenovirus D
ccgcggaguccag

SEQ ID NO: 3921570 - RNA, 15 nt, Human adenovirus D
ccgcgucgcugucca

SEQ ID NO: 3921571 - RNA, 14 nt, Human adenovirus D
ccgcuaucugcucu

SEQ ID NO: 3921572 - RNA, 15 nt, Human adenovirus D
ccgcuguggagccac

SEQ ID NO: 3921573 - RNA, 13 nt, Human adenovirus D
ccgcuugcuggau

SEQ ID NO: 3921574 - RNA, 22 nt, Human adenovirus D
ccggaccccgccauaagggcgg

SEQ ID NO: 3921575 - RNA, 17 nt, Human adenovirus D
ccggaggcgugcacugg

SEQ ID NO: 3921576 - RNA, 14 nt, Human adenovirus D
ccggcaacgaccgg

SEQ ID NO: 3921577 - RNA, 19 nt, Human adenovirus D
ccggcauccugcacgcagc

SEQ ID NO: 3921578 - RNA, 14 nt, Human adenovirus D
ccggccccgcgggc

SEQ ID NO: 3921579 - RNA, 13 nt, Human adenovirus D
ccggccgcgcuug

SEQ ID NO: 3921580 - RNA, 19 nt, Human adenovirus D
ccggcgaacgugccgcgcg

SEQ ID NO: 3921581 - RNA, 16 nt, Human adenovirus D
ccggcgacaagcuggc

SEQ ID NO: 3921582 - RNA, 19 nt, Human adenovirus D
ccggcgacaagcuggccug

SEQ ID NO: 3921583 - RNA, 14 nt, Human adenovirus D
ccggcgaccaccgc

SEQ ID NO: 3921584 - RNA, 12 nt, Human adenovirus D
gcagcggcagga

SEQ ID NO: 3921585 - RNA, 22 nt, Human adenovirus D
gcagcgucgacggggaaggcua

SEQ ID NO: 3921586 - RNA, 16 nt, Human adenovirus D
gcagcguguucaaaac

SEQ ID NO: 3921587 - RNA, 12 nt, Human adenovirus D
gcaggaccuggg

SEQ ID NO: 3921588 - RNA, 17 nt, Human adenovirus D
gcaggagcaggaggagg

SEQ ID NO: 3921589 - RNA, 14 nt, Human adenovirus D
gcaggccaggagga

SEQ ID NO: 3921590 - RNA, 17 nt, Human adenovirus D
gcaggccgggcugcacg

SEQ ID NO: 3921591 - RNA, 14 nt, Human adenovirus D
gcaggccgugcugc

SEQ ID NO: 3921592 - RNA, 14 nt, Human adenovirus D
gcaggcgcccagcc

SEQ ID NO: 3921593 - RNA, 17 nt, Human adenovirus D
gcaggcgcuggaagagg

SEQ ID NO: 3921594 - RNA, 19 nt, Human adenovirus D
gcaggggcuacauucugga

SEQ ID NO: 3921595 - RNA, 14 nt, Human adenovirus D
gcaggguaaagcca

SEQ ID NO: 3921596 - RNA, 19 nt, Human adenovirus D
gcagguggacgagccgccu

SEQ ID NO: 3921597 - RNA, 13 nt, Human adenovirus D
gcagucucugccg

SEQ ID NO: 3921598 - RNA, 17 nt, Human adenovirus D
gcaucccguccugcgcc

SEQ ID NO: 3921599 - RNA, 20 nt, Human adenovirus D
gcauccugagauaugugcag

SEQ ID NO: 3921600 - RNA, 17 nt, Human adenovirus D
gcaucgaggugcagacc

SEQ ID NO: 3921601 - RNA, 17 nt, Human adenovirus D
gcaucggaacccuccag

SEQ ID NO: 3921602 - RNA, 15 nt, Human adenovirus D
gcaucuuccuggggc

SEQ ID NO: 3921603 - RNA, 21 nt, Human adenovirus D
gcaugaaggaagcccagagcu

SEQ ID NO: 3921604 - RNA, 20 nt, Human adenovirus D
gcaugaaggggacgagcugc

SEQ ID NO: 3921605 - RNA, 14 nt, Human adenovirus D
gcaugaccagaccc

SEQ ID NO: 3921606 - RNA, 12 nt, Human adenovirus D
gcauggcaggca

SEQ ID NO: 3921607 - RNA, 13 nt, Human adenovirus D
gcauggcaggcag

SEQ ID NO: 3921608 - RNA, 20 nt, Human adenovirus D
gcaugguuucggugacggcg

SEQ ID NO: 3921609 - RNA, 20 nt, Human adenovirus D
gcauguacaacaugcugacu

SEQ ID NO: 3921610 - RNA, 21 nt, Human adenovirus D
gcauguacaacaugcugacug

SEQ ID NO: 3921611 - RNA, 14 nt, Human adenovirus D
gccaacauuacuuc

SEQ ID NO: 3921612 - RNA, 18 nt, Human adenovirus D
gccaaccuggugacggcc

SEQ ID NO: 3921613 - RNA, 16 nt, Human adenovirus D
gccaagauagcccugc

SEQ ID NO: 3921614 - RNA, 16 nt, Human adenovirus D
gccacaggugcugccc

SEQ ID NO: 3921615 - RNA, 14 nt, Human adenovirus D
gccacaugacccug

SEQ ID NO: 3921616 - RNA, 20 nt, Human adenovirus D
gccacccgccgccgucugcc

SEQ ID NO: 3921617 - RNA, 21 nt, Human adenovirus D
gccaccucgccgcgcaggggc

SEQ ID NO: 3921618 - RNA, 11 nt, Human adenovirus D
gccacucccag

SEQ ID NO: 3921619 - RNA, 16 nt, Human adenovirus D
gccagcacgcucuugu

SEQ ID NO: 3921620 - RNA, 24 nt, Human adenovirus D
gccagcccaacggcaccugcgagc

SEQ ID NO: 3921621 - RNA, 14 nt, Human adenovirus D
gccagccgcaggcg

SEQ ID NO: 3921622 - RNA, 15 nt, Human adenovirus D
gccagcgcgugcugc

SEQ ID NO: 3921623 - RNA, 18 nt, Human adenovirus D
gccagcgcuggguggccg

SEQ ID NO: 3921624 - RNA, 19 nt, Human adenovirus D
gccaggaggcggugcgcac

SEQ ID NO: 3921625 - RNA, 21 nt, Human adenovirus D
gccaggccuccgagcagcgca

SEQ ID NO: 3921626 - RNA, 21 nt, Human adenovirus D
gccaggggaugaacaguggca

SEQ ID NO: 3921627 - RNA, 13 nt, Human adenovirus D
gccaggguugaau

SEQ ID NO: 3921628 - RNA, 15 nt, Human adenovirus D
gccagucccucaucc

SEQ ID NO: 3921629 - RNA, 15 nt, Human adenovirus D
gccauagcucagccc

SEQ ID NO: 3921630 - RNA, 20 nt, Human adenovirus D
gccaucaacauccaccagug

SEQ ID NO: 3921631 - RNA, 15 nt, Human adenovirus D
gccauccccauccag

SEQ ID NO: 3921632 - RNA, 21 nt, Human adenovirus D
gccaucggcacgaucccgggc

SEQ ID NO: 3921633 - RNA, 16 nt, Human adenovirus D
gccaucgugcagaacc

SEQ ID NO: 3921634 - RNA, 15 nt, Human adenovirus D
gccauggggcgccgc

SEQ ID NO: 3921635 - RNA, 17 nt, Human adenovirus D
gcccaaacuggggcgac

SEQ ID NO: 3921636 - RNA, 14 nt, Human adenovirus D
gcccaacaggccua

SEQ ID NO: 3921637 - RNA, 14 nt, Human adenovirus D
gcccacccucaggc

SEQ ID NO: 3921638 - RNA, 12 nt, Human adenovirus D
gcccacggccau

SEQ ID NO: 3921639 - RNA, 16 nt, Human adenovirus D
gcccacggugguggag

SEQ ID NO: 3921640 - RNA, 20 nt, Human adenovirus D
gcccagagcucgcgggccau

SEQ ID NO: 3921641 - RNA, 22 nt, Human adenovirus D
gcccagcaauaacaccggcugg

SEQ ID NO: 3921642 - RNA, 23 nt, Human adenovirus D
gcccagcagcauguacggaggag

SEQ ID NO: 3921643 - RNA, 16 nt, Human adenovirus D
gcccagcgagaggagc

SEQ ID NO: 3921644 - RNA, 19 nt, Human adenovirus D
gccccaggcggugcugcug

SEQ ID NO: 3921645 - RNA, 22 nt, Human adenovirus D
gccccaggcggugcugcugccg

SEQ ID NO: 3921646 - RNA, 22 nt, Human adenovirus D
gcccgacuucaugagccagagc

SEQ ID NO: 3921647 - RNA, 22 nt, Human adenovirus D
gcccgagggucgcuggcugcug

SEQ ID NO: 3921648 - RNA, 18 nt, Human adenovirus D
gcccgaguuguccuggua

SEQ ID NO: 3921649 - RNA, 15 nt, Human adenovirus D
gcccgccgccaggcc

SEQ ID NO: 3921650 - RNA, 17 nt, Human adenovirus D
gcccgccgccaggccca

SEQ ID NO: 3921651 - RNA, 13 nt, Human adenovirus D
gcccgcgccgcgg

SEQ ID NO: 3921652 - RNA, 16 nt, Human adenovirus D
gcccgggacggaggcu

SEQ ID NO: 3921653 - RNA, 16 nt, Human adenovirus D
gcccggggccaggucc

SEQ ID NO: 3921654 - RNA, 19 nt, Human adenovirus D
gcccgggucuggugcaguu

SEQ ID NO: 3921655 - RNA, 13 nt, Human adenovirus D
gcccgugggcgac

SEQ ID NO: 3921656 - RNA, 23 nt, Human adenovirus D
gcccguggucagcgaugagcagc

SEQ ID NO: 3921657 - RNA, 17 nt, Human adenovirus D
gcccugagccgccagcu

SEQ ID NO: 3921658 - RNA, 23 nt, Human adenovirus D
gcccugagcucgcgccucaaugu

SEQ ID NO: 3921659 - RNA, 14 nt, Human adenovirus D
gcccugcgcccaga

SEQ ID NO: 3921660 - RNA, 17 nt, Human adenovirus D
gcccugcuauggcucau

SEQ ID NO: 3921661 - RNA, 23 nt, Human adenovirus D
gcccugcuggccgagcuggaagc

SEQ ID NO: 3921662 - RNA, 16 nt, Human adenovirus D
gcccugguccaccucu

SEQ ID NO: 3921663 - RNA, 14 nt, Human adenovirus D
gccgaacgagcaga

SEQ ID NO: 3921664 - RNA, 12 nt, Human adenovirus D
gccgaccggagc

SEQ ID NO: 3921665 - RNA, 16 nt, Human adenovirus D
gccgagaccgugagcu

SEQ ID NO: 3921666 - RNA, 19 nt, Human adenovirus D
gccgauugggaagaacugg

SEQ ID NO: 3921667 - RNA, 20 nt, Human adenovirus D
gccgccaaggagcuccucga

SEQ ID NO: 3921668 - RNA, 22 nt, Human adenovirus D
gccgccacugcaccccccgcag

SEQ ID NO: 3921669 - RNA, 17 nt, Human adenovirus D
gccgcccugacccagca

SEQ ID NO: 3921670 - RNA, 15 nt, Human adenovirus D
gccgccgcaccgcca

SEQ ID NO: 3921671 - RNA, 13 nt, Human adenovirus D
gccgccgccgcgg

SEQ ID NO: 3921672 - RNA, 18 nt, Human adenovirus D
gccgccggcggcgggcca

SEQ ID NO: 3921673 - RNA, 21 nt, Human adenovirus D
gccgccggcggcgggccaugc

SEQ ID NO: 3921674 - RNA, 13 nt, Human adenovirus D
gccgccugcgcug

SEQ ID NO: 3921675 - RNA, 15 nt, Human adenovirus D
gccgcgagaccggag

SEQ ID NO: 3921676 - RNA, 14 nt, Human adenovirus D
gccgcgcaggggcu

SEQ ID NO: 3921677 - RNA, 16 nt, Human adenovirus D
gccgcgccaaccgcac

SEQ ID NO: 3921678 - RNA, 15 nt, Human adenovirus D
gccgcgcgcuggggc

SEQ ID NO: 3921679 - RNA, 22 nt, Human adenovirus D
gccgcggccagaugcggaggag

SEQ ID NO: 3921680 - RNA, 16 nt, Human adenovirus D
gccgcggcgagcggga

SEQ ID NO: 3921681 - RNA, 17 nt, Human adenovirus D
gccgcggcgagcgggac

SEQ ID NO: 3921682 - RNA, 20 nt, Human adenovirus D
gccgcucgcucguucugccc

SEQ ID NO: 3921683 - RNA, 14 nt, Human adenovirus D
gccgcuggacgaga

SEQ ID NO: 3921684 - RNA, 22 nt, Human adenovirus D
gccggccaauguuacgcugccc

SEQ ID NO: 3921685 - RNA, 21 nt, Human adenovirus D
gccggccgcgcuugcugggcg

SEQ ID NO: 3921686 - RNA, 16 nt, Human adenovirus D
gccggcgaaccgagca

SEQ ID NO: 3921687 - RNA, 21 nt, Human adenovirus D
gccggcgaacgugccgcgcgg

SEQ ID NO: 3921688 - RNA, 20 nt, Human adenovirus D
gccgggccaugaugcgagcc

SEQ ID NO: 3921689 - RNA, 22 nt, Human adenovirus D
gccgggguucuauacgggcgag

SEQ ID NO: 3921690 - RNA, 22 nt, Human adenovirus D
gccgguuucgggcgggcaggga

SEQ ID NO: 3921691 - RNA, 20 nt, Human adenovirus D
gccguacgugcccauagaca

SEQ ID NO: 3921692 - RNA, 16 nt, Human adenovirus D
gccguagcaggcgccg

SEQ ID NO: 3921693 - RNA, 15 nt, Human adenovirus D
gccgucacccugccc

SEQ ID NO: 3921694 - RNA, 14 nt, Human adenovirus D
gccguccgcccgcg

SEQ ID NO: 3921695 - RNA, 18 nt, Human adenovirus D
gccguccuuucgcugcug

SEQ ID NO: 3921696 - RNA, 19 nt, Human adenovirus D
gccguggccucuucgcccg

SEQ ID NO: 3921697 - RNA, 16 nt, Human adenovirus D
gccuacgagcagacgg

SEQ ID NO: 3921698 - RNA, 17 nt, Human adenovirus D
gccucaaugucagcugc

SEQ ID NO: 3921699 - RNA, 17 nt, Human adenovirus D
gccuccacccuggaagc

SEQ ID NO: 3921700 - RNA, 18 nt, Human adenovirus D
gccucggaguaccugagc

SEQ ID NO: 3921701 - RNA, 15 nt, Human adenovirus D
gccucguccucuucc

SEQ ID NO: 3921702 - RNA, 14 nt, Human adenovirus D
gccugaggcagacg

SEQ ID NO: 3921703 - RNA, 16 nt, Human adenovirus D
gccugaguggcggcuu

SEQ ID NO: 3921704 - RNA, 18 nt, Human adenovirus D
gccugaugcaccuguggg

SEQ ID NO: 3921705 - RNA, 13 nt, Human adenovirus D
gccugaugcagga

SEQ ID NO: 3921706 - RNA, 14 nt, Human adenovirus D
gccugaugcaggau

SEQ ID NO: 3921707 - RNA, 16 nt, Human adenovirus D
gccugcaaacggugaa

SEQ ID NO: 3921708 - RNA, 16 nt, Human adenovirus D
gccugccaggaugggc

SEQ ID NO: 3921709 - RNA, 17 nt, Human adenovirus D
gccugcgcccgcgccgc

SEQ ID NO: 3921710 - RNA, 21 nt, Human adenovirus D
gccugcgucaucacccagggc

SEQ ID NO: 3921711 - RNA, 18 nt, Human adenovirus D
gccugggcucgcuggugg

SEQ ID NO: 3921712 - RNA, 14 nt, Human adenovirus D
gccuggggcagaca

SEQ ID NO: 3921713 - RNA, 15 nt, Human adenovirus D
gccuggggcagacag

SEQ ID NO: 3921714 - RNA, 14 nt, Human adenovirus D
gccuucgaaggggg

SEQ ID NO: 3921715 - RNA, 21 nt, Human adenovirus D
gccuuguagggacagcagccc

SEQ ID NO: 3921716 - RNA, 19 nt, Human adenovirus D
gccuuuagguguugcauga

SEQ ID NO: 3921717 - RNA, 20 nt, Human adenovirus D
gcgaagccguggcgcagcgc

SEQ ID NO: 3921718 - RNA, 16 nt, Human adenovirus D
gcgacacacuuccauu

SEQ ID NO: 3921719 - RNA, 19 nt, Human adenovirus D
gcgacccaugagcugcgag

SEQ ID NO: 3921720 - RNA, 14 nt, Human adenovirus D
gcgacgcggcggcg

SEQ ID NO: 3921721 - RNA, 21 nt, Human adenovirus D
gcgagaacauguacccgacca

SEQ ID NO: 3921722 - RNA, 14 nt, Human adenovirus D
gcgagaagcggccg

SEQ ID NO: 3921723 - RNA, 13 nt, Human adenovirus D
gcgagacccaggu

SEQ ID NO: 3921724 - RNA, 15 nt, Human adenovirus D
gcgagccgcgcgccg

SEQ ID NO: 3921725 - RNA, 15 nt, Human adenovirus D
gcgaggacaccagua

SEQ ID NO: 3921726 - RNA, 15 nt, Human adenovirus D
gcgagggcgagaaca

SEQ ID NO: 3921727 - RNA, 13 nt, Human adenovirus D
gcgaggggccaag

SEQ ID NO: 3921728 - RNA, 17 nt, Human adenovirus D
gcgaggggcuccucucg

SEQ ID NO: 3921729 - RNA, 13 nt, Human adenovirus D
gcgagguugagcu

SEQ ID NO: 3921730 - RNA, 16 nt, Human adenovirus D
gcgauaugccagacgc

SEQ ID NO: 3921731 - RNA, 15 nt, Human adenovirus D
gcgcacaacaccgcc

SEQ ID NO: 3921732 - RNA, 18 nt, Human adenovirus D
gcgcacguggcggcggcc

SEQ ID NO: 3921733 - RNA, 14 nt, Human adenovirus D
gcgcagcggcagga

SEQ ID NO: 3921734 - RNA, 13 nt, Human adenovirus D
gcgcaggcgaccc

SEQ ID NO: 3921735 - RNA, 14 nt, Human adenovirus D
gcgcaggcgcugga

SEQ ID NO: 3921736 - RNA, 21 nt, Human adenovirus D
gcgcagguggacgagcagacc

SEQ ID NO: 3921737 - RNA, 15 nt, Human adenovirus D
gcgcaguugggagcu

SEQ ID NO: 3921738 - RNA, 19 nt, Human adenovirus D
gcgccaaaugcgucccacc

SEQ ID NO: 3921739 - RNA, 18 nt, Human adenovirus D
gcgccagacgcacgggcc

SEQ ID NO: 3921740 - RNA, 14 nt, Human adenovirus D
gcgccagccgcggu

SEQ ID NO: 3921741 - RNA, 12 nt, Human adenovirus D
gcgcccucagca

SEQ ID NO: 3921742 - RNA, 15 nt, Human adenovirus D
gcgcccugagagcgc

SEQ ID NO: 3921743 - RNA, 12 nt, Human adenovirus D
gcgccgcccgag

SEQ ID NO: 3921744 - RNA, 14 nt, Human adenovirus D
gcgccgcgccagac

SEQ ID NO: 3921745 - RNA, 18 nt, Human adenovirus D
gcgccgcggcgacagcgc

SEQ ID NO: 3921746 - RNA, 19 nt, Human adenovirus D
gcgccuucaauuggagcag

SEQ ID NO: 3921747 - RNA, 17 nt, Human adenovirus D
gcgcgaagauggccacc

SEQ ID NO: 3921748 - RNA, 19 nt, Human adenovirus D
gcgcgaagccguggcgcag

SEQ ID NO: 3921749 - RNA, 14 nt, Human adenovirus D
gcgcgaccugggcu

SEQ ID NO: 3921750 - RNA, 15 nt, Human adenovirus D
gcgcgagcugagcga

SEQ ID NO: 3921751 - RNA, 16 nt, Human adenovirus D
gcgcgaguucgcuccg

SEQ ID NO: 3921752 - RNA, 15 nt, Human adenovirus D
gcgcgcaugaccacc

SEQ ID NO: 3921753 - RNA, 16 nt, Human adenovirus D
gcgcgcccggggccag

SEQ ID NO: 3921754 - RNA, 18 nt, Human adenovirus D
gcgcgggagccaggucca

SEQ ID NO: 3921755 - RNA, 14 nt, Human adenovirus D
gcgcgggcaggaug

SEQ ID NO: 3921756 - RNA, 13 nt, Human adenovirus D
gcgcggggccacg

SEQ ID NO: 3921757 - RNA, 18 nt, Human adenovirus D
gcgcgucauggcugguca

SEQ ID NO: 3921758 - RNA, 19 nt, Human adenovirus D
gcgcgugcccgugcgcacc

SEQ ID NO: 3921759 - RNA, 13 nt, Human adenovirus D
gcgcuaccacccc

SEQ ID NO: 3921760 - RNA, 13 nt, Human adenovirus D
gcgcuccgugggg

SEQ ID NO: 3921761 - RNA, 22 nt, Human adenovirus D
gcgcucgaaauccccgggggcc

SEQ ID NO: 3921762 - RNA, 19 nt, Human adenovirus D
gcgcucgcgcaccugcuac

SEQ ID NO: 3921763 - RNA, 16 nt, Human adenovirus D
gcgcuggggagggcca

SEQ ID NO: 3921764 - RNA, 21 nt, Human adenovirus D
gcggaccugcauuggcagccg

SEQ ID NO: 3921765 - RNA, 15 nt, Human adenovirus D
gcggacgcgcucccg

SEQ ID NO: 3921766 - RNA, 23 nt, Human adenovirus D
gcggacggaucgcccaggcgcca

SEQ ID NO: 3921767 - RNA, 22 nt, Human adenovirus D
gcggaggccaucgugcagaacc

SEQ ID NO: 3921768 - RNA, 21 nt, Human adenovirus D
gcggaguccagcgagugaccg

SEQ ID NO: 3921769 - RNA, 23 nt, Human adenovirus D
gcggagucuuccaugcgggugac

SEQ ID NO: 3921770 - RNA, 22 nt, Human adenovirus D
gcggcaaaauggcgugcuggag

SEQ ID NO: 3921771 - RNA, 14 nt, Human adenovirus D
gcggccagcgcugg

SEQ ID NO: 3921772 - RNA, 14 nt, Human adenovirus D
gcggccgcggccag

SEQ ID NO: 3921773 - RNA, 23 nt, Human adenovirus D
gcggccguucaugggcaccugga

SEQ ID NO: 3921774 - RNA, 19 nt, Human adenovirus D
gcggcgaacuuucuccaca

SEQ ID NO: 3921775 - RNA, 15 nt, Human adenovirus D
gcggcgcggagcaag

SEQ ID NO: 3921776 - RNA, 20 nt, Human adenovirus D
gcggcggaugguggcgagga

SEQ ID NO: 3921777 - RNA, 14 nt, Human adenovirus D
gcggcggccaucgg

SEQ ID NO: 3921778 - RNA, 13 nt, Human adenovirus D
gcggcgggggcgg

SEQ ID NO: 3921779 - RNA, 16 nt, Human adenovirus D
gcggcgggggcggaga

SEQ ID NO: 3921780 - RNA, 21 nt, Human adenovirus D
gcggcgguuccggccccgcgg

SEQ ID NO: 3921781 - RNA, 22 nt, Human adenovirus D
gcgggacauccaggugaugccg

SEQ ID NO: 3921782 - RNA, 18 nt, Human adenovirus D
gcgggaucaucgccugcu

SEQ ID NO: 3921783 - RNA, 21 nt, Human adenovirus D
gcgggcaggggcggcagaggc

SEQ ID NO: 3921784 - RNA, 18 nt, Human adenovirus D
gcgggcgccucccaggac

SEQ ID NO: 3921785 - RNA, 20 nt, Human adenovirus D
gcggggccacgaccgugccg

SEQ ID NO: 3921786 - RNA, 15 nt, Human adenovirus D
gcggggccuggugug

SEQ ID NO: 3921787 - RNA, 15 nt, Human adenovirus D
gcguaagcaggagca

SEQ ID NO: 3921788 - RNA, 19 nt, Human adenovirus D
gcgucagggcgaagguguc

SEQ ID NO: 3921789 - RNA, 20 nt, Human adenovirus D
gcguccgcuccgcagugggc

SEQ ID NO: 3921790 - RNA, 15 nt, Human adenovirus D
gcguccgucagcagc

SEQ ID NO: 3921791 - RNA, 16 nt, Human adenovirus D
gcgucgacggcgccuc

SEQ ID NO: 3921792 - RNA, 20 nt, Human adenovirus D
gcgucuagccaaucgcaguc

SEQ ID NO: 3921793 - RNA, 14 nt, Human adenovirus D
gcgucuccaugagu

SEQ ID NO: 3921794 - RNA, 15 nt, Human adenovirus D
gcgugcgaguuggag

SEQ ID NO: 3921795 - RNA, 19 nt, Human adenovirus D
gcgugcgaguuggaggaga

SEQ ID NO: 3921796 - RNA, 22 nt, Human adenovirus D
gcguggcccuuggcgcggagcu

SEQ ID NO: 3921797 - RNA, 14 nt, Human adenovirus D
gcguguugcggccc

SEQ ID NO: 3921798 - RNA, 15 nt, Human adenovirus D
gcuaaucaugcccca

SEQ ID NO: 3921799 - RNA, 19 nt, Human adenovirus D
gcuaaugguccugcaagag

SEQ ID NO: 3921800 - RNA, 18 nt, Human adenovirus D
gcuaccaccccagcaucc

SEQ ID NO: 3921801 - RNA, 14 nt, Human adenovirus D
gcuaccgcggcacc

SEQ ID NO: 3921802 - RNA, 17 nt, Human adenovirus D
gcuaccucuugcagcug

SEQ ID NO: 3921803 - RNA, 16 nt, Human adenovirus D
gcuaccugggaggaga

SEQ ID NO: 3921804 - RNA, 19 nt, Human adenovirus D
gcuagaaaacacccacagg

SEQ ID NO: 3921805 - RNA, 16 nt, Human adenovirus D
gcuagcacgcagacga

SEQ ID NO: 3921806 - RNA, 20 nt, Human adenovirus D
gcuaguguacaacgcccugc

SEQ ID NO: 3921807 - RNA, 16 nt, Human adenovirus D
gcuauaaaucuuuucu

SEQ ID NO: 3921808 - RNA, 16 nt, Human adenovirus D
gcucaggaccauaggg

SEQ ID NO: 3921809 - RNA, 17 nt, Human adenovirus D
gcucaggaccauaggga

SEQ ID NO: 3921810 - RNA, 17 nt, Human adenovirus D
gcuccaccaccugcagc

SEQ ID NO: 3921811 - RNA, 16 nt, Human adenovirus D
gcuccaccgaaggcag

SEQ ID NO: 3921812 - RNA, 15 nt, Human adenovirus D
gcuccagccaaagcu

SEQ ID NO: 3921813 - RNA, 20 nt, Human adenovirus D
gcuccagccaaagcucaugu

SEQ ID NO: 3921814 - RNA, 21 nt, Human adenovirus D
gcuccagccaaagcucauguu

SEQ ID NO: 3921815 - RNA, 16 nt, Human adenovirus D
gcucccaaucccaguc

SEQ ID NO: 3921816 - RNA, 14 nt, Human adenovirus D
gcucccaccgcgcc

SEQ ID NO: 3921817 - RNA, 14 nt, Human adenovirus D
gcucccgggcuccu

SEQ ID NO: 3921818 - RNA, 20 nt, Human adenovirus D
gcuccggcggauagcgcgcc

SEQ ID NO: 3921819 - RNA, 21 nt, Human adenovirus D
gcuccgguugugcagcccccu

SEQ ID NO: 3921820 - RNA, 22 nt, Human adenovirus D
gcuccgguugugcagcccccuc

SEQ ID NO: 3921821 - RNA, 18 nt, Human adenovirus D
gcuccucgaggacggaga

SEQ ID NO: 3921822 - RNA, 14 nt, Human adenovirus D
cucagcagucucug

SEQ ID NO: 3921823 - RNA, 18 nt, Human adenovirus D
cucagcagucucugccgc

SEQ ID NO: 3921824 - RNA, 23 nt, Human adenovirus D
cucagccucgaacaguccaccca

SEQ ID NO: 3921825 - RNA, 21 nt, Human adenovirus D
cucaggcgcaaccaggaggag

SEQ ID NO: 3921826 - RNA, 23 nt, Human adenovirus D
cucaggcgcaaccaggaggagcu

SEQ ID NO: 3921827 - RNA, 15 nt, Human adenovirus D
cucaucggccagaca

SEQ ID NO: 3921828 - RNA, 16 nt, Human adenovirus D
cucaucucgcccagca

SEQ ID NO: 3921829 - RNA, 21 nt, Human adenovirus D
cucaucugcagggcgcccagc

SEQ ID NO: 3921830 - RNA, 15 nt, Human adenovirus D
cucaugaacacacug

SEQ ID NO: 3921831 - RNA, 18 nt, Human adenovirus D
cucaugcccuuccgcgcc

SEQ ID NO: 3921832 - RNA, 15 nt, Human adenovirus D
cucauuuuuccagcc

SEQ ID NO: 3921833 - RNA, 14 nt, Human adenovirus D
cuccaaagcuagca

SEQ ID NO: 3921834 - RNA, 15 nt, Human adenovirus D
cuccaaagcuagcac

SEQ ID NO: 3921835 - RNA, 18 nt, Human adenovirus D
cuccaacguggagcugac

SEQ ID NO: 3921836 - RNA, 12 nt, Human adenovirus D
cuccacgugccg

SEQ ID NO: 3921837 - RNA, 19 nt, Human adenovirus D
cuccagcaacuucaugucc

SEQ ID NO: 3921838 - RNA, 18 nt, Human adenovirus D
cuccaugcuucugggcaa

SEQ ID NO: 3921839 - RNA, 13 nt, Human adenovirus D
cucccacagugcc

SEQ ID NO: 3921840 - RNA, 22 nt, Human adenovirus D
cucccagcucauccgcagcuac

SEQ ID NO: 3921841 - RNA, 23 nt, Human adenovirus D
cuccccuuacuuucgcucccacc

SEQ ID NO: 3921842 - RNA, 15 nt, Human adenovirus D
cucccgccccuucga

SEQ ID NO: 3921843 - RNA, 16 nt, Human adenovirus D
cucccggcggcagcgg

SEQ ID NO: 3921844 - RNA, 13 nt, Human adenovirus D
cuccgcaccgcuc

SEQ ID NO: 3921845 - RNA, 13 nt, Human adenovirus D
cuccgcagugggc

SEQ ID NO: 3921846 - RNA, 14 nt, Human adenovirus D
cuccgcgaacagca

SEQ ID NO: 3921847 - RNA, 17 nt, Human adenovirus D
cuccgcgaacagcagca

SEQ ID NO: 3921848 - RNA, 16 nt, Human adenovirus D
cuccgcgaccuccucc

SEQ ID NO: 3921849 - RNA, 18 nt, Human adenovirus D
cuccggaccuaugggaac

SEQ ID NO: 3921850 - RNA, 17 nt, Human adenovirus D
cuccggguucuggagac

SEQ ID NO: 3921851 - RNA, 18 nt, Human adenovirus D
cuccggguucuggagaca

SEQ ID NO: 3921852 - RNA, 17 nt, Human adenovirus D
cuccgguggcgaccgcc

SEQ ID NO: 3921853 - RNA, 17 nt, Human adenovirus D
cuccgguugugcagccc

SEQ ID NO: 3921854 - RNA, 14 nt, Human adenovirus D
cuccguagccuggc

SEQ ID NO: 3921855 - RNA, 14 nt, Human adenovirus D
cuccguggggcgcu

SEQ ID NO: 3921856 - RNA, 14 nt, Human adenovirus D
cuccguuguacgac

SEQ ID NO: 3921857 - RNA, 20 nt, Human adenovirus D
cuccuccuguuacuguaaag

SEQ ID NO: 3921858 - RNA, 20 nt, Human adenovirus D
cuccucgaggacggagaggc

SEQ ID NO: 3921859 - RNA, 20 nt, Human adenovirus D
cuccucuuugcccugcucac

SEQ ID NO: 3921860 - RNA, 14 nt, Human adenovirus D
cuccugccugggaa

SEQ ID NO: 3921861 - RNA, 18 nt, Human adenovirus D
cuccugcucccgggcucc

SEQ ID NO: 3921862 - RNA, 21 nt, Human adenovirus D
cuccuggugcgucgagcacag

SEQ ID NO: 3921863 - RNA, 23 nt, Human adenovirus D
cucgaaggacgauaaagugcaag

SEQ ID NO: 3921864 - RNA, 20 nt, Human adenovirus D
cucgaaucaggcuggagccg

SEQ ID NO: 3921865 - RNA, 17 nt, Human adenovirus D
cucgacgagccagguga

SEQ ID NO: 3921866 - RNA, 19 nt, Human adenovirus D
cucgagcucgaaugcaugc

SEQ ID NO: 3921867 - RNA, 19 nt, Human adenovirus D
cucgcaguccgccaagcuc

SEQ ID NO: 3921868 - RNA, 23 nt, Human adenovirus D
cucgcaguccgccaagcuccucg

SEQ ID NO: 3921869 - RNA, 16 nt, Human adenovirus D
cucgcuccggaggcau

SEQ ID NO: 3921870 - RNA, 14 nt, Human adenovirus D
cucgcucuggggcc

SEQ ID NO: 3921871 - RNA, 22 nt, Human adenovirus D
cucgcugguggacgccuacauc

SEQ ID NO: 3921872 - RNA, 20 nt, Human adenovirus D
cucgcugguggcgcugaacg

SEQ ID NO: 3921873 - RNA, 17 nt, Human adenovirus D
cucggaccuggccgaga

SEQ ID NO: 3921874 - RNA, 12 nt, Human adenovirus D
cucggagcuggc

SEQ ID NO: 3921875 - RNA, 12 nt, Human adenovirus D
cucggcaacgac

SEQ ID NO: 3921876 - RNA, 16 nt, Human adenovirus D
cucggcggcguggccc

SEQ ID NO: 3921877 - RNA, 16 nt, Human adenovirus D
cucgguacccuccucc

SEQ ID NO: 3921878 - RNA, 15 nt, Human adenovirus D
cucggugcggcugcu

SEQ ID NO: 3921879 - RNA, 16 nt, Human adenovirus D
cucggugcuuagccug

SEQ ID NO: 3921880 - RNA, 19 nt, Human adenovirus D
cucguagaggcgggugagg

SEQ ID NO: 3921881 - RNA, 16 nt, Human adenovirus D
cucgucuuccaggagc

SEQ ID NO: 3921882 - RNA, 20 nt, Human adenovirus D
cucuacgcguacauccagca

SEQ ID NO: 3921883 - RNA, 21 nt, Human adenovirus D
cucuacgcguacauccagcau

SEQ ID NO: 3921884 - RNA, 12 nt, Human adenovirus D
cucucagcacgg

SEQ ID NO: 3921885 - RNA, 17 nt, Human adenovirus D
cucucagcacgguggcc

SEQ ID NO: 3921886 - RNA, 14 nt, Human adenovirus D
cucuccgcaccgcu

SEQ ID NO: 3921887 - RNA, 15 nt, Human adenovirus D
cucuccugaaccaca

SEQ ID NO: 3921888 - RNA, 20 nt, Human adenovirus D
cucuccuuucuucucccaca

SEQ ID NO: 3921889 - RNA, 18 nt, Human adenovirus D
cucucgaagacgccgagg

SEQ ID NO: 3921890 - RNA, 16 nt, Human adenovirus D
cucucuuugugucucc

SEQ ID NO: 3921891 - RNA, 17 nt, Human adenovirus D
cucucuuugugucuccg

SEQ ID NO: 3921892 - RNA, 15 nt, Human adenovirus D
cucugacacaccugg

SEQ ID NO: 3921893 - RNA, 21 nt, Human adenovirus D
cucugauucaugugaacaaaa

SEQ ID NO: 3921894 - RNA, 19 nt, Human adenovirus D
cucugcgcucgcucacccg

SEQ ID NO: 3921895 - RNA, 12 nt, Human adenovirus D
cucugugcccag

SEQ ID NO: 3921896 - RNA, 13 nt, Human adenovirus D
cucugugcccagu

SEQ ID NO: 3921897 - RNA, 14 nt, Human adenovirus D
cucuucgcccgacc

SEQ ID NO: 3921898 - RNA, 15 nt, Human adenovirus D
cucuuuccagcagca

SEQ ID NO: 3921899 - RNA, 17 nt, Human adenovirus D
cucuuuccagcagcagg

SEQ ID NO: 3921900 - RNA, 15 nt, Human adenovirus D
cugaaacaccugcag

SEQ ID NO: 3921901 - RNA, 17 nt, Human adenovirus D
cugaaaggcgggcugcc

SEQ ID NO: 3921902 - RNA, 18 nt, Human adenovirus D
cugaaaguaugucucugg

SEQ ID NO: 3921903 - RNA, 16 nt, Human adenovirus D
cugaacgccuuccugg

SEQ ID NO: 3921904 - RNA, 14 nt, Human adenovirus D
cugaagcgccgccg

SEQ ID NO: 3921905 - RNA, 16 nt, Human adenovirus D
cugacacaccuggucc

SEQ ID NO: 3921906 - RNA, 20 nt, Human adenovirus D
cugaccaauagacagcagaa

SEQ ID NO: 3921907 - RNA, 21 nt, Human adenovirus D
cugaccaauagacagcagaag

SEQ ID NO: 3921908 - RNA, 15 nt, Human adenovirus D
cugaccuugcagagc

SEQ ID NO: 3921909 - RNA, 13 nt, Human adenovirus D
cugacgacccgca

SEQ ID NO: 3921910 - RNA, 17 nt, Human adenovirus D
cugagccugcgccgggc

SEQ ID NO: 3921911 - RNA, 21 nt, Human adenovirus D
cugagcggcugcacgagcgcc

SEQ ID NO: 3921912 - RNA, 23 nt, Human adenovirus D
cugagcucuuaccaaguccaggg

SEQ ID NO: 3921913 - RNA, 22 nt, Human adenovirus D
cugauauugcuucccuggaaga

SEQ ID NO: 3921914 - RNA, 19 nt, Human adenovirus D
cugaucugauccuugucca

SEQ ID NO: 3921915 - RNA, 16 nt, Human adenovirus D
cugcaacgccuucccc

SEQ ID NO: 3921916 - RNA, 20 nt, Human adenovirus D
cugcaccccccgcaggcagg

SEQ ID NO: 3921917 - RNA, 16 nt, Human adenovirus D
cugcacgaccucggag

SEQ ID NO: 3921918 - RNA, 21 nt, Human adenovirus D
cugcagcccaaacuggggcga

SEQ ID NO: 3921919 - RNA, 18 nt, Human adenovirus D
cugcagcucaucgacugg

SEQ ID NO: 3921920 - RNA, 19 nt, Human adenovirus D
cugcaggcgucgcagcgcc

SEQ ID NO: 3921921 - RNA, 17 nt, Human adenovirus D
cugcagggagccagggg

SEQ ID NO: 3921922 - RNA, 19 nt, Human adenovirus D
cugcagggcgcccagcaug

SEQ ID NO: 3921923 - RNA, 20 nt, Human adenovirus D
cugcagggcgcccagcaugu

SEQ ID NO: 3921924 - RNA, 19 nt, Human adenovirus D
cugcaggggcgucccgcgg

SEQ ID NO: 3921925 - RNA, 19 nt, Human adenovirus D
cugcaugcuggaauaagcu

SEQ ID NO: 3921926 - RNA, 20 nt, Human adenovirus D
cugccaacauuacuucuggc

SEQ ID NO: 3921927 - RNA, 19 nt, Human adenovirus D
cugccaugggaggaagcaa

SEQ ID NO: 3921928 - RNA, 16 nt, Human adenovirus D
cugccgagccgcggga

SEQ ID NO: 3921929 - RNA, 15 nt, Human adenovirus D
cugccgcgccaaccg

SEQ ID NO: 3921930 - RNA, 24 nt, Human adenovirus D
cugccgcugcaaccugugcucucc

SEQ ID NO: 3921931 - RNA, 13 nt, Human adenovirus D
cugcgagaggagu

SEQ ID NO: 3921932 - RNA, 23 nt, Human adenovirus D
cugcgcaaauuuguacccgagga

SEQ ID NO: 3921933 - RNA, 21 nt, Human adenovirus D
cugcgccauugucaacacggc

SEQ ID NO: 3921934 - RNA, 15 nt, Human adenovirus D
cugcgcccgcgccgc

SEQ ID NO: 3921935 - RNA, 14 nt, Human adenovirus D
cugcgcgagggccu

SEQ ID NO: 3921936 - RNA, 19 nt, Human adenovirus D
cugcgcgagggccuggacc

SEQ ID NO: 3921937 - RNA, 18 nt, Human adenovirus D
cugcgcguccgucagcag

SEQ ID NO: 3921938 - RNA, 16 nt, Human adenovirus D
cugcggcgcggagcaa

SEQ ID NO: 3921939 - RNA, 16 nt, Human adenovirus D
cugcucgggcaugagc

SEQ ID NO: 3921940 - RNA, 17 nt, Human adenovirus D
cugcucuucccuggaga

SEQ ID NO: 3921941 - RNA, 17 nt, Human adenovirus D
cggcccuggcugguggu

SEQ ID NO: 3921942 - RNA, 13 nt, Human adenovirus D
cggccgccaacau

SEQ ID NO: 3921943 - RNA, 13 nt, Human adenovirus D
cggccgcccacgg

SEQ ID NO: 3921944 - RNA, 20 nt, Human adenovirus D
cggccguccuuucgcugcug

SEQ ID NO: 3921945 - RNA, 21 nt, Human adenovirus D
cggccuuugaugugcggcagc

SEQ ID NO: 3921946 - RNA, 12 nt, Human adenovirus D
cggcgaccaccg

SEQ ID NO: 3921947 - RNA, 20 nt, Human adenovirus D
cggcgacgacgacauccugg

SEQ ID NO: 3921948 - RNA, 23 nt, Human adenovirus D
cggcgaggggcuccucucgugcu

SEQ ID NO: 3921949 - RNA, 15 nt, Human adenovirus D
cggcgaggggcugcu

SEQ ID NO: 3921950 - RNA, 22 nt, Human adenovirus D
cggcgcagcuguuccugguggu

SEQ ID NO: 3921951 - RNA, 16 nt, Human adenovirus D
cggcgcguggaggaag

SEQ ID NO: 3921952 - RNA, 19 nt, Human adenovirus D
cggcggacaucgcuucccu

SEQ ID NO: 3921953 - RNA, 19 nt, Human adenovirus D
cggcggcgaggggcuccuc

SEQ ID NO: 3921954 - RNA, 15 nt, Human adenovirus D
cggcggcgggccaug

SEQ ID NO: 3921955 - RNA, 15 nt, Human adenovirus D
cggcggcuggcggua

SEQ ID NO: 3921956 - RNA, 19 nt, Human adenovirus D
cggcgggccaugcgcaggc

SEQ ID NO: 3921957 - RNA, 23 nt, Human adenovirus D
cggcggugguguucacgcccggc

SEQ ID NO: 3921958 - RNA, 18 nt, Human adenovirus D
cggcguaguugcgcaggc

SEQ ID NO: 3921959 - RNA, 20 nt, Human adenovirus D
cggcgucauugacggcgggc

SEQ ID NO: 3921960 - RNA, 14 nt, Human adenovirus D
cggcugcugcaaau

SEQ ID NO: 3921961 - RNA, 14 nt, Human adenovirus D
cgggaaccccacca

SEQ ID NO: 3921962 - RNA, 20 nt, Human adenovirus D
cgggaccgaguucagcucca

SEQ ID NO: 3921963 - RNA, 18 nt, Human adenovirus D
cgggacuuggucaccccg

SEQ ID NO: 3921964 - RNA, 22 nt, Human adenovirus D
cgggagcgguggggucaacccg

SEQ ID NO: 3921965 - RNA, 21 nt, Human adenovirus D
cgggauagagagucuggugga

SEQ ID NO: 3921966 - RNA, 23 nt, Human adenovirus D
cgggccaugagggucuggagcuc

SEQ ID NO: 3921967 - RNA, 23 nt, Human adenovirus D
cgggccaugaugcgagccgcgcg

SEQ ID NO: 3921968 - RNA, 15 nt, Human adenovirus D
cgggccuacgagcuc

SEQ ID NO: 3921969 - RNA, 20 nt, Human adenovirus D
cgggccuacuuuuugggcac

SEQ ID NO: 3921970 - RNA, 19 nt, Human adenovirus D
cgggcggccauugcucgcu

SEQ ID NO: 3921971 - RNA, 22 nt, Human adenovirus D
cgggcgggcagggagcugcgcg

SEQ ID NO: 3921972 - RNA, 12 nt, Human adenovirus D
cgggcucuuccu

SEQ ID NO: 3921973 - RNA, 20 nt, Human adenovirus D
cgggcucuuccuccguagcc

SEQ ID NO: 3921974 - RNA, 17 nt, Human adenovirus D
cgggcuguggggcgugc

SEQ ID NO: 3921975 - RNA, 24 nt, Human adenovirus D
cgggcuucaccggcuaccuugcac

SEQ ID NO: 3921976 - RNA, 15 nt, Human adenovirus D
cggggaucagccccg

SEQ ID NO: 3921977 - RNA, 13 nt, Human adenovirus D
cggggcacaggca

SEQ ID NO: 3921978 - RNA, 23 nt, Human adenovirus D
cggggcucggugcggcugcugca

SEQ ID NO: 3921979 - RNA, 20 nt, Human adenovirus D
cggguguaaugaaacccgcc

SEQ ID NO: 3921980 - RNA, 13 nt, Human adenovirus D
cggguucuggaga

SEQ ID NO: 3921981 - RNA, 14 nt, Human adenovirus D
cgguaagcacgagc

SEQ ID NO: 3921982 - RNA, 19 nt, Human adenovirus D
cgguaccuucgagcugcaa

SEQ ID NO: 3921983 - RNA, 22 nt, Human adenovirus D
cggucaccgagccucccaggag

SEQ ID NO: 3921984 - RNA, 21 nt, Human adenovirus D
cggucgacggugagcagcuug

SEQ ID NO: 3921985 - RNA, 20 nt, Human adenovirus D
cggucgcgguggggcgguga

SEQ ID NO: 3921986 - RNA, 17 nt, Human adenovirus D
cggugaaccugagccag

SEQ ID NO: 3921987 - RNA, 22 nt, Human adenovirus D
cggugagcagcuugcugacgcc

SEQ ID NO: 3921988 - RNA, 15 nt, Human adenovirus D
cggugcccgcuccgc

SEQ ID NO: 3921989 - RNA, 16 nt, Human adenovirus D
cggugcggcugcugca

SEQ ID NO: 3921990 - RNA, 17 nt, Human adenovirus D
cggugcuuagccugggc

SEQ ID NO: 3921991 - RNA, 16 nt, Human adenovirus D
cgguggccccgaccca

SEQ ID NO: 3921992 - RNA, 19 nt, Human adenovirus D
cgguggccccgacccacga

SEQ ID NO: 3921993 - RNA, 17 nt, Human adenovirus D
cggugggucggagcccc

SEQ ID NO: 3921994 - RNA, 16 nt, Human adenovirus D
cggugguaggccccug

SEQ ID NO: 3921995 - RNA, 17 nt, Human adenovirus D
cggugguaggccccugu

SEQ ID NO: 3921996 - RNA, 16 nt, Human adenovirus D
cguacgugccugcgca

SEQ ID NO: 3921997 - RNA, 16 nt, Human adenovirus D
cguagaaauccacggc

SEQ ID NO: 3921998 - RNA, 19 nt, Human adenovirus D
cguaggagucuugcagcuu

SEQ ID NO: 3921999 - RNA, 18 nt, Human adenovirus D
cgucaccugcggcgcgga

SEQ ID NO: 3922000 - RNA, 12 nt, Human adenovirus D
cgucaggcaggc

SEQ ID NO: 3922001 - RNA, 16 nt, Human adenovirus D
cguccacgccaagaca

SEQ ID NO: 3922002 - RNA, 16 nt, Human adenovirus D
cguccagcgcggccag

SEQ ID NO: 3922003 - RNA, 21 nt, Human adenovirus D
cguccaucgugcgcgaccugg

SEQ ID NO: 3922004 - RNA, 13 nt, Human adenovirus D
cgucccagcagca

SEQ ID NO: 3922005 - RNA, 19 nt, Human adenovirus D
cgucccgacgaggccgggc

SEQ ID NO: 3922006 - RNA, 15 nt, Human adenovirus D
cguccgcaggcggga

SEQ ID NO: 3922007 - RNA, 16 nt, Human adenovirus D
cguccgucagcagcag

SEQ ID NO: 3922008 - RNA, 19 nt, Human adenovirus D
cguccuuucgcugcugccg

SEQ ID NO: 3922009 - RNA, 12 nt, Human adenovirus D
cgucgcaucaug

SEQ ID NO: 3922010 - RNA, 17 nt, Human adenovirus D
cgucggcgucgcgcgcg

SEQ ID NO: 3922011 - RNA, 20 nt, Human adenovirus D
cgucuacaaggcccugggca

SEQ ID NO: 3922012 - RNA, 15 nt, Human adenovirus D
cgucuuugccaugga

SEQ ID NO: 3922013 - RNA, 19 nt, Human adenovirus D
cgugagcgcgagccggcgg

SEQ ID NO: 3922014 - RNA, 12 nt, Human adenovirus D
cgugcacuggcu

SEQ ID NO: 3922015 - RNA, 17 nt, Human adenovirus D
cgugcgcgugcccgugc

SEQ ID NO: 3922016 - RNA, 20 nt, Human adenovirus D
cgugcgcuaccaccccagca

SEQ ID NO: 3922017 - RNA, 14 nt, Human adenovirus D
cguggcgcagcgcg

SEQ ID NO: 3922018 - RNA, 15 nt, Human adenovirus D
cguggugcugcugcc

SEQ ID NO: 3922019 - RNA, 14 nt, Human adenovirus D
cguguacugggugc

SEQ ID NO: 3922020 - RNA, 21 nt, Human adenovirus D
cgugugauuaaaaagcagcac

SEQ ID NO: 3922021 - RNA, 22 nt, Human adenovirus D
cguuacgucacuuuugcccuua

SEQ ID NO: 3922022 - RNA, 16 nt, Human adenovirus D
cguuacucggagcugg

SEQ ID NO: 3922023 - RNA, 17 nt, Human adenovirus D
cguucuacccagcaagu

SEQ ID NO: 3922024 - RNA, 16 nt, Human adenovirus D
cguugagcucacccac

SEQ ID NO: 3922025 - RNA, 20 nt, Human adenovirus D
cuaaaaaaugucuauucuca

SEQ ID NO: 3922026 - RNA, 18 nt, Human adenovirus D
cuaaagccaaacacaccu

SEQ ID NO: 3922027 - RNA, 13 nt, Human adenovirus D
cuaaagcucuucu

SEQ ID NO: 3922028 - RNA, 22 nt, Human adenovirus D
cuaagcuaguacucuacaaucc

SEQ ID NO: 3922029 - RNA, 23 nt, Human adenovirus D
cuaaucauuuaauaaagaucacu

SEQ ID NO: 3922030 - RNA, 19 nt, Human adenovirus D
cuaaugacagaggcaacag

SEQ ID NO: 3922031 - RNA, 14 nt, Human adenovirus D
cuaauuacagucac

SEQ ID NO: 3922032 - RNA, 20 nt, Human adenovirus D
cuacaaggccgucacccugc

SEQ ID NO: 3922033 - RNA, 12 nt, Human adenovirus D
cuacagccagca

SEQ ID NO: 3922034 - RNA, 13 nt, Human adenovirus D
cuacaugcccagc

SEQ ID NO: 3922035 - RNA, 14 nt, Human adenovirus D
cuacaugcccagca

SEQ ID NO: 3922036 - RNA, 18 nt, Human adenovirus D
cuacauguucgaccccuu

SEQ ID NO: 3922037 - RNA, 19 nt, Human adenovirus D
cuacccagcaagucagcaa

SEQ ID NO: 3922038 - RNA, 16 nt, Human adenovirus D
cuaccgcugcgcagca

SEQ ID NO: 3922039 - RNA, 19 nt, Human adenovirus D
cuaccugcaucgcgcggcg

SEQ ID NO: 3922040 - RNA, 12 nt, Human adenovirus D
cuaccugggagu

SEQ ID NO: 3922041 - RNA, 15 nt, Human adenovirus D
cuaccuugcacccac

SEQ ID NO: 3922042 - RNA, 18 nt, Human adenovirus D
cuacgaaucauggaggcc

SEQ ID NO: 3922043 - RNA, 16 nt, Human adenovirus D
cuacugcaucugucca

SEQ ID NO: 3922044 - RNA, 20 nt, Human adenovirus D
cuacuggcuucuacagccag

SEQ ID NO: 3922045 - RNA, 15 nt, Human adenovirus D
cuacuggucgcugcc

SEQ ID NO: 3922046 - RNA, 16 nt, Human adenovirus D
cuagacauggccagca

SEQ ID NO: 3922047 - RNA, 17 nt, Human adenovirus D
cuagacuucauggcuug

SEQ ID NO: 3922048 - RNA, 19 nt, Human adenovirus D
cuagacuugaaagcggccg

SEQ ID NO: 3922049 - RNA, 15 nt, Human adenovirus D
cuagagugaggcacu

SEQ ID NO: 3922050 - RNA, 17 nt, Human adenovirus D
cuagagugaggcacugc

SEQ ID NO: 3922051 - RNA, 20 nt, Human adenovirus D
cuagagugaggcacugcucu

SEQ ID NO: 3922052 - RNA, 14 nt, Human adenovirus D
cuaggcccagcagc

SEQ ID NO: 3922053 - RNA, 16 nt, Human adenovirus D
cuaggcccagcagcau

SEQ ID NO: 3922054 - RNA, 13 nt, Human adenovirus D
cuaggcgcagcug

SEQ ID NO: 3922055 - RNA, 14 nt, Human adenovirus D
cuaggcgcagcugc

SEQ ID NO: 3922056 - RNA, 13 nt, Human adenovirus D
cuaucauucagag

SEQ ID NO: 3922057 - RNA, 17 nt, Human adenovirus D
cuaucuaugaaagcaua

SEQ ID NO: 3922058 - RNA, 13 nt, Human adenovirus D
cucaacagcuggg

SEQ ID NO: 3922059 - RNA, 20 nt, Human adenovirus D
cucacaguaagugcagcaca

SEQ ID NO: 3922060 - RNA, 17 nt, Human adenovirus D
uuucugcagacaucaug

SEQ ID NO: 3922061 - RNA, 22 nt, Human adenovirus D
uuucuggggucagagacaucau

SEQ ID NO: 3922062 - RNA, 20 nt, Human adenovirus D
uuugcaagaaggaaguauga

SEQ ID NO: 3922063 - RNA, 20 nt, Human adenovirus D
uuuuauggcugcuggauggg

SEQ ID NO: 3922064 - RNA, 12 nt, Human adenovirus D
uuuuuccagccc

SEQ ID NO: 3922065 - RNA, 12 nt, Human adenovirus D
uuuuuccagccu

SEQ ID NO: 3922066 - RNA, 13 nt, Human adenovirus D
gugcgggggcaga

SEQ ID NO: 3922067 - RNA, 15 nt, Human adenovirus D
gugcgucgagcacag

SEQ ID NO: 3922068 - RNA, 18 nt, Human adenovirus D
gugcuagacauggccagc

SEQ ID NO: 3922069 - RNA, 13 nt, Human adenovirus D
gugcuccagccaa

SEQ ID NO: 3922070 - RNA, 21 nt, Human adenovirus D
gugcugacauccauggccagg

SEQ ID NO: 3922071 - RNA, 15 nt, Human adenovirus D
gugcugccccaggcg

SEQ ID NO: 3922072 - RNA, 13 nt, Human adenovirus D
gugcugcugccga

SEQ ID NO: 3922073 - RNA, 17 nt, Human adenovirus D
gugcugcugccgagccg

SEQ ID NO: 3922074 - RNA, 15 nt, Human adenovirus D
guggaaacagacagc

SEQ ID NO: 3922075 - RNA, 16 nt, Human adenovirus D
guggaagaggggcagc

SEQ ID NO: 3922076 - RNA, 16 nt, Human adenovirus D
guggccccggggcgga

SEQ ID NO: 3922077 - RNA, 15 nt, Human adenovirus D
guggcccugggccug

SEQ ID NO: 3922078 - RNA, 12 nt, Human adenovirus D
guggccucuucg

SEQ ID NO: 3922079 - RNA, 15 nt, Human adenovirus D
guggccuuguaccug

SEQ ID NO: 3922080 - RNA, 17 nt, Human adenovirus D
guggcgccgggccuggg

SEQ ID NO: 3922081 - RNA, 21 nt, Human adenovirus D
guggcgcucgggcaggucccg

SEQ ID NO: 3922082 - RNA, 13 nt, Human adenovirus D
guggcuguugaug

SEQ ID NO: 3922083 - RNA, 20 nt, Human adenovirus D
gugggccccuggcugggcgc

SEQ ID NO: 3922084 - RNA, 22 nt, Human adenovirus D
guggguuggcuugcaugaagga

SEQ ID NO: 3922085 - RNA, 19 nt, Human adenovirus D
guggucagcgaugagcagc

SEQ ID NO: 3922086 - RNA, 17 nt, Human adenovirus D
gugguccuggucacccu

SEQ ID NO: 3922087 - RNA, 16 nt, Human adenovirus D
guggugguggcggggc

SEQ ID NO: 3922088 - RNA, 16 nt, Human adenovirus D
guguaccgcaacgacc

SEQ ID NO: 3922089 - RNA, 13 nt, Human adenovirus D
guguccagcuggc

SEQ ID NO: 3922090 - RNA, 17 nt, Human adenovirus D
guguccgcgcucgguga

SEQ ID NO: 3922091 - RNA, 15 nt, Human adenovirus D
gugugcgucagggcg

SEQ ID NO: 3922092 - RNA, 18 nt, Human adenovirus D
gugugcuggcuggucagg

SEQ ID NO: 3922093 - RNA, 19 nt, Human adenovirus D
guguugcaugaugggaaug

SEQ ID NO: 3922094 - RNA, 23 nt, Human adenovirus D
guuauugagcccaucaagcaaga

SEQ ID NO: 3922095 - RNA, 15 nt, Human adenovirus D
guucaauggagagaa

SEQ ID NO: 3922096 - RNA, 17 nt, Human adenovirus D
guucaggagcgcagccu

SEQ ID NO: 3922097 - RNA, 19 nt, Human adenovirus D
guucauggccaacagccac

SEQ ID NO: 3922098 - RNA, 20 nt, Human adenovirus D
guuccggccccgcgggcagg

SEQ ID NO: 3922099 - RNA, 22 nt, Human adenovirus D
guuccuggugguacagcacagc

SEQ ID NO: 3922100 - RNA, 15 nt, Human adenovirus D
guucucgcuggucac

SEQ ID NO: 3922101 - RNA, 15 nt, Human adenovirus D
guucugggucaccuu

SEQ ID NO: 3922102 - RNA, 14 nt, Human adenovirus D
guucuugcaugccu

SEQ ID NO: 3922103 - RNA, 22 nt, Human adenovirus D
guugccaaagaaaauggucagg

SEQ ID NO: 3922104 - RNA, 16 nt, Human adenovirus D
guugcgcagcggcagg

SEQ ID NO: 3922105 - RNA, 21 nt, Human adenovirus D
guuggaggaagaaaugaggca

SEQ ID NO: 3922106 - RNA, 22 nt, Human adenovirus D
guuggaggaagaaaugaggcag

SEQ ID NO: 3922107 - RNA, 18 nt, Human adenovirus D
guuggcgacccaggaaug

SEQ ID NO: 3922108 - RNA, 13 nt, Human adenovirus D
guugggcagcgag

SEQ ID NO: 3922109 - RNA, 16 nt, Human adenovirus D
guugguccagauggaa

SEQ ID NO: 3922110 - RNA, 12 nt, Human adenovirus D
guugugcaggac

SEQ ID NO: 3922111 - RNA, 13 nt, Human adenovirus D
guugugcgccgcg

SEQ ID NO: 3922112 - RNA, 19 nt, Human adenovirus D
guuucuggggucagagaca

SEQ ID NO: 3922113 - RNA, 19 nt, Human adenovirus D
guuugaguagugggcgugg

SEQ ID NO: 3922114 - RNA, 22 nt, Human adenovirus D
uaaaaauauuagaugacaaaag

SEQ ID NO: 3922115 - RNA, 15 nt, Human adenovirus D
uaaaaguaaacacua

SEQ ID NO: 3922116 - RNA, 15 nt, Human adenovirus D
uaaaauucaacugca

SEQ ID NO: 3922117 - RNA, 16 nt, Human adenovirus D
uaaagaaacagaacaa

SEQ ID NO: 3922118 - RNA, 20 nt, Human adenovirus D
uaaagccaaacacaccugac

SEQ ID NO: 3922119 - RNA, 15 nt, Human adenovirus D
uaaagccacaaccag

SEQ ID NO: 3922120 - RNA, 15 nt, Human adenovirus D
uaaaggcgggugucu

SEQ ID NO: 3922121 - RNA, 20 nt, Human adenovirus D
uaaauauggccuggagcaga

SEQ ID NO: 3922122 - RNA, 13 nt, Human adenovirus D
uaagagcccagca

SEQ ID NO: 3922123 - RNA, 13 nt, Human adenovirus D
uaaggagaaggau

SEQ ID NO: 3922124 - RNA, 17 nt, Human adenovirus D
uaaguguaagagcaaga

SEQ ID NO: 3922125 - RNA, 16 nt, Human adenovirus D
uaagugugacaaucaa

SEQ ID NO: 3922126 - RNA, 16 nt, Human adenovirus D
uaauuaugcuccuggg

SEQ ID NO: 3922127 - RNA, 12 nt, Human adenovirus D
uacaaagugugg

SEQ ID NO: 3922128 - RNA, 21 nt, Human adenovirus D
uacaacaucggcuaccagggc

SEQ ID NO: 3922129 - RNA, 11 nt, Human adenovirus D
uacaacaugcu

SEQ ID NO: 3922130 - RNA, 21 nt, Human adenovirus D
uacaaccaaggcacccaccac

SEQ ID NO: 3922131 - RNA, 14 nt, Human adenovirus D
uacaacguggccca

SEQ ID NO: 3922132 - RNA, 12 nt, Human adenovirus D
uacaacuacaca

SEQ ID NO: 3922133 - RNA, 20 nt, Human adenovirus D
uacaagcgccaacagcagcg

SEQ ID NO: 3922134 - RNA, 17 nt, Human adenovirus D
uacaaggacuacaaggc

SEQ ID NO: 3922135 - RNA, 14 nt, Human adenovirus D
uacaauacucuggg

SEQ ID NO: 3922136 - RNA, 17 nt, Human adenovirus D
uacacagcuagacacca

SEQ ID NO: 3922137 - RNA, 19 nt, Human adenovirus D
uacacgguucucucagcac

SEQ ID NO: 3922138 - RNA, 17 nt, Human adenovirus D
uacagcacagcagggac

SEQ ID NO: 3922139 - RNA, 19 nt, Human adenovirus D
uacagccagcagcuccggg

SEQ ID NO: 3922140 - RNA, 15 nt, Human adenovirus D
uacagucacuagugg

SEQ ID NO: 3922141 - RNA, 20 nt, Human adenovirus D
uacauagaccacgcuacaaa

SEQ ID NO: 3922142 - RNA, 16 nt, Human adenovirus D
uacaugcccagcagca

SEQ ID NO: 3922143 - RNA, 16 nt, Human adenovirus D
uacauggacaagauau

SEQ ID NO: 3922144 - RNA, 14 nt, Human adenovirus D
uacccacugggugg

SEQ ID NO: 3922145 - RNA, 16 nt, Human adenovirus D
uacccgaccaugcaga

SEQ ID NO: 3922146 - RNA, 16 nt, Human adenovirus D
uaccucuugcagcugg

SEQ ID NO: 3922147 - RNA, 21 nt, Human adenovirus D
uacgaggcagaggcacacagc

SEQ ID NO: 3922148 - RNA, 18 nt, Human adenovirus D
uacgcguacauccagcau

SEQ ID NO: 3922149 - RNA, 19 nt, Human adenovirus D
uacggaccaccccaggcgg

SEQ ID NO: 3922150 - RNA, 23 nt, Human adenovirus D
uacggaccaccccaggcggacca

SEQ ID NO: 3922151 - RNA, 13 nt, Human adenovirus D
uacuccagucucc

SEQ ID NO: 3922152 - RNA, 22 nt, Human adenovirus D
uacucccagcucauccgcagcu

SEQ ID NO: 3922153 - RNA, 12 nt, Human adenovirus D
uacucccgcccc

SEQ ID NO: 3922154 - RNA, 20 nt, Human adenovirus D
uacuuucgcucccaccgcgc

SEQ ID NO: 3922155 - RNA, 15 nt, Human adenovirus D
uacuuugucugcugu

SEQ ID NO: 3922156 - RNA, 20 nt, Human adenovirus D
uagaagaccauaguaaagaa

SEQ ID NO: 3922157 - RNA, 15 nt, Human adenovirus D
uagaagagcccccuc

SEQ ID NO: 3922158 - RNA, 20 nt, Human adenovirus D
uagacaaagagcacagcagu

SEQ ID NO: 3922159 - RNA, 14 nt, Human adenovirus D
uagacauggccagc

SEQ ID NO: 3922160 - RNA, 16 nt, Human adenovirus D
uagcaauggaaaucac

SEQ ID NO: 3922161 - RNA, 16 nt, Human adenovirus D
uagcaccacugcaugg

SEQ ID NO: 3922162 - RNA, 16 nt, Human adenovirus D
uagcagacagggccug

SEQ ID NO: 3922163 - RNA, 14 nt, Human adenovirus D
uaggcccagcagca

SEQ ID NO: 3922164 - RNA, 13 nt, Human adenovirus D
uagggacagcagc

SEQ ID NO: 3922165 - RNA, 19 nt, Human adenovirus D
uagggccuuuccccaccua

SEQ ID NO: 3922166 - RNA, 13 nt, Human adenovirus D
uauaaaucuuaca

SEQ ID NO: 3922167 - RNA, 21 nt, Human adenovirus D
uauaaucgccagggaacugaa

SEQ ID NO: 3922168 - RNA, 12 nt, Human adenovirus D
uaucacaucuuu

SEQ ID NO: 3922169 - RNA, 15 nt, Human adenovirus D
uaucagcgcgcugcg

SEQ ID NO: 3922170 - RNA, 20 nt, Human adenovirus D
uauccagccuguacccagag

SEQ ID NO: 3922171 - RNA, 19 nt, Human adenovirus D
uauccaguaggaaccagca

SEQ ID NO: 3922172 - RNA, 18 nt, Human adenovirus D
uaugaccaugcagacucu

SEQ ID NO: 3922173 - RNA, 17 nt, Human adenovirus D
uaugagaugccccagca

SEQ ID NO: 3922174 - RNA, 13 nt, Human adenovirus D
uaugaggaucuag

SEQ ID NO: 3922175 - RNA, 11 nt, Human adenovirus D
uaugccagacg

SEQ ID NO: 3922176 - RNA, 14 nt, Human adenovirus D
uauggccuggagca

SEQ ID NO: 3922177 - RNA, 14 nt, Human adenovirus D
uauggucugcuccu

SEQ ID NO: 3922178 - RNA, 21 nt, Human adenovirus D
ucaaacagcaaagcaucuuua

SEQ ID NO: 3922179 - RNA, 16 nt, Human adenovirus D
ucaaacaggcaaagau

SEQ ID NO: 3922180 - RNA, 17 nt, Human adenovirus D
ucaacaucugugcugcc

SEQ ID NO: 3922181 - RNA, 22 nt, Human adenovirus D
ucaacccgggucucccccagca

SEQ ID NO: 3922182 - RNA, 15 nt, Human adenovirus D
ucaacuacuguggca

SEQ ID NO: 3922183 - RNA, 14 nt, Human adenovirus D
ucaacugcagaccg

SEQ ID NO: 3922184 - RNA, 17 nt, Human adenovirus D
ucaacuguuaagaccac

SEQ ID NO: 3922185 - RNA, 19 nt, Human adenovirus D
ucaacuguuaagaccacua

SEQ ID NO: 3922186 - RNA, 12 nt, Human adenovirus D
cagccugagcuu

SEQ ID NO: 3922187 - RNA, 23 nt, Human adenovirus D
cagccuugauuuuuccagcccag

SEQ ID NO: 3922188 - RNA, 20 nt, Human adenovirus D
cagccuuggauuaucucuac

SEQ ID NO: 3922189 - RNA, 15 nt, Human adenovirus D
cagcgaaagagagcu

SEQ ID NO: 3922190 - RNA, 19 nt, Human adenovirus D
cagcgacgagacuggccuc

SEQ ID NO: 3922191 - RNA, 14 nt, Human adenovirus D
cagcgagaggagcu

SEQ ID NO: 3922192 - RNA, 17 nt, Human adenovirus D
cagcgcauccugcaacu

SEQ ID NO: 3922193 - RNA, 14 nt, Human adenovirus D
cagcgccccgagga

SEQ ID NO: 3922194 - RNA, 12 nt, Human adenovirus D
cagcgcgagcgg

SEQ ID NO: 3922195 - RNA, 15 nt, Human adenovirus D
cagcgcgcugcggcu

SEQ ID NO: 3922196 - RNA, 16 nt, Human adenovirus D
cagcgcuggguggccg

SEQ ID NO: 3922197 - RNA, 18 nt, Human adenovirus D
cagcgucaaccucuacgc

SEQ ID NO: 3922198 - RNA, 12 nt, Human adenovirus D
cagcgugguggc

SEQ ID NO: 3922199 - RNA, 14 nt, Human adenovirus D
cagcuacaccuccc

SEQ ID NO: 3922200 - RNA, 18 nt, Human adenovirus D
cagcucaucgacuggugc

SEQ ID NO: 3922201 - RNA, 20 nt, Human adenovirus D
cagcuccgguugugcagccc

SEQ ID NO: 3922202 - RNA, 13 nt, Human adenovirus D
cagcugcagaagg

SEQ ID NO: 3922203 - RNA, 13 nt, Human adenovirus D
cagcugcagcgca

SEQ ID NO: 3922204 - RNA, 17 nt, Human adenovirus D
cagcugccgucgucccg

SEQ ID NO: 3922205 - RNA, 18 nt, Human adenovirus D
cagcuggccgcccugacc

SEQ ID NO: 3922206 - RNA, 18 nt, Human adenovirus D
cagcugggacuugccgca

SEQ ID NO: 3922207 - RNA, 21 nt, Human adenovirus D
caggaaaggguacuccacagc

SEQ ID NO: 3922208 - RNA, 16 nt, Human adenovirus D
caggaaauccccgggc

SEQ ID NO: 3922209 - RNA, 13 nt, Human adenovirus D
caggaccaccagg

SEQ ID NO: 3922210 - RNA, 16 nt, Human adenovirus D
caggagaggcauggca

SEQ ID NO: 3922211 - RNA, 14 nt, Human adenovirus D
caggagcaggagga

SEQ ID NO: 3922212 - RNA, 20 nt, Human adenovirus D
caggagggggccacucccag

SEQ ID NO: 3922213 - RNA, 21 nt, Human adenovirus D
caggagggggccacucccagc

SEQ ID NO: 3922214 - RNA, 22 nt, Human adenovirus D
caggagggggccacucccagcg

SEQ ID NO: 3922215 - RNA, 17 nt, Human adenovirus D
caggaugaacaggagca

SEQ ID NO: 3922216 - RNA, 21 nt, Human adenovirus D
caggcccagaacuggcagagc

SEQ ID NO: 3922217 - RNA, 16 nt, Human adenovirus D
caggccgcagcucuuc

SEQ ID NO: 3922218 - RNA, 14 nt, Human adenovirus D
caggccgugcugcu

SEQ ID NO: 3922219 - RNA, 20 nt, Human adenovirus D
caggcgaaacgccccugcaa

SEQ ID NO: 3922220 - RNA, 16 nt, Human adenovirus D
caggcgacccuggagg

SEQ ID NO: 3922221 - RNA, 17 nt, Human adenovirus D
caggcgacccuggaggu

SEQ ID NO: 3922222 - RNA, 21 nt, Human adenovirus D
caggcgccggcgcuagccagc

SEQ ID NO: 3922223 - RNA, 18 nt, Human adenovirus D
caggcgccugaguggcgg

SEQ ID NO: 3922224 - RNA, 14 nt, Human adenovirus D
caggcgggacagag

SEQ ID NO: 3922225 - RNA, 23 nt, Human adenovirus D
caggcuggccgugcucaagcgca

SEQ ID NO: 3922226 - RNA, 14 nt, Human adenovirus D
cagggaacugauaa

SEQ ID NO: 3922227 - RNA, 12 nt, Human adenovirus D
cagggagccagg

SEQ ID NO: 3922228 - RNA, 14 nt, Human adenovirus D
cagggaggcgcugc

SEQ ID NO: 3922229 - RNA, 21 nt, Human adenovirus D
cagggcacugccggugcacuc

SEQ ID NO: 3922230 - RNA, 18 nt, Human adenovirus D
cagggcgaaggugucccu

SEQ ID NO: 3922231 - RNA, 22 nt, Human adenovirus D
caggggcuugaguccgucggcc

SEQ ID NO: 3922232 - RNA, 12 nt, Human adenovirus D
cagggggguccg

SEQ ID NO: 3922233 - RNA, 18 nt, Human adenovirus D
caggguaaagccagcagc

SEQ ID NO: 3922234 - RNA, 17 nt, Human adenovirus D
cagggugccucccgccc

SEQ ID NO: 3922235 - RNA, 19 nt, Human adenovirus D
caggucacagucuggugga

SEQ ID NO: 3922236 - RNA, 20 nt, Human adenovirus D
cagguccacgcugguggcca

SEQ ID NO: 3922237 - RNA, 21 nt, Human adenovirus D
caggugacagcguuccccucc

SEQ ID NO: 3922238 - RNA, 13 nt, Human adenovirus D
caggugcugccca

SEQ ID NO: 3922239 - RNA, 13 nt, Human adenovirus D
caguaagugcagc

SEQ ID NO: 3922240 - RNA, 23 nt, Human adenovirus D
caguacuuagaagagcccccucc

SEQ ID NO: 3922241 - RNA, 17 nt, Human adenovirus D
caguaggaaccagcaca

SEQ ID NO: 3922242 - RNA, 13 nt, Human adenovirus D
caguaguccagcg

SEQ ID NO: 3922243 - RNA, 22 nt, Human adenovirus D
caguauccgcggaguccagcga

SEQ ID NO: 3922244 - RNA, 19 nt, Human adenovirus D
caguauugugggccuggga

SEQ ID NO: 3922245 - RNA, 20 nt, Human adenovirus D
caguauugugggccugggag

SEQ ID NO: 3922246 - RNA, 12 nt, Human adenovirus D
cagucacucuca

SEQ ID NO: 3922247 - RNA, 20 nt, Human adenovirus D
cagucagugaagcccugguu

SEQ ID NO: 3922248 - RNA, 19 nt, Human adenovirus D
caguccaaccuggaccggc

SEQ ID NO: 3922249 - RNA, 18 nt, Human adenovirus D
caguccaugcccaacagg

SEQ ID NO: 3922250 - RNA, 20 nt, Human adenovirus D
cagucucugccgccggggcu

SEQ ID NO: 3922251 - RNA, 16 nt, Human adenovirus D
cagucugagggccacc

SEQ ID NO: 3922252 - RNA, 19 nt, Human adenovirus D
cagugaaaacgugccugcu

SEQ ID NO: 3922253 - RNA, 22 nt, Human adenovirus D
cagugcaacuuuagccagacca

SEQ ID NO: 3922254 - RNA, 21 nt, Human adenovirus D
caguggcgagaggcgagcagc

SEQ ID NO: 3922255 - RNA, 13 nt, Human adenovirus D
caguguuugagaa

SEQ ID NO: 3922256 - RNA, 15 nt, Human adenovirus D
caguuaaugcugccu

SEQ ID NO: 3922257 - RNA, 17 nt, Human adenovirus D
caguuugggcacugggg

SEQ ID NO: 3922258 - RNA, 16 nt, Human adenovirus D
cauaaagauggaugga

SEQ ID NO: 3922259 - RNA, 18 nt, Human adenovirus D
cauaagaaucacauuaaa

SEQ ID NO: 3922260 - RNA, 21 nt, Human adenovirus D
cauaauuaugcuccuggguga

SEQ ID NO: 3922261 - RNA, 17 nt, Human adenovirus D
cauacaaagcugaaagc

SEQ ID NO: 3922262 - RNA, 17 nt, Human adenovirus D
cauacagagauucagcc

SEQ ID NO: 3922263 - RNA, 14 nt, Human adenovirus D
cauacuuauggcuc

SEQ ID NO: 3922264 - RNA, 18 nt, Human adenovirus D
cauagaccugaugaacaa

SEQ ID NO: 3922265 - RNA, 15 nt, Human adenovirus D
cauagaugggcuccg

SEQ ID NO: 3922266 - RNA, 15 nt, Human adenovirus D
cauaguaaagaaaca

SEQ ID NO: 3922267 - RNA, 13 nt, Human adenovirus D
cauaucagccagu

SEQ ID NO: 3922268 - RNA, 22 nt, Human adenovirus D
cauaucccaggggacuggaaac

SEQ ID NO: 3922269 - RNA, 19 nt, Human adenovirus D
cauaugcuacaucugcugc

SEQ ID NO: 3922270 - RNA, 20 nt, Human adenovirus D
cauaugcuacaucugcugcc

SEQ ID NO: 3922271 - RNA, 13 nt, Human adenovirus D
caucaccacaggc

SEQ ID NO: 3922272 - RNA, 22 nt, Human adenovirus D
caucauaagacauuuuaaugaa

SEQ ID NO: 3922273 - RNA, 21 nt, Human adenovirus D
cauccaacugaaguacaucca

SEQ ID NO: 3922274 - RNA, 17 nt, Human adenovirus D
cauccacaaggccguga

SEQ ID NO: 3922275 - RNA, 22 nt, Human adenovirus D
cauccacaaggccgugagcgcg

SEQ ID NO: 3922276 - RNA, 15 nt, Human adenovirus D
cauccauggccaggg

SEQ ID NO: 3922277 - RNA, 15 nt, Human adenovirus D
cauccccgcgccgcg

SEQ ID NO: 3922278 - RNA, 18 nt, Human adenovirus D
caucccggccaaggccac

SEQ ID NO: 3922279 - RNA, 13 nt, Human adenovirus D
caucuugcagagc

SEQ ID NO: 3922280 - RNA, 16 nt, Human adenovirus D
caugaaagaacauaca

SEQ ID NO: 3922281 - RNA, 16 nt, Human adenovirus D
caugacaaccucuucu

SEQ ID NO: 3922282 - RNA, 20 nt, Human adenovirus D
caugaccauagaccugauga

SEQ ID NO: 3922283 - RNA, 16 nt, Human adenovirus D
caugacccugcauggc

SEQ ID NO: 3922284 - RNA, 19 nt, Human adenovirus D
caugacccugcauggcugc

SEQ ID NO: 3922285 - RNA, 20 nt, Human adenovirus D
caugacccugcauggcugcg

SEQ ID NO: 3922286 - RNA, 15 nt, Human adenovirus D
caugagccagagcau

SEQ ID NO: 3922287 - RNA, 16 nt, Human adenovirus D
caugagucuguguccg

SEQ ID NO: 3922288 - RNA, 15 nt, Human adenovirus D
caugauccagcggcg

SEQ ID NO: 3922289 - RNA, 16 nt, Human adenovirus D
caugcaccuguggagg

SEQ ID NO: 3922290 - RNA, 15 nt, Human adenovirus D
caugcagacucugcu

SEQ ID NO: 3922291 - RNA, 20 nt, Human adenovirus D
caugccacgaacagccacga

SEQ ID NO: 3922292 - RNA, 16 nt, Human adenovirus D
caugcggggggagaug

SEQ ID NO: 3922293 - RNA, 22 nt, Human adenovirus D
cauggacgagaacccgaggagc

SEQ ID NO: 3922294 - RNA, 18 nt, Human adenovirus D
cauggacgggaaccccac

SEQ ID NO: 3922295 - RNA, 20 nt, Human adenovirus D
cauggccaacagccacauga

SEQ ID NO: 3922296 - RNA, 17 nt, Human adenovirus D
cauggccucgugcucug

SEQ ID NO: 3922297 - RNA, 21 nt, Human adenovirus D
cauggcgcaguaguccagcgu

SEQ ID NO: 3922298 - RNA, 21 nt, Human adenovirus D
caugggaggaagcaacaucac

SEQ ID NO: 3922299 - RNA, 20 nt, Human adenovirus D
cauggggcgccgcccgagcu

SEQ ID NO: 3922300 - RNA, 22 nt, Human adenovirus D
caugguagcaauggaaaucaca

SEQ ID NO: 3922301 - RNA, 21 nt, Human adenovirus D
cauggugggcgucaaccccau

SEQ ID NO: 3922302 - RNA, 21 nt, Human adenovirus D
cauguccaccugcggggcgau

SEQ ID NO: 3922303 - RNA, 17 nt, Human adenovirus D
caugugaacaaaaccca

SEQ ID NO: 3922304 - RNA, 16 nt, Human adenovirus D
caugugcgcacccuga

SEQ ID NO: 3922305 - RNA, 20 nt, Human adenovirus D
caugugugauaucacacugc

SEQ ID NO: 3922306 - RNA, 16 nt, Human adenovirus D
cauguucaccagcaag

SEQ ID NO: 3922307 - RNA, 23 nt, Human adenovirus D
cauuacuauuacugccacugcca

SEQ ID NO: 3922308 - RNA, 12 nt, Human adenovirus D
cauucaaggcca

SEQ ID NO: 3922309 - RNA, 12 nt, Human adenovirus D
cauucuggaggc

SEQ ID NO: 3922310 - RNA, 18 nt, Human adenovirus D
cauugaauggcacuggca

SEQ ID NO: 3922311 - RNA, 13 nt, Human adenovirus D
cauugucugccug

SEQ ID NO: 3922312 - RNA, 15 nt, Human adenovirus D
cauugucugccuggu

SEQ ID NO: 3922313 - RNA, 14 nt, Human adenovirus D
ccaaaaaaacacac

SEQ ID NO: 3922314 - RNA, 18 nt, Human adenovirus D
ccaaaauggcuuacaugu

SEQ ID NO: 3922315 - RNA, 16 nt, Human adenovirus D
ccaaacgccagcccaa

SEQ ID NO: 3922316 - RNA, 18 nt, Human adenovirus D
ccaaacuauugcuuccca

SEQ ID NO: 3922317 - RNA, 18 nt, Human adenovirus D
ccaaaugcgucccacccc

SEQ ID NO: 3922318 - RNA, 20 nt, Human adenovirus D
ccaagaaacgucccagcagc

SEQ ID NO: 3922319 - RNA, 21 nt, Human adenovirus D
ccaagauagcccugcgcccag

SEQ ID NO: 3922320 - RNA, 16 nt, Human adenovirus D
ccaaugcaacaugacc

SEQ ID NO: 3922321 - RNA, 23 nt, Human adenovirus D
ccacaaaaacgaagaucagcugc

SEQ ID NO: 3922322 - RNA, 19 nt, Human adenovirus D
ccacacauggcaagcugcc

SEQ ID NO: 3922323 - RNA, 18 nt, Human adenovirus D
ccacaccugugacaugca

SEQ ID NO: 3922324 - RNA, 14 nt, Human adenovirus D
ccacacggccagca

SEQ ID NO: 3922325 - RNA, 12 nt, Human adenovirus D
ccacagccagcc

SEQ ID NO: 3922326 - RNA, 19 nt, Human adenovirus D
ccacagcucgcgguugagg

SEQ ID NO: 3922327 - RNA, 14 nt, Human adenovirus D
ccacaggugcugcc

SEQ ID NO: 3922328 - RNA, 16 nt, Human adenovirus D
ccacauccaagugccc

SEQ ID NO: 3922329 - RNA, 14 nt, Human adenovirus D
ccaccaccagccca

SEQ ID NO: 3922330 - RNA, 15 nt, Human adenovirus D
ccaccaccagcccau

SEQ ID NO: 3922331 - RNA, 18 nt, Human adenovirus D
ccacccacgagcaaccca

SEQ ID NO: 3922332 - RNA, 15 nt, Human adenovirus D
ccacccagaccgugc

SEQ ID NO: 3922333 - RNA, 11 nt, Human adenovirus D
ccaccccaggc

SEQ ID NO: 3922334 - RNA, 15 nt, Human adenovirus D
ccaccgaaggcagcu

SEQ ID NO: 3922335 - RNA, 15 nt, Human adenovirus D
ccaccucgccgcgca

SEQ ID NO: 3922336 - RNA, 22 nt, Human adenovirus D
ccaccugcgcgagguugagcuc

SEQ ID NO: 3922337 - RNA, 18 nt, Human adenovirus D
ccaccuggugauggccug

SEQ ID NO: 3922338 - RNA, 22 nt, Human adenovirus D
ccacgagcgccagcuguugggg

SEQ ID NO: 3922339 - RNA, 19 nt, Human adenovirus D
ccacgcgcucgacaugacc

SEQ ID NO: 3922340 - RNA, 19 nt, Human adenovirus D
ccacgucuucaaccgcuuc

SEQ ID NO: 3922341 - RNA, 13 nt, Human adenovirus D
ccacgugaccauc

SEQ ID NO: 3922342 - RNA, 14 nt, Human adenovirus D
ccacuacucacacu

SEQ ID NO: 3922343 - RNA, 12 nt, Human adenovirus D
ccacuccgcaca

SEQ ID NO: 3922344 - RNA, 12 nt, Human adenovirus D
ccacucgcgggc

SEQ ID NO: 3922345 - RNA, 21 nt, Human adenovirus D
ccacugcaccccccgcaggca

SEQ ID NO: 3922346 - RNA, 21 nt, Human adenovirus D
ccagaaagaaguggccagugu

SEQ ID NO: 3922347 - RNA, 16 nt, Human adenovirus D
ccagaacuuccagcag

SEQ ID NO: 3922348 - RNA, 21 nt, Human adenovirus D
ccagaaggggcaccuuccagc

SEQ ID NO: 3922349 - RNA, 17 nt, Human adenovirus D
ccagaccaagcugcugu

SEQ ID NO: 3922350 - RNA, 17 nt, Human adenovirus D
ccagacccaggcgcgga

SEQ ID NO: 3922351 - RNA, 22 nt, Human adenovirus D
ccagaugaggauugggaggagg

SEQ ID NO: 3922352 - RNA, 20 nt, Human adenovirus D
ccagauguugcgcagcggca

SEQ ID NO: 3922353 - RNA, 11 nt, Human adenovirus D
ccagcagcaca

SEQ ID NO: 3922354 - RNA, 12 nt, Human adenovirus D
ccagcagcaggg

SEQ ID NO: 3922355 - RNA, 12 nt, Human adenovirus D
ccagcccagggc

SEQ ID NO: 3922356 - RNA, 21 nt, Human adenovirus D
ccagccuuuccauggccucgu

SEQ ID NO: 3922357 - RNA, 14 nt, Human adenovirus D
ccagcgcggccagc

SEQ ID NO: 3922358 - RNA, 16 nt, Human adenovirus D
ccagcgcgugcugcgc

SEQ ID NO: 3922359 - RNA, 17 nt, Human adenovirus D
ccagcgcgugcugcgcg

SEQ ID NO: 3922360 - RNA, 17 nt, Human adenovirus D
ccagcguaagcgcgcgg

SEQ ID NO: 3922361 - RNA, 21 nt, Human adenovirus D
ccagcgucauguccuuccagg

SEQ ID NO: 3922362 - RNA, 14 nt, Human adenovirus D
ccaggaauggcacg

SEQ ID NO: 3922363 - RNA, 17 nt, Human adenovirus D
ccaggaggagcucuauc

SEQ ID NO: 3922364 - RNA, 14 nt, Human adenovirus D
ccaggaggcggugc

SEQ ID NO: 3922365 - RNA, 14 nt, Human adenovirus D
ccaggcccagaacu

SEQ ID NO: 3922366 - RNA, 22 nt, Human adenovirus D
ccaggcccagaacuggcagagc

SEQ ID NO: 3922367 - RNA, 15 nt, Human adenovirus D
ccaggcccuggagca

SEQ ID NO: 3922368 - RNA, 20 nt, Human adenovirus D
ccaggccuccgagcagcgca

SEQ ID NO: 3922369 - RNA, 17 nt, Human adenovirus D
ccaggcggaccagaaac

SEQ ID NO: 3922370 - RNA, 20 nt, Human adenovirus D
ccaggcggcagagcgggcgg

SEQ ID NO: 3922371 - RNA, 17 nt, Human adenovirus D
ccagggcuuccacgugc

SEQ ID NO: 3922372 - RNA, 14 nt, Human adenovirus D
ccaggggguccacc

SEQ ID NO: 3922373 - RNA, 16 nt, Human adenovirus D
ccaggggguccaccuu

SEQ ID NO: 3922374 - RNA, 14 nt, Human adenovirus D
ccagguccacgcug

SEQ ID NO: 3922375 - RNA, 21 nt, Human adenovirus D
ccaggugagcucgggcugcuc

SEQ ID NO: 3922376 - RNA, 21 nt, Human adenovirus D
ccaguaggaaccagcacacuc

SEQ ID NO: 3922377 - RNA, 18 nt, Human adenovirus D
ccagucccuuuuccagga

SEQ ID NO: 3922378 - RNA, 19 nt, Human adenovirus D
ccaguuucaaacccuacuc

SEQ ID NO: 3922379 - RNA, 19 nt, Human adenovirus D
ccauagggagccugcgccc

SEQ ID NO: 3922380 - RNA, 19 nt, Human adenovirus D
ccauagucaucacccagca

SEQ ID NO: 3922381 - RNA, 22 nt, Human adenovirus D
ccaugcagacacuugagcuggc

SEQ ID NO: 3922382 - RNA, 21 nt, Human adenovirus D
ccauucggagcacgcccgcca

SEQ ID NO: 3922383 - RNA, 16 nt, Human adenovirus D
ccauugucaacacggc

SEQ ID NO: 3922384 - RNA, 16 nt, Human adenovirus D
cccaaaaacugcaugc

SEQ ID NO: 3922385 - RNA, 16 nt, Human adenovirus D
cccaaaaucgagcagg

SEQ ID NO: 3922386 - RNA, 18 nt, Human adenovirus D
cccaaaaucgagcaggac

SEQ ID NO: 3922387 - RNA, 15 nt, Human adenovirus D
cccacagggcacugc

SEQ ID NO: 3922388 - RNA, 20 nt, Human adenovirus D
cccacgccgagccugaagcc

SEQ ID NO: 3922389 - RNA, 16 nt, Human adenovirus D
cccacugacuuagcuc

SEQ ID NO: 3922390 - RNA, 19 nt, Human adenovirus D
cccagaacuggcagagcac

SEQ ID NO: 3922391 - RNA, 13 nt, Human adenovirus D
cccagccuccacc

SEQ ID NO: 3922392 - RNA, 14 nt, Human adenovirus D
cccagcgccgcgcu

SEQ ID NO: 3922393 - RNA, 19 nt, Human adenovirus D
cccaggaauggcacgcucu

SEQ ID NO: 3922394 - RNA, 21 nt, Human adenovirus D
cccaggacgagaccagaggca

SEQ ID NO: 3922395 - RNA, 21 nt, Human adenovirus D
cccaggcaaagcucaacccgc

SEQ ID NO: 3922396 - RNA, 15 nt, Human adenovirus D
cccaggcggugcugc

SEQ ID NO: 3922397 - RNA, 10 nt, Human adenovirus D
cccagugcuu

SEQ ID NO: 3922398 - RNA, 16 nt, Human adenovirus D
cccagugcuuccagca

SEQ ID NO: 3922399 - RNA, 15 nt, Human adenovirus D
cccauuccuggagau

SEQ ID NO: 3922400 - RNA, 14 nt, Human adenovirus D
ccccaaacgccagc

SEQ ID NO: 3922401 - RNA, 15 nt, Human adenovirus D
ccccaaacgccagcc

SEQ ID NO: 3922402 - RNA, 18 nt, Human adenovirus D
ccccaagggcgcucccaa

SEQ ID NO: 3922403 - RNA, 13 nt, Human adenovirus D
ccccacgguggcc

SEQ ID NO: 3922404 - RNA, 14 nt, Human adenovirus D
ccccagacacccac

SEQ ID NO: 3922405 - RNA, 19 nt, Human adenovirus D
ccccaggcccuggagcagc

SEQ ID NO: 3922406 - RNA, 17 nt, Human adenovirus D
ccccaggcggaccagaa

SEQ ID NO: 3922407 - RNA, 19 nt, Human adenovirus D
ccccaggcggugcugcugc

SEQ ID NO: 3922408 - RNA, 23 nt, Human adenovirus D
ccccaggcggugcugcugccgag

SEQ ID NO: 3922409 - RNA, 15 nt, Human adenovirus D
ccccagucagaccca

SEQ ID NO: 3922410 - RNA, 18 nt, Human adenovirus D
ccccauggacaacgucaa

SEQ ID NO: 3922411 - RNA, 23 nt, Human adenovirus D
ccccauggaugagcccaccgucc

SEQ ID NO: 3922412 - RNA, 18 nt, Human adenovirus D
cccccaagggcgcuccca

SEQ ID NO: 3922413 - RNA, 12 nt, Human adenovirus D
cccccagcuccu

SEQ ID NO: 3922414 - RNA, 14 nt, Human adenovirus D
cccccagcuccuga

SEQ ID NO: 3922415 - RNA, 15 nt, Human adenovirus D
cccccaggcccugga

SEQ ID NO: 3922416 - RNA, 22 nt, Human adenovirus D
ccccgagaauuucaugaccagc

SEQ ID NO: 3922417 - RNA, 18 nt, Human adenovirus D
ccccgcaaaaucaagcgg

SEQ ID NO: 3922418 - RNA, 13 nt, Human adenovirus D
ccccgcgcgcgcg

SEQ ID NO: 3922419 - RNA, 21 nt, Human adenovirus D
ccccggacgucaccugcggcg

SEQ ID NO: 3922420 - RNA, 21 nt, Human adenovirus D
ccccucaucacaucagccagg

SEQ ID NO: 3922421 - RNA, 18 nt, Human adenovirus D
ccccucaugaacacacug

SEQ ID NO: 3922422 - RNA, 11 nt, Human adenovirus D
ccccuccugcg

SEQ ID NO: 3922423 - RNA, 12 nt, Human adenovirus D
ccccuggcuccc

SEQ ID NO: 3922424 - RNA, 15 nt, Human adenovirus D
ccccuggcucccagc

SEQ ID NO: 3922425 - RNA, 13 nt, Human adenovirus D
ccccuggcugggc

SEQ ID NO: 3922426 - RNA, 17 nt, Human adenovirus D
ccccuucaaccaccacc

SEQ ID NO: 3922427 - RNA, 16 nt, Human adenovirus D
cccgaguuguccuggu

SEQ ID NO: 3922428 - RNA, 14 nt, Human adenovirus D
cccgauagccgcca

SEQ ID NO: 3922429 - RNA, 12 nt, Human adenovirus D
cccgcaggcagg

SEQ ID NO: 3922430 - RNA, 20 nt, Human adenovirus D
cccgccaaaaaaacacacac

SEQ ID NO: 3922431 - RNA, 19 nt, Human adenovirus D
cccgccauggggcgccgcc

SEQ ID NO: 3922432 - RNA, 19 nt, Human adenovirus D
cccgcccgcgugcgccgcg

SEQ ID NO: 3922433 - RNA, 13 nt, Human adenovirus D
cccgccgccaggc

SEQ ID NO: 3922434 - RNA, 14 nt, Human adenovirus D
cccgcgacccccag

SEQ ID NO: 3922435 - RNA, 15 nt, Human adenovirus D
cccgcggaugcuggc

SEQ ID NO: 3922436 - RNA, 13 nt, Human adenovirus D
cccgcgugcgccg

SEQ ID NO: 3922437 - RNA, 24 nt, Human adenovirus D
cccgcuugcuggaugcggagccgc

SEQ ID NO: 3922438 - RNA, 12 nt, Human adenovirus D
cccggacagcaa

SEQ ID NO: 3922439 - RNA, 13 nt, Human adenovirus D
cccggacagcaag

SEQ ID NO: 3922440 - RNA, 19 nt, Human adenovirus D
cccggacgucaccugcggc

SEQ ID NO: 3922441 - RNA, 16 nt, Human adenovirus D
cccgggucucccccag

SEQ ID NO: 3922442 - RNA, 14 nt, Human adenovirus D
cccguccugcgcca

SEQ ID NO: 3922443 - RNA, 15 nt, Human adenovirus D
cccguucucgcuggu

SEQ ID NO: 3922444 - RNA, 23 nt, Human adenovirus D
cccuccacuuucauaaucaggca

SEQ ID NO: 3922445 - RNA, 13 nt, Human adenovirus D
cccucccucggcu

SEQ ID NO: 3922446 - RNA, 17 nt, Human adenovirus D
cccuccgcccugagcuc

SEQ ID NO: 3922447 - RNA, 15 nt, Human adenovirus D
cccugacccagcagg

SEQ ID NO: 3922448 - RNA, 18 nt, Human adenovirus D
cccugcaagugcacagac

SEQ ID NO: 3922449 - RNA, 19 nt, Human adenovirus D
cccugcaagugcacagacc

SEQ ID NO: 3922450 - RNA, 15 nt, Human adenovirus D
cccugcauggcugcg

SEQ ID NO: 3922451 - RNA, 15 nt, Human adenovirus D
cccugcucaccugca

SEQ ID NO: 3922452 - RNA, 22 nt, Human adenovirus D
cccuggagacgggcugcuucug

SEQ ID NO: 3922453 - RNA, 19 nt, Human adenovirus D
cccuggccgaccggagcga

SEQ ID NO: 3922454 - RNA, 17 nt, Human adenovirus D
cccuggcucccagccuc

SEQ ID NO: 3922455 - RNA, 22 nt, Human adenovirus D
cccugggcauagucgcgccgcg

SEQ ID NO: 3922456 - RNA, 22 nt, Human adenovirus D
cccuggugauacgaggcagagg

SEQ ID NO: 3922457 - RNA, 23 nt, Human adenovirus D
ccgaccuugcaaaagcgccagga

SEQ ID NO: 3922458 - RNA, 23 nt, Human adenovirus D
ccgacgauguagaguuccaugaa

SEQ ID NO: 3922459 - RNA, 14 nt, Human adenovirus D
ccgagaccgugagc

SEQ ID NO: 3922460 - RNA, 15 nt, Human adenovirus D
ccgagaccugcgcaa

SEQ ID NO: 3922461 - RNA, 21 nt, Human adenovirus D
ccgagcuccgcgaacagcagc

SEQ ID NO: 3922462 - RNA, 19 nt, Human adenovirus D
ccgagggucgcuggcugcu

SEQ ID NO: 3922463 - RNA, 20 nt, Human adenovirus D
ccgaguucagcuccaguggg

SEQ ID NO: 3922464 - RNA, 21 nt, Human adenovirus D
ccgcaccgccacccgccgccg

SEQ ID NO: 3922465 - RNA, 22 nt, Human adenovirus D
ccgcagcuacaccucccucacc

SEQ ID NO: 3922466 - RNA, 22 nt, Human adenovirus D
ccgcaggaguccaccgcuccgc

SEQ ID NO: 3922467 - RNA, 20 nt, Human adenovirus D
ccgcaggcgcccagccagca

SEQ ID NO: 3922468 - RNA, 22 nt, Human adenovirus D
ccgcauccacaaggccgugagc

SEQ ID NO: 3922469 - RNA, 22 nt, Human adenovirus D
ccgccaucgaacacgccaccgc

SEQ ID NO: 3922470 - RNA, 15 nt, Human adenovirus D
ccgcccgacacugca

SEQ ID NO: 3922471 - RNA, 20 nt, Human adenovirus D
ccgccgaggcuagcacgcag

SEQ ID NO: 3922472 - RNA, 13 nt, Human adenovirus D
ccgccgcaccgcc

SEQ ID NO: 3922473 - RNA, 15 nt, Human adenovirus D
ccgcgacccccaggc

SEQ ID NO: 3922474 - RNA, 13 nt, Human adenovirus D
ccgcgaggccaua

SEQ ID NO: 3922475 - RNA, 16 nt, Human adenovirus D
ccgcgccagacgcacg

SEQ ID NO: 3922476 - RNA, 19 nt, Human adenovirus D
ccgcgccgacgcgcuccuc

SEQ ID NO: 3922477 - RNA, 20 nt, Human adenovirus D
ccgcgcgccgcgccgccacu

SEQ ID NO: 3922478 - RNA, 15 nt, Human adenovirus D
ccgcgcgcuggggca

SEQ ID NO: 3922479 - RNA, 18 nt, Human adenovirus D
ccgcguaagcaggagcag

SEQ ID NO: 3922480 - RNA, 21 nt, Human adenovirus D
ccgcguccccgcccgccgcca

SEQ ID NO: 3922481 - RNA, 14 nt, Human adenovirus D
ccgcgugcagcugc

SEQ ID NO: 3922482 - RNA, 17 nt, Human adenovirus D
ccgcucaucggccagac

SEQ ID NO: 3922483 - RNA, 22 nt, Human adenovirus D
ccgcuccaccgaaggcagcucc

SEQ ID NO: 3922484 - RNA, 21 nt, Human adenovirus D
ccgcucgcucguucugcccac

SEQ ID NO: 3922485 - RNA, 15 nt, Human adenovirus D
ccgcugcgcagcagu

SEQ ID NO: 3922486 - RNA, 16 nt, Human adenovirus D
ccgcugucucagccuc

SEQ ID NO: 3922487 - RNA, 23 nt, Human adenovirus D
ccgcugugcugguggaaacagac

SEQ ID NO: 3922488 - RNA, 21 nt, Human adenovirus D
ccggaguaucauugaugcaug

SEQ ID NO: 3922489 - RNA, 12 nt, Human adenovirus D
ccggcacggcgg

SEQ ID NO: 3922490 - RNA, 15 nt, Human adenovirus D
ccggcacggcggugg

SEQ ID NO: 3922491 - RNA, 20 nt, Human adenovirus D
ccggccgcgcuugcugggcg

SEQ ID NO: 3922492 - RNA, 20 nt, Human adenovirus D
ccggcgcacgucugacugcc

SEQ ID NO: 3922493 - RNA, 24 nt, Human adenovirus D
ccggcgcacgucugacugccgccg

SEQ ID NO: 3922494 - RNA, 22 nt, Human adenovirus D
ccggcgcuagccagccacagcc

SEQ ID NO: 3922495 - RNA, 18 nt, Human adenovirus D
ccggcggauagcgcgccg

SEQ ID NO: 3922496 - RNA, 20 nt, Human adenovirus D
ccggcugcucacgccgaacg

SEQ ID NO: 3922497 - RNA, 12 nt, Human adenovirus D
ccgggccugggc

SEQ ID NO: 3922498 - RNA, 23 nt, Human adenovirus D
ccgggcucugugaacagcggcag

SEQ ID NO: 3922499 - RNA, 17 nt, Human adenovirus D
ccggggaggcaccaccu

SEQ ID NO: 3922500 - RNA, 16 nt, Human adenovirus D
ccgggucucccccagc

SEQ ID NO: 3922501 - RNA, 15 nt, Human adenovirus D
ccgggucuggugcag

SEQ ID NO: 3922502 - RNA, 17 nt, Human adenovirus D
ccgggucuggugcaguu

SEQ ID NO: 3922503 - RNA, 14 nt, Human adenovirus D
ccggucgacgguga

SEQ ID NO: 3922504 - RNA, 19 nt, Human adenovirus D
ccggucgacggugagcagc

SEQ ID NO: 3922505 - RNA, 18 nt, Human adenovirus D
ccggugagacgcgcgcag

SEQ ID NO: 3922506 - RNA, 14 nt, Human adenovirus D
ccgucacccagaaa

SEQ ID NO: 3922507 - RNA, 11 nt, Human adenovirus D
ccguccucuga

SEQ ID NO: 3922508 - RNA, 14 nt, Human adenovirus D
ccgucgccacgguc

SEQ ID NO: 3922509 - RNA, 13 nt, Human adenovirus D
ccgucgccgcacc

SEQ ID NO: 3922510 - RNA, 16 nt, Human adenovirus D
ccgucggaagaggagu

SEQ ID NO: 3922511 - RNA, 18 nt, Human adenovirus D
ccgucuacucccagcuca

SEQ ID NO: 3922512 - RNA, 13 nt, Human adenovirus D
ccgugcgcaccac

SEQ ID NO: 3922513 - RNA, 15 nt, Human adenovirus D
ccgugcgcaccaccg

SEQ ID NO: 3922514 - RNA, 12 nt, Human adenovirus D
ccgugcgcaccc

SEQ ID NO: 3922515 - RNA, 17 nt, Human adenovirus D
ccgugcgcuaccacccc

SEQ ID NO: 3922516 - RNA, 24 nt, Human adenovirus D
ccgugugauuaaaaagcagcacag

SEQ ID NO: 3922517 - RNA, 17 nt, Human adenovirus D
ccucaaugucagcugca

SEQ ID NO: 3922518 - RNA, 18 nt, Human adenovirus D
ccucacaguccaggucac

SEQ ID NO: 3922519 - RNA, 11 nt, Human adenovirus D
ccucagccacu

SEQ ID NO: 3922520 - RNA, 21 nt, Human adenovirus D
ccucaucacaucagccaggac

SEQ ID NO: 3922521 - RNA, 23 nt, Human adenovirus D
ccucaugaacacacugcccauau

SEQ ID NO: 3922522 - RNA, 20 nt, Human adenovirus D
ccuccgggacgcccuggccg

SEQ ID NO: 3922523 - RNA, 15 nt, Human adenovirus D
ccuccgucggaagag

SEQ ID NO: 3922524 - RNA, 16 nt, Human adenovirus D
ccuccgucggaagagg

SEQ ID NO: 3922525 - RNA, 22 nt, Human adenovirus D
ccucgaaucaggcuggagccgc

SEQ ID NO: 3922526 - RNA, 21 nt, Human adenovirus D
ccucgagcuacaugcccagca

SEQ ID NO: 3922527 - RNA, 20 nt, Human adenovirus D
ccucgaugaugccgcagugg

SEQ ID NO: 3922528 - RNA, 20 nt, Human adenovirus D
ccucgccgucuacucccagc

SEQ ID NO: 3922529 - RNA, 14 nt, Human adenovirus D
ccucgcgcaacugg

SEQ ID NO: 3922530 - RNA, 15 nt, Human adenovirus D
ccucggaccuggccg

SEQ ID NO: 3922531 - RNA, 14 nt, Human adenovirus D
ccucguucauccag

SEQ ID NO: 3922532 - RNA, 16 nt, Human adenovirus D
ccucucgugcuccggc

SEQ ID NO: 3922533 - RNA, 17 nt, Human adenovirus D
ccucuugcagcuggcca

SEQ ID NO: 3922534 - RNA, 17 nt, Human adenovirus D
ccugacacaaaacuaau

SEQ ID NO: 3922535 - RNA, 18 nt, Human adenovirus D
ccugacgacccgcaaccc

SEQ ID NO: 3922536 - RNA, 13 nt, Human adenovirus D
ccugagcccgggu

SEQ ID NO: 3922537 - RNA, 18 nt, Human adenovirus D
ccugagccgccagcuggc

SEQ ID NO: 3922538 - RNA, 20 nt, Human adenovirus D
ccugagcgagacccagguca

SEQ ID NO: 3922539 - RNA, 15 nt, Human adenovirus D
ccugaucucugccau

SEQ ID NO: 3922540 - RNA, 19 nt, Human adenovirus D
ccugaugaacaacgccauc

SEQ ID NO: 3922541 - RNA, 14 nt, Human adenovirus D
ccugcaagaggaga

SEQ ID NO: 3922542 - RNA, 15 nt, Human adenovirus D
aacgccaggcuggcc

SEQ ID NO: 3922543 - RNA, 16 nt, Human adenovirus D
aacgcccugcuggagc

SEQ ID NO: 3922544 - RNA, 19 nt, Human adenovirus D
aacggcugcauccacugcu

SEQ ID NO: 3922545 - RNA, 22 nt, Human adenovirus D
aacggcugcauccacugcuccu

SEQ ID NO: 3922546 - RNA, 23 nt, Human adenovirus D
aacuacucggugcuuagccuggg

SEQ ID NO: 3922547 - RNA, 21 nt, Human adenovirus D
aacuacuugcaaguggggcgg

SEQ ID NO: 3922548 - RNA, 23 nt, Human adenovirus D
aacuuccugaccacgguggugca

SEQ ID NO: 3922549 - RNA, 14 nt, Human adenovirus D
aagaacauccaugu

SEQ ID NO: 3922550 - RNA, 17 nt, Human adenovirus D
aagaacgagggccuggg

SEQ ID NO: 3922551 - RNA, 15 nt, Human adenovirus D
aagaagacuauaaag

SEQ ID NO: 3922552 - RNA, 13 nt, Human adenovirus D
aagaaguggccag

SEQ ID NO: 3922553 - RNA, 16 nt, Human adenovirus D
aagaauccacagauca

SEQ ID NO: 3922554 - RNA, 23 nt, Human adenovirus D
aagaccauucugcacaccaacau

SEQ ID NO: 3922555 - RNA, 16 nt, Human adenovirus D
aagacgaaugggaaga

SEQ ID NO: 3922556 - RNA, 17 nt, Human adenovirus D
aagacgcaggccaggag

SEQ ID NO: 3922557 - RNA, 16 nt, Human adenovirus D
aagacguuucuggggu

SEQ ID NO: 3922558 - RNA, 21 nt, Human adenovirus D
aagaggcuccggguggaagau

SEQ ID NO: 3922559 - RNA, 15 nt, Human adenovirus D
aagagggagaggagc

SEQ ID NO: 3922560 - RNA, 23 nt, Human adenovirus D
aagauacagaguaaaaguaaaca

SEQ ID NO: 3922561 - RNA, 17 nt, Human adenovirus D
aagcaguucacuagccu

SEQ ID NO: 3922562 - RNA, 17 nt, Human adenovirus D
aagccucugacggcgca

SEQ ID NO: 3922563 - RNA, 21 nt, Human adenovirus D
aagccuucuauggaggcagag

SEQ ID NO: 3922564 - RNA, 16 nt, Human adenovirus D
aagcgggccucacagu

SEQ ID NO: 3922565 - RNA, 19 nt, Human adenovirus D
aagcgggccucacagucca

SEQ ID NO: 3922566 - RNA, 22 nt, Human adenovirus D
aagcggucgcgcgaagaggagc

SEQ ID NO: 3922567 - RNA, 13 nt, Human adenovirus D
aagcucccacagu

SEQ ID NO: 3922568 - RNA, 13 nt, Human adenovirus D
aagcuggccugcg

SEQ ID NO: 3922569 - RNA, 15 nt, Human adenovirus D
aaggcgcgcccaccc

SEQ ID NO: 3922570 - RNA, 16 nt, Human adenovirus D
aagggcaucuucugcc

SEQ ID NO: 3922571 - RNA, 20 nt, Human adenovirus D
aaggugguggacggccuggc

SEQ ID NO: 3922572 - RNA, 19 nt, Human adenovirus D
aaguacauagugaccaaga

SEQ ID NO: 3922573 - RNA, 22 nt, Human adenovirus D
aagucacaguuauaccaccucc

SEQ ID NO: 3922574 - RNA, 19 nt, Human adenovirus D
aaguguggaagucaaauau

SEQ ID NO: 3922575 - RNA, 23 nt, Human adenovirus D
aauaaaaaacuugagcuuguuua

SEQ ID NO: 3922576 - RNA, 12 nt, Human adenovirus D
aauaagucacua

SEQ ID NO: 3922577 - RNA, 14 nt, Human adenovirus D
aaucagccccuucc

SEQ ID NO: 3922578 - RNA, 13 nt, Human adenovirus D
aaucgcggcggcc

SEQ ID NO: 3922579 - RNA, 15 nt, Human adenovirus D
aaucgcggcggccau

SEQ ID NO: 3922580 - RNA, 11 nt, Human adenovirus D
aaucugcauga

SEQ ID NO: 3922581 - RNA, 18 nt, Human adenovirus D
aaugcaggauccagcgcu

SEQ ID NO: 3922582 - RNA, 14 nt, Human adenovirus D
aauggcgugcugga

SEQ ID NO: 3922583 - RNA, 15 nt, Human adenovirus D
aauggcgugcuggag

SEQ ID NO: 3922584 - RNA, 14 nt, Human adenovirus D
aauuacagucacua

SEQ ID NO: 3922585 - RNA, 20 nt, Human adenovirus D
aauuuuuguuguacucugug

SEQ ID NO: 3922586 - RNA, 13 nt, Human adenovirus D
acaaagcugaaag

SEQ ID NO: 3922587 - RNA, 13 nt, Human adenovirus D
acaacagccgcag

SEQ ID NO: 3922588 - RNA, 19 nt, Human adenovirus D
acaaccagauccucugccg

SEQ ID NO: 3922589 - RNA, 20 nt, Human adenovirus D
acaacuacacagucaacugu

SEQ ID NO: 3922590 - RNA, 19 nt, Human adenovirus D
acaagcgccaacagcagcg

SEQ ID NO: 3922591 - RNA, 13 nt, Human adenovirus D
acaagcuggccug

SEQ ID NO: 3922592 - RNA, 12 nt, Human adenovirus D
acaaggcgcgcu

SEQ ID NO: 3922593 - RNA, 18 nt, Human adenovirus D
acaauaaaagaccaauaa

SEQ ID NO: 3922594 - RNA, 16 nt, Human adenovirus D
acaaucagccccuucc

SEQ ID NO: 3922595 - RNA, 21 nt, Human adenovirus D
acaaucuggcgguaccagggg

SEQ ID NO: 3922596 - RNA, 20 nt, Human adenovirus D
acacgggguugcagcacugg

SEQ ID NO: 3922597 - RNA, 21 nt, Human adenovirus D
acacugcagggagccagggga

SEQ ID NO: 3922598 - RNA, 13 nt, Human adenovirus D
acagagagccgcc

SEQ ID NO: 3922599 - RNA, 22 nt, Human adenovirus D
acagauuugaauugcaaauuga

SEQ ID NO: 3922600 - RNA, 16 nt, Human adenovirus D
acagcauauaccccuc

SEQ ID NO: 3922601 - RNA, 13 nt, Human adenovirus D
acagccagcagcu

SEQ ID NO: 3922602 - RNA, 14 nt, Human adenovirus D
acagccagcagcuc

SEQ ID NO: 3922603 - RNA, 17 nt, Human adenovirus D
acagcgccacgaccggc

SEQ ID NO: 3922604 - RNA, 14 nt, Human adenovirus D
acagcgugguggcg

SEQ ID NO: 3922605 - RNA, 16 nt, Human adenovirus D
acagcguuccccuccg

SEQ ID NO: 3922606 - RNA, 19 nt, Human adenovirus D
acagcuagacaccacagug

SEQ ID NO: 3922607 - RNA, 20 nt, Human adenovirus D
acagcucgcgguugagggcg

SEQ ID NO: 3922608 - RNA, 20 nt, Human adenovirus D
acaguaaguuccugucuucu

SEQ ID NO: 3922609 - RNA, 21 nt, Human adenovirus D
acaguccacccagaccgugca

SEQ ID NO: 3922610 - RNA, 21 nt, Human adenovirus D
acaguuauaccaccuccuccu

SEQ ID NO: 3922611 - RNA, 14 nt, Human adenovirus D
acauagaccacgcu

SEQ ID NO: 3922612 - RNA, 14 nt, Human adenovirus D
acauauuggaacuu

SEQ ID NO: 3922613 - RNA, 17 nt, Human adenovirus D
acaucaauuuugcgucc

SEQ ID NO: 3922614 - RNA, 15 nt, Human adenovirus D
acauccuggaccagg

SEQ ID NO: 3922615 - RNA, 16 nt, Human adenovirus D
acaucugugcugccuu

SEQ ID NO: 3922616 - RNA, 11 nt, Human adenovirus D
acaugacaugg

SEQ ID NO: 3922617 - RNA, 23 nt, Human adenovirus D
acaugcagcugccgucgucccgg

SEQ ID NO: 3922618 - RNA, 17 nt, Human adenovirus D
acaugcucuaccccauc

SEQ ID NO: 3922619 - RNA, 17 nt, Human adenovirus D
acauggaaccuagcaug

SEQ ID NO: 3922620 - RNA, 18 nt, Human adenovirus D
acauggcaagcugccaug

SEQ ID NO: 3922621 - RNA, 23 nt, Human adenovirus D
acaugggcaugagcccgucccgg

SEQ ID NO: 3922622 - RNA, 12 nt, Human adenovirus D
acauguggagcu

SEQ ID NO: 3922623 - RNA, 22 nt, Human adenovirus D
acauuccugcaccauccccagg

SEQ ID NO: 3922624 - RNA, 11 nt, Human adenovirus D
accaaccagac

SEQ ID NO: 3922625 - RNA, 19 nt, Human adenovirus D
accaacuggucuccugccu

SEQ ID NO: 3922626 - RNA, 17 nt, Human adenovirus D
accaaguccaggguagc

SEQ ID NO: 3922627 - RNA, 13 nt, Human adenovirus D
accacaccuguga

SEQ ID NO: 3922628 - RNA, 15 nt, Human adenovirus D
accacaccuucaaga

SEQ ID NO: 3922629 - RNA, 15 nt, Human adenovirus D
accaccccagcaucc

SEQ ID NO: 3922630 - RNA, 14 nt, Human adenovirus D
accacuggccccgu

SEQ ID NO: 3922631 - RNA, 14 nt, Human adenovirus D
accagaaagacuaa

SEQ ID NO: 3922632 - RNA, 18 nt, Human adenovirus D
accagaacuuccagcaga

SEQ ID NO: 3922633 - RNA, 16 nt, Human adenovirus D
accagacccaggcgcg

SEQ ID NO: 3922634 - RNA, 22 nt, Human adenovirus D
accagauccucugccguccgcc

SEQ ID NO: 3922635 - RNA, 20 nt, Human adenovirus D
accagaugcggcaguauauc

SEQ ID NO: 3922636 - RNA, 13 nt, Human adenovirus D
accaggaugcagc

SEQ ID NO: 3922637 - RNA, 16 nt, Human adenovirus D
accaggaugcagccag

SEQ ID NO: 3922638 - RNA, 23 nt, Human adenovirus D
accaugaaggggcucuugcugau

SEQ ID NO: 3922639 - RNA, 20 nt, Human adenovirus D
acccacgugguauacaagcc

SEQ ID NO: 3922640 - RNA, 16 nt, Human adenovirus D
acccacucuauuuuca

SEQ ID NO: 3922641 - RNA, 17 nt, Human adenovirus D
acccagagcuuagcaag

SEQ ID NO: 3922642 - RNA, 20 nt, Human adenovirus D
accccgaugacggguugcag

SEQ ID NO: 3922643 - RNA, 22 nt, Human adenovirus D
accccgccauaagggcggcgcu

SEQ ID NO: 3922644 - RNA, 20 nt, Human adenovirus D
accccuuacauguggagcua

SEQ ID NO: 3922645 - RNA, 13 nt, Human adenovirus D
acccgaggagcgg

SEQ ID NO: 3922646 - RNA, 21 nt, Human adenovirus D
acccgauaucgcgcauccugc

SEQ ID NO: 3922647 - RNA, 14 nt, Human adenovirus D
acccgccucuccuu

SEQ ID NO: 3922648 - RNA, 18 nt, Human adenovirus D
acccgcggccgcccacgg

SEQ ID NO: 3922649 - RNA, 18 nt, Human adenovirus D
acccggacguggugcugc

SEQ ID NO: 3922650 - RNA, 22 nt, Human adenovirus D
acccggacguggugcugcugcc

SEQ ID NO: 3922651 - RNA, 18 nt, Human adenovirus D
acccggcccguggucagc

SEQ ID NO: 3922652 - RNA, 21 nt, Human adenovirus D
acccgguucgcggacggccgc

SEQ ID NO: 3922653 - RNA, 13 nt, Human adenovirus D
acccguccuccuc

SEQ ID NO: 3922654 - RNA, 19 nt, Human adenovirus D
acccuaaucaauguaacua

SEQ ID NO: 3922655 - RNA, 22 nt, Human adenovirus D
acccucagaagaagaccacccg

SEQ ID NO: 3922656 - RNA, 14 nt, Human adenovirus D
acccugugaccaag

SEQ ID NO: 3922657 - RNA, 14 nt, Human adenovirus D
accgacgcugggcu

SEQ ID NO: 3922658 - RNA, 22 nt, Human adenovirus D
accgcagcggggaggagcccga

SEQ ID NO: 3922659 - RNA, 12 nt, Human adenovirus D
accgccuccccg

SEQ ID NO: 3922660 - RNA, 20 nt, Human adenovirus D
accgccuccccgcagaaauc

SEQ ID NO: 3922661 - RNA, 13 nt, Human adenovirus D
accgccuggggca

SEQ ID NO: 3922662 - RNA, 17 nt, Human adenovirus D
accgcugucucagccuc

SEQ ID NO: 3922663 - RNA, 14 nt, Human adenovirus D
accggaggcuggcu

SEQ ID NO: 3922664 - RNA, 18 nt, Human adenovirus D
accguagagggcaccacc

SEQ ID NO: 3922665 - RNA, 17 nt, Human adenovirus D
accgucaccuucacagc

SEQ ID NO: 3922666 - RNA, 14 nt, Human adenovirus D
accucaucgccacc

SEQ ID NO: 3922667 - RNA, 15 nt, Human adenovirus D
accucccucacccac

SEQ ID NO: 3922668 - RNA, 13 nt, Human adenovirus D
accuccugggcau

SEQ ID NO: 3922669 - RNA, 17 nt, Human adenovirus D
accucgguacccuccuc

SEQ ID NO: 3922670 - RNA, 17 nt, Human adenovirus D
accucuacgccaccuuc

SEQ ID NO: 3922671 - RNA, 21 nt, Human adenovirus D
accugaacgacucgcugcugc

SEQ ID NO: 3922672 - RNA, 23 nt, Human adenovirus D
accugaacgacucgcugcugcag

SEQ ID NO: 3922673 - RNA, 18 nt, Human adenovirus D
accugaaggagcuggaca

SEQ ID NO: 3922674 - RNA, 22 nt, Human adenovirus D
accugcgcaaggucgaggagac

SEQ ID NO: 3922675 - RNA, 14 nt, Human adenovirus D
accugcuacauguu

SEQ ID NO: 3922676 - RNA, 17 nt, Human adenovirus D
accuggugauggccugu

SEQ ID NO: 3922677 - RNA, 21 nt, Human adenovirus D
accuucaagaaagucuccauc

SEQ ID NO: 3922678 - RNA, 13 nt, Human adenovirus D
accuuccugcagc

SEQ ID NO: 3922679 - RNA, 16 nt, Human adenovirus D
accuuccugcagcuca

SEQ ID NO: 3922680 - RNA, 21 nt, Human adenovirus D
acgacauccuggaccaggcgg

SEQ ID NO: 3922681 - RNA, 16 nt, Human adenovirus D
acgacccgcaaccccg

SEQ ID NO: 3922682 - RNA, 23 nt, Human adenovirus D
acgaccucgccgucuacucccag

SEQ ID NO: 3922683 - RNA, 12 nt, Human adenovirus D
acgaccugggcg

SEQ ID NO: 3922684 - RNA, 14 nt, Human adenovirus D
acgacucgcugcug

SEQ ID NO: 3922685 - RNA, 15 nt, Human adenovirus D
acgagcggcagggcu

SEQ ID NO: 3922686 - RNA, 14 nt, Human adenovirus D
acgaggcagaggca

SEQ ID NO: 3922687 - RNA, 19 nt, Human adenovirus D
acgcacgagaaggugcugg

SEQ ID NO: 3922688 - RNA, 13 nt, Human adenovirus D
acgcacgggccgc

SEQ ID NO: 3922689 - RNA, 22 nt, Human adenovirus D
acgccggcucaucugcagggcg

SEQ ID NO: 3922690 - RNA, 23 nt, Human adenovirus D
acgccguucuccgccggaaacgc

SEQ ID NO: 3922691 - RNA, 19 nt, Human adenovirus D
acgccucggaguaccugag

SEQ ID NO: 3922692 - RNA, 14 nt, Human adenovirus D
acgccuuccuggcg

SEQ ID NO: 3922693 - RNA, 16 nt, Human adenovirus D
acgcgcacacuuugga

SEQ ID NO: 3922694 - RNA, 19 nt, Human adenovirus D
acgcugaaaggcgggcugc

SEQ ID NO: 3922695 - RNA, 22 nt, Human adenovirus D
acgcugagcgacgaccugggcg

SEQ ID NO: 3922696 - RNA, 19 nt, Human adenovirus D
acggacuugauuggccugu

SEQ ID NO: 3922697 - RNA, 17 nt, Human adenovirus D
acggcaucuuccugggg

SEQ ID NO: 3922698 - RNA, 19 nt, Human adenovirus D
acggcaucuuccuggggca

SEQ ID NO: 3922699 - RNA, 19 nt, Human adenovirus D
acggccuuguagggacagc

SEQ ID NO: 3922700 - RNA, 20 nt, Human adenovirus D
acggcugcauccacugcucc

SEQ ID NO: 3922701 - RNA, 16 nt, Human adenovirus D
acgggauagagagucu

SEQ ID NO: 3922702 - RNA, 19 nt, Human adenovirus D
acggggugguggacaucgc

SEQ ID NO: 3922703 - RNA, 21 nt, Human adenovirus D
acggucugcaggccgggcugc

SEQ ID NO: 3922704 - RNA, 16 nt, Human adenovirus D
acgguggugcagaaca

SEQ ID NO: 3922705 - RNA, 12 nt, Human adenovirus D
acuaaucauuua

SEQ ID NO: 3922706 - RNA, 14 nt, Human adenovirus D
acuaaucauuuaau

SEQ ID NO: 3922707 - RNA, 16 nt, Human adenovirus D
acuaaugacaaacaaa

SEQ ID NO: 3922708 - RNA, 20 nt, Human adenovirus D
acuacaaggacuacaaggcc

SEQ ID NO: 3922709 - RNA, 10 nt, Human adenovirus D
acuacagccg

SEQ ID NO: 3922710 - RNA, 23 nt, Human adenovirus D
acuacucggugcuuagccugggc

SEQ ID NO: 3922711 - RNA, 16 nt, Human adenovirus D
acuacugaacagacag

SEQ ID NO: 3922712 - RNA, 21 nt, Human adenovirus D
acuacuuccgcgugacgcacu

SEQ ID NO: 3922713 - RNA, 14 nt, Human adenovirus D
acuaggaccccagg

SEQ ID NO: 3922714 - RNA, 18 nt, Human adenovirus D
acuaggaccccagggacc

SEQ ID NO: 3922715 - RNA, 16 nt, Human adenovirus D
acuauaaagucacagu

SEQ ID NO: 3922716 - RNA, 17 nt, Human adenovirus D
acuaucuaugaaagcau

SEQ ID NO: 3922717 - RNA, 15 nt, Human adenovirus D
acuauugcuucccau

SEQ ID NO: 3922718 - RNA, 11 nt, Human adenovirus D
acuccacagcc

SEQ ID NO: 3922719 - RNA, 19 nt, Human adenovirus D
acucccagcgccgcgcugg

SEQ ID NO: 3922720 - RNA, 20 nt, Human adenovirus D
acuccgcgaccuccucccca

SEQ ID NO: 3922721 - RNA, 22 nt, Human adenovirus D
acuccuacaaguacacgccggc

SEQ ID NO: 3922722 - RNA, 18 nt, Human adenovirus D
acuccuacaauacucugg

SEQ ID NO: 3922723 - RNA, 21 nt, Human adenovirus D
acuccucggucagcuggcccg

SEQ ID NO: 3922724 - RNA, 21 nt, Human adenovirus D
acuccuucuuccgcaacuucc

SEQ ID NO: 3922725 - RNA, 21 nt, Human adenovirus D
acucgacccugaagggcgagg

SEQ ID NO: 3922726 - RNA, 14 nt, Human adenovirus D
acucgcggcugcug

SEQ ID NO: 3922727 - RNA, 12 nt, Human adenovirus D
acucgcugcugc

SEQ ID NO: 3922728 - RNA, 19 nt, Human adenovirus D
acucggugcuuagccuggg

SEQ ID NO: 3922729 - RNA, 22 nt, Human adenovirus D
acucuccugaaccacacggcca

SEQ ID NO: 3922730 - RNA, 18 nt, Human adenovirus D
acucugcucauacugcua

SEQ ID NO: 3922731 - RNA, 14 nt, Human adenovirus D
acucuggccguggg

SEQ ID NO: 3922732 - RNA, 15 nt, Human adenovirus D
acucuuaaagacuaa

SEQ ID NO: 3922733 - RNA, 16 nt, Human adenovirus D
acucuuaaaucauuua

SEQ ID NO: 3922734 - RNA, 18 nt, Human adenovirus D
acucuuaaaucauuuaaa

SEQ ID NO: 3922735 - RNA, 15 nt, Human adenovirus D
acugaccaccaccug

SEQ ID NO: 3922736 - RNA, 15 nt, Human adenovirus D
acugccgcugcaacc

SEQ ID NO: 3922737 - RNA, 14 nt, Human adenovirus D
acugcuaccucuug

SEQ ID NO: 3922738 - RNA, 22 nt, Human adenovirus D
acugcuaucaggagaaaauuga

SEQ ID NO: 3922739 - RNA, 18 nt, Human adenovirus D
acugcuggcccugcuggc

SEQ ID NO: 3922740 - RNA, 22 nt, Human adenovirus D
acuggcuucuacagccagcagc

SEQ ID NO: 3922741 - RNA, 13 nt, Human adenovirus D
acuggguggcccu

SEQ ID NO: 3922742 - RNA, 19 nt, Human adenovirus D
acuggucuccugccuggga

SEQ ID NO: 3922743 - RNA, 15 nt, Human adenovirus D
acuguaaagccacaa

SEQ ID NO: 3922744 - RNA, 20 nt, Human adenovirus D
acuuacuugaaaucugaaag

SEQ ID NO: 3922745 - RNA, 22 nt, Human adenovirus D
acuuagaagagcccccuccccg

SEQ ID NO: 3922746 - RNA, 20 nt, Human adenovirus D
acuucagccugggcaacaag

SEQ ID NO: 3922747 - RNA, 22 nt, Human adenovirus D
acuuccucguuucggggguugg

SEQ ID NO: 3922748 - RNA, 16 nt, Human adenovirus D
acuugacuuccggguu

SEQ ID NO: 3922749 - RNA, 16 nt, Human adenovirus D
acuugccgccugcgca

SEQ ID NO: 3922750 - RNA, 21 nt, Human adenovirus D
acuuugguacuuacaaagugu

SEQ ID NO: 3922751 - RNA, 21 nt, Human adenovirus D
acuuugucugcuguaaagcca

SEQ ID NO: 3922752 - RNA, 22 nt, Human adenovirus D
acuuuugcccuuacauguaacu

SEQ ID NO: 3922753 - RNA, 19 nt, Human adenovirus D
agaaaauugauaugcccuc

SEQ ID NO: 3922754 - RNA, 14 nt, Human adenovirus D
agaaacaagucaaa

SEQ ID NO: 3922755 - RNA, 18 nt, Human adenovirus D
agaaacgucccagcagca

SEQ ID NO: 3922756 - RNA, 20 nt, Human adenovirus D
agaacacccaacugagcagg

SEQ ID NO: 3922757 - RNA, 21 nt, Human adenovirus D
agaacacccaacugagcaggg

SEQ ID NO: 3922758 - RNA, 21 nt, Human adenovirus D
agaacccggacagcaagccuc

SEQ ID NO: 3922759 - RNA, 17 nt, Human adenovirus D
agaaccugaaggagcug

SEQ ID NO: 3922760 - RNA, 14 nt, Human adenovirus D
agaacgagggccug

SEQ ID NO: 3922761 - RNA, 18 nt, Human adenovirus D
agaacgagggccugggcu

SEQ ID NO: 3922762 - RNA, 15 nt, Human adenovirus D
agaagaacaggagcc

SEQ ID NO: 3922763 - RNA, 19 nt, Human adenovirus D
agaagaaugggacagccag

SEQ ID NO: 3922764 - RNA, 15 nt, Human adenovirus D
agaagagcccccucc

SEQ ID NO: 3922765 - RNA, 17 nt, Human adenovirus D
agaaggguuaacauuug

SEQ ID NO: 3922766 - RNA, 15 nt, Human adenovirus D
agaaggugcuggcga

SEQ ID NO: 3922767 - RNA, 13 nt, Human adenovirus D
agaaguuccucug

SEQ ID NO: 3922768 - RNA, 17 nt, Human adenovirus D
agacacuugagcuggcc

SEQ ID NO: 3922769 - RNA, 22 nt, Human adenovirus D
agacaucauaauuaugcuccug

SEQ ID NO: 3922770 - RNA, 14 nt, Human adenovirus D
agacauggccagca

SEQ ID NO: 3922771 - RNA, 14 nt, Human adenovirus D
agaccaccugguga

SEQ ID NO: 3922772 - RNA, 21 nt, Human adenovirus D
agaccaccuggugauggccug

SEQ ID NO: 3922773 - RNA, 17 nt, Human adenovirus D
agacccggagcccaccc

SEQ ID NO: 3922774 - RNA, 18 nt, Human adenovirus D
agacgauccugcaggugg

SEQ ID NO: 3922775 - RNA, 23 nt, Human adenovirus D
agacgcugaaaggcgggcugccc

SEQ ID NO: 3922776 - RNA, 16 nt, Human adenovirus D
agacucauccugcugg

SEQ ID NO: 3922777 - RNA, 16 nt, Human adenovirus D
agacugauggccacgg

SEQ ID NO: 3922778 - RNA, 21 nt, Human adenovirus D
agagaaggguuaacauuugac

SEQ ID NO: 3922779 - RNA, 22 nt, Human adenovirus D
agagaaggguuaacauuugaca

SEQ ID NO: 3922780 - RNA, 19 nt, Human adenovirus D
agagaaguuuaauggggug

SEQ ID NO: 3922781 - RNA, 13 nt, Human adenovirus D
agagccggcgggc

SEQ ID NO: 3922782 - RNA, 21 nt, Human adenovirus D
agaggagucgccggaggaggc

SEQ ID NO: 3922783 - RNA, 16 nt, Human adenovirus D
agaggcgacccaugau

SEQ ID NO: 3922784 - RNA, 15 nt, Human adenovirus D
agaggcgagcagcug

SEQ ID NO: 3922785 - RNA, 17 nt, Human adenovirus D
agagucugaaaaacaga

SEQ ID NO: 3922786 - RNA, 20 nt, Human adenovirus D
agaucaccuacgagcucgug

SEQ ID NO: 3922787 - RNA, 13 nt, Human adenovirus D
agauccagguccg

SEQ ID NO: 3922788 - RNA, 18 nt, Human adenovirus D
agaucccgccgcaggaga

SEQ ID NO: 3922789 - RNA, 16 nt, Human adenovirus D
agauccugcugcucca

SEQ ID NO: 3922790 - RNA, 19 nt, Human adenovirus D
agaugaggcgugcgguggu

SEQ ID NO: 3922791 - RNA, 23 nt, Human adenovirus D
agaugcagcaagccccggacccc

SEQ ID NO: 3922792 - RNA, 16 nt, Human adenovirus D
agaugccgggacagag

SEQ ID NO: 3922793 - RNA, 20 nt, Human adenovirus D
agauggaagaagaaugggac

SEQ ID NO: 3922794 - RNA, 21 nt, Human adenovirus D
agauguggguuggcuugcaug

SEQ ID NO: 3922795 - RNA, 21 nt, Human adenovirus D
agauucaauaagguucugccc

SEQ ID NO: 3922796 - RNA, 15 nt, Human adenovirus D
agcaaacgccgccgc

SEQ ID NO: 3922797 - RNA, 22 nt, Human adenovirus D
agcaagccucugacggcgcagc

SEQ ID NO: 3922798 - RNA, 18 nt, Human adenovirus D
agcaagggcgaccagcuc

SEQ ID NO: 3922799 - RNA, 20 nt, Human adenovirus D
agcaagggcgaccagcucug

SEQ ID NO: 3922800 - RNA, 20 nt, Human adenovirus D
agcaaguuuaaggcgcgggu

SEQ ID NO: 3922801 - RNA, 12 nt, Human adenovirus D
agcaauaccacc

SEQ ID NO: 3922802 - RNA, 16 nt, Human adenovirus D
agcaauccuccaggac

SEQ ID NO: 3922803 - RNA, 23 nt, Human adenovirus D
agcacccaaaaacugcaugcugg

SEQ ID NO: 3922804 - RNA, 20 nt, Human adenovirus D
agcaccucgguacccuccuc

SEQ ID NO: 3922805 - RNA, 21 nt, Human adenovirus D
agcacgcccgccauggggcgc

SEQ ID NO: 3922806 - RNA, 14 nt, Human adenovirus D
agcagaggaagagg

SEQ ID NO: 3922807 - RNA, 12 nt, Human adenovirus D
agcagcggcgca

SEQ ID NO: 3922808 - RNA, 17 nt, Human adenovirus D
agcagcuugcgcgcugg

SEQ ID NO: 3922809 - RNA, 19 nt, Human adenovirus D
agcagcuugcgcgcuggcu

SEQ ID NO: 3922810 - RNA, 23 nt, Human adenovirus D
agcagcuugcgcgcuggcuuggu

SEQ ID NO: 3922811 - RNA, 21 nt, Human adenovirus D
agcagcuugcugacgcccaac

SEQ ID NO: 3922812 - RNA, 15 nt, Human adenovirus D
agcaggaccugggcu

SEQ ID NO: 3922813 - RNA, 16 nt, Human adenovirus D
agcaggaccugggcuu

SEQ ID NO: 3922814 - RNA, 16 nt, Human adenovirus D
agcaggagcaggagga

SEQ ID NO: 3922815 - RNA, 19 nt, Human adenovirus D
agcaggagugcagggauga

SEQ ID NO: 3922816 - RNA, 21 nt, Human adenovirus D
agcaguauccgcggaguccag

SEQ ID NO: 3922817 - RNA, 17 nt, Human adenovirus D
agcaguccaugcccaac

SEQ ID NO: 3922818 - RNA, 23 nt, Human adenovirus D
agcaguguguguuugagaaaugc

SEQ ID NO: 3922819 - RNA, 16 nt, Human adenovirus D
agcauauaccccuccu

SEQ ID NO: 3922820 - RNA, 13 nt, Human adenovirus D
agcaucaaaaauu

SEQ ID NO: 3922821 - RNA, 12 nt, Human adenovirus D
agcauguggaac

SEQ ID NO: 3922822 - RNA, 19 nt, Human adenovirus D
agccaagaaacgucccagc

SEQ ID NO: 3922823 - RNA, 19 nt, Human adenovirus D
agccacagccacagacaga

SEQ ID NO: 3922824 - RNA, 19 nt, Human adenovirus D
agccacgauguaacaucac

SEQ ID NO: 3922825 - RNA, 20 nt, Human adenovirus D
agccaggucaaaacccacuc

SEQ ID NO: 3922826 - RNA, 21 nt, Human adenovirus D
agccaggucaaaacccacucu

SEQ ID NO: 3922827 - RNA, 17 nt, Human adenovirus D
agccaggugagcucggg

SEQ ID NO: 3922828 - RNA, 18 nt, Human adenovirus D
agccauugaccaccaggg

SEQ ID NO: 3922829 - RNA, 15 nt, Human adenovirus D
agcccaaacuggggc

SEQ ID NO: 3922830 - RNA, 21 nt, Human adenovirus D
agcccccuuuuuucuuuuugc

SEQ ID NO: 3922831 - RNA, 17 nt, Human adenovirus D
agccccggaccccgcca

SEQ ID NO: 3922832 - RNA, 15 nt, Human adenovirus D
agccccucugugccc

SEQ ID NO: 3922833 - RNA, 19 nt, Human adenovirus D
agcccugagccgccagcug

SEQ ID NO: 3922834 - RNA, 22 nt, Human adenovirus D
agcccugagccgccagcuggcc

SEQ ID NO: 3922835 - RNA, 16 nt, Human adenovirus D
agcccugcgcccagau

SEQ ID NO: 3922836 - RNA, 13 nt, Human adenovirus D
agccgcaggcgcc

SEQ ID NO: 3922837 - RNA, 17 nt, Human adenovirus D
agccgcaggcgcccagc

SEQ ID NO: 3922838 - RNA, 12 nt, Human adenovirus D
agccgccagcug

SEQ ID NO: 3922839 - RNA, 18 nt, Human adenovirus D
agccgcgguuaugcaggg

SEQ ID NO: 3922840 - RNA, 19 nt, Human adenovirus D
agccgcguaagcaggagca

SEQ ID NO: 3922841 - RNA, 23 nt, Human adenovirus D
agccgucuggacccgcggccgcc

SEQ ID NO: 3922842 - RNA, 16 nt, Human adenovirus D
agccugaugagcucgg

SEQ ID NO: 3922843 - RNA, 23 nt, Human adenovirus D
agcgacacccccgcgugcagcug

SEQ ID NO: 3922844 - RNA, 13 nt, Human adenovirus D
agcgagacccagg

SEQ ID NO: 3922845 - RNA, 23 nt, Human adenovirus D
agcgauucccgggcuuucuugcc

SEQ ID NO: 3922846 - RNA, 13 nt, Human adenovirus D
agcgcauccugag

SEQ ID NO: 3922847 - RNA, 15 nt, Human adenovirus D
agcgccaacagcagc

SEQ ID NO: 3922848 - RNA, 16 nt, Human adenovirus D
agcgcccauuccugga

SEQ ID NO: 3922849 - RNA, 20 nt, Human adenovirus D
agcgcccauuccuggagaug

SEQ ID NO: 3922850 - RNA, 15 nt, Human adenovirus D
agcgcccucagcagu

SEQ ID NO: 3922851 - RNA, 15 nt, Human adenovirus D
agcgcgagggcgaga

SEQ ID NO: 3922852 - RNA, 18 nt, Human adenovirus D
agcggccagcgcugggug

SEQ ID NO: 3922853 - RNA, 13 nt, Human adenovirus D
agcggccgcggcc

SEQ ID NO: 3922854 - RNA, 16 nt, Human adenovirus D
agcggcgcaggggcau

SEQ ID NO: 3922855 - RNA, 16 nt, Human adenovirus D
agcgguggacggccac

SEQ ID NO: 3922856 - RNA, 14 nt, Human adenovirus D
agcgguucaagaac

SEQ ID NO: 3922857 - RNA, 22 nt, Human adenovirus D
agcuagcacccaaaaacugcau

SEQ ID NO: 3922858 - RNA, 16 nt, Human adenovirus D
cuuccaggagccugau

SEQ ID NO: 3922859 - RNA, 17 nt, Human adenovirus D
cuuccguucuacccagc

SEQ ID NO: 3922860 - RNA, 18 nt, Human adenovirus D
cuuccuauuuaacauccu

SEQ ID NO: 3922861 - RNA, 20 nt, Human adenovirus D
cuuccuggcgacgcagccgg

SEQ ID NO: 3922862 - RNA, 15 nt, Human adenovirus D
cuucgagcaguggcu

SEQ ID NO: 3922863 - RNA, 21 nt, Human adenovirus D
cuucuguacuuugucugcugu

SEQ ID NO: 3922864 - RNA, 19 nt, Human adenovirus D
cuucuuccgcaacuuccag

SEQ ID NO: 3922865 - RNA, 12 nt, Human adenovirus D
cuugaacagcau

SEQ ID NO: 3922866 - RNA, 22 nt, Human adenovirus D
cuugaacucggggaucaccagu

SEQ ID NO: 3922867 - RNA, 16 nt, Human adenovirus D
cuugagaugcagaugg

SEQ ID NO: 3922868 - RNA, 23 nt, Human adenovirus D
cuugcaagacagaaacaccgagc

SEQ ID NO: 3922869 - RNA, 23 nt, Human adenovirus D
cuugcacaguuggcgacccagga

SEQ ID NO: 3922870 - RNA, 12 nt, Human adenovirus D
cuugcagagcau

SEQ ID NO: 3922871 - RNA, 17 nt, Human adenovirus D
cuugcugacgcccaacu

SEQ ID NO: 3922872 - RNA, 16 nt, Human adenovirus D
cuuggcgauggaucuc

SEQ ID NO: 3922873 - RNA, 14 nt, Human adenovirus D
cuugguaugaugau

SEQ ID NO: 3922874 - RNA, 17 nt, Human adenovirus D
cuuggucacaugcuugg

SEQ ID NO: 3922875 - RNA, 15 nt, Human adenovirus D
cuuggugggcagagg

SEQ ID NO: 3922876 - RNA, 16 nt, Human adenovirus D
cuuguagggacagcag

SEQ ID NO: 3922877 - RNA, 14 nt, Human adenovirus D
cuuguguccucccc

SEQ ID NO: 3922878 - RNA, 17 nt, Human adenovirus D
cuuguuauugagcccau

SEQ ID NO: 3922879 - RNA, 17 nt, Human adenovirus D
cuuuaucagcacugcaa

SEQ ID NO: 3922880 - RNA, 18 nt, Human adenovirus D
cuuuaucagcacugcaaa

SEQ ID NO: 3922881 - RNA, 15 nt, Human adenovirus D
cuuuaucagccagaa

SEQ ID NO: 3922882 - RNA, 11 nt, Human adenovirus D
cuuucaagaac

SEQ ID NO: 3922883 - RNA, 16 nt, Human adenovirus D
cuuuccagcagcaggg

SEQ ID NO: 3922884 - RNA, 14 nt, Human adenovirus D
cuuucggcgcuugg

SEQ ID NO: 3922885 - RNA, 22 nt, Human adenovirus D
cuuucugcccgcgcucaucccc

SEQ ID NO: 3922886 - RNA, 21 nt, Human adenovirus D
cuuugacacaccuggaggcac

SEQ ID NO: 3922887 - RNA, 11 nt, Human adenovirus D
cuuuggcuuuu

SEQ ID NO: 3922888 - RNA, 20 nt, Human adenovirus D
cuuuugguuucaaauucauu

SEQ ID NO: 3922889 - RNA, 18 nt, Human adenovirus D
cuuuuuagcccuuauuug

SEQ ID NO: 3922890 - RNA, 21 nt, Human adenovirus D
gaaacacagauuugaauugca

SEQ ID NO: 3922891 - RNA, 23 nt, Human adenovirus D
gaaaccagauauuguuggagcag

SEQ ID NO: 3922892 - RNA, 22 nt, Human adenovirus D
gaaaccucaaaaagcuguggac

SEQ ID NO: 3922893 - RNA, 13 nt, Human adenovirus D
gaaagcauacaga

SEQ ID NO: 3922894 - RNA, 15 nt, Human adenovirus D
gaaagucaggagcag

SEQ ID NO: 3922895 - RNA, 15 nt, Human adenovirus D
gaaaucgcaguuggg

SEQ ID NO: 3922896 - RNA, 20 nt, Human adenovirus D
gaaaugggcccuugaacagc

SEQ ID NO: 3922897 - RNA, 15 nt, Human adenovirus D
gaacacacugcccau

SEQ ID NO: 3922898 - RNA, 14 nt, Human adenovirus D
gaaccgccuggggc

SEQ ID NO: 3922899 - RNA, 16 nt, Human adenovirus D
gaaccucagccacucc

SEQ ID NO: 3922900 - RNA, 16 nt, Human adenovirus D
gaaccugaaggagcug

SEQ ID NO: 3922901 - RNA, 21 nt, Human adenovirus D
gaacgacucgcugcugcagcc

SEQ ID NO: 3922902 - RNA, 13 nt, Human adenovirus D
gaacgagggccug

SEQ ID NO: 3922903 - RNA, 14 nt, Human adenovirus D
gaacgagggccugg

SEQ ID NO: 3922904 - RNA, 14 nt, Human adenovirus D
gaacguagccagaa

SEQ ID NO: 3922905 - RNA, 13 nt, Human adenovirus D
gaacuuucuccac

SEQ ID NO: 3922906 - RNA, 16 nt, Human adenovirus D
gaagaagaacaggagc

SEQ ID NO: 3922907 - RNA, 17 nt, Human adenovirus D
gaagaccuacgcucagg

SEQ ID NO: 3922908 - RNA, 14 nt, Human adenovirus D
gaagagcagcacag

SEQ ID NO: 3922909 - RNA, 22 nt, Human adenovirus D
gaagauguuaaagugggcgugg

SEQ ID NO: 3922910 - RNA, 18 nt, Human adenovirus D
gaagcagaaguucaccug

SEQ ID NO: 3922911 - RNA, 21 nt, Human adenovirus D
gaagcauaauauggugaaggg

SEQ ID NO: 3922912 - RNA, 14 nt, Human adenovirus D
gaagcaucgccagg

SEQ ID NO: 3922913 - RNA, 22 nt, Human adenovirus D
gaagcggugucgcggacgcgcu

SEQ ID NO: 3922914 - RNA, 16 nt, Human adenovirus D
gaaggcgcccaggccg

SEQ ID NO: 3922915 - RNA, 16 nt, Human adenovirus D
gaaggcuuucacagcu

SEQ ID NO: 3922916 - RNA, 17 nt, Human adenovirus D
gaagggcaucuucugcc

SEQ ID NO: 3922917 - RNA, 22 nt, Human adenovirus D
gaagggcgagaagcggccgcgg

SEQ ID NO: 3922918 - RNA, 20 nt, Human adenovirus D
gaaggggacgagcugcuugc

SEQ ID NO: 3922919 - RNA, 20 nt, Human adenovirus D
gaaggugagggggucccgcu

SEQ ID NO: 3922920 - RNA, 13 nt, Human adenovirus D
gaaggugauuggc

SEQ ID NO: 3922921 - RNA, 19 nt, Human adenovirus D
gaaggugguggacggccug

SEQ ID NO: 3922922 - RNA, 17 nt, Human adenovirus D
gaagugcggcggcggcu

SEQ ID NO: 3922923 - RNA, 17 nt, Human adenovirus D
gaaucgcgggcggccuu

SEQ ID NO: 3922924 - RNA, 22 nt, Human adenovirus D
gaaucucggccaccagucccuu

SEQ ID NO: 3922925 - RNA, 13 nt, Human adenovirus D
gacaaaggaggcc

SEQ ID NO: 3922926 - RNA, 23 nt, Human adenovirus D
gacaagauaucauaaagauggau

SEQ ID NO: 3922927 - RNA, 23 nt, Human adenovirus D
gacacauguccccuuccuccgca

SEQ ID NO: 3922928 - RNA, 15 nt, Human adenovirus D
gacaccacagugcag

SEQ ID NO: 3922929 - RNA, 17 nt, Human adenovirus D
gacacugguuuggaacu

SEQ ID NO: 3922930 - RNA, 20 nt, Human adenovirus D
gacagaggcuaccucaagug

SEQ ID NO: 3922931 - RNA, 21 nt, Human adenovirus D
gacagucugagggccacccug

SEQ ID NO: 3922932 - RNA, 15 nt, Human adenovirus D
acagauccugcugcu

SEQ ID NO: 3922933 - RNA, 13 nt, Human adenovirus D
acagaugguagca

SEQ ID NO: 3922934 - RNA, 15 nt, Human adenovirus D
acagcaagccucuga

SEQ ID NO: 3922935 - RNA, 16 nt, Human adenovirus D
acagcaccgccgcagc

SEQ ID NO: 3922936 - RNA, 19 nt, Human adenovirus D
acagcaucgccucaccuau

SEQ ID NO: 3922937 - RNA, 23 nt, Human adenovirus D
acagccgucuggacccgcggccg

SEQ ID NO: 3922938 - RNA, 17 nt, Human adenovirus D
acagccucucugaagca

SEQ ID NO: 3922939 - RNA, 22 nt, Human adenovirus D
acagccuucagcaucagucucc

SEQ ID NO: 3922940 - RNA, 15 nt, Human adenovirus D
acagccuugccccca

SEQ ID NO: 3922941 - RNA, 21 nt, Human adenovirus D
acaggagccgcuaguggaaga

SEQ ID NO: 3922942 - RNA, 13 nt, Human adenovirus D
acaggccgcagcu

SEQ ID NO: 3922943 - RNA, 17 nt, Human adenovirus D
acaguaagugcagcaca

SEQ ID NO: 3922944 - RNA, 18 nt, Human adenovirus D
acaguaagugcagcacau

SEQ ID NO: 3922945 - RNA, 13 nt, Human adenovirus D
acaguacuggcaa

SEQ ID NO: 3922946 - RNA, 20 nt, Human adenovirus D
acaguagucaucaaaugcga

SEQ ID NO: 3922947 - RNA, 16 nt, Human adenovirus D
acagucaacuguuaag

SEQ ID NO: 3922948 - RNA, 21 nt, Human adenovirus D
acaguucagaaguaaauuuga

SEQ ID NO: 3922949 - RNA, 14 nt, Human adenovirus D
acaucagccaggac

SEQ ID NO: 3922950 - RNA, 13 nt, Human adenovirus D
acauccaugugac

SEQ ID NO: 3922951 - RNA, 23 nt, Human adenovirus D
acauccuggaccaggcggcagag

SEQ ID NO: 3922952 - RNA, 18 nt, Human adenovirus D
acaucgccgagcccgagg

SEQ ID NO: 3922953 - RNA, 14 nt, Human adenovirus D
acaugaccaaggac

SEQ ID NO: 3922954 - RNA, 11 nt, Human adenovirus D
acaugcacugg

SEQ ID NO: 3922955 - RNA, 13 nt, Human adenovirus D
acaugcagcugcc

SEQ ID NO: 3922956 - RNA, 16 nt, Human adenovirus D
acaugcccagcagcag

SEQ ID NO: 3922957 - RNA, 11 nt, Human adenovirus D
acauggcaagc

SEQ ID NO: 3922958 - RNA, 22 nt, Human adenovirus D
acauggugggcuaauauaacuu

SEQ ID NO: 3922959 - RNA, 11 nt, Human adenovirus D
acauguaacuu

SEQ ID NO: 3922960 - RNA, 21 nt, Human adenovirus D
acauucuggacuucgcagcca

SEQ ID NO: 3922961 - RNA, 20 nt, Human adenovirus D
accaaggcacccaccacagu

SEQ ID NO: 3922962 - RNA, 14 nt, Human adenovirus D
accacaaaaacgaa

SEQ ID NO: 3922963 - RNA, 17 nt, Human adenovirus D
accacacggccagcagg

SEQ ID NO: 3922964 - RNA, 16 nt, Human adenovirus D
accacccacaccgccu

SEQ ID NO: 3922965 - RNA, 13 nt, Human adenovirus D
accaccccaggcg

SEQ ID NO: 3922966 - RNA, 15 nt, Human adenovirus D
accaccccaggcgga

SEQ ID NO: 3922967 - RNA, 22 nt, Human adenovirus D
accaccgagucucaccugguua

SEQ ID NO: 3922968 - RNA, 19 nt, Human adenovirus D
accaccgcgaccgcggccg

SEQ ID NO: 3922969 - RNA, 12 nt, Human adenovirus D
accaccugguga

SEQ ID NO: 3922970 - RNA, 20 nt, Human adenovirus D
accaccuggugauggccugu

SEQ ID NO: 3922971 - RNA, 22 nt, Human adenovirus D
accacgcuacaaauccaacucu

SEQ ID NO: 3922972 - RNA, 16 nt, Human adenovirus D
accacgguggugcaga

SEQ ID NO: 3922973 - RNA, 13 nt, Human adenovirus D
accagacacaucu

SEQ ID NO: 3922974 - RNA, 16 nt, Human adenovirus D
accagcccauuucaca

SEQ ID NO: 3922975 - RNA, 16 nt, Human adenovirus D
accaggacgguguagc

SEQ ID NO: 3922976 - RNA, 15 nt, Human adenovirus D
accaggcagugcagc

SEQ ID NO: 3922977 - RNA, 14 nt, Human adenovirus D
accaggggguccac

SEQ ID NO: 3922978 - RNA, 15 nt, Human adenovirus D
accaggggguccacc

SEQ ID NO: 3922979 - RNA, 22 nt, Human adenovirus D
accauguuauucagcagcccau

SEQ ID NO: 3922980 - RNA, 19 nt, Human adenovirus D
acccagaccgugcaggggc

SEQ ID NO: 3922981 - RNA, 10 nt, Human adenovirus D
acccagcagg

SEQ ID NO: 3922982 - RNA, 17 nt, Human adenovirus D
accccagaaagaagugg

SEQ ID NO: 3922983 - RNA, 17 nt, Human adenovirus D
acccgcgacccccaggc

SEQ ID NO: 3922984 - RNA, 23 nt, Human adenovirus D
acccggacguggugcugcugccg

SEQ ID NO: 3922985 - RNA, 22 nt, Human adenovirus D
acccguccaugcgaauuccccu

SEQ ID NO: 3922986 - RNA, 16 nt, Human adenovirus D
acccugcccuuccagc

SEQ ID NO: 3922987 - RNA, 13 nt, Human adenovirus D
accgaaggcagcu

SEQ ID NO: 3922988 - RNA, 13 nt, Human adenovirus D
accgacgcugggc

SEQ ID NO: 3922989 - RNA, 17 nt, Human adenovirus D
accgagccucccaggag

SEQ ID NO: 3922990 - RNA, 13 nt, Human adenovirus D
accgaggugcccc

SEQ ID NO: 3922991 - RNA, 19 nt, Human adenovirus D
accgaggugccccagagcg

SEQ ID NO: 3922992 - RNA, 11 nt, Human adenovirus D
accgccacccg

SEQ ID NO: 3922993 - RNA, 16 nt, Human adenovirus D
accgccuccccgcaga

SEQ ID NO: 3922994 - RNA, 20 nt, Human adenovirus D
accgcggcgucaucgaggcc

SEQ ID NO: 3922995 - RNA, 21 nt, Human adenovirus D
accgcuccaugcuucugggca

SEQ ID NO: 3922996 - RNA, 23 nt, Human adenovirus D
accggucucugcgcucgcucacc

SEQ ID NO: 3922997 - RNA, 14 nt, Human adenovirus D
accggugcucugcg

SEQ ID NO: 3922998 - RNA, 14 nt, Human adenovirus D
accguggggaacuc

SEQ ID NO: 3922999 - RNA, 22 nt, Human adenovirus D
accuaugggaacaaggccugga

SEQ ID NO: 3923000 - RNA, 12 nt, Human adenovirus D
accuccugggca

SEQ ID NO: 3923001 - RNA, 20 nt, Human adenovirus D
accucgccgcgcaggggcuc

SEQ ID NO: 3923002 - RNA, 17 nt, Human adenovirus D
accucuugcagcuggcc

SEQ ID NO: 3923003 - RNA, 19 nt, Human adenovirus D
accugcagcaggugcugcc

SEQ ID NO: 3923004 - RNA, 23 nt, Human adenovirus D
accugccuccaccacccacgccc

SEQ ID NO: 3923005 - RNA, 15 nt, Human adenovirus D
accuucaaccucacc

SEQ ID NO: 3923006 - RNA, 12 nt, Human adenovirus D
accuucacagcu

SEQ ID NO: 3923007 - RNA, 14 nt, Human adenovirus D
accuuccuugcugg

SEQ ID NO: 3923008 - RNA, 20 nt, Human adenovirus D
accuuggcuuugcuggguug

SEQ ID NO: 3923009 - RNA, 13 nt, Human adenovirus D
acgaacagccacg

SEQ ID NO: 3923010 - RNA, 22 nt, Human adenovirus D
acgacacagcgauucccgggcu

SEQ ID NO: 3923011 - RNA, 20 nt, Human adenovirus D
acgacgacauccuggaccag

SEQ ID NO: 3923012 - RNA, 16 nt, Human adenovirus D
acgacucgcugcugca

SEQ ID NO: 3923013 - RNA, 22 nt, Human adenovirus D
acgagagcgugauggcgcaggc

SEQ ID NO: 3923014 - RNA, 19 nt, Human adenovirus D
acgagcaagacgcaggcca

SEQ ID NO: 3923015 - RNA, 20 nt, Human adenovirus D
acgagcagaccuuccaggag

SEQ ID NO: 3923016 - RNA, 17 nt, Human adenovirus D
acgagcggucgcggugg

SEQ ID NO: 3923017 - RNA, 19 nt, Human adenovirus D
acgagcucgccgaggaggc

SEQ ID NO: 3923018 - RNA, 17 nt, Human adenovirus D
acgauccugcaggugga

SEQ ID NO: 3923019 - RNA, 13 nt, Human adenovirus D
acgaugagaccaa

SEQ ID NO: 3923020 - RNA, 15 nt, Human adenovirus D
acgaugagaccaagu

SEQ ID NO: 3923021 - RNA, 19 nt, Human adenovirus D
acgaugguuucccucgggc

SEQ ID NO: 3923022 - RNA, 17 nt, Human adenovirus D
acgaugugaccacggac

SEQ ID NO: 3923023 - RNA, 18 nt, Human adenovirus D
acgcacgggccgccgggc

SEQ ID NO: 3923024 - RNA, 15 nt, Human adenovirus D
acgccaggcuggccg

SEQ ID NO: 3923025 - RNA, 21 nt, Human adenovirus D
acgccccugagcggcugcacg

SEQ ID NO: 3923026 - RNA, 15 nt, Human adenovirus D
acgcccuugugcccg

SEQ ID NO: 3923027 - RNA, 15 nt, Human adenovirus D
acgccguacgugccc

SEQ ID NO: 3923028 - RNA, 21 nt, Human adenovirus D
acgccucggaguaccugagcc

SEQ ID NO: 3923029 - RNA, 15 nt, Human adenovirus D
acgccuuccuggcga

SEQ ID NO: 3923030 - RNA, 14 nt, Human adenovirus D
acgcgaccgugggg

SEQ ID NO: 3923031 - RNA, 15 nt, Human adenovirus D
acgcgccggggccgc

SEQ ID NO: 3923032 - RNA, 22 nt, Human adenovirus D
acgcgcuccucgcucuggggcc

SEQ ID NO: 3923033 - RNA, 19 nt, Human adenovirus D
acgcggaucucacggccug

SEQ ID NO: 3923034 - RNA, 22 nt, Human adenovirus D
acgcggaucucacggccugcgu

SEQ ID NO: 3923035 - RNA, 18 nt, Human adenovirus D
acgcugaaaggcgggcug

SEQ ID NO: 3923036 - RNA, 20 nt, Human adenovirus D
acgcugagcgacgaccuggg

SEQ ID NO: 3923037 - RNA, 19 nt, Human adenovirus D
acgcuguaccgcgaggcca

SEQ ID NO: 3923038 - RNA, 18 nt, Human adenovirus D
acggacuugauuggccug

SEQ ID NO: 3923039 - RNA, 22 nt, Human adenovirus D
acggagaggcugacgagcccgc

SEQ ID NO: 3923040 - RNA, 21 nt, Human adenovirus D
acggcaucucgauccagcaga

SEQ ID NO: 3923041 - RNA, 22 nt, Human adenovirus D
acggcgcagcuguuccuggugg

SEQ ID NO: 3923042 - RNA, 14 nt, Human adenovirus D
acggcgggcugacg

SEQ ID NO: 3923043 - RNA, 19 nt, Human adenovirus D
acgguccagaggacuugga

SEQ ID NO: 3923044 - RNA, 16 nt, Human adenovirus D
acggugaaccugagcc

SEQ ID NO: 3923045 - RNA, 23 nt, Human adenovirus D
acgguggacgggcgcccagugcu

SEQ ID NO: 3923046 - RNA, 15 nt, Human adenovirus D
acgguggcggcgagg

SEQ ID NO: 3923047 - RNA, 19 nt, Human adenovirus D
acguacuucagccugggca

SEQ ID NO: 3923048 - RNA, 15 nt, Human adenovirus D
acgucaccugcggcg

SEQ ID NO: 3923049 - RNA, 16 nt, Human adenovirus D
acguccauggcgcagu

SEQ ID NO: 3923050 - RNA, 15 nt, Human adenovirus D
acgugagcggcgagg

SEQ ID NO: 3923051 - RNA, 20 nt, Human adenovirus D
ggcgccggcgcuagccagcc

SEQ ID NO: 3923052 - RNA, 14 nt, Human adenovirus D
ggcgccucccagga

SEQ ID NO: 3923053 - RNA, 21 nt, Human adenovirus D
ggcgcuagccagccacagcca

SEQ ID NO: 3923054 - RNA, 22 nt, Human adenovirus D
ggcggaccugcauuggcagccg

SEQ ID NO: 3923055 - RNA, 18 nt, Human adenovirus D
ggcggacugccaccgccg

SEQ ID NO: 3923056 - RNA, 12 nt, Human adenovirus D
ggcggaggcgga

SEQ ID NO: 3923057 - RNA, 11 nt, Human adenovirus D
ggcggagggug

SEQ ID NO: 3923058 - RNA, 16 nt, Human adenovirus D
ggcggagggugccaga

SEQ ID NO: 3923059 - RNA, 16 nt, Human adenovirus D
ggcggaugguggcgag

SEQ ID NO: 3923060 - RNA, 21 nt, Human adenovirus D
ggcggccuuugaugugcggca

SEQ ID NO: 3923061 - RNA, 19 nt, Human adenovirus D
ggcggcgauaugccagacg

SEQ ID NO: 3923062 - RNA, 21 nt, Human adenovirus D
ggcggcgauaugccagacgca

SEQ ID NO: 3923063 - RNA, 21 nt, Human adenovirus D
ggcggcgcugcaaagccagcc

SEQ ID NO: 3923064 - RNA, 17 nt, Human adenovirus D
ggcgggggugaugagcu

SEQ ID NO: 3923065 - RNA, 14 nt, Human adenovirus D
ggcggugcugcugc

SEQ ID NO: 3923066 - RNA, 16 nt, Human adenovirus D
ggcggugcugcugccg

SEQ ID NO: 3923067 - RNA, 14 nt, Human adenovirus D
ggcggugguagccg

SEQ ID NO: 3923068 - RNA, 21 nt, Human adenovirus D
ggcguaguugcgcaggcgcug

SEQ ID NO: 3923069 - RNA, 18 nt, Human adenovirus D
ggcgugcacuggcucgcc

SEQ ID NO: 3923070 - RNA, 15 nt, Human adenovirus D
ggcgugcaggcgccc

SEQ ID NO: 3923071 - RNA, 14 nt, Human adenovirus D
ggcguucagggagg

SEQ ID NO: 3923072 - RNA, 18 nt, Human adenovirus D
ggcuacgcgcggaaucag

SEQ ID NO: 3923073 - RNA, 23 nt, Human adenovirus D
ggcucaucugcagggcgcccagc

SEQ ID NO: 3923074 - RNA, 21 nt, Human adenovirus D
ggcuccagcgaaagagagcuc

SEQ ID NO: 3923075 - RNA, 15 nt, Human adenovirus D
ggcuccucucgugcu

SEQ ID NO: 3923076 - RNA, 20 nt, Human adenovirus D
ggcuccucucgugcuccggc

SEQ ID NO: 3923077 - RNA, 22 nt, Human adenovirus D
ggcucgguuguugaugaccugg

SEQ ID NO: 3923078 - RNA, 19 nt, Human adenovirus D
ggcucuaaaaaauaugcaa

SEQ ID NO: 3923079 - RNA, 21 nt, Human adenovirus D
ggcucuuccuccguagccugg

SEQ ID NO: 3923080 - RNA, 21 nt, Human adenovirus D
ggcugcuagagugccacugcc

SEQ ID NO: 3923081 - RNA, 20 nt, Human adenovirus D
ggcugcuucugccuggugaa

SEQ ID NO: 3923082 - RNA, 19 nt, Human adenovirus D
ggcuggaacccgcgcucgc

SEQ ID NO: 3923083 - RNA, 19 nt, Human adenovirus D
ggcuggcgagacugggggc

SEQ ID NO: 3923084 - RNA, 19 nt, Human adenovirus D
ggcuuacaacagccuugcc

SEQ ID NO: 3923085 - RNA, 16 nt, Human adenovirus D
ggcuuccgccgccggg

SEQ ID NO: 3923086 - RNA, 21 nt, Human adenovirus D
ggcuuugcuggguugcuccuu

SEQ ID NO: 3923087 - RNA, 15 nt, Human adenovirus D
gggaacaaggccugg

SEQ ID NO: 3923088 - RNA, 20 nt, Human adenovirus D
gggagcugcgcgagggccug

SEQ ID NO: 3923089 - RNA, 12 nt, Human adenovirus D
gggaggagcccg

SEQ ID NO: 3923090 - RNA, 15 nt, Human adenovirus D
gggcaccaccgaguc

SEQ ID NO: 3923091 - RNA, 17 nt, Human adenovirus D
gggccacuacagcugac

SEQ ID NO: 3923092 - RNA, 23 nt, Human adenovirus D
gggccucggcggcguggcccuug

SEQ ID NO: 3923093 - RNA, 15 nt, Human adenovirus D
gggccugaugcagga

SEQ ID NO: 3923094 - RNA, 21 nt, Human adenovirus D
gggcgcccagugcuuccagca

SEQ ID NO: 3923095 - RNA, 12 nt, Human adenovirus D
gggcggaccugc

SEQ ID NO: 3923096 - RNA, 15 nt, Human adenovirus D
gggcguagagcuugg

SEQ ID NO: 3923097 - RNA, 21 nt, Human adenovirus D
gggcguagagcuugggcgcaa

SEQ ID NO: 3923098 - RNA, 15 nt, Human adenovirus D
gggcgucaaccccau

SEQ ID NO: 3923099 - RNA, 16 nt, Human adenovirus D
gggcguccagcgcggc

SEQ ID NO: 3923100 - RNA, 19 nt, Human adenovirus D
gggcucguuaguccagcag

SEQ ID NO: 3923101 - RNA, 17 nt, Human adenovirus D
gggcugcucggcgcgga

SEQ ID NO: 3923102 - RNA, 14 nt, Human adenovirus D
gggcuggcgagacu

SEQ ID NO: 3923103 - RNA, 13 nt, Human adenovirus D
ggggacagagaau

SEQ ID NO: 3923104 - RNA, 13 nt, Human adenovirus D
ggggacgugagcg

SEQ ID NO: 3923105 - RNA, 21 nt, Human adenovirus D
ggggaucaccaguuugggcac

SEQ ID NO: 3923106 - RNA, 18 nt, Human adenovirus D
ggggcaacauccccgccc

SEQ ID NO: 3923107 - RNA, 14 nt, Human adenovirus D
ggggcaauaccggg

SEQ ID NO: 3923108 - RNA, 13 nt, Human adenovirus D
ggggcauugcagg

SEQ ID NO: 3923109 - RNA, 20 nt, Human adenovirus D
ggggcgccgccggcggcgag

SEQ ID NO: 3923110 - RNA, 13 nt, Human adenovirus D
ggggcgugcaggc

SEQ ID NO: 3923111 - RNA, 19 nt, Human adenovirus D
ggggcucguuaguccagca

SEQ ID NO: 3923112 - RNA, 21 nt, Human adenovirus D
gggggccacucccagcgccgc

SEQ ID NO: 3923113 - RNA, 20 nt, Human adenovirus D
gggguacuuuacgcuggcca

SEQ ID NO: 3923114 - RNA, 20 nt, Human adenovirus D
gggguucauguugugcagga

SEQ ID NO: 3923115 - RNA, 24 nt, Human adenovirus D
ggguagguauucccucucgagagc

SEQ ID NO: 3923116 - RNA, 15 nt, Human adenovirus D
ggguaguggcucgcg

SEQ ID NO: 3923117 - RNA, 15 nt, Human adenovirus D
gggugacagaaccag

SEQ ID NO: 3923118 - RNA, 15 nt, Human adenovirus D
ggguuaggccgcgcg

SEQ ID NO: 3923119 - RNA, 14 nt, Human adenovirus D
gguaagagcccagc

SEQ ID NO: 3923120 - RNA, 12 nt, Human adenovirus D
gguaauucucau

SEQ ID NO: 3923121 - RNA, 18 nt, Human adenovirus D
gguacaugggcaugagcc

SEQ ID NO: 3923122 - RNA, 16 nt, Human adenovirus D
gguacuuuacgcuggc

SEQ ID NO: 3923123 - RNA, 17 nt, Human adenovirus D
gguagagcggccagcgc

SEQ ID NO: 3923124 - RNA, 18 nt, Human adenovirus D
gguagcaccacugcaugg

SEQ ID NO: 3923125 - RNA, 22 nt, Human adenovirus D
gguagcggucguuguccaccag

SEQ ID NO: 3923126 - RNA, 19 nt, Human adenovirus D
gguagggggcgccgccggc

SEQ ID NO: 3923127 - RNA, 23 nt, Human adenovirus D
ggucacggauacaacucgcaguc

SEQ ID NO: 3923128 - RNA, 15 nt, Human adenovirus D
gguccacgcuggugg

SEQ ID NO: 3923129 - RNA, 16 nt, Human adenovirus D
gguccccgaggcccuu

SEQ ID NO: 3923130 - RNA, 23 nt, Human adenovirus D
gguccgcaggaguccaccgcucc

SEQ ID NO: 3923131 - RNA, 13 nt, Human adenovirus D
gguccgggggcag

SEQ ID NO: 3923132 - RNA, 20 nt, Human adenovirus D
gguccugcaagaggagacag

SEQ ID NO: 3923133 - RNA, 12 nt, Human adenovirus D
ggucgcgguggg

SEQ ID NO: 3923134 - RNA, 14 nt, Human adenovirus D
ggucgcgguggggc

SEQ ID NO: 3923135 - RNA, 23 nt, Human adenovirus D
ggucucgcacucgacgagccagg

SEQ ID NO: 3923136 - RNA, 20 nt, Human adenovirus D
ggucugucauauccugaaga

SEQ ID NO: 3923137 - RNA, 22 nt, Human adenovirus D
ggucugucauauccugaagaac

SEQ ID NO: 3923138 - RNA, 17 nt, Human adenovirus D
ggugaaccugagccagg

SEQ ID NO: 3923139 - RNA, 18 nt, Human adenovirus D
ggugaaccugagccaggc

SEQ ID NO: 3923140 - RNA, 15 nt, Human adenovirus D
ggugaaggggugggc

SEQ ID NO: 3923141 - RNA, 20 nt, Human adenovirus D
ggugacggccuacgagcaga

SEQ ID NO: 3923142 - RNA, 19 nt, Human adenovirus D
ggugacgguaagcacgagc

SEQ ID NO: 3923143 - RNA, 16 nt, Human adenovirus D
ggugagccggccgcgc

SEQ ID NO: 3923144 - RNA, 17 nt, Human adenovirus D
ggugagcucgggcugcu

SEQ ID NO: 3923145 - RNA, 17 nt, Human adenovirus D
ggugaugccggcagcgg

SEQ ID NO: 3923146 - RNA, 13 nt, Human adenovirus D
ggugcgcuggggc

SEQ ID NO: 3923147 - RNA, 12 nt, Human adenovirus D
ggugcuccagcc

SEQ ID NO: 3923148 - RNA, 13 nt, Human adenovirus D
ggugcugcugccg

SEQ ID NO: 3923149 - RNA, 15 nt, Human adenovirus D
ggugcuuagccuggg

SEQ ID NO: 3923150 - RNA, 21 nt, Human adenovirus D
gguggaaacagacagccaggu

SEQ ID NO: 3923151 - RNA, 22 nt, Human adenovirus D
gguggauuuuuuccaagacccg

SEQ ID NO: 3923152 - RNA, 20 nt, Human adenovirus D
ggugucagaggauggucauc

SEQ ID NO: 3923153 - RNA, 18 nt, Human adenovirus D
ggugucgcggagauccag

SEQ ID NO: 3923154 - RNA, 14 nt, Human adenovirus D
gguguggaagauga

SEQ ID NO: 3923155 - RNA, 18 nt, Human adenovirus D
gguucauguugugcagga

SEQ ID NO: 3923156 - RNA, 15 nt, Human adenovirus D
gguuccggccccgcg

SEQ ID NO: 3923157 - RNA, 16 nt, Human adenovirus D
gguugagcgggcucuu

SEQ ID NO: 3923158 - RNA, 14 nt, Human adenovirus D
guaagagcccagca

SEQ ID NO: 3923159 - RNA, 16 nt, Human adenovirus D
guaaugaaacccgcca

SEQ ID NO: 3923160 - RNA, 19 nt, Human adenovirus D
guacacgguucucucagca

SEQ ID NO: 3923161 - RNA, 16 nt, Human adenovirus D
guacauccagcauaag

SEQ ID NO: 3923162 - RNA, 21 nt, Human adenovirus D
guacccgcgacccccaggccc

SEQ ID NO: 3923163 - RNA, 22 nt, Human adenovirus D
guaccuugucguacuucugcca

SEQ ID NO: 3923164 - RNA, 19 nt, Human adenovirus D
guacgaggccaugcugcgc

SEQ ID NO: 3923165 - RNA, 13 nt, Human adenovirus D
guacuucugccag

SEQ ID NO: 3923166 - RNA, 22 nt, Human adenovirus D
guacuuuacgcuggccagcacg

SEQ ID NO: 3923167 - RNA, 17 nt, Human adenovirus D
guagacaaagagcacag

SEQ ID NO: 3923168 - RNA, 18 nt, Human adenovirus D
guagagcuugggcgcaag

SEQ ID NO: 3923169 - RNA, 20 nt, Human adenovirus D
guagcugcgcggggccacga

SEQ ID NO: 3923170 - RNA, 22 nt, Human adenovirus D
guaggaaccagcacacucacuu

SEQ ID NO: 3923171 - RNA, 20 nt, Human adenovirus D
guaggccauccccauccagu

SEQ ID NO: 3923172 - RNA, 17 nt, Human adenovirus D
guaguucaggagcgcag

SEQ ID NO: 3923173 - RNA, 15 nt, Human adenovirus D
guaguugcgcaggcg

SEQ ID NO: 3923174 - RNA, 21 nt, Human adenovirus D
guauccagccuguacccagag

SEQ ID NO: 3923175 - RNA, 22 nt, Human adenovirus D
guaucugaggcauauaaaaaug

SEQ ID NO: 3923176 - RNA, 16 nt, Human adenovirus D
guaucuuuauugauuu

SEQ ID NO: 3923177 - RNA, 20 nt, Human adenovirus D
guaugucucugguguaguug

SEQ ID NO: 3923178 - RNA, 14 nt, Human adenovirus D
gucaacaugauccu

SEQ ID NO: 3923179 - RNA, 19 nt, Human adenovirus D
gucaaggugcgccccauca

SEQ ID NO: 3923180 - RNA, 17 nt, Human adenovirus D
gucaaguuugacagcag

SEQ ID NO: 3923181 - RNA, 19 nt, Human adenovirus D
gucacauccaucuccacca

SEQ ID NO: 3923182 - RNA, 16 nt, Human adenovirus D
gucaccuucacagcua

SEQ ID NO: 3923183 - RNA, 18 nt, Human adenovirus D
gucacggucggcgcgcuc

SEQ ID NO: 3923184 - RNA, 17 nt, Human adenovirus D
gucacuuaaguccuggg

SEQ ID NO: 3923185 - RNA, 18 nt, Human adenovirus D
gucacuuaaguccugggc

SEQ ID NO: 3923186 - RNA, 16 nt, Human adenovirus D
gucacuuuugcccuua

SEQ ID NO: 3923187 - RNA, 19 nt, Human adenovirus D
gucagcaacuaccccgugg

SEQ ID NO: 3923188 - RNA, 20 nt, Human adenovirus D
gucaggaaaauaucaauaca

SEQ ID NO: 3923189 - RNA, 13 nt, Human adenovirus D
gucaggagcagcg

SEQ ID NO: 3923190 - RNA, 15 nt, Human adenovirus D
gucaggucugcuggu

SEQ ID NO: 3923191 - RNA, 12 nt, Human adenovirus D
gucaucacccag

SEQ ID NO: 3923192 - RNA, 15 nt, Human adenovirus D
gucaucacccucaga

SEQ ID NO: 3923193 - RNA, 12 nt, Human adenovirus D
gucauccuucca

SEQ ID NO: 3923194 - RNA, 15 nt, Human adenovirus D
gucauggcuggucag

SEQ ID NO: 3923195 - RNA, 18 nt, Human adenovirus D
gucauugauacccuggac

SEQ ID NO: 3923196 - RNA, 19 nt, Human adenovirus D
guccaacggcaaacagcau

SEQ ID NO: 3923197 - RNA, 17 nt, Human adenovirus D
guccagcgcggccagcg

SEQ ID NO: 3923198 - RNA, 13 nt, Human adenovirus D
guccaggucacag

SEQ ID NO: 3923199 - RNA, 18 nt, Human adenovirus D
ugcagacacuugagcugg

SEQ ID NO: 3923200 - RNA, 22 nt, Human adenovirus D
ugcagacacuugagcuggccuu

SEQ ID NO: 3923201 - RNA, 17 nt, Human adenovirus D
ugcagaccgaccccugg

SEQ ID NO: 3923202 - RNA, 14 nt, Human adenovirus D
ugcagaccgcgggc

SEQ ID NO: 3923203 - RNA, 23 nt, Human adenovirus D
ugcagcacauaaucaccauguua

SEQ ID NO: 3923204 - RNA, 12 nt, Human adenovirus D
ugcagcacugga

SEQ ID NO: 3923205 - RNA, 15 nt, Human adenovirus D
ugcagcauugucugc

SEQ ID NO: 3923206 - RNA, 22 nt, Human adenovirus D
ugcagcguguucaaaacaacaa

SEQ ID NO: 3923207 - RNA, 18 nt, Human adenovirus D
ugcaggcgucgcagcgcc

SEQ ID NO: 3923208 - RNA, 17 nt, Human adenovirus D
ugcagggaagcaaaguu

SEQ ID NO: 3923209 - RNA, 13 nt, Human adenovirus D
ugcagggugacca

SEQ ID NO: 3923210 - RNA, 14 nt, Human adenovirus D
ugcagguggacgag

SEQ ID NO: 3923211 - RNA, 15 nt, Human adenovirus D
ugcaguuggccauga

SEQ ID NO: 3923212 - RNA, 18 nt, Human adenovirus D
ugcauacaaaugcuucaa

SEQ ID NO: 3923213 - RNA, 21 nt, Human adenovirus D
ugcaucaacguuucucggcca

SEQ ID NO: 3923214 - RNA, 15 nt, Human adenovirus D
ugcaucccguccugc

SEQ ID NO: 3923215 - RNA, 21 nt, Human adenovirus D
ugcauggccucgugcucuggg

SEQ ID NO: 3923216 - RNA, 18 nt, Human adenovirus D
ugcauuggggauaaaguu

SEQ ID NO: 3923217 - RNA, 17 nt, Human adenovirus D
ugccacaugcaccuggg

SEQ ID NO: 3923218 - RNA, 15 nt, Human adenovirus D
ugccacucgcgggcg

SEQ ID NO: 3923219 - RNA, 20 nt, Human adenovirus D
ugccacucgcgggcggccau

SEQ ID NO: 3923220 - RNA, 16 nt, Human adenovirus D
ugccagacgcaagagc

SEQ ID NO: 3923221 - RNA, 20 nt, Human adenovirus D
ugccagacgcaagagccggc

SEQ ID NO: 3923222 - RNA, 20 nt, Human adenovirus D
ugccagauugggggacgaug

SEQ ID NO: 3923223 - RNA, 14 nt, Human adenovirus D
ugccaggggucuac

SEQ ID NO: 3923224 - RNA, 19 nt, Human adenovirus D
ugccccacaucgaggcccu

SEQ ID NO: 3923225 - RNA, 12 nt, Human adenovirus D
ugccccagcaga

SEQ ID NO: 3923226 - RNA, 13 nt, Human adenovirus D
ugcccccuccacu

SEQ ID NO: 3923227 - RNA, 23 nt, Human adenovirus D
ugcccgagggcuacaaggaccgc

SEQ ID NO: 3923228 - RNA, 22 nt, Human adenovirus D
ugcccuuccacauccaagugcc

SEQ ID NO: 3923229 - RNA, 13 nt, Human adenovirus D
ugcccuuccagca

SEQ ID NO: 3923230 - RNA, 12 nt, Human adenovirus D
ugccggccccuc

SEQ ID NO: 3923231 - RNA, 16 nt, Human adenovirus D
ugccgguuucgggcgg

SEQ ID NO: 3923232 - RNA, 12 nt, Human adenovirus D
ugccugccccuc

SEQ ID NO: 3923233 - RNA, 13 nt, Human adenovirus D
ugccuugucuauc

SEQ ID NO: 3923234 - RNA, 16 nt, Human adenovirus D
ugcgaaaacacuuccg

SEQ ID NO: 3923235 - RNA, 13 nt, Human adenovirus D
ugcgcgaccuggg

SEQ ID NO: 3923236 - RNA, 18 nt, Human adenovirus D
ugcgcgagguugagcucc

SEQ ID NO: 3923237 - RNA, 15 nt, Human adenovirus D
ugcgcuuugugcccg

SEQ ID NO: 3923238 - RNA, 23 nt, Human adenovirus D
ugcggagccgcucggccaugccc

SEQ ID NO: 3923239 - RNA, 20 nt, Human adenovirus D
ugcggccuugcggagcgagg

SEQ ID NO: 3923240 - RNA, 15 nt, Human adenovirus D
ugcggcugaugguga

SEQ ID NO: 3923241 - RNA, 23 nt, Human adenovirus D
ugcgguggauuuuuuccaagacc

SEQ ID NO: 3923242 - RNA, 19 nt, Human adenovirus D
ugcgucgagcacagcaccg

SEQ ID NO: 3923243 - RNA, 15 nt, Human adenovirus D
ugcgucugcagcauu

SEQ ID NO: 3923244 - RNA, 13 nt, Human adenovirus D
ugcuaaagcucuu

SEQ ID NO: 3923245 - RNA, 16 nt, Human adenovirus D
ugcuacaucugcugcc

SEQ ID NO: 3923246 - RNA, 17 nt, Human adenovirus D
ugcuagcccuuccugga

SEQ ID NO: 3923247 - RNA, 18 nt, Human adenovirus D
ugcugaccaauagacagc

SEQ ID NO: 3923248 - RNA, 18 nt, Human adenovirus D
ugcugauugcucuggccu

SEQ ID NO: 3923249 - RNA, 14 nt, Human adenovirus D
ugcugccccaggcg

SEQ ID NO: 3923250 - RNA, 16 nt, Human adenovirus D
ugcugccgcucaguca

SEQ ID NO: 3923251 - RNA, 14 nt, Human adenovirus D
ugcugccgggcugc

SEQ ID NO: 3923252 - RNA, 19 nt, Human adenovirus D
ugcugcgccgcgccagacg

SEQ ID NO: 3923253 - RNA, 18 nt, Human adenovirus D
ugcuggcuggucaggccu

SEQ ID NO: 3923254 - RNA, 21 nt, Human adenovirus D
ugcugguggaaacagacagcc

SEQ ID NO: 3923255 - RNA, 20 nt, Human adenovirus D
ugcuucugggcaacggccgc

SEQ ID NO: 3923256 - RNA, 20 nt, Human adenovirus D
uggaaacagacagccagguc

SEQ ID NO: 3923257 - RNA, 20 nt, Human adenovirus D
uggaaacucuuggagcaggg

SEQ ID NO: 3923258 - RNA, 20 nt, Human adenovirus D
uggaacaccaucagacuggg

SEQ ID NO: 3923259 - RNA, 17 nt, Human adenovirus D
uggaacccaaaguauga

SEQ ID NO: 3923260 - RNA, 19 nt, Human adenovirus D
uggaacgagaucggcacca

SEQ ID NO: 3923261 - RNA, 20 nt, Human adenovirus D
uggaagaagaaugggacagc

SEQ ID NO: 3923262 - RNA, 16 nt, Human adenovirus D
uggaagaagagcagca

SEQ ID NO: 3923263 - RNA, 24 nt, Human adenovirus D
uggaagaccuacgcucaggaccau

SEQ ID NO: 3923264 - RNA, 15 nt, Human adenovirus D
uggaagccaugcugc

SEQ ID NO: 3923265 - RNA, 17 nt, Human adenovirus D
uggacgagggggcagua

SEQ ID NO: 3923266 - RNA, 18 nt, Human adenovirus D
uggacgaguggcuguuga

SEQ ID NO: 3923267 - RNA, 13 nt, Human adenovirus D
uggaggagcagcc

SEQ ID NO: 3923268 - RNA, 16 nt, Human adenovirus D
uggaggagcagccgcg

SEQ ID NO: 3923269 - RNA, 15 nt, Human adenovirus D
uggaggcgcgcggga

SEQ ID NO: 3923270 - RNA, 22 nt, Human adenovirus D
uggagggcaugggucaggcagc

SEQ ID NO: 3923271 - RNA, 15 nt, Human adenovirus D
uggaugcggagccgc

SEQ ID NO: 3923272 - RNA, 15 nt, Human adenovirus D
uggauguggagcccg

SEQ ID NO: 3923273 - RNA, 18 nt, Human adenovirus D
uggauuaucucuacaaau

SEQ ID NO: 3923274 - RNA, 19 nt, Human adenovirus D
uggcaacaccugggcacug

SEQ ID NO: 3923275 - RNA, 13 nt, Human adenovirus D
uggcaagcugcca

SEQ ID NO: 3923276 - RNA, 14 nt, Human adenovirus D
uggccacggggagc

SEQ ID NO: 3923277 - RNA, 20 nt, Human adenovirus D
uggcccugggccugaugcac

SEQ ID NO: 3923278 - RNA, 12 nt, Human adenovirus D
uggccgaccgga

SEQ ID NO: 3923279 - RNA, 22 nt, Human adenovirus D
uggccgagcuggaagcccugag

SEQ ID NO: 3923280 - RNA, 22 nt, Human adenovirus D
uggccuggaucuugagguuggc

SEQ ID NO: 3923281 - RNA, 19 nt, Human adenovirus D
uggccuuaaauaaggaaau

SEQ ID NO: 3923282 - RNA, 20 nt, Human adenovirus D
uggcgaccgccgugcgccgc

SEQ ID NO: 3923283 - RNA, 18 nt, Human adenovirus D
uggcgagaggcgagcagc

SEQ ID NO: 3923284 - RNA, 21 nt, Human adenovirus D
uggcgaucgugaacgcgcugg

SEQ ID NO: 3923285 - RNA, 20 nt, Human adenovirus D
uggcgccgggccugggcgug

SEQ ID NO: 3923286 - RNA, 18 nt, Human adenovirus D
uggcggagaacaaggcca

SEQ ID NO: 3923287 - RNA, 16 nt, Human adenovirus D
uggcggcccuggcugg

SEQ ID NO: 3923288 - RNA, 23 nt, Human adenovirus D
uggcuauuuucacugaaggaaaa

SEQ ID NO: 3923289 - RNA, 17 nt, Human adenovirus D
uggcucagcugccaugg

SEQ ID NO: 3923290 - RNA, 15 nt, Human adenovirus D
uggcuucagagacaa

SEQ ID NO: 3923291 - RNA, 12 nt, Human adenovirus D
uggcuugcauga

SEQ ID NO: 3923292 - RNA, 17 nt, Human adenovirus D
uggcuugguacccgcga

SEQ ID NO: 3923293 - RNA, 14 nt, Human adenovirus D
ugggaacaaggccu

SEQ ID NO: 3923294 - RNA, 15 nt, Human adenovirus D
ugggacagccagcag

SEQ ID NO: 3923295 - RNA, 23 nt, Human adenovirus D
ugggaccggugcucugcgcgcgc

SEQ ID NO: 3923296 - RNA, 12 nt, Human adenovirus D
ugggaugcugcc

SEQ ID NO: 3923297 - RNA, 14 nt, Human adenovirus D
ugggaugcugcccg

SEQ ID NO: 3923298 - RNA, 23 nt, Human adenovirus D
ugggaugcugcccgccaccugca

SEQ ID NO: 3923299 - RNA, 14 nt, Human adenovirus D
ugggcacccacgac

SEQ ID NO: 3923300 - RNA, 14 nt, Human adenovirus D
ugggcacuggagca

SEQ ID NO: 3923301 - RNA, 17 nt, Human adenovirus D
ugggccguuggaagaug

SEQ ID NO: 3923302 - RNA, 15 nt, Human adenovirus D
ugggcguguggcagc

SEQ ID NO: 3923303 - RNA, 19 nt, Human adenovirus D
ugggcuauaauaagcagag

SEQ ID NO: 3923304 - RNA, 15 nt, Human adenovirus D
ugggcucgcuggugg

SEQ ID NO: 3923305 - RNA, 22 nt, Human adenovirus D
uggggcagaacgacaccgacag

SEQ ID NO: 3923306 - RNA, 11 nt, Human adenovirus D
uggggcgccgc

SEQ ID NO: 3923307 - RNA, 16 nt, Human adenovirus D
uggggcgugcaggcgc

SEQ ID NO: 3923308 - RNA, 14 nt, Human adenovirus D
uggggcuccucgag

SEQ ID NO: 3923309 - RNA, 23 nt, Human adenovirus D
ugggggcaauaccgggaugauga

SEQ ID NO: 3923310 - RNA, 23 nt, Human adenovirus D
ugggguacuuuacgcuggccagc

SEQ ID NO: 3923311 - RNA, 13 nt, Human adenovirus D
uggucggcgccga

SEQ ID NO: 3923312 - RNA, 21 nt, Human adenovirus D
uggucuuucuggcuugcuucu

SEQ ID NO: 3923313 - RNA, 14 nt, Human adenovirus D
uggugaagggcugc

SEQ ID NO: 3923314 - RNA, 22 nt, Human adenovirus D
uggugcaguuugcccgcgccac

SEQ ID NO: 3923315 - RNA, 18 nt, Human adenovirus D
uggugcgucgagcacagc

SEQ ID NO: 3923316 - RNA, 19 nt, Human adenovirus D
gcgcacgccguucuccgcc

SEQ ID NO: 3923317 - RNA, 22 nt, Human adenovirus D
gcgcacguucaggacaccgggg

SEQ ID NO: 3923318 - RNA, 14 nt, Human adenovirus D
gcgcaggaggccau

SEQ ID NO: 3923319 - RNA, 16 nt, Human adenovirus D
gcgcaggcgcuggaag

SEQ ID NO: 3923320 - RNA, 19 nt, Human adenovirus D
gcgcagguggacgagcaga

SEQ ID NO: 3923321 - RNA, 20 nt, Human adenovirus D
gcgcagguggacgagcagac

SEQ ID NO: 3923322 - RNA, 16 nt, Human adenovirus D
gcgcauccccuucucc

SEQ ID NO: 3923323 - RNA, 17 nt, Human adenovirus D
gcgcauccccuucucca

SEQ ID NO: 3923324 - RNA, 20 nt, Human adenovirus D
gcgcauccccuucuccagca

SEQ ID NO: 3923325 - RNA, 20 nt, Human adenovirus D
gcgccauugucaacacggcc

SEQ ID NO: 3923326 - RNA, 18 nt, Human adenovirus D
gcgcccaccaucaccacc

SEQ ID NO: 3923327 - RNA, 11 nt, Human adenovirus D
gcgcccgcagc

SEQ ID NO: 3923328 - RNA, 15 nt, Human adenovirus D
gcgcccucagcaguc

SEQ ID NO: 3923329 - RNA, 19 nt, Human adenovirus D
gcgccgccaucgaacacgc

SEQ ID NO: 3923330 - RNA, 14 nt, Human adenovirus D
gcgccgcgccgcca

SEQ ID NO: 3923331 - RNA, 20 nt, Human adenovirus D
gcgccgcggcgacagcgcca

SEQ ID NO: 3923332 - RNA, 20 nt, Human adenovirus D
gcgccggggccgcucgcucg

SEQ ID NO: 3923333 - RNA, 15 nt, Human adenovirus D
gcgccugaggcagac

SEQ ID NO: 3923334 - RNA, 13 nt, Human adenovirus D
gcgcgaccugggc

SEQ ID NO: 3923335 - RNA, 17 nt, Human adenovirus D
gcgcgagguugagcucc

SEQ ID NO: 3923336 - RNA, 22 nt, Human adenovirus D
gcgcgaguagucaaucucccac

SEQ ID NO: 3923337 - RNA, 19 nt, Human adenovirus D
gcgcgaucccgcuguggcu

SEQ ID NO: 3923338 - RNA, 12 nt, Human adenovirus D
gcgcgcugcccg

SEQ ID NO: 3923339 - RNA, 19 nt, Human adenovirus D
gcgcgggcggacugccacc

SEQ ID NO: 3923340 - RNA, 22 nt, Human adenovirus D
gcgcgguaggcccugguccacc

SEQ ID NO: 3923341 - RNA, 23 nt, Human adenovirus D
gcgcguggaggaagugcuggaca

SEQ ID NO: 3923342 - RNA, 23 nt, Human adenovirus D
gcgcugcccguucucgcugguca

SEQ ID NO: 3923343 - RNA, 14 nt, Human adenovirus D
gcgcuggcuuggua

SEQ ID NO: 3923344 - RNA, 20 nt, Human adenovirus D
gcgcuggggcugcucggcgc

SEQ ID NO: 3923345 - RNA, 22 nt, Human adenovirus D
gcgcugguagggggcgccgccg

SEQ ID NO: 3923346 - RNA, 22 nt, Human adenovirus D
gcgcuuccaagaucaggggaug

SEQ ID NO: 3923347 - RNA, 15 nt, Human adenovirus D
gcgcuugcugggcga

SEQ ID NO: 3923348 - RNA, 18 nt, Human adenovirus D
gcgcuuggugggcagagg

SEQ ID NO: 3923349 - RNA, 15 nt, Human adenovirus D
gcggagggugccaga

SEQ ID NO: 3923350 - RNA, 21 nt, Human adenovirus D
gcggaucaccguagagggcac

SEQ ID NO: 3923351 - RNA, 16 nt, Human adenovirus D
gcggaugcuggcgcgc

SEQ ID NO: 3923352 - RNA, 20 nt, Human adenovirus D
gcggccagaugcggaggaga

SEQ ID NO: 3923353 - RNA, 21 nt, Human adenovirus D
gcggccagcgcuggguggccg

SEQ ID NO: 3923354 - RNA, 14 nt, Human adenovirus D
gcggccgcccacgg

SEQ ID NO: 3923355 - RNA, 13 nt, Human adenovirus D
gcggcguccugga

SEQ ID NO: 3923356 - RNA, 22 nt, Human adenovirus D
gcggcguggcccuuggcgcgga

SEQ ID NO: 3923357 - RNA, 21 nt, Human adenovirus D
gcggcuggaguuucacccguc

SEQ ID NO: 3923358 - RNA, 14 nt, Human adenovirus D
gcgggagcgguggg

SEQ ID NO: 3923359 - RNA, 21 nt, Human adenovirus D
gcgggccaugcgcaggcgccu

SEQ ID NO: 3923360 - RNA, 19 nt, Human adenovirus D
gcgggccucacaguccagg

SEQ ID NO: 3923361 - RNA, 20 nt, Human adenovirus D
aaccugagccaggcuuucaa

SEQ ID NO: 3923362 - RNA, 21 nt, Human adenovirus D
aaccugcgcgggcuguggggc

SEQ ID NO: 3923363 - RNA, 22 nt, Human adenovirus D
aacgagaucggcaccagccagc

SEQ ID NO: 3923364 - RNA, 13 nt, Human adenovirus D
aacgagggccugg

SEQ ID NO: 3923365 - RNA, 17 nt, Human adenovirus D
aacgagggccugggcuc

SEQ ID NO: 3923366 - RNA, 21 nt, Human adenovirus D
aacuacuggcuucuacagcca

SEQ ID NO: 3923367 - RNA, 19 nt, Human adenovirus D
aacucgugcgaggggccaa

SEQ ID NO: 3923368 - RNA, 16 nt, Human adenovirus D
aacucuguugaggcau

SEQ ID NO: 3923369 - RNA, 17 nt, Human adenovirus D
aacugaaccgcuggaag

SEQ ID NO: 3923370 - RNA, 23 nt, Human adenovirus D
aacugcgcguccgucagcagcag

SEQ ID NO: 3923371 - RNA, 13 nt, Human adenovirus D
aacuuccagcaga

SEQ ID NO: 3923372 - RNA, 13 nt, Human adenovirus D
aagaaacagaaca

SEQ ID NO: 3923373 - RNA, 21 nt, Human adenovirus D
aagaaccugcgcgggcugugg

SEQ ID NO: 3923374 - RNA, 12 nt, Human adenovirus D
aagaagaaguua

SEQ ID NO: 3923375 - RNA, 12 nt, Human adenovirus D
aagaagagcagc

SEQ ID NO: 3923376 - RNA, 16 nt, Human adenovirus D
aagaaguaugccaaga

SEQ ID NO: 3923377 - RNA, 18 nt, Human adenovirus D
aagaggagucgccggagg

SEQ ID NO: 3923378 - RNA, 13 nt, Human adenovirus D
aagauacagagua

SEQ ID NO: 3923379 - RNA, 14 nt, Human adenovirus D
aagauaucauaaag

SEQ ID NO: 3923380 - RNA, 15 nt, Human adenovirus D
aagauaucauaaaga

SEQ ID NO: 3923381 - RNA, 19 nt, Human adenovirus D
aagauggaggagcagccgc

SEQ ID NO: 3923382 - RNA, 22 nt, Human adenovirus D
aagauggauggaaaaauauuug

SEQ ID NO: 3923383 - RNA, 19 nt, Human adenovirus D
aagauguuaaagugggcgu

SEQ ID NO: 3923384 - RNA, 19 nt, Human adenovirus D
aagcaagaugauaccaaga

SEQ ID NO: 3923385 - RNA, 14 nt, Human adenovirus D
aagcagguggcgcc

SEQ ID NO: 3923386 - RNA, 14 nt, Human adenovirus D
aagcaucgcgcagg

SEQ ID NO: 3923387 - RNA, 22 nt, Human adenovirus D
aagcgcagcguugagcucaccc

SEQ ID NO: 3923388 - RNA, 18 nt, Human adenovirus D
aagcgcugguugaacaug

SEQ ID NO: 3923389 - RNA, 22 nt, Human adenovirus D
aagcguccgcuccgcagugggc

SEQ ID NO: 3923390 - RNA, 19 nt, Human adenovirus D
aagcuagcacccaaaaacu

SEQ ID NO: 3923391 - RNA, 16 nt, Human adenovirus D
aagcugaggauggcaa

SEQ ID NO: 3923392 - RNA, 14 nt, Human adenovirus D
aaggacgauaaagu

SEQ ID NO: 3923393 - RNA, 11 nt, Human adenovirus D
aaggcagcuga

SEQ ID NO: 3923394 - RNA, 19 nt, Human adenovirus D
aagggcucggucgggacga

SEQ ID NO: 3923395 - RNA, 13 nt, Human adenovirus D
aagugugguuuau

SEQ ID NO: 3923396 - RNA, 23 nt, Human adenovirus D
aaguuccugucuucuuccggcaa

SEQ ID NO: 3923397 - RNA, 19 nt, Human adenovirus D
aaguugaaaaacugggcgu

SEQ ID NO: 3923398 - RNA, 16 nt, Human adenovirus D
aaguuuaauggggugc

SEQ ID NO: 3923399 - RNA, 23 nt, Human adenovirus D
aaguuuaauggggugcuguucau

SEQ ID NO: 3923400 - RNA, 17 nt, Human adenovirus D
aaguuuuucauccagaa

SEQ ID NO: 3923401 - RNA, 19 nt, Human adenovirus D
aauaggcacugaaaauuug

SEQ ID NO: 3923402 - RNA, 18 nt, Human adenovirus D
aauauggccuggagcaga

SEQ ID NO: 3923403 - RNA, 14 nt, Human adenovirus D
aaucaauguaacua

SEQ ID NO: 3923404 - RNA, 19 nt, Human adenovirus D
aaucaauguaacuaaacuu

SEQ ID NO: 3923405 - RNA, 21 nt, Human adenovirus D
aaucacucuuuccagcagcag

SEQ ID NO: 3923406 - RNA, 23 nt, Human adenovirus D
aaucaggaugguuuacaauuuug

SEQ ID NO: 3923407 - RNA, 21 nt, Human adenovirus D
aaucuaggaggcccaucuaca

SEQ ID NO: 3923408 - RNA, 22 nt, Human adenovirus D
aaucucccaccaccagcccauu

SEQ ID NO: 3923409 - RNA, 15 nt, Human adenovirus D
aaucuuuaucugcug

SEQ ID NO: 3923410 - RNA, 19 nt, Human adenovirus D
aaugacaaacaaaagccau

SEQ ID NO: 3923411 - RNA, 17 nt, Human adenovirus D
aaugcaggauccagcgc

SEQ ID NO: 3923412 - RNA, 14 nt, Human adenovirus D
aaugcuccaaagcu

SEQ ID NO: 3923413 - RNA, 16 nt, Human adenovirus D
aaugucaggucugcug

SEQ ID NO: 3923414 - RNA, 23 nt, Human adenovirus D
aaugucuuauggugacucggcug

SEQ ID NO: 3923415 - RNA, 18 nt, Human adenovirus D
aauuggaaaaguggaaga

SEQ ID NO: 3923416 - RNA, 16 nt, Human adenovirus D
aauuggugcgcugggg

SEQ ID NO: 3923417 - RNA, 13 nt, Human adenovirus D
aauuucaagcugg

SEQ ID NO: 3923418 - RNA, 17 nt, Human adenovirus D
acaaagagcacagcagu

SEQ ID NO: 3923419 - RNA, 21 nt, Human adenovirus D
acaaccaugugcgcacccuga

SEQ ID NO: 3923420 - RNA, 22 nt, Human adenovirus D
acaacugcguguaucucaauaa

SEQ ID NO: 3923421 - RNA, 19 nt, Human adenovirus D
acaagauucaauaagguuc

SEQ ID NO: 3923422 - RNA, 16 nt, Human adenovirus D
acaaggcccugggcau

SEQ ID NO: 3923423 - RNA, 18 nt, Human adenovirus D
acaaguacacgccggcca

SEQ ID NO: 3923424 - RNA, 16 nt, Human adenovirus D
acaagucaaaagaaaa

SEQ ID NO: 3923425 - RNA, 20 nt, Human adenovirus D
acaagucggcggacaucgcu

SEQ ID NO: 3923426 - RNA, 13 nt, Human adenovirus D
acaauaaaaauua

SEQ ID NO: 3923427 - RNA, 17 nt, Human adenovirus D
acaccagacacaucucc

SEQ ID NO: 3923428 - RNA, 23 nt, Human adenovirus D
acaccgccuccacccuggaagcc

SEQ ID NO: 3923429 - RNA, 14 nt, Human adenovirus D
acaccgccuccccg

SEQ ID NO: 3923430 - RNA, 19 nt, Human adenovirus D
acaccgugaaaauggaugu

SEQ ID NO: 3923431 - RNA, 21 nt, Human adenovirus D
acaccuggaggcaccaucaca

SEQ ID NO: 3923432 - RNA, 15 nt, Human adenovirus D
acacugaaaauguca

SEQ ID NO: 3923433 - RNA, 22 nt, Human adenovirus D
acacuuaguucagcugcaauga

SEQ ID NO: 3923434 - RNA, 14 nt, Human adenovirus D
acagaacaaaaaca

SEQ ID NO: 3923435 - RNA, 13 nt, Human adenovirus D
acagaaccggagg

SEQ ID NO: 3923436 - RNA, 13 nt, Human adenovirus D
gcugguggcgcug

SEQ ID NO: 3923437 - RNA, 13 nt, Human adenovirus D
gcugguugaacau

SEQ ID NO: 3923438 - RNA, 18 nt, Human adenovirus D
gcuguaccgcgaggccau

SEQ ID NO: 3923439 - RNA, 20 nt, Human adenovirus D
gcuguauuaccuuccuugcu

SEQ ID NO: 3923440 - RNA, 12 nt, Human adenovirus D
gcugucgguguc

SEQ ID NO: 3923441 - RNA, 19 nt, Human adenovirus D
gcuguggucgacuugcaag

SEQ ID NO: 3923442 - RNA, 15 nt, Human adenovirus D
gcuguucauggccaa

SEQ ID NO: 3923443 - RNA, 14 nt, Human adenovirus D
gcuucacucuggcc

SEQ ID NO: 3923444 - RNA, 16 nt, Human adenovirus D
gcuuccguugcgcugc

SEQ ID NO: 3923445 - RNA, 21 nt, Human adenovirus D
gcuucgaguacgaggccaugc

SEQ ID NO: 3923446 - RNA, 13 nt, Human adenovirus D
gcuucuacagcca

SEQ ID NO: 3923447 - RNA, 19 nt, Human adenovirus D
gcuuggucuuucuggcuug

SEQ ID NO: 3923448 - RNA, 16 nt, Human adenovirus D
ggaaagacgguggugc

SEQ ID NO: 3923449 - RNA, 16 nt, Human adenovirus D
ggaaccccaccaugaa

SEQ ID NO: 3923450 - RNA, 17 nt, Human adenovirus D
ggaacugauaagacaca

SEQ ID NO: 3923451 - RNA, 19 nt, Human adenovirus D
ggaagaagagacagaagaa

SEQ ID NO: 3923452 - RNA, 23 nt, Human adenovirus D
ggaagcaaaguuuuucaggggcu

SEQ ID NO: 3923453 - RNA, 17 nt, Human adenovirus D
ggaagccaugcugcgca

SEQ ID NO: 3923454 - RNA, 16 nt, Human adenovirus D
ggaagggaaugcgugg

SEQ ID NO: 3923455 - RNA, 14 nt, Human adenovirus D
ggaagugcuggaca

SEQ ID NO: 3923456 - RNA, 16 nt, Human adenovirus D
ggaauguuacugcaua

SEQ ID NO: 3923457 - RNA, 15 nt, Human adenovirus D
ggacagcagcccuuc

SEQ ID NO: 3923458 - RNA, 22 nt, Human adenovirus D
ggacaucgcgaaccaggcagug

SEQ ID NO: 3923459 - RNA, 14 nt, Human adenovirus D
ggacaugcagcugc

SEQ ID NO: 3923460 - RNA, 18 nt, Human adenovirus D
ggaccaggcggcagagcg

SEQ ID NO: 3923461 - RNA, 17 nt, Human adenovirus D
ggaccccacggcauggg

SEQ ID NO: 3923462 - RNA, 18 nt, Human adenovirus D
ggacgacugggaggcugc

SEQ ID NO: 3923463 - RNA, 18 nt, Human adenovirus D
ggacgagaaccugaagga

SEQ ID NO: 3923464 - RNA, 22 nt, Human adenovirus D
ggacgcccuggccgaccggagc

SEQ ID NO: 3923465 - RNA, 19 nt, Human adenovirus D
ggacgcugcucaccacccc

SEQ ID NO: 3923466 - RNA, 16 nt, Human adenovirus D
ggacgggcgcccagug

SEQ ID NO: 3923467 - RNA, 18 nt, Human adenovirus D
ggacuucgcagccaugca

SEQ ID NO: 3923468 - RNA, 21 nt, Human adenovirus D
ggagaucacuagcgugagccg

SEQ ID NO: 3923469 - RNA, 19 nt, Human adenovirus D
ggagaugcgcgacugccgg

SEQ ID NO: 3923470 - RNA, 12 nt, Human adenovirus D
ggagcaggagga

SEQ ID NO: 3923471 - RNA, 20 nt, Human adenovirus D
ggagcaggguaaagccagca

SEQ ID NO: 3923472 - RNA, 12 nt, Human adenovirus D
ggagccacugcu

SEQ ID NO: 3923473 - RNA, 15 nt, Human adenovirus D
ggagccauagagggc

SEQ ID NO: 3923474 - RNA, 16 nt, Human adenovirus D
ggagccugaugagcuc

SEQ ID NO: 3923475 - RNA, 13 nt, Human adenovirus D
ggagcgcauccug

SEQ ID NO: 3923476 - RNA, 16 nt, Human adenovirus D
ggagcgcguaggccgc

SEQ ID NO: 3923477 - RNA, 19 nt, Human adenovirus D
caacucgcggcugcugcug

SEQ ID NO: 3923478 - RNA, 20 nt, Human adenovirus D
caacucuuaaaucauuuaaa

SEQ ID NO: 3923479 - RNA, 15 nt, Human adenovirus D
caacugcagaccggg

SEQ ID NO: 3923480 - RNA, 15 nt, Human adenovirus D
caacuuccccuaccc

SEQ ID NO: 3923481 - RNA, 17 nt, Human adenovirus D
caagaaacgucccagca

SEQ ID NO: 3923482 - RNA, 19 nt, Human adenovirus D
caagaacgagggccugggc

SEQ ID NO: 3923483 - RNA, 20 nt, Human adenovirus D
caagaagaaguuagaggagg

SEQ ID NO: 3923484 - RNA, 20 nt, Human adenovirus D
caagacgcaggccaggagga

SEQ ID NO: 3923485 - RNA, 22 nt, Human adenovirus D
caagacgcaggccaggaggaga

SEQ ID NO: 3923486 - RNA, 23 nt, Human adenovirus D
caagacgcaggccaggaggagac

SEQ ID NO: 3923487 - RNA, 18 nt, Human adenovirus D
caagcgccaacagcagcg

SEQ ID NO: 3923488 - RNA, 20 nt, Human adenovirus D
caagcuggugaugccagggg

SEQ ID NO: 3923489 - RNA, 17 nt, Human adenovirus D
caaggacuacaaggccg

SEQ ID NO: 3923490 - RNA, 14 nt, Human adenovirus D
caaggcacccacca

SEQ ID NO: 3923491 - RNA, 21 nt, Human adenovirus D
caaggccauaaaucugcccug

SEQ ID NO: 3923492 - RNA, 17 nt, Human adenovirus D
caaggccauagcgugcg

SEQ ID NO: 3923493 - RNA, 16 nt, Human adenovirus D
caaggccgugagcgcg

SEQ ID NO: 3923494 - RNA, 13 nt, Human adenovirus D
caaggcgcgcuuc

SEQ ID NO: 3923495 - RNA, 17 nt, Human adenovirus D
caagguccgcaggaguc

SEQ ID NO: 3923496 - RNA, 15 nt, Human adenovirus D
caaggucgaggagac

SEQ ID NO: 3923497 - RNA, 19 nt, Human adenovirus D
caaguaggugaagaaaacu

SEQ ID NO: 3923498 - RNA, 13 nt, Human adenovirus D
caaguccagggug

SEQ ID NO: 3923499 - RNA, 15 nt, Human adenovirus D
caagugccuuuauca

SEQ ID NO: 3923500 - RNA, 21 nt, Human adenovirus D
caauaauggaagcauuacuau

SEQ ID NO: 3923501 - RNA, 15 nt, Human adenovirus D
caaucagccccuucc

SEQ ID NO: 3923502 - RNA, 18 nt, Human adenovirus D
caaucgggcaacagggga

SEQ ID NO: 3923503 - RNA, 18 nt, Human adenovirus D
caaucucccaccaccagc

SEQ ID NO: 3923504 - RNA, 23 nt, Human adenovirus D
caaucucggcgucauugacggcg

SEQ ID NO: 3923505 - RNA, 13 nt, Human adenovirus D
caauggaaaucac

SEQ ID NO: 3923506 - RNA, 15 nt, Human adenovirus D
caaugucagcugcaa

SEQ ID NO: 3923507 - RNA, 19 nt, Human adenovirus D
caaugucaggucugcuggu

SEQ ID NO: 3923508 - RNA, 17 nt, Human adenovirus D
caauucagagccagggc

SEQ ID NO: 3923509 - RNA, 18 nt, Human adenovirus D
cacagcaguccaugccca

SEQ ID NO: 3923510 - RNA, 14 nt, Human adenovirus D
cacagccucucuga

SEQ ID NO: 3923511 - RNA, 17 nt, Human adenovirus D
cacaggaugaacaggag

SEQ ID NO: 3923512 - RNA, 13 nt, Human adenovirus D
cacaggcacacug

SEQ ID NO: 3923513 - RNA, 14 nt, Human adenovirus D
cacaggcacacuga

SEQ ID NO: 3923514 - RNA, 16 nt, Human adenovirus D
cacaggcacacugaca

SEQ ID NO: 3923515 - RNA, 14 nt, Human adenovirus D
cacagugcccccuc

SEQ ID NO: 3923516 - RNA, 14 nt, Human adenovirus D
cacauacacacuag

SEQ ID NO: 3923517 - RNA, 13 nt, Human adenovirus D
cacaucagccagg

SEQ ID NO: 3923518 - RNA, 14 nt, Human adenovirus D
cacaucagccagga

SEQ ID NO: 3923519 - RNA, 14 nt, Human adenovirus D
cacaucggacuggg

SEQ ID NO: 3923520 - RNA, 21 nt, Human adenovirus D
cacauguccccuuccuccgca

SEQ ID NO: 3923521 - RNA, 23 nt, Human adenovirus D
cacauguccccuuccuccgcauc

SEQ ID NO: 3923522 - RNA, 11 nt, Human adenovirus D
caccaaggcca

SEQ ID NO: 3923523 - RNA, 17 nt, Human adenovirus D
caccacccacgcccgcu

SEQ ID NO: 3923524 - RNA, 14 nt, Human adenovirus D
caccagacacaucu

SEQ ID NO: 3923525 - RNA, 12 nt, Human adenovirus D
caccagcccauu

SEQ ID NO: 3923526 - RNA, 21 nt, Human adenovirus D
caccauccgcgccgcagcccg

SEQ ID NO: 3923527 - RNA, 14 nt, Human adenovirus D
caccaucugagcuc

SEQ ID NO: 3923528 - RNA, 11 nt, Human adenovirus D
caccaugcgcc

SEQ ID NO: 3923529 - RNA, 12 nt, Human adenovirus D
caccccaggcgg

SEQ ID NO: 3923530 - RNA, 17 nt, Human adenovirus D
caccccccgcaggcagg

SEQ ID NO: 3923531 - RNA, 19 nt, Human adenovirus D
cacccccgccgaggcuagc

SEQ ID NO: 3923532 - RNA, 19 nt, Human adenovirus D
cacccggacguggugcugc

SEQ ID NO: 3923533 - RNA, 21 nt, Human adenovirus D
cacccggacguggugcugcug

SEQ ID NO: 3923534 - RNA, 23 nt, Human adenovirus D
cacccgguacuacgccagccgca

SEQ ID NO: 3923535 - RNA, 22 nt, Human adenovirus D
cacccguaaaugacucuccuga

SEQ ID NO: 3923536 - RNA, 13 nt, Human adenovirus D
cacccucaggcgc

SEQ ID NO: 3923537 - RNA, 14 nt, Human adenovirus D
cacccucaggcgca

SEQ ID NO: 3923538 - RNA, 15 nt, Human adenovirus D
cacccugcccuucca

SEQ ID NO: 3923539 - RNA, 18 nt, Human adenovirus D
cacccugcccuuccagca

SEQ ID NO: 3923540 - RNA, 15 nt, Human adenovirus D
cacccuggggcuccu

SEQ ID NO: 3923541 - RNA, 16 nt, Human adenovirus D
caccgaccuugcaaaa

SEQ ID NO: 3923542 - RNA, 14 nt, Human adenovirus D
caccgagccuccca

SEQ ID NO: 3923543 - RNA, 16 nt, Human adenovirus D
caccgagccucccagg

SEQ ID NO: 3923544 - RNA, 15 nt, Human adenovirus D
caccgcgaccgcggc

SEQ ID NO: 3923545 - RNA, 16 nt, Human adenovirus D
caccgcuaccgcuucc

SEQ ID NO: 3923546 - RNA, 16 nt, Human adenovirus D
caccgcuccuggucug

SEQ ID NO: 3923547 - RNA, 20 nt, Human adenovirus D
caccgugcgcuaccacccca

SEQ ID NO: 3923548 - RNA, 21 nt, Human adenovirus D
caccguuccaugcagacacuu

SEQ ID NO: 3923549 - RNA, 17 nt, Human adenovirus D
caccucggugcagccgu

SEQ ID NO: 3923550 - RNA, 19 nt, Human adenovirus D
caccugcagcgccaguccc

SEQ ID NO: 3923551 - RNA, 15 nt, Human adenovirus D
caccuuacacugacg

SEQ ID NO: 3923552 - RNA, 14 nt, Human adenovirus D
caccuuccugcagc

SEQ ID NO: 3923553 - RNA, 19 nt, Human adenovirus D
cacgaucccgggcauagcu

SEQ ID NO: 3923554 - RNA, 12 nt, Human adenovirus D
cacgcccugggu

SEQ ID NO: 3923555 - RNA, 14 nt, Human adenovirus D
cacggccagcaggg

SEQ ID NO: 3923556 - RNA, 20 nt, Human adenovirus D
cacgguaagagcccagcaug

SEQ ID NO: 3923557 - RNA, 21 nt, Human adenovirus D
cacggucaccgagccucccag

SEQ ID NO: 3923558 - RNA, 16 nt, Human adenovirus D
cacguacuucagccug

SEQ ID NO: 3923559 - RNA, 23 nt, Human adenovirus D
cacguacuuugacauccgcggcg

SEQ ID NO: 3923560 - RNA, 24 nt, Human adenovirus D
cacuagaaagcaguucacuagccu

SEQ ID NO: 3923561 - RNA, 21 nt, Human adenovirus D
cacucacuuuuaggugaagca

SEQ ID NO: 3923562 - RNA, 21 nt, Human adenovirus D
cacucccgucucgacccgagc

SEQ ID NO: 3923563 - RNA, 22 nt, Human adenovirus D
cacuccuaaaaccggaggugag

SEQ ID NO: 3923564 - RNA, 17 nt, Human adenovirus D
cacugcauggccucgug

SEQ ID NO: 3923565 - RNA, 18 nt, Human adenovirus D
cacugccgccgccugcgc

SEQ ID NO: 3923566 - RNA, 20 nt, Human adenovirus D
cacugccgccgccugcgcug

SEQ ID NO: 3923567 - RNA, 16 nt, Human adenovirus D
cacugcuccugcgaaa

SEQ ID NO: 3923568 - RNA, 17 nt, Human adenovirus D
cacuggcuuccgccgcc

SEQ ID NO: 3923569 - RNA, 16 nt, Human adenovirus D
cacuuaaguccugggc

SEQ ID NO: 3923570 - RNA, 17 nt, Human adenovirus D
cacuucgccuaccccgc

SEQ ID NO: 3923571 - RNA, 17 nt, Human adenovirus D
cacuugagcuggccuuc

SEQ ID NO: 3923572 - RNA, 20 nt, Human adenovirus D
cacuuucauaaucaggcaga

SEQ ID NO: 3923573 - RNA, 11 nt, Human adenovirus D
cagaaagaaau

SEQ ID NO: 3923574 - RNA, 14 nt, Human adenovirus D
cagaacuggcagag

SEQ ID NO: 3923575 - RNA, 17 nt, Human adenovirus D
cagaauauccccuuccu

SEQ ID NO: 3923576 - RNA, 22 nt, Human adenovirus D
cagaaucaaaucgccaagggca

SEQ ID NO: 3923577 - RNA, 18 nt, Human adenovirus D
cagaauucaaccacaccu

SEQ ID NO: 3923578 - RNA, 15 nt, Human adenovirus D
cagacaaacauccau

SEQ ID NO: 3923579 - RNA, 16 nt, Human adenovirus D
cagacacaucuccuaa

SEQ ID NO: 3923580 - RNA, 17 nt, Human adenovirus D
cagacacaucuccuaau

SEQ ID NO: 3923581 - RNA, 19 nt, Human adenovirus D
cagacagccaggucaaaac

SEQ ID NO: 3923582 - RNA, 15 nt, Human adenovirus D
cagaccaccugguga

SEQ ID NO: 3923583 - RNA, 16 nt, Human adenovirus D
cagacgcaagagccgg

SEQ ID NO: 3923584 - RNA, 17 nt, Human adenovirus D
cagacucugcucauacu

SEQ ID NO: 3923585 - RNA, 22 nt, Human adenovirus D
cagacucugcucauacugcuau

SEQ ID NO: 3923586 - RNA, 22 nt, Human adenovirus D
cagagcucuuaagaaagacaca

SEQ ID NO: 3923587 - RNA, 19 nt, Human adenovirus D
cagaggauggucaucaccc

SEQ ID NO: 3923588 - RNA, 13 nt, Human adenovirus D
cagaguaagagga

SEQ ID NO: 3923589 - RNA, 15 nt, Human adenovirus D
cagaucauggugccc

SEQ ID NO: 3923590 - RNA, 15 nt, Human adenovirus D
cagauuuaagcaagg

SEQ ID NO: 3923591 - RNA, 15 nt, Human adenovirus D
cagcaacccuuccug

SEQ ID NO: 3923592 - RNA, 17 nt, Human adenovirus D
cugcugaaacaccugca

SEQ ID NO: 3923593 - RNA, 22 nt, Human adenovirus D
cugcugaaacaccugcagcgcc

SEQ ID NO: 3923594 - RNA, 14 nt, Human adenovirus D
cugcugccgcucag

SEQ ID NO: 3923595 - RNA, 20 nt, Human adenovirus D
cugcugccgcucagucaucc

SEQ ID NO: 3923596 - RNA, 15 nt, Human adenovirus D
cugcugccgggcugc

SEQ ID NO: 3923597 - RNA, 16 nt, Human adenovirus D
cugcuggcccacggcc

SEQ ID NO: 3923598 - RNA, 15 nt, Human adenovirus D
cugcuguaaagccag

SEQ ID NO: 3923599 - RNA, 15 nt, Human adenovirus D
cugcuucgcccggga

SEQ ID NO: 3923600 - RNA, 14 nt, Human adenovirus D
cugcuucugccugg

SEQ ID NO: 3923601 - RNA, 16 nt, Human adenovirus D
cugcuucugccuggug

SEQ ID NO: 3923602 - RNA, 21 nt, Human adenovirus D
cuggaagccaugcugcgcaac

SEQ ID NO: 3923603 - RNA, 23 nt, Human adenovirus D
cuggacuucgcagccaugcaccu

SEQ ID NO: 3923604 - RNA, 19 nt, Human adenovirus D
cuggaucgaaaucaaaauc

SEQ ID NO: 3923605 - RNA, 20 nt, Human adenovirus D
cuggaugauguccuugagga

SEQ ID NO: 3923606 - RNA, 17 nt, Human adenovirus D
cuggcagagcacgcugc

SEQ ID NO: 3923607 - RNA, 16 nt, Human adenovirus D
cuggccagcacgcucu

SEQ ID NO: 3923608 - RNA, 12 nt, Human adenovirus D
cuggcccgaccg

SEQ ID NO: 3923609 - RNA, 15 nt, Human adenovirus D
cuggccgugggcgac

SEQ ID NO: 3923610 - RNA, 18 nt, Human adenovirus D
cuggccgugguccugguc

SEQ ID NO: 3923611 - RNA, 16 nt, Human adenovirus D
cuggccucgagcuaca

SEQ ID NO: 3923612 - RNA, 19 nt, Human adenovirus D
cuggcgaaagauggcgugc

SEQ ID NO: 3923613 - RNA, 15 nt, Human adenovirus D
cuggcgacgcagccg

SEQ ID NO: 3923614 - RNA, 22 nt, Human adenovirus D
cuggcgaucgugaacgcgcugg

SEQ ID NO: 3923615 - RNA, 20 nt, Human adenovirus D
cuggcgguagagcggccagc

SEQ ID NO: 3923616 - RNA, 15 nt, Human adenovirus D
cuggcugcuggagcu

SEQ ID NO: 3923617 - RNA, 16 nt, Human adenovirus D
cuggcugcuggagcug

SEQ ID NO: 3923618 - RNA, 17 nt, Human adenovirus D
cuggcuucuacagccag

SEQ ID NO: 3923619 - RNA, 16 nt, Human adenovirus D
cugggagggaugcaug

SEQ ID NO: 3923620 - RNA, 17 nt, Human adenovirus D
cugggcucgagcauggc

SEQ ID NO: 3923621 - RNA, 17 nt, Human adenovirus D
cugggcucgcugguggc

SEQ ID NO: 3923622 - RNA, 19 nt, Human adenovirus D
cugggugacagaaccagau

SEQ ID NO: 3923623 - RNA, 17 nt, Human adenovirus D
cugguacuugggcugcc

SEQ ID NO: 3923624 - RNA, 20 nt, Human adenovirus D
cuggucaguugcaccacgcu

SEQ ID NO: 3923625 - RNA, 17 nt, Human adenovirus D
cuggugaagggcacagc

SEQ ID NO: 3923626 - RNA, 15 nt, Human adenovirus D
cuggugcgucgagca

SEQ ID NO: 3923627 - RNA, 21 nt, Human adenovirus D
ccggcgcaguacgcgcugucg

SEQ ID NO: 3923628 - RNA, 20 nt, Human adenovirus D
ccggcggcgcgagcugagcg

SEQ ID NO: 3923629 - RNA, 12 nt, Human adenovirus D
ccggcugaugcc

SEQ ID NO: 3923630 - RNA, 17 nt, Human adenovirus D
ccgggacgcccuggccg

SEQ ID NO: 3923631 - RNA, 15 nt, Human adenovirus D
ccggggcggggguga

SEQ ID NO: 3923632 - RNA, 22 nt, Human adenovirus D
ccggggguucauguugugcagg

SEQ ID NO: 3923633 - RNA, 18 nt, Human adenovirus D
ccggucucugcgcucgcu

SEQ ID NO: 3923634 - RNA, 23 nt, Human adenovirus D
ccgguggcgaccgccgugcgccg

SEQ ID NO: 3923635 - RNA, 19 nt, Human adenovirus D
ccguaucgugcugcucucu

SEQ ID NO: 3923636 - RNA, 14 nt, Human adenovirus D
ccgucagcagcagg

SEQ ID NO: 3923637 - RNA, 16 nt, Human adenovirus D
ccgucagcagcaggag

SEQ ID NO: 3923638 - RNA, 14 nt, Human adenovirus D
ccguccuugccuuc

SEQ ID NO: 3923639 - RNA, 15 nt, Human adenovirus D
ccgucggccaugggc

SEQ ID NO: 3923640 - RNA, 22 nt, Human adenovirus D
ccgugagcucgucuuccaggag

SEQ ID NO: 3923641 - RNA, 21 nt, Human adenovirus D
ccgugcgcuaccaccccagca

SEQ ID NO: 3923642 - RNA, 17 nt, Human adenovirus D
ccgugcucaagcgcagc

SEQ ID NO: 3923643 - RNA, 23 nt, Human adenovirus D
ccguggcuucgagcaguggcucu

SEQ ID NO: 3923644 - RNA, 15 nt, Human adenovirus D
ccguucuacccagca

SEQ ID NO: 3923645 - RNA, 17 nt, Human adenovirus D
ccguucuccgccggaaa

SEQ ID NO: 3923646 - RNA, 17 nt, Human adenovirus D
ccuacaucaacauaggc

SEQ ID NO: 3923647 - RNA, 16 nt, Human adenovirus D
ccuacucgggcacggc

SEQ ID NO: 3923648 - RNA, 19 nt, Human adenovirus D
ccuagcauguacgccgcca

SEQ ID NO: 3923649 - RNA, 21 nt, Human adenovirus D
ccuaggggaagauggaggagc

SEQ ID NO: 3923650 - RNA, 15 nt, Human adenovirus D
ccucacucucuuccg

SEQ ID NO: 3923651 - RNA, 17 nt, Human adenovirus D
ccucaggcgcaaccagg

SEQ ID NO: 3923652 - RNA, 20 nt, Human adenovirus D
ccucaucacaucagccagga

SEQ ID NO: 3923653 - RNA, 11 nt, Human adenovirus D
ccuccacccug

SEQ ID NO: 3923654 - RNA, 19 nt, Human adenovirus D
ccucccgcccgacacugca

SEQ ID NO: 3923655 - RNA, 18 nt, Human adenovirus D
ccuccgguggcgaccgcc

SEQ ID NO: 3923656 - RNA, 18 nt, Human adenovirus D
ccuccgucggaagaggag

SEQ ID NO: 3923657 - RNA, 21 nt, Human adenovirus D
ccuccuguuacuguaaagcca

SEQ ID NO: 3923658 - RNA, 18 nt, Human adenovirus D
ccucgaggacggagaggc

SEQ ID NO: 3923659 - RNA, 23 nt, Human adenovirus D
ccucgaugaaagucaggagcagc

SEQ ID NO: 3923660 - RNA, 13 nt, Human adenovirus D
ccucggcggcgug

SEQ ID NO: 3923661 - RNA, 14 nt, Human adenovirus D
ccucggucagcugg

SEQ ID NO: 3923662 - RNA, 19 nt, Human adenovirus D
ccucgucauccuuccagua

SEQ ID NO: 3923663 - RNA, 15 nt, Human adenovirus D
ccucguccucuuccu

SEQ ID NO: 3923664 - RNA, 16 nt, Human adenovirus D
ccucguccucuuccuc

SEQ ID NO: 3923665 - RNA, 20 nt, Human adenovirus D
ccucguuucggggguuggga

SEQ ID NO: 3923666 - RNA, 16 nt, Human adenovirus D
ccucuacgccaccuuc

SEQ ID NO: 3923667 - RNA, 14 nt, Human adenovirus D
ccucucggccgcca

SEQ ID NO: 3923668 - RNA, 11 nt, Human adenovirus D
ccucugcaucu

SEQ ID NO: 3923669 - RNA, 16 nt, Human adenovirus D
ccucugcaucugauga

SEQ ID NO: 3923670 - RNA, 16 nt, Human adenovirus D
ccucugccguccgccc

SEQ ID NO: 3923671 - RNA, 21 nt, Human adenovirus D
ccucugccguccgcccgcgcc

SEQ ID NO: 3923672 - RNA, 18 nt, Human adenovirus D
ccucuugcagcuggccaa

SEQ ID NO: 3923673 - RNA, 20 nt, Human adenovirus D
ccucuuugcccugcucaccu

SEQ ID NO: 3923674 - RNA, 15 nt, Human adenovirus D
ccugaaccgccgccg

SEQ ID NO: 3923675 - RNA, 22 nt, Human adenovirus D
ccugaagaacauccaugugacc

SEQ ID NO: 3923676 - RNA, 14 nt, Human adenovirus D
ccugaaggagcugg

SEQ ID NO: 3923677 - RNA, 14 nt, Human adenovirus D
ccugacgagccaaa

SEQ ID NO: 3923678 - RNA, 17 nt, Human adenovirus D
ccugauauugcuucccu

SEQ ID NO: 3923679 - RNA, 19 nt, Human adenovirus D
ccugaucucugccauguuc

SEQ ID NO: 3923680 - RNA, 16 nt, Human adenovirus D
ccugcacgcagcagcg

SEQ ID NO: 3923681 - RNA, 12 nt, Human adenovirus D
ccugcagcccaa

SEQ ID NO: 3923682 - RNA, 18 nt, Human adenovirus D
ccugcaggggcgucccgc

SEQ ID NO: 3923683 - RNA, 15 nt, Human adenovirus D
ccugcauuggcagcc

SEQ ID NO: 3923684 - RNA, 12 nt, Human adenovirus D
ccugcccuucca

SEQ ID NO: 3923685 - RNA, 21 nt, Human adenovirus D
ccugcgcgagguugagcucca

SEQ ID NO: 3923686 - RNA, 16 nt, Human adenovirus D
ccugcgcgggcugugg

SEQ ID NO: 3923687 - RNA, 14 nt, Human adenovirus D
ccugcgcugcuucg

SEQ ID NO: 3923688 - RNA, 17 nt, Human adenovirus D
ccugcucaccugcaccu

SEQ ID NO: 3923689 - RNA, 18 nt, Human adenovirus D
ccugcucaccugcaccug

SEQ ID NO: 3923690 - RNA, 14 nt, Human adenovirus D
ccugcuggagcgcg

SEQ ID NO: 3923691 - RNA, 22 nt, Human adenovirus D
ccugcuggagcgcguaggccgc

SEQ ID NO: 3923692 - RNA, 18 nt, Human adenovirus D
ccugcuggccgagcugga

SEQ ID NO: 3923693 - RNA, 13 nt, Human adenovirus D
ccuggagcagcgg

SEQ ID NO: 3923694 - RNA, 20 nt, Human adenovirus D
ccuggaucuugagguuggcg

SEQ ID NO: 3923695 - RNA, 15 nt, Human adenovirus D
ccuggcucccagccu

SEQ ID NO: 3923696 - RNA, 15 nt, Human adenovirus D
ccuggcuccgcggca

SEQ ID NO: 3923697 - RNA, 17 nt, Human adenovirus D
ccuggcuccgcggcacg

SEQ ID NO: 3923698 - RNA, 21 nt, Human adenovirus D
ccugggagucucuaccgaggg

SEQ ID NO: 3923699 - RNA, 17 nt, Human adenovirus D
ccuggucaucaccuucc

SEQ ID NO: 3923700 - RNA, 15 nt, Human adenovirus D
ccuggucgagcggga

SEQ ID NO: 3923701 - RNA, 19 nt, Human adenovirus D
ccuggugauacgaggcaga

SEQ ID NO: 3923702 - RNA, 21 nt, Human adenovirus D
ccuggugcgucgagcacagca

SEQ ID NO: 3923703 - RNA, 21 nt, Human adenovirus D
ccugugacaugcaaaaucuua

SEQ ID NO: 3923704 - RNA, 17 nt, Human adenovirus D
ccuucaccgaccugggu

SEQ ID NO: 3923705 - RNA, 15 nt, Human adenovirus D
ccuucggcuggaacc

SEQ ID NO: 3923706 - RNA, 20 nt, Human adenovirus D
ccuucuuccgcaacuuccag

SEQ ID NO: 3923707 - RNA, 15 nt, Human adenovirus D
ccuugaccugccucc

SEQ ID NO: 3923708 - RNA, 18 nt, Human adenovirus D
ugggccacuacagcugac

SEQ ID NO: 3923709 - RNA, 23 nt, Human adenovirus D
ugggcugcggcuuuggcaaagac

SEQ ID NO: 3923710 - RNA, 21 nt, Human adenovirus D
ugggguacuuuacgcuggcca

SEQ ID NO: 3923711 - RNA, 15 nt, Human adenovirus D
uggggucucggggaa

SEQ ID NO: 3923712 - RNA, 21 nt, Human adenovirus D
uggggugcuguucauggccaa

SEQ ID NO: 3923713 - RNA, 24 nt, Human adenovirus D
ugguagggggcgccgccggcggcg

SEQ ID NO: 3923714 - RNA, 18 nt, Human adenovirus D
uggucagcgaugagcagc

SEQ ID NO: 3923715 - RNA, 22 nt, Human adenovirus D
uggucgagcgggaccggggagg

SEQ ID NO: 3923716 - RNA, 17 nt, Human adenovirus D
uggucggcacggucugg

SEQ ID NO: 3923717 - RNA, 13 nt, Human adenovirus D
uggugauggccug

SEQ ID NO: 3923718 - RNA, 11 nt, Human adenovirus D
uggugcccaag

SEQ ID NO: 3923719 - RNA, 19 nt, Human adenovirus D
ugguggcgcgcaccucgcg

SEQ ID NO: 3923720 - RNA, 14 nt, Human adenovirus D
uguaaauaagucac

SEQ ID NO: 3923721 - RNA, 16 nt, Human adenovirus D
uguaaccuugcaagag

SEQ ID NO: 3923722 - RNA, 18 nt, Human adenovirus D
uguaagugugacaaucaa

SEQ ID NO: 3923723 - RNA, 13 nt, Human adenovirus D
uguacacugaaaa

SEQ ID NO: 3923724 - RNA, 14 nt, Human adenovirus D
uguacuuugucugc

SEQ ID NO: 3923725 - RNA, 18 nt, Human adenovirus D
uguagagggaaccuacca

SEQ ID NO: 3923726 - RNA, 20 nt, Human adenovirus D
uguaggccauccccauccag

SEQ ID NO: 3923727 - RNA, 17 nt, Human adenovirus D
ugucaaagcgcaucuac

SEQ ID NO: 3923728 - RNA, 23 nt, Human adenovirus D
ugucacuagaggugguaaaauua

SEQ ID NO: 3923729 - RNA, 16 nt, Human adenovirus D
ugucaggucugcuggu

SEQ ID NO: 3923730 - RNA, 18 nt, Human adenovirus D
uguccagauccucggcgu

SEQ ID NO: 3923731 - RNA, 19 nt, Human adenovirus D
ugucgccgauggccuccag

SEQ ID NO: 3923732 - RNA, 19 nt, Human adenovirus D
ugucuucccucucagaugu

SEQ ID NO: 3923733 - RNA, 23 nt, Human adenovirus D
ugugcaaugucaggucugcuggu

SEQ ID NO: 3923734 - RNA, 16 nt, Human adenovirus D
ugugcaguuuggccug

SEQ ID NO: 3923735 - RNA, 14 nt, Human adenovirus D
ugugcccgcccagg

SEQ ID NO: 3923736 - RNA, 19 nt, Human adenovirus D
ugugggaccuggcggaggc

SEQ ID NO: 3923737 - RNA, 16 nt, Human adenovirus D
ugugguuuaugacuca

SEQ ID NO: 3923738 - RNA, 22 nt, Human adenovirus D
uguuauugagcccaucaagcaa

SEQ ID NO: 3923739 - RNA, 15 nt, Human adenovirus D
uguucagcagcaccu

SEQ ID NO: 3923740 - RNA, 13 nt, Human adenovirus D
uguugcagagaga

SEQ ID NO: 3923741 - RNA, 14 nt, Human adenovirus D
uguuuauaaaucuu

SEQ ID NO: 3923742 - RNA, 20 nt, Human adenovirus D
uuaaaaaccaaaaaaaacaa

SEQ ID NO: 3923743 - RNA, 16 nt, Human adenovirus D
uuaaaggcuggcccuc

SEQ ID NO: 3923744 - RNA, 22 nt, Human adenovirus D
uuaacauccucuucugucucuu

SEQ ID NO: 3923745 - RNA, 21 nt, Human adenovirus D
uuacaccgcgucgcugaaagc

SEQ ID NO: 3923746 - RNA, 22 nt, Human adenovirus D
uuauaaucgccagggaacugaa

SEQ ID NO: 3923747 - RNA, 21 nt, Human adenovirus D
uucaaggccauaaaucugccc

SEQ ID NO: 3923748 - RNA, 15 nt, Human adenovirus D
uucauugucuucccu

SEQ ID NO: 3923749 - RNA, 13 nt, Human adenovirus D
uuccaaaaucaga

SEQ ID NO: 3923750 - RNA, 16 nt, Human adenovirus D
uuccagacgcggcugu

SEQ ID NO: 3923751 - RNA, 22 nt, Human adenovirus D
uuccccaccuacuccucuuugc

SEQ ID NO: 3923752 - RNA, 19 nt, Human adenovirus D
uucccuggaagagugccca

SEQ ID NO: 3923753 - RNA, 16 nt, Human adenovirus D
uuccggcaaaaaucac

SEQ ID NO: 3923754 - RNA, 17 nt, Human adenovirus D
uucgagacgucccagag

SEQ ID NO: 3923755 - RNA, 20 nt, Human adenovirus D
uucucuuacugaaacucagu

SEQ ID NO: 3923756 - RNA, 22 nt, Human adenovirus D
uucuggagaaguuccucugcau

SEQ ID NO: 3923757 - RNA, 12 nt, Human adenovirus D
uugaaaaaauug

SEQ ID NO: 3923758 - RNA, 15 nt, Human adenovirus D
uugaaaaggcagcug

SEQ ID NO: 3923759 - RNA, 15 nt, Human adenovirus D
uugaaaccacuuccu

SEQ ID NO: 3923760 - RNA, 22 nt, Human adenovirus D
uugaagucaugugugauaucac

SEQ ID NO: 3923761 - RNA, 19 nt, Human adenovirus D
uugaauuuguauggaauaa

SEQ ID NO: 3923762 - RNA, 18 nt, Human adenovirus D
uugagaauaacaugcuga

SEQ ID NO: 3923763 - RNA, 17 nt, Human adenovirus D
uugagcccaucaagcaa

SEQ ID NO: 3923764 - RNA, 15 nt, Human adenovirus D
uugaggcauucacau

SEQ ID NO: 3923765 - RNA, 22 nt, Human adenovirus D
uugaugcgcuucuuaccucgcg

SEQ ID NO: 3923766 - RNA, 12 nt, Human adenovirus D
uugauuggccug

SEQ ID NO: 3923767 - RNA, 13 nt, Human adenovirus D
uugcaaggcagaa

SEQ ID NO: 3923768 - RNA, 13 nt, Human adenovirus D
uugcccgcgccac

SEQ ID NO: 3923769 - RNA, 16 nt, Human adenovirus D
uuguagugucagaugg

SEQ ID NO: 3923770 - RNA, 19 nt, Human adenovirus D
uuuaaaaccucauuugcau

SEQ ID NO: 3923771 - RNA, 14 nt, Human adenovirus D
uuuaauuggcaaac

SEQ ID NO: 3923772 - RNA, 16 nt, Human adenovirus D
uuuacaugcacuggag

SEQ ID NO: 3923773 - RNA, 20 nt, Human adenovirus D
uuuagugggaccucagauau

SEQ ID NO: 3923774 - RNA, 23 nt, Human adenovirus D
uuucgggcgggcagggagcugcg

SEQ ID NO: 3923775 - RNA, 15 nt, Human adenovirus D
gaauugguauaagug

SEQ ID NO: 3923776 - RNA, 18 nt, Human adenovirus D
gaauuugaaaccacuucc

SEQ ID NO: 3923777 - RNA, 16 nt, Human adenovirus D
gacaaacaaaagccau

SEQ ID NO: 3923778 - RNA, 14 nt, Human adenovirus D
gacaaagagcacag

SEQ ID NO: 3923779 - RNA, 17 nt, Human adenovirus D
gacaaagagcacagcag

SEQ ID NO: 3923780 - RNA, 14 nt, Human adenovirus D
gacaacagccgcag

SEQ ID NO: 3923781 - RNA, 12 nt, Human adenovirus D
gacaacgccagg

SEQ ID NO: 3923782 - RNA, 14 nt, Human adenovirus D
gacaagcuggccug

SEQ ID NO: 3923783 - RNA, 12 nt, Human adenovirus D
gacaaugaugga

SEQ ID NO: 3923784 - RNA, 15 nt, Human adenovirus D
gacacaccuggaggc

SEQ ID NO: 3923785 - RNA, 13 nt, Human adenovirus D
gacacccccgcgu

SEQ ID NO: 3923786 - RNA, 20 nt, Human adenovirus D
gacacguacuucagccuggg

SEQ ID NO: 3923787 - RNA, 17 nt, Human adenovirus D
gacagagauggacuugg

SEQ ID NO: 3923788 - RNA, 23 nt, Human adenovirus D
gacagagauggacuuggaagagg

SEQ ID NO: 3923789 - RNA, 21 nt, Human adenovirus D
gacagcgacgagacuggccuc

SEQ ID NO: 3923790 - RNA, 15 nt, Human adenovirus D
gacagcguuccccuc

SEQ ID NO: 3923791 - RNA, 21 nt, Human adenovirus D
gacauccuggaccaggcggca

SEQ ID NO: 3923792 - RNA, 23 nt, Human adenovirus D
gacaucgcgaaccaggcagugca

SEQ ID NO: 3923793 - RNA, 13 nt, Human adenovirus D
gacauggccagca

SEQ ID NO: 3923794 - RNA, 17 nt, Human adenovirus D
gaccaggcggcagagcg

SEQ ID NO: 3923795 - RNA, 20 nt, Human adenovirus D
gaccagguccacgcuggugg

SEQ ID NO: 3923796 - RNA, 22 nt, Human adenovirus D
gaccaugacuuucaagaacugg

SEQ ID NO: 3923797 - RNA, 22 nt, Human adenovirus D
gaccaugcagaucauggugccc

SEQ ID NO: 3923798 - RNA, 15 nt, Human adenovirus D
gaccauucugcacac

SEQ ID NO: 3923799 - RNA, 13 nt, Human adenovirus D
gacccacagccag

SEQ ID NO: 3923800 - RNA, 18 nt, Human adenovirus D
gacccaggaauggcacgc

SEQ ID NO: 3923801 - RNA, 15 nt, Human adenovirus D
gaccccauggacaac

SEQ ID NO: 3923802 - RNA, 12 nt, Human adenovirus D
gacccccaggcc

SEQ ID NO: 3923803 - RNA, 20 nt, Human adenovirus D
ugagcucgucuuccaggagc

SEQ ID NO: 3923804 - RNA, 22 nt, Human adenovirus D
ugagcucuuaccaaguccaggg

SEQ ID NO: 3923805 - RNA, 12 nt, Human adenovirus D
ugagcugggagg

SEQ ID NO: 3923806 - RNA, 17 nt, Human adenovirus D
ugaggaucauaucccag

SEQ ID NO: 3923807 - RNA, 14 nt, Human adenovirus D
ugagggccucggcg

SEQ ID NO: 3923808 - RNA, 15 nt, Human adenovirus D
ugaggguguccugga

SEQ ID NO: 3923809 - RNA, 19 nt, Human adenovirus D
ugagguccucggggcauug

SEQ ID NO: 3923810 - RNA, 18 nt, Human adenovirus D
ugaguccgucggccaugg

SEQ ID NO: 3923811 - RNA, 13 nt, Human adenovirus D
ugauaaagcgugg

SEQ ID NO: 3923812 - RNA, 13 nt, Human adenovirus D
ugaugcaggaggg

SEQ ID NO: 3923813 - RNA, 23 nt, Human adenovirus D
ugaugcaggauaaauauggccug

SEQ ID NO: 3923814 - RNA, 18 nt, Human adenovirus D
ugauggauguguggacua

SEQ ID NO: 3923815 - RNA, 14 nt, Human adenovirus D
ugauuaaaaaccaa

SEQ ID NO: 3923816 - RNA, 18 nt, Human adenovirus D
ugauucaguacuuagaag

SEQ ID NO: 3923817 - RNA, 13 nt, Human adenovirus D
ugauuccacauau

SEQ ID NO: 3923818 - RNA, 15 nt, Human adenovirus D
ugauugcucuggccu

SEQ ID NO: 3923819 - RNA, 14 nt, Human adenovirus D
ugcaaaaagucacu

SEQ ID NO: 3923820 - RNA, 14 nt, Human adenovirus D
ugcaaacaauaaaa

SEQ ID NO: 3923821 - RNA, 14 nt, Human adenovirus D
ugcaaccugugcuc

SEQ ID NO: 3923822 - RNA, 23 nt, Human adenovirus D
ugcaacugcgcguccgucagcag

SEQ ID NO: 3923823 - RNA, 15 nt, Human adenovirus D
ugcaagucacgcagg

SEQ ID NO: 3923824 - RNA, 20 nt, Human adenovirus D
ugcaaugucaggucugcugg

SEQ ID NO: 3923825 - RNA, 23 nt, Human adenovirus D
ugcacaguagucaucaaaugcga

SEQ ID NO: 3923826 - RNA, 18 nt, Human adenovirus D
ugcaccauccccagguaa

SEQ ID NO: 3923827 - RNA, 12 nt, Human adenovirus D
ugcacccaccau

SEQ ID NO: 3923828 - RNA, 23 nt, Human adenovirus D
ugcacccaccaugcgccaagggc

SEQ ID NO: 3923829 - RNA, 21 nt, Human adenovirus D
ugcagaacaacgauuucaccc

SEQ ID NO: 3923830 - RNA, 20 nt, Human adenovirus D
ugcagacacuugagcuggcc

SEQ ID NO: 3923831 - RNA, 18 nt, Human adenovirus D
ugcagccaguggcccugg

SEQ ID NO: 3923832 - RNA, 16 nt, Human adenovirus D
ugcagcccccuccggu

SEQ ID NO: 3923833 - RNA, 23 nt, Human adenovirus D
ugcagccgccgcgggucaagaac

SEQ ID NO: 3923834 - RNA, 20 nt, Human adenovirus D
ugcaggauaaauauggccug

SEQ ID NO: 3923835 - RNA, 17 nt, Human adenovirus D
ugcagggagccagggga

SEQ ID NO: 3923836 - RNA, 20 nt, Human adenovirus D
ugcagucguggacgcugcuc

SEQ ID NO: 3923837 - RNA, 15 nt, Human adenovirus D
ugcaguuuggccugg

SEQ ID NO: 3923838 - RNA, 16 nt, Human adenovirus D
ugcaugagaauuuuug

SEQ ID NO: 3923839 - RNA, 19 nt, Human adenovirus D
ugccaccaguuggacgagu

SEQ ID NO: 3923840 - RNA, 14 nt, Human adenovirus D
ugcccaacaggccu

SEQ ID NO: 3923841 - RNA, 15 nt, Human adenovirus D
ugcccagcagcagca

SEQ ID NO: 3923842 - RNA, 21 nt, Human adenovirus D
ugcccagcagcagcaguagcc

SEQ ID NO: 3923843 - RNA, 13 nt, Human adenovirus D
ugcccccaagggc

SEQ ID NO: 3923844 - RNA, 21 nt, Human adenovirus D
ugcccgacgauguagaguucc

SEQ ID NO: 3923845 - RNA, 15 nt, Human adenovirus D
ugcccucgcuacugc

SEQ ID NO: 3923846 - RNA, 14 nt, Human adenovirus D
ugcccuuacaugua

SEQ ID NO: 3923847 - RNA, 20 nt, Human adenovirus D
ugccggcgacaagcuggccu

SEQ ID NO: 3923848 - RNA, 12 nt, Human adenovirus D
ugccgggacaga

SEQ ID NO: 3923849 - RNA, 16 nt, Human adenovirus D
ugccgucgucccggag

SEQ ID NO: 3923850 - RNA, 18 nt, Human adenovirus D
ugccuucgugcacuggcc

SEQ ID NO: 3923851 - RNA, 15 nt, Human adenovirus D
ugcgagaaggcgccc

SEQ ID NO: 3923852 - RNA, 22 nt, Human adenovirus D
ugcgagaaggcgcccaggccgc

SEQ ID NO: 3923853 - RNA, 17 nt, Human adenovirus D
ugcgagccgcgcgccgc

SEQ ID NO: 3923854 - RNA, 18 nt, Human adenovirus D
ugcgagccgcgcgccgcg

SEQ ID NO: 3923855 - RNA, 15 nt, Human adenovirus D
ugcgaguuggaggag

SEQ ID NO: 3923856 - RNA, 15 nt, Human adenovirus D
ugcgauauggaugau

SEQ ID NO: 3923857 - RNA, 22 nt, Human adenovirus D
ugcgcaaaaccuguucagggac

SEQ ID NO: 3923858 - RNA, 19 nt, Human adenovirus D
ugcgcaggcgccugagugg

SEQ ID NO: 3923859 - RNA, 15 nt, Human adenovirus D
ugcgccaagggcagc

SEQ ID NO: 3923860 - RNA, 18 nt, Human adenovirus D
ugcgccaagggcagcccu

SEQ ID NO: 3923861 - RNA, 16 nt, Human adenovirus D
ugcgccgaagcgccgu

SEQ ID NO: 3923862 - RNA, 16 nt, Human adenovirus D
acugauggccacgggg

SEQ ID NO: 3923863 - RNA, 17 nt, Human adenovirus D
acugcaccccccgcagg

SEQ ID NO: 3923864 - RNA, 16 nt, Human adenovirus D
acugcagggagccagg

SEQ ID NO: 3923865 - RNA, 13 nt, Human adenovirus D
acugcauggccuc

SEQ ID NO: 3923866 - RNA, 15 nt, Human adenovirus D
acugccaccgccgcc

SEQ ID NO: 3923867 - RNA, 18 nt, Human adenovirus D
acugccgccgccugcgcu

SEQ ID NO: 3923868 - RNA, 21 nt, Human adenovirus D
acugccgguuucgggcgggca

SEQ ID NO: 3923869 - RNA, 13 nt, Human adenovirus D
acugcuggcccug

SEQ ID NO: 3923870 - RNA, 18 nt, Human adenovirus D
acuggcuuccgccgccgg

SEQ ID NO: 3923871 - RNA, 19 nt, Human adenovirus D
acugggcguugcgggccga

SEQ ID NO: 3923872 - RNA, 22 nt, Human adenovirus D
acuuaacucugauucaugugaa

SEQ ID NO: 3923873 - RNA, 19 nt, Human adenovirus D
acuuacuugaaaucugaaa

SEQ ID NO: 3923874 - RNA, 13 nt, Human adenovirus D
acuuacuuugcaa

SEQ ID NO: 3923875 - RNA, 20 nt, Human adenovirus D
acuuauggcucagcugccau

SEQ ID NO: 3923876 - RNA, 15 nt, Human adenovirus D
acuucagccugggca

SEQ ID NO: 3923877 - RNA, 23 nt, Human adenovirus D
acuucuuuuugauaauaaaggug

SEQ ID NO: 3923878 - RNA, 15 nt, Human adenovirus D
acuugagcuggccuu

SEQ ID NO: 3923879 - RNA, 23 nt, Human adenovirus D
acuugcaaacaauaaaaaacuug

SEQ ID NO: 3923880 - RNA, 21 nt, Human adenovirus D
acuugcaaguggggcggcaaa

SEQ ID NO: 3923881 - RNA, 16 nt, Human adenovirus D
acuugggcugccacuu

SEQ ID NO: 3923882 - RNA, 13 nt, Human adenovirus D
acuuggggaacuu

SEQ ID NO: 3923883 - RNA, 18 nt, Human adenovirus D
acuuguaugugccuuacc

SEQ ID NO: 3923884 - RNA, 17 nt, Human adenovirus D
agaaaaguccuguaaau

SEQ ID NO: 3923885 - RNA, 23 nt, Human adenovirus D
agaaaugggcccuugaacagcau

SEQ ID NO: 3923886 - RNA, 14 nt, Human adenovirus D
agaaauuucaagcu

SEQ ID NO: 3923887 - RNA, 22 nt, Human adenovirus D
agaacaaaaacagacuggucaa

SEQ ID NO: 3923888 - RNA, 17 nt, Human adenovirus D
agaaccccacaggauga

SEQ ID NO: 3923889 - RNA, 15 nt, Human adenovirus D
agaaccugcgcgggc

SEQ ID NO: 3923890 - RNA, 16 nt, Human adenovirus D
agaaccugcuccugcu

SEQ ID NO: 3923891 - RNA, 14 nt, Human adenovirus D
agaagaacgcacag

SEQ ID NO: 3923892 - RNA, 15 nt, Human adenovirus D
agacccacagccagc

SEQ ID NO: 3923893 - RNA, 17 nt, Human adenovirus D
agaccgacgcugggcuc

SEQ ID NO: 3923894 - RNA, 21 nt, Human adenovirus D
agacugauggccacggggagc

SEQ ID NO: 3923895 - RNA, 17 nt, Human adenovirus D
agacugcuaucaggaga

SEQ ID NO: 3923896 - RNA, 14 nt, Human adenovirus D
agagagaggaagga

SEQ ID NO: 3923897 - RNA, 16 nt, Human adenovirus D
agagcaaucccacgcc

SEQ ID NO: 3923898 - RNA, 13 nt, Human adenovirus D
agagcacagcagu

SEQ ID NO: 3923899 - RNA, 21 nt, Human adenovirus D
agagggcgaagggcuggcgag

SEQ ID NO: 3923900 - RNA, 14 nt, Human adenovirus D
agaguaaaaguaaa

SEQ ID NO: 3923901 - RNA, 14 nt, Human adenovirus D
agagugccacugcc

SEQ ID NO: 3923902 - RNA, 15 nt, Human adenovirus D
agauacagaguaaaa

SEQ ID NO: 3923903 - RNA, 15 nt, Human adenovirus D
agaucaggggaugua

SEQ ID NO: 3923904 - RNA, 17 nt, Human adenovirus D
agauccugcugcuccac

SEQ ID NO: 3923905 - RNA, 15 nt, Human adenovirus D
agaucggcaccagcc

SEQ ID NO: 3923906 - RNA, 13 nt, Human adenovirus D
agaugcagcaagc

SEQ ID NO: 3923907 - RNA, 16 nt, Human adenovirus D
agcaaccuccugggca

SEQ ID NO: 3923908 - RNA, 22 nt, Human adenovirus D
agcaagacacgccggcuuguag

SEQ ID NO: 3923909 - RNA, 17 nt, Human adenovirus D
agcaauccuccaggacu

SEQ ID NO: 3923910 - RNA, 21 nt, Human adenovirus D
agcacaugguaauccacggac

SEQ ID NO: 3923911 - RNA, 15 nt, Human adenovirus D
agcacugcaaauuua

SEQ ID NO: 3923912 - RNA, 19 nt, Human adenovirus D
agcagaaauuucaagcugg

SEQ ID NO: 3923913 - RNA, 21 nt, Human adenovirus D
agcagaagaucccggcgcagu

SEQ ID NO: 3923914 - RNA, 20 nt, Human adenovirus D
agcagcaagagcucaaagua

SEQ ID NO: 3923915 - RNA, 10 nt, Human adenovirus D
agcagcacag

SEQ ID NO: 3923916 - RNA, 14 nt, Human adenovirus D
agcagcaccucggu

SEQ ID NO: 3923917 - RNA, 24 nt, Human adenovirus D
agcagcaccucgguacccuccucc

SEQ ID NO: 3923918 - RNA, 13 nt, Human adenovirus D
agcagcaguagcc

SEQ ID NO: 3923919 - RNA, 16 nt, Human adenovirus D
agcagcuguugaaaaa

SEQ ID NO: 3923920 - RNA, 14 nt, Human adenovirus D
agcaggagugcagg

SEQ ID NO: 3923921 - RNA, 21 nt, Human adenovirus D
agcaggagugcagggaugagu

SEQ ID NO: 3923922 - RNA, 14 nt, Human adenovirus D
agcaggggcgcugg

SEQ ID NO: 3923923 - RNA, 18 nt, Human adenovirus D
agcaggguaaagccagca

SEQ ID NO: 3923924 - RNA, 22 nt, Human adenovirus D
agcagggugggcaaaaagaaac

SEQ ID NO: 3923925 - RNA, 22 nt, Human adenovirus D
agcagguggcgccgggccuggg

SEQ ID NO: 3923926 - RNA, 21 nt, Human adenovirus D
agcagguuucucaacagcugg

SEQ ID NO: 3923927 - RNA, 22 nt, Human adenovirus D
agcaguagccccucugugccca

SEQ ID NO: 3923928 - RNA, 14 nt, Human adenovirus D
agcagucucugccg

SEQ ID NO: 3923929 - RNA, 16 nt, Human adenovirus D
agcauacaugcccucu

SEQ ID NO: 3923930 - RNA, 17 nt, Human adenovirus D
agcauacaugcccucuc

SEQ ID NO: 3923931 - RNA, 16 nt, Human adenovirus D
agcaucgaggugcaga

SEQ ID NO: 3923932 - RNA, 21 nt, Human adenovirus D
agcaucguaguucaggagcgc

SEQ ID NO: 3923933 - RNA, 20 nt, Human adenovirus D
agcaugaaggggacgagcug

SEQ ID NO: 3923934 - RNA, 17 nt, Human adenovirus D
agccacaugacccugca

SEQ ID NO: 3923935 - RNA, 13 nt, Human adenovirus D
agccagaccaagc

SEQ ID NO: 3923936 - RNA, 15 nt, Human adenovirus D
agccagaccaagcug

SEQ ID NO: 3923937 - RNA, 14 nt, Human adenovirus D
agccagcagcacau

SEQ ID NO: 3923938 - RNA, 21 nt, Human adenovirus D
agccaguggaagaggggcagc

SEQ ID NO: 3923939 - RNA, 17 nt, Human adenovirus D
agccaucgcgcaggagg

SEQ ID NO: 3923940 - RNA, 21 nt, Human adenovirus D
agccauugaccaccagggagc

SEQ ID NO: 3923941 - RNA, 22 nt, Human adenovirus D
agcccagggcgcacuacagccg

SEQ ID NO: 3923942 - RNA, 17 nt, Human adenovirus D
agcccaugagcaggcag

SEQ ID NO: 3923943 - RNA, 15 nt, Human adenovirus D
agcccgauagccgcc

SEQ ID NO: 3923944 - RNA, 14 nt, Human adenovirus D
agccgcaggccaac

SEQ ID NO: 3923945 - RNA, 16 nt, Human adenovirus D
agccgcgcgcuggggc

SEQ ID NO: 3923946 - RNA, 17 nt, Human adenovirus D
agccgcgcgcuggggca

SEQ ID NO: 3923947 - RNA, 19 nt, Human adenovirus D
agccggagugaugaauaug

SEQ ID NO: 3923948 - RNA, 22 nt, Human adenovirus D
agccggccgcgcuugcugggcg

SEQ ID NO: 3923949 - RNA, 13 nt, Human adenovirus D
agccggcggcgcg

SEQ ID NO: 3923950 - RNA, 22 nt, Human adenovirus D
agccgucuggacccgcggccgc

SEQ ID NO: 3923951 - RNA, 22 nt, Human adenovirus D
agccugcgccgggcgcugguag

SEQ ID NO: 3923952 - RNA, 20 nt, Human adenovirus D
agccuugauuuuuccagccc

SEQ ID NO: 3923953 - RNA, 16 nt, Human adenovirus D
agcgacgaccugggcg

SEQ ID NO: 3923954 - RNA, 17 nt, Human adenovirus D
agcgaugagcagcuugc

SEQ ID NO: 3923955 - RNA, 12 nt, Human adenovirus D
agcgcagccuga

SEQ ID NO: 3923956 - RNA, 18 nt, Human adenovirus D
agcgccagucccucaucc

SEQ ID NO: 3923957 - RNA, 13 nt, Human adenovirus D
agcgcccugguag

SEQ ID NO: 3923958 - RNA, 21 nt, Human adenovirus D
agcgcgcgucauggcugguca

SEQ ID NO: 3923959 - RNA, 15 nt, Human adenovirus D
agcgcguaggccgcu

SEQ ID NO: 3923960 - RNA, 11 nt, Human adenovirus D
agcggccagcg

SEQ ID NO: 3923961 - RNA, 17 nt, Human adenovirus D
agcggcgcaagcucaug

SEQ ID NO: 3923962 - RNA, 12 nt, Human adenovirus D
agcggggccugg

SEQ ID NO: 3923963 - RNA, 13 nt, Human adenovirus D
agcguccgcuccg

SEQ ID NO: 3923964 - RNA, 16 nt, Human adenovirus D
agcuacaugcccagca

SEQ ID NO: 3923965 - RNA, 14 nt, Human adenovirus D
agcuauaaaaauga

SEQ ID NO: 3923966 - RNA, 21 nt, Human adenovirus D
agcucaucgacuggugcugcg

SEQ ID NO: 3923967 - RNA, 19 nt, Human adenovirus D
agcuccgguugugcagccc

SEQ ID NO: 3923968 - RNA, 17 nt, Human adenovirus D
agcucgaaaucggugcg

SEQ ID NO: 3923969 - RNA, 14 nt, Human adenovirus D
agcucgcgggccau

SEQ ID NO: 3923970 - RNA, 18 nt, Human adenovirus D
agcucggcgaugguggcg

SEQ ID NO: 3923971 - RNA, 18 nt, Human adenovirus D
agcucgucuuccaggagc

SEQ ID NO: 3923972 - RNA, 21 nt, Human adenovirus D
agcucgucuuccaggagccug

SEQ ID NO: 3923973 - RNA, 19 nt, Human adenovirus D
agcugaacgggggcgccuu

SEQ ID NO: 3923974 - RNA, 15 nt, Human adenovirus D
agcugacggccaguc

SEQ ID NO: 3923975 - RNA, 16 nt, Human adenovirus D
agcugaucucgcugcc

SEQ ID NO: 3923976 - RNA, 21 nt, Human adenovirus D
agcugcaagguccgcaggagu

SEQ ID NO: 3923977 - RNA, 22 nt, Human adenovirus D
agcugcgagaaggcgcccaggc

SEQ ID NO: 3923978 - RNA, 16 nt, Human adenovirus D
agcugcgcgagggccu

SEQ ID NO: 3923979 - RNA, 23 nt, Human adenovirus D
caaacggugaaccugagccaggc

SEQ ID NO: 3923980 - RNA, 20 nt, Human adenovirus D
caaacguaacuuuaguuggu

SEQ ID NO: 3923981 - RNA, 22 nt, Human adenovirus D
caaagcuagcacccaaaaacug

SEQ ID NO: 3923982 - RNA, 21 nt, Human adenovirus D
caaaguaaaaaaccggucucu

SEQ ID NO: 3923983 - RNA, 22 nt, Human adenovirus D
caaauaaacuuuaucagccaga

SEQ ID NO: 3923984 - RNA, 12 nt, Human adenovirus D
caaauacauccu

SEQ ID NO: 3923985 - RNA, 23 nt, Human adenovirus D
caaauuguugguguaaauccacu

SEQ ID NO: 3923986 - RNA, 20 nt, Human adenovirus D
caacaaguuuaggaacccca

SEQ ID NO: 3923987 - RNA, 22 nt, Human adenovirus D
caacaccugggcacuggagcac

SEQ ID NO: 3923988 - RNA, 14 nt, Human adenovirus D
caacagccgcaggc

SEQ ID NO: 3923989 - RNA, 15 nt, Human adenovirus D
caacagccuucagca

SEQ ID NO: 3923990 - RNA, 19 nt, Human adenovirus D
caacagccuucagcaucag

SEQ ID NO: 3923991 - RNA, 16 nt, Human adenovirus D
caacaucuugcagagc

SEQ ID NO: 3923992 - RNA, 15 nt, Human adenovirus D
caacaugcugacugc

SEQ ID NO: 3923993 - RNA, 19 nt, Human adenovirus D
caacaugggugugcuggcu

SEQ ID NO: 3923994 - RNA, 17 nt, Human adenovirus D
caaccccauagucauca

SEQ ID NO: 3923995 - RNA, 19 nt, Human adenovirus D
caacccgauaucgcgcauc

SEQ ID NO: 3923996 - RNA, 22 nt, Human adenovirus D
caacccgcguaauuggcccucc

SEQ ID NO: 3923997 - RNA, 16 nt, Human adenovirus D
caaccggcugaugccc

SEQ ID NO: 3923998 - RNA, 17 nt, Human adenovirus D
caaccuccaggccaacc

SEQ ID NO: 3923999 - RNA, 14 nt, Human adenovirus D
caaccuccugggca

SEQ ID NO: 3924000 - RNA, 17 nt, Human adenovirus D
caaccucuacgccaccu

SEQ ID NO: 3924001 - RNA, 17 nt, Human adenovirus D
caacgucaaccccuuca

SEQ ID NO: 3924002 - RNA, 22 nt, Human adenovirus D
caacgugcccaucuccaucccc

SEQ ID NO: 3924003 - RNA, 16 nt, Human adenovirus D
caacuggucuccugcc

SEQ ID NO: 3924004 - RNA, 20 nt, Human adenovirus D
caagaaacgucccagcagca

SEQ ID NO: 3924005 - RNA, 12 nt, Human adenovirus D
caagaacgccau

SEQ ID NO: 3924006 - RNA, 17 nt, Human adenovirus D
caagacaaaggaggcca

SEQ ID NO: 3924007 - RNA, 18 nt, Human adenovirus D
caagaccccgucaccuuc

SEQ ID NO: 3924008 - RNA, 21 nt, Human adenovirus D
caagauagcccugcgcccaga

SEQ ID NO: 3924009 - RNA, 19 nt, Human adenovirus D
caagcagguggcgccgggc

SEQ ID NO: 3924010 - RNA, 15 nt, Human adenovirus D
caagcgggccucaca

SEQ ID NO: 3924011 - RNA, 22 nt, Human adenovirus D
caagcuaaauuuaagccagugg

SEQ ID NO: 3924012 - RNA, 16 nt, Human adenovirus D
caagcucaugcuggcc

SEQ ID NO: 3924013 - RNA, 19 nt, Human adenovirus D
caagcuggugaugccaggg

SEQ ID NO: 3924014 - RNA, 18 nt, Human adenovirus D
caagcuugguggcaaagg

SEQ ID NO: 3924015 - RNA, 12 nt, Human adenovirus D
caaggaggugaa

SEQ ID NO: 3924016 - RNA, 23 nt, Human adenovirus D
caaggccauccgucccgacgagg

SEQ ID NO: 3924017 - RNA, 20 nt, Human adenovirus D
caaguacacgccggccaaug

SEQ ID NO: 3924018 - RNA, 14 nt, Human adenovirus D
caagucucucuaac

SEQ ID NO: 3924019 - RNA, 15 nt, Human adenovirus D
caauaaacagcacuu

SEQ ID NO: 3924020 - RNA, 16 nt, Human adenovirus D
caaucagccccuuccc

SEQ ID NO: 3924021 - RNA, 16 nt, Human adenovirus D
caaucgccacaggugc

SEQ ID NO: 3924022 - RNA, 21 nt, Human adenovirus D
caaucuggcgguaccagggga

SEQ ID NO: 3924023 - RNA, 13 nt, Human adenovirus D
caaugagaggagu

SEQ ID NO: 3924024 - RNA, 18 nt, Human adenovirus D
caaugucaggucugcugg

SEQ ID NO: 3924025 - RNA, 13 nt, Human adenovirus D
cacacagcucaac

SEQ ID NO: 3924026 - RNA, 22 nt, Human adenovirus D
cacaccuggaggcaccaucaca

SEQ ID NO: 3924027 - RNA, 16 nt, Human adenovirus D
cacacgcccugggugu

SEQ ID NO: 3924028 - RNA, 20 nt, Human adenovirus D
cacacuagcgcccugguaga

SEQ ID NO: 3924029 - RNA, 19 nt, Human adenovirus D
cacagcaacuuccugacca

SEQ ID NO: 3924030 - RNA, 17 nt, Human adenovirus D
cacagcaccgcauccug

SEQ ID NO: 3924031 - RNA, 19 nt, Human adenovirus D
cacagcaguacaagcgcca

SEQ ID NO: 3924032 - RNA, 17 nt, Human adenovirus D
cacagccacagacagag

SEQ ID NO: 3924033 - RNA, 19 nt, Human adenovirus D
cacaggaugaacaggagca

SEQ ID NO: 3924034 - RNA, 21 nt, Human adenovirus D
cacaguauugugggccuggga

SEQ ID NO: 3924035 - RNA, 15 nt, Human adenovirus D
cacagucaacuguua

SEQ ID NO: 3924036 - RNA, 16 nt, Human adenovirus D
cacaguccaggucaca

SEQ ID NO: 3924037 - RNA, 12 nt, Human adenovirus D
cacagugcagaa

SEQ ID NO: 3924038 - RNA, 15 nt, Human adenovirus D
cacagugcccccucc

SEQ ID NO: 3924039 - RNA, 22 nt, Human adenovirus D
cacaguuaguacaacuacacag

SEQ ID NO: 3924040 - RNA, 16 nt, Human adenovirus D
cacaguuggcgaccca

SEQ ID NO: 3924041 - RNA, 16 nt, Human adenovirus D
cacaucggacuggguu

SEQ ID NO: 3924042 - RNA, 17 nt, Human adenovirus D
cacaucggacuggguua

SEQ ID NO: 3924043 - RNA, 19 nt, Human adenovirus D
cacaugacccugcauggcu

SEQ ID NO: 3924044 - RNA, 22 nt, Human adenovirus D
cacaugcuuggucuuucuggcu

SEQ ID NO: 3924045 - RNA, 16 nt, Human adenovirus D
caccaacgaccagucc

SEQ ID NO: 3924046 - RNA, 20 nt, Human adenovirus D
caccaccagcccauuucaca

SEQ ID NO: 3924047 - RNA, 20 nt, Human adenovirus D
caccagcgcgaguagucaau

SEQ ID NO: 3924048 - RNA, 22 nt, Human adenovirus D
caccaggccuacuacuccugau

SEQ ID NO: 3924049 - RNA, 15 nt, Human adenovirus D
caccagggagcugag

SEQ ID NO: 3924050 - RNA, 16 nt, Human adenovirus D
caccauccgcgccgca

SEQ ID NO: 3924051 - RNA, 17 nt, Human adenovirus D
caccaugagcaaggaga

SEQ ID NO: 3924052 - RNA, 19 nt, Human adenovirus D
caccauguuauucagcagc

SEQ ID NO: 3924053 - RNA, 14 nt, Human adenovirus D
cacccacaccgccu

SEQ ID NO: 3924054 - RNA, 14 nt, Human adenovirus D
cacccaccacaguu

SEQ ID NO: 3924055 - RNA, 21 nt, Human adenovirus D
cacccagaccgugcaggggcc

SEQ ID NO: 3924056 - RNA, 22 nt, Human adenovirus D
cacccagaucccgccggggguu

SEQ ID NO: 3924057 - RNA, 17 nt, Human adenovirus D
caccccaggcggaccag

SEQ ID NO: 3924058 - RNA, 15 nt, Human adenovirus D
cacccccgcgugcag

SEQ ID NO: 3924059 - RNA, 20 nt, Human adenovirus D
cacccgccgccgucugcccc

SEQ ID NO: 3924060 - RNA, 15 nt, Human adenovirus D
cacccucagaagaag

SEQ ID NO: 3924061 - RNA, 21 nt, Human adenovirus D
caccgagucucaccugguuag

SEQ ID NO: 3924062 - RNA, 21 nt, Human adenovirus D
caccgcaaugcgggccugcgc

SEQ ID NO: 3924063 - RNA, 22 nt, Human adenovirus D
caccgcaaugcgggccugcgcu

SEQ ID NO: 3924064 - RNA, 13 nt, Human adenovirus D
caccgccgcagcc

SEQ ID NO: 3924065 - RNA, 14 nt, Human adenovirus D
caccgcgaccgcgg

SEQ ID NO: 3924066 - RNA, 19 nt, Human adenovirus D
caccgcgucgcugaaagca

SEQ ID NO: 3924067 - RNA, 21 nt, Human adenovirus D
caccgucgccucggaccuggc

SEQ ID NO: 3924068 - RNA, 17 nt, Human adenovirus D
caccucaacgcccaggc

SEQ ID NO: 3924069 - RNA, 13 nt, Human adenovirus D
caccugcggcgcg

SEQ ID NO: 3924070 - RNA, 16 nt, Human adenovirus D
caccuguggagggcau

SEQ ID NO: 3924071 - RNA, 12 nt, Human adenovirus D
caccuuccagcc

SEQ ID NO: 3924072 - RNA, 19 nt, Human adenovirus D
caccuuggcuuugcugggu

SEQ ID NO: 3924073 - RNA, 20 nt, Human adenovirus D
cacgaccgugccgcggugcg

SEQ ID NO: 3924074 - RNA, 22 nt, Human adenovirus D
cacgaccgugccgcggugcgcu

SEQ ID NO: 3924075 - RNA, 18 nt, Human adenovirus D
cacgagcaagacgcaggc

SEQ ID NO: 3924076 - RNA, 14 nt, Human adenovirus D
cacgagcgccaggu

SEQ ID NO: 3924077 - RNA, 23 nt, Human adenovirus D
cacgauguaacaucaccacaggc

SEQ ID NO: 3924078 - RNA, 14 nt, Human adenovirus D
cacgcauugcauga

SEQ ID NO: 3924079 - RNA, 13 nt, Human adenovirus D
cacgcccugggug

SEQ ID NO: 3924080 - RNA, 17 nt, Human adenovirus D
cacgccguucuccgccg

SEQ ID NO: 3924081 - RNA, 17 nt, Human adenovirus D
cacgcgcacacuuugga

SEQ ID NO: 3924082 - RNA, 20 nt, Human adenovirus D
cacgcguguugcggcccggc

SEQ ID NO: 3924083 - RNA, 16 nt, Human adenovirus D
cacggaccggucccag

SEQ ID NO: 3924084 - RNA, 23 nt, Human adenovirus D
cacgggacgcuaccgcugcgcag

SEQ ID NO: 3924085 - RNA, 16 nt, Human adenovirus D
cacgggccgccgggcc

SEQ ID NO: 3924086 - RNA, 17 nt, Human adenovirus D
cacggucuucgcccugc

SEQ ID NO: 3924087 - RNA, 16 nt, Human adenovirus D
cacgguucucucagca

SEQ ID NO: 3924088 - RNA, 19 nt, Human adenovirus D
cacgugaccaggggucccc

SEQ ID NO: 3924089 - RNA, 22 nt, Human adenovirus D
cacgugcgagggguagcggucg

SEQ ID NO: 3924090 - RNA, 15 nt, Human adenovirus D
cacguggcggcggcc

SEQ ID NO: 3924091 - RNA, 21 nt, Human adenovirus D
cacuagcgugagccgcgcgcu

SEQ ID NO: 3924092 - RNA, 16 nt, Human adenovirus D
cacucccagcgccgcg

SEQ ID NO: 3924093 - RNA, 14 nt, Human adenovirus D
cacucgcagugcac

SEQ ID NO: 3924094 - RNA, 12 nt, Human adenovirus D
cacucuauuuuc

SEQ ID NO: 3924095 - RNA, 13 nt, Human adenovirus D
ccgccggcggcga

SEQ ID NO: 3924096 - RNA, 15 nt, Human adenovirus D
ccgcgccagacgcac

SEQ ID NO: 3924097 - RNA, 13 nt, Human adenovirus D
ccgcgccgcagcc

SEQ ID NO: 3924098 - RNA, 15 nt, Human adenovirus D
ccgcgccgccacugc

SEQ ID NO: 3924099 - RNA, 19 nt, Human adenovirus D
ccgcgcgcgcgcacguggc

SEQ ID NO: 3924100 - RNA, 15 nt, Human adenovirus D
ccgcgcuugcugggc

SEQ ID NO: 3924101 - RNA, 17 nt, Human adenovirus D
ccgcggaugcuggcgcg

SEQ ID NO: 3924102 - RNA, 15 nt, Human adenovirus D
ccgcggccgcccacg

SEQ ID NO: 3924103 - RNA, 17 nt, Human adenovirus D
ccgcggccguagcaggc

SEQ ID NO: 3924104 - RNA, 17 nt, Human adenovirus D
ccgcgguauauggcucc

SEQ ID NO: 3924105 - RNA, 12 nt, Human adenovirus D
ccgcggucccag

SEQ ID NO: 3924106 - RNA, 18 nt, Human adenovirus D
ccgcgguuaugcagggug

SEQ ID NO: 3924107 - RNA, 13 nt, Human adenovirus D
ccgcguccccgcc

SEQ ID NO: 3924108 - RNA, 17 nt, Human adenovirus D
ccgcguccgcggccacu

SEQ ID NO: 3924109 - RNA, 17 nt, Human adenovirus D
ccgcuaccgcuuccacu

SEQ ID NO: 3924110 - RNA, 18 nt, Human adenovirus D
ccgcuacgugcccuucca

SEQ ID NO: 3924111 - RNA, 17 nt, Human adenovirus D
ccgcuaucugcucuucc

SEQ ID NO: 3924112 - RNA, 15 nt, Human adenovirus D
ccgcucggccaugcc

SEQ ID NO: 3924113 - RNA, 21 nt, Human adenovirus D
ccgcugucucagccucgaaca

SEQ ID NO: 3924114 - RNA, 16 nt, Human adenovirus D
ccgcugugcuggugga

SEQ ID NO: 3924115 - RNA, 13 nt, Human adenovirus D
ccggaaacgccac

SEQ ID NO: 3924116 - RNA, 22 nt, Human adenovirus D
ccggagauuuacggaccacccc

SEQ ID NO: 3924117 - RNA, 15 nt, Human adenovirus D
ccggagcgacacccc

SEQ ID NO: 3924118 - RNA, 17 nt, Human adenovirus D
ccggagcgacacccccg

SEQ ID NO: 3924119 - RNA, 18 nt, Human adenovirus D
ccggaggcgugcacuggc

SEQ ID NO: 3924120 - RNA, 15 nt, Human adenovirus D
ccggccaaggccacc

SEQ ID NO: 3924121 - RNA, 14 nt, Human adenovirus D
ccggccgcgagacc

SEQ ID NO: 3924122 - RNA, 21 nt, Human adenovirus D
ccggcgacaagcuggccugcg

SEQ ID NO: 3924123 - RNA, 14 nt, Human adenovirus D
ccggcggcagcggc

SEQ ID NO: 3924124 - RNA, 18 nt, Human adenovirus D
ccggcuaccuugcaccca

SEQ ID NO: 3924125 - RNA, 20 nt, Human adenovirus D
ccggggcggaguggccucuc

SEQ ID NO: 3924126 - RNA, 16 nt, Human adenovirus D
ccggucaucucccggu

SEQ ID NO: 3924127 - RNA, 15 nt, Human adenovirus D
ccggucucugcgcuc

SEQ ID NO: 3924128 - RNA, 17 nt, Human adenovirus D
ccggugucagaggaugg

SEQ ID NO: 3924129 - RNA, 18 nt, Human adenovirus D
ccgguuucgggcgggcag

SEQ ID NO: 3924130 - RNA, 21 nt, Human adenovirus D
ccgucagcagcaggagcgugc

SEQ ID NO: 3924131 - RNA, 23 nt, Human adenovirus D
ccguccaugcgaauuccccucau

SEQ ID NO: 3924132 - RNA, 20 nt, Human adenovirus D
ccguccgcccgcgcccacca

SEQ ID NO: 3924133 - RNA, 21 nt, Human adenovirus D
ccgucgccucggaccuggccg

SEQ ID NO: 3924134 - RNA, 14 nt, Human adenovirus D
ccgucuacugcauc

SEQ ID NO: 3924135 - RNA, 15 nt, Human adenovirus D
ccgucuacugcaucu

SEQ ID NO: 3924136 - RNA, 16 nt, Human adenovirus D
ccgucuacugcaucug

SEQ ID NO: 3924137 - RNA, 21 nt, Human adenovirus D
ccuacaaguacacgccggcca

SEQ ID NO: 3924138 - RNA, 21 nt, Human adenovirus D
ccuacgcgaccguggggaacu

SEQ ID NO: 3924139 - RNA, 15 nt, Human adenovirus D
ccuacuacuccugau

SEQ ID NO: 3924140 - RNA, 23 nt, Human adenovirus D
ccucacaguccaggucacagucu

SEQ ID NO: 3924141 - RNA, 14 nt, Human adenovirus D
ccucagcagucucu

SEQ ID NO: 3924142 - RNA, 17 nt, Human adenovirus D
ccucaugaacacacugc

SEQ ID NO: 3924143 - RNA, 18 nt, Human adenovirus D
ccucaugaacacacugcc

SEQ ID NO: 3924144 - RNA, 18 nt, Human adenovirus D
ccuccaggacuaucuaug

SEQ ID NO: 3924145 - RNA, 16 nt, Human adenovirus D
ccucccccgcaagcga

SEQ ID NO: 3924146 - RNA, 19 nt, Human adenovirus D
ccuccccgacccccuucca

SEQ ID NO: 3924147 - RNA, 16 nt, Human adenovirus D
ccuccgcauccaagaa

SEQ ID NO: 3924148 - RNA, 16 nt, Human adenovirus D
ccuccgcccugagcuc

SEQ ID NO: 3924149 - RNA, 15 nt, Human adenovirus D
ccuccguagccuggc

SEQ ID NO: 3924150 - RNA, 20 nt, Human adenovirus D
ccucgagcaugaggcggugg

SEQ ID NO: 3924151 - RNA, 14 nt, Human adenovirus D
ccucgcuacugcug

SEQ ID NO: 3924152 - RNA, 22 nt, Human adenovirus D
ccucggggcauugcaggccgug

SEQ ID NO: 3924153 - RNA, 18 nt, Human adenovirus D
ccucgucauccuuccagu

SEQ ID NO: 3924154 - RNA, 22 nt, Human adenovirus D
ccucuccaucagcgcccucagc

SEQ ID NO: 3924155 - RNA, 23 nt, Human adenovirus D
ccucugacggcgcagcuguuccu

SEQ ID NO: 3924156 - RNA, 14 nt, Human adenovirus D
ccucugugcccagu

SEQ ID NO: 3924157 - RNA, 18 nt, Human adenovirus D
ccucuuugcccugcucac

SEQ ID NO: 3924158 - RNA, 21 nt, Human adenovirus D
ccugaaggagcuggacaagcu

SEQ ID NO: 3924159 - RNA, 20 nt, Human adenovirus D
ccugacgacccgcaaccccg

SEQ ID NO: 3924160 - RNA, 19 nt, Human adenovirus D
ccugacgcgccagccgcgg

SEQ ID NO: 3924161 - RNA, 19 nt, Human adenovirus D
ccugagcaaccuccugggc

SEQ ID NO: 3924162 - RNA, 22 nt, Human adenovirus D
ccugaucucugccauguucuca

SEQ ID NO: 3924163 - RNA, 12 nt, Human adenovirus D
ccugaugaacaa

SEQ ID NO: 3924164 - RNA, 15 nt, Human adenovirus D
ccugcacuuucuuug

SEQ ID NO: 3924165 - RNA, 17 nt, Human adenovirus D
ccugcagcaggugcugc

SEQ ID NO: 3924166 - RNA, 16 nt, Human adenovirus D
ccugcauuggcagccg

SEQ ID NO: 3924167 - RNA, 13 nt, Human adenovirus D
ccugcccgacucc

SEQ ID NO: 3924168 - RNA, 22 nt, Human adenovirus D
ccugcgcgucgacggcgccucc

SEQ ID NO: 3924169 - RNA, 15 nt, Human adenovirus D
ccugcggggcgauga

SEQ ID NO: 3924170 - RNA, 23 nt, Human adenovirus D
ccugcucaccugcaccugcgucu

SEQ ID NO: 3924171 - RNA, 21 nt, Human adenovirus D
ccugcuggccgagcuggaagc

SEQ ID NO: 3924172 - RNA, 14 nt, Human adenovirus D
ccuggaccaggcgg

SEQ ID NO: 3924173 - RNA, 20 nt, Human adenovirus D
ccuggaucugccgccucugc

SEQ ID NO: 3924174 - RNA, 19 nt, Human adenovirus D
ccuggccgaccggagcgaa

SEQ ID NO: 3924175 - RNA, 13 nt, Human adenovirus D
ccuggcucccagc

SEQ ID NO: 3924176 - RNA, 19 nt, Human adenovirus D
ccugggcauagucgcgccg

SEQ ID NO: 3924177 - RNA, 15 nt, Human adenovirus D
ccugggcucgcuggu

SEQ ID NO: 3924178 - RNA, 19 nt, Human adenovirus D
ccugggcugcgggccuacu

SEQ ID NO: 3924179 - RNA, 14 nt, Human adenovirus D
ccugggucagaaca

SEQ ID NO: 3924180 - RNA, 15 nt, Human adenovirus D
ccuggugauggccug

SEQ ID NO: 3924181 - RNA, 17 nt, Human adenovirus D
ccuggugcgucgagcac

SEQ ID NO: 3924182 - RNA, 22 nt, Human adenovirus D
ccuggugcgucgagcacagcac

SEQ ID NO: 3924183 - RNA, 16 nt, Human adenovirus D
ccugugacaugcaaaa

SEQ ID NO: 3924184 - RNA, 22 nt, Human adenovirus D
ccuuacuuucgcucccaccgcg

SEQ ID NO: 3924185 - RNA, 15 nt, Human adenovirus D
ccuucaccgaccugg

SEQ ID NO: 3924186 - RNA, 12 nt, Human adenovirus D
ccuucauaauag

SEQ ID NO: 3924187 - RNA, 16 nt, Human adenovirus D
ccuuccaccucggugc

SEQ ID NO: 3924188 - RNA, 13 nt, Human adenovirus D
ccuuccaguacuc

SEQ ID NO: 3924189 - RNA, 23 nt, Human adenovirus D
ccuuccaguacucccggagcggg

SEQ ID NO: 3924190 - RNA, 16 nt, Human adenovirus D
ccuuccugcagcucau

SEQ ID NO: 3924191 - RNA, 13 nt, Human adenovirus D
ccuucgagcugca

SEQ ID NO: 3924192 - RNA, 11 nt, Human adenovirus D
ccuucgcaguc

SEQ ID NO: 3924193 - RNA, 15 nt, Human adenovirus D
ccuucgugcacuggc

SEQ ID NO: 3924194 - RNA, 20 nt, Human adenovirus D
ccuucucgggaucgccaggc

SEQ ID NO: 3924195 - RNA, 16 nt, Human adenovirus D
ccuugcccccaagggc

SEQ ID NO: 3924196 - RNA, 16 nt, Human adenovirus D
ccuuguagggacagca

SEQ ID NO: 3924197 - RNA, 18 nt, Human adenovirus D
ccuuguagggacagcagc

SEQ ID NO: 3924198 - RNA, 17 nt, Human adenovirus D
ccuugucguacuucugc

SEQ ID NO: 3924199 - RNA, 14 nt, Human adenovirus D
ccuuuaucagcacu

SEQ ID NO: 3924200 - RNA, 22 nt, Human adenovirus D
ccuuucacccggacguggugcu

SEQ ID NO: 3924201 - RNA, 18 nt, Human adenovirus D
cgaagauggggccccgcc

SEQ ID NO: 3924202 - RNA, 17 nt, Human adenovirus D
cgaaucaggcuggagcc

SEQ ID NO: 3924203 - RNA, 22 nt, Human adenovirus D
cgacacccccgcgugcagcugc

SEQ ID NO: 3924204 - RNA, 15 nt, Human adenovirus D
cgacacguacuucag

SEQ ID NO: 3924205 - RNA, 17 nt, Human adenovirus D
cgacagucugagggcca

SEQ ID NO: 3924206 - RNA, 22 nt, Human adenovirus D
cgacccaggaauggcacgcucu

SEQ ID NO: 3924207 - RNA, 18 nt, Human adenovirus D
cgacccccaggcccugga

SEQ ID NO: 3924208 - RNA, 20 nt, Human adenovirus D
cgaccgcauccacaaggccg

SEQ ID NO: 3924209 - RNA, 15 nt, Human adenovirus D
cgaccgcgagcugau

SEQ ID NO: 3924210 - RNA, 19 nt, Human adenovirus D
cgaccggaucggagaaucu

SEQ ID NO: 3924211 - RNA, 18 nt, Human adenovirus D
cgaccgugccgcggugcg

SEQ ID NO: 3924212 - RNA, 20 nt, Human adenovirus D
ggggaugaaccuuuggaccu

SEQ ID NO: 3924213 - RNA, 23 nt, Human adenovirus D
ggggccaagaaggccggggccga

SEQ ID NO: 3924214 - RNA, 18 nt, Human adenovirus D
ggggcuacauucuggacu

SEQ ID NO: 3924215 - RNA, 22 nt, Human adenovirus D
gggggguccgcaucgaugguga

SEQ ID NO: 3924216 - RNA, 22 nt, Human adenovirus D
ggguagaagcaacagauuuaag

SEQ ID NO: 3924217 - RNA, 17 nt, Human adenovirus D
ggguccugucacucaaa

SEQ ID NO: 3924218 - RNA, 22 nt, Human adenovirus D
gggugccagauugggggacgau

SEQ ID NO: 3924219 - RNA, 14 nt, Human adenovirus D
gggugggccccugg

SEQ ID NO: 3924220 - RNA, 15 nt, Human adenovirus D
gguaagagcccagca

SEQ ID NO: 3924221 - RNA, 17 nt, Human adenovirus D
gguacuccagucuccgg

SEQ ID NO: 3924222 - RNA, 18 nt, Human adenovirus D
gguagggggcgccgccgg

SEQ ID NO: 3924223 - RNA, 23 nt, Human adenovirus D
gguaguucaaggacaugcagcug

SEQ ID NO: 3924224 - RNA, 16 nt, Human adenovirus D
ggucacaugcuugguc

SEQ ID NO: 3924225 - RNA, 14 nt, Human adenovirus D
ggucaccuuggcuu

SEQ ID NO: 3924226 - RNA, 21 nt, Human adenovirus D
ggucagcgaugagcagcuugc

SEQ ID NO: 3924227 - RNA, 12 nt, Human adenovirus D
ggucagcuggcc

SEQ ID NO: 3924228 - RNA, 16 nt, Human adenovirus D
ggucccgcucccagcg

SEQ ID NO: 3924229 - RNA, 23 nt, Human adenovirus D
ggucccuucucggaccaacccca

SEQ ID NO: 3924230 - RNA, 19 nt, Human adenovirus D
gguccgcgugagggugguc

SEQ ID NO: 3924231 - RNA, 16 nt, Human adenovirus D
ggucgacggugagcag

SEQ ID NO: 3924232 - RNA, 20 nt, Human adenovirus D
ggucgaggagaccugcacua

SEQ ID NO: 3924233 - RNA, 19 nt, Human adenovirus D
ggucucccccagcaugccg

SEQ ID NO: 3924234 - RNA, 12 nt, Human adenovirus D
ggucugcaggcc

SEQ ID NO: 3924235 - RNA, 19 nt, Human adenovirus D
ggucugcgaccggacggag

SEQ ID NO: 3924236 - RNA, 15 nt, Human adenovirus D
ggugaaccugagcca

SEQ ID NO: 3924237 - RNA, 18 nt, Human adenovirus D
ggugagccggccgcgcuu

SEQ ID NO: 3924238 - RNA, 16 nt, Human adenovirus D
ggugcgcacgcccgcg

SEQ ID NO: 3924239 - RNA, 22 nt, Human adenovirus D
ggugcgccccaucaagcaggug

SEQ ID NO: 3924240 - RNA, 18 nt, Human adenovirus D
ggugcuccggguucugga

SEQ ID NO: 3924241 - RNA, 13 nt, Human adenovirus D
gguggaagaugac

SEQ ID NO: 3924242 - RNA, 21 nt, Human adenovirus D
gguggauagcuaugauccaga

SEQ ID NO: 3924243 - RNA, 11 nt, Human adenovirus D
gguggccccga

SEQ ID NO: 3924244 - RNA, 15 nt, Human adenovirus D
gguggcccugggccu

SEQ ID NO: 3924245 - RNA, 17 nt, Human adenovirus D
gguggcccugggccuga

SEQ ID NO: 3924246 - RNA, 11 nt, Human adenovirus D
gguggcggcga

SEQ ID NO: 3924247 - RNA, 22 nt, Human adenovirus D
ggugggcaaaaagaaacaaguc

SEQ ID NO: 3924248 - RNA, 16 nt, Human adenovirus D
gguggggcggugaucu

SEQ ID NO: 3924249 - RNA, 14 nt, Human adenovirus D
gguggugcagaaca

SEQ ID NO: 3924250 - RNA, 16 nt, Human adenovirus D
gguuacacucgcagug

SEQ ID NO: 3924251 - RNA, 20 nt, Human adenovirus D
gguuagguucuucacccagc

SEQ ID NO: 3924252 - RNA, 20 nt, Human adenovirus D
gguuccucguccagaugcuc

SEQ ID NO: 3924253 - RNA, 16 nt, Human adenovirus D
gguugacauccuggau

SEQ ID NO: 3924254 - RNA, 18 nt, Human adenovirus D
gguuucucaacagcuggg

SEQ ID NO: 3924255 - RNA, 19 nt, Human adenovirus D
guaaagaaacagaacaaaa

SEQ ID NO: 3924256 - RNA, 16 nt, Human adenovirus D
guaacuaaacuuuaug

SEQ ID NO: 3924257 - RNA, 21 nt, Human adenovirus D
guaagcacgagcggcagggcu

SEQ ID NO: 3924258 - RNA, 20 nt, Human adenovirus D
guaaguuuuauggcugcugg

SEQ ID NO: 3924259 - RNA, 21 nt, Human adenovirus D
guacaacgcccugcuggagcg

SEQ ID NO: 3924260 - RNA, 17 nt, Human adenovirus D
guacaugauccagcggc

SEQ ID NO: 3924261 - RNA, 20 nt, Human adenovirus D
guacauguucaccagcaagu

SEQ ID NO: 3924262 - RNA, 21 nt, Human adenovirus D
guacccgaggacuaccacgcc

SEQ ID NO: 3924263 - RNA, 22 nt, Human adenovirus D
guacccuccucccaacucuggu

SEQ ID NO: 3924264 - RNA, 19 nt, Human adenovirus D
guaccuucgagcugcaagg

SEQ ID NO: 3924265 - RNA, 23 nt, Human adenovirus D
guacuacgccagccgcaggcgcc

SEQ ID NO: 3924266 - RNA, 19 nt, Human adenovirus D
guacugguacuugggcugc

SEQ ID NO: 3924267 - RNA, 21 nt, Human adenovirus D
guacuuagaagagcccccucc

SEQ ID NO: 3924268 - RNA, 16 nt, Human adenovirus D
guacuucagccugggc

SEQ ID NO: 3924269 - RNA, 17 nt, Human adenovirus D
guagguauucccucucg

SEQ ID NO: 3924270 - RNA, 23 nt, Human adenovirus D
guaguugcgcaggcgcuggaaga

SEQ ID NO: 3924271 - RNA, 20 nt, Human adenovirus D
guaucugaggcauauaaaaa

SEQ ID NO: 3924272 - RNA, 22 nt, Human adenovirus D
guaugacacgcgcacacuuugg

SEQ ID NO: 3924273 - RNA, 21 nt, Human adenovirus D
guaugccaagauagcccugcg

SEQ ID NO: 3924274 - RNA, 20 nt, Human adenovirus D
guauuaccuuccuugcugga

SEQ ID NO: 3924275 - RNA, 13 nt, Human adenovirus D
gucaaacaggcaa

SEQ ID NO: 3924276 - RNA, 20 nt, Human adenovirus D
gucagacccaguggcgagag

SEQ ID NO: 3924277 - RNA, 15 nt, Human adenovirus D
gucagcugcaaaaag

SEQ ID NO: 3924278 - RNA, 14 nt, Human adenovirus D
gucagcuggcccgg

SEQ ID NO: 3924279 - RNA, 21 nt, Human adenovirus D
gucaggagcagcgccccgagg

SEQ ID NO: 3924280 - RNA, 15 nt, Human adenovirus D
gucaggcaggauuca

SEQ ID NO: 3924281 - RNA, 13 nt, Human adenovirus D
gucaggcaggcau

SEQ ID NO: 3924282 - RNA, 23 nt, Human adenovirus D
gucauaacccgccucuccuuucu

SEQ ID NO: 3924283 - RNA, 23 nt, Human adenovirus D
gucaucaccuuccugcagcucau

SEQ ID NO: 3924284 - RNA, 16 nt, Human adenovirus D
gucaugugugauauca

SEQ ID NO: 3924285 - RNA, 14 nt, Human adenovirus D
guccaccgcuccgc

SEQ ID NO: 3924286 - RNA, 14 nt, Human adenovirus D
guccagcuggccgg

SEQ ID NO: 3924287 - RNA, 15 nt, Human adenovirus D
guccaugggcgccuu

SEQ ID NO: 3924288 - RNA, 22 nt, Human adenovirus D
gucccagcgucugacgcugcgc

SEQ ID NO: 3924289 - RNA, 13 nt, Human adenovirus D
guccccgcccgcc

SEQ ID NO: 3924290 - RNA, 18 nt, Human adenovirus D
gucccggaggaggggggc

SEQ ID NO: 3924291 - RNA, 23 nt, Human adenovirus D
guccgcacgguaagagcccagca

SEQ ID NO: 3924292 - RNA, 19 nt, Human adenovirus D
guccgcaggcgggacagag

SEQ ID NO: 3924293 - RNA, 18 nt, Human adenovirus D
guccgcccgcgcccacca

SEQ ID NO: 3924294 - RNA, 23 nt, Human adenovirus D
guccgcuccgcagugggcgcaga

SEQ ID NO: 3924295 - RNA, 13 nt, Human adenovirus D
guccucuuccucu

SEQ ID NO: 3924296 - RNA, 14 nt, Human adenovirus D
guccucuuccucuu

SEQ ID NO: 3924297 - RNA, 23 nt, Human adenovirus D
gucgccacggucaccgagccucc

SEQ ID NO: 3924298 - RNA, 22 nt, Human adenovirus D
gucgccgcaccauccgcgccgc

SEQ ID NO: 3924299 - RNA, 16 nt, Human adenovirus D
gucgccucggaccugg

SEQ ID NO: 3924300 - RNA, 16 nt, Human adenovirus D
gucgcuggcugcugga

SEQ ID NO: 3924301 - RNA, 22 nt, Human adenovirus D
gucggaagacccaagagcgaga

SEQ ID NO: 3924302 - RNA, 20 nt, Human adenovirus D
gucuagaaccccacaggaug

SEQ ID NO: 3924303 - RNA, 17 nt, Human adenovirus D
gucuccaacgccugcgc

SEQ ID NO: 3924304 - RNA, 15 nt, Human adenovirus D
gucuccgucacggug

SEQ ID NO: 3924305 - RNA, 20 nt, Human adenovirus D
gucucgaggacgagaaccug

SEQ ID NO: 3924306 - RNA, 13 nt, Human adenovirus D
gucucgcacucga

SEQ ID NO: 3924307 - RNA, 20 nt, Human adenovirus D
gucugcaacccccagcuccu

SEQ ID NO: 3924308 - RNA, 15 nt, Human adenovirus D
gucugccccccgccc

SEQ ID NO: 3924309 - RNA, 14 nt, Human adenovirus D
gucugccuggucau

SEQ ID NO: 3924310 - RNA, 15 nt, Human adenovirus D
gucugcucgggcaug

SEQ ID NO: 3924311 - RNA, 19 nt, Human adenovirus D
gucuggacccgcggccgcc

SEQ ID NO: 3924312 - RNA, 18 nt, Human adenovirus D
gucugucauauccugaag

SEQ ID NO: 3924313 - RNA, 22 nt, Human adenovirus D
gucuucccucucagaugucaaa

SEQ ID NO: 3924314 - RNA, 18 nt, Human adenovirus D
gugaagaaaacuggcaag

SEQ ID NO: 3924315 - RNA, 19 nt, Human adenovirus D
gugaagaccacuggccccg

SEQ ID NO: 3924316 - RNA, 19 nt, Human adenovirus D
gugaagaugccgggacaga

SEQ ID NO: 3924317 - RNA, 13 nt, Human adenovirus D
gugaagcaauacc

SEQ ID NO: 3924318 - RNA, 21 nt, Human adenovirus D
gugaagcccugguuucaucau

SEQ ID NO: 3924319 - RNA, 15 nt, Human adenovirus D
gugaagggcacagcc

SEQ ID NO: 3924320 - RNA, 17 nt, Human adenovirus D
gugaccaagcuggugau

SEQ ID NO: 3924321 - RNA, 19 nt, Human adenovirus D
gugacucggcugagcucgc

SEQ ID NO: 3924322 - RNA, 21 nt, Human adenovirus D
gugagccgcgcgcuggggcag

SEQ ID NO: 3924323 - RNA, 19 nt, Human adenovirus D
gugagcggcgaggggcugc

SEQ ID NO: 3924324 - RNA, 18 nt, Human adenovirus D
gugagcucuucaaucggu

SEQ ID NO: 3924325 - RNA, 19 nt, Human adenovirus D
gugaggguguccuggaagu

SEQ ID NO: 3924326 - RNA, 15 nt, Human adenovirus D
gugaguugguggccg

SEQ ID NO: 3924327 - RNA, 23 nt, Human adenovirus D
ugcgaaagccccgaguguaucua

SEQ ID NO: 3924328 - RNA, 17 nt, Human adenovirus D
ugcgacccaugagcugc

SEQ ID NO: 3924329 - RNA, 14 nt, Human adenovirus D
ugcgaggagagcag

SEQ ID NO: 3924330 - RNA, 16 nt, Human adenovirus D
ugcgcgagggccugga

SEQ ID NO: 3924331 - RNA, 12 nt, Human adenovirus D
ugcgcgggcugu

SEQ ID NO: 3924332 - RNA, 15 nt, Human adenovirus D
ugcgcggggccacga

SEQ ID NO: 3924333 - RNA, 18 nt, Human adenovirus D
ugcgcguccgucagcagc

SEQ ID NO: 3924334 - RNA, 21 nt, Human adenovirus D
ugcgcuaccgcuccaugcuuc

SEQ ID NO: 3924335 - RNA, 23 nt, Human adenovirus D
ugcggaucaccguagagggcacc

SEQ ID NO: 3924336 - RNA, 20 nt, Human adenovirus D
ugcggcagcuuuuugagcuc

SEQ ID NO: 3924337 - RNA, 14 nt, Human adenovirus D
ugcgguacacgggg

SEQ ID NO: 3924338 - RNA, 23 nt, Human adenovirus D
ugcgguacugguacuugggcugc

SEQ ID NO: 3924339 - RNA, 20 nt, Human adenovirus D
ugcguggaagaauuuggaga

SEQ ID NO: 3924340 - RNA, 19 nt, Human adenovirus D
ugcuaccucuugcagcugg

SEQ ID NO: 3924341 - RNA, 21 nt, Human adenovirus D
ugcuaccucuugcagcuggcc

SEQ ID NO: 3924342 - RNA, 14 nt, Human adenovirus D
ugcuagcccuuccu

SEQ ID NO: 3924343 - RNA, 16 nt, Human adenovirus D
ugcuccaccaccugca

SEQ ID NO: 3924344 - RNA, 22 nt, Human adenovirus D
ugcuccacucgacccugaaggg

SEQ ID NO: 3924345 - RNA, 22 nt, Human adenovirus D
ugcuccaggucgucgccccgga

SEQ ID NO: 3924346 - RNA, 21 nt, Human adenovirus D
ugcucgcucguagggguugag

SEQ ID NO: 3924347 - RNA, 21 nt, Human adenovirus D
ugcucuccgcaccgcuccugg

SEQ ID NO: 3924348 - RNA, 15 nt, Human adenovirus D
ugcucuggggucgug

SEQ ID NO: 3924349 - RNA, 18 nt, Human adenovirus D
ugcugaaacaccugcagc

SEQ ID NO: 3924350 - RNA, 22 nt, Human adenovirus D
ugcugaccaauagacagcagaa

SEQ ID NO: 3924351 - RNA, 15 nt, Human adenovirus D
ugcugcagccgccgc

SEQ ID NO: 3924352 - RNA, 14 nt, Human adenovirus D
ugcugcccgccacc

SEQ ID NO: 3924353 - RNA, 14 nt, Human adenovirus D
ugcugccgagccgc

SEQ ID NO: 3924354 - RNA, 21 nt, Human adenovirus D
ugcugccgcucagucauccaa

SEQ ID NO: 3924355 - RNA, 17 nt, Human adenovirus D
ugcugcucgagcgccca

SEQ ID NO: 3924356 - RNA, 15 nt, Human adenovirus D
ugcugcugcugcuga

SEQ ID NO: 3924357 - RNA, 19 nt, Human adenovirus D
ugcuggaggguugaaagau

SEQ ID NO: 3924358 - RNA, 18 nt, Human adenovirus D
ugcuggaugcggagccgc

SEQ ID NO: 3924359 - RNA, 15 nt, Human adenovirus D
ugcuggcccugcugg

SEQ ID NO: 3924360 - RNA, 20 nt, Human adenovirus D
ugcugguggaaacagacagc

SEQ ID NO: 3924361 - RNA, 22 nt, Human adenovirus D
ugcuguggucgacuugcaagac

SEQ ID NO: 3924362 - RNA, 17 nt, Human adenovirus D
ugcuucaauaauggaag

SEQ ID NO: 3924363 - RNA, 14 nt, Human adenovirus D
ugcuucugggcaac

SEQ ID NO: 3924364 - RNA, 21 nt, Human adenovirus D
ugcuuguguccucccccgcaa

SEQ ID NO: 3924365 - RNA, 17 nt, Human adenovirus D
uggaaaaguggaagaag

SEQ ID NO: 3924366 - RNA, 15 nt, Human adenovirus D
uggaagaagagcagc

SEQ ID NO: 3924367 - RNA, 23 nt, Human adenovirus D
uggaagagauggaagaagaaugg

SEQ ID NO: 3924368 - RNA, 17 nt, Human adenovirus D
uggacaacaccagacac

SEQ ID NO: 3924369 - RNA, 22 nt, Human adenovirus D
uggacgcgguucauugacagcg

SEQ ID NO: 3924370 - RNA, 17 nt, Human adenovirus D
uggacuugggcgggagc

SEQ ID NO: 3924371 - RNA, 22 nt, Human adenovirus D
uggagaucgccgcgacccgcgc

SEQ ID NO: 3924372 - RNA, 20 nt, Human adenovirus D
uggagcacagaccuucaggg

SEQ ID NO: 3924373 - RNA, 20 nt, Human adenovirus D
uggagcaggguaaagccagc

SEQ ID NO: 3924374 - RNA, 21 nt, Human adenovirus D
uggagcaggguaaagccagca

SEQ ID NO: 3924375 - RNA, 17 nt, Human adenovirus D
uggagcgcguaggccgc

SEQ ID NO: 3924376 - RNA, 13 nt, Human adenovirus D
uggaggccgccua

SEQ ID NO: 3924377 - RNA, 15 nt, Human adenovirus D
uggaggguugaaaga

SEQ ID NO: 3924378 - RNA, 20 nt, Human adenovirus D
uggagguuuucccggacgag

SEQ ID NO: 3924379 - RNA, 18 nt, Human adenovirus D
uggauagcuaugauccag

SEQ ID NO: 3924380 - RNA, 15 nt, Human adenovirus D
uggauugcaauuuug

SEQ ID NO: 3924381 - RNA, 20 nt, Human adenovirus D
uggcaaagcgguugagcugg

SEQ ID NO: 3924382 - RNA, 19 nt, Human adenovirus D
uggcagagcacgcugcaca

SEQ ID NO: 3924383 - RNA, 14 nt, Human adenovirus D
uggccaacagccac

SEQ ID NO: 3924384 - RNA, 14 nt, Human adenovirus D
uggccaggggagug

SEQ ID NO: 3924385 - RNA, 18 nt, Human adenovirus D
uggccaguguuugagaau

SEQ ID NO: 3924386 - RNA, 22 nt, Human adenovirus D
uggccccggggcggaguggccu

SEQ ID NO: 3924387 - RNA, 18 nt, Human adenovirus D
uggcccugacgacccgca

SEQ ID NO: 3924388 - RNA, 12 nt, Human adenovirus D
uggcccugcugg

SEQ ID NO: 3924389 - RNA, 23 nt, Human adenovirus D
uggccggcgcgcccggggccagg

SEQ ID NO: 3924390 - RNA, 15 nt, Human adenovirus D
uggccggugagacgc

SEQ ID NO: 3924391 - RNA, 14 nt, Human adenovirus D
uggcgacccaggaa

SEQ ID NO: 3924392 - RNA, 21 nt, Human adenovirus D
uggcgagaggcgagcagcugu

SEQ ID NO: 3924393 - RNA, 18 nt, Human adenovirus D
uggcgccgggccugggcg

SEQ ID NO: 3924394 - RNA, 15 nt, Human adenovirus D
uggcgcucgggcagg

SEQ ID NO: 3924395 - RNA, 13 nt, Human adenovirus D
uggcggagcgagc

SEQ ID NO: 3924396 - RNA, 13 nt, Human adenovirus D
uggcggaggccau

SEQ ID NO: 3924397 - RNA, 23 nt, Human adenovirus D
uggcggaggcggagucuuccaug

SEQ ID NO: 3924398 - RNA, 19 nt, Human adenovirus D
uggcgugcgaguuggagga

SEQ ID NO: 3924399 - RNA, 12 nt, Human adenovirus D
uggcucagcugc

SEQ ID NO: 3924400 - RNA, 22 nt, Human adenovirus D
uggcucuaaaaaauaugcaagg

SEQ ID NO: 3924401 - RNA, 17 nt, Human adenovirus D
ugggaucuuuauucuug

SEQ ID NO: 3924402 - RNA, 21 nt, Human adenovirus D
ugggaugcugcccgccaccug

SEQ ID NO: 3924403 - RNA, 18 nt, Human adenovirus D
ugggcaaaaagaaacaag

SEQ ID NO: 3924404 - RNA, 17 nt, Human adenovirus D
ugggccacuacagcuga

SEQ ID NO: 3924405 - RNA, 14 nt, Human adenovirus D
ugggcccgugggcu

SEQ ID NO: 3924406 - RNA, 22 nt, Human adenovirus D
ugggcgcuugcaagggugcgcu

SEQ ID NO: 3924407 - RNA, 13 nt, Human adenovirus D
uggggcagacagu

SEQ ID NO: 3924408 - RNA, 22 nt, Human adenovirus D
uggggcgcuuacaagcgcgggc

SEQ ID NO: 3924409 - RNA, 16 nt, Human adenovirus D
uggguuggcuugcaug

SEQ ID NO: 3924410 - RNA, 23 nt, Human adenovirus D
uggucaucaccuuccugcagcuc

SEQ ID NO: 3924411 - RNA, 21 nt, Human adenovirus D
ugguccagauggaaaggucac

SEQ ID NO: 3924412 - RNA, 17 nt, Human adenovirus D
uggucccuucucggacc

SEQ ID NO: 3924413 - RNA, 21 nt, Human adenovirus D
uggugcgcucgucgggcacga

SEQ ID NO: 3924414 - RNA, 16 nt, Human adenovirus D
uggugcgucgagcaca

SEQ ID NO: 3924415 - RNA, 22 nt, Human adenovirus D
ugguggaaacagacagccaggu

SEQ ID NO: 3924416 - RNA, 14 nt, Human adenovirus D
ugguggaggcgcgc

SEQ ID NO: 3924417 - RNA, 16 nt, Human adenovirus D
ugguggccaccucgcc

SEQ ID NO: 3924418 - RNA, 23 nt, Human adenovirus D
ugguggcuagaaaacacccacag

SEQ ID NO: 3924419 - RNA, 18 nt, Human adenovirus D
uggugggccguuggaaga

SEQ ID NO: 3924420 - RNA, 12 nt, Human adenovirus D
uguaaagccaga

SEQ ID NO: 3924421 - RNA, 17 nt, Human adenovirus D
uguaaagccagaaagaa

SEQ ID NO: 3924422 - RNA, 12 nt, Human adenovirus D
uguaacaucacc

SEQ ID NO: 3924423 - RNA, 19 nt, Human adenovirus D
uguacccgaggacuaccac

SEQ ID NO: 3924424 - RNA, 18 nt, Human adenovirus D
uguacgacaccacucgcg

SEQ ID NO: 3924425 - RNA, 18 nt, Human adenovirus D
uguacuccuucuuccgca

SEQ ID NO: 3924426 - RNA, 13 nt, Human adenovirus D
uguacuucuccca

SEQ ID NO: 3924427 - RNA, 14 nt, Human adenovirus D
uguacuucucccaa

SEQ ID NO: 3924428 - RNA, 16 nt, Human adenovirus D
ugucaaauuccugguc

SEQ ID NO: 3924429 - RNA, 13 nt, Human adenovirus D
uguccaaccccga

SEQ ID NO: 3924430 - RNA, 14 nt, Human adenovirus D
ugucccccgccgcu

SEQ ID NO: 3924431 - RNA, 11 nt, Human adenovirus D
uguccggggcg

SEQ ID NO: 3924432 - RNA, 17 nt, Human adenovirus D
ugucguacuucugccag

SEQ ID NO: 3924433 - RNA, 22 nt, Human adenovirus D
ugugaccacggaccggucccag

SEQ ID NO: 3924434 - RNA, 14 nt, Human adenovirus D
ugugauaugcacag

SEQ ID NO: 3924435 - RNA, 20 nt, Human adenovirus D
ugugauuaaaaagcagcaca

SEQ ID NO: 3924436 - RNA, 23 nt, Human adenovirus D
ugugcucuccgcaccgcuccugg

SEQ ID NO: 3924437 - RNA, 13 nt, Human adenovirus D
uguggagccacug

SEQ ID NO: 3924438 - RNA, 13 nt, Human adenovirus D
uguucagcagcac

SEQ ID NO: 3924439 - RNA, 15 nt, Human adenovirus D
uguugcauccuucca

SEQ ID NO: 3924440 - RNA, 21 nt, Human adenovirus D
uguuggaggaagaaaugaggc

SEQ ID NO: 3924441 - RNA, 16 nt, Human adenovirus D
uuaaagacccacagcc

SEQ ID NO: 3924442 - RNA, 14 nt, Human adenovirus D
uuaccgccagagaa

SEQ ID NO: 3924443 - RNA, 16 nt, Human adenovirus D
accaggcagugcagcg

SEQ ID NO: 3924444 - RNA, 17 nt, Human adenovirus D
accaggggguccaccuu

SEQ ID NO: 3924445 - RNA, 16 nt, Human adenovirus D
accagguccacgcugg

SEQ ID NO: 3924446 - RNA, 21 nt, Human adenovirus D
accagguccacgcugguggcc

SEQ ID NO: 3924447 - RNA, 21 nt, Human adenovirus D
accaguacucguacaaggcgc

SEQ ID NO: 3924448 - RNA, 13 nt, Human adenovirus D
accagucgggccc

SEQ ID NO: 3924449 - RNA, 18 nt, Human adenovirus D
acccaaaaacugcaugcu

SEQ ID NO: 3924450 - RNA, 14 nt, Human adenovirus D
acccacgacacagc

SEQ ID NO: 3924451 - RNA, 19 nt, Human adenovirus D
acccagaucccgccggggg

SEQ ID NO: 3924452 - RNA, 21 nt, Human adenovirus D
accccacgguggccccgaccc

SEQ ID NO: 3924453 - RNA, 14 nt, Human adenovirus D
accccagacaccca

SEQ ID NO: 3924454 - RNA, 22 nt, Human adenovirus D
accccauccagguguagguuuc

SEQ ID NO: 3924455 - RNA, 15 nt, Human adenovirus D
accccaucccggcca

SEQ ID NO: 3924456 - RNA, 12 nt, Human adenovirus D
acccgccacccu

SEQ ID NO: 3924457 - RNA, 18 nt, Human adenovirus D
acccuacucgggcacggc

SEQ ID NO: 3924458 - RNA, 21 nt, Human adenovirus D
acccucaggcgcaaccaggag

SEQ ID NO: 3924459 - RNA, 21 nt, Human adenovirus D
acccugagaacggggugcagu

SEQ ID NO: 3924460 - RNA, 16 nt, Human adenovirus D
acccugcccgagggca

SEQ ID NO: 3924461 - RNA, 14 nt, Human adenovirus D
accgaccccuggcu

SEQ ID NO: 3924462 - RNA, 14 nt, Human adenovirus D
accgagccucccag

SEQ ID NO: 3924463 - RNA, 18 nt, Human adenovirus D
accgagccucccaggagg

SEQ ID NO: 3924464 - RNA, 18 nt, Human adenovirus D
accgcaaugcgggccugc

SEQ ID NO: 3924465 - RNA, 21 nt, Human adenovirus D
accgcaaugcgggccugcgcu

SEQ ID NO: 3924466 - RNA, 14 nt, Human adenovirus D
accgcauccugauc

SEQ ID NO: 3924467 - RNA, 16 nt, Human adenovirus D
accgccgugcgccgcg

SEQ ID NO: 3924468 - RNA, 15 nt, Human adenovirus D
accgcuccuggucug

SEQ ID NO: 3924469 - RNA, 20 nt, Human adenovirus D
accgcuccuggucugcaacc

SEQ ID NO: 3924470 - RNA, 20 nt, Human adenovirus D
accggaggcgugcacuggcu

SEQ ID NO: 3924471 - RNA, 14 nt, Human adenovirus D
accggcagcggggc

SEQ ID NO: 3924472 - RNA, 16 nt, Human adenovirus D
accggcagcggggccu

SEQ ID NO: 3924473 - RNA, 21 nt, Human adenovirus D
accgggaugaugaccgagcug

SEQ ID NO: 3924474 - RNA, 16 nt, Human adenovirus D
accguaccaugggaaa

SEQ ID NO: 3924475 - RNA, 21 nt, Human adenovirus D
accgugaauaucagacaugcu

SEQ ID NO: 3924476 - RNA, 16 nt, Human adenovirus D
accuacgaguacauga

SEQ ID NO: 3924477 - RNA, 21 nt, Human adenovirus D
accuacuccucuuugcccugc

SEQ ID NO: 3924478 - RNA, 19 nt, Human adenovirus D
accuaugggaacaaggccu

SEQ ID NO: 3924479 - RNA, 19 nt, Human adenovirus D
accucaaaaagcuguggac

SEQ ID NO: 3924480 - RNA, 20 nt, Human adenovirus D
accucuucuauuucuuccuc

SEQ ID NO: 3924481 - RNA, 21 nt, Human adenovirus D
accucuucuauuucuuccucu

SEQ ID NO: 3924482 - RNA, 16 nt, Human adenovirus D
accugaccuugcagag

SEQ ID NO: 3924483 - RNA, 12 nt, Human adenovirus D
accugagccgcg

SEQ ID NO: 3924484 - RNA, 18 nt, Human adenovirus D
accugcaccugcgucugc

SEQ ID NO: 3924485 - RNA, 17 nt, Human adenovirus D
accugcagcgccagucc

SEQ ID NO: 3924486 - RNA, 23 nt, Human adenovirus D
accugcagcguguucaaaacaac

SEQ ID NO: 3924487 - RNA, 19 nt, Human adenovirus D
accugcauuggcagccgag

SEQ ID NO: 3924488 - RNA, 18 nt, Human adenovirus D
accugcgcaaggucgagg

SEQ ID NO: 3924489 - RNA, 16 nt, Human adenovirus D
accuggcggaggccau

SEQ ID NO: 3924490 - RNA, 12 nt, Human adenovirus D
accugggcggcg

SEQ ID NO: 3924491 - RNA, 15 nt, Human adenovirus D
accugugacaugcaa

SEQ ID NO: 3924492 - RNA, 19 nt, Human adenovirus D
accuguucagggaccgcag

SEQ ID NO: 3924493 - RNA, 16 nt, Human adenovirus D
accuucaaccucacca

SEQ ID NO: 3924494 - RNA, 15 nt, Human adenovirus D
accuugaaaccccag

SEQ ID NO: 3924495 - RNA, 14 nt, Human adenovirus D
accuugaaagggau

SEQ ID NO: 3924496 - RNA, 16 nt, Human adenovirus D
acgaccggcugcucac

SEQ ID NO: 3924497 - RNA, 13 nt, Human adenovirus D
acgagaccagagg

SEQ ID NO: 3924498 - RNA, 14 nt, Human adenovirus D
acgagacuggccuc

SEQ ID NO: 3924499 - RNA, 22 nt, Human adenovirus D
acgagcaagacgcaggccagga

SEQ ID NO: 3924500 - RNA, 20 nt, Human adenovirus D
acgagcccgcgcgggagcca

SEQ ID NO: 3924501 - RNA, 13 nt, Human adenovirus D
acgagcggccgcc

SEQ ID NO: 3924502 - RNA, 17 nt, Human adenovirus D
acgaggaauuugaaaau

SEQ ID NO: 3924503 - RNA, 19 nt, Human adenovirus D
acgaggcguucagggaggc

SEQ ID NO: 3924504 - RNA, 21 nt, Human adenovirus D
acgcaaacggguuaggccgcg

SEQ ID NO: 3924505 - RNA, 14 nt, Human adenovirus D
acgcaagagccggc

SEQ ID NO: 3924506 - RNA, 14 nt, Human adenovirus D
acgcacgggccgcc

SEQ ID NO: 3924507 - RNA, 22 nt, Human adenovirus D
acgcagccggcgaacgugccgc

SEQ ID NO: 3924508 - RNA, 15 nt, Human adenovirus D
acgcaggccaggagg

SEQ ID NO: 3924509 - RNA, 16 nt, Human adenovirus D
acgcaggccaggagga

SEQ ID NO: 3924510 - RNA, 13 nt, Human adenovirus D
acgccagccgcag

SEQ ID NO: 3924511 - RNA, 14 nt, Human adenovirus D
acgcccugcuggag

SEQ ID NO: 3924512 - RNA, 16 nt, Human adenovirus D
acgcccugcuggagcg

SEQ ID NO: 3924513 - RNA, 15 nt, Human adenovirus D
acgcccuggccgacc

SEQ ID NO: 3924514 - RNA, 15 nt, Human adenovirus D
acgccgaggcucugu

SEQ ID NO: 3924515 - RNA, 18 nt, Human adenovirus D
acgcgcgaagauggccac

SEQ ID NO: 3924516 - RNA, 21 nt, Human adenovirus D
acgcgcgaagauggccacccc

SEQ ID NO: 3924517 - RNA, 16 nt, Human adenovirus D
acgcgcucgacaugac

SEQ ID NO: 3924518 - RNA, 23 nt, Human adenovirus D
acgcucaggaccauagggagccu

SEQ ID NO: 3924519 - RNA, 21 nt, Human adenovirus D
acgcugaaaggcgggcugccc

SEQ ID NO: 3924520 - RNA, 11 nt, Human adenovirus D
acgcuggccag

SEQ ID NO: 3924521 - RNA, 18 nt, Human adenovirus D
acggaccaccccaggcgg

SEQ ID NO: 3924522 - RNA, 14 nt, Human adenovirus D
acggagggcagaaa

SEQ ID NO: 3924523 - RNA, 15 nt, Human adenovirus D
acggagggcagaaac

SEQ ID NO: 3924524 - RNA, 18 nt, Human adenovirus D
acggcaucuuccuggggc

SEQ ID NO: 3924525 - RNA, 14 nt, Human adenovirus D
acggccagcagggu

SEQ ID NO: 3924526 - RNA, 18 nt, Human adenovirus D
acggccuggccucgggca

SEQ ID NO: 3924527 - RNA, 23 nt, Human adenovirus D
acggcugcauccacugcuccugc

SEQ ID NO: 3924528 - RNA, 22 nt, Human adenovirus D
acggcuuacaacagccuugccc

SEQ ID NO: 3924529 - RNA, 13 nt, Human adenovirus D
acgggcccugcga

SEQ ID NO: 3924530 - RNA, 12 nt, Human adenovirus D
acgggccgccgg

SEQ ID NO: 3924531 - RNA, 18 nt, Human adenovirus D
acgggcugcuucugccug

SEQ ID NO: 3924532 - RNA, 17 nt, Human adenovirus D
acggucugcaggccggg

SEQ ID NO: 3924533 - RNA, 22 nt, Human adenovirus D
acggucugcaggccgggcugca

SEQ ID NO: 3924534 - RNA, 22 nt, Human adenovirus D
acgucaucgacucgguggucgc

SEQ ID NO: 3924535 - RNA, 17 nt, Human adenovirus D
acgucggcguggcgcuc

SEQ ID NO: 3924536 - RNA, 21 nt, Human adenovirus D
acgucuacaaggcccugggca

SEQ ID NO: 3924537 - RNA, 17 nt, Human adenovirus D
acgugcccaucuccauc

SEQ ID NO: 3924538 - RNA, 16 nt, Human adenovirus D
acgugccgcgcgggca

SEQ ID NO: 3924539 - RNA, 13 nt, Human adenovirus D
acguggugcugcu

SEQ ID NO: 3924540 - RNA, 21 nt, Human adenovirus D
acguggugcugcugccgggcu

SEQ ID NO: 3924541 - RNA, 22 nt, Human adenovirus D
acguggugcugcugccgggcug

SEQ ID NO: 3924542 - RNA, 18 nt, Human adenovirus D
acguuaccgacagcagca

SEQ ID NO: 3924543 - RNA, 21 nt, Human adenovirus D
acuaauucucaaagugugaaa

SEQ ID NO: 3924544 - RNA, 22 nt, Human adenovirus D
acuacuaauucucaaaguguga

SEQ ID NO: 3924545 - RNA, 16 nt, Human adenovirus D
acuaggcccagcagca

SEQ ID NO: 3924546 - RNA, 15 nt, Human adenovirus D
acucaccaaggccau

SEQ ID NO: 3924547 - RNA, 15 nt, Human adenovirus D
acucacccuggggcu

SEQ ID NO: 3924548 - RNA, 22 nt, Human adenovirus D
acucccgucucgacccgagccc

SEQ ID NO: 3924549 - RNA, 12 nt, Human adenovirus D
acucccuucuca

SEQ ID NO: 3924550 - RNA, 21 nt, Human adenovirus D
acucgcaaaaauaaaucauug

SEQ ID NO: 3924551 - RNA, 20 nt, Human adenovirus D
acucgcagacgagcggccgc

SEQ ID NO: 3924552 - RNA, 18 nt, Human adenovirus D
acucgcagugcacgggca

SEQ ID NO: 3924553 - RNA, 14 nt, Human adenovirus D
acucggagcuggcu

SEQ ID NO: 3924554 - RNA, 20 nt, Human adenovirus D
acucugguacuccagucucc

SEQ ID NO: 3924555 - RNA, 21 nt, Human adenovirus D
acucuguaggccauccccauc

SEQ ID NO: 3924556 - RNA, 15 nt, Human adenovirus D
acucugugugcugag

SEQ ID NO: 3924557 - RNA, 16 nt, Human adenovirus D
acucuuccgccgccga

SEQ ID NO: 3924558 - RNA, 19 nt, Human adenovirus D
acugaaggaaaaaucacuc

SEQ ID NO: 3924559 - RNA, 15 nt, Human adenovirus D
cgcuggccagcacgc

SEQ ID NO: 3924560 - RNA, 14 nt, Human adenovirus D
cgcuggcugcugga

SEQ ID NO: 3924561 - RNA, 22 nt, Human adenovirus D
cgcugggcguggugcuggauga

SEQ ID NO: 3924562 - RNA, 12 nt, Human adenovirus D
cgcuggggcaga

SEQ ID NO: 3924563 - RNA, 15 nt, Human adenovirus D
cgcuggggcagaacg

SEQ ID NO: 3924564 - RNA, 12 nt, Human adenovirus D
cgcuguggagcc

SEQ ID NO: 3924565 - RNA, 12 nt, Human adenovirus D
cgcuucuucccc

SEQ ID NO: 3924566 - RNA, 22 nt, Human adenovirus D
cgcuugcuggaugcggagccgc

SEQ ID NO: 3924567 - RNA, 14 nt, Human adenovirus D
cggaaacgccacca

SEQ ID NO: 3924568 - RNA, 22 nt, Human adenovirus D
cggaaucagaauauccccuucc

SEQ ID NO: 3924569 - RNA, 22 nt, Human adenovirus D
cggacggaguguuccaacuagc

SEQ ID NO: 3924570 - RNA, 14 nt, Human adenovirus D
cggacguggugcug

SEQ ID NO: 3924571 - RNA, 20 nt, Human adenovirus D
cggacguggugcugcugccg

SEQ ID NO: 3924572 - RNA, 15 nt, Human adenovirus D
cggagcccacccgcu

SEQ ID NO: 3924573 - RNA, 14 nt, Human adenovirus D
cggagcgaggugug

SEQ ID NO: 3924574 - RNA, 22 nt, Human adenovirus D
cggaggcgugcacuggcucgcc

SEQ ID NO: 3924575 - RNA, 16 nt, Human adenovirus D
cggagggugccagauu

SEQ ID NO: 3924576 - RNA, 12 nt, Human adenovirus D
cggaggugagcu

SEQ ID NO: 3924577 - RNA, 17 nt, Human adenovirus D
cggaguaccugagcccg

SEQ ID NO: 3924578 - RNA, 14 nt, Human adenovirus D
cggaucgcccaggc

SEQ ID NO: 3924579 - RNA, 22 nt, Human adenovirus D
cggcacccgguacuacgccagc

SEQ ID NO: 3924580 - RNA, 17 nt, Human adenovirus D
cggcacgaucccgggca

SEQ ID NO: 3924581 - RNA, 16 nt, Human adenovirus D
cggcagccgcagccgc

SEQ ID NO: 3924582 - RNA, 16 nt, Human adenovirus D
cggcagcggggccugg

SEQ ID NO: 3924583 - RNA, 22 nt, Human adenovirus D
cggcaugggaugcgugagggcg

SEQ ID NO: 3924584 - RNA, 15 nt, Human adenovirus D
cggccaaccugguga

SEQ ID NO: 3924585 - RNA, 12 nt, Human adenovirus D
cggccaaggcca

SEQ ID NO: 3924586 - RNA, 19 nt, Human adenovirus D
cggccagcagggugccucc

SEQ ID NO: 3924587 - RNA, 15 nt, Human adenovirus D
cggccagucugauga

SEQ ID NO: 3924588 - RNA, 16 nt, Human adenovirus D
cggccauucuggaggc

SEQ ID NO: 3924589 - RNA, 17 nt, Human adenovirus D
cggccgaaaaccccgcc

SEQ ID NO: 3924590 - RNA, 13 nt, Human adenovirus D
cggccgcggccag

SEQ ID NO: 3924591 - RNA, 18 nt, Human adenovirus D
cggccgcggcgagcggga

SEQ ID NO: 3924592 - RNA, 22 nt, Human adenovirus D
cggccguccuuucgcugcugcc

SEQ ID NO: 3924593 - RNA, 13 nt, Human adenovirus D
cggcgcgagcuga

SEQ ID NO: 3924594 - RNA, 14 nt, Human adenovirus D
cggcgcgagcugag

SEQ ID NO: 3924595 - RNA, 14 nt, Human adenovirus D
cggcgcugcaaagc

SEQ ID NO: 3924596 - RNA, 16 nt, Human adenovirus D
cggcgcugcaaagcca

SEQ ID NO: 3924597 - RNA, 18 nt, Human adenovirus D
cggcggcagcggcgguuc

SEQ ID NO: 3924598 - RNA, 17 nt, Human adenovirus D
cggcggccaaccuggug

SEQ ID NO: 3924599 - RNA, 18 nt, Human adenovirus D
cggcggccaaccugguga

SEQ ID NO: 3924600 - RNA, 13 nt, Human adenovirus D
cggcgggggcgga

SEQ ID NO: 3924601 - RNA, 24 nt, Human adenovirus D
cggcggucaccucaacgcccaggc

SEQ ID NO: 3924602 - RNA, 23 nt, Human adenovirus D
cggcugcauccacugcuccugcg

SEQ ID NO: 3924603 - RNA, 16 nt, Human adenovirus D
cggcuguagaccacgu

SEQ ID NO: 3924604 - RNA, 18 nt, Human adenovirus D
cgggaccggggaggcacc

SEQ ID NO: 3924605 - RNA, 15 nt, Human adenovirus D
cgggacgcccuggcc

SEQ ID NO: 3924606 - RNA, 11 nt, Human adenovirus D
cgggagcgagc

SEQ ID NO: 3924607 - RNA, 22 nt, Human adenovirus D
cgggccaugagggucuggagcu

SEQ ID NO: 3924608 - RNA, 13 nt, Human adenovirus D
cgggccuacgagc

SEQ ID NO: 3924609 - RNA, 21 nt, Human adenovirus D
cgggccuacgagcucaaccuc

SEQ ID NO: 3924610 - RNA, 22 nt, Human adenovirus D
cgggcggacggaucgcccaggc

SEQ ID NO: 3924611 - RNA, 17 nt, Human adenovirus D
cgggcgggcagggagcu

SEQ ID NO: 3924612 - RNA, 18 nt, Human adenovirus D
cggggaaggucucgcucc

SEQ ID NO: 3924613 - RNA, 14 nt, Human adenovirus D
cggggaggagcccg

SEQ ID NO: 3924614 - RNA, 16 nt, Human adenovirus D
cggggaucagccccgc

SEQ ID NO: 3924615 - RNA, 21 nt, Human adenovirus D
cggggcgggggugaugagcug

SEQ ID NO: 3924616 - RNA, 22 nt, Human adenovirus D
cggggcgggggugaugagcugc

SEQ ID NO: 3924617 - RNA, 15 nt, Human adenovirus D
cgggguacugacgcc

SEQ ID NO: 3924618 - RNA, 22 nt, Human adenovirus D
cgggugaccccgacgccccuga

SEQ ID NO: 3924619 - RNA, 20 nt, Human adenovirus D
cgggugaggguguccuggaa

SEQ ID NO: 3924620 - RNA, 22 nt, Human adenovirus D
cggguguaaugaaacccgccac

SEQ ID NO: 3924621 - RNA, 21 nt, Human adenovirus D
cggucaccucaacgcccaggc

SEQ ID NO: 3924622 - RNA, 17 nt, Human adenovirus D
cgguccccgaggcccuu

SEQ ID NO: 3924623 - RNA, 18 nt, Human adenovirus D
cggucgcgcgaagaggag

SEQ ID NO: 3924624 - RNA, 18 nt, Human adenovirus D
cggucguuguccaccagg

SEQ ID NO: 3924625 - RNA, 14 nt, Human adenovirus D
cggugcugcugccg

SEQ ID NO: 3924626 - RNA, 15 nt, Human adenovirus D
cgguggccccgaccc

SEQ ID NO: 3924627 - RNA, 14 nt, Human adenovirus D
cgguggggcgguga

SEQ ID NO: 3924628 - RNA, 16 nt, Human adenovirus D
cggugggucggagccc

SEQ ID NO: 3924629 - RNA, 21 nt, Human adenovirus D
cgguggucccuucucggacca

SEQ ID NO: 3924630 - RNA, 15 nt, Human adenovirus D
cgguguugcgcccug

SEQ ID NO: 3924631 - RNA, 14 nt, Human adenovirus D
cgguugagcuggga

SEQ ID NO: 3924632 - RNA, 19 nt, Human adenovirus D
cguacuucagccugggcaa

SEQ ID NO: 3924633 - RNA, 21 nt, Human adenovirus D
cguagaggcgggugagggcgu

SEQ ID NO: 3924634 - RNA, 11 nt, Human adenovirus D
cguagccagaa

SEQ ID NO: 3924635 - RNA, 18 nt, Human adenovirus D
cguaguugcgcaggcgcu

SEQ ID NO: 3924636 - RNA, 18 nt, Human adenovirus D
cgucacccugcccuucca

SEQ ID NO: 3924637 - RNA, 22 nt, Human adenovirus D
cgucagggcgaaggugucccug

SEQ ID NO: 3924638 - RNA, 14 nt, Human adenovirus D
cgucauugaagaga

SEQ ID NO: 3924639 - RNA, 22 nt, Human adenovirus D
cguccgcaguacucgcagcgcu

SEQ ID NO: 3924640 - RNA, 18 nt, Human adenovirus D
cguccgucagcagcagga

SEQ ID NO: 3924641 - RNA, 17 nt, Human adenovirus D
cguccuuucgcugcugc

SEQ ID NO: 3924642 - RNA, 17 nt, Human adenovirus D
cgucgacggggaaggcu

SEQ ID NO: 3924643 - RNA, 20 nt, Human adenovirus D
cgugaaggccggcaugccca

SEQ ID NO: 3924644 - RNA, 13 nt, Human adenovirus D
cgugaccaggggu

SEQ ID NO: 3924645 - RNA, 14 nt, Human adenovirus D
cgugcccgagggcu

SEQ ID NO: 3924646 - RNA, 18 nt, Human adenovirus D
cgugcugcgcgacgagga

SEQ ID NO: 3924647 - RNA, 21 nt, Human adenovirus D
cgugcugcucucucuucuugu

SEQ ID NO: 3924648 - RNA, 16 nt, Human adenovirus D
cguggacgcugcucac

SEQ ID NO: 3924649 - RNA, 12 nt, Human adenovirus D
cguggcgcagcg

SEQ ID NO: 3924650 - RNA, 14 nt, Human adenovirus D
cguggcuucgagca

SEQ ID NO: 3924651 - RNA, 21 nt, Human adenovirus D
cgugggacucacccuggggcu

SEQ ID NO: 3924652 - RNA, 17 nt, Human adenovirus D
cguguccacgcauugca

SEQ ID NO: 3924653 - RNA, 22 nt, Human adenovirus D
cgugugcugugauacuguugca

SEQ ID NO: 3924654 - RNA, 14 nt, Human adenovirus D
cguguggcagcagu

SEQ ID NO: 3924655 - RNA, 21 nt, Human adenovirus D
cguucgcgaggacgcagcgug

SEQ ID NO: 3924656 - RNA, 15 nt, Human adenovirus D
cuaaacuaaagccaa

SEQ ID NO: 3924657 - RNA, 16 nt, Human adenovirus D
cuaaauuuaagccagu

SEQ ID NO: 3924658 - RNA, 15 nt, Human adenovirus D
cuaaucaagacaaaa

SEQ ID NO: 3924659 - RNA, 19 nt, Human adenovirus D
cuaaucauuuaauaaagau

SEQ ID NO: 3924660 - RNA, 14 nt, Human adenovirus D
cuaaugacaaacaa

SEQ ID NO: 3924661 - RNA, 17 nt, Human adenovirus D
cuaaugacaaacaaaag

SEQ ID NO: 3924662 - RNA, 14 nt, Human adenovirus D
cuacaaggaccgca

SEQ ID NO: 3924663 - RNA, 19 nt, Human adenovirus D
cuacaucguaggugacaaa

SEQ ID NO: 3924664 - RNA, 13 nt, Human adenovirus D
cuacaucugcugc

SEQ ID NO: 3924665 - RNA, 15 nt, Human adenovirus D
cuaccaccccagcau

SEQ ID NO: 3924666 - RNA, 15 nt, Human adenovirus D
cuaccgcggcacccg

SEQ ID NO: 3924667 - RNA, 17 nt, Human adenovirus D
cuaccugggagucucua

SEQ ID NO: 3924668 - RNA, 14 nt, Human adenovirus D
cuaccuugcaccca

SEQ ID NO: 3924669 - RNA, 16 nt, Human adenovirus D
cuacgagcucaaccuc

SEQ ID NO: 3924670 - RNA, 18 nt, Human adenovirus D
cuacgccagccgcaggcg

SEQ ID NO: 3924671 - RNA, 18 nt, Human adenovirus D
cuacgcguacauccagca

SEQ ID NO: 3924672 - RNA, 17 nt, Human adenovirus D
cuacgucuacaaggccc

SEQ ID NO: 3924673 - RNA, 15 nt, Human adenovirus D
cuacgugcccuucca

SEQ ID NO: 3924674 - RNA, 16 nt, Human adenovirus D
cuacuggucgcugccg

SEQ ID NO: 3924675 - RNA, 18 nt, Human adenovirus D
cuacuuuuugggcaccca

SEQ ID NO: 3924676 - RNA, 22 nt, Human adenovirus D
cugcuaccucuugcagcuggcc

SEQ ID NO: 3924677 - RNA, 12 nt, Human adenovirus D
cugcuccugcac

SEQ ID NO: 3924678 - RNA, 19 nt, Human adenovirus D
cugcuccugcucccgggcu

SEQ ID NO: 3924679 - RNA, 22 nt, Human adenovirus D
cugcucucucuucuuguaacuu

SEQ ID NO: 3924680 - RNA, 15 nt, Human adenovirus D
cugcugcagccgccg

SEQ ID NO: 3924681 - RNA, 17 nt, Human adenovirus D
cugcugccgcucaguca

SEQ ID NO: 3924682 - RNA, 12 nt, Human adenovirus D
cugcugcuccac

SEQ ID NO: 3924683 - RNA, 14 nt, Human adenovirus D
cugcugcuccacca

SEQ ID NO: 3924684 - RNA, 23 nt, Human adenovirus D
cugcuugcaagacugcgggggga

SEQ ID NO: 3924685 - RNA, 22 nt, Human adenovirus D
cuggaaacucuuggagcagggu

SEQ ID NO: 3924686 - RNA, 22 nt, Human adenovirus D
cuggaagagguaguugagggug

SEQ ID NO: 3924687 - RNA, 15 nt, Human adenovirus D
cuggaagccaugcug

SEQ ID NO: 3924688 - RNA, 18 nt, Human adenovirus D
cuggaccaggcggcagag

SEQ ID NO: 3924689 - RNA, 20 nt, Human adenovirus D
cuggacccgcggccgcccac

SEQ ID NO: 3924690 - RNA, 22 nt, Human adenovirus D
cuggacccuccgucggaagagg

SEQ ID NO: 3924691 - RNA, 17 nt, Human adenovirus D
cuggaccggcuggugac

SEQ ID NO: 3924692 - RNA, 17 nt, Human adenovirus D
cuggagacacugguuug

SEQ ID NO: 3924693 - RNA, 23 nt, Human adenovirus D
cuggaguuucacccgucugaaaa

SEQ ID NO: 3924694 - RNA, 14 nt, Human adenovirus D
cuggaugcggagcc

SEQ ID NO: 3924695 - RNA, 16 nt, Human adenovirus D
cuggcccggcaacgac

SEQ ID NO: 3924696 - RNA, 23 nt, Human adenovirus D
cuggccgcgggcgccucccagga

SEQ ID NO: 3924697 - RNA, 15 nt, Human adenovirus D
cuggccuuccaccuc

SEQ ID NO: 3924698 - RNA, 16 nt, Human adenovirus D
cuggcgacgcagccgg

SEQ ID NO: 3924699 - RNA, 17 nt, Human adenovirus D
cuggcggagaacaaggc

SEQ ID NO: 3924700 - RNA, 13 nt, Human adenovirus D
cuggcugcuggag

SEQ ID NO: 3924701 - RNA, 14 nt, Human adenovirus D
cuggcuggucaggc

SEQ ID NO: 3924702 - RNA, 16 nt, Human adenovirus D
cuggcuucuacagcca

SEQ ID NO: 3924703 - RNA, 15 nt, Human adenovirus D
cugggaauccugcac

SEQ ID NO: 3924704 - RNA, 13 nt, Human adenovirus D
cugggaggcugcg

SEQ ID NO: 3924705 - RNA, 15 nt, Human adenovirus D
cugggcacuggagca

SEQ ID NO: 3924706 - RNA, 16 nt, Human adenovirus D
cugggcauucgcaaga

SEQ ID NO: 3924707 - RNA, 19 nt, Human adenovirus D
cugggcguugcgggccgag

SEQ ID NO: 3924708 - RNA, 15 nt, Human adenovirus D
cugggcucgcuggug

SEQ ID NO: 3924709 - RNA, 19 nt, Human adenovirus D
cugggcucgcugguggcgc

SEQ ID NO: 3924710 - RNA, 11 nt, Human adenovirus D
cugggggcgcc

SEQ ID NO: 3924711 - RNA, 13 nt, Human adenovirus D
cugggggcggugg

SEQ ID NO: 3924712 - RNA, 21 nt, Human adenovirus D
cugggguauuacuaggcccag

SEQ ID NO: 3924713 - RNA, 23 nt, Human adenovirus D
cugggguauuacuaggcccagca

SEQ ID NO: 3924714 - RNA, 13 nt, Human adenovirus D
cugguacuugggc

SEQ ID NO: 3924715 - RNA, 23 nt, Human adenovirus D
cuggugauacgaggcagaggcac

SEQ ID NO: 3924716 - RNA, 18 nt, Human adenovirus D
cuggugcgucgagcacag

SEQ ID NO: 3924717 - RNA, 16 nt, Human adenovirus D
cugguuccucguccag

SEQ ID NO: 3924718 - RNA, 21 nt, Human adenovirus D
cugguugacaaauggagccag

SEQ ID NO: 3924719 - RNA, 17 nt, Human adenovirus D
cuguauuaccuuccuug

SEQ ID NO: 3924720 - RNA, 16 nt, Human adenovirus D
cugugccucuccauca

SEQ ID NO: 3924721 - RNA, 14 nt, Human adenovirus D
cuguuacuguaaag

SEQ ID NO: 3924722 - RNA, 12 nt, Human adenovirus D
cuuaaaucauuu

SEQ ID NO: 3924723 - RNA, 23 nt, Human adenovirus D
cuuaaaucauuuaaaauaaaacu

SEQ ID NO: 3924724 - RNA, 16 nt, Human adenovirus D
cuuaccaaguccaggg

SEQ ID NO: 3924725 - RNA, 24 nt, Human adenovirus D
cuuacucagguuuggauauucaaa

SEQ ID NO: 3924726 - RNA, 20 nt, Human adenovirus D
cuuaguucagcugcaaugau

SEQ ID NO: 3924727 - RNA, 13 nt, Human adenovirus D
cuuaguuuaaaag

SEQ ID NO: 3924728 - RNA, 20 nt, Human adenovirus D
cuucaacgacuaccucucgg

SEQ ID NO: 3924729 - RNA, 23 nt, Human adenovirus D
cuucacagagagccgccugagca

SEQ ID NO: 3924730 - RNA, 16 nt, Human adenovirus D
cuuccagcccaugagc

SEQ ID NO: 3924731 - RNA, 17 nt, Human adenovirus D
cuuccaguacucccgga

SEQ ID NO: 3924732 - RNA, 23 nt, Human adenovirus D
cuuccaugcgggugaccccgacg

SEQ ID NO: 3924733 - RNA, 21 nt, Human adenovirus D
cuucccggugcccgcuccgcc

SEQ ID NO: 3924734 - RNA, 20 nt, Human adenovirus D
cuuccguucuacccagcaag

SEQ ID NO: 3924735 - RNA, 20 nt, Human adenovirus D
cuuccguugcgcugcaggcg

SEQ ID NO: 3924736 - RNA, 21 nt, Human adenovirus D
cuuccuccguagccuggcgga

SEQ ID NO: 3924737 - RNA, 14 nt, Human adenovirus D
cuuccugcagcuca

SEQ ID NO: 3924738 - RNA, 23 nt, Human adenovirus D
cuucgagguggaccccauggaug

SEQ ID NO: 3924739 - RNA, 20 nt, Human adenovirus D
cuucgaguacgaggccaugc

SEQ ID NO: 3924740 - RNA, 22 nt, Human adenovirus D
cuucgaguacgaggccaugcug

SEQ ID NO: 3924741 - RNA, 12 nt, Human adenovirus D
cuucuacagcca

SEQ ID NO: 3924742 - RNA, 15 nt, Human adenovirus D
cuucuacagccagca

SEQ ID NO: 3924743 - RNA, 14 nt, Human adenovirus D
cuucugggcaacgg

SEQ ID NO: 3924744 - RNA, 18 nt, Human adenovirus D
cuugaaagggaugucaaa

SEQ ID NO: 3924745 - RNA, 17 nt, Human adenovirus D
cuugaaaucgcaguugg

SEQ ID NO: 3924746 - RNA, 17 nt, Human adenovirus D
cuugaacuacuggcuuc

SEQ ID NO: 3924747 - RNA, 16 nt, Human adenovirus D
cuugaccugccuccac

SEQ ID NO: 3924748 - RNA, 21 nt, Human adenovirus D
cuugaccugccuccaccaccc

SEQ ID NO: 3924749 - RNA, 23 nt, Human adenovirus D
cuugagacucauccugcuggugc

SEQ ID NO: 3924750 - RNA, 18 nt, Human adenovirus D
cuugaggaggaacuucag

SEQ ID NO: 3924751 - RNA, 18 nt, Human adenovirus D
cuugcaacuugcaaacaa

SEQ ID NO: 3924752 - RNA, 15 nt, Human adenovirus D
cuugcugggcgagga

SEQ ID NO: 3924753 - RNA, 14 nt, Human adenovirus D
cuugggcugccacu

SEQ ID NO: 3924754 - RNA, 19 nt, Human adenovirus D
cuuguagggacagcagccc

SEQ ID NO: 3924755 - RNA, 23 nt, Human adenovirus D
cuuucacccggacguggugcugc

SEQ ID NO: 3924756 - RNA, 15 nt, Human adenovirus D
cuuucauccaucugg

SEQ ID NO: 3924757 - RNA, 14 nt, Human adenovirus D
cuuucucugccaca

SEQ ID NO: 3924758 - RNA, 16 nt, Human adenovirus D
cuuucuuugacacacc

SEQ ID NO: 3924759 - RNA, 19 nt, Human adenovirus D
cuuucuuugccaucaugau

SEQ ID NO: 3924760 - RNA, 22 nt, Human adenovirus D
cuuugacacaccuggaggcacc

SEQ ID NO: 3924761 - RNA, 14 nt, Human adenovirus D
cuuugucugcugua

SEQ ID NO: 3924762 - RNA, 22 nt, Human adenovirus D
cuuugucugcuguaaagccaga

SEQ ID NO: 3924763 - RNA, 15 nt, Human adenovirus D
cuuuuuaaaaacacu

SEQ ID NO: 3924764 - RNA, 18 nt, Human adenovirus D
gaaaaacagaaagcaugc

SEQ ID NO: 3924765 - RNA, 13 nt, Human adenovirus D
gaaaaggcagcug

SEQ ID NO: 3924766 - RNA, 14 nt, Human adenovirus D
gaaacaagucaaaa

SEQ ID NO: 3924767 - RNA, 16 nt, Human adenovirus D
gaaacaccugcagcgc

SEQ ID NO: 3924768 - RNA, 18 nt, Human adenovirus D
gaaacagauccugcugcu

SEQ ID NO: 3924769 - RNA, 18 nt, Human adenovirus D
gaaagaacauacaugggc

SEQ ID NO: 3924770 - RNA, 19 nt, Human adenovirus D
gaaagaggcggaacugcug

SEQ ID NO: 3924771 - RNA, 19 nt, Human adenovirus D
gaaagauuuaauuggcaaa

SEQ ID NO: 3924772 - RNA, 19 nt, Human adenovirus D
gaaagcgguugagcgggcu

SEQ ID NO: 3924773 - RNA, 16 nt, Human adenovirus D
gaaagcuauaaaaaug

SEQ ID NO: 3924774 - RNA, 16 nt, Human adenovirus D
gaaaggcgggcugccc

SEQ ID NO: 3924775 - RNA, 14 nt, Human adenovirus D
gaaagucaggagca

SEQ ID NO: 3924776 - RNA, 17 nt, Human adenovirus D
gaaaucaguuucccaug

SEQ ID NO: 3924777 - RNA, 14 nt, Human adenovirus D
gaaaugaggcaggc

SEQ ID NO: 3924778 - RNA, 15 nt, Human adenovirus D
gaaaugcuaccuggg

SEQ ID NO: 3924779 - RNA, 12 nt, Human adenovirus D
gaacaaggccau

SEQ ID NO: 3924780 - RNA, 16 nt, Human adenovirus D
gaacagcagcagcaaa

SEQ ID NO: 3924781 - RNA, 17 nt, Human adenovirus D
gaacaguccacccagac

SEQ ID NO: 3924782 - RNA, 19 nt, Human adenovirus D
gaaccgccgccggcggcgg

SEQ ID NO: 3924783 - RNA, 19 nt, Human adenovirus D
gaaccugcgcgggcugugg

SEQ ID NO: 3924784 - RNA, 19 nt, Human adenovirus D
gaaccuuuggaccugagcu

SEQ ID NO: 3924785 - RNA, 16 nt, Human adenovirus D
gaacgggggcagcaca

SEQ ID NO: 3924786 - RNA, 21 nt, Human adenovirus D
gaacuaaucauuuaauaaaga

SEQ ID NO: 3924787 - RNA, 19 nt, Human adenovirus D
gaacugauguugauuaaaa

SEQ ID NO: 3924788 - RNA, 19 nt, Human adenovirus D
gaacugcuggcccugcugg

SEQ ID NO: 3924789 - RNA, 15 nt, Human adenovirus D
gaacuggcagagcac

SEQ ID NO: 3924790 - RNA, 10 nt, Human adenovirus D
gaacuuucuc

SEQ ID NO: 3924791 - RNA, 17 nt, Human adenovirus D
gaagaaaacuggcaaga

SEQ ID NO: 3924792 - RNA, 13 nt, Human adenovirus D
gagcuuggccgag

SEQ ID NO: 3924793 - RNA, 22 nt, Human adenovirus D
gagcuuuuacaacgaccucgcc

SEQ ID NO: 3924794 - RNA, 17 nt, Human adenovirus D
gaggaccaaucgcgccc

SEQ ID NO: 3924795 - RNA, 19 nt, Human adenovirus D
gaggagaacugcuggcccu

SEQ ID NO: 3924796 - RNA, 17 nt, Human adenovirus D
gaggagagcagguuucu

SEQ ID NO: 3924797 - RNA, 22 nt, Human adenovirus D
gaggagcaccccaacggcccug

SEQ ID NO: 3924798 - RNA, 21 nt, Human adenovirus D
gaggcacgucggcguggcgcu

SEQ ID NO: 3924799 - RNA, 18 nt, Human adenovirus D
gaggcauggcaggcagcg

SEQ ID NO: 3924800 - RNA, 17 nt, Human adenovirus D
gaggccacgugcgaggg

SEQ ID NO: 3924801 - RNA, 21 nt, Human adenovirus D
gaggccaucuaaacuaaagcc

SEQ ID NO: 3924802 - RNA, 21 nt, Human adenovirus D
gaggccuugacaaaggccgug

SEQ ID NO: 3924803 - RNA, 14 nt, Human adenovirus D
gaggcgguccccgc

SEQ ID NO: 3924804 - RNA, 14 nt, Human adenovirus D
gagggcauggguca

SEQ ID NO: 3924805 - RNA, 13 nt, Human adenovirus D
gagggccuggacc

SEQ ID NO: 3924806 - RNA, 14 nt, Human adenovirus D
gagggucuggagcu

SEQ ID NO: 3924807 - RNA, 23 nt, Human adenovirus D
gagguaguugagggugguggcga

SEQ ID NO: 3924808 - RNA, 12 nt, Human adenovirus D
gaggugagcucu

SEQ ID NO: 3924809 - RNA, 13 nt, Human adenovirus D
gaguaccugagcc

SEQ ID NO: 3924810 - RNA, 12 nt, Human adenovirus D
gagugaagaggg

SEQ ID NO: 3924811 - RNA, 13 nt, Human adenovirus D
gagugcagggaug

SEQ ID NO: 3924812 - RNA, 12 nt, Human adenovirus D
gaguggcggcuu

SEQ ID NO: 3924813 - RNA, 19 nt, Human adenovirus D
gaguggcggcuuucugccc

SEQ ID NO: 3924814 - RNA, 22 nt, Human adenovirus D
gauaaggagaaggauucaaaac

SEQ ID NO: 3924815 - RNA, 22 nt, Human adenovirus D
gauacgaggcagaggcacacag

SEQ ID NO: 3924816 - RNA, 13 nt, Human adenovirus D
gauagccgccagg

SEQ ID NO: 3924817 - RNA, 18 nt, Human adenovirus D
gaucaaccuccaggccaa

SEQ ID NO: 3924818 - RNA, 14 nt, Human adenovirus D
gaucagccccgcgc

SEQ ID NO: 3924819 - RNA, 23 nt, Human adenovirus D
gaucagccccgcgcgcgcgcacg

SEQ ID NO: 3924820 - RNA, 22 nt, Human adenovirus D
gauccccgucuccugccgcgcc

SEQ ID NO: 3924821 - RNA, 21 nt, Human adenovirus D
gaucccgcuguggcugaagau

SEQ ID NO: 3924822 - RNA, 23 nt, Human adenovirus D
gauccucgcccaauugcacgcca

SEQ ID NO: 3924823 - RNA, 18 nt, Human adenovirus D
gaugaaccuuuggaccug

SEQ ID NO: 3924824 - RNA, 21 nt, Human adenovirus D
gaugaccgagcugacggccag

SEQ ID NO: 3924825 - RNA, 15 nt, Human adenovirus D
gaugaguugggccug

SEQ ID NO: 3924826 - RNA, 15 nt, Human adenovirus D
gaugauaccaagaga

SEQ ID NO: 3924827 - RNA, 16 nt, Human adenovirus D
gaugaugccgcagugg

SEQ ID NO: 3924828 - RNA, 13 nt, Human adenovirus D
gaugcagcaagcc

SEQ ID NO: 3924829 - RNA, 21 nt, Human adenovirus D
gaugcaugcggggggagauga

SEQ ID NO: 3924830 - RNA, 12 nt, Human adenovirus D
gaugccaggggu

SEQ ID NO: 3924831 - RNA, 16 nt, Human adenovirus D
gaugcugcccgccacc

SEQ ID NO: 3924832 - RNA, 20 nt, Human adenovirus D
gaugcugcccgccaccugca

SEQ ID NO: 3924833 - RNA, 20 nt, Human adenovirus D
gauggaacucuguugaggca

SEQ ID NO: 3924834 - RNA, 16 nt, Human adenovirus D
gauggacuuggaagag

SEQ ID NO: 3924835 - RNA, 19 nt, Human adenovirus D
gauggccuccagccuuucc

SEQ ID NO: 3924836 - RNA, 16 nt, Human adenovirus D
gauggccuguaccggg

SEQ ID NO: 3924837 - RNA, 13 nt, Human adenovirus D
gauggcgugcgag

SEQ ID NO: 3924838 - RNA, 17 nt, Human adenovirus D
gaugguuucccucgggc

SEQ ID NO: 3924839 - RNA, 17 nt, Human adenovirus D
gaugucauaacccgccu

SEQ ID NO: 3924840 - RNA, 19 nt, Human adenovirus D
gaugucaucacuggcggag

SEQ ID NO: 3924841 - RNA, 13 nt, Human adenovirus D
gaugucucggugu

SEQ ID NO: 3924842 - RNA, 22 nt, Human adenovirus D
gaugugcccaaguacuuggaaa

SEQ ID NO: 3924843 - RNA, 23 nt, Human adenovirus D
gauguguuuuuagaugcagcaag

SEQ ID NO: 3924844 - RNA, 18 nt, Human adenovirus D
gauuaaaaagcagcacag

SEQ ID NO: 3924845 - RNA, 21 nt, Human adenovirus D
gauucaauaagguucugcccu

SEQ ID NO: 3924846 - RNA, 21 nt, Human adenovirus D
gauuucaucaaucaucagguu

SEQ ID NO: 3924847 - RNA, 19 nt, Human adenovirus D
gcaaagcgguugagcuggg

SEQ ID NO: 3924848 - RNA, 21 nt, Human adenovirus D
gcaacauccccgcccugcugg

SEQ ID NO: 3924849 - RNA, 15 nt, Human adenovirus D
gcaaccaggaggagc

SEQ ID NO: 3924850 - RNA, 20 nt, Human adenovirus D
gcaacuucauguccaugggc

SEQ ID NO: 3924851 - RNA, 14 nt, Human adenovirus D
gcaagaggagacag

SEQ ID NO: 3924852 - RNA, 19 nt, Human adenovirus D
gcaagaugauaccaagaga

SEQ ID NO: 3924853 - RNA, 14 nt, Human adenovirus D
gcaagcgcccagag

SEQ ID NO: 3924854 - RNA, 16 nt, Human adenovirus D
gcaagggcgaccagcu

SEQ ID NO: 3924855 - RNA, 17 nt, Human adenovirus D
gcaagguccgcaggagu

SEQ ID NO: 3924856 - RNA, 20 nt, Human adenovirus D
gcaagucacgcaggugacag

SEQ ID NO: 3924857 - RNA, 19 nt, Human adenovirus D
gcaauaccgggaugaugac

SEQ ID NO: 3924858 - RNA, 21 nt, Human adenovirus D
gcaaugcuagagugaggcacu

SEQ ID NO: 3924859 - RNA, 20 nt, Human adenovirus D
gcacaaacgugcaguccaac

SEQ ID NO: 3924860 - RNA, 21 nt, Human adenovirus D
gcacagacaccgucgccgcac

SEQ ID NO: 3924861 - RNA, 22 nt, Human adenovirus D
gcacagacccaccccagucaga

SEQ ID NO: 3924862 - RNA, 15 nt, Human adenovirus D
gcacagaccuucagg

SEQ ID NO: 3924863 - RNA, 14 nt, Human adenovirus D
gcacagcagggaca

SEQ ID NO: 3924864 - RNA, 21 nt, Human adenovirus D
gcacaguuggcgacccaggaa

SEQ ID NO: 3924865 - RNA, 18 nt, Human adenovirus D
gcacaucgccgggcagga

SEQ ID NO: 3924866 - RNA, 14 nt, Human adenovirus D
gcaccauccccagg

SEQ ID NO: 3924867 - RNA, 15 nt, Human adenovirus D
gcaccccccgcaggc

SEQ ID NO: 3924868 - RNA, 18 nt, Human adenovirus D
gcaccugcuacauguucg

SEQ ID NO: 3924869 - RNA, 21 nt, Human adenovirus D
gcaccugugggaccuggcgga

SEQ ID NO: 3924870 - RNA, 23 nt, Human adenovirus D
gcacgcggccguucaugggcacc

SEQ ID NO: 3924871 - RNA, 19 nt, Human adenovirus D
gcacgguaagagcccagca

SEQ ID NO: 3924872 - RNA, 20 nt, Human adenovirus D
gcacgucggcguggcgcucg

SEQ ID NO: 3924873 - RNA, 18 nt, Human adenovirus D
gcacguucaggacaccgg

SEQ ID NO: 3924874 - RNA, 18 nt, Human adenovirus D
gcacguuucgucaggcag

SEQ ID NO: 3924875 - RNA, 17 nt, Human adenovirus D
gcacucauccaugauga

SEQ ID NO: 3924876 - RNA, 15 nt, Human adenovirus D
gcacuggagcacaga

SEQ ID NO: 3924877 - RNA, 15 nt, Human adenovirus D
gcagaacgggggcag

SEQ ID NO: 3924878 - RNA, 17 nt, Human adenovirus D
gcagaaggugguggacg

SEQ ID NO: 3924879 - RNA, 18 nt, Human adenovirus D
gcagacacaccaggaugc

SEQ ID NO: 3924880 - RNA, 18 nt, Human adenovirus D
gcagaccgcgggccuccu

SEQ ID NO: 3924881 - RNA, 19 nt, Human adenovirus D
gcagaccuucauaauagaa

SEQ ID NO: 3924882 - RNA, 15 nt, Human adenovirus D
gcagacggugaagca

SEQ ID NO: 3924883 - RNA, 13 nt, Human adenovirus D
gcagcacauaauc

SEQ ID NO: 3924884 - RNA, 22 nt, Human adenovirus D
gcagcauugucugccuggucau

SEQ ID NO: 3924885 - RNA, 12 nt, Human adenovirus D
gcagccgagccg

SEQ ID NO: 3924886 - RNA, 18 nt, Human adenovirus D
gcagccgcguaagcagga

SEQ ID NO: 3924887 - RNA, 23 nt, Human adenovirus D
gcagccgugaucccacagggcac

SEQ ID NO: 3924888 - RNA, 15 nt, Human adenovirus D
gcagccugagcuugg

SEQ ID NO: 3924889 - RNA, 19 nt, Human adenovirus D
gcagccugagcuuggccga

SEQ ID NO: 3924890 - RNA, 20 nt, Human adenovirus D
gcagcgacugacuacccacu

SEQ ID NO: 3924891 - RNA, 22 nt, Human adenovirus D
gcagcgacugacuacccacuga

SEQ ID NO: 3924892 - RNA, 13 nt, Human adenovirus D
gcagcgcacucuc

SEQ ID NO: 3924893 - RNA, 14 nt, Human adenovirus D
gcagcgccccgagg

SEQ ID NO: 3924894 - RNA, 15 nt, Human adenovirus D
gcagcgccccgagga

SEQ ID NO: 3924895 - RNA, 13 nt, Human adenovirus D
gcagcggggccug

SEQ ID NO: 3924896 - RNA, 15 nt, Human adenovirus D
gcagcggggccuggu

SEQ ID NO: 3924897 - RNA, 13 nt, Human adenovirus D
gcagcucuucccg

SEQ ID NO: 3924898 - RNA, 17 nt, Human adenovirus D
gcagcuguuccuggugg

SEQ ID NO: 3924899 - RNA, 15 nt, Human adenovirus D
gcaggcagcggccug

SEQ ID NO: 3924900 - RNA, 13 nt, Human adenovirus D
gcaggccaacaga

SEQ ID NO: 3924901 - RNA, 15 nt, Human adenovirus D
gcaggcgacccugga

SEQ ID NO: 3924902 - RNA, 17 nt, Human adenovirus D
gcaggcgacccuggagg

SEQ ID NO: 3924903 - RNA, 15 nt, Human adenovirus D
gcaggcgccggcgcu

SEQ ID NO: 3924904 - RNA, 15 nt, Human adenovirus D
gcaggcgcuggaaga

SEQ ID NO: 3924905 - RNA, 16 nt, Human adenovirus D
gcagggagccagggga

SEQ ID NO: 3924906 - RNA, 14 nt, Human adenovirus D
gcagggagcugcgc

SEQ ID NO: 3924907 - RNA, 16 nt, Human adenovirus D
gcagggagcugcgcga

SEQ ID NO: 3924908 - RNA, 22 nt, Human adenovirus D
gccuacuuuuugggcacccacg

SEQ ID NO: 3924909 - RNA, 19 nt, Human adenovirus D
gccucaaugucagcugcaa

SEQ ID NO: 3924910 - RNA, 16 nt, Human adenovirus D
gccuccaccacccacg

SEQ ID NO: 3924911 - RNA, 22 nt, Human adenovirus D
gccuccgcgguauauggcuccu

SEQ ID NO: 3924912 - RNA, 20 nt, Human adenovirus D
gccucgagcuacaugcccag

SEQ ID NO: 3924913 - RNA, 21 nt, Human adenovirus D
gccucggcggcguggcccuug

SEQ ID NO: 3924914 - RNA, 18 nt, Human adenovirus D
gccucugacggcgcagcu

SEQ ID NO: 3924915 - RNA, 14 nt, Human adenovirus D
gccugaugagcucg

SEQ ID NO: 3924916 - RNA, 15 nt, Human adenovirus D
gccuggccucgggca

SEQ ID NO: 3924917 - RNA, 18 nt, Human adenovirus D
gccugggaauccugcacg

SEQ ID NO: 3924918 - RNA, 17 nt, Human adenovirus D
gccugggcgugcagacc

SEQ ID NO: 3924919 - RNA, 14 nt, Human adenovirus D
gccuggucaaacag

SEQ ID NO: 3924920 - RNA, 12 nt, Human adenovirus D
gccuuaccuggu

SEQ ID NO: 3924921 - RNA, 16 nt, Human adenovirus D
gccuucgaaggggggc

SEQ ID NO: 3924922 - RNA, 19 nt, Human adenovirus D
gccuucgugcacuggcccg

SEQ ID NO: 3924923 - RNA, 21 nt, Human adenovirus D
gccuugauuuuuccagcccag

SEQ ID NO: 3924924 - RNA, 15 nt, Human adenovirus D
gccuuguaccugccc

SEQ ID NO: 3924925 - RNA, 19 nt, Human adenovirus D
gccuuguagggacagcagc

SEQ ID NO: 3924926 - RNA, 16 nt, Human adenovirus D
gccuuuaucagcacug

SEQ ID NO: 3924927 - RNA, 20 nt, Human adenovirus D
gcgaaccgagcacucgugcu

SEQ ID NO: 3924928 - RNA, 15 nt, Human adenovirus D
gcgaagauggccacc

SEQ ID NO: 3924929 - RNA, 20 nt, Human adenovirus D
gcgaagauggggccccgcca

SEQ ID NO: 3924930 - RNA, 22 nt, Human adenovirus D
gcgaagggcuggcgagacuggg

SEQ ID NO: 3924931 - RNA, 15 nt, Human adenovirus D
gcgacaacgccaggc

SEQ ID NO: 3924932 - RNA, 15 nt, Human adenovirus D
gcgaccaccgcgacc

SEQ ID NO: 3924933 - RNA, 23 nt, Human adenovirus D
gcgaccgcggccguagcaggcgc

SEQ ID NO: 3924934 - RNA, 18 nt, Human adenovirus D
gcgaccugggcugcgggc

SEQ ID NO: 3924935 - RNA, 14 nt, Human adenovirus D
gcgagaaggcgcgc

SEQ ID NO: 3924936 - RNA, 18 nt, Human adenovirus D
gcgagaccggaggcgugc

SEQ ID NO: 3924937 - RNA, 13 nt, Human adenovirus D
gcgagaugucugu

SEQ ID NO: 3924938 - RNA, 14 nt, Human adenovirus D
gcgaggacgcagcg

SEQ ID NO: 3924939 - RNA, 15 nt, Human adenovirus D
gcgaggagguggccc

SEQ ID NO: 3924940 - RNA, 21 nt, Human adenovirus D
gcgaggccauaggccaggcgc

SEQ ID NO: 3924941 - RNA, 20 nt, Human adenovirus D
gcgagugcgggggcagacac

SEQ ID NO: 3924942 - RNA, 17 nt, Human adenovirus D
gcgaucucggacaugaa

SEQ ID NO: 3924943 - RNA, 17 nt, Human adenovirus D
gcgauguugagcuggac

SEQ ID NO: 3924944 - RNA, 20 nt, Human adenovirus D
gcgcaaauuuguacccgagg

SEQ ID NO: 3924945 - RNA, 13 nt, Human adenovirus D
gcgcaacugggcc

SEQ ID NO: 3924946 - RNA, 20 nt, Human adenovirus D
gcgcagacggucucgcacuc

SEQ ID NO: 3924947 - RNA, 19 nt, Human adenovirus D
gcgcagcaguauccgcgga

SEQ ID NO: 3924948 - RNA, 16 nt, Human adenovirus D
gcgcagcggcaggaaa

SEQ ID NO: 3924949 - RNA, 16 nt, Human adenovirus D
gcgcaucuacaagaga

SEQ ID NO: 3924950 - RNA, 22 nt, Human adenovirus D
gcgcccaccaucaccaccguca

SEQ ID NO: 3924951 - RNA, 23 nt, Human adenovirus D
gcgcccagauugcaaguacauag

SEQ ID NO: 3924952 - RNA, 13 nt, Human adenovirus D
gcgcccaggccgc

SEQ ID NO: 3924953 - RNA, 20 nt, Human adenovirus D
gcgccccgaggacacccggc

SEQ ID NO: 3924954 - RNA, 13 nt, Human adenovirus D
gcgcccggggcca

SEQ ID NO: 3924955 - RNA, 14 nt, Human adenovirus D
gcgcccucagcagu

SEQ ID NO: 3924956 - RNA, 18 nt, Human adenovirus D
gcgcccugagagcgcugg

SEQ ID NO: 3924957 - RNA, 16 nt, Human adenovirus D
gcgcccuucaccgaca

SEQ ID NO: 3924958 - RNA, 15 nt, Human adenovirus D
gcgccgacgcgcucc

SEQ ID NO: 3924959 - RNA, 17 nt, Human adenovirus D
gcgccgcccgagcucug

SEQ ID NO: 3924960 - RNA, 20 nt, Human adenovirus D
gcgccucaaugucagcugca

SEQ ID NO: 3924961 - RNA, 17 nt, Human adenovirus D
gcgccugaggcagacgc

SEQ ID NO: 3924962 - RNA, 22 nt, Human adenovirus D
gcgcgagcagaacgggggcagc

SEQ ID NO: 3924963 - RNA, 17 nt, Human adenovirus D
gcgcgccgcgccgccac

SEQ ID NO: 3924964 - RNA, 20 nt, Human adenovirus D
gcgcgccgcgccgccacugc

SEQ ID NO: 3924965 - RNA, 15 nt, Human adenovirus D
gcgcgcucacucuua

SEQ ID NO: 3924966 - RNA, 14 nt, Human adenovirus D
gcgcgcuggggcag

SEQ ID NO: 3924967 - RNA, 15 nt, Human adenovirus D
gcgcgguaggcccug

SEQ ID NO: 3924968 - RNA, 17 nt, Human adenovirus D
gcgcgucccuugaggag

SEQ ID NO: 3924969 - RNA, 19 nt, Human adenovirus D
gcgcugggcguggugcugg

SEQ ID NO: 3924970 - RNA, 15 nt, Human adenovirus D
gcgcuugcaagggug

SEQ ID NO: 3924971 - RNA, 14 nt, Human adenovirus D
gcggagcuugcccu

SEQ ID NO: 3924972 - RNA, 23 nt, Human adenovirus D
gcggagcuugcccuuggaagagc

SEQ ID NO: 3924973 - RNA, 13 nt, Human adenovirus D
gcggaggagacga

SEQ ID NO: 3924974 - RNA, 17 nt, Human adenovirus D
gcggaguccagcgagug

SEQ ID NO: 3924975 - RNA, 23 nt, Human adenovirus D
gcggauaucuugaaaucgcaguu

SEQ ID NO: 3924976 - RNA, 20 nt, Human adenovirus D
gcggcagcuuuuugagcucc

SEQ ID NO: 3924977 - RNA, 14 nt, Human adenovirus D
gcggcccggcacgg

SEQ ID NO: 3924978 - RNA, 23 nt, Human adenovirus D
gcggccguccuuucgcugcugcc

SEQ ID NO: 3924979 - RNA, 18 nt, Human adenovirus D
gcggccuugcggagcgag

SEQ ID NO: 3924980 - RNA, 14 nt, Human adenovirus D
gcggcgcaggggca

SEQ ID NO: 3924981 - RNA, 18 nt, Human adenovirus D
gcggcggaugguggcgag

SEQ ID NO: 3924982 - RNA, 12 nt, Human adenovirus D
gcggcugcugca

SEQ ID NO: 3924983 - RNA, 23 nt, Human adenovirus D
gcggcuuuggcaaagacguuucu

SEQ ID NO: 3924984 - RNA, 20 nt, Human adenovirus D
gcgggaucaucgccugcuug

SEQ ID NO: 3924985 - RNA, 19 nt, Human adenovirus D
gcgggcagggagcugcgcg

SEQ ID NO: 3924986 - RNA, 14 nt, Human adenovirus D
gcgggcaggggcgg

SEQ ID NO: 3924987 - RNA, 18 nt, Human adenovirus D
gcgggcaugaccucggca

SEQ ID NO: 3924988 - RNA, 15 nt, Human adenovirus D
gcgggccucacaguc

SEQ ID NO: 3924989 - RNA, 22 nt, Human adenovirus D
gcggguccccguugggcagcga

SEQ ID NO: 3924990 - RNA, 22 nt, Human adenovirus D
gcgguacacgggguugcagcac

SEQ ID NO: 3924991 - RNA, 18 nt, Human adenovirus D
gcggucgcgguggggcgg

SEQ ID NO: 3924992 - RNA, 22 nt, Human adenovirus D
gcgguucaagaacgagggccug

SEQ ID NO: 3924993 - RNA, 15 nt, Human adenovirus D
gcgguugagcgggcu

SEQ ID NO: 3924994 - RNA, 15 nt, Human adenovirus D
gcgucccuggcuccg

SEQ ID NO: 3924995 - RNA, 20 nt, Human adenovirus D
gcguccgcaguacucgcagc

SEQ ID NO: 3924996 - RNA, 18 nt, Human adenovirus D
gcguccgcggccacuucc

SEQ ID NO: 3924997 - RNA, 16 nt, Human adenovirus D
gcgucgcugaaagcau

SEQ ID NO: 3924998 - RNA, 17 nt, Human adenovirus D
gcgugauggcgcaggcg

SEQ ID NO: 3924999 - RNA, 18 nt, Human adenovirus D
gcgugcccgugcgcaccc

SEQ ID NO: 3925000 - RNA, 14 nt, Human adenovirus D
gcguguggcagcag

SEQ ID NO: 3925001 - RNA, 21 nt, Human adenovirus D
gcguuccccuccgcugugcug

SEQ ID NO: 3925002 - RNA, 13 nt, Human adenovirus D
gcuaaagcucuuc

SEQ ID NO: 3925003 - RNA, 15 nt, Human adenovirus D
gcuaccucuugcagc

SEQ ID NO: 3925004 - RNA, 16 nt, Human adenovirus D
gcuaccuugcacccac

SEQ ID NO: 3925005 - RNA, 23 nt, Human adenovirus D
gcuaccuugcacccaccaugcgc

SEQ ID NO: 3925006 - RNA, 16 nt, Human adenovirus D
gcuagacaccacagug

SEQ ID NO: 3925007 - RNA, 22 nt, Human adenovirus D
gcuagagugaggcacugcucuu

SEQ ID NO: 3925008 - RNA, 17 nt, Human adenovirus D
gcuagagugccacugcc

SEQ ID NO: 3925009 - RNA, 17 nt, Human adenovirus D
gcuagcccuuccuggac

SEQ ID NO: 3925010 - RNA, 15 nt, Human adenovirus D
gcucaccaccccgga

SEQ ID NO: 3925011 - RNA, 12 nt, Human adenovirus D
gcucacccgcag

SEQ ID NO: 3925012 - RNA, 15 nt, Human adenovirus D
gcucaugcuggccgu

SEQ ID NO: 3925013 - RNA, 21 nt, Human adenovirus D
gcuccaaagcuagcacccaaa

SEQ ID NO: 3925014 - RNA, 17 nt, Human adenovirus D
gcuccaccgaaggcagc

SEQ ID NO: 3925015 - RNA, 20 nt, Human adenovirus D
gcuccacgguggcggcgagg

SEQ ID NO: 3925016 - RNA, 18 nt, Human adenovirus D
gcuccaugcuucugggca

SEQ ID NO: 3925017 - RNA, 22 nt, Human adenovirus D
gcucccacagugcccccuccac

SEQ ID NO: 3925018 - RNA, 16 nt, Human adenovirus D
gcucccaccgcgccgc

SEQ ID NO: 3925019 - RNA, 17 nt, Human adenovirus D
gcuccggguucuggaga

SEQ ID NO: 3925020 - RNA, 12 nt, Human adenovirus D
gcuccguggggc

SEQ ID NO: 3925021 - RNA, 21 nt, Human adenovirus D
gcuccguuguacgacaccacu

SEQ ID NO: 3925022 - RNA, 11 nt, Human adenovirus D
gcuccugagcg

SEQ ID NO: 3925023 - RNA, 17 nt, Human adenovirus D
gcuccugagcgagaccc

SEQ ID NO: 3925024 - RNA, 19 nt, Human adenovirus D
caaaguuuuucaggggcuu

SEQ ID NO: 3925025 - RNA, 22 nt, Human adenovirus D
caaauuggcggacauauggaau

SEQ ID NO: 3925026 - RNA, 19 nt, Human adenovirus D
caacaacucgggcuucacc

SEQ ID NO: 3925027 - RNA, 14 nt, Human adenovirus D
caacaauaaaagac

SEQ ID NO: 3925028 - RNA, 14 nt, Human adenovirus D
caacaccagacaca

SEQ ID NO: 3925029 - RNA, 15 nt, Human adenovirus D
caacaccgccuccac

SEQ ID NO: 3925030 - RNA, 16 nt, Human adenovirus D
caacaucaccauugaa

SEQ ID NO: 3925031 - RNA, 20 nt, Human adenovirus D
caacaucggcuaccagggcu

SEQ ID NO: 3925032 - RNA, 13 nt, Human adenovirus D
caacaugcugacu

SEQ ID NO: 3925033 - RNA, 15 nt, Human adenovirus D
caaccagagccagaa

SEQ ID NO: 3925034 - RNA, 23 nt, Human adenovirus D
caaccaugugcgcacccugaucg

SEQ ID NO: 3925035 - RNA, 18 nt, Human adenovirus D
caaccucaccaaccagac

SEQ ID NO: 3925036 - RNA, 15 nt, Human adenovirus D
caaccugugcucucc

SEQ ID NO: 3925037 - RNA, 18 nt, Human adenovirus D
caaccuugaaaccccaga

SEQ ID NO: 3925038 - RNA, 19 nt, Human adenovirus D
caacgauuucacccccgcc

SEQ ID NO: 3925039 - RNA, 20 nt, Human adenovirus D
caacgcaucauggcccugac

SEQ ID NO: 3925040 - RNA, 14 nt, Human adenovirus D
caacgccaggcugg

SEQ ID NO: 3925041 - RNA, 18 nt, Human adenovirus D
caacgugcccaucuccau

SEQ ID NO: 3925042 - RNA, 18 nt, Human adenovirus D
caacucuuaaaucauuua

SEQ ID NO: 3925043 - RNA, 17 nt, Human adenovirus D
caacucuuccgccgccg

SEQ ID NO: 3925044 - RNA, 18 nt, Human adenovirus D
caacuggucuccugccug

SEQ ID NO: 3925045 - RNA, 12 nt, Human adenovirus D
caacuuccagcc

SEQ ID NO: 3925046 - RNA, 21 nt, Human adenovirus D
caacuuuaucagcgcgcugcg

SEQ ID NO: 3925047 - RNA, 15 nt, Human adenovirus D
caagaacgagggccu

SEQ ID NO: 3925048 - RNA, 19 nt, Human adenovirus D
caagaccuaccaaugaaaa

SEQ ID NO: 3925049 - RNA, 16 nt, Human adenovirus D
caagagccggcgggcg

SEQ ID NO: 3925050 - RNA, 23 nt, Human adenovirus D
caagagcgagaugucugugaagc

SEQ ID NO: 3925051 - RNA, 23 nt, Human adenovirus D
caagaggcgacccaugauggugc

SEQ ID NO: 3925052 - RNA, 20 nt, Human adenovirus D
caagaucaggggauguaagu

SEQ ID NO: 3925053 - RNA, 15 nt, Human adenovirus D
caagcagguggcgcc

SEQ ID NO: 3925054 - RNA, 23 nt, Human adenovirus D
caagcagguggcgccgggccugg

SEQ ID NO: 3925055 - RNA, 20 nt, Human adenovirus D
caagccucugacggcgcagc

SEQ ID NO: 3925056 - RNA, 12 nt, Human adenovirus D
caagcgcccaga

SEQ ID NO: 3925057 - RNA, 13 nt, Human adenovirus D
caagcgcccagag

SEQ ID NO: 3925058 - RNA, 22 nt, Human adenovirus D
caagcgcgggcggacugccacc

SEQ ID NO: 3925059 - RNA, 17 nt, Human adenovirus D
caagcuggugaugccag

SEQ ID NO: 3925060 - RNA, 21 nt, Human adenovirus D
caaggcgcgcuucacucuggc

SEQ ID NO: 3925061 - RNA, 20 nt, Human adenovirus D
caagggcgcucccaauccca

SEQ ID NO: 3925062 - RNA, 11 nt, Human adenovirus D
caagucaaaag

SEQ ID NO: 3925063 - RNA, 12 nt, Human adenovirus D
caagucaaaaga

SEQ ID NO: 3925064 - RNA, 20 nt, Human adenovirus D
caagucaaaagaaaacuaau

SEQ ID NO: 3925065 - RNA, 12 nt, Human adenovirus D
caagugcacaga

SEQ ID NO: 3925066 - RNA, 21 nt, Human adenovirus D
caagugccacaugcaccuggg

SEQ ID NO: 3925067 - RNA, 22 nt, Human adenovirus D
caauaagguucugcccuccgcc

SEQ ID NO: 3925068 - RNA, 14 nt, Human adenovirus D
caauaccgggauga

SEQ ID NO: 3925069 - RNA, 12 nt, Human adenovirus D
caauacucuggg

SEQ ID NO: 3925070 - RNA, 13 nt, Human adenovirus D
caauagacagcag

SEQ ID NO: 3925071 - RNA, 17 nt, Human adenovirus D
caaucucccaccaccag

SEQ ID NO: 3925072 - RNA, 19 nt, Human adenovirus D
caaucuggcgguaccaggg

SEQ ID NO: 3925073 - RNA, 14 nt, Human adenovirus D
caauguaacuaaac

SEQ ID NO: 3925074 - RNA, 14 nt, Human adenovirus D
caaugucagcugca

SEQ ID NO: 3925075 - RNA, 20 nt, Human adenovirus D
cacaaaaaugaagcccugcu

SEQ ID NO: 3925076 - RNA, 23 nt, Human adenovirus D
cacaaguacugcgcgcucacucu

SEQ ID NO: 3925077 - RNA, 13 nt, Human adenovirus D
cacaccugugaca

SEQ ID NO: 3925078 - RNA, 13 nt, Human adenovirus D
cacacgcccuggg

SEQ ID NO: 3925079 - RNA, 19 nt, Human adenovirus D
cacagagagccgccugagc

SEQ ID NO: 3925080 - RNA, 16 nt, Human adenovirus D
cacagcaguccaugcc

SEQ ID NO: 3925081 - RNA, 18 nt, Human adenovirus D
cacagcuagacaccacag

SEQ ID NO: 3925082 - RNA, 19 nt, Human adenovirus D
cacagcuagacaccacagu

SEQ ID NO: 3925083 - RNA, 14 nt, Human adenovirus D
cacaggaggcacag

SEQ ID NO: 3925084 - RNA, 17 nt, Human adenovirus D
cacaggugcugcccacc

SEQ ID NO: 3925085 - RNA, 19 nt, Human adenovirus D
cacagugcccccuccacuu

SEQ ID NO: 3925086 - RNA, 19 nt, Human adenovirus D
cacaguuggcgacccagga

SEQ ID NO: 3925087 - RNA, 15 nt, Human adenovirus D
cacaucgaggcccuc

SEQ ID NO: 3925088 - RNA, 13 nt, Human adenovirus D
cacaucgccgggc

SEQ ID NO: 3925089 - RNA, 19 nt, Human adenovirus D
caccaacgugcccaucucc

SEQ ID NO: 3925090 - RNA, 21 nt, Human adenovirus D
caccaacuuuaucagcgcgcu

SEQ ID NO: 3925091 - RNA, 13 nt, Human adenovirus D
caccacugcaugg

SEQ ID NO: 3925092 - RNA, 13 nt, Human adenovirus D
caccagccgcacc

SEQ ID NO: 3925093 - RNA, 20 nt, Human adenovirus D
caccagccgcaccgcggcgu

SEQ ID NO: 3925094 - RNA, 14 nt, Human adenovirus D
caccaggaugcagc

SEQ ID NO: 3925095 - RNA, 17 nt, Human adenovirus D
caccaggggguccaccu

SEQ ID NO: 3925096 - RNA, 16 nt, Human adenovirus D
caccaucaccaccguc

SEQ ID NO: 3925097 - RNA, 18 nt, Human adenovirus D
caccaugcgccaagggca

SEQ ID NO: 3925098 - RNA, 23 nt, Human adenovirus D
caccauguuauucagcagcccau

SEQ ID NO: 3925099 - RNA, 17 nt, Human adenovirus D
cacccagaccgugcagg

SEQ ID NO: 3925100 - RNA, 22 nt, Human adenovirus D
cacccccucgaugaugccgcag

SEQ ID NO: 3925101 - RNA, 21 nt, Human adenovirus D
cacccgguacuacgccagccg

SEQ ID NO: 3925102 - RNA, 15 nt, Human adenovirus D
cacccuggaagccau

SEQ ID NO: 3925103 - RNA, 11 nt, Human adenovirus D
cacccuggugu

SEQ ID NO: 3925104 - RNA, 13 nt, Human adenovirus D
caccgaaggcagc

SEQ ID NO: 3925105 - RNA, 14 nt, Human adenovirus D
caccgacacguacu

SEQ ID NO: 3925106 - RNA, 20 nt, Human adenovirus D
caccgacagucugagggcca

SEQ ID NO: 3925107 - RNA, 12 nt, Human adenovirus D
caccgaccuggg

SEQ ID NO: 3925108 - RNA, 16 nt, Human adenovirus D
caccgcauccugaucu

SEQ ID NO: 3925109 - RNA, 17 nt, Human adenovirus D
caccgccacccgccgcc

SEQ ID NO: 3925110 - RNA, 20 nt, Human adenovirus D
caccgccgcagccgcggcag

SEQ ID NO: 3925111 - RNA, 13 nt, Human adenovirus D
caccgccuccacc

SEQ ID NO: 3925112 - RNA, 16 nt, Human adenovirus D
caccgccuccacccug

SEQ ID NO: 3925113 - RNA, 18 nt, Human adenovirus D
caccgccuccacccugga

SEQ ID NO: 3925114 - RNA, 13 nt, Human adenovirus D
caccggcuggggu

SEQ ID NO: 3925115 - RNA, 19 nt, Human adenovirus D
caccgugcgcuaccacccc

SEQ ID NO: 3925116 - RNA, 23 nt, Human adenovirus D
caccgugcgcuaccaccccagca

SEQ ID NO: 3925117 - RNA, 13 nt, Human adenovirus D
caccucggugcag

SEQ ID NO: 3925118 - RNA, 18 nt, Human adenovirus D
caccugcggcgcggagca

SEQ ID NO: 3925119 - RNA, 17 nt, Human adenovirus D
caccugcgucugcagca

SEQ ID NO: 3925120 - RNA, 15 nt, Human adenovirus D
caccuggaggcacca

SEQ ID NO: 3925121 - RNA, 18 nt, Human adenovirus D
caccugggcacuggagca

SEQ ID NO: 3925122 - RNA, 17 nt, Human adenovirus D
caccuggugauggccug

SEQ ID NO: 3925123 - RNA, 14 nt, Human adenovirus D
caccugucccuacg

SEQ ID NO: 3925124 - RNA, 14 nt, Human adenovirus D
caccuguggagggc

SEQ ID NO: 3925125 - RNA, 23 nt, Human adenovirus D
caccuuccguucuacccagcaag

SEQ ID NO: 3925126 - RNA, 15 nt, Human adenovirus D
caccuuccugcagcu

SEQ ID NO: 3925127 - RNA, 18 nt, Human adenovirus D
cacgagaaccgccugggg

SEQ ID NO: 3925128 - RNA, 22 nt, Human adenovirus D
cacgauguaacaucaccacagg

SEQ ID NO: 3925129 - RNA, 13 nt, Human adenovirus D
cacgccaccgcuu

SEQ ID NO: 3925130 - RNA, 12 nt, Human adenovirus D
cacgcccgcucc

SEQ ID NO: 3925131 - RNA, 22 nt, Human adenovirus D
cacgccggcuuguagaggauag

SEQ ID NO: 3925132 - RNA, 16 nt, Human adenovirus D
cacgcgcacacuuugg

SEQ ID NO: 3925133 - RNA, 21 nt, Human adenovirus D
cacgcugguggccaccucgcc

SEQ ID NO: 3925134 - RNA, 18 nt, Human adenovirus D
cacgguaagagcccagca

SEQ ID NO: 3925135 - RNA, 15 nt, Human adenovirus D
cacgguggugcagaa

SEQ ID NO: 3925136 - RNA, 19 nt, Human adenovirus D
cacguacuucagccugggc

SEQ ID NO: 3925137 - RNA, 21 nt, Human adenovirus D
cacgucugacugccgccggcc

SEQ ID NO: 3925138 - RNA, 12 nt, Human adenovirus D
cacgugaccagg

SEQ ID NO: 3925139 - RNA, 23 nt, Human adenovirus D
cacgugaccagggguccccgacg

SEQ ID NO: 3925140 - RNA, 18 nt, Human adenovirus D
cacguuucgucaggcagg

SEQ ID NO: 3925141 - RNA, 15 nt, Human adenovirus D
cacuacagccggggu

SEQ ID NO: 3925142 - RNA, 12 nt, Human adenovirus D
cacuccccccuu

SEQ ID NO: 3925143 - RNA, 16 nt, Human adenovirus D
aguucacuagccucca

SEQ ID NO: 3925144 - RNA, 20 nt, Human adenovirus D
aguucaggagcgcagccuga

SEQ ID NO: 3925145 - RNA, 17 nt, Human adenovirus D
aguugagggugguggcg

SEQ ID NO: 3925146 - RNA, 17 nt, Human adenovirus D
aguugcagaccgcgggc

SEQ ID NO: 3925147 - RNA, 15 nt, Human adenovirus D
aguugcgcaggcgcu

SEQ ID NO: 3925148 - RNA, 18 nt, Human adenovirus D
aguuuaauaaaagcuaaa

SEQ ID NO: 3925149 - RNA, 22 nt, Human adenovirus D
aguuucaacaaccaugugcgca

SEQ ID NO: 3925150 - RNA, 19 nt, Human adenovirus D
aguuuccugacgagccaaa

SEQ ID NO: 3925151 - RNA, 14 nt, Human adenovirus D
aguuuggccuggau

SEQ ID NO: 3925152 - RNA, 15 nt, Human adenovirus D
auaaauuuugacgag

SEQ ID NO: 3925153 - RNA, 15 nt, Human adenovirus D
auaagucacuaggac

SEQ ID NO: 3925154 - RNA, 13 nt, Human adenovirus D
auaaucaggcaga

SEQ ID NO: 3925155 - RNA, 22 nt, Human adenovirus D
auaauucagggugcuccagcca

SEQ ID NO: 3925156 - RNA, 19 nt, Human adenovirus D
auacagaugguagcagcag

SEQ ID NO: 3925157 - RNA, 16 nt, Human adenovirus D
auaccauugcaaggca

SEQ ID NO: 3925158 - RNA, 12 nt, Human adenovirus D
auaucagccagu

SEQ ID NO: 3925159 - RNA, 21 nt, Human adenovirus D
auauccaguaggaaccagcac

SEQ ID NO: 3925160 - RNA, 17 nt, Human adenovirus D
auauuccagaucacaug

SEQ ID NO: 3925161 - RNA, 15 nt, Human adenovirus D
aucaacauaggcgcc

SEQ ID NO: 3925162 - RNA, 20 nt, Human adenovirus D
aucaagugccacaugcaccu

SEQ ID NO: 3925163 - RNA, 22 nt, Human adenovirus D
aucaagugccacaugcaccugg

SEQ ID NO: 3925164 - RNA, 16 nt, Human adenovirus D
aucacaucagccagga

SEQ ID NO: 3925165 - RNA, 18 nt, Human adenovirus D
aucacaucggacuggguu

SEQ ID NO: 3925166 - RNA, 21 nt, Human adenovirus D
aucaccauguuauucagcagc

SEQ ID NO: 3925167 - RNA, 22 nt, Human adenovirus D
aucaccauguuauucagcagcc

SEQ ID NO: 3925168 - RNA, 17 nt, Human adenovirus D
aucacccucagaagaag

SEQ ID NO: 3925169 - RNA, 21 nt, Human adenovirus D
aucacucuuuccagcagcagg

SEQ ID NO: 3925170 - RNA, 13 nt, Human adenovirus D
aucagacaugcug

SEQ ID NO: 3925171 - RNA, 15 nt, Human adenovirus D
aucaugguguggaag

SEQ ID NO: 3925172 - RNA, 15 nt, Human adenovirus D
aucccacgccgagcc

SEQ ID NO: 3925173 - RNA, 14 nt, Human adenovirus D
aucccaugcccucg

SEQ ID NO: 3925174 - RNA, 17 nt, Human adenovirus D
auccccuucuccagcaa

SEQ ID NO: 3925175 - RNA, 19 nt, Human adenovirus D
aucccggccaaggccacca

SEQ ID NO: 3925176 - RNA, 21 nt, Human adenovirus D
auccuccgggacgcccuggcc

SEQ ID NO: 3925177 - RNA, 22 nt, Human adenovirus D
auccuccgggacgcccuggccg

SEQ ID NO: 3925178 - RNA, 18 nt, Human adenovirus D
auccuugcagacuuuagc

SEQ ID NO: 3925179 - RNA, 16 nt, Human adenovirus D
auccuuucccuggugg

SEQ ID NO: 3925180 - RNA, 18 nt, Human adenovirus D
aucgaacacgccaccgcu

SEQ ID NO: 3925181 - RNA, 17 nt, Human adenovirus D
aucgagcaggaccuggg

SEQ ID NO: 3925182 - RNA, 15 nt, Human adenovirus D
aucgauggugaagau

SEQ ID NO: 3925183 - RNA, 11 nt, Human adenovirus D
aucgccaggcc

SEQ ID NO: 3925184 - RNA, 14 nt, Human adenovirus D
aucgccgagcccga

SEQ ID NO: 3925185 - RNA, 18 nt, Human adenovirus D
aucuccaacguggagcug

SEQ ID NO: 3925186 - RNA, 15 nt, Human adenovirus D
aucucgauccagcag

SEQ ID NO: 3925187 - RNA, 16 nt, Human adenovirus D
aucucgcugccgcugg

SEQ ID NO: 3925188 - RNA, 23 nt, Human adenovirus D
aucugcccugauauccaguagga

SEQ ID NO: 3925189 - RNA, 14 nt, Human adenovirus D
aucuugcccacguc

SEQ ID NO: 3925190 - RNA, 17 nt, Human adenovirus D
aucuuugacauggaugu

SEQ ID NO: 3925191 - RNA, 12 nt, Human adenovirus D
augaacugcucg

SEQ ID NO: 3925192 - RNA, 15 nt, Human adenovirus D
augaaggcuuucaca

SEQ ID NO: 3925193 - RNA, 21 nt, Human adenovirus D
augaaggggacgagcugcuug

SEQ ID NO: 3925194 - RNA, 18 nt, Human adenovirus D
augaaguucaauggagag

SEQ ID NO: 3925195 - RNA, 19 nt, Human adenovirus D
augaccauagaccugauga

SEQ ID NO: 3925196 - RNA, 21 nt, Human adenovirus D
augaccccgaugacggguugc

SEQ ID NO: 3925197 - RNA, 22 nt, Human adenovirus D
augaccuucgagguggacccca

SEQ ID NO: 3925198 - RNA, 18 nt, Human adenovirus D
augacggguugcaggugg

SEQ ID NO: 3925199 - RNA, 15 nt, Human adenovirus D
augagagucugaaaa

SEQ ID NO: 3925200 - RNA, 21 nt, Human adenovirus D
augagcagcuugcgcgcuggc

SEQ ID NO: 3925201 - RNA, 18 nt, Human adenovirus D
augaggauugggaggagg

SEQ ID NO: 3925202 - RNA, 13 nt, Human adenovirus D
augaggcaggcca

SEQ ID NO: 3925203 - RNA, 16 nt, Human adenovirus D
augaugaccgagcuga

SEQ ID NO: 3925204 - RNA, 15 nt, Human adenovirus D
augaugauuuaaaaa

SEQ ID NO: 3925205 - RNA, 13 nt, Human adenovirus D
augcaccugggcg

SEQ ID NO: 3925206 - RNA, 20 nt, Human adenovirus D
augcagggugaccaggucca

SEQ ID NO: 3925207 - RNA, 22 nt, Human adenovirus D
augcccagcagcagcaguagcc

SEQ ID NO: 3925208 - RNA, 16 nt, Human adenovirus D
augccccaggccuggc

SEQ ID NO: 3925209 - RNA, 19 nt, Human adenovirus D
augcccuuccgcgccaaga

SEQ ID NO: 3925210 - RNA, 18 nt, Human adenovirus D
augcccuuuucccaggac

SEQ ID NO: 3925211 - RNA, 15 nt, Human adenovirus D
augcgacccaugagc

SEQ ID NO: 3925212 - RNA, 21 nt, Human adenovirus D
augcgucccacccccccggcg

SEQ ID NO: 3925213 - RNA, 14 nt, Human adenovirus D
augcuaccugggag

SEQ ID NO: 3925214 - RNA, 23 nt, Human adenovirus D
augcuccaggucgucgccccgga

SEQ ID NO: 3925215 - RNA, 20 nt, Human adenovirus D
augcugagccugcgccgggc

SEQ ID NO: 3925216 - RNA, 13 nt, Human adenovirus D
augcugaucaagu

SEQ ID NO: 3925217 - RNA, 21 nt, Human adenovirus D
augcugcccgccaccugcaac

SEQ ID NO: 3925218 - RNA, 22 nt, Human adenovirus D
auggacgagaacccgaggagcg

SEQ ID NO: 3925219 - RNA, 19 nt, Human adenovirus D
auggagcuuaucuugguua

SEQ ID NO: 3925220 - RNA, 16 nt, Human adenovirus D
auggcuuguggccccc

SEQ ID NO: 3925221 - RNA, 15 nt, Human adenovirus D
augggaacaaggccu

SEQ ID NO: 3925222 - RNA, 18 nt, Human adenovirus D
augggaacaaggccugga

SEQ ID NO: 3925223 - RNA, 15 nt, Human adenovirus D
augggaacauauauc

SEQ ID NO: 3925224 - RNA, 15 nt, Human adenovirus D
augggacagccagca

SEQ ID NO: 3925225 - RNA, 23 nt, Human adenovirus D
augggcgccuucaccgaccuggg

SEQ ID NO: 3925226 - RNA, 17 nt, Human adenovirus D
augggggcggaccugca

SEQ ID NO: 3925227 - RNA, 15 nt, Human adenovirus D
augguacuaaugaca

SEQ ID NO: 3925228 - RNA, 19 nt, Human adenovirus D
auggugcccaagcgccggc

SEQ ID NO: 3925229 - RNA, 22 nt, Human adenovirus D
auguaaguuuuauggcugcugg

SEQ ID NO: 3925230 - RNA, 13 nt, Human adenovirus D
auguguggacuau

SEQ ID NO: 3925231 - RNA, 18 nt, Human adenovirus D
auguuauucagcagccca

SEQ ID NO: 3925232 - RNA, 17 nt, Human adenovirus D
auuaaaaagcagcacag

SEQ ID NO: 3925233 - RNA, 16 nt, Human adenovirus D
auuacuauuacugcca

SEQ ID NO: 3925234 - RNA, 16 nt, Human adenovirus D
auuacucgcaaaaaua

SEQ ID NO: 3925235 - RNA, 14 nt, Human adenovirus D
auuaugacauagau

SEQ ID NO: 3925236 - RNA, 16 nt, Human adenovirus D
auuccucgaccaugac

SEQ ID NO: 3925237 - RNA, 20 nt, Human adenovirus D
auucucauuuuuccagccuu

SEQ ID NO: 3925238 - RNA, 23 nt, Human adenovirus D
auucuggacuucgcagccaugca

SEQ ID NO: 3925239 - RNA, 17 nt, Human adenovirus D
auugagagugcggugga

SEQ ID NO: 3925240 - RNA, 20 nt, Human adenovirus D
auugcaggauugauaaggag

SEQ ID NO: 3925241 - RNA, 16 nt, Human adenovirus D
auugcccaacaauaaa

SEQ ID NO: 3925242 - RNA, 19 nt, Human adenovirus D
auugcccaacaauaaaaga

SEQ ID NO: 3925243 - RNA, 15 nt, Human adenovirus D
auugcucuggccugc

SEQ ID NO: 3925244 - RNA, 12 nt, Human adenovirus D
auugcuucccau

SEQ ID NO: 3925245 - RNA, 21 nt, Human adenovirus D
auuguugggaggaaccaugaa

SEQ ID NO: 3925246 - RNA, 17 nt, Human adenovirus D
auuuaauaaagaucacu

SEQ ID NO: 3925247 - RNA, 23 nt, Human adenovirus D
auuugacacagcaguccaugccc

SEQ ID NO: 3925248 - RNA, 14 nt, Human adenovirus D
caaaaauuaucuuu

SEQ ID NO: 3925249 - RNA, 18 nt, Human adenovirus D
caaaaccuaccacuggcu

SEQ ID NO: 3925250 - RNA, 15 nt, Human adenovirus D
caaaacucacuuugg

SEQ ID NO: 3925251 - RNA, 16 nt, Human adenovirus D
caaaacucacuuuggu

SEQ ID NO: 3925252 - RNA, 17 nt, Human adenovirus D
caaaacuuaacucugau

SEQ ID NO: 3925253 - RNA, 18 nt, Human adenovirus D
caaaagauacagaguaaa

SEQ ID NO: 3925254 - RNA, 17 nt, Human adenovirus D
caaaagugcuggagggu

SEQ ID NO: 3925255 - RNA, 19 nt, Human adenovirus D
caaaauggcgugcuggaga

SEQ ID NO: 3925256 - RNA, 12 nt, Human adenovirus D
caaacaaaagcc

SEQ ID NO: 3925257 - RNA, 19 nt, Human adenovirus D
caaacacaccugacacaaa

SEQ ID NO: 3925258 - RNA, 12 nt, Human adenovirus D
caaagagcacag

SEQ ID NO: 3925259 - RNA, 14 nt, Human adenovirus D
caaagagcacagca

SEQ ID NO: 3925260 - RNA, 21 nt, Human adenovirus D
caaaggagccauagagggcgu

SEQ ID NO: 3925261 - RNA, 23 nt, Human adenovirus D
caaaggucuaaaaaccccgccaa

SEQ ID NO: 3925262 - RNA, 16 nt, Human adenovirus D
acaggcacacugacau

SEQ ID NO: 3925263 - RNA, 20 nt, Human adenovirus D
acaggccgcagcucuucccg

SEQ ID NO: 3925264 - RNA, 12 nt, Human adenovirus D
acaguacuggca

SEQ ID NO: 3925265 - RNA, 16 nt, Human adenovirus D
acagugcccccuccac

SEQ ID NO: 3925266 - RNA, 17 nt, Human adenovirus D
acagugcccccuccacu

SEQ ID NO: 3925267 - RNA, 17 nt, Human adenovirus D
acaguuggcgacccagg

SEQ ID NO: 3925268 - RNA, 20 nt, Human adenovirus D
acaucaauuuugcgucccug

SEQ ID NO: 3925269 - RNA, 18 nt, Human adenovirus D
acaucacauucaaaaacc

SEQ ID NO: 3925270 - RNA, 13 nt, Human adenovirus D
acaucagccagga

SEQ ID NO: 3925271 - RNA, 21 nt, Human adenovirus D
acaucauaauuaugcuccugg

SEQ ID NO: 3925272 - RNA, 14 nt, Human adenovirus D
acauccauggccag

SEQ ID NO: 3925273 - RNA, 18 nt, Human adenovirus D
acauccucuucugucucu

SEQ ID NO: 3925274 - RNA, 20 nt, Human adenovirus D
acaucgccgggcaggacgcc

SEQ ID NO: 3925275 - RNA, 15 nt, Human adenovirus D
acaucugugcugccu

SEQ ID NO: 3925276 - RNA, 14 nt, Human adenovirus D
acaugcccagcagc

SEQ ID NO: 3925277 - RNA, 17 nt, Human adenovirus D
acaugcgcauggcgcuc

SEQ ID NO: 3925278 - RNA, 23 nt, Human adenovirus D
acauggccagcacguacuuugac

SEQ ID NO: 3925279 - RNA, 13 nt, Human adenovirus D
acauguugaaaag

SEQ ID NO: 3925280 - RNA, 19 nt, Human adenovirus D
acauuaugauaaucugcau

SEQ ID NO: 3925281 - RNA, 16 nt, Human adenovirus D
accaaggaaacucccu

SEQ ID NO: 3925282 - RNA, 12 nt, Human adenovirus D
accacaccuuca

SEQ ID NO: 3925283 - RNA, 18 nt, Human adenovirus D
accacagcaacuuccuga

SEQ ID NO: 3925284 - RNA, 13 nt, Human adenovirus D
accaccagcccau

SEQ ID NO: 3925285 - RNA, 19 nt, Human adenovirus D
accacggaccggucccagc

SEQ ID NO: 3925286 - RNA, 15 nt, Human adenovirus D
accacucugagacaa

SEQ ID NO: 3925287 - RNA, 18 nt, Human adenovirus D
accacugcauggccucgu

SEQ ID NO: 3925288 - RNA, 15 nt, Human adenovirus D
accagaacuuccagc

SEQ ID NO: 3925289 - RNA, 16 nt, Human adenovirus D
accagaacuuccagca

SEQ ID NO: 3925290 - RNA, 13 nt, Human adenovirus D
accagaccaccug

SEQ ID NO: 3925291 - RNA, 18 nt, Human adenovirus D
accagacccaggcgcgga

SEQ ID NO: 3925292 - RNA, 12 nt, Human adenovirus D
cgugaaggccgg

SEQ ID NO: 3925293 - RNA, 18 nt, Human adenovirus D
cgugaccugcagcaggug

SEQ ID NO: 3925294 - RNA, 16 nt, Human adenovirus D
cgugaucccacagggc

SEQ ID NO: 3925295 - RNA, 21 nt, Human adenovirus D
cgugaucccacagggcacugc

SEQ ID NO: 3925296 - RNA, 16 nt, Human adenovirus D
cgugcagcugcagaag

SEQ ID NO: 3925297 - RNA, 21 nt, Human adenovirus D
cgugccccccaaacgccagcc

SEQ ID NO: 3925298 - RNA, 20 nt, Human adenovirus D
cgugcgcacccguccuccuc

SEQ ID NO: 3925299 - RNA, 16 nt, Human adenovirus D
cgugcgcgaccugggc

SEQ ID NO: 3925300 - RNA, 23 nt, Human adenovirus D
cgugcuccggcggauagcgcgcc

SEQ ID NO: 3925301 - RNA, 18 nt, Human adenovirus D
cgugcuugagaugcagau

SEQ ID NO: 3925302 - RNA, 13 nt, Human adenovirus D
cguggacgcugcu

SEQ ID NO: 3925303 - RNA, 13 nt, Human adenovirus D
cguggcgcagcgc

SEQ ID NO: 3925304 - RNA, 15 nt, Human adenovirus D
cguggcuucgagcag

SEQ ID NO: 3925305 - RNA, 21 nt, Human adenovirus D
cguggggcgcuuacaagcgcg

SEQ ID NO: 3925306 - RNA, 21 nt, Human adenovirus D
cguguccacgcauugcaugag

SEQ ID NO: 3925307 - RNA, 14 nt, Human adenovirus D
cguguucaaaacaa

SEQ ID NO: 3925308 - RNA, 21 nt, Human adenovirus D
cguuagccgugcgucgugacg

SEQ ID NO: 3925309 - RNA, 14 nt, Human adenovirus D
cguuaguccagcag

SEQ ID NO: 3925310 - RNA, 18 nt, Human adenovirus D
cguucagggaggcgcugc

SEQ ID NO: 3925311 - RNA, 12 nt, Human adenovirus D
cguucaugggca

SEQ ID NO: 3925312 - RNA, 14 nt, Human adenovirus D
cguucuacccagca

SEQ ID NO: 3925313 - RNA, 23 nt, Human adenovirus D
cuaaacuaagguggcuauuuuca

SEQ ID NO: 3925314 - RNA, 22 nt, Human adenovirus D
cuaacgcuguaccgcgaggcca

SEQ ID NO: 3925315 - RNA, 22 nt, Human adenovirus D
cuaagguggcuauuuucacuga

SEQ ID NO: 3925316 - RNA, 12 nt, Human adenovirus D
cuaaugacaaac

SEQ ID NO: 3925317 - RNA, 22 nt, Human adenovirus D
cuaaugacagaggcaacagcaa

SEQ ID NO: 3925318 - RNA, 22 nt, Human adenovirus D
cuaaugguccugcaagaggaga

SEQ ID NO: 3925319 - RNA, 14 nt, Human adenovirus D
cuacaacagcacaa

SEQ ID NO: 3925320 - RNA, 17 nt, Human adenovirus D
cuacaaggcccugggca

SEQ ID NO: 3925321 - RNA, 14 nt, Human adenovirus D
cuacaaggccguca

SEQ ID NO: 3925322 - RNA, 16 nt, Human adenovirus D
cuacaaucgccacagg

SEQ ID NO: 3925323 - RNA, 18 nt, Human adenovirus D
cuacacggucacugucca

SEQ ID NO: 3925324 - RNA, 15 nt, Human adenovirus D
cuacaugcccagcag

SEQ ID NO: 3925325 - RNA, 17 nt, Human adenovirus D
cuaccacgcccaugaga

SEQ ID NO: 3925326 - RNA, 16 nt, Human adenovirus D
cuaccucucggccgcc

SEQ ID NO: 3925327 - RNA, 20 nt, Human adenovirus D
cuaccugggaggagaggagg

SEQ ID NO: 3925328 - RNA, 23 nt, Human adenovirus D
cuacgccagccgcaggcgcccag

SEQ ID NO: 3925329 - RNA, 23 nt, Human adenovirus D
cuacucggugcuuagccugggca

SEQ ID NO: 3925330 - RNA, 17 nt, Human adenovirus D
cuacuugcaaguggggc

SEQ ID NO: 3925331 - RNA, 16 nt, Human adenovirus D
cuacuuuuugggcacc

SEQ ID NO: 3925332 - RNA, 15 nt, Human adenovirus D
cuagaaccccacagg

SEQ ID NO: 3925333 - RNA, 16 nt, Human adenovirus D
cuagcccuuccuggac

SEQ ID NO: 3925334 - RNA, 15 nt, Human adenovirus D
cuagcgcccugguag

SEQ ID NO: 3925335 - RNA, 23 nt, Human adenovirus D
cuaguguacaacgcccugcugga

SEQ ID NO: 3925336 - RNA, 16 nt, Human adenovirus D
cuaucauucagagggg

SEQ ID NO: 3925337 - RNA, 17 nt, Human adenovirus D
cuaucgcuuccucgcgc

SEQ ID NO: 3925338 - RNA, 17 nt, Human adenovirus D
cuaugggaacaaggccu

SEQ ID NO: 3925339 - RNA, 12 nt, Human adenovirus D
cuauuuucacug

SEQ ID NO: 3925340 - RNA, 14 nt, Human adenovirus D
cucaacagcuggga

SEQ ID NO: 3925341 - RNA, 17 nt, Human adenovirus D
cucaauaaacagcacuu

SEQ ID NO: 3925342 - RNA, 15 nt, Human adenovirus D
cucaccaaggccaua

SEQ ID NO: 3925343 - RNA, 17 nt, Human adenovirus D
cucaccaaggccauagc

SEQ ID NO: 3925344 - RNA, 20 nt, Human adenovirus D
cucaccaccccggacgucac

SEQ ID NO: 3925345 - RNA, 15 nt, Human adenovirus D
cucacuugccgccug

SEQ ID NO: 3925346 - RNA, 16 nt, Human adenovirus D
cucacuuuuaggugaa

SEQ ID NO: 3925347 - RNA, 13 nt, Human adenovirus D
cucagcagucucu

SEQ ID NO: 3925348 - RNA, 12 nt, Human adenovirus D
cucaggcgcaac

SEQ ID NO: 3925349 - RNA, 20 nt, Human adenovirus D
cucaggcgcaaccaggagga

SEQ ID NO: 3925350 - RNA, 18 nt, Human adenovirus D
cucagucacucucauuuc

SEQ ID NO: 3925351 - RNA, 19 nt, Human adenovirus D
cucaucacaucagccagga

SEQ ID NO: 3925352 - RNA, 14 nt, Human adenovirus D
cucaugcccuuccg

SEQ ID NO: 3925353 - RNA, 14 nt, Human adenovirus D
cuccaccacccacg

SEQ ID NO: 3925354 - RNA, 14 nt, Human adenovirus D
cuccaggccaaccu

SEQ ID NO: 3925355 - RNA, 18 nt, Human adenovirus D
cuccaguuuguggaggag

SEQ ID NO: 3925356 - RNA, 16 nt, Human adenovirus D
cuccauccccucgcgc

SEQ ID NO: 3925357 - RNA, 17 nt, Human adenovirus D
cucccacaaucacggca

SEQ ID NO: 3925358 - RNA, 13 nt, Human adenovirus D
cucccaccccaga

SEQ ID NO: 3925359 - RNA, 18 nt, Human adenovirus D
cuccccgacccccuucca

SEQ ID NO: 3925360 - RNA, 14 nt, Human adenovirus D
cucccucacccacg

SEQ ID NO: 3925361 - RNA, 19 nt, Human adenovirus D
cuccgcggcacggcacgcg

SEQ ID NO: 3925362 - RNA, 15 nt, Human adenovirus D
cuccgcggcggcgcg

SEQ ID NO: 3925363 - RNA, 22 nt, Human adenovirus D
cuccggaggcaucggaacccuc

SEQ ID NO: 3925364 - RNA, 18 nt, Human adenovirus D
cuccgggacgcccuggcc

SEQ ID NO: 3925365 - RNA, 15 nt, Human adenovirus D
cuccggguucuggag

SEQ ID NO: 3925366 - RNA, 12 nt, Human adenovirus D
cuccguagccug

SEQ ID NO: 3925367 - RNA, 13 nt, Human adenovirus D
cuccguccgcuuc

SEQ ID NO: 3925368 - RNA, 16 nt, Human adenovirus D
cuccuccuccuggaga

SEQ ID NO: 3925369 - RNA, 13 nt, Human adenovirus D
cuccuccuggaga

SEQ ID NO: 3925370 - RNA, 14 nt, Human adenovirus D
cuccuccuggagau

SEQ ID NO: 3925371 - RNA, 17 nt, Human adenovirus D
cuccucgcucuggggcc

SEQ ID NO: 3925372 - RNA, 15 nt, Human adenovirus D
cuccucguagagaaa

SEQ ID NO: 3925373 - RNA, 15 nt, Human adenovirus D
cuccucucgugcucc

SEQ ID NO: 3925374 - RNA, 22 nt, Human adenovirus D
cuccugaaccacacggccagca

SEQ ID NO: 3925375 - RNA, 19 nt, Human adenovirus D
cuccugccgcgccaaccgc

SEQ ID NO: 3925376 - RNA, 20 nt, Human adenovirus D
cuccuucaacgcgcgcugcc

SEQ ID NO: 3925377 - RNA, 20 nt, Human adenovirus D
cucgaagacgccgaggcucu

SEQ ID NO: 3925378 - RNA, 17 nt, Human adenovirus D
cucgaagauucuggaga

SEQ ID NO: 3925379 - RNA, 21 nt, Human adenovirus D
cucgagcgcccauuccuggag

SEQ ID NO: 3925380 - RNA, 22 nt, Human adenovirus D
cucgagcgcccauuccuggaga

SEQ ID NO: 3925381 - RNA, 22 nt, Human adenovirus D
cucgagcuacaugcccagcagc

SEQ ID NO: 3925382 - RNA, 17 nt, Human adenovirus D
cucgcagugcacgggca

SEQ ID NO: 3925383 - RNA, 13 nt, Human adenovirus D
cucgcccagcaau

SEQ ID NO: 3925384 - RNA, 19 nt, Human adenovirus D
cucgccgucuacucccagc

SEQ ID NO: 3925385 - RNA, 15 nt, Human adenovirus D
cucgcgcaacugggc

SEQ ID NO: 3925386 - RNA, 15 nt, Human adenovirus D
cucgcggcugcugcu

SEQ ID NO: 3925387 - RNA, 11 nt, Human adenovirus D
cucgcuccaca

SEQ ID NO: 3925388 - RNA, 20 nt, Human adenovirus D
cucgcugaaaaacaggccgc

SEQ ID NO: 3925389 - RNA, 12 nt, Human adenovirus D
cucgcugcugca

SEQ ID NO: 3925390 - RNA, 22 nt, Human adenovirus D
cucggaguaccugagcccgggu

SEQ ID NO: 3925391 - RNA, 15 nt, Human adenovirus D
cucggccaaucagca

SEQ ID NO: 3925392 - RNA, 16 nt, Human adenovirus D
cucggccauucuggag

SEQ ID NO: 3925393 - RNA, 14 nt, Human adenovirus D
cucggggcauugca

SEQ ID NO: 3925394 - RNA, 18 nt, Human adenovirus D
cucgguacccuccuccca

SEQ ID NO: 3925395 - RNA, 18 nt, Human adenovirus D
cucggugcggcugcugca

SEQ ID NO: 3925396 - RNA, 23 nt, Human adenovirus D
cucguacaaggcgcgcuucacuc

SEQ ID NO: 3925397 - RNA, 17 nt, Human adenovirus D
cucguacccgcucacca

SEQ ID NO: 3925398 - RNA, 18 nt, Human adenovirus D
cucgucgcuugacagcac

SEQ ID NO: 3925399 - RNA, 15 nt, Human adenovirus D
cucgucuuccaggag

SEQ ID NO: 3925400 - RNA, 23 nt, Human adenovirus D
cucuagcaugaccagacccaggc

SEQ ID NO: 3925401 - RNA, 23 nt, Human adenovirus D
ugagagucugaaaaacagaaagc

SEQ ID NO: 3925402 - RNA, 16 nt, Human adenovirus D
ugagauaugugcagca

SEQ ID NO: 3925403 - RNA, 23 nt, Human adenovirus D
ugagcgcauguacaacaugcuga

SEQ ID NO: 3925404 - RNA, 20 nt, Human adenovirus D
ugagcgcgagccggcggcgc

SEQ ID NO: 3925405 - RNA, 14 nt, Human adenovirus D
ugagcggcugcacg

SEQ ID NO: 3925406 - RNA, 19 nt, Human adenovirus D
ugagcgggcucuuccuccg

SEQ ID NO: 3925407 - RNA, 22 nt, Human adenovirus D
ugagcuugaaacgucccaggaa

SEQ ID NO: 3925408 - RNA, 22 nt, Human adenovirus D
ugaggaggagacugauggccac

SEQ ID NO: 3925409 - RNA, 21 nt, Human adenovirus D
ugaggaucauaucccagggga

SEQ ID NO: 3925410 - RNA, 17 nt, Human adenovirus D
ugaggauugggaggagg

SEQ ID NO: 3925411 - RNA, 12 nt, Human adenovirus D
ugaggcagacgc

SEQ ID NO: 3925412 - RNA, 21 nt, Human adenovirus D
ugaggcauauaaaaaugcagu

SEQ ID NO: 3925413 - RNA, 18 nt, Human adenovirus D
ugaggcggugguagccgu

SEQ ID NO: 3925414 - RNA, 17 nt, Human adenovirus D
ugagguuagugccaaua

SEQ ID NO: 3925415 - RNA, 16 nt, Human adenovirus D
ugauauccaguaggaa

SEQ ID NO: 3925416 - RNA, 13 nt, Human adenovirus D
ugauauugcuucc

SEQ ID NO: 3925417 - RNA, 14 nt, Human adenovirus D
ugaucaaaacuuaa

SEQ ID NO: 3925418 - RNA, 11 nt, Human adenovirus D
ugaugcccaac

SEQ ID NO: 3925419 - RNA, 16 nt, Human adenovirus D
ugauguccuugaggag

SEQ ID NO: 3925420 - RNA, 17 nt, Human adenovirus D
ugauuucuacgggugag

SEQ ID NO: 3925421 - RNA, 17 nt, Human adenovirus D
ugauuuuuacaccagcg

SEQ ID NO: 3925422 - RNA, 21 nt, Human adenovirus D
ugcaaacaauaaaaaacuuga

SEQ ID NO: 3925423 - RNA, 21 nt, Human adenovirus D
ugcaaacggugaaccugagcc

SEQ ID NO: 3925424 - RNA, 18 nt, Human adenovirus D
ugcaacaugaccaaggac

SEQ ID NO: 3925425 - RNA, 13 nt, Human adenovirus D
ugcaaccugugcu

SEQ ID NO: 3925426 - RNA, 13 nt, Human adenovirus D
ugcaaugucaggu

SEQ ID NO: 3925427 - RNA, 18 nt, Human adenovirus D
ugcacaucgccgggcagg

SEQ ID NO: 3925428 - RNA, 16 nt, Human adenovirus D
ugcaccauccccaggu

SEQ ID NO: 3925429 - RNA, 19 nt, Human adenovirus D
ugcaccuguggagggcaug

SEQ ID NO: 3925430 - RNA, 20 nt, Human adenovirus D
ugcaccuguggagggcaugg

SEQ ID NO: 3925431 - RNA, 13 nt, Human adenovirus D
ugcaccuguggga

SEQ ID NO: 3925432 - RNA, 14 nt, Human adenovirus D
ugcacgcgggugag

SEQ ID NO: 3925433 - RNA, 23 nt, Human adenovirus D
ugcagaacccggacagcaagccu

SEQ ID NO: 3925434 - RNA, 15 nt, Human adenovirus D
ugcagcacuggaaca

SEQ ID NO: 3925435 - RNA, 16 nt, Human adenovirus D
ugcagcaggugcugcc

SEQ ID NO: 3925436 - RNA, 13 nt, Human adenovirus D
ugcaggauccagc

SEQ ID NO: 3925437 - RNA, 18 nt, Human adenovirus D
ugcagggcgcccagcaug

SEQ ID NO: 3925438 - RNA, 16 nt, Human adenovirus D
ugcaguuuggccugga

SEQ ID NO: 3925439 - RNA, 11 nt, Human adenovirus D
ugccaauaaac

SEQ ID NO: 3925440 - RNA, 16 nt, Human adenovirus D
ugccacucgcgggcgg

SEQ ID NO: 3925441 - RNA, 17 nt, Human adenovirus D
ugccacugccaacauua

SEQ ID NO: 3925442 - RNA, 18 nt, Human adenovirus D
ugccagauugggggacga

SEQ ID NO: 3925443 - RNA, 17 nt, Human adenovirus D
ugccaggaugggccgga

SEQ ID NO: 3925444 - RNA, 19 nt, Human adenovirus D
ugccaucaugaucuacccc

SEQ ID NO: 3925445 - RNA, 16 nt, Human adenovirus D
ugccauguucucacag

SEQ ID NO: 3925446 - RNA, 18 nt, Human adenovirus D
ugccauuuugaacccgca

SEQ ID NO: 3925447 - RNA, 20 nt, Human adenovirus D
ugcccaaaaucuucgaaggg

SEQ ID NO: 3925448 - RNA, 19 nt, Human adenovirus D
ugcccaacggcaugcuaca

SEQ ID NO: 3925449 - RNA, 15 nt, Human adenovirus D
ugcccccaagggcgc

SEQ ID NO: 3925450 - RNA, 17 nt, Human adenovirus D
ugcccugcucaccugca

SEQ ID NO: 3925451 - RNA, 13 nt, Human adenovirus D
ugcccuuggaaga

SEQ ID NO: 3925452 - RNA, 17 nt, Human adenovirus D
ugcccuuuucccaggac

SEQ ID NO: 3925453 - RNA, 14 nt, Human adenovirus D
ugccgaagaagaac

SEQ ID NO: 3925454 - RNA, 21 nt, Human adenovirus D
ugccgagccgcgggaucaagc

SEQ ID NO: 3925455 - RNA, 14 nt, Human adenovirus D
ugccgcagugggcg

SEQ ID NO: 3925456 - RNA, 19 nt, Human adenovirus D
ugccgccaaggagcuccuc

SEQ ID NO: 3925457 - RNA, 15 nt, Human adenovirus D
ugccgcuggacgaga

SEQ ID NO: 3925458 - RNA, 16 nt, Human adenovirus D
ugccggaccucaugca

SEQ ID NO: 3925459 - RNA, 16 nt, Human adenovirus D
ugccuccaccacccac

SEQ ID NO: 3925460 - RNA, 14 nt, Human adenovirus D
ugccucuccaucag

SEQ ID NO: 3925461 - RNA, 15 nt, Human adenovirus D
ugccucuccaucagc

SEQ ID NO: 3925462 - RNA, 15 nt, Human adenovirus D
ugccuggugaagggc

SEQ ID NO: 3925463 - RNA, 17 nt, Human adenovirus D
ugccuuccaaaauguga

SEQ ID NO: 3925464 - RNA, 14 nt, Human adenovirus D
ugccuucuccaggg

SEQ ID NO: 3925465 - RNA, 18 nt, Human adenovirus D
ugcgcacccguccuccuc

SEQ ID NO: 3925466 - RNA, 15 nt, Human adenovirus D
ugcgcccgcgccgcg

SEQ ID NO: 3925467 - RNA, 23 nt, Human adenovirus D
ugcgccgcgcuggggagggccac

SEQ ID NO: 3925468 - RNA, 21 nt, Human adenovirus D
ugcgcgaagccguggcgcagc

SEQ ID NO: 3925469 - RNA, 15 nt, Human adenovirus D
ugcgcgaccugggcu

SEQ ID NO: 3925470 - RNA, 17 nt, Human adenovirus D
ugcgcgaccugggcugc

SEQ ID NO: 3925471 - RNA, 14 nt, Human adenovirus D
ugcgcgagggccug

SEQ ID NO: 3925472 - RNA, 17 nt, Human adenovirus D
ugcgcgagguugagcuc

SEQ ID NO: 3925473 - RNA, 21 nt, Human adenovirus D
ugcgcguaggagucuugcagc

SEQ ID NO: 3925474 - RNA, 22 nt, Human adenovirus D
ugcggacuuuucuguugcaugu

SEQ ID NO: 3925475 - RNA, 23 nt, Human adenovirus D
ugcggccguccuuucgcugcugc

SEQ ID NO: 3925476 - RNA, 15 nt, Human adenovirus D
ugcgucccuggcucc

SEQ ID NO: 3925477 - RNA, 15 nt, Human adenovirus D
ugcuacaucugcugc

SEQ ID NO: 3925478 - RNA, 18 nt, Human adenovirus D
ugcuauaaaucuuuucuc

SEQ ID NO: 3925479 - RNA, 22 nt, Human adenovirus D
ugcuauggcucauuugcaagac

SEQ ID NO: 3925480 - RNA, 15 nt, Human adenovirus D
ugcucaccaccccgg

SEQ ID NO: 3925481 - RNA, 21 nt, Human adenovirus D
ugcuccaaagcuagcacccaa

SEQ ID NO: 3925482 - RNA, 12 nt, Human adenovirus D
ugcuccagccaa

SEQ ID NO: 3925483 - RNA, 16 nt, Human adenovirus D
ugcuccagccaaagcu

SEQ ID NO: 3925484 - RNA, 14 nt, Human adenovirus D
ugcuccugggugag

SEQ ID NO: 3925485 - RNA, 19 nt, Human adenovirus D
ugcucgucagggggguccg

SEQ ID NO: 3925486 - RNA, 22 nt, Human adenovirus D
ugcucuccgcaccgcuccuggu

SEQ ID NO: 3925487 - RNA, 13 nt, Human adenovirus D
ugcugacugcgac

SEQ ID NO: 3925488 - RNA, 19 nt, Human adenovirus D
ugcugauugcucuggccug

SEQ ID NO: 3925489 - RNA, 23 nt, Human adenovirus D
ugcugccccaggcggugcugcug

SEQ ID NO: 3925490 - RNA, 13 nt, Human adenovirus D
ugcugcuccacca

SEQ ID NO: 3925491 - RNA, 14 nt, Human adenovirus D
ugcuggaugauguc

SEQ ID NO: 3925492 - RNA, 16 nt, Human adenovirus D
ugcuggaugcggagcc

SEQ ID NO: 3925493 - RNA, 14 nt, Human adenovirus D
uggaaacagacagc

SEQ ID NO: 3925494 - RNA, 20 nt, Human adenovirus D
uggaaagauucagggcaaaa

SEQ ID NO: 3925495 - RNA, 12 nt, Human adenovirus D
uggaagaagaau

SEQ ID NO: 3925496 - RNA, 18 nt, Human adenovirus D
uggaagaagagcagcaca

SEQ ID NO: 3925497 - RNA, 18 nt, Human adenovirus D
uggaagagauggaagaag

SEQ ID NO: 3925498 - RNA, 21 nt, Human adenovirus D
uggaagagggcgaagggcugg

SEQ ID NO: 3925499 - RNA, 16 nt, Human adenovirus D
uggaagaggggcagca

SEQ ID NO: 3925500 - RNA, 17 nt, Human adenovirus D
uggaagcccugagccgc

SEQ ID NO: 3925501 - RNA, 17 nt, Human adenovirus D
uggacaacgucaacccc

SEQ ID NO: 3925502 - RNA, 19 nt, Human adenovirus D
uggacaucgcgaaccaggc

SEQ ID NO: 3925503 - RNA, 18 nt, Human adenovirus D
uggacccgcggccgccca

SEQ ID NO: 3925504 - RNA, 16 nt, Human adenovirus D
uggaccgcggucccag

SEQ ID NO: 3925505 - RNA, 17 nt, Human adenovirus D
uggagaaguuccucugc

SEQ ID NO: 3925506 - RNA, 15 nt, Human adenovirus D
uggagaaugcugcua

SEQ ID NO: 3925507 - RNA, 20 nt, Human adenovirus D
uggagacgcccuugugcccg

SEQ ID NO: 3925508 - RNA, 23 nt, Human adenovirus D
uggagaucaaccuccaggccaac

SEQ ID NO: 3925509 - RNA, 23 nt, Human adenovirus D
uggagcacagaccuucagggagu

SEQ ID NO: 3925510 - RNA, 15 nt, Human adenovirus D
uggagccacugcuac

SEQ ID NO: 3925511 - RNA, 16 nt, Human adenovirus D
uggaggaagugcugga

SEQ ID NO: 3925512 - RNA, 12 nt, Human adenovirus D
uggaggagcagc

SEQ ID NO: 3925513 - RNA, 15 nt, Human adenovirus D
uggagguuuucccgg

SEQ ID NO: 3925514 - RNA, 14 nt, Human adenovirus D
uggaucgaaaucaa

SEQ ID NO: 3925515 - RNA, 20 nt, Human adenovirus D
uggauggaaaaauauuugug

SEQ ID NO: 3925516 - RNA, 17 nt, Human adenovirus D
uggauugcaauuuugug

SEQ ID NO: 3925517 - RNA, 13 nt, Human adenovirus D
uggcaccaauuca

SEQ ID NO: 3925518 - RNA, 16 nt, Human adenovirus D
uggcagccgagccggc

SEQ ID NO: 3925519 - RNA, 20 nt, Human adenovirus D
uggcagccgagccggcgcgc

SEQ ID NO: 3925520 - RNA, 13 nt, Human adenovirus D
auccagcggcgca

SEQ ID NO: 3925521 - RNA, 16 nt, Human adenovirus D
aucccacgccgagccu

SEQ ID NO: 3925522 - RNA, 14 nt, Human adenovirus D
auccgcgccgcagc

SEQ ID NO: 3925523 - RNA, 20 nt, Human adenovirus D
auccuccaggacuaucuaug

SEQ ID NO: 3925524 - RNA, 21 nt, Human adenovirus D
auccugacgcgccagccgcgg

SEQ ID NO: 3925525 - RNA, 14 nt, Human adenovirus D
auccugaucucugc

SEQ ID NO: 3925526 - RNA, 13 nt, Human adenovirus D
aucgaggugcaga

SEQ ID NO: 3925527 - RNA, 18 nt, Human adenovirus D
aucgccaggccucuaccc

SEQ ID NO: 3925528 - RNA, 12 nt, Human adenovirus D
aucgcccaggcg

SEQ ID NO: 3925529 - RNA, 18 nt, Human adenovirus D
aucgccgaggagaacugc

SEQ ID NO: 3925530 - RNA, 21 nt, Human adenovirus D
aucggaucuuccccacucuuu

SEQ ID NO: 3925531 - RNA, 21 nt, Human adenovirus D
aucgguccgugugauuaaaaa

SEQ ID NO: 3925532 - RNA, 17 nt, Human adenovirus D
aucgugaacgcgcuggc

SEQ ID NO: 3925533 - RNA, 16 nt, Human adenovirus D
aucuacaagagagaug

SEQ ID NO: 3925534 - RNA, 19 nt, Human adenovirus D
aucucccaccaccagccca

SEQ ID NO: 3925535 - RNA, 12 nt, Human adenovirus D
aucugaaaguau

SEQ ID NO: 3925536 - RNA, 15 nt, Human adenovirus D
aucuugcccacgucc

SEQ ID NO: 3925537 - RNA, 23 nt, Human adenovirus D
augaaaaagcugaggauggcaaa

SEQ ID NO: 3925538 - RNA, 18 nt, Human adenovirus D
augaaagcauacagagau

SEQ ID NO: 3925539 - RNA, 19 nt, Human adenovirus D
augaaagucaggagcagcg

SEQ ID NO: 3925540 - RNA, 11 nt, Human adenovirus D
augaacacacu

SEQ ID NO: 3925541 - RNA, 22 nt, Human adenovirus D
augaacacacugcccauauaca

SEQ ID NO: 3925542 - RNA, 13 nt, Human adenovirus D
augaacaggagca

SEQ ID NO: 3925543 - RNA, 14 nt, Human adenovirus D
augaacaggagcac

SEQ ID NO: 3925544 - RNA, 15 nt, Human adenovirus D
augaacaggagcacg

SEQ ID NO: 3925545 - RNA, 13 nt, Human adenovirus D
augaacaugaagu

SEQ ID NO: 3925546 - RNA, 17 nt, Human adenovirus D
augaaggcuuucacagc

SEQ ID NO: 3925547 - RNA, 19 nt, Human adenovirus D
augaaggcuuucacagcuu

SEQ ID NO: 3925548 - RNA, 19 nt, Human adenovirus D
augacagaggcaacagcaa

SEQ ID NO: 3925549 - RNA, 16 nt, Human adenovirus D
augaccauagaccuga

SEQ ID NO: 3925550 - RNA, 15 nt, Human adenovirus D
augacugaccaccac

SEQ ID NO: 3925551 - RNA, 18 nt, Human adenovirus D
augagaugccccagcaga

SEQ ID NO: 3925552 - RNA, 21 nt, Human adenovirus D
augagcucguaguugagggcc

SEQ ID NO: 3925553 - RNA, 13 nt, Human adenovirus D
augaggcgguggu

SEQ ID NO: 3925554 - RNA, 17 nt, Human adenovirus D
augauggaacccacgug

SEQ ID NO: 3925555 - RNA, 23 nt, Human adenovirus D
augcaccuguggagggcaugggu

SEQ ID NO: 3925556 - RNA, 22 nt, Human adenovirus D
augcagccaguggcccuggaug

SEQ ID NO: 3925557 - RNA, 23 nt, Human adenovirus D
augcaggauaaauauggccugga

SEQ ID NO: 3925558 - RNA, 19 nt, Human adenovirus D
augcaucccguccugcgcc

SEQ ID NO: 3925559 - RNA, 15 nt, Human adenovirus D
augccagacgcaaga

SEQ ID NO: 3925560 - RNA, 16 nt, Human adenovirus D
augccaucaacaucca

SEQ ID NO: 3925561 - RNA, 21 nt, Human adenovirus D
augccccacaucgaggcccuc

SEQ ID NO: 3925562 - RNA, 14 nt, Human adenovirus D
augccccagcagaa

SEQ ID NO: 3925563 - RNA, 12 nt, Human adenovirus D
augccccaggcc

SEQ ID NO: 3925564 - RNA, 22 nt, Human adenovirus D
augcccuccuauuacuugguga

SEQ ID NO: 3925565 - RNA, 12 nt, Human adenovirus D
augccgcagugg

SEQ ID NO: 3925566 - RNA, 21 nt, Human adenovirus D
augccggcagcggugguggag

SEQ ID NO: 3925567 - RNA, 17 nt, Human adenovirus D
augccuucuccagggug

SEQ ID NO: 3925568 - RNA, 20 nt, Human adenovirus D
augcgacccaugagcugcga

SEQ ID NO: 3925569 - RNA, 13 nt, Human adenovirus D
augcgcaggcgcc

SEQ ID NO: 3925570 - RNA, 14 nt, Human adenovirus D
augcgccaagggca

SEQ ID NO: 3925571 - RNA, 17 nt, Human adenovirus D
augcgccaagggcagcc

SEQ ID NO: 3925572 - RNA, 21 nt, Human adenovirus D
augcggaggaauguggaaaga

SEQ ID NO: 3925573 - RNA, 20 nt, Human adenovirus D
augcggggggagaugaugug

SEQ ID NO: 3925574 - RNA, 13 nt, Human adenovirus D
augcuccugggug

SEQ ID NO: 3925575 - RNA, 21 nt, Human adenovirus D
augcugagccugcgccgggcg

SEQ ID NO: 3925576 - RNA, 16 nt, Human adenovirus D
auggacuuggaagagg

SEQ ID NO: 3925577 - RNA, 14 nt, Human adenovirus D
auggaggagcagcc

SEQ ID NO: 3925578 - RNA, 17 nt, Human adenovirus D
auggauguggagcccga

SEQ ID NO: 3925579 - RNA, 22 nt, Human adenovirus D
auggccuccagccuuuccaugg

SEQ ID NO: 3925580 - RNA, 22 nt, Human adenovirus D
auggccuguaccgggaccgagu

SEQ ID NO: 3925581 - RNA, 14 nt, Human adenovirus D
auggcgaugggccc

SEQ ID NO: 3925582 - RNA, 17 nt, Human adenovirus D
auggcggagcgagcugg

SEQ ID NO: 3925583 - RNA, 20 nt, Human adenovirus D
auggcgugcgaguuggagga

SEQ ID NO: 3925584 - RNA, 18 nt, Human adenovirus D
auggcgugcuggagagcg

SEQ ID NO: 3925585 - RNA, 21 nt, Human adenovirus D
auggcuaccugggaggagagg

SEQ ID NO: 3925586 - RNA, 13 nt, Human adenovirus D
augggaaugagag

SEQ ID NO: 3925587 - RNA, 13 nt, Human adenovirus D
augggugugcugg

SEQ ID NO: 3925588 - RNA, 21 nt, Human adenovirus D
augguacuaaugacagaggca

SEQ ID NO: 3925589 - RNA, 20 nt, Human adenovirus D
auguaaguuuuauggcugcu

SEQ ID NO: 3925590 - RNA, 16 nt, Human adenovirus D
auguacaacaugcuga

SEQ ID NO: 3925591 - RNA, 22 nt, Human adenovirus D
augucagcugcaaaaagucacu

SEQ ID NO: 3925592 - RNA, 13 nt, Human adenovirus D
auguccggggcgg

SEQ ID NO: 3925593 - RNA, 22 nt, Human adenovirus D
augugaugggaucgacggugga

SEQ ID NO: 3925594 - RNA, 16 nt, Human adenovirus D
augugccuuaccgcca

SEQ ID NO: 3925595 - RNA, 20 nt, Human adenovirus D
auguggaacucugcggugga

SEQ ID NO: 3925596 - RNA, 19 nt, Human adenovirus D
auguuauucagcagcccau

SEQ ID NO: 3925597 - RNA, 17 nt, Human adenovirus D
auguugauuaaaaacca

SEQ ID NO: 3925598 - RNA, 22 nt, Human adenovirus D
auuaacuuuuguuuacuuugug

SEQ ID NO: 3925599 - RNA, 22 nt, Human adenovirus D
auuaccucaucgccaccaugag

SEQ ID NO: 3925600 - RNA, 17 nt, Human adenovirus D
auucaaaacucacuuug

SEQ ID NO: 3925601 - RNA, 12 nt, Human adenovirus D
auucaaggccau

SEQ ID NO: 3925602 - RNA, 14 nt, Human adenovirus D
auucagagccaggg

SEQ ID NO: 3925603 - RNA, 18 nt, Human adenovirus D
auucagggugcuccagcc

SEQ ID NO: 3925604 - RNA, 23 nt, Human adenovirus D
auucuggaaauuaugagcaucaa

SEQ ID NO: 3925605 - RNA, 14 nt, Human adenovirus D
auugauaaggagaa

SEQ ID NO: 3925606 - RNA, 19 nt, Human adenovirus D
auugauuuuuacaccagcg

SEQ ID NO: 3925607 - RNA, 14 nt, Human adenovirus D
auugcuagcccuuc

SEQ ID NO: 3925608 - RNA, 19 nt, Human adenovirus D
auugcuucccuggaagagu

SEQ ID NO: 3925609 - RNA, 19 nt, Human adenovirus D
auuggccuguccugcaggg

SEQ ID NO: 3925610 - RNA, 14 nt, Human adenovirus D
auuggugcgcuggg

SEQ ID NO: 3925611 - RNA, 18 nt, Human adenovirus D
auuuaaagacccacagcc

SEQ ID NO: 3925612 - RNA, 12 nt, Human adenovirus D
auuucacagugu

SEQ ID NO: 3925613 - RNA, 16 nt, Human adenovirus D
auuugacaacccgccu

SEQ ID NO: 3925614 - RNA, 15 nt, Human adenovirus D
auuuuuacaccagcg

SEQ ID NO: 3925615 - RNA, 12 nt, Human adenovirus D
caaaaagaaaca

SEQ ID NO: 3925616 - RNA, 21 nt, Human adenovirus D
caaaacuaauuacagucacua

SEQ ID NO: 3925617 - RNA, 14 nt, Human adenovirus D
caaaagcgccagga

SEQ ID NO: 3925618 - RNA, 22 nt, Human adenovirus D
caaacuauugcuucccauugaa

SEQ ID NO: 3925619 - RNA, 15 nt, Human adenovirus D
caaagcgggaucauc

SEQ ID NO: 3925620 - RNA, 18 nt, Human adenovirus D
caaagcuagcacccaaaa

SEQ ID NO: 3925621 - RNA, 21 nt, Human adenovirus D
caaauccaacucuuaaaucau

SEQ ID NO: 3925622 - RNA, 16 nt, Human adenovirus D
caaaugcgagcauaca

SEQ ID NO: 3925623 - RNA, 15 nt, Human adenovirus D
caacaccagacacau

SEQ ID NO: 3925624 - RNA, 21 nt, Human adenovirus D
caacagaaccggaggcuggcu

SEQ ID NO: 3925625 - RNA, 18 nt, Human adenovirus D
caacaggccuaacuacau

SEQ ID NO: 3925626 - RNA, 15 nt, Human adenovirus D
caaccaaggcaccca

SEQ ID NO: 3925627 - RNA, 16 nt, Human adenovirus D
caaccaugugcgcacc

SEQ ID NO: 3925628 - RNA, 21 nt, Human adenovirus D
caacccgggucucccccagca

SEQ ID NO: 3925629 - RNA, 19 nt, Human adenovirus D
caaccuccaggccaaccug

SEQ ID NO: 3925630 - RNA, 21 nt, Human adenovirus D
caacgacgguauugaaauacc

SEQ ID NO: 3925631 - RNA, 17 nt, Human adenovirus D
caacgugcccaucucca

SEQ ID NO: 3925632 - RNA, 19 nt, Human adenovirus D
ugcacgagaaccgccuggg

SEQ ID NO: 3925633 - RNA, 21 nt, Human adenovirus D
ugcacucauccaugaugaugg

SEQ ID NO: 3925634 - RNA, 19 nt, Human adenovirus D
ugcacuuucuuugccauca

SEQ ID NO: 3925635 - RNA, 19 nt, Human adenovirus D
ugcagaacccggacagcaa

SEQ ID NO: 3925636 - RNA, 13 nt, Human adenovirus D
uggugcuggauga

SEQ ID NO: 3925637 - RNA, 18 nt, Human adenovirus D
uguacaacgcccugcugg

SEQ ID NO: 3925638 - RNA, 18 nt, Human adenovirus D
uguaccgcgaggccauag

SEQ ID NO: 3925639 - RNA, 15 nt, Human adenovirus D
uguagggacagcagc

SEQ ID NO: 3925640 - RNA, 18 nt, Human adenovirus D
uguagguguuggcaaagc

SEQ ID NO: 3925641 - RNA, 15 nt, Human adenovirus D
uguccuugaggagga

SEQ ID NO: 3925642 - RNA, 12 nt, Human adenovirus D
ugucucuggugu

SEQ ID NO: 3925643 - RNA, 19 nt, Human adenovirus D
ugugagugauaaagcgugg

SEQ ID NO: 3925644 - RNA, 22 nt, Human adenovirus D
ugugauuaaaaagcagcacagu

SEQ ID NO: 3925645 - RNA, 22 nt, Human adenovirus D
ugugggccugggagugaaaagu

SEQ ID NO: 3925646 - RNA, 16 nt, Human adenovirus D
ugugguagcuuacacc

SEQ ID NO: 3925647 - RNA, 19 nt, Human adenovirus D
uguucaaaacaacaagauu

SEQ ID NO: 3925648 - RNA, 21 nt, Human adenovirus D
uguugcaugaugggaaugaga

SEQ ID NO: 3925649 - RNA, 16 nt, Human adenovirus D
uguuggagcaggcggc

SEQ ID NO: 3925650 - RNA, 20 nt, Human adenovirus D
uguuguacucugugugcuga

SEQ ID NO: 3925651 - RNA, 18 nt, Human adenovirus D
uguuuauaaaucuuacac

SEQ ID NO: 3925652 - RNA, 13 nt, Human adenovirus D
uuaaaaaccaaaa

SEQ ID NO: 3925653 - RNA, 14 nt, Human adenovirus D
uuaaaaagcagcac

SEQ ID NO: 3925654 - RNA, 19 nt, Human adenovirus D
uuaaaaagcagcacaguaa

SEQ ID NO: 3925655 - RNA, 13 nt, Human adenovirus D
uuaaaggcaccuu

SEQ ID NO: 3925656 - RNA, 16 nt, Human adenovirus D
uuaaccacccacgagc

SEQ ID NO: 3925657 - RNA, 14 nt, Human adenovirus D
uuaaccuauaaaaa

SEQ ID NO: 3925658 - RNA, 14 nt, Human adenovirus D
uuaagaauccacag

SEQ ID NO: 3925659 - RNA, 21 nt, Human adenovirus D
uuaauaugggagagaacaaaa

SEQ ID NO: 3925660 - RNA, 12 nt, Human adenovirus D
uuaaugcugccu

SEQ ID NO: 3925661 - RNA, 22 nt, Human adenovirus D
uuacaccgcgucgcugaaagca

SEQ ID NO: 3925662 - RNA, 13 nt, Human adenovirus D
uuaccgccagaga

SEQ ID NO: 3925663 - RNA, 22 nt, Human adenovirus D
uuaccucaucgccaccaugagc

SEQ ID NO: 3925664 - RNA, 18 nt, Human adenovirus D
uuagacucugacacaccu

SEQ ID NO: 3925665 - RNA, 13 nt, Human adenovirus D
uuaguccagcaga

SEQ ID NO: 3925666 - RNA, 14 nt, Human adenovirus D
uuaguucagcugca

SEQ ID NO: 3925667 - RNA, 21 nt, Human adenovirus D
uuauaucuauugcuagcccuu

SEQ ID NO: 3925668 - RNA, 15 nt, Human adenovirus D
uucaaaaacuucccc

SEQ ID NO: 3925669 - RNA, 12 nt, Human adenovirus D
uucaagaacugg

SEQ ID NO: 3925670 - RNA, 16 nt, Human adenovirus D
uucaaggacaugcagc

SEQ ID NO: 3925671 - RNA, 19 nt, Human adenovirus D
uucaaggacaugcagcugc

SEQ ID NO: 3925672 - RNA, 13 nt, Human adenovirus D
uucagagccaggg

SEQ ID NO: 3925673 - RNA, 15 nt, Human adenovirus D
uucagccugggcaac

SEQ ID NO: 3925674 - RNA, 16 nt, Human adenovirus D
uucaugaccagcauga

SEQ ID NO: 3925675 - RNA, 20 nt, Human adenovirus D
uuccaccucggugcagccgu

SEQ ID NO: 3925676 - RNA, 17 nt, Human adenovirus D
uuccaguacucccggag

SEQ ID NO: 3925677 - RNA, 22 nt, Human adenovirus D
uucccauugaauggcacuggca

SEQ ID NO: 3925678 - RNA, 16 nt, Human adenovirus D
uuccgcguaccugcgc

SEQ ID NO: 3925679 - RNA, 20 nt, Human adenovirus D
uucucacaguaagugcagca

SEQ ID NO: 3925680 - RNA, 20 nt, Human adenovirus D
uucucggccaaucagcagua

SEQ ID NO: 3925681 - RNA, 13 nt, Human adenovirus D
uucugccagcaga

SEQ ID NO: 3925682 - RNA, 21 nt, Human adenovirus D
uucuggaaauuaugagcauca

SEQ ID NO: 3925683 - RNA, 20 nt, Human adenovirus D
uucuuccggcaaaaaucaca

SEQ ID NO: 3925684 - RNA, 22 nt, Human adenovirus D
uugaagauucuggaaauuauga

SEQ ID NO: 3925685 - RNA, 20 nt, Human adenovirus D
uugacaaauggagccagaac

SEQ ID NO: 3925686 - RNA, 17 nt, Human adenovirus D
uugaccugccuccacca

SEQ ID NO: 3925687 - RNA, 19 nt, Human adenovirus D
uugaguuucccgaggagca

SEQ ID NO: 3925688 - RNA, 20 nt, Human adenovirus D
uugcacccaccaugcgccaa

SEQ ID NO: 3925689 - RNA, 13 nt, Human adenovirus D
uugcagagcagcu

SEQ ID NO: 3925690 - RNA, 16 nt, Human adenovirus D
uugccgaaggacccca

SEQ ID NO: 3925691 - RNA, 21 nt, Human adenovirus D
uugccggcgacaagcuggccu

SEQ ID NO: 3925692 - RNA, 17 nt, Human adenovirus D
uugcgcgagcagaacgg

SEQ ID NO: 3925693 - RNA, 17 nt, Human adenovirus D
uugcgucccuggcuccg

SEQ ID NO: 3925694 - RNA, 12 nt, Human adenovirus D
uuggcagccgag

SEQ ID NO: 3925695 - RNA, 21 nt, Human adenovirus D
uuggccuguccugcaggggcg

SEQ ID NO: 3925696 - RNA, 15 nt, Human adenovirus D
uugucccgcugagcu

SEQ ID NO: 3925697 - RNA, 19 nt, Human adenovirus D
uugucgcugaucugauccu

SEQ ID NO: 3925698 - RNA, 15 nt, Human adenovirus D
uuguuguacucugug

SEQ ID NO: 3925699 - RNA, 17 nt, Human adenovirus D
uuuaaaauaaaacuucu

SEQ ID NO: 3925700 - RNA, 18 nt, Human adenovirus D
uuuaauuggcaaacuugu

SEQ ID NO: 3925701 - RNA, 17 nt, Human adenovirus D
uuuacaugcgcauggcg

SEQ ID NO: 3925702 - RNA, 20 nt, Human adenovirus D
uuucaaauuuuauguaucuu

SEQ ID NO: 3925703 - RNA, 22 nt, Human adenovirus D
uuucacugaaggaaaaaucacu

SEQ ID NO: 3925704 - RNA, 18 nt, Human adenovirus D
uuuccaugcacucaucca

SEQ ID NO: 3925705 - RNA, 11 nt, Human adenovirus D
uuuccggggcg

SEQ ID NO: 3925706 - RNA, 16 nt, Human adenovirus D
uuucugcagacaucau

SEQ ID NO: 3925707 - RNA, 22 nt, Human adenovirus D
uuugaggcggcggaugguggcg

SEQ ID NO: 3925708 - RNA, 14 nt, Human adenovirus D
uuugcgaaaacacu

SEQ ID NO: 3925709 - RNA, 11 nt, Human adenovirus D
uuugggcacug

SEQ ID NO: 3925710 - RNA, 16 nt, Human adenovirus D
uuuuaaugaagaagca

SEQ ID NO: 3925711 - RNA, 20 nt, Human adenovirus D
uuuugaggaugcaucaucca

SEQ ID NO: 3925712 - RNA, 18 nt, Human adenovirus D
ccuugauuuuuccagccc

SEQ ID NO: 3925713 - RNA, 20 nt, Human adenovirus D
ccuugcagagcagcucuucg

SEQ ID NO: 3925714 - RNA, 20 nt, Human adenovirus D
ccuugcccccaagggcgcuc

SEQ ID NO: 3925715 - RNA, 23 nt, Human adenovirus D
ccuugcgcgagcagaacgggggc

SEQ ID NO: 3925716 - RNA, 16 nt, Human adenovirus D
cgaacacgccaccgcu

SEQ ID NO: 3925717 - RNA, 19 nt, Human adenovirus D
cgaagacgagggcgcgcag

SEQ ID NO: 3925718 - RNA, 22 nt, Human adenovirus D
cgaagcgccguggccucuucgc

SEQ ID NO: 3925719 - RNA, 17 nt, Human adenovirus D
cgaaguuccccucgcag

SEQ ID NO: 3925720 - RNA, 20 nt, Human adenovirus D
cgacacccccgcgugcagcu

SEQ ID NO: 3925721 - RNA, 22 nt, Human adenovirus D
cgacaugggggcggaccugcau

SEQ ID NO: 3925722 - RNA, 12 nt, Human adenovirus D
cgaccacagcaa

SEQ ID NO: 3925723 - RNA, 14 nt, Human adenovirus D
cgacccaugagcug

SEQ ID NO: 3925724 - RNA, 15 nt, Human adenovirus D
cgaccccuggcuccc

SEQ ID NO: 3925725 - RNA, 18 nt, Human adenovirus D
cgaccggucgacggugag

SEQ ID NO: 3925726 - RNA, 15 nt, Human adenovirus D
cgaccuccuccccau

SEQ ID NO: 3925727 - RNA, 20 nt, Human adenovirus D
cgaccucggaguaccugagc

SEQ ID NO: 3925728 - RNA, 12 nt, Human adenovirus D
cgacgccccuga

SEQ ID NO: 3925729 - RNA, 14 nt, Human adenovirus D
cgacgccccugagc

SEQ ID NO: 3925730 - RNA, 23 nt, Human adenovirus D
cgacgcuuuuucagcgaccccga

SEQ ID NO: 3925731 - RNA, 14 nt, Human adenovirus D
cgacuccucgguca

SEQ ID NO: 3925732 - RNA, 20 nt, Human adenovirus D
cgacucgcugcugcagccgc

SEQ ID NO: 3925733 - RNA, 22 nt, Human adenovirus D
cgacuucaugagccagagcaug

SEQ ID NO: 3925734 - RNA, 23 nt, Human adenovirus D
cgagaacguccauggcgcaguag

SEQ ID NO: 3925735 - RNA, 16 nt, Human adenovirus D
cgagaagaacgcacag

SEQ ID NO: 3925736 - RNA, 21 nt, Human adenovirus D
cgagaccggaggcgugcacug

SEQ ID NO: 3925737 - RNA, 14 nt, Human adenovirus D
cgagaucaagcgca

SEQ ID NO: 3925738 - RNA, 18 nt, Human adenovirus D
cgagaucggcaccagcca

SEQ ID NO: 3925739 - RNA, 18 nt, Human adenovirus D
cgagauggacggccaggc

SEQ ID NO: 3925740 - RNA, 20 nt, Human adenovirus D
cgagcagaacgggggcagca

SEQ ID NO: 3925741 - RNA, 12 nt, Human adenovirus D
cgagcaggaccu

SEQ ID NO: 3925742 - RNA, 16 nt, Human adenovirus D
cgagccgaacgagcag

SEQ ID NO: 3925743 - RNA, 23 nt, Human adenovirus D
cgagccgccuucguacgaggagg

SEQ ID NO: 3925744 - RNA, 18 nt, Human adenovirus D
cgagccgcgcgccgcgcc

SEQ ID NO: 3925745 - RNA, 14 nt, Human adenovirus D
cgagccucccagga

SEQ ID NO: 3925746 - RNA, 23 nt, Human adenovirus D
cgagcuacaugcccagcagcagc

SEQ ID NO: 3925747 - RNA, 23 nt, Human adenovirus D
cgagcucaaccucuucucgccgc

SEQ ID NO: 3925748 - RNA, 22 nt, Human adenovirus D
cgagcuccgcgaacagcagcag

SEQ ID NO: 3925749 - RNA, 21 nt, Human adenovirus D
cgagcucugcugcgccgcgcc

SEQ ID NO: 3925750 - RNA, 17 nt, Human adenovirus D
cgagcugacggccaguc

SEQ ID NO: 3925751 - RNA, 15 nt, Human adenovirus D
cgagcugcaaggucc

SEQ ID NO: 3925752 - RNA, 16 nt, Human adenovirus D
cgagcuggaagcccug

SEQ ID NO: 3925753 - RNA, 18 nt, Human adenovirus D
cgaggagaacugcuggcc

SEQ ID NO: 3925754 - RNA, 23 nt, Human adenovirus D
cgaggagaacugcuggcccugcu

SEQ ID NO: 3925755 - RNA, 19 nt, Human adenovirus D
cgaggagcugagaccagac

SEQ ID NO: 3925756 - RNA, 16 nt, Human adenovirus D
cgaggccgggcuagug

SEQ ID NO: 3925757 - RNA, 20 nt, Human adenovirus D
cgaggccgucuaccugcgca

SEQ ID NO: 3925758 - RNA, 16 nt, Human adenovirus D
cgaggcguucagggag

SEQ ID NO: 3925759 - RNA, 20 nt, Human adenovirus D
cgagggccuggaccgccagc

SEQ ID NO: 3925760 - RNA, 14 nt, Human adenovirus D
cgaggggcuccucu

SEQ ID NO: 3925761 - RNA, 19 nt, Human adenovirus D
cgaguacauguucaccagc

SEQ ID NO: 3925762 - RNA, 16 nt, Human adenovirus D
cgaguggaacuuccgc

SEQ ID NO: 3925763 - RNA, 17 nt, Human adenovirus D
cgaucugggaugcugcc

SEQ ID NO: 3925764 - RNA, 15 nt, Human adenovirus D
cgaugagcagcuugc

SEQ ID NO: 3925765 - RNA, 23 nt, Human adenovirus D
cgaugcuauugagagagaggaag

SEQ ID NO: 3925766 - RNA, 16 nt, Human adenovirus D
cgauguugccacccag

SEQ ID NO: 3925767 - RNA, 13 nt, Human adenovirus D
cgcaacuuccagc

SEQ ID NO: 3925768 - RNA, 14 nt, Human adenovirus D
cgcaagcucaugcu

SEQ ID NO: 3925769 - RNA, 23 nt, Human adenovirus D
cgcaagcucaugcuggccguggu

SEQ ID NO: 3925770 - RNA, 22 nt, Human adenovirus D
cgcacaacaccgccuccacccu

SEQ ID NO: 3925771 - RNA, 23 nt, Human adenovirus D
cgcacuggcuuccgccgccgggg

SEQ ID NO: 3925772 - RNA, 11 nt, Human adenovirus D
cgcagccugag

SEQ ID NO: 3925773 - RNA, 19 nt, Human adenovirus D
cgcagcggggaggagcccg

SEQ ID NO: 3925774 - RNA, 15 nt, Human adenovirus D
cgcaggaggccaucu

SEQ ID NO: 3925775 - RNA, 18 nt, Human adenovirus D
cgcaggcgacccuggagg

SEQ ID NO: 3925776 - RNA, 18 nt, Human adenovirus D
cgcaggcgcuggaagagg

SEQ ID NO: 3925777 - RNA, 15 nt, Human adenovirus D
cgcaguccgccaagc

SEQ ID NO: 3925778 - RNA, 13 nt, Human adenovirus D
cgcauugcaugag

SEQ ID NO: 3925779 - RNA, 16 nt, Human adenovirus D
cgccacaggugcugcc

SEQ ID NO: 3925780 - RNA, 21 nt, Human adenovirus D
cgccaccuucuuccccauggc

SEQ ID NO: 3925781 - RNA, 13 nt, Human adenovirus D
cgccaggcuggcc

SEQ ID NO: 3925782 - RNA, 15 nt, Human adenovirus D
cgccaggcuggccgu

SEQ ID NO: 3925783 - RNA, 22 nt, Human adenovirus D
cgcccaacucgcggcugcugcu

SEQ ID NO: 3925784 - RNA, 22 nt, Human adenovirus D
cgcccacggugguggagaugga

SEQ ID NO: 3925785 - RNA, 20 nt, Human adenovirus D
cgcccagcaauaacaccggc

SEQ ID NO: 3925786 - RNA, 21 nt, Human adenovirus D
cgcccagccagcaaacgccgc

SEQ ID NO: 3925787 - RNA, 11 nt, Human adenovirus D
cgcccaggcgc

SEQ ID NO: 3925788 - RNA, 12 nt, Human adenovirus D
cgcccaggcgcc

SEQ ID NO: 3925789 - RNA, 22 nt, Human adenovirus D
cgcccaggcgccauucggagca

SEQ ID NO: 3925790 - RNA, 17 nt, Human adenovirus D
cgcccagugcuuccagc

SEQ ID NO: 3925791 - RNA, 18 nt, Human adenovirus D
cgccccgaggacacccgg

SEQ ID NO: 3925792 - RNA, 18 nt, Human adenovirus D
cgcccggcguacgugccu

SEQ ID NO: 3925793 - RNA, 17 nt, Human adenovirus D
cgcccgggagagcugcg

SEQ ID NO: 3925794 - RNA, 17 nt, Human adenovirus D
cgcccgugggcgaccgg

SEQ ID NO: 3925795 - RNA, 12 nt, Human adenovirus D
cgcccugcugga

SEQ ID NO: 3925796 - RNA, 20 nt, Human adenovirus D
cgccgacccguggccccggg

SEQ ID NO: 3925797 - RNA, 19 nt, Human adenovirus D
cgccgacgcgcuccucgcu

SEQ ID NO: 3925798 - RNA, 16 nt, Human adenovirus D
cgccgagccugaagcc

SEQ ID NO: 3925799 - RNA, 14 nt, Human adenovirus D
cgccgccugcgcug

SEQ ID NO: 3925800 - RNA, 20 nt, Human adenovirus D
cgccgcgcuggggagggcca

SEQ ID NO: 3925801 - RNA, 23 nt, Human adenovirus D
cgccgcgcuggggagggccacgu

SEQ ID NO: 3925802 - RNA, 15 nt, Human adenovirus D
cgccggggcucggug

SEQ ID NO: 3925803 - RNA, 21 nt, Human adenovirus D
cgccucugcgugaagaccacu

SEQ ID NO: 3925804 - RNA, 23 nt, Human adenovirus D
cgccuuccuggcgacgcagccgg

SEQ ID NO: 3925805 - RNA, 15 nt, Human adenovirus D
cgccuuggaggccgc

SEQ ID NO: 3925806 - RNA, 15 nt, Human adenovirus D
cgcgaacagcagcag

SEQ ID NO: 3925807 - RNA, 17 nt, Human adenovirus D
cgcgaaccaggcagugc

SEQ ID NO: 3925808 - RNA, 16 nt, Human adenovirus D
cgcgaagaggagcuga

SEQ ID NO: 3925809 - RNA, 17 nt, Human adenovirus D
cgcgagccggcggcgcg

SEQ ID NO: 3925810 - RNA, 22 nt, Human adenovirus D
cgcgaggccauaggccaggcgc

SEQ ID NO: 3925811 - RNA, 23 nt, Human adenovirus D
cgcgaggccauaggccaggcgca

SEQ ID NO: 3925812 - RNA, 22 nt, Human adenovirus D
cgcgagggccuggaccgccagc

SEQ ID NO: 3925813 - RNA, 17 nt, Human adenovirus D
cgcgagugucccccgcc

SEQ ID NO: 3925814 - RNA, 18 nt, Human adenovirus D
cgcgccacuggccacggg

SEQ ID NO: 3925815 - RNA, 15 nt, Human adenovirus D
cgcgcgaggaggugg

SEQ ID NO: 3925816 - RNA, 19 nt, Human adenovirus D
cgcgcgcgaggagguggcc

SEQ ID NO: 3925817 - RNA, 16 nt, Human adenovirus D
cgcgcgguaggcccug

SEQ ID NO: 3925818 - RNA, 15 nt, Human adenovirus D
cgcgcuggcggagaa

SEQ ID NO: 3925819 - RNA, 22 nt, Human adenovirus D
cgcgcuggcuugguacccgcga

SEQ ID NO: 3925820 - RNA, 13 nt, Human adenovirus D
gaccgcagcgggg

SEQ ID NO: 3925821 - RNA, 19 nt, Human adenovirus D
gaccggcagcggggccugg

SEQ ID NO: 3925822 - RNA, 16 nt, Human adenovirus D
gaccggugcucugcgc

SEQ ID NO: 3925823 - RNA, 22 nt, Human adenovirus D
gaccucgccgucuacucccagc

SEQ ID NO: 3925824 - RNA, 20 nt, Human adenovirus D
gaccugcauuggcagccgag

SEQ ID NO: 3925825 - RNA, 15 nt, Human adenovirus D
gaccugccuccacca

SEQ ID NO: 3925826 - RNA, 18 nt, Human adenovirus D
gaccugcgcgucgacggc

SEQ ID NO: 3925827 - RNA, 15 nt, Human adenovirus D
gaccuugcagagcag

SEQ ID NO: 3925828 - RNA, 14 nt, Human adenovirus D
gacgacauccugga

SEQ ID NO: 3925829 - RNA, 13 nt, Human adenovirus D
gacgagaccagag

SEQ ID NO: 3925830 - RNA, 18 nt, Human adenovirus D
gacgagaccagaggcaga

SEQ ID NO: 3925831 - RNA, 19 nt, Human adenovirus D
gacgagaccagaggcagac

SEQ ID NO: 3925832 - RNA, 12 nt, Human adenovirus D
gacgagccaaac

SEQ ID NO: 3925833 - RNA, 17 nt, Human adenovirus D
gacgagccaggugagcu

SEQ ID NO: 3925834 - RNA, 19 nt, Human adenovirus D
gacgagccaggugagcucg

SEQ ID NO: 3925835 - RNA, 15 nt, Human adenovirus D
gacgagcccgcgcgg

SEQ ID NO: 3925836 - RNA, 19 nt, Human adenovirus D
gacgagguguacggcgacg

SEQ ID NO: 3925837 - RNA, 16 nt, Human adenovirus D
gacgaguuggugagcu

SEQ ID NO: 3925838 - RNA, 16 nt, Human adenovirus D
gacgcacgggccgccg

SEQ ID NO: 3925839 - RNA, 16 nt, Human adenovirus D
gacgcaggccaggagg

SEQ ID NO: 3925840 - RNA, 19 nt, Human adenovirus D
gacgcgcucccggcggcag

SEQ ID NO: 3925841 - RNA, 22 nt, Human adenovirus D
gacgcgcucccggcggcagcgg

SEQ ID NO: 3925842 - RNA, 23 nt, Human adenovirus D
gacgcggcgguugacauccugga

SEQ ID NO: 3925843 - RNA, 22 nt, Human adenovirus D
gacgcugaaaggcgggcugccc

SEQ ID NO: 3925844 - RNA, 24 nt, Human adenovirus D
gacggacuugauuggccuguccug

SEQ ID NO: 3925845 - RNA, 15 nt, Human adenovirus D
gacggaucgcccagg

SEQ ID NO: 3925846 - RNA, 15 nt, Human adenovirus D
gacggccgcggcgag

SEQ ID NO: 3925847 - RNA, 17 nt, Human adenovirus D
gacggccuacgagcaga

SEQ ID NO: 3925848 - RNA, 22 nt, Human adenovirus D
gacgggugcuccggguucugga

SEQ ID NO: 3925849 - RNA, 16 nt, Human adenovirus D
gacguggugcugcugc

SEQ ID NO: 3925850 - RNA, 17 nt, Human adenovirus D
gacguggugcugcugcc

SEQ ID NO: 3925851 - RNA, 14 nt, Human adenovirus D
gacguuucuggggu

SEQ ID NO: 3925852 - RNA, 15 nt, Human adenovirus D
gacuauccuugcaga

SEQ ID NO: 3925853 - RNA, 17 nt, Human adenovirus D
gacucacccuggggcuc

SEQ ID NO: 3925854 - RNA, 17 nt, Human adenovirus D
gacuccgcgaccuccuc

SEQ ID NO: 3925855 - RNA, 16 nt, Human adenovirus D
gacugacuacccacug

SEQ ID NO: 3925856 - RNA, 15 nt, Human adenovirus D
gacugauggccacgg

SEQ ID NO: 3925857 - RNA, 16 nt, Human adenovirus D
gacugauggccacggg

SEQ ID NO: 3925858 - RNA, 22 nt, Human adenovirus D
gacugcgacuguagggcacgag

SEQ ID NO: 3925859 - RNA, 20 nt, Human adenovirus D
gacuuggaugaggaagagga

SEQ ID NO: 3925860 - RNA, 19 nt, Human adenovirus D
gacuuugucccgcugagcu

SEQ ID NO: 3925861 - RNA, 17 nt, Human adenovirus D
gagaacggggugcaguc

SEQ ID NO: 3925862 - RNA, 17 nt, Human adenovirus D
gagaacugcuggcccug

SEQ ID NO: 3925863 - RNA, 19 nt, Human adenovirus D
gagaacugcuggcccugcu

SEQ ID NO: 3925864 - RNA, 16 nt, Human adenovirus D
gagaccaaguccaggg

SEQ ID NO: 3925865 - RNA, 22 nt, Human adenovirus D
gagaccggaggcgugcacuggc

SEQ ID NO: 3925866 - RNA, 17 nt, Human adenovirus D
gagagcaaucccacgcc

SEQ ID NO: 3925867 - RNA, 19 nt, Human adenovirus D
gagagcgugauggcgcagg

SEQ ID NO: 3925868 - RNA, 18 nt, Human adenovirus D
gagaggcugacgagcccg

SEQ ID NO: 3925869 - RNA, 22 nt, Human adenovirus D
gagauagcaguugaccaugagc

SEQ ID NO: 3925870 - RNA, 22 nt, Human adenovirus D
gagauccagguccgggggcagg

SEQ ID NO: 3925871 - RNA, 21 nt, Human adenovirus D
gagcaacccaaaaucgagcag

SEQ ID NO: 3925872 - RNA, 21 nt, Human adenovirus D
gagcagcuugcgcgcuggcuu

SEQ ID NO: 3925873 - RNA, 15 nt, Human adenovirus D
gagcaggaccugggc

SEQ ID NO: 3925874 - RNA, 21 nt, Human adenovirus D
gagcaggggcuacauucugga

SEQ ID NO: 3925875 - RNA, 21 nt, Human adenovirus D
gagcagugucuggagcgggcu

SEQ ID NO: 3925876 - RNA, 20 nt, Human adenovirus D
gagcaucguaguucaggagc

SEQ ID NO: 3925877 - RNA, 19 nt, Human adenovirus D
gagccacugcuaccucuug

SEQ ID NO: 3925878 - RNA, 16 nt, Human adenovirus D
gagccauugaccacca

SEQ ID NO: 3925879 - RNA, 12 nt, Human adenovirus D
gagcccacccgc

SEQ ID NO: 3925880 - RNA, 18 nt, Human adenovirus D
gagcccgaggagaugcgc

SEQ ID NO: 3925881 - RNA, 23 nt, Human adenovirus D
gagcccgagggucgcuggcugcu

SEQ ID NO: 3925882 - RNA, 20 nt, Human adenovirus D
gagcccgcgcgggagccagg

SEQ ID NO: 3925883 - RNA, 22 nt, Human adenovirus D
gagcccguagcugcgcggggcc

SEQ ID NO: 3925884 - RNA, 15 nt, Human adenovirus D
gagccgccagcuggc

SEQ ID NO: 3925885 - RNA, 13 nt, Human adenovirus D
gagccgccugagc

SEQ ID NO: 3925886 - RNA, 18 nt, Human adenovirus D
gagccugcgccgggcgcu

SEQ ID NO: 3925887 - RNA, 20 nt, Human adenovirus D
gagccugcgccgggcgcugg

SEQ ID NO: 3925888 - RNA, 23 nt, Human adenovirus D
gagcgacacccccgcgugcagcu

SEQ ID NO: 3925889 - RNA, 23 nt, Human adenovirus D
gagcgaggugugcgucagggcga

SEQ ID NO: 3925890 - RNA, 20 nt, Human adenovirus D
gagcgcccauuccuggagau

SEQ ID NO: 3925891 - RNA, 16 nt, Human adenovirus D
gagcgccugaggcaga

SEQ ID NO: 3925892 - RNA, 20 nt, Human adenovirus D
gagcgccugaggcagacgcu

SEQ ID NO: 3925893 - RNA, 15 nt, Human adenovirus D
gagcgccuuaccugg

SEQ ID NO: 3925894 - RNA, 14 nt, Human adenovirus D
gagcggcuccagcg

SEQ ID NO: 3925895 - RNA, 12 nt, Human adenovirus D
gagcgggacuug

SEQ ID NO: 3925896 - RNA, 19 nt, Human adenovirus D
gagcuacaugcccagcagc

SEQ ID NO: 3925897 - RNA, 14 nt, Human adenovirus D
gagcucgcgggcca

SEQ ID NO: 3925898 - RNA, 22 nt, Human adenovirus D
gagcugagaccagaccaccugg

SEQ ID NO: 3925899 - RNA, 19 nt, Human adenovirus D
gagcuggacaagcuucuug

SEQ ID NO: 3925900 - RNA, 14 nt, Human adenovirus D
gagcuggccuucca

SEQ ID NO: 3925901 - RNA, 23 nt, Human adenovirus D
gagcuggccuuccaccucggugc

SEQ ID NO: 3925902 - RNA, 22 nt, Human adenovirus D
gaggaagaucccgccgcaggag

SEQ ID NO: 3925903 - RNA, 22 nt, Human adenovirus D
gaggaaucggaucuuccccacu

SEQ ID NO: 3925904 - RNA, 15 nt, Human adenovirus D
gaggacacccggccc

SEQ ID NO: 3925905 - RNA, 16 nt, Human adenovirus D
gaggacgagaaccuga

SEQ ID NO: 3925906 - RNA, 16 nt, Human adenovirus D
gaggacuaccacgccc

SEQ ID NO: 3925907 - RNA, 20 nt, Human adenovirus D
gaggagaacugcuggcccug

SEQ ID NO: 3925908 - RNA, 19 nt, Human adenovirus D
gaggagacugauggccacg

SEQ ID NO: 3925909 - RNA, 19 nt, Human adenovirus D
gaggagcggucuggacccu

SEQ ID NO: 3925910 - RNA, 17 nt, Human adenovirus D
gauacagaguaaaagua

SEQ ID NO: 3925911 - RNA, 14 nt, Human adenovirus D
gauacccuggacaa

SEQ ID NO: 3925912 - RNA, 17 nt, Human adenovirus D
gauacuguugcagagag

SEQ ID NO: 3925913 - RNA, 20 nt, Human adenovirus D
gauacuuucggcgcuuggug

SEQ ID NO: 3925914 - RNA, 21 nt, Human adenovirus D
gauaugcccuccuauuacuug

SEQ ID NO: 3925915 - RNA, 18 nt, Human adenovirus D
gauaugugcagcagagcg

SEQ ID NO: 3925916 - RNA, 23 nt, Human adenovirus D
gaucaccguagagggcaccaccg

SEQ ID NO: 3925917 - RNA, 15 nt, Human adenovirus D
gaucagaaacacaga

SEQ ID NO: 3925918 - RNA, 12 nt, Human adenovirus D
gauccagcggcg

SEQ ID NO: 3925919 - RNA, 17 nt, Human adenovirus D
gaucccacagggcacug

SEQ ID NO: 3925920 - RNA, 15 nt, Human adenovirus D
gaucccgccgcagga

SEQ ID NO: 3925921 - RNA, 20 nt, Human adenovirus D
gaucuccaacguggagcuga

SEQ ID NO: 3925922 - RNA, 13 nt, Human adenovirus D
gaucucgcugccg

SEQ ID NO: 3925923 - RNA, 13 nt, Human adenovirus D
gaucuuggaugga

SEQ ID NO: 3925924 - RNA, 20 nt, Human adenovirus D
gaucuuuaugaacaugaagu

SEQ ID NO: 3925925 - RNA, 20 nt, Human adenovirus D
gaugacggguugcagguggu

SEQ ID NO: 3925926 - RNA, 14 nt, Human adenovirus D
gaugaguugggccu

SEQ ID NO: 3925927 - RNA, 16 nt, Human adenovirus D
gaugaguugggccuga

SEQ ID NO: 3925928 - RNA, 14 nt, Human adenovirus D
gaugccgcaguggg

SEQ ID NO: 3925929 - RNA, 18 nt, Human adenovirus D
gaugcuucaacagcugug

SEQ ID NO: 3925930 - RNA, 20 nt, Human adenovirus D
gauggacuuggaagagggcg

SEQ ID NO: 3925931 - RNA, 14 nt, Human adenovirus D
gauggaugugugga

SEQ ID NO: 3925932 - RNA, 14 nt, Human adenovirus D
gauggugaagaugc

SEQ ID NO: 3925933 - RNA, 21 nt, Human adenovirus D
gaugguggcgaggaggaccag

SEQ ID NO: 3925934 - RNA, 23 nt, Human adenovirus D
gauguaaguuuuauggcugcugg

SEQ ID NO: 3925935 - RNA, 18 nt, Human adenovirus D
gauucagccauagcucag

SEQ ID NO: 3925936 - RNA, 12 nt, Human adenovirus D
gauugcucuggc

SEQ ID NO: 3925937 - RNA, 15 nt, Human adenovirus D
gcaaaaauaaaucau

SEQ ID NO: 3925938 - RNA, 20 nt, Human adenovirus D
gcaaaaccuguucagggacc

SEQ ID NO: 3925939 - RNA, 21 nt, Human adenovirus D
gcaaaauaaaacucaccaagg

SEQ ID NO: 3925940 - RNA, 15 nt, Human adenovirus D
gcaaacuugugguuu

SEQ ID NO: 3925941 - RNA, 17 nt, Human adenovirus D
gcaaccaggaggagcuc

SEQ ID NO: 3925942 - RNA, 15 nt, Human adenovirus D
gcaacccccagcucc

SEQ ID NO: 3925943 - RNA, 13 nt, Human adenovirus D
gcaacgccuuccc

SEQ ID NO: 3925944 - RNA, 21 nt, Human adenovirus D
gcaacucguaccugggucacc

SEQ ID NO: 3925945 - RNA, 19 nt, Human adenovirus D
gcaacuuuuccgagaccau

SEQ ID NO: 3925946 - RNA, 21 nt, Human adenovirus D
gcaagagccggcgggcggacg

SEQ ID NO: 3925947 - RNA, 21 nt, Human adenovirus D
gcaagauuuacaagacgccgu

SEQ ID NO: 3925948 - RNA, 20 nt, Human adenovirus D
gcaagccccggaccccgcca

SEQ ID NO: 3925949 - RNA, 17 nt, Human adenovirus D
gcaagccucugacggcg

SEQ ID NO: 3925950 - RNA, 20 nt, Human adenovirus D
gcaagccucugacggcgcag

SEQ ID NO: 3925951 - RNA, 15 nt, Human adenovirus D
gcaagcgcccagagc

SEQ ID NO: 3925952 - RNA, 15 nt, Human adenovirus D
gcaagggcgaccagc

SEQ ID NO: 3925953 - RNA, 19 nt, Human adenovirus D
gcaagggcgaccagcucug

SEQ ID NO: 3925954 - RNA, 17 nt, Human adenovirus D
gcaaggucgaggagacc

SEQ ID NO: 3925955 - RNA, 22 nt, Human adenovirus D
gcaaguacauagugaccaagac

SEQ ID NO: 3925956 - RNA, 13 nt, Human adenovirus D
gcacaaacgugca

SEQ ID NO: 3925957 - RNA, 19 nt, Human adenovirus D
gcacaguuggcgacccagg

SEQ ID NO: 3925958 - RNA, 21 nt, Human adenovirus D
gcaccauccgcgccgcagccc

SEQ ID NO: 3925959 - RNA, 13 nt, Human adenovirus D
gcacccaccacag

SEQ ID NO: 3925960 - RNA, 14 nt, Human adenovirus D
gcacccaccacagu

SEQ ID NO: 3925961 - RNA, 21 nt, Human adenovirus D
gcacccgguacuacgccagcc

SEQ ID NO: 3925962 - RNA, 16 nt, Human adenovirus D
gcaccgccacccgccg

SEQ ID NO: 3925963 - RNA, 11 nt, Human adenovirus D
gcaccgcuccu

SEQ ID NO: 3925964 - RNA, 18 nt, Human adenovirus D
gcaccugggcgccagaag

SEQ ID NO: 3925965 - RNA, 14 nt, Human adenovirus D
gcaccugugggacc

SEQ ID NO: 3925966 - RNA, 15 nt, Human adenovirus D
gcaccugugggaccu

SEQ ID NO: 3925967 - RNA, 16 nt, Human adenovirus D
gcaccugugggaccug

SEQ ID NO: 3925968 - RNA, 22 nt, Human adenovirus D
gcacgagcaagacgcaggccag

SEQ ID NO: 3925969 - RNA, 23 nt, Human adenovirus D
gcacgcgggugaggguguccugg

SEQ ID NO: 3925970 - RNA, 16 nt, Human adenovirus D
gcacguacuuugacau

SEQ ID NO: 3925971 - RNA, 23 nt, Human adenovirus D
gcacgucggcguggcgcucgggc

SEQ ID NO: 3925972 - RNA, 16 nt, Human adenovirus D
gcacguggcggcggcc

SEQ ID NO: 3925973 - RNA, 17 nt, Human adenovirus D
gcacguggcggcggcca

SEQ ID NO: 3925974 - RNA, 18 nt, Human adenovirus D
gcacucauccaugaugau

SEQ ID NO: 3925975 - RNA, 13 nt, Human adenovirus D
gcacugccggugc

SEQ ID NO: 3925976 - RNA, 16 nt, Human adenovirus D
gcacuggagcacagac

SEQ ID NO: 3925977 - RNA, 18 nt, Human adenovirus D
gcacuggggucucgggga

SEQ ID NO: 3925978 - RNA, 19 nt, Human adenovirus D
gcacuuucauucucgagcg

SEQ ID NO: 3925979 - RNA, 22 nt, Human adenovirus D
gcagaaauuucaagcugggcug

SEQ ID NO: 3925980 - RNA, 21 nt, Human adenovirus D
gcagacacauguccccuuccu

SEQ ID NO: 3925981 - RNA, 16 nt, Human adenovirus D
gcagacuuuagcaaga

SEQ ID NO: 3925982 - RNA, 15 nt, Human adenovirus D
gcagagcagcucuuc

SEQ ID NO: 3925983 - RNA, 15 nt, Human adenovirus D
gcagaggucuggggc

SEQ ID NO: 3925984 - RNA, 16 nt, Human adenovirus D
gcagaggucuggggcg

SEQ ID NO: 3925985 - RNA, 19 nt, Human adenovirus D
gcagaggucuggggcgcuu

SEQ ID NO: 3925986 - RNA, 19 nt, Human adenovirus D
gcagaguacucauaaagaa

SEQ ID NO: 3925987 - RNA, 19 nt, Human adenovirus D
gcagagucugccgcccuug

SEQ ID NO: 3925988 - RNA, 22 nt, Human adenovirus D
gcagcacaguaaguuccugucu

SEQ ID NO: 3925989 - RNA, 19 nt, Human adenovirus D
gcagcacauaaucaccaug

SEQ ID NO: 3925990 - RNA, 22 nt, Human adenovirus D
gcagcacaugguaauccacgga

SEQ ID NO: 3925991 - RNA, 23 nt, Human adenovirus D
gcagcaccucgguacccuccucc

SEQ ID NO: 3925992 - RNA, 16 nt, Human adenovirus D
gcagcagcaguagccc

SEQ ID NO: 3925993 - RNA, 21 nt, Human adenovirus D
gcagcaggugcugccccaggc

SEQ ID NO: 3925994 - RNA, 24 nt, Human adenovirus D
gcagcaguauccgcggaguccagc

SEQ ID NO: 3925995 - RNA, 20 nt, Human adenovirus D
gcagcccaaacuggggcgac

SEQ ID NO: 3925996 - RNA, 23 nt, Human adenovirus D
gcagcccuaccccgccaacuucc

SEQ ID NO: 3925997 - RNA, 20 nt, Human adenovirus D
gcagcccuucuccacgggga

SEQ ID NO: 3925998 - RNA, 14 nt, Human adenovirus D
gcagccgccaugac

SEQ ID NO: 3925999 - RNA, 13 nt, Human adenovirus D
gcagccgccgcgg

SEQ ID NO: 3926000 - RNA, 17 nt, Human adenovirus D
gcagccgccgugcuccc

SEQ ID NO: 3926001 - RNA, 21 nt, Human adenovirus D
gcagccgcguaagcaggagca

SEQ ID NO: 3926002 - RNA, 22 nt, Human adenovirus D
gcagccgcguaagcaggagcag

SEQ ID NO: 3926003 - RNA, 20 nt, Human adenovirus D
gcagccugagcuuggccgag

SEQ ID NO: 3926004 - RNA, 16 nt, Human adenovirus D
gcagcgcauccugcaa

SEQ ID NO: 3926005 - RNA, 23 nt, Human adenovirus D
gcucgagcgcccauuccuggaga

SEQ ID NO: 3926006 - RNA, 14 nt, Human adenovirus D
gcucgcgcccguag

SEQ ID NO: 3926007 - RNA, 17 nt, Human adenovirus D
gcucgcgggccaugagg

SEQ ID NO: 3926008 - RNA, 19 nt, Human adenovirus D
gcucggcgaggauggccug

SEQ ID NO: 3926009 - RNA, 23 nt, Human adenovirus D
gcucucucuucuuguaacuuuua

SEQ ID NO: 3926010 - RNA, 20 nt, Human adenovirus D
gcucugcugcgccgcgccag

SEQ ID NO: 3926011 - RNA, 19 nt, Human adenovirus D
gcucuuaagaaagacacaa

SEQ ID NO: 3926012 - RNA, 12 nt, Human adenovirus D
gcucuugcaggg

SEQ ID NO: 3926013 - RNA, 21 nt, Human adenovirus D
gcugacaauucagagccaggg

SEQ ID NO: 3926014 - RNA, 23 nt, Human adenovirus D
gcugacaauucagagccagggcu

SEQ ID NO: 3926015 - RNA, 18 nt, Human adenovirus D
gcugacauccauggccag

SEQ ID NO: 3926016 - RNA, 20 nt, Human adenovirus D
gcugacauccauggccaggg

SEQ ID NO: 3926017 - RNA, 21 nt, Human adenovirus D
gcugagcgacgaccugggcgu

SEQ ID NO: 3926018 - RNA, 23 nt, Human adenovirus D
gcugaggaaucggaucuucccca

SEQ ID NO: 3926019 - RNA, 17 nt, Human adenovirus D
gcugaucaagugccaca

SEQ ID NO: 3926020 - RNA, 14 nt, Human adenovirus D
gcugcaaagccagc

SEQ ID NO: 3926021 - RNA, 22 nt, Human adenovirus D
gcugccccaggcggugcugcug

SEQ ID NO: 3926022 - RNA, 21 nt, Human adenovirus D
gcugcccgacuucaugagcca

SEQ ID NO: 3926023 - RNA, 21 nt, Human adenovirus D
gcugcccguucucgcugguca

SEQ ID NO: 3926024 - RNA, 22 nt, Human adenovirus D
gcugccgcuggacgagagcaau

SEQ ID NO: 3926025 - RNA, 17 nt, Human adenovirus D
gcugcgcuuugugcccg

SEQ ID NO: 3926026 - RNA, 13 nt, Human adenovirus D
gcugcggcugaug

SEQ ID NO: 3926027 - RNA, 21 nt, Human adenovirus D
gcugcuagagugccacugccg

SEQ ID NO: 3926028 - RNA, 19 nt, Human adenovirus D
gcugcucgagcgcccauuc

SEQ ID NO: 3926029 - RNA, 15 nt, Human adenovirus D
gcugcugccgagccg

SEQ ID NO: 3926030 - RNA, 14 nt, Human adenovirus D
gcugcuucugccug

SEQ ID NO: 3926031 - RNA, 18 nt, Human adenovirus D
gcuggaagcccugagccg

SEQ ID NO: 3926032 - RNA, 14 nt, Human adenovirus D
gcuggagagcgaua

SEQ ID NO: 3926033 - RNA, 15 nt, Human adenovirus D
gcuggaugcggagcc

SEQ ID NO: 3926034 - RNA, 12 nt, Human adenovirus D
gcuggccagcac

SEQ ID NO: 3926035 - RNA, 13 nt, Human adenovirus D
gcuggcccuccau

SEQ ID NO: 3926036 - RNA, 13 nt, Human adenovirus D
gcuggccgagcug

SEQ ID NO: 3926037 - RNA, 21 nt, Human adenovirus D
gcuggccgugguccuggucac

SEQ ID NO: 3926038 - RNA, 14 nt, Human adenovirus D
gcuggccuuccacc

SEQ ID NO: 3926039 - RNA, 15 nt, Human adenovirus D
gcuggcgcgcacgua

SEQ ID NO: 3926040 - RNA, 20 nt, Human adenovirus D
gcuggcugaaucccacuccc

SEQ ID NO: 3926041 - RNA, 16 nt, Human adenovirus D
gcuggcuggucaggcc

SEQ ID NO: 3926042 - RNA, 21 nt, Human adenovirus D
gcuggcuugguacccgcgacc

SEQ ID NO: 3926043 - RNA, 13 nt, Human adenovirus D
gcugggcgaggac

SEQ ID NO: 3926044 - RNA, 16 nt, Human adenovirus D
gcuggggcugcucggc

SEQ ID NO: 3926045 - RNA, 14 nt, Human adenovirus D
gcuggguggccggc

SEQ ID NO: 3926046 - RNA, 15 nt, Human adenovirus D
gcuggucaggccucu

SEQ ID NO: 3926047 - RNA, 11 nt, Human adenovirus D
gcugguugaac

SEQ ID NO: 3926048 - RNA, 13 nt, Human adenovirus D
gcuguccacgagc

SEQ ID NO: 3926049 - RNA, 20 nt, Human adenovirus D
gcuguggagccacugcuacc

SEQ ID NO: 3926050 - RNA, 19 nt, Human adenovirus D
gcuguggggcgugcaggcg

SEQ ID NO: 3926051 - RNA, 21 nt, Human adenovirus D
gcuuaaggaaucuucuuuucu

SEQ ID NO: 3926052 - RNA, 21 nt, Human adenovirus D
gcuucccauugaauggcacug

SEQ ID NO: 3926053 - RNA, 18 nt, Human adenovirus D
gcuuccguugcgcugcag

SEQ ID NO: 3926054 - RNA, 21 nt, Human adenovirus D
gcuucgcccgggagagcugcg

SEQ ID NO: 3926055 - RNA, 19 nt, Human adenovirus D
gcuugcaagggugcgcuug

SEQ ID NO: 3926056 - RNA, 12 nt, Human adenovirus D
gcuugcccugcc

SEQ ID NO: 3926057 - RNA, 22 nt, Human adenovirus D
gcuuguaaaagcguccgcagua

SEQ ID NO: 3926058 - RNA, 20 nt, Human adenovirus D
gcuuguaagcaucgcgcagg

SEQ ID NO: 3926059 - RNA, 14 nt, Human adenovirus D
ggaaccauggacac

SEQ ID NO: 3926060 - RNA, 22 nt, Human adenovirus D
ggaacuaaucauuuaauaaaga

SEQ ID NO: 3926061 - RNA, 17 nt, Human adenovirus D
ggaacucgcggacgcgg

SEQ ID NO: 3926062 - RNA, 13 nt, Human adenovirus D
ggaagagugccca

SEQ ID NO: 3926063 - RNA, 11 nt, Human adenovirus D
ggaagcccuga

SEQ ID NO: 3926064 - RNA, 22 nt, Human adenovirus D
ggaagcccugagccgccagcug

SEQ ID NO: 3926065 - RNA, 14 nt, Human adenovirus D
ggaaggaggacacu

SEQ ID NO: 3926066 - RNA, 19 nt, Human adenovirus D
ggaauaaagaauaugccag

SEQ ID NO: 3926067 - RNA, 18 nt, Human adenovirus D
ggacagccagcagaagaa

SEQ ID NO: 3926068 - RNA, 13 nt, Human adenovirus D
ggaccaaccccac

SEQ ID NO: 3926069 - RNA, 18 nt, Human adenovirus D
ggaccauagggagccugc

SEQ ID NO: 3926070 - RNA, 20 nt, Human adenovirus D
ggacccuuuuaccuuaacca

SEQ ID NO: 3926071 - RNA, 15 nt, Human adenovirus D
ggaccgcagcgggga

SEQ ID NO: 3926072 - RNA, 16 nt, Human adenovirus D
ggaccgcagcggggag

SEQ ID NO: 3926073 - RNA, 16 nt, Human adenovirus D
ggacgacgaggacucg

SEQ ID NO: 3926074 - RNA, 18 nt, Human adenovirus D
ggacgggcgcccagugcu

SEQ ID NO: 3926075 - RNA, 13 nt, Human adenovirus D
ggacuaccugcau

SEQ ID NO: 3926076 - RNA, 17 nt, Human adenovirus D
ggacuauccuugcagac

SEQ ID NO: 3926077 - RNA, 16 nt, Human adenovirus D
ggacucacccuggggc

SEQ ID NO: 3926078 - RNA, 22 nt, Human adenovirus D
ggacugguuccucguccagaug

SEQ ID NO: 3926079 - RNA, 17 nt, Human adenovirus D
ggacuucacagagagcc

SEQ ID NO: 3926080 - RNA, 19 nt, Human adenovirus D
ggagacuuucauccaucug

SEQ ID NO: 3926081 - RNA, 18 nt, Human adenovirus D
ggagaggcauggcaggca

SEQ ID NO: 3926082 - RNA, 20 nt, Human adenovirus D
ggagaucacuagcgugagcc

SEQ ID NO: 3926083 - RNA, 20 nt, Human adenovirus D
ggagauuuacggaccacccc

SEQ ID NO: 3926084 - RNA, 22 nt, Human adenovirus D
ggagcaggguaaagccagcagc

SEQ ID NO: 3926085 - RNA, 20 nt, Human adenovirus D
ggagccaagaaacgucccag

SEQ ID NO: 3926086 - RNA, 14 nt, Human adenovirus D
ggagccagguccag

SEQ ID NO: 3926087 - RNA, 15 nt, Human adenovirus D
ggagcccacccgcug

SEQ ID NO: 3926088 - RNA, 17 nt, Human adenovirus D
ggagccgcucggccaug

SEQ ID NO: 3926089 - RNA, 17 nt, Human adenovirus D
ggagccugaugagcucg

SEQ ID NO: 3926090 - RNA, 18 nt, Human adenovirus D
ggagccugaugagcucgg

SEQ ID NO: 3926091 - RNA, 21 nt, Human adenovirus D
ggagcgaggugugcgucaggg

SEQ ID NO: 3926092 - RNA, 15 nt, Human adenovirus D
ggagcggucuggacc

SEQ ID NO: 3926093 - RNA, 19 nt, Human adenovirus D
ggagcucuugcagggaagc

SEQ ID NO: 3926094 - RNA, 15 nt, Human adenovirus D
ggagcugaccaacug

SEQ ID NO: 3926095 - RNA, 15 nt, Human adenovirus D
ggaggaccagguccu

SEQ ID NO: 3926096 - RNA, 21 nt, Human adenovirus D
ggaggagaccgacgcugggcu

SEQ ID NO: 3926097 - RNA, 16 nt, Human adenovirus D
ggaggaugcacccgcu

SEQ ID NO: 3926098 - RNA, 21 nt, Human adenovirus D
ggaggcaccaucacaggaggc

SEQ ID NO: 3926099 - RNA, 20 nt, Human adenovirus D
ggaggccaucgugcagaacc

SEQ ID NO: 3926100 - RNA, 19 nt, Human adenovirus D
ggaggccgugaaggccggc

SEQ ID NO: 3926101 - RNA, 14 nt, Human adenovirus D
ggaggcgaagaugg

SEQ ID NO: 3926102 - RNA, 17 nt, Human adenovirus D
ggaggcgguccccgccc

SEQ ID NO: 3926103 - RNA, 21 nt, Human adenovirus D
ggaggcgguccccgcccagcg

SEQ ID NO: 3926104 - RNA, 15 nt, Human adenovirus D
ggaggcggugcgcac

SEQ ID NO: 3926105 - RNA, 24 nt, Human adenovirus D
ggaggcguacaugccgcaaauguc

SEQ ID NO: 3926106 - RNA, 17 nt, Human adenovirus D
ggaggcgugcacuggcu

SEQ ID NO: 3926107 - RNA, 15 nt, Human adenovirus D
ggagggauugcaggg

SEQ ID NO: 3926108 - RNA, 18 nt, Human adenovirus D
ggaguaccugagcccggg

SEQ ID NO: 3926109 - RNA, 17 nt, Human adenovirus D
ggagucuugcagcuugg

SEQ ID NO: 3926110 - RNA, 19 nt, Human adenovirus D
ggaucuagaagggggcaac

SEQ ID NO: 3926111 - RNA, 11 nt, Human adenovirus D
ggaucuucccc

SEQ ID NO: 3926112 - RNA, 23 nt, Human adenovirus D
ggaugaaccuuuggaccugagcu

SEQ ID NO: 3926113 - RNA, 23 nt, Human adenovirus D
ggcaacauccccgcccugcugga

SEQ ID NO: 3926114 - RNA, 17 nt, Human adenovirus D
ggcaagagucugaagcc

SEQ ID NO: 3926115 - RNA, 15 nt, Human adenovirus D
ggcacagacgaagaa

SEQ ID NO: 3926116 - RNA, 16 nt, Human adenovirus D
ggcacggcacgcggcc

SEQ ID NO: 3926117 - RNA, 14 nt, Human adenovirus D
ggcacggcgguggu

SEQ ID NO: 3926118 - RNA, 13 nt, Human adenovirus D
ggcacuggagcac

SEQ ID NO: 3926119 - RNA, 17 nt, Human adenovirus D
ggcagcggggacagaga

SEQ ID NO: 3926120 - RNA, 14 nt, Human adenovirus D
ggcagcggggccug

SEQ ID NO: 3926121 - RNA, 15 nt, Human adenovirus D
ggcagggagcugcgc

SEQ ID NO: 3926122 - RNA, 16 nt, Human adenovirus D
ggcaggggcggcagag

SEQ ID NO: 3926123 - RNA, 15 nt, Human adenovirus D
ggcagggugagccgg

SEQ ID NO: 3926124 - RNA, 21 nt, Human adenovirus D
ggcaguauaucaggugccugc

SEQ ID NO: 3926125 - RNA, 13 nt, Human adenovirus D
ggcagugcagcgc

SEQ ID NO: 3926126 - RNA, 20 nt, Human adenovirus D
ggcauggcaggcagcggccu

SEQ ID NO: 3926127 - RNA, 18 nt, Human adenovirus D
ggcaugggucaggcagcg

SEQ ID NO: 3926128 - RNA, 20 nt, Human adenovirus D
ggcauuggagaaugcugcua

SEQ ID NO: 3926129 - RNA, 14 nt, Human adenovirus D
ggccaaccugguga

SEQ ID NO: 3926130 - RNA, 13 nt, Human adenovirus D
ggccaaggccacc

SEQ ID NO: 3926131 - RNA, 14 nt, Human adenovirus D
ggccaaucagcagu

SEQ ID NO: 3926132 - RNA, 13 nt, Human adenovirus D
ggccaccucgccg

SEQ ID NO: 3926133 - RNA, 22 nt, Human adenovirus D
ggccaccucgccgcgcaggggc

SEQ ID NO: 3926134 - RNA, 23 nt, Human adenovirus D
ggccacguugcgguacugguacu

SEQ ID NO: 3926135 - RNA, 15 nt, Human adenovirus D
ggccagucugaugaa

SEQ ID NO: 3926136 - RNA, 18 nt, Human adenovirus D
ggcccaaugcaacaugac

SEQ ID NO: 3926137 - RNA, 22 nt, Human adenovirus D
ggccccgccaaccggcugaugc

SEQ ID NO: 3926138 - RNA, 18 nt, Human adenovirus D
ggccccgcgggcaggggc

SEQ ID NO: 3926139 - RNA, 16 nt, Human adenovirus D
ggcccgggacggaggc

SEQ ID NO: 3926140 - RNA, 15 nt, Human adenovirus D
ggcccuggagcagcg

SEQ ID NO: 3926141 - RNA, 20 nt, Human adenovirus D
ggccgagaagguggcggcaa

SEQ ID NO: 3926142 - RNA, 17 nt, Human adenovirus D
ggccgagaccgugagcu

SEQ ID NO: 3926143 - RNA, 16 nt, Human adenovirus D
  misc_feature (7)..(7): n is a, c, g or u
ggccgangggagucgc

SEQ ID NO: 3926144 - RNA, 14 nt, Human adenovirus D
ggccgcagcucuuc

SEQ ID NO: 3926145 - RNA, 21 nt, Human adenovirus D
ggccgcccugacccagcaggu

SEQ ID NO: 3926146 - RNA, 19 nt, Human adenovirus D
ggccgccuuuagguguugc

SEQ ID NO: 3926147 - RNA, 18 nt, Human adenovirus D
ggccgcgagaccggaggc

SEQ ID NO: 3926148 - RNA, 13 nt, Human adenovirus D
ggccguagcaggc

SEQ ID NO: 3926149 - RNA, 14 nt, Human adenovirus D
ggccguuggaagau

SEQ ID NO: 3926150 - RNA, 22 nt, Human adenovirus D
ggccuacuacuccugaucagaa

SEQ ID NO: 3926151 - RNA, 19 nt, Human adenovirus D
ggccugaaccgccgccggc

SEQ ID NO: 3926152 - RNA, 18 nt, Human adenovirus D
ggccugggcgugcagacc

SEQ ID NO: 3926153 - RNA, 13 nt, Human adenovirus D
ggccuguccugca

SEQ ID NO: 3926154 - RNA, 20 nt, Human adenovirus D
ggcgacaacgccaggcuggc

SEQ ID NO: 3926155 - RNA, 18 nt, Human adenovirus D
ggcgaugggcccgugggc

SEQ ID NO: 3926156 - RNA, 16 nt, Human adenovirus D
ggcgcaaccaggagga

SEQ ID NO: 3926157 - RNA, 21 nt, Human adenovirus D
ggcgcaagcucaugcuggccg

SEQ ID NO: 3926158 - RNA, 23 nt, Human adenovirus D
ggcgcaagcucaugcuggccgug

SEQ ID NO: 3926159 - RNA, 23 nt, Human adenovirus D
ggcgcacaacaccgccuccaccc

SEQ ID NO: 3926160 - RNA, 17 nt, Human adenovirus D
ggcgcccgugggcgacc

SEQ ID NO: 3926161 - RNA, 17 nt, Human adenovirus D
ggcgccgagcucaugcc

SEQ ID NO: 3926162 - RNA, 19 nt, Human adenovirus D
ggcgccgcccgagcucugc

SEQ ID NO: 3926163 - RNA, 21 nt, Human adenovirus D
ggcgccgcccgagcucugcug

SEQ ID NO: 3926164 - RNA, 20 nt, Human adenovirus D
ggcgccuucaauuggagcag

SEQ ID NO: 3926165 - RNA, 21 nt, Human adenovirus D
ggcgcgcuccuuggccgcgau

SEQ ID NO: 3926166 - RNA, 14 nt, Human adenovirus D
ggcgcugcaaagcc

SEQ ID NO: 3926167 - RNA, 17 nt, Human adenovirus D
ggcgcugcaaagccagc

SEQ ID NO: 3926168 - RNA, 18 nt, Human adenovirus D
ggcgcugcaaagccagcc

SEQ ID NO: 3926169 - RNA, 17 nt, Human adenovirus D
ggcgcugggcguggugc

SEQ ID NO: 3926170 - RNA, 20 nt, Human adenovirus D
ggcggaacugcuggcccacg

SEQ ID NO: 3926171 - RNA, 19 nt, Human adenovirus D
ggcggacaucgcuucccug

SEQ ID NO: 3926172 - RNA, 21 nt, Human adenovirus D
ggcggaccugcauuggcagcc

SEQ ID NO: 3926173 - RNA, 21 nt, Human adenovirus D
ggcggacugccaccgccgccg

SEQ ID NO: 3926174 - RNA, 22 nt, Human adenovirus D
ggcggacugccaccgccgccgc

SEQ ID NO: 3926175 - RNA, 23 nt, Human adenovirus D
ggcggaggcguacaugccgcaaa

SEQ ID NO: 3926176 - RNA, 12 nt, Human adenovirus D
ggcggagggugc

SEQ ID NO: 3926177 - RNA, 20 nt, Human adenovirus D
ggcggagggugccagauugg

SEQ ID NO: 3926178 - RNA, 11 nt, Human adenovirus D
ggcggcagagc

SEQ ID NO: 3926179 - RNA, 17 nt, Human adenovirus D
ggcggcgcugcaaagcc

SEQ ID NO: 3926180 - RNA, 16 nt, Human adenovirus D
ggcgggcagggagcug

SEQ ID NO: 3926181 - RNA, 13 nt, Human adenovirus D
ggcggugcugcug

SEQ ID NO: 3926182 - RNA, 17 nt, Human adenovirus D
ggcgguuccggccccgc

SEQ ID NO: 3926183 - RNA, 13 nt, Human adenovirus D
ggcguacaugcac

SEQ ID NO: 3926184 - RNA, 14 nt, Human adenovirus D
ggcgucgcagcgcc

SEQ ID NO: 3926185 - RNA, 20 nt, Human adenovirus D
ggcgugcgaguuggaggaga

SEQ ID NO: 3926186 - RNA, 22 nt, Human adenovirus D
ggcguggcccuuggcgcggagc

SEQ ID NO: 3926187 - RNA, 17 nt, Human adenovirus D
ggcguucagggaggcgc

SEQ ID NO: 3926188 - RNA, 18 nt, Human adenovirus D
ggcguuuuugaggcggcg

SEQ ID NO: 3926189 - RNA, 18 nt, Human adenovirus D
ggcuaccuugcacccacc

SEQ ID NO: 3926190 - RNA, 15 nt, Human adenovirus D
ggcuccgcggcacgg

SEQ ID NO: 3926191 - RNA, 20 nt, Human adenovirus D
ggcuccuacggagggcagaa

SEQ ID NO: 3926192 - RNA, 20 nt, Human adenovirus D
ggcuccucgaggacggagag

SEQ ID NO: 3926193 - RNA, 19 nt, Human adenovirus D
ggcucggugcggcugcugc

SEQ ID NO: 3926194 - RNA, 20 nt, Human adenovirus D
ggcugaaucccacucccaca

SEQ ID NO: 3926195 - RNA, 21 nt, Human adenovirus D
ggcugcauccacugcuccugc

SEQ ID NO: 3926196 - RNA, 11 nt, Human adenovirus D
ggcugcugcug

SEQ ID NO: 3926197 - RNA, 12 nt, Human adenovirus D
ggcugcuggagc

SEQ ID NO: 3926198 - RNA, 22 nt, Human adenovirus D
ggcugggcgcuugcaagggugc

SEQ ID NO: 3926199 - RNA, 17 nt, Human adenovirus D
ggcuucaccggcuaccu

SEQ ID NO: 3926200 - RNA, 22 nt, Human adenovirus D
ggcuuuuccugaugcaggaggg

SEQ ID NO: 3926201 - RNA, 22 nt, Human adenovirus D
gggaaaggaauaggcacugaaa

SEQ ID NO: 3926202 - RNA, 16 nt, Human adenovirus D
gggaacggggcagagg

SEQ ID NO: 3926203 - RNA, 13 nt, Human adenovirus D
gggaagagcccuu

SEQ ID NO: 3926204 - RNA, 19 nt, Human adenovirus D
gggacgacguggacagcgc

SEQ ID NO: 3926205 - RNA, 21 nt, Human adenovirus D
gggagacggucgacgaagcgc

SEQ ID NO: 3926206 - RNA, 11 nt, Human adenovirus D
gggagagcugc

SEQ ID NO: 3926207 - RNA, 15 nt, Human adenovirus D
gggaugaacaguggc

SEQ ID NO: 3926208 - RNA, 14 nt, Human adenovirus D
gggcacagccucuc

SEQ ID NO: 3926209 - RNA, 19 nt, Human adenovirus D
gggcagcgagagggcgcug

SEQ ID NO: 3926210 - RNA, 22 nt, Human adenovirus D
gggcaucucgcugaugucgccg

SEQ ID NO: 3926211 - RNA, 15 nt, Human adenovirus D
gggcaugagcccguc

SEQ ID NO: 3926212 - RNA, 16 nt, Human adenovirus D
gggcaugggucaggca

SEQ ID NO: 3926213 - RNA, 19 nt, Human adenovirus D
gggccccgccaaccggcug

SEQ ID NO: 3926214 - RNA, 12 nt, Human adenovirus D
gggcccgacucc

SEQ ID NO: 3926215 - RNA, 20 nt, Human adenovirus D
aucaccaguuugggcacugg

SEQ ID NO: 3926216 - RNA, 13 nt, Human adenovirus D
aucacccagggcg

SEQ ID NO: 3926217 - RNA, 14 nt, Human adenovirus D
aucagaaacacaga

SEQ ID NO: 3926218 - RNA, 14 nt, Human adenovirus D
aucagacaugcugc

SEQ ID NO: 3926219 - RNA, 15 nt, Human adenovirus D
aucagacaugcugcu

SEQ ID NO: 3926220 - RNA, 19 nt, Human adenovirus D
aucagcaguagccccgccc

SEQ ID NO: 3926221 - RNA, 18 nt, Human adenovirus D
aucauuauuuucauaugc

SEQ ID NO: 3926222 - RNA, 21 nt, Human adenovirus D
auccacaaggccgugagcgcg

SEQ ID NO: 3926223 - RNA, 12 nt, Human adenovirus D
auccacugcucc

SEQ ID NO: 3926224 - RNA, 16 nt, Human adenovirus D
caauguuacgcugccc

SEQ ID NO: 3926225 - RNA, 15 nt, Human adenovirus D
cacaacaccgccucc

SEQ ID NO: 3926226 - RNA, 14 nt, Human adenovirus D
cacaaucacggcau

SEQ ID NO: 3926227 - RNA, 15 nt, Human adenovirus D
cacacaguuuccuga

SEQ ID NO: 3926228 - RNA, 19 nt, Human adenovirus D
cacaccaggaugcagccag

SEQ ID NO: 3926229 - RNA, 14 nt, Human adenovirus D
cacacuagaaagca

SEQ ID NO: 3926230 - RNA, 21 nt, Human adenovirus D
cacacuagaaagcaguucacu

SEQ ID NO: 3926231 - RNA, 18 nt, Human adenovirus D
cacacuuaguucagcugc

SEQ ID NO: 3926232 - RNA, 20 nt, Human adenovirus D
cacacuuuugguuucaaauu

SEQ ID NO: 3926233 - RNA, 18 nt, Human adenovirus D
cacagaccuucagggagu

SEQ ID NO: 3926234 - RNA, 21 nt, Human adenovirus D
cacagcgauucccgggcuuuc

SEQ ID NO: 3926235 - RNA, 16 nt, Human adenovirus D
cacaggaggcacagac

SEQ ID NO: 3926236 - RNA, 13 nt, Human adenovirus D
cacaggugcugcc

SEQ ID NO: 3926237 - RNA, 20 nt, Human adenovirus D
cacaggugcugcccacccuc

SEQ ID NO: 3926238 - RNA, 18 nt, Human adenovirus D
cacaguaagugcagcaca

SEQ ID NO: 3926239 - RNA, 15 nt, Human adenovirus D
cacaguaaguuccug

SEQ ID NO: 3926240 - RNA, 14 nt, Human adenovirus D
cacaguagucauca

SEQ ID NO: 3926241 - RNA, 19 nt, Human adenovirus D
cacaguagucaucaaaugc

SEQ ID NO: 3926242 - RNA, 23 nt, Human adenovirus D
cacagucaacuguuaagaccacu

SEQ ID NO: 3926243 - RNA, 21 nt, Human adenovirus D
cacaguuauaccaccuccucc

SEQ ID NO: 3926244 - RNA, 15 nt, Human adenovirus D
cacaucggacugggu

SEQ ID NO: 3926245 - RNA, 15 nt, Human adenovirus D
cacauggcaagcugc

SEQ ID NO: 3926246 - RNA, 12 nt, Human adenovirus D
caccaaggccau

SEQ ID NO: 3926247 - RNA, 21 nt, Human adenovirus D
caccacgcuucuuccccagcg

SEQ ID NO: 3926248 - RNA, 13 nt, Human adenovirus D
caccagccagcug

SEQ ID NO: 3926249 - RNA, 23 nt, Human adenovirus D
caccaggacgguguagcccgugc

SEQ ID NO: 3926250 - RNA, 22 nt, Human adenovirus D
caccaguuggacgaguggcugu

SEQ ID NO: 3926251 - RNA, 22 nt, Human adenovirus D
caccauguuauucagcagccca

SEQ ID NO: 3926252 - RNA, 19 nt, Human adenovirus D
cacccaacugagcaggggc

SEQ ID NO: 3926253 - RNA, 15 nt, Human adenovirus D
cacccacgacacagc

SEQ ID NO: 3926254 - RNA, 13 nt, Human adenovirus D
caccccccgcagg

SEQ ID NO: 3926255 - RNA, 21 nt, Human adenovirus D
caccccuuacauguggagcua

SEQ ID NO: 3926256 - RNA, 22 nt, Human adenovirus D
cacccgcgccgacgcgcuccuc

SEQ ID NO: 3926257 - RNA, 22 nt, Human adenovirus D
cacccucagaagaagaccaccc

SEQ ID NO: 3926258 - RNA, 14 nt, Human adenovirus D
cacccugcccuucc

SEQ ID NO: 3926259 - RNA, 20 nt, Human adenovirus D
cacccuggaagccaugcugc

SEQ ID NO: 3926260 - RNA, 17 nt, Human adenovirus D
caccgagucucaccugg

SEQ ID NO: 3926261 - RNA, 15 nt, Human adenovirus D
caccgcuccuggucu

SEQ ID NO: 3926262 - RNA, 20 nt, Human adenovirus D
caccggcuaccuugcaccca

SEQ ID NO: 3926263 - RNA, 19 nt, Human adenovirus D
caccguuccaugcagacac

SEQ ID NO: 3926264 - RNA, 13 nt, Human adenovirus D
caccuagaccacu

SEQ ID NO: 3926265 - RNA, 15 nt, Human adenovirus D
caccugcaccugcgu

SEQ ID NO: 3926266 - RNA, 18 nt, Human adenovirus D
caccugcgagcccaaccc

SEQ ID NO: 3926267 - RNA, 16 nt, Human adenovirus D
caccugggcgccagaa

SEQ ID NO: 3926268 - RNA, 17 nt, Human adenovirus D
caccugugggaccuggc

SEQ ID NO: 3926269 - RNA, 15 nt, Human adenovirus D
caccuucaagaaagu

SEQ ID NO: 3926270 - RNA, 13 nt, Human adenovirus D
caccuuccagccg

SEQ ID NO: 3926271 - RNA, 14 nt, Human adenovirus D
cacgagaaggugcu

SEQ ID NO: 3926272 - RNA, 21 nt, Human adenovirus D
cacgagcaagacgcaggccag

SEQ ID NO: 3926273 - RNA, 22 nt, Human adenovirus D
cacgagcgccaggucggcgacg

SEQ ID NO: 3926274 - RNA, 21 nt, Human adenovirus D
cacgcacgagaaggugcuggc

SEQ ID NO: 3926275 - RNA, 18 nt, Human adenovirus D
cacgccaccacccacacc

SEQ ID NO: 3926276 - RNA, 14 nt, Human adenovirus D
cacgcccugggugu

SEQ ID NO: 3926277 - RNA, 15 nt, Human adenovirus D
cacgccgagccugaa

SEQ ID NO: 3926278 - RNA, 23 nt, Human adenovirus D
cacgccgagccugaagcccguga

SEQ ID NO: 3926279 - RNA, 23 nt, Human adenovirus D
cacgcggaucucacggccugcgu

SEQ ID NO: 3926280 - RNA, 12 nt, Human adenovirus D
cacgcgggugag

SEQ ID NO: 3926281 - RNA, 16 nt, Human adenovirus D
cacggccuuguaggga

SEQ ID NO: 3926282 - RNA, 18 nt, Human adenovirus D
cacgggguugcagcacug

SEQ ID NO: 3926283 - RNA, 14 nt, Human adenovirus D
cacgguaagagccc

SEQ ID NO: 3926284 - RNA, 19 nt, Human adenovirus D
cacuacuaauucucaaagu

SEQ ID NO: 3926285 - RNA, 15 nt, Human adenovirus D
cacuacucagcuucu

SEQ ID NO: 3926286 - RNA, 17 nt, Human adenovirus D
cacuagcgcccugguag

SEQ ID NO: 3926287 - RNA, 16 nt, Human adenovirus D
cacucaaacuggcuga

SEQ ID NO: 3926288 - RNA, 14 nt, Human adenovirus D
cacucuuuccagca

SEQ ID NO: 3926289 - RNA, 18 nt, Human adenovirus D
cacugacuuagcucccua

SEQ ID NO: 3926290 - RNA, 13 nt, Human adenovirus D
cacugcaaauuua

SEQ ID NO: 3926291 - RNA, 17 nt, Human adenovirus D
cacugcaccccccgcag

SEQ ID NO: 3926292 - RNA, 18 nt, Human adenovirus D
cacugcagggagccaggg

SEQ ID NO: 3926293 - RNA, 19 nt, Human adenovirus D
cacugcccauauacaugau

SEQ ID NO: 3926294 - RNA, 13 nt, Human adenovirus D
cacugccgccgcc

SEQ ID NO: 3926295 - RNA, 22 nt, Human adenovirus D
cacugccgccgccugcgcugcu

SEQ ID NO: 3926296 - RNA, 19 nt, Human adenovirus D
cacugcucuucccuggaga

SEQ ID NO: 3926297 - RNA, 15 nt, Human adenovirus D
cacuggcucgccuuc

SEQ ID NO: 3926298 - RNA, 20 nt, Human adenovirus D
cacuuccuuuaccuucuccu

SEQ ID NO: 3926299 - RNA, 16 nt, Human adenovirus D
cacuugccgccugcgc

SEQ ID NO: 3926300 - RNA, 18 nt, Human adenovirus D
cacuuuugcccuuacaug

SEQ ID NO: 3926301 - RNA, 17 nt, Human adenovirus D
cagaaagaaguggccag

SEQ ID NO: 3926302 - RNA, 11 nt, Human adenovirus D
cagaacaaaaa

SEQ ID NO: 3926303 - RNA, 14 nt, Human adenovirus D
cagaacaaaaacag

SEQ ID NO: 3926304 - RNA, 19 nt, Human adenovirus D
cagaacccggacagcaagc

SEQ ID NO: 3926305 - RNA, 19 nt, Human adenovirus D
cagaaggggcaccuuccag

SEQ ID NO: 3926306 - RNA, 16 nt, Human adenovirus D
cagaaguucaccugca

SEQ ID NO: 3926307 - RNA, 12 nt, Human adenovirus D
cagacagccagg

SEQ ID NO: 3926308 - RNA, 16 nt, Human adenovirus D
cagacagggccugcaa

SEQ ID NO: 3926309 - RNA, 17 nt, Human adenovirus D
cagaccgaccccuggcu

SEQ ID NO: 3926310 - RNA, 16 nt, Human adenovirus D
cagaccuucagggagu

SEQ ID NO: 3926311 - RNA, 24 nt, Human adenovirus D
cagacgauaaauuuugacgagcgg

SEQ ID NO: 3926312 - RNA, 13 nt, Human adenovirus D
cagacgcugaaag

SEQ ID NO: 3926313 - RNA, 13 nt, Human adenovirus D
cagagagauggcu

SEQ ID NO: 3926314 - RNA, 22 nt, Human adenovirus D
cagagauggacuuggaagaggg

SEQ ID NO: 3926315 - RNA, 11 nt, Human adenovirus D
cagagccaggg

SEQ ID NO: 3926316 - RNA, 13 nt, Human adenovirus D
cagagcucgguga

SEQ ID NO: 3926317 - RNA, 19 nt, Human adenovirus D
cagaggacuuggaugagga

SEQ ID NO: 3926318 - RNA, 18 nt, Human adenovirus D
cagagggggcgguggcag

SEQ ID NO: 3926319 - RNA, 14 nt, Human adenovirus D
cagaguaagaggag

SEQ ID NO: 3926320 - RNA, 22 nt, Human adenovirus D
cagcaagccucugacggcgcag

SEQ ID NO: 3926321 - RNA, 23 nt, Human adenovirus D
cagcaaguuuaaggcgcggguga

SEQ ID NO: 3926322 - RNA, 22 nt, Human adenovirus D
cagcagaaauuucaagcugggc

SEQ ID NO: 3926323 - RNA, 20 nt, Human adenovirus D
cagcagcacaugguaaucca

SEQ ID NO: 3926324 - RNA, 11 nt, Human adenovirus D
cagcagcaccu

SEQ ID NO: 3926325 - RNA, 13 nt, Human adenovirus D
cagcagcaggagc

SEQ ID NO: 3926326 - RNA, 22 nt, Human adenovirus D
cagcagcauguacggaggagcc

SEQ ID NO: 3926327 - RNA, 15 nt, Human adenovirus D
cagcaggagugcagg

SEQ ID NO: 3926328 - RNA, 15 nt, Human adenovirus D
cagcaggugcugccc

SEQ ID NO: 3926329 - RNA, 15 nt, Human adenovirus D
cagccaguggcccug

SEQ ID NO: 3926330 - RNA, 16 nt, Human adenovirus D
cagcccaaacuggggc

SEQ ID NO: 3926331 - RNA, 18 nt, Human adenovirus D
cagcccauuucacagugu

SEQ ID NO: 3926332 - RNA, 14 nt, Human adenovirus D
cagccgccaugaca

SEQ ID NO: 3926333 - RNA, 14 nt, Human adenovirus D
cagccgcggcagcc

SEQ ID NO: 3926334 - RNA, 21 nt, Human adenovirus D
cagccgucuggacccgcggcc

SEQ ID NO: 3926335 - RNA, 18 nt, Human adenovirus D
cagccgugaucccacagg

SEQ ID NO: 3926336 - RNA, 23 nt, Human adenovirus D
agcucaaacacguagcagcccug

SEQ ID NO: 3926337 - RNA, 16 nt, Human adenovirus D
agcucaaagaccagaa

SEQ ID NO: 3926338 - RNA, 22 nt, Human adenovirus D
agcucccacagugcccccucca

SEQ ID NO: 3926339 - RNA, 19 nt, Human adenovirus D
agcugaccaacuggucucc

SEQ ID NO: 3926340 - RNA, 18 nt, Human adenovirus D
agcugcaaaaagucacuu

SEQ ID NO: 3926341 - RNA, 13 nt, Human adenovirus D
agcugcgaggaga

SEQ ID NO: 3926342 - RNA, 18 nt, Human adenovirus D
agcuggacaagcuucuug

SEQ ID NO: 3926343 - RNA, 22 nt, Human adenovirus D
agcuugguggcaaaggagccau

SEQ ID NO: 3926344 - RNA, 19 nt, Human adenovirus D
aggaaacuaggcgcagcug

SEQ ID NO: 3926345 - RNA, 19 nt, Human adenovirus D
aggaauaggcacugaaaau

SEQ ID NO: 3926346 - RNA, 19 nt, Human adenovirus D
aggaauugguauaagugua

SEQ ID NO: 3926347 - RNA, 18 nt, Human adenovirus D
aggacgagaccagaggca

SEQ ID NO: 3926348 - RNA, 16 nt, Human adenovirus D
aggacgaguaccugaa

SEQ ID NO: 3926349 - RNA, 21 nt, Human adenovirus D
cagcaacuaccccguggucgg

SEQ ID NO: 3926350 - RNA, 15 nt, Human adenovirus D
cagcaagagcucaaa

SEQ ID NO: 3926351 - RNA, 19 nt, Human adenovirus D
cagcaagccccggaccccg

SEQ ID NO: 3926352 - RNA, 21 nt, Human adenovirus D
cagcaagccucugacggcgca

SEQ ID NO: 3926353 - RNA, 14 nt, Human adenovirus D
ggaugaggaagagg

SEQ ID NO: 3926354 - RNA, 15 nt, Human adenovirus D
ggaugcgugagggcg

SEQ ID NO: 3926355 - RNA, 17 nt, Human adenovirus D
ggaugcgugagggcgga

SEQ ID NO: 3926356 - RNA, 18 nt, Human adenovirus D
ggaugguuuacaauuuug

SEQ ID NO: 3926357 - RNA, 22 nt, Human adenovirus D
ggauguaaguuuuauggcugcu

SEQ ID NO: 3926358 - RNA, 20 nt, Human adenovirus D
ggaugucaaauuccuggucc

SEQ ID NO: 3926359 - RNA, 23 nt, Human adenovirus D
ggauuaaaaauauuagaugacaa

SEQ ID NO: 3926360 - RNA, 22 nt, Human adenovirus D
ggauucaaaaacuuccccccug

SEQ ID NO: 3926361 - RNA, 22 nt, Human adenovirus D
ggcaaaauggcgugcuggagag

SEQ ID NO: 3926362 - RNA, 20 nt, Human adenovirus D
ggcaaagcgguugagcuggg

SEQ ID NO: 3926363 - RNA, 16 nt, Human adenovirus D
accagauacuucagca

SEQ ID NO: 3926364 - RNA, 13 nt, Human adenovirus D
accagcacacuca

SEQ ID NO: 3926365 - RNA, 19 nt, Human adenovirus D
accagcaucgaggugcaga

SEQ ID NO: 3926366 - RNA, 23 nt, Human adenovirus D
accagguccacgcugguggccac

SEQ ID NO: 3926367 - RNA, 21 nt, Human adenovirus D
accaugaaggcuuucacagcu

SEQ ID NO: 3926368 - RNA, 17 nt, Human adenovirus D
accaugaauacagugau

SEQ ID NO: 3926369 - RNA, 19 nt, Human adenovirus D
accaugaccauagaccuga

SEQ ID NO: 3926370 - RNA, 21 nt, Human adenovirus D
acccaaaaccuaccacuggcu

SEQ ID NO: 3926371 - RNA, 13 nt, Human adenovirus D
acccacaccgccu

SEQ ID NO: 3926372 - RNA, 22 nt, Human adenovirus D
acccacgugguauacaagccag

SEQ ID NO: 3926373 - RNA, 18 nt, Human adenovirus D
accccaggcggaccagaa

SEQ ID NO: 3926374 - RNA, 20 nt, Human adenovirus D
accccaucccggccaaggcc

SEQ ID NO: 3926375 - RNA, 19 nt, Human adenovirus D
accccuggcucccagccuc

SEQ ID NO: 3926376 - RNA, 20 nt, Human adenovirus D
accccuggcucccagccucc

SEQ ID NO: 3926377 - RNA, 23 nt, Human adenovirus D
accccuuuggguucucggaccgc

SEQ ID NO: 3926378 - RNA, 14 nt, Human adenovirus D
acccgcucaccauc

SEQ ID NO: 3926379 - RNA, 21 nt, Human adenovirus D
acccuaaggcucccuugcaac

SEQ ID NO: 3926380 - RNA, 21 nt, Human adenovirus D
accgacacguacuucagccug

SEQ ID NO: 3926381 - RNA, 16 nt, Human adenovirus D
accgacaguggcagcg

SEQ ID NO: 3926382 - RNA, 14 nt, Human adenovirus D
accgacauggaugu

SEQ ID NO: 3926383 - RNA, 21 nt, Human adenovirus D
accgcaacucguaccuggguc

SEQ ID NO: 3926384 - RNA, 16 nt, Human adenovirus D
accgccgccggcggcg

SEQ ID NO: 3926385 - RNA, 19 nt, Human adenovirus D
accgcgagcugaugcugag

SEQ ID NO: 3926386 - RNA, 14 nt, Human adenovirus D
accgcgccgccauc

SEQ ID NO: 3926387 - RNA, 14 nt, Human adenovirus D
accgcggucccagu

SEQ ID NO: 3926388 - RNA, 19 nt, Human adenovirus D
accgcgucgcugaaagcau

SEQ ID NO: 3926389 - RNA, 17 nt, Human adenovirus D
accgcuaccgcuuccac

SEQ ID NO: 3926390 - RNA, 17 nt, Human adenovirus D
accggaggcgugcacug

SEQ ID NO: 3926391 - RNA, 13 nt, Human adenovirus D
accggaggcuggc

SEQ ID NO: 3926392 - RNA, 12 nt, Human adenovirus D
accggcuggggu

SEQ ID NO: 3926393 - RNA, 17 nt, Human adenovirus D
accggggaggcaccacc

SEQ ID NO: 3926394 - RNA, 22 nt, Human adenovirus D
accgucgccucggaccuggccg

SEQ ID NO: 3926395 - RNA, 14 nt, Human adenovirus D
accgugaaaaugga

SEQ ID NO: 3926396 - RNA, 14 nt, Human adenovirus D
accuaccacugcca

SEQ ID NO: 3926397 - RNA, 21 nt, Human adenovirus D
accucauuugcauauuaacuu

SEQ ID NO: 3926398 - RNA, 16 nt, Human adenovirus D
accucccaccccagaa

SEQ ID NO: 3926399 - RNA, 16 nt, Human adenovirus D
accucuacgccaccuu

SEQ ID NO: 3926400 - RNA, 13 nt, Human adenovirus D
accucucggccgc

SEQ ID NO: 3926401 - RNA, 20 nt, Human adenovirus D
accugcagcaggugcugccc

SEQ ID NO: 3926402 - RNA, 22 nt, Human adenovirus D
accugcauuggcagccgagccg

SEQ ID NO: 3926403 - RNA, 12 nt, Human adenovirus D
accugccuccac

SEQ ID NO: 3926404 - RNA, 13 nt, Human adenovirus D
accugcgcgggcu

SEQ ID NO: 3926405 - RNA, 14 nt, Human adenovirus D
accugcggggcgau

SEQ ID NO: 3926406 - RNA, 22 nt, Human adenovirus D
accuuccagccguaccagugca

SEQ ID NO: 3926407 - RNA, 23 nt, Human adenovirus D
accuucuuuuugauacuaacacu

SEQ ID NO: 3926408 - RNA, 20 nt, Human adenovirus D
accuugcagagcagcucuuc

SEQ ID NO: 3926409 - RNA, 16 nt, Human adenovirus D
accuugcuuccacacu

SEQ ID NO: 3926410 - RNA, 18 nt, Human adenovirus D
accuuggcuuugcugggu

SEQ ID NO: 3926411 - RNA, 12 nt, Human adenovirus D
accuuggucaca

SEQ ID NO: 3926412 - RNA, 18 nt, Human adenovirus D
acgaacucggcggugacg

SEQ ID NO: 3926413 - RNA, 15 nt, Human adenovirus D
acgacauccuggacc

SEQ ID NO: 3926414 - RNA, 17 nt, Human adenovirus D
acgacauccuggaccag

SEQ ID NO: 3926415 - RNA, 21 nt, Human adenovirus D
acgaccacagcaacuuccuga

SEQ ID NO: 3926416 - RNA, 20 nt, Human adenovirus D
acgacugcgacuguagggca

SEQ ID NO: 3926417 - RNA, 16 nt, Human adenovirus D
acgagacgcgcgcggc

SEQ ID NO: 3926418 - RNA, 16 nt, Human adenovirus D
acgagcccgcgcggga

SEQ ID NO: 3926419 - RNA, 18 nt, Human adenovirus D
acgaggauuucgagccga

SEQ ID NO: 3926420 - RNA, 13 nt, Human adenovirus D
acgaggcagaggc

SEQ ID NO: 3926421 - RNA, 13 nt, Human adenovirus D
acgagggccuggg

SEQ ID NO: 3926422 - RNA, 14 nt, Human adenovirus D
acgagggccugggc

SEQ ID NO: 3926423 - RNA, 15 nt, Human adenovirus D
acgagggccugggcu

SEQ ID NO: 3926424 - RNA, 23 nt, Human adenovirus D
acgaugagaccaaguccagggug

SEQ ID NO: 3926425 - RNA, 19 nt, Human adenovirus D
acgcacgggccgccgggcc

SEQ ID NO: 3926426 - RNA, 21 nt, Human adenovirus D
acgcagccggcgaacgugccg

SEQ ID NO: 3926427 - RNA, 13 nt, Human adenovirus D
acgcccgcuccac

SEQ ID NO: 3926428 - RNA, 13 nt, Human adenovirus D
acgcccugggugu

SEQ ID NO: 3926429 - RNA, 23 nt, Human adenovirus D
acgccuuccuggcgacgcagccg

SEQ ID NO: 3926430 - RNA, 19 nt, Human adenovirus D
acgcgcaucaucgcgccac

SEQ ID NO: 3926431 - RNA, 14 nt, Human adenovirus D
acgcgccagccgcg

SEQ ID NO: 3926432 - RNA, 21 nt, Human adenovirus D
acgcgcugucggccgaggagg

SEQ ID NO: 3926433 - RNA, 24 nt, Human adenovirus D
acgcgcugucggccgaggaggagc

SEQ ID NO: 3926434 - RNA, 15 nt, Human adenovirus D
acgcguacauccagc

SEQ ID NO: 3926435 - RNA, 13 nt, Human adenovirus D
acgcugcccgcca

SEQ ID NO: 3926436 - RNA, 14 nt, Human adenovirus D
acgcuguaccgcag

SEQ ID NO: 3926437 - RNA, 18 nt, Human adenovirus D
acgcuguaccgcagcugg

SEQ ID NO: 3926438 - RNA, 21 nt, Human adenovirus D
acggaccggucccagcgucug

SEQ ID NO: 3926439 - RNA, 23 nt, Human adenovirus D
acggcaugggaugcgugagggcg

SEQ ID NO: 3926440 - RNA, 21 nt, Human adenovirus D
acggccggccgcgagaccgga

SEQ ID NO: 3926441 - RNA, 18 nt, Human adenovirus D
acgggagcgagcccccuu

SEQ ID NO: 3926442 - RNA, 19 nt, Human adenovirus D
acgggcugcuucugccugg

SEQ ID NO: 3926443 - RNA, 20 nt, Human adenovirus D
acgggcugcuucugccuggu

SEQ ID NO: 3926444 - RNA, 22 nt, Human adenovirus D
agcagccgcguaagcaggagca

SEQ ID NO: 3926445 - RNA, 22 nt, Human adenovirus D
agcagcgcgcgucauggcuggu

SEQ ID NO: 3926446 - RNA, 13 nt, Human adenovirus D
agcaggcgccggc

SEQ ID NO: 3926447 - RNA, 15 nt, Human adenovirus D
agcaggggcgcuggg

SEQ ID NO: 3926448 - RNA, 21 nt, Human adenovirus D
agcaggggcgcugggcguggu

SEQ ID NO: 3926449 - RNA, 19 nt, Human adenovirus D
agcaggggcuacauucugg

SEQ ID NO: 3926450 - RNA, 17 nt, Human adenovirus D
agcaggugcugccccag

SEQ ID NO: 3926451 - RNA, 23 nt, Human adenovirus D
agcagguggcgccgggccugggc

SEQ ID NO: 3926452 - RNA, 20 nt, Human adenovirus D
agcaguccaugcccaacagg

SEQ ID NO: 3926453 - RNA, 15 nt, Human adenovirus D
agcagucucugccgc

SEQ ID NO: 3926454 - RNA, 18 nt, Human adenovirus D
agcaucagucuccuggug

SEQ ID NO: 3926455 - RNA, 23 nt, Human adenovirus D
agcaugcgcuaaacuaagguggc

SEQ ID NO: 3926456 - RNA, 20 nt, Human adenovirus D
agcauuacuauuacugccac

SEQ ID NO: 3926457 - RNA, 14 nt, Human adenovirus D
agccaaacacaccu

SEQ ID NO: 3926458 - RNA, 15 nt, Human adenovirus D
agccaaagcucaugu

SEQ ID NO: 3926459 - RNA, 14 nt, Human adenovirus D
agccaguggcccug

SEQ ID NO: 3926460 - RNA, 16 nt, Human adenovirus D
agcccaaacuggggcg

SEQ ID NO: 3926461 - RNA, 23 nt, Human adenovirus D
agcccaacggcaccugcgagccc

SEQ ID NO: 3926462 - RNA, 22 nt, Human adenovirus D
agcccgaggucaaggugcgccc

SEQ ID NO: 3926463 - RNA, 18 nt, Human adenovirus D
agcccgggucuggugcag

SEQ ID NO: 3926464 - RNA, 13 nt, Human adenovirus D
agccgccagcugg

SEQ ID NO: 3926465 - RNA, 12 nt, Human adenovirus D
agccgccugagc

SEQ ID NO: 3926466 - RNA, 19 nt, Human adenovirus D
agccgccugagcaaccucc

SEQ ID NO: 3926467 - RNA, 14 nt, Human adenovirus D
agccggcggcgcga

SEQ ID NO: 3926468 - RNA, 17 nt, Human adenovirus D
agccgugaucccacagg

SEQ ID NO: 3926469 - RNA, 15 nt, Human adenovirus D
agccucccaggaggc

SEQ ID NO: 3926470 - RNA, 22 nt, Human adenovirus D
agccucgaacaguccacccaga

SEQ ID NO: 3926471 - RNA, 22 nt, Human adenovirus D
agcgacacccccgcgugcagcu

SEQ ID NO: 3926472 - RNA, 15 nt, Human adenovirus D
agcgaccccgagacc

SEQ ID NO: 3926473 - RNA, 17 nt, Human adenovirus D
agcgaccccgagaccug

SEQ ID NO: 3926474 - RNA, 14 nt, Human adenovirus D
agcgacgaccuggg

SEQ ID NO: 3926475 - RNA, 12 nt, Human adenovirus D
agcgccagcugu

SEQ ID NO: 3926476 - RNA, 12 nt, Human adenovirus D
agcgccaggagg

SEQ ID NO: 3926477 - RNA, 12 nt, Human adenovirus D
agcgcgagccgg

SEQ ID NO: 3926478 - RNA, 18 nt, Human adenovirus D
agcgcgccgacccguggc

SEQ ID NO: 3926479 - RNA, 19 nt, Human adenovirus D
agcgcgccgacccguggcc

SEQ ID NO: 3926480 - RNA, 22 nt, Human adenovirus D
agcgcgcgucauggcuggucag

SEQ ID NO: 3926481 - RNA, 14 nt, Human adenovirus D
agcgcgcugcggcu

SEQ ID NO: 3926482 - RNA, 16 nt, Human adenovirus D
agcgcgguguuuucac

SEQ ID NO: 3926483 - RNA, 13 nt, Human adenovirus D
agcgcgugcugcg

SEQ ID NO: 3926484 - RNA, 14 nt, Human adenovirus D
agcgcgugcugcgc

SEQ ID NO: 3926485 - RNA, 12 nt, Human adenovirus D
agcggcagggcu

SEQ ID NO: 3926486 - RNA, 17 nt, Human adenovirus D
agcggccgaaaaccccg

SEQ ID NO: 3926487 - RNA, 22 nt, Human adenovirus D
agcggccugaaccgccgccggc

SEQ ID NO: 3926488 - RNA, 19 nt, Human adenovirus D
agcggcgcaagcucaugcu

SEQ ID NO: 3926489 - RNA, 16 nt, Human adenovirus D
agcggggacagagaau

SEQ ID NO: 3926490 - RNA, 22 nt, Human adenovirus D
cagagcagcucuucggagccuc

SEQ ID NO: 3926491 - RNA, 13 nt, Human adenovirus D
cagaggaagaggg

SEQ ID NO: 3926492 - RNA, 13 nt, Human adenovirus D
cagaggagggauu

SEQ ID NO: 3926493 - RNA, 20 nt, Human adenovirus D
cagagggggcgguggcagga

SEQ ID NO: 3926494 - RNA, 15 nt, Human adenovirus D
cagauccugcugcuc

SEQ ID NO: 3926495 - RNA, 20 nt, Human adenovirus D
cagauccugcugcuccacca

SEQ ID NO: 3926496 - RNA, 17 nt, Human adenovirus D
cagauggaaaggucacu

SEQ ID NO: 3926497 - RNA, 16 nt, Human adenovirus D
cagaugggccuggccg

SEQ ID NO: 3926498 - RNA, 16 nt, Human adenovirus D
cagaugguagcagcag

SEQ ID NO: 3926499 - RNA, 20 nt, Human adenovirus D
cagaugucaggaucauugaa

SEQ ID NO: 3926500 - RNA, 23 nt, Human adenovirus D
cagcaaauuccucgaccaugacc

SEQ ID NO: 3926501 - RNA, 21 nt, Human adenovirus D
cagcaacccuuccuggucgag

SEQ ID NO: 3926502 - RNA, 23 nt, Human adenovirus D
cagcaacuucauguccaugggcg

SEQ ID NO: 3926503 - RNA, 14 nt, Human adenovirus D
cagcaagccccgga

SEQ ID NO: 3926504 - RNA, 15 nt, Human adenovirus D
cagcaagccccggac

SEQ ID NO: 3926505 - RNA, 14 nt, Human adenovirus D
cagcaagccucuga

SEQ ID NO: 3926506 - RNA, 16 nt, Human adenovirus D
cagcaauaacaccggc

SEQ ID NO: 3926507 - RNA, 14 nt, Human adenovirus D
cagcacacucacuu

SEQ ID NO: 3926508 - RNA, 15 nt, Human adenovirus D
cagcacagcagggac

SEQ ID NO: 3926509 - RNA, 20 nt, Human adenovirus D
cagcacaguaaguuccuguc

SEQ ID NO: 3926510 - RNA, 13 nt, Human adenovirus D
cagcaccccgucc

SEQ ID NO: 3926511 - RNA, 18 nt, Human adenovirus D
cagcaccgcauccugauc

SEQ ID NO: 3926512 - RNA, 15 nt, Human adenovirus D
cagcagcaagagcuc

SEQ ID NO: 3926513 - RNA, 21 nt, Human adenovirus D
cagcagcccuucuccacgggg

SEQ ID NO: 3926514 - RNA, 17 nt, Human adenovirus D
cagcaggagcgugccgc

SEQ ID NO: 3926515 - RNA, 18 nt, Human adenovirus D
cagcaggagcgugccgcc

SEQ ID NO: 3926516 - RNA, 14 nt, Human adenovirus D
cagcaggagugcag

SEQ ID NO: 3926517 - RNA, 22 nt, Human adenovirus D
cagcaggguacccacugggugg

SEQ ID NO: 3926518 - RNA, 14 nt, Human adenovirus D
cagcaggugcugcc

SEQ ID NO: 3926519 - RNA, 20 nt, Human adenovirus D
cagcaggugcugccccaggc

SEQ ID NO: 3926520 - RNA, 18 nt, Human adenovirus D
cagcaguacaagcgccaa

SEQ ID NO: 3926521 - RNA, 15 nt, Human adenovirus D
cagcaguagccccgc

SEQ ID NO: 3926522 - RNA, 17 nt, Human adenovirus D
cagcagucucugccgcc

SEQ ID NO: 3926523 - RNA, 22 nt, Human adenovirus D
cagcagugucucgaggacgaga

SEQ ID NO: 3926524 - RNA, 20 nt, Human adenovirus D
cagcaucagucuccuggugc

SEQ ID NO: 3926525 - RNA, 20 nt, Human adenovirus D
cagccacagacagagaugga

SEQ ID NO: 3926526 - RNA, 13 nt, Human adenovirus D
cagccacagccac

SEQ ID NO: 3926527 - RNA, 21 nt, Human adenovirus D
cagccacaugacccugcaugg

SEQ ID NO: 3926528 - RNA, 12 nt, Human adenovirus D
cagccagcagaa

SEQ ID NO: 3926529 - RNA, 20 nt, Human adenovirus D
cagccaguggcccuggaugu

SEQ ID NO: 3926530 - RNA, 20 nt, Human adenovirus D
cagcccaacggcaccugcga

SEQ ID NO: 3926531 - RNA, 20 nt, Human adenovirus D
cagcccauaauucagggugc

SEQ ID NO: 3926532 - RNA, 14 nt, Human adenovirus D
cagcccaugagcag

SEQ ID NO: 3926533 - RNA, 12 nt, Human adenovirus D
cagccgcaggcc

SEQ ID NO: 3926534 - RNA, 13 nt, Human adenovirus D
cagccgcaggcca

SEQ ID NO: 3926535 - RNA, 21 nt, Human adenovirus D
cagccgcaggcgcccagccag

SEQ ID NO: 3926536 - RNA, 19 nt, Human adenovirus D
cagccgcguaagcaggagc

SEQ ID NO: 3926537 - RNA, 21 nt, Human adenovirus D
cagccgugaucccacagggca

SEQ ID NO: 3926538 - RNA, 12 nt, Human adenovirus D
cagccuucagca

SEQ ID NO: 3926539 - RNA, 17 nt, Human adenovirus D
cagccuugcccccaagg

SEQ ID NO: 3926540 - RNA, 13 nt, Human adenovirus D
cagcgagaggagc

SEQ ID NO: 3926541 - RNA, 20 nt, Human adenovirus D
cagcgccacgaccggcagcg

SEQ ID NO: 3926542 - RNA, 22 nt, Human adenovirus D
cagcgcccucagcagucucugc

SEQ ID NO: 3926543 - RNA, 15 nt, Human adenovirus D
cagcgccgcgcugga

SEQ ID NO: 3926544 - RNA, 21 nt, Human adenovirus D
cagcgcgaguagucaaucucc

SEQ ID NO: 3926545 - RNA, 22 nt, Human adenovirus D
cagcgcucguacccgcucacca

SEQ ID NO: 3926546 - RNA, 14 nt, Human adenovirus D
cagcgcuggguggc

SEQ ID NO: 3926547 - RNA, 12 nt, Human adenovirus D
cagcggcgcagg

SEQ ID NO: 3926548 - RNA, 16 nt, Human adenovirus D
cagcucaucgacuggu

SEQ ID NO: 3926549 - RNA, 14 nt, Human adenovirus D
cagcuccagugggg

SEQ ID NO: 3926550 - RNA, 16 nt, Human adenovirus D
cagcucuucggagccu

SEQ ID NO: 3926551 - RNA, 16 nt, Human adenovirus D
cagcuguuccuggugg

SEQ ID NO: 3926552 - RNA, 23 nt, Human adenovirus D
cagcuucgaguacgaggccaugc

SEQ ID NO: 3926553 - RNA, 20 nt, Human adenovirus D
caggaaacuaggcgcagcug

SEQ ID NO: 3926554 - RNA, 20 nt, Human adenovirus D
caggacucgcagacgagcgg

SEQ ID NO: 3926555 - RNA, 17 nt, Human adenovirus D
caggagaggcauggcag

SEQ ID NO: 3926556 - RNA, 19 nt, Human adenovirus D
caggagaggcauggcaggc

SEQ ID NO: 3926557 - RNA, 21 nt, Human adenovirus D
caggagaugagcagaacuaca

SEQ ID NO: 3926558 - RNA, 20 nt, Human adenovirus D
caggagccgcuaguggaaga

SEQ ID NO: 3926559 - RNA, 22 nt, Human adenovirus D
caggagccgcuaguggaagaga

SEQ ID NO: 3926560 - RNA, 18 nt, Human adenovirus D
caggaggcggugcgcacg

SEQ ID NO: 3926561 - RNA, 19 nt, Human adenovirus D
caggaugcagccaguggcc

SEQ ID NO: 3926562 - RNA, 16 nt, Human adenovirus D
caggcagcggccugaa

SEQ ID NO: 3926563 - RNA, 16 nt, Human adenovirus D
caggcccuggagcagc

SEQ ID NO: 3926564 - RNA, 19 nt, Human adenovirus D
caggccuaacuacauuggc

SEQ ID NO: 3926565 - RNA, 18 nt, Human adenovirus D
caggcgcaaccaggagga

SEQ ID NO: 3926566 - RNA, 19 nt, Human adenovirus D
caggcgccauucggagcac

SEQ ID NO: 3926567 - RNA, 17 nt, Human adenovirus D
caggcgcuggaagaggu

SEQ ID NO: 3926568 - RNA, 19 nt, Human adenovirus D
caggcggcggucaccucaa

SEQ ID NO: 3926569 - RNA, 18 nt, Human adenovirus D
caggcgggacagaggagg

SEQ ID NO: 3926570 - RNA, 14 nt, Human adenovirus D
cagggaacugaaag

SEQ ID NO: 3926571 - RNA, 14 nt, Human adenovirus D
cagggacaacgagg

SEQ ID NO: 3926572 - RNA, 13 nt, Human adenovirus D
cagggagccaggg

SEQ ID NO: 3926573 - RNA, 15 nt, Human adenovirus D
cagggaggcgcugcu

SEQ ID NO: 3926574 - RNA, 14 nt, Human adenovirus D
cauagaccugauga

SEQ ID NO: 3926575 - RNA, 22 nt, Human adenovirus D
cauagagggcguuggagagaag

SEQ ID NO: 3926576 - RNA, 20 nt, Human adenovirus D
cauagcuuccguugcgcugc

SEQ ID NO: 3926577 - RNA, 13 nt, Human adenovirus D
cauauaccccucc

SEQ ID NO: 3926578 - RNA, 15 nt, Human adenovirus D
caucacaggaggcac

SEQ ID NO: 3926579 - RNA, 16 nt, Human adenovirus D
caucacaucagccagg

SEQ ID NO: 3926580 - RNA, 12 nt, Human adenovirus D
caucaccacagg

SEQ ID NO: 3926581 - RNA, 18 nt, Human adenovirus D
caucaccuuccugcagcu

SEQ ID NO: 3926582 - RNA, 12 nt, Human adenovirus D
caucagccagga

SEQ ID NO: 3926583 - RNA, 22 nt, Human adenovirus D
caucagguuacauuccugcacc

SEQ ID NO: 3926584 - RNA, 19 nt, Human adenovirus D
caucaucgcgccacuggcc

SEQ ID NO: 3926585 - RNA, 13 nt, Human adenovirus D
caucauggcccug

SEQ ID NO: 3926586 - RNA, 15 nt, Human adenovirus D
cauccaaggccaucu

SEQ ID NO: 3926587 - RNA, 16 nt, Human adenovirus D
cauccaccagugcaag

SEQ ID NO: 3926588 - RNA, 14 nt, Human adenovirus D
cauccacugcuccu

SEQ ID NO: 3926589 - RNA, 22 nt, Human adenovirus D
cauccagaauucaaccacaccu

SEQ ID NO: 3926590 - RNA, 19 nt, Human adenovirus D
cauccaguuaaugcugccu

SEQ ID NO: 3926591 - RNA, 21 nt, Human adenovirus D
cauccgucccgacgaggccgg

SEQ ID NO: 3926592 - RNA, 15 nt, Human adenovirus D
cauccugcacgcagc

SEQ ID NO: 3926593 - RNA, 14 nt, Human adenovirus D
cauccugcuggugc

SEQ ID NO: 3926594 - RNA, 19 nt, Human adenovirus D
cauccuggaccaggcggca

SEQ ID NO: 3926595 - RNA, 17 nt, Human adenovirus D
caucguaguucaggagc

SEQ ID NO: 3926596 - RNA, 14 nt, Human adenovirus D
caucgugcagaacc

SEQ ID NO: 3926597 - RNA, 18 nt, Human adenovirus D
caucgugcgcgaccuggg

SEQ ID NO: 3926598 - RNA, 22 nt, Human adenovirus D
caucuuuuggaagaucucgguc

SEQ ID NO: 3926599 - RNA, 16 nt, Human adenovirus D
caugauccagcggcgc

SEQ ID NO: 3926600 - RNA, 18 nt, Human adenovirus D
caugcacccguaaaugac

SEQ ID NO: 3926601 - RNA, 17 nt, Human adenovirus D
caugccacgaacagcca

SEQ ID NO: 3926602 - RNA, 14 nt, Human adenovirus D
caugcccgacccca

SEQ ID NO: 3926603 - RNA, 18 nt, Human adenovirus D
caugcccuuuucccagga

SEQ ID NO: 3926604 - RNA, 22 nt, Human adenovirus D
caugccgaagaagaacaggagc

SEQ ID NO: 3926605 - RNA, 17 nt, Human adenovirus D
caugccuucgugcacug

SEQ ID NO: 3926606 - RNA, 15 nt, Human adenovirus D
caugcgccaagggca

SEQ ID NO: 3926607 - RNA, 24 nt, Human adenovirus D
caugcggggggagaugaugugcag

SEQ ID NO: 3926608 - RNA, 18 nt, Human adenovirus D
cauggcaagcugccaugg

SEQ ID NO: 3926609 - RNA, 22 nt, Human adenovirus D
cauggccaggggagugaagagg

SEQ ID NO: 3926610 - RNA, 19 nt, Human adenovirus D
cauggccucgugcucuggg

SEQ ID NO: 3926611 - RNA, 22 nt, Human adenovirus D
cauggcgcucaaggugcugacg

SEQ ID NO: 3926612 - RNA, 17 nt, Human adenovirus D
cauggugcccaagcgcc

SEQ ID NO: 3926613 - RNA, 19 nt, Human adenovirus D
cauguacccgaccaugcag

SEQ ID NO: 3926614 - RNA, 12 nt, Human adenovirus D
cauguccaccug

SEQ ID NO: 3926615 - RNA, 14 nt, Human adenovirus D
caugugaacaaaac

SEQ ID NO: 3926616 - RNA, 16 nt, Human adenovirus D
cauguuauucagcagc

SEQ ID NO: 3926617 - RNA, 17 nt, Human adenovirus D
cauguucaccagcaagu

SEQ ID NO: 3926618 - RNA, 17 nt, Human adenovirus D
cauguucucacaguaag

SEQ ID NO: 3926619 - RNA, 18 nt, Human adenovirus D
cauuaacgggguggugga

SEQ ID NO: 3926620 - RNA, 22 nt, Human adenovirus D
cauucuggacuucgcagccaug

SEQ ID NO: 3926621 - RNA, 17 nt, Human adenovirus D
cauuggagaaugcugcu

SEQ ID NO: 3926622 - RNA, 17 nt, Human adenovirus D
cauugucuucccucuca

SEQ ID NO: 3926623 - RNA, 19 nt, Human adenovirus D
ccaacaauaaaagaccaau

SEQ ID NO: 3926624 - RNA, 17 nt, Human adenovirus D
ccaacagccacaugacc

SEQ ID NO: 3926625 - RNA, 14 nt, Human adenovirus D
ccaacguggagcug

SEQ ID NO: 3926626 - RNA, 16 nt, Human adenovirus D
ccaacucuuaaaucau

SEQ ID NO: 3926627 - RNA, 20 nt, Human adenovirus D
ccaacuggucuccugccugg

SEQ ID NO: 3926628 - RNA, 17 nt, Human adenovirus D
ccaagaucaggggaugu

SEQ ID NO: 3926629 - RNA, 17 nt, Human adenovirus D
ccacacggccagcaggg

SEQ ID NO: 3926630 - RNA, 16 nt, Human adenovirus D
ccacaggaugaacagg

SEQ ID NO: 3926631 - RNA, 21 nt, Human adenovirus D
ccacaggaugaacaggagcac

SEQ ID NO: 3926632 - RNA, 16 nt, Human adenovirus D
ccacagggcacugccg

SEQ ID NO: 3926633 - RNA, 17 nt, Human adenovirus D
ccacaggugcugcccac

SEQ ID NO: 3926634 - RNA, 20 nt, Human adenovirus D
ccacaggugcugcccacccu

SEQ ID NO: 3926635 - RNA, 21 nt, Human adenovirus D
ccacaggugcugcccacccuc

SEQ ID NO: 3926636 - RNA, 18 nt, Human adenovirus D
ccacauccaagugcccca

SEQ ID NO: 3926637 - RNA, 14 nt, Human adenovirus D
ccaccacgcgcauc

SEQ ID NO: 3926638 - RNA, 15 nt, Human adenovirus D
ccaccagggagcuga

SEQ ID NO: 3926639 - RNA, 20 nt, Human adenovirus D
ccacccgcaugaacuggcuc

SEQ ID NO: 3926640 - RNA, 15 nt, Human adenovirus D
ccacgaacagccacg

SEQ ID NO: 3926641 - RNA, 23 nt, Human adenovirus D
ccacgauguaacaucaccacagg

SEQ ID NO: 3926642 - RNA, 17 nt, Human adenovirus D
ccacgcugguggccacc

SEQ ID NO: 3926643 - RNA, 18 nt, Human adenovirus D
ccacguuacgucacuuuu

SEQ ID NO: 3926644 - RNA, 14 nt, Human adenovirus D
ccacuacagcugac

SEQ ID NO: 3926645 - RNA, 23 nt, Human adenovirus D
ccacucgcgggcggccauugcuc

SEQ ID NO: 3926646 - RNA, 15 nt, Human adenovirus D
ccacugcauggccuc

SEQ ID NO: 3926647 - RNA, 14 nt, Human adenovirus D
ccacuuccgcgcuc

SEQ ID NO: 3926648 - RNA, 16 nt, Human adenovirus D
ccagacacccacgugg

SEQ ID NO: 3926649 - RNA, 16 nt, Human adenovirus D
ccagaccaccugguga

SEQ ID NO: 3926650 - RNA, 22 nt, Human adenovirus D
ccagacgggcgaagugcucaac

SEQ ID NO: 3926651 - RNA, 22 nt, Human adenovirus D
ccagagaacgcgcgaagauggc

SEQ ID NO: 3926652 - RNA, 13 nt, Human adenovirus D
ccagaucacaugg

SEQ ID NO: 3926653 - RNA, 13 nt, Human adenovirus D
ccagaugaggauu

SEQ ID NO: 3926654 - RNA, 15 nt, Human adenovirus D
ccagaugcucuccca

SEQ ID NO: 3926655 - RNA, 21 nt, Human adenovirus D
ccagauguugcgcagcggcag

SEQ ID NO: 3926656 - RNA, 23 nt, Human adenovirus D
ccagcaacuucauguccaugggc

SEQ ID NO: 3926657 - RNA, 17 nt, Human adenovirus D
ccagcacacucacuuuu

SEQ ID NO: 3926658 - RNA, 22 nt, Human adenovirus D
ccagcagcagcaguagccccuc

SEQ ID NO: 3926659 - RNA, 21 nt, Human adenovirus D
ccagcaucgaggugcagaccg

SEQ ID NO: 3926660 - RNA, 18 nt, Human adenovirus D
ccagccacagccacagac

SEQ ID NO: 3926661 - RNA, 12 nt, Human adenovirus D
ccagccagcaaa

SEQ ID NO: 3926662 - RNA, 16 nt, Human adenovirus D
ccagccguaccagugc

SEQ ID NO: 3926663 - RNA, 18 nt, Human adenovirus D
ccagccuguacccagagc

SEQ ID NO: 3926664 - RNA, 17 nt, Human adenovirus D
ccagcgaaagagagcuc

SEQ ID NO: 3926665 - RNA, 16 nt, Human adenovirus D
ccagcgaucccagcgu

SEQ ID NO: 3926666 - RNA, 19 nt, Human adenovirus D
ccagcugaacgggggcgcc

SEQ ID NO: 3926667 - RNA, 17 nt, Human adenovirus D
ccagcuggccgcccuga

SEQ ID NO: 3926668 - RNA, 16 nt, Human adenovirus D
cuuacugaaacucagu

SEQ ID NO: 3926669 - RNA, 13 nt, Human adenovirus D
cuuagccugggca

SEQ ID NO: 3926670 - RNA, 18 nt, Human adenovirus D
cuuagcucccuauuuaaa

SEQ ID NO: 3926671 - RNA, 20 nt, Human adenovirus D
cuuagcucccuauuuaaagg

SEQ ID NO: 3926672 - RNA, 20 nt, Human adenovirus D
cuucaacaucugugcugccu

SEQ ID NO: 3926673 - RNA, 20 nt, Human adenovirus D
cuucacagagagccgccuga

SEQ ID NO: 3926674 - RNA, 18 nt, Human adenovirus D
cuucaccgaccuggguca

SEQ ID NO: 3926675 - RNA, 21 nt, Human adenovirus D
cuucagcauguggaacucugc

SEQ ID NO: 3926676 - RNA, 16 nt, Human adenovirus D
cuucaugagccagagc

SEQ ID NO: 3926677 - RNA, 12 nt, Human adenovirus D
cuuccagcagaa

SEQ ID NO: 3926678 - RNA, 14 nt, Human adenovirus D
cuuccguugcgcug

SEQ ID NO: 3926679 - RNA, 16 nt, Human adenovirus D
cuuccucacucccccc

SEQ ID NO: 3926680 - RNA, 13 nt, Human adenovirus D
cuucgagcagugg

SEQ ID NO: 3926681 - RNA, 17 nt, Human adenovirus D
cuucgagguggacccca

SEQ ID NO: 3926682 - RNA, 15 nt, Human adenovirus D
cuucgcagccaugca

SEQ ID NO: 3926683 - RNA, 15 nt, Human adenovirus D
cuucuauggaggcag

SEQ ID NO: 3926684 - RNA, 17 nt, Human adenovirus D
cuucuauggaggcagag

SEQ ID NO: 3926685 - RNA, 17 nt, Human adenovirus D
cuucucccaaguucaaa

SEQ ID NO: 3926686 - RNA, 15 nt, Human adenovirus D
cuucucuuacugaaa

SEQ ID NO: 3926687 - RNA, 14 nt, Human adenovirus D
cuucugccagcaga

SEQ ID NO: 3926688 - RNA, 13 nt, Human adenovirus D
cuugacagcaccg

SEQ ID NO: 3926689 - RNA, 19 nt, Human adenovirus D
cuugacagcaccgccgcag

SEQ ID NO: 3926690 - RNA, 13 nt, Human adenovirus D
cuugaggaggaac

SEQ ID NO: 3926691 - RNA, 12 nt, Human adenovirus D
cuugaggaggag

SEQ ID NO: 3926692 - RNA, 19 nt, Human adenovirus D
cuugauuuuuccagcccag

SEQ ID NO: 3926693 - RNA, 21 nt, Human adenovirus D
cuugauuuuuccagcccaggg

SEQ ID NO: 3926694 - RNA, 15 nt, Human adenovirus D
cuugcaaacaauaaa

SEQ ID NO: 3926695 - RNA, 16 nt, Human adenovirus D
cuugcaacuugcaaac

SEQ ID NO: 3926696 - RNA, 18 nt, Human adenovirus D
cuugcagacuuuagcaag

SEQ ID NO: 3926697 - RNA, 16 nt, Human adenovirus D
cuugccgaaggacccc

SEQ ID NO: 3926698 - RNA, 21 nt, Human adenovirus D
cuugcugaccaauagacagca

SEQ ID NO: 3926699 - RNA, 23 nt, Human adenovirus D
cuuggagcaggguaaagccagca

SEQ ID NO: 3926700 - RNA, 18 nt, Human adenovirus D
cuuguuacaugacauggg

SEQ ID NO: 3926701 - RNA, 16 nt, Human adenovirus D
cuuguuagagaugagg

SEQ ID NO: 3926702 - RNA, 15 nt, Human adenovirus D
cuuguugggccuugg

SEQ ID NO: 3926703 - RNA, 13 nt, Human adenovirus D
cuuuaaucauuug

SEQ ID NO: 3926704 - RNA, 14 nt, Human adenovirus D
cuuuaaugcuccaa

SEQ ID NO: 3926705 - RNA, 16 nt, Human adenovirus D
cuuuagccagaccaag

SEQ ID NO: 3926706 - RNA, 19 nt, Human adenovirus D
cuuuagguguugcaugaug

SEQ ID NO: 3926707 - RNA, 21 nt, Human adenovirus D
cuuuagguguugcaugauggg

SEQ ID NO: 3926708 - RNA, 16 nt, Human adenovirus D
cuuuaucagccagaac

SEQ ID NO: 3926709 - RNA, 13 nt, Human adenovirus D
cuuuaucugcugg

SEQ ID NO: 3926710 - RNA, 14 nt, Human adenovirus D
cuuuaucugcuggg

SEQ ID NO: 3926711 - RNA, 13 nt, Human adenovirus D
cuuucacuuuggu

SEQ ID NO: 3926712 - RNA, 13 nt, Human adenovirus D
cuuuccagcagca

SEQ ID NO: 3926713 - RNA, 14 nt, Human adenovirus D
cuuuccagcagcag

SEQ ID NO: 3926714 - RNA, 14 nt, Human adenovirus D
cuuuccauggccuc

SEQ ID NO: 3926715 - RNA, 15 nt, Human adenovirus D
cuuugacacaccugg

SEQ ID NO: 3926716 - RNA, 19 nt, Human adenovirus D
cuuuuaggugaagcaauac

SEQ ID NO: 3926717 - RNA, 15 nt, Human adenovirus D
cuuuuccugaugcag

SEQ ID NO: 3926718 - RNA, 20 nt, Human adenovirus D
cuuuuuauauguugacaaua

SEQ ID NO: 3926719 - RNA, 22 nt, Human adenovirus D
ccgccacccuugaccugccucc

SEQ ID NO: 3926720 - RNA, 23 nt, Human adenovirus D
ccgccaucgaacacgccaccgcu

SEQ ID NO: 3926721 - RNA, 13 nt, Human adenovirus D
ccgccauggggcg

SEQ ID NO: 3926722 - RNA, 15 nt, Human adenovirus D
ccgcccgccgccagg

SEQ ID NO: 3926723 - RNA, 13 nt, Human adenovirus D
ccgcccgcgugcg

SEQ ID NO: 3926724 - RNA, 14 nt, Human adenovirus D
ccgcccugcuggau

SEQ ID NO: 3926725 - RNA, 13 nt, Human adenovirus D
ccgccgccgugcg

SEQ ID NO: 3926726 - RNA, 15 nt, Human adenovirus D
ccgccgccugcgcug

SEQ ID NO: 3926727 - RNA, 17 nt, Human adenovirus D
ccgcgauguugagcugg

SEQ ID NO: 3926728 - RNA, 23 nt, Human adenovirus D
ccgcgccaaccgcacccgcgccg

SEQ ID NO: 3926729 - RNA, 19 nt, Human adenovirus D
ccgcgccagacgcacgggc

SEQ ID NO: 3926730 - RNA, 20 nt, Human adenovirus D
ccgcgcgggagccaggucca

SEQ ID NO: 3926731 - RNA, 17 nt, Human adenovirus D
ccgcgcucggugacaaa

SEQ ID NO: 3926732 - RNA, 16 nt, Human adenovirus D
ccgcgcuugcugggcg

SEQ ID NO: 3926733 - RNA, 18 nt, Human adenovirus D
ccgcggccguagcaggcg

SEQ ID NO: 3926734 - RNA, 16 nt, Human adenovirus D
ccgcgggaucaagcgc

SEQ ID NO: 3926735 - RNA, 18 nt, Human adenovirus D
ccgcgggcaggggcggca

SEQ ID NO: 3926736 - RNA, 14 nt, Human adenovirus D
ccgcgguccuccuc

SEQ ID NO: 3926737 - RNA, 19 nt, Human adenovirus D
ccgcguaauuggcccucca

SEQ ID NO: 3926738 - RNA, 19 nt, Human adenovirus D
ccgcgugacgcacuggccg

SEQ ID NO: 3926739 - RNA, 16 nt, Human adenovirus D
ccgcuaguggaagaga

SEQ ID NO: 3926740 - RNA, 13 nt, Human adenovirus D
ccgcugugcuggu

SEQ ID NO: 3926741 - RNA, 23 nt, Human adenovirus D
ccggaccuaugggaacaaggccu

SEQ ID NO: 3926742 - RNA, 15 nt, Human adenovirus D
ccggagcccacccgc

SEQ ID NO: 3926743 - RNA, 12 nt, Human adenovirus D
ccggcagcgggg

SEQ ID NO: 3926744 - RNA, 18 nt, Human adenovirus D
ccggcagcggggccuggu

SEQ ID NO: 3926745 - RNA, 13 nt, Human adenovirus D
ccggcagcggugg

SEQ ID NO: 3926746 - RNA, 20 nt, Human adenovirus D
ccggcaugcccaccacgcgc

SEQ ID NO: 3926747 - RNA, 14 nt, Human adenovirus D
ccggccaaggccac

SEQ ID NO: 3926748 - RNA, 16 nt, Human adenovirus D
ccggccccgcgggcag

SEQ ID NO: 3926749 - RNA, 15 nt, Human adenovirus D
ccggcgaccaccgcg

SEQ ID NO: 3926750 - RNA, 16 nt, Human adenovirus D
ccggcgcuagccagcc

SEQ ID NO: 3926751 - RNA, 15 nt, Human adenovirus D
ccggcggcagcggcg

SEQ ID NO: 3926752 - RNA, 16 nt, Human adenovirus D
ccgggaccgaguucag

SEQ ID NO: 3926753 - RNA, 16 nt, Human adenovirus D
ccgggccugggcgugc

SEQ ID NO: 3926754 - RNA, 18 nt, Human adenovirus D
ccgggccugggcgugcag

SEQ ID NO: 3926755 - RNA, 16 nt, Human adenovirus D
ccgggcuaccgcggca

SEQ ID NO: 3926756 - RNA, 20 nt, Human adenovirus D
ccggucucugcgcucgcuca

SEQ ID NO: 3926757 - RNA, 16 nt, Human adenovirus D
ccggugcccgcuccgc

SEQ ID NO: 3926758 - RNA, 12 nt, Human adenovirus D
ccguagccuggc

SEQ ID NO: 3926759 - RNA, 22 nt, Human adenovirus D
ccguccuuucgcugcugccgcu

SEQ ID NO: 3926760 - RNA, 16 nt, Human adenovirus D
ccgucugccccccgcc

SEQ ID NO: 3926761 - RNA, 21 nt, Human adenovirus D
ccgucuggacccgcggccgcc

SEQ ID NO: 3926762 - RNA, 17 nt, Human adenovirus D
ccgugaccugcagcagg

SEQ ID NO: 3926763 - RNA, 18 nt, Human adenovirus D
ccgugcacuuggggaacu

SEQ ID NO: 3926764 - RNA, 19 nt, Human adenovirus D
ccgugcaggggcccgacuc

SEQ ID NO: 3926765 - RNA, 15 nt, Human adenovirus D
ccgugguccugguca

SEQ ID NO: 3926766 - RNA, 20 nt, Human adenovirus D
ccguuuaucaauaagcuaau

SEQ ID NO: 3926767 - RNA, 16 nt, Human adenovirus D
ccuacgcgaccguggg

SEQ ID NO: 3926768 - RNA, 14 nt, Human adenovirus D
ccuacgguccagag

SEQ ID NO: 3926769 - RNA, 18 nt, Human adenovirus D
ccuacgucuacaaggccc

SEQ ID NO: 3926770 - RNA, 19 nt, Human adenovirus D
ccuauaaaaacaacaaaac

SEQ ID NO: 3926771 - RNA, 19 nt, Human adenovirus D
ccuaugggaacaaggccug

SEQ ID NO: 3926772 - RNA, 19 nt, Human adenovirus D
ccucaucacaucagccagg

SEQ ID NO: 3926773 - RNA, 19 nt, Human adenovirus D
ccucaugaacacacugccc

SEQ ID NO: 3926774 - RNA, 19 nt, Human adenovirus D
ccuccagccuuuccauggc

SEQ ID NO: 3926775 - RNA, 13 nt, Human adenovirus D
ccuccaggccaac

SEQ ID NO: 3926776 - RNA, 20 nt, Human adenovirus D
ccuccaguuuguggaggagu

SEQ ID NO: 3926777 - RNA, 21 nt, Human adenovirus D
ccuccgcgguauauggcuccu

SEQ ID NO: 3926778 - RNA, 22 nt, Human adenovirus D
ccuccgguggcgaccgccgugc

SEQ ID NO: 3926779 - RNA, 14 nt, Human adenovirus D
ccuccuccuggaga

SEQ ID NO: 3926780 - RNA, 22 nt, Human adenovirus D
ccuccuguuacuguaaagccac

SEQ ID NO: 3926781 - RNA, 14 nt, Human adenovirus D
ccucgaccaugacc

SEQ ID NO: 3926782 - RNA, 20 nt, Human adenovirus D
ccucgagcuacaugcccagc

SEQ ID NO: 3926783 - RNA, 17 nt, Human adenovirus D
ccucgcgucuccaugag

SEQ ID NO: 3926784 - RNA, 12 nt, Human adenovirus D
ccucgcugaaaa

SEQ ID NO: 3926785 - RNA, 19 nt, Human adenovirus D
ccucggaguaccugagccg

SEQ ID NO: 3926786 - RNA, 14 nt, Human adenovirus D
ccucggugcagccg

SEQ ID NO: 3926787 - RNA, 22 nt, Human adenovirus D
ccucugcgugaagaccacuggc

SEQ ID NO: 3926788 - RNA, 17 nt, Human adenovirus D
ccucuguggugaggauc

SEQ ID NO: 3926789 - RNA, 18 nt, Human adenovirus D
ccucuucuauuucuuccu

SEQ ID NO: 3926790 - RNA, 17 nt, Human adenovirus D
ccucuucucgccgcgcg

SEQ ID NO: 3926791 - RNA, 21 nt, Human adenovirus D
ccugaaccacacggccagcag

SEQ ID NO: 3926792 - RNA, 22 nt, Human adenovirus D
ccugaaccgccgccggcggcgg

SEQ ID NO: 3926793 - RNA, 17 nt, Human adenovirus D
ccugaacggcaucuuug

SEQ ID NO: 3926794 - RNA, 15 nt, Human adenovirus D
ccugacccagcaggu

SEQ ID NO: 3926795 - RNA, 14 nt, Human adenovirus D
ccugagagcgcugg

SEQ ID NO: 3926796 - RNA, 15 nt, Human adenovirus D
ccugagagcgcuggc

SEQ ID NO: 3926797 - RNA, 21 nt, Human adenovirus D
ccugagauacgaugagaccaa

SEQ ID NO: 3926798 - RNA, 14 nt, Human adenovirus D
ccugagccgccagc

SEQ ID NO: 3926799 - RNA, 17 nt, Human adenovirus D
ccugagccgccagcugg

SEQ ID NO: 3926800 - RNA, 11 nt, Human adenovirus D
ccugagcgaga

SEQ ID NO: 3926801 - RNA, 12 nt, Human adenovirus D
ccugaucagaaa

SEQ ID NO: 3926802 - RNA, 14 nt, Human adenovirus D
ccugaucucugcca

SEQ ID NO: 3926803 - RNA, 13 nt, Human adenovirus D
ccugaugcaggag

SEQ ID NO: 3926804 - RNA, 16 nt, Human adenovirus D
ccugcacacggagugc

SEQ ID NO: 3926805 - RNA, 17 nt, Human adenovirus D
ccugcaccugcgucugc

SEQ ID NO: 3926806 - RNA, 20 nt, Human adenovirus D
ccugcagcccaaacuggggc

SEQ ID NO: 3926807 - RNA, 15 nt, Human adenovirus D
ccugcagcgccaguc

SEQ ID NO: 3926808 - RNA, 15 nt, Human adenovirus D
ccugcccuuccagca

SEQ ID NO: 3926809 - RNA, 15 nt, Human adenovirus D
ccugccgcgccaacc

SEQ ID NO: 3926810 - RNA, 20 nt, Human adenovirus D
ccugcgcaaggucgaggaga

SEQ ID NO: 3926811 - RNA, 16 nt, Human adenovirus D
ccugcgcuaccgcucc

SEQ ID NO: 3926812 - RNA, 14 nt, Human adenovirus D
ccugcucaccugca

SEQ ID NO: 3926813 - RNA, 13 nt, Human adenovirus D
ccugcucccgggc

SEQ ID NO: 3926814 - RNA, 12 nt, Human adenovirus D
ccugcucucaca

SEQ ID NO: 3926815 - RNA, 13 nt, Human adenovirus D
ccuggcccugaca

SEQ ID NO: 3926816 - RNA, 16 nt, Human adenovirus D
ccuggcgacgcagccg

SEQ ID NO: 3926817 - RNA, 12 nt, Human adenovirus D
ccuggcucccag

SEQ ID NO: 3926818 - RNA, 16 nt, Human adenovirus D
ccugggaggagaggag

SEQ ID NO: 3926819 - RNA, 18 nt, Human adenovirus D
ccugggaggagaggagga

SEQ ID NO: 3926820 - RNA, 20 nt, Human adenovirus D
ccugggcacuggagcacaga

SEQ ID NO: 3926821 - RNA, 20 nt, Human adenovirus D
ccugggcauucgcaagaagc

SEQ ID NO: 3926822 - RNA, 16 nt, Human adenovirus D
ccugggcgccagaagg

SEQ ID NO: 3926823 - RNA, 13 nt, Human adenovirus D
ccugggcucgcug

SEQ ID NO: 3926824 - RNA, 18 nt, Human adenovirus D
ccuggggcaucucuucgu

SEQ ID NO: 3926825 - RNA, 23 nt, Human adenovirus D
ccuguauauuuuuagaauggaag

SEQ ID NO: 3926826 - RNA, 24 nt, Human adenovirus D
ccuuaccugguacgagcuacagca

SEQ ID NO: 3926827 - RNA, 15 nt, Human adenovirus D
ccuucuccaggguga

SEQ ID NO: 3926828 - RNA, 20 nt, Human adenovirus D
ccuuugcggacuccgcgacc

SEQ ID NO: 3926829 - RNA, 13 nt, Human adenovirus D
gcgccgggcgcug

SEQ ID NO: 3926830 - RNA, 14 nt, Human adenovirus D
gcgccucaauguca

SEQ ID NO: 3926831 - RNA, 19 nt, Human adenovirus D
gcgccucaaugucagcugc

SEQ ID NO: 3926832 - RNA, 22 nt, Human adenovirus D
gcgccucccaggacuacuccac

SEQ ID NO: 3926833 - RNA, 14 nt, Human adenovirus D
gcgccugaggcaga

SEQ ID NO: 3926834 - RNA, 16 nt, Human adenovirus D
gcgccuuggaggccgc

SEQ ID NO: 3926835 - RNA, 23 nt, Human adenovirus D
gcgcgcuccacgguggcggcgag

SEQ ID NO: 3926836 - RNA, 16 nt, Human adenovirus D
gcgcggcgggggcgga

SEQ ID NO: 3926837 - RNA, 13 nt, Human adenovirus D
gcgcuaccgcucc

SEQ ID NO: 3926838 - RNA, 15 nt, Human adenovirus D
gcgcucccggcggca

SEQ ID NO: 3926839 - RNA, 18 nt, Human adenovirus D
gcgcucccggcggcagcg

SEQ ID NO: 3926840 - RNA, 17 nt, Human adenovirus D
gcgcucgcgcaccugcu

SEQ ID NO: 3926841 - RNA, 16 nt, Human adenovirus D
gcgcucgcucacccgc

SEQ ID NO: 3926842 - RNA, 22 nt, Human adenovirus D
gcgcuggcggagaacaaggcca

SEQ ID NO: 3926843 - RNA, 14 nt, Human adenovirus D
gcgcuggggcagaa

SEQ ID NO: 3926844 - RNA, 16 nt, Human adenovirus D
gcgcuggggcugcucg

SEQ ID NO: 3926845 - RNA, 19 nt, Human adenovirus D
gcgcuggggcugcucggcg

SEQ ID NO: 3926846 - RNA, 14 nt, Human adenovirus D
gcgcugucggccga

SEQ ID NO: 3926847 - RNA, 18 nt, Human adenovirus D
gcgcuucacucuggccgu

SEQ ID NO: 3926848 - RNA, 23 nt, Human adenovirus D
gcgcuugagacucauccugcugg

SEQ ID NO: 3926849 - RNA, 19 nt, Human adenovirus D
gcggacggaucgcccaggc

SEQ ID NO: 3926850 - RNA, 16 nt, Human adenovirus D
gcggacugccaccgcc

SEQ ID NO: 3926851 - RNA, 17 nt, Human adenovirus D
gcggagaacaaggccau

SEQ ID NO: 3926852 - RNA, 18 nt, Human adenovirus D
gcggagccgcucggccau

SEQ ID NO: 3926853 - RNA, 16 nt, Human adenovirus D
gcggagcuugcccuug

SEQ ID NO: 3926854 - RNA, 15 nt, Human adenovirus D
gcggaugcuggcgcg

SEQ ID NO: 3926855 - RNA, 22 nt, Human adenovirus D
gcggccguccuuucgcugcugc

SEQ ID NO: 3926856 - RNA, 17 nt, Human adenovirus D
gcggccguucaugggca

SEQ ID NO: 3926857 - RNA, 17 nt, Human adenovirus D
gcggcgcaagcucaugc

SEQ ID NO: 3926858 - RNA, 15 nt, Human adenovirus D
gcggcgcgagcugag

SEQ ID NO: 3926859 - RNA, 13 nt, Human adenovirus D
gcggcggcuggcg

SEQ ID NO: 3926860 - RNA, 18 nt, Human adenovirus D
gcgggccaugagggucug

SEQ ID NO: 3926861 - RNA, 17 nt, Human adenovirus D
gcgggcuguggggcgug

SEQ ID NO: 3926862 - RNA, 14 nt, Human adenovirus D
gcggggggagauga

SEQ ID NO: 3926863 - RNA, 23 nt, Human adenovirus D
gcgguacacgggguugcagcacu

SEQ ID NO: 3926864 - RNA, 20 nt, Human adenovirus D
gcgguccccgaggcccuugc

SEQ ID NO: 3926865 - RNA, 21 nt, Human adenovirus D
gcgguucaagaacgagggccu

SEQ ID NO: 3926866 - RNA, 16 nt, Human adenovirus D
gcgguuccggccccgc

SEQ ID NO: 3926867 - RNA, 23 nt, Human adenovirus D
gcguaagcaggagcaggaggagg

SEQ ID NO: 3926868 - RNA, 17 nt, Human adenovirus D
gcgucauggcuggucag

SEQ ID NO: 3926869 - RNA, 20 nt, Human adenovirus D
gcguccccgcccgccgccag

SEQ ID NO: 3926870 - RNA, 13 nt, Human adenovirus D
gcguccgcaggcg

SEQ ID NO: 3926871 - RNA, 14 nt, Human adenovirus D
gcguccgcuccgca

SEQ ID NO: 3926872 - RNA, 15 nt, Human adenovirus D
gcgucgacggggaag

SEQ ID NO: 3926873 - RNA, 22 nt, Human adenovirus D
gcgucuuucucuuucucugcca

SEQ ID NO: 3926874 - RNA, 15 nt, Human adenovirus D
gcgugaagacgccgc

SEQ ID NO: 3926875 - RNA, 14 nt, Human adenovirus D
gcgugcagcugcag

SEQ ID NO: 3926876 - RNA, 13 nt, Human adenovirus D
ggggccagguccu

SEQ ID NO: 3926877 - RNA, 21 nt, Human adenovirus D
ggggcgccgccggcggcgagg

SEQ ID NO: 3926878 - RNA, 15 nt, Human adenovirus D
ggggcgcugggcgug

SEQ ID NO: 3926879 - RNA, 11 nt, Human adenovirus D
ggggcgguggu

SEQ ID NO: 3926880 - RNA, 17 nt, Human adenovirus D
gggggcagacacaccag

SEQ ID NO: 3926881 - RNA, 19 nt, Human adenovirus D
gggguagcggucguugucc

SEQ ID NO: 3926882 - RNA, 21 nt, Human adenovirus D
gggguauuacuaggcccagca

SEQ ID NO: 3926883 - RNA, 22 nt, Human adenovirus D
ggggugcccaacggcaugcuac

SEQ ID NO: 3926884 - RNA, 14 nt, Human adenovirus D
gggucaggcagcgg

SEQ ID NO: 3926885 - RNA, 19 nt, Human adenovirus D
gggucuaucuggaccccca

SEQ ID NO: 3926886 - RNA, 21 nt, Human adenovirus D
gggugaccagguccacgcugg

SEQ ID NO: 3926887 - RNA, 17 nt, Human adenovirus D
gggugagccggccgcgc

SEQ ID NO: 3926888 - RNA, 15 nt, Human adenovirus D
gggugaugcggaaag

SEQ ID NO: 3926889 - RNA, 18 nt, Human adenovirus D
gggugcgcuugagacuca

SEQ ID NO: 3926890 - RNA, 19 nt, Human adenovirus D
gggugcuagacauggccag

SEQ ID NO: 3926891 - RNA, 23 nt, Human adenovirus D
gggugggccccuggcugggcgcu

SEQ ID NO: 3926892 - RNA, 15 nt, Human adenovirus D
gguaaagccagcagc

SEQ ID NO: 3926893 - RNA, 15 nt, Human adenovirus D
gguacccuccuccca

SEQ ID NO: 3926894 - RNA, 15 nt, Human adenovirus D
gguauauuauugaug

SEQ ID NO: 3926895 - RNA, 21 nt, Human adenovirus D
gguauucccucucgagagcgg

SEQ ID NO: 3926896 - RNA, 15 nt, Human adenovirus D
ggucacacuagcgcc

SEQ ID NO: 3926897 - RNA, 20 nt, Human adenovirus D
ggucaccccgccgauuuaaa

SEQ ID NO: 3926898 - RNA, 16 nt, Human adenovirus D
ggucagaacauguucu

SEQ ID NO: 3926899 - RNA, 19 nt, Human adenovirus D
ggucaucaccuuccugcag

SEQ ID NO: 3926900 - RNA, 14 nt, Human adenovirus D
ggucccgguguugc

SEQ ID NO: 3926901 - RNA, 16 nt, Human adenovirus D
gguccugcaagaggag

SEQ ID NO: 3926902 - RNA, 23 nt, Human adenovirus D
ggucggaagacccaagagcgaga

SEQ ID NO: 3926903 - RNA, 17 nt, Human adenovirus D
ggucggcgacgacgcgc

SEQ ID NO: 3926904 - RNA, 20 nt, Human adenovirus D
ggucugcaacccccagcucc

SEQ ID NO: 3926905 - RNA, 17 nt, Human adenovirus D
ggucugcuccugcacuu

SEQ ID NO: 3926906 - RNA, 21 nt, Human adenovirus D
ggugaagaugccgggacagag

SEQ ID NO: 3926907 - RNA, 15 nt, Human adenovirus D
ggugacagaaccaga

SEQ ID NO: 3926908 - RNA, 17 nt, Human adenovirus D
ggugacggccuacgagc

SEQ ID NO: 3926909 - RNA, 18 nt, Human adenovirus D
ggugacgguaagcacgag

SEQ ID NO: 3926910 - RNA, 19 nt, Human adenovirus D
ggugacucggcugagcucg

SEQ ID NO: 3926911 - RNA, 15 nt, Human adenovirus D
ggugagcagcuugcu

SEQ ID NO: 3926912 - RNA, 21 nt, Human adenovirus D
ggugagccggccgcgcuugcu

SEQ ID NO: 3926913 - RNA, 15 nt, Human adenovirus D
ggugagggcgugcuu

SEQ ID NO: 3926914 - RNA, 24 nt, Human adenovirus D
ggugcccaagcgccggcgcgugga

SEQ ID NO: 3926915 - RNA, 20 nt, Human adenovirus D
ggugcuagacauggccagca

SEQ ID NO: 3926916 - RNA, 14 nt, Human adenovirus D
ggugcuuagccugg

SEQ ID NO: 3926917 - RNA, 12 nt, Human adenovirus D
gguggaggcgcg

SEQ ID NO: 3926918 - RNA, 23 nt, Human adenovirus D
gguggauagcuaugauccagaug

SEQ ID NO: 3926919 - RNA, 16 nt, Human adenovirus D
gguggcccugggccug

SEQ ID NO: 3926920 - RNA, 15 nt, Human adenovirus D
gguggcgccgggccu

SEQ ID NO: 3926921 - RNA, 20 nt, Human adenovirus D
ggugguguucacgcccggcg

SEQ ID NO: 3926922 - RNA, 17 nt, Human adenovirus D
gguuaguaugucccugg

SEQ ID NO: 3926923 - RNA, 14 nt, Human adenovirus D
gguuggcuugcaug

SEQ ID NO: 3926924 - RNA, 16 nt, Human adenovirus D
guaaagccagaaagaa

SEQ ID NO: 3926925 - RNA, 19 nt, Human adenovirus D
guaacaucaccacaggcaa

SEQ ID NO: 3926926 - RNA, 14 nt, Human adenovirus D
guaagugcagcaca

SEQ ID NO: 3926927 - RNA, 17 nt, Human adenovirus D
guaagugcagcacauaa

SEQ ID NO: 3926928 - RNA, 17 nt, Human adenovirus D
guaagugcaguuggcca

SEQ ID NO: 3926929 - RNA, 16 nt, Human adenovirus D
guaauggggcgggucc

SEQ ID NO: 3926930 - RNA, 16 nt, Human adenovirus D
guaauuggaacugaug

SEQ ID NO: 3926931 - RNA, 17 nt, Human adenovirus D
guaccagucgggcccgg

SEQ ID NO: 3926932 - RNA, 11 nt, Human adenovirus D
guacccagagc

SEQ ID NO: 3926933 - RNA, 13 nt, Human adenovirus D
guaccgcagcugg

SEQ ID NO: 3926934 - RNA, 12 nt, Human adenovirus D
guacgagagcgu

SEQ ID NO: 3926935 - RNA, 17 nt, Human adenovirus D
guacggcgacgacgaca

SEQ ID NO: 3926936 - RNA, 15 nt, Human adenovirus D
guacuggcaacaugg

SEQ ID NO: 3926937 - RNA, 13 nt, Human adenovirus D
guacuugggcugc

SEQ ID NO: 3926938 - RNA, 23 nt, Human adenovirus D
guacuuugucugcuguaaagcca

SEQ ID NO: 3926939 - RNA, 18 nt, Human adenovirus D
guagacaaagagcacagc

SEQ ID NO: 3926940 - RNA, 22 nt, Human adenovirus D
guagagggaaccuaccacugcc

SEQ ID NO: 3926941 - RNA, 13 nt, Human adenovirus D
uggccccggggcg

SEQ ID NO: 3926942 - RNA, 14 nt, Human adenovirus D
uggccccggggcgg

SEQ ID NO: 3926943 - RNA, 23 nt, Human adenovirus D
uggccccgugacuuugaaccuga

SEQ ID NO: 3926944 - RNA, 12 nt, Human adenovirus D
uggcccugggcc

SEQ ID NO: 3926945 - RNA, 13 nt, Human adenovirus D
uggcccugggccu

SEQ ID NO: 3926946 - RNA, 20 nt, Human adenovirus D
uggccgcgauguugagcugg

SEQ ID NO: 3926947 - RNA, 20 nt, Human adenovirus D
uggccggcgcgcccggggcc

SEQ ID NO: 3926948 - RNA, 13 nt, Human adenovirus D
uggccuggagcag

SEQ ID NO: 3926949 - RNA, 15 nt, Human adenovirus D
uggccuguccugcag

SEQ ID NO: 3926950 - RNA, 18 nt, Human adenovirus D
uggccuuguaccugcccg

SEQ ID NO: 3926951 - RNA, 14 nt, Human adenovirus D
uggcgagggucugc

SEQ ID NO: 3926952 - RNA, 22 nt, Human adenovirus D
uggcgaugggcccgugggcugc

SEQ ID NO: 3926953 - RNA, 18 nt, Human adenovirus D
uggcgaugugcucgguga

SEQ ID NO: 3926954 - RNA, 22 nt, Human adenovirus D
uggcgcacaacaccgccuccac

SEQ ID NO: 3926955 - RNA, 16 nt, Human adenovirus D
uggcgcucgggcaggu

SEQ ID NO: 3926956 - RNA, 22 nt, Human adenovirus D
uggcggagaacaaggccauccg

SEQ ID NO: 3926957 - RNA, 15 nt, Human adenovirus D
uggcgugcuggagag

SEQ ID NO: 3926958 - RNA, 17 nt, Human adenovirus D
uggcucccagccuccac

SEQ ID NO: 3926959 - RNA, 18 nt, Human adenovirus D
uggcuccuacggagggca

SEQ ID NO: 3926960 - RNA, 17 nt, Human adenovirus D
uggcuucuacagccagc

SEQ ID NO: 3926961 - RNA, 19 nt, Human adenovirus D
uggcuucuacagccagcag

SEQ ID NO: 3926962 - RNA, 13 nt, Human adenovirus D
uggcuugcaugaa

SEQ ID NO: 3926963 - RNA, 16 nt, Human adenovirus D
ugggaagaagagacag

SEQ ID NO: 3926964 - RNA, 14 nt, Human adenovirus D
ugggacgacgugga

SEQ ID NO: 3926965 - RNA, 15 nt, Human adenovirus D
ugggcaacggccgcu

SEQ ID NO: 3926966 - RNA, 19 nt, Human adenovirus D
ugggcacccacgacacagc

SEQ ID NO: 3926967 - RNA, 19 nt, Human adenovirus D
ugggcauagucgcgccgcg

SEQ ID NO: 3926968 - RNA, 23 nt, Human adenovirus D
ugggcccuugaacagcauauacc

SEQ ID NO: 3926969 - RNA, 15 nt, Human adenovirus D
ugggcgugcagaccg

SEQ ID NO: 3926970 - RNA, 19 nt, Human adenovirus D
ugggcgugcagaccgugga

SEQ ID NO: 3926971 - RNA, 12 nt, Human adenovirus D
ugggcugggacc

SEQ ID NO: 3926972 - RNA, 19 nt, Human adenovirus D
ugggcuucgaagagccggc

SEQ ID NO: 3926973 - RNA, 20 nt, Human adenovirus D
ugggguauuacuaggcccag

SEQ ID NO: 3926974 - RNA, 16 nt, Human adenovirus D
uggguggccggcgcgc

SEQ ID NO: 3926975 - RNA, 19 nt, Human adenovirus D
uggguuggcuugcaugaag

SEQ ID NO: 3926976 - RNA, 16 nt, Human adenovirus D
ugguagggggcgccgc

SEQ ID NO: 3926977 - RNA, 22 nt, Human adenovirus D
ugguaguuuuuucuuuaaucau

SEQ ID NO: 3926978 - RNA, 15 nt, Human adenovirus D
ugguauccaugcccu

SEQ ID NO: 3926979 - RNA, 19 nt, Human adenovirus D
uggucagagugcaccagcc

SEQ ID NO: 3926980 - RNA, 19 nt, Human adenovirus D
uggucagcgaugagcagcu

SEQ ID NO: 3926981 - RNA, 14 nt, Human adenovirus D
uggucaucacccuc

SEQ ID NO: 3926982 - RNA, 14 nt, Human adenovirus D
ugguccuggucacc

SEQ ID NO: 3926983 - RNA, 19 nt, Human adenovirus D
ugguccuggucacccucga

SEQ ID NO: 3926984 - RNA, 22 nt, Human adenovirus D
uggucggcgccgagcucaugcc

SEQ ID NO: 3926985 - RNA, 20 nt, Human adenovirus D
uggugcaguuugcccgcgcc

SEQ ID NO: 3926986 - RNA, 20 nt, Human adenovirus D
uggugcugaaacgggcacgg

SEQ ID NO: 3926987 - RNA, 14 nt, Human adenovirus D
ugguggaaacagac

SEQ ID NO: 3926988 - RNA, 22 nt, Human adenovirus D
ugguggcuagaaaacacccaca

SEQ ID NO: 3926989 - RNA, 18 nt, Human adenovirus D
uggugggauaacagcgcc

SEQ ID NO: 3926990 - RNA, 14 nt, Human adenovirus D
uggugucaggaaaa

SEQ ID NO: 3926991 - RNA, 18 nt, Human adenovirus D
uguaaagccacaaccaga

SEQ ID NO: 3926992 - RNA, 22 nt, Human adenovirus D
uguacacgguucucucagcacg

SEQ ID NO: 3926993 - RNA, 17 nt, Human adenovirus D
uguagaugauccaguca

SEQ ID NO: 3926994 - RNA, 16 nt, Human adenovirus D
uguagggacagcagcc

SEQ ID NO: 3926995 - RNA, 17 nt, Human adenovirus D
uguaguuguucagcagc

SEQ ID NO: 3926996 - RNA, 18 nt, Human adenovirus D
uguaguuguucagcagca

SEQ ID NO: 3926997 - RNA, 23 nt, Human adenovirus D
ugucagaugguuuuccaaaauca

SEQ ID NO: 3926998 - RNA, 20 nt, Human adenovirus D
uguccuggaagucguccaug

SEQ ID NO: 3926999 - RNA, 16 nt, Human adenovirus D
ugucgccgauggccuc

SEQ ID NO: 3927000 - RNA, 23 nt, Human adenovirus D
ugucuccuccgauggauucaaaa

SEQ ID NO: 3927001 - RNA, 14 nt, Human adenovirus D
ugugaccaagcugg

SEQ ID NO: 3927002 - RNA, 13 nt, Human adenovirus D
ugugaccacggac

SEQ ID NO: 3927003 - RNA, 13 nt, Human adenovirus D
ugugaccucccac

SEQ ID NO: 3927004 - RNA, 18 nt, Human adenovirus D
ugugcucuccgcaccgcu

SEQ ID NO: 3927005 - RNA, 21 nt, Human adenovirus D
ugugcugguggaaacagacag

SEQ ID NO: 3927006 - RNA, 21 nt, Human adenovirus D
uguggagggcaugggucaggc

SEQ ID NO: 3927007 - RNA, 16 nt, Human adenovirus D
uguugcacgcggguga

SEQ ID NO: 3927008 - RNA, 16 nt, Human adenovirus D
uguuguagaugaucca

SEQ ID NO: 3927009 - RNA, 17 nt, Human adenovirus D
uguuuacaaucuggcgg

SEQ ID NO: 3927010 - RNA, 18 nt, Human adenovirus D
uguuuuugcgaaaacacu

SEQ ID NO: 3927011 - RNA, 17 nt, Human adenovirus D
uuaaaaagcagcacagu

SEQ ID NO: 3927012 - RNA, 19 nt, Human adenovirus D
uuacacucgcagugcacgg

SEQ ID NO: 3927013 - RNA, 12 nt, Human adenovirus D
uuacgucacuuu

SEQ ID NO: 3927014 - RNA, 17 nt, Human adenovirus D
uuacuaggcccagcagc

SEQ ID NO: 3927015 - RNA, 12 nt, Human adenovirus D
uuacuucaucau

SEQ ID NO: 3927016 - RNA, 20 nt, Human adenovirus D
uuagucauguguaaauaaag

SEQ ID NO: 3927017 - RNA, 12 nt, Human adenovirus D
uuaguccagcag

SEQ ID NO: 3927018 - RNA, 18 nt, Human adenovirus D
uucaacgacuaccucucg

SEQ ID NO: 3927019 - RNA, 16 nt, Human adenovirus D
uucaauaauggaagca

SEQ ID NO: 3927020 - RNA, 23 nt, Human adenovirus D
uucacagcuaagaaaaaaucaga

SEQ ID NO: 3927021 - RNA, 23 nt, Human adenovirus D
uucacccggacguggugcugcug

SEQ ID NO: 3927022 - RNA, 13 nt, Human adenovirus D
uucacgcccggcg

SEQ ID NO: 3927023 - RNA, 12 nt, Human adenovirus D
uucagcagcacc

SEQ ID NO: 3927024 - RNA, 20 nt, Human adenovirus D
uucagcuccaguggggagga

SEQ ID NO: 3927025 - RNA, 14 nt, Human adenovirus D
uucagggugcucca

SEQ ID NO: 3927026 - RNA, 18 nt, Human adenovirus D
uucagggugcuccagcca

SEQ ID NO: 3927027 - RNA, 19 nt, Human adenovirus D
uuccaucaucgccgaggag

SEQ ID NO: 3927028 - RNA, 16 nt, Human adenovirus D
uuccccuccgcugugc

SEQ ID NO: 3927029 - RNA, 19 nt, Human adenovirus D
uuccgcaacuuccagccca

SEQ ID NO: 3927030 - RNA, 18 nt, Human adenovirus D
uuccguucuacccagcaa

SEQ ID NO: 3927031 - RNA, 12 nt, Human adenovirus D
uuccugaugcag

SEQ ID NO: 3927032 - RNA, 14 nt, Human adenovirus D
uuccugguccacaa

SEQ ID NO: 3927033 - RNA, 20 nt, Human adenovirus D
uuccugucuucuuccggcaa

SEQ ID NO: 3927034 - RNA, 14 nt, Human adenovirus D
uucgacagcgucaa

SEQ ID NO: 3927035 - RNA, 23 nt, Human adenovirus D
uucgucaggcaggcaugcaagau

SEQ ID NO: 3927036 - RNA, 18 nt, Human adenovirus D
uucuagaaacgaggagga

SEQ ID NO: 3927037 - RNA, 18 nt, Human adenovirus D
uucucaucucgcccagca

SEQ ID NO: 3927038 - RNA, 17 nt, Human adenovirus D
uucucggccaaucagca

SEQ ID NO: 3927039 - RNA, 20 nt, Human adenovirus D
uucugcccuccgcccugagc

SEQ ID NO: 3927040 - RNA, 14 nt, Human adenovirus D
uucugguugucugu

SEQ ID NO: 3927041 - RNA, 14 nt, Human adenovirus D
uucuguacuuuguc

SEQ ID NO: 3927042 - RNA, 16 nt, Human adenovirus D
uugaaaaggcagcuga

SEQ ID NO: 3927043 - RNA, 16 nt, Human adenovirus D
uugaccaccagggagc

SEQ ID NO: 3927044 - RNA, 22 nt, Human adenovirus D
uugagagagaggaaggaggaca

SEQ ID NO: 3927045 - RNA, 12 nt, Human adenovirus D
uugagcuggccu

SEQ ID NO: 3927046 - RNA, 19 nt, Human adenovirus D
uugagcuuguuuauguuga

SEQ ID NO: 3927047 - RNA, 15 nt, Human adenovirus D
uugcccuuacaugua

SEQ ID NO: 3927048 - RNA, 15 nt, Human adenovirus D
uugcgcccugagagc

SEQ ID NO: 3927049 - RNA, 22 nt, Human adenovirus D
uugcugaccaauagacagcaga

SEQ ID NO: 3927050 - RNA, 20 nt, Human adenovirus D
uuggugggauaacagcgccc

SEQ ID NO: 3927051 - RNA, 18 nt, Human adenovirus D
uuggugggcagaggaggu

SEQ ID NO: 3927052 - RNA, 17 nt, Human adenovirus D
uuguugagggaggaaag

SEQ ID NO: 3927053 - RNA, 14 nt, Human adenovirus D
uuuaacuguaucug

SEQ ID NO: 3927054 - RNA, 22 nt, Human adenovirus D
uuuccccaccuacuccucuuug

SEQ ID NO: 3927055 - RNA, 10 nt, Human adenovirus D
uuuccucugu

SEQ ID NO: 3927056 - RNA, 23 nt, Human adenovirus D
uuucuggggucagagacaucaua

SEQ ID NO: 3927057 - RNA, 16 nt, Human adenovirus D
uuuuagaauggaagac

SEQ ID NO: 3927058 - RNA, 19 nt, Human adenovirus D
uuuuccaugcacucaucca

SEQ ID NO: 3927059 - RNA, 21 nt, Human adenovirus D
uuuucugguugacaaauggag

SEQ ID NO: 3927060 - RNA, 18 nt, Human adenovirus D
uuuugaagucauguguga

SEQ ID NO: 3927061 - RNA, 21 nt, Human adenovirus D
aaaaagcagcacaguaaguuc

SEQ ID NO: 3927062 - RNA, 22 nt, Human adenovirus D
aaaaagucacuuaaguccuggg

SEQ ID NO: 3927063 - RNA, 22 nt, Human adenovirus D
aaaaaucacucuuuccagcagc

SEQ ID NO: 3927064 - RNA, 13 nt, Human adenovirus D
aaaacuaaugaca

SEQ ID NO: 3927065 - RNA, 13 nt, Human adenovirus D
aaaagcagcacag

SEQ ID NO: 3927066 - RNA, 20 nt, Human adenovirus D
aaaagcguccgcuccgcagu

SEQ ID NO: 3927067 - RNA, 15 nt, Human adenovirus D
aaaagcucccacagu

SEQ ID NO: 3927068 - RNA, 11 nt, Human adenovirus D
aaaagucacuu

SEQ ID NO: 3927069 - RNA, 22 nt, Human adenovirus D
aaaauagucuauuuuugaggau

SEQ ID NO: 3927070 - RNA, 11 nt, Human adenovirus D
aaaauaugcaa

SEQ ID NO: 3927071 - RNA, 15 nt, Human adenovirus D
aaacaauaaaaaacu

SEQ ID NO: 3927072 - RNA, 13 nt, Human adenovirus D
aaacaggcaaaga

SEQ ID NO: 3927073 - RNA, 12 nt, Human adenovirus D
aaacauccaugu

SEQ ID NO: 3927074 - RNA, 17 nt, Human adenovirus D
aaaccacauuugaagau

SEQ ID NO: 3927075 - RNA, 19 nt, Human adenovirus D
aaaccccgccaaaaaaaca

SEQ ID NO: 3927076 - RNA, 22 nt, Human adenovirus D
aaaccuuaguugggccuccagg

SEQ ID NO: 3927077 - RNA, 21 nt, Human adenovirus D
aaacuaagguggcuauuuuca

SEQ ID NO: 3927078 - RNA, 17 nt, Human adenovirus D
aaacuaggcgcagcugc

SEQ ID NO: 3927079 - RNA, 12 nt, Human adenovirus D
aaacuggggcga

SEQ ID NO: 3927080 - RNA, 19 nt, Human adenovirus D
aaacuugagcuuguuuaug

SEQ ID NO: 3927081 - RNA, 15 nt, Human adenovirus D
aaagaaacagcagag

SEQ ID NO: 3927082 - RNA, 17 nt, Human adenovirus D
aaagaaguggccagugu

SEQ ID NO: 3927083 - RNA, 22 nt, Human adenovirus D
aaagaggcuccggguggaagau

SEQ ID NO: 3927084 - RNA, 17 nt, Human adenovirus D
aaagccacaaccagagc

SEQ ID NO: 3927085 - RNA, 12 nt, Human adenovirus D
aaagccagcagc

SEQ ID NO: 3927086 - RNA, 13 nt, Human adenovirus D
aaagccagcagca

SEQ ID NO: 3927087 - RNA, 19 nt, Human adenovirus D
aaaggcgcgcguccacgcc

SEQ ID NO: 3927088 - RNA, 14 nt, Human adenovirus D
aaagggaugucaaa

SEQ ID NO: 3927089 - RNA, 19 nt, Human adenovirus D
aaaucacaucggacugggu

SEQ ID NO: 3927090 - RNA, 20 nt, Human adenovirus D
aaaucacucuuuccagcagc

SEQ ID NO: 3927091 - RNA, 21 nt, Human adenovirus D
aaaucacucuuuccagcagca

SEQ ID NO: 3927092 - RNA, 17 nt, Human adenovirus D
uccagcgaaagagagcu

SEQ ID NO: 3927093 - RNA, 19 nt, Human adenovirus D
uccagcgcucguacccgcu

SEQ ID NO: 3927094 - RNA, 17 nt, Human adenovirus D
uccagcggcgcaggggc

SEQ ID NO: 3927095 - RNA, 18 nt, Human adenovirus D
uccaguaggaaccagcac

SEQ ID NO: 3927096 - RNA, 17 nt, Human adenovirus D
uccaguuaaugcugccu

SEQ ID NO: 3927097 - RNA, 21 nt, Human adenovirus D
uccaugaugauggcgaugggc

SEQ ID NO: 3927098 - RNA, 20 nt, Human adenovirus D
uccaugcagacacuugagcu

SEQ ID NO: 3927099 - RNA, 13 nt, Human adenovirus D
ucccaccaccagc

SEQ ID NO: 3927100 - RNA, 14 nt, Human adenovirus D
ucccaccccuuaca

SEQ ID NO: 3927101 - RNA, 15 nt, Human adenovirus D
ucccaccgcgccgcc

SEQ ID NO: 3927102 - RNA, 13 nt, Human adenovirus D
ucccagcgccgcg

SEQ ID NO: 3927103 - RNA, 18 nt, Human adenovirus D
ucccaugauucaguacuu

SEQ ID NO: 3927104 - RNA, 22 nt, Human adenovirus D
uccccagcgguucugggucacc

SEQ ID NO: 3927105 - RNA, 17 nt, Human adenovirus D
uccccgacccccuucca

SEQ ID NO: 3927106 - RNA, 19 nt, Human adenovirus D
uccccucaucacaucagcc

SEQ ID NO: 3927107 - RNA, 19 nt, Human adenovirus D
uccccucgaaucaggcugg

SEQ ID NO: 3927108 - RNA, 23 nt, Human adenovirus D
uccccucgaaucaggcuggagcc

SEQ ID NO: 3927109 - RNA, 15 nt, Human adenovirus D
ucccgcucccagcga

SEQ ID NO: 3927110 - RNA, 16 nt, Human adenovirus D
ucccggccaaggccac

SEQ ID NO: 3927111 - RNA, 18 nt, Human adenovirus D
ucccggcgcaguacgcgc

SEQ ID NO: 3927112 - RNA, 22 nt, Human adenovirus D
ucccgucucgacccgagcccga

SEQ ID NO: 3927113 - RNA, 21 nt, Human adenovirus D
uccgcaggaguccaccgcucc

SEQ ID NO: 3927114 - RNA, 15 nt, Human adenovirus D
uccgcauccaagaag

SEQ ID NO: 3927115 - RNA, 15 nt, Human adenovirus D
uccgcgaacagcagc

SEQ ID NO: 3927116 - RNA, 15 nt, Human adenovirus D
uccgcgaccuccucc

SEQ ID NO: 3927117 - RNA, 12 nt, Human adenovirus D
uccgcgcuccgu

SEQ ID NO: 3927118 - RNA, 16 nt, Human adenovirus D
uccgcggccacuuccg

SEQ ID NO: 3927119 - RNA, 21 nt, Human adenovirus D
uccguaaccaucgaaaccaga

SEQ ID NO: 3927120 - RNA, 17 nt, Human adenovirus D
uccuacggagggcagaa

SEQ ID NO: 3927121 - RNA, 13 nt, Human adenovirus D
uccuccgcaucca

SEQ ID NO: 3927122 - RNA, 13 nt, Human adenovirus D
uccuccuggagau

SEQ ID NO: 3927123 - RNA, 15 nt, Human adenovirus D
uccucgcucuggggc

SEQ ID NO: 3927124 - RNA, 14 nt, Human adenovirus D
uccucuccuccucc

SEQ ID NO: 3927125 - RNA, 15 nt, Human adenovirus D
uccucuucugucucu

SEQ ID NO: 3927126 - RNA, 15 nt, Human adenovirus D
uccucuucuuccaug

SEQ ID NO: 3927127 - RNA, 21 nt, Human adenovirus D
uccugagauaugugcagcaga

SEQ ID NO: 3927128 - RNA, 22 nt, Human adenovirus D
uccugcacuuucuuugccauca

SEQ ID NO: 3927129 - RNA, 14 nt, Human adenovirus D
uccugcgaaagccc

SEQ ID NO: 3927130 - RNA, 17 nt, Human adenovirus D
uccugcugcuccaccac

SEQ ID NO: 3927131 - RNA, 20 nt, Human adenovirus D
uccugggccacuacagcuga

SEQ ID NO: 3927132 - RNA, 21 nt, Human adenovirus D
uccugggccacuacagcugac

SEQ ID NO: 3927133 - RNA, 20 nt, Human adenovirus D
uccuggucugcaacccccag

SEQ ID NO: 3927134 - RNA, 12 nt, Human adenovirus D
uccuuucgcugc

SEQ ID NO: 3927135 - RNA, 18 nt, Human adenovirus D
ucgacgcagugagagaag

SEQ ID NO: 3927136 - RNA, 16 nt, Human adenovirus D
ucgacggugagcagcu

SEQ ID NO: 3927137 - RNA, 24 nt, Human adenovirus D
ucgagacgucccagagcucgguga

SEQ ID NO: 3927138 - RNA, 13 nt, Human adenovirus D
ucgagcacagcac

SEQ ID NO: 3927139 - RNA, 21 nt, Human adenovirus D
ucgaggacgugagcggcgagg

SEQ ID NO: 3927140 - RNA, 20 nt, Human adenovirus D
ucgaguacgaggccaugcug

SEQ ID NO: 3927141 - RNA, 20 nt, Human adenovirus D
ucgaucaucuccccgcggcg

SEQ ID NO: 3927142 - RNA, 19 nt, Human adenovirus D
ucgcacucgacgagccagg

SEQ ID NO: 3927143 - RNA, 20 nt, Human adenovirus D
ucgcagcgcugcacgggcug

SEQ ID NO: 3927144 - RNA, 19 nt, Human adenovirus D
ucgccagggaacugaaaga

SEQ ID NO: 3927145 - RNA, 23 nt, Human adenovirus D
ucgcccgaccgcugucucagccu

SEQ ID NO: 3927146 - RNA, 22 nt, Human adenovirus D
ucgccgcaccauccgcgccgca

SEQ ID NO: 3927147 - RNA, 13 nt, Human adenovirus D
ucgcggaugaugu

SEQ ID NO: 3927148 - RNA, 14 nt, Human adenovirus D
ucgcggaugauguc

SEQ ID NO: 3927149 - RNA, 13 nt, Human adenovirus D
ucgcggcugcugc

SEQ ID NO: 3927150 - RNA, 17 nt, Human adenovirus D
ucgcgguggggcgguga

SEQ ID NO: 3927151 - RNA, 16 nt, Human adenovirus D
ucgcucguucugccca

SEQ ID NO: 3927152 - RNA, 12 nt, Human adenovirus D
ucgcugcugccg

SEQ ID NO: 3927153 - RNA, 11 nt, Human adenovirus D
ucggagccccu

SEQ ID NO: 3927154 - RNA, 17 nt, Human adenovirus D
ucggaguaccugagccc

SEQ ID NO: 3927155 - RNA, 19 nt, Human adenovirus D
ucggcuggaacccgcgcuc

SEQ ID NO: 3927156 - RNA, 19 nt, Human adenovirus D
ucgggcauuaacggggugg

SEQ ID NO: 3927157 - RNA, 19 nt, Human adenovirus D
ucggggcauugcaggccgu

SEQ ID NO: 3927158 - RNA, 19 nt, Human adenovirus D
ucguccagaugcucuccca

SEQ ID NO: 3927159 - RNA, 15 nt, Human adenovirus D
ucguuaguccagcag

SEQ ID NO: 3927160 - RNA, 12 nt, Human adenovirus D
ucguucugccca

SEQ ID NO: 3927161 - RNA, 16 nt, Human adenovirus D
ucuaaacuaaagccaa

SEQ ID NO: 3927162 - RNA, 19 nt, Human adenovirus D
ucuacgcguacauccagca

SEQ ID NO: 3927163 - RNA, 16 nt, Human adenovirus D
ucuauugcuagcccuu

SEQ ID NO: 3927164 - RNA, 23 nt, Human adenovirus D
ucuccaucauguucgacuccucg

SEQ ID NO: 3927165 - RNA, 14 nt, Human adenovirus D
ucuccauccccucg

SEQ ID NO: 3927166 - RNA, 22 nt, Human adenovirus D
ucucccacagcucgcgguugag

SEQ ID NO: 3927167 - RNA, 17 nt, Human adenovirus D
ucucugaaucucggcca

SEQ ID NO: 3927168 - RNA, 18 nt, Human adenovirus D
ucucuucaacaucugugc

SEQ ID NO: 3927169 - RNA, 16 nt, Human adenovirus D
ucucuucuuguaacuu

SEQ ID NO: 3927170 - RNA, 23 nt, Human adenovirus D
ucugccagcagaaaugggcccuu

SEQ ID NO: 3927171 - RNA, 23 nt, Human adenovirus D
ucugccuggugaagggcacagcc

SEQ ID NO: 3927172 - RNA, 15 nt, Human adenovirus D
ucuggacccccagac

SEQ ID NO: 3927173 - RNA, 22 nt, Human adenovirus D
ucuggacccuccgucggaagag

SEQ ID NO: 3927174 - RNA, 19 nt, Human adenovirus D
ucuggagaaguuccucugc

SEQ ID NO: 3927175 - RNA, 13 nt, Human adenovirus D
ucuggcuugcuuc

SEQ ID NO: 3927176 - RNA, 14 nt, Human adenovirus D
ucuguccaaccccg

SEQ ID NO: 3927177 - RNA, 17 nt, Human adenovirus D
ucuguccaaccccgaag

SEQ ID NO: 3927178 - RNA, 19 nt, Human adenovirus D
ucuuacgagggucuuuuug

SEQ ID NO: 3927179 - RNA, 12 nt, Human adenovirus D
ucuuccuggggc

SEQ ID NO: 3927180 - RNA, 16 nt, Human adenovirus D
ucuucucccacagcuc

SEQ ID NO: 3927181 - RNA, 11 nt, Human adenovirus D
ucuucugccug

SEQ ID NO: 3927182 - RNA, 12 nt, Human adenovirus D
ucuucugggugg

SEQ ID NO: 3927183 - RNA, 16 nt, Human adenovirus D
ucuuuagacucugaca

SEQ ID NO: 3927184 - RNA, 14 nt, Human adenovirus D
ucuuuccagcagca

SEQ ID NO: 3927185 - RNA, 19 nt, Human adenovirus D
ugaaaaaaacgguuuccgg

SEQ ID NO: 3927186 - RNA, 13 nt, Human adenovirus D
ugaaaaccaagga

SEQ ID NO: 3927187 - RNA, 16 nt, Human adenovirus D
ugaaagcauacagaga

SEQ ID NO: 3927188 - RNA, 19 nt, Human adenovirus D
ugaaagcuauaaaaaugaa

SEQ ID NO: 3927189 - RNA, 12 nt, Human adenovirus D
ugaacaggagca

SEQ ID NO: 3927190 - RNA, 19 nt, Human adenovirus D
ugaaccacacggccagcag

SEQ ID NO: 3927191 - RNA, 22 nt, Human adenovirus D
ugaaccugaacggcaucuuuga

SEQ ID NO: 3927192 - RNA, 15 nt, Human adenovirus D
ugaaccugagccagg

SEQ ID NO: 3927193 - RNA, 15 nt, Human adenovirus D
ugaacgccuuccugg

SEQ ID NO: 3927194 - RNA, 18 nt, Human adenovirus D
ugaacgccuuccuggcga

SEQ ID NO: 3927195 - RNA, 15 nt, Human adenovirus D
ugaacuucuugcuga

SEQ ID NO: 3927196 - RNA, 12 nt, Human adenovirus D
ugaacuugcuga

SEQ ID NO: 3927197 - RNA, 17 nt, Human adenovirus D
ugaagaaaacuggcaag

SEQ ID NO: 3927198 - RNA, 15 nt, Human adenovirus D
ugaagagggagagga

SEQ ID NO: 3927199 - RNA, 15 nt, Human adenovirus D
ugaagcaggagcgca

SEQ ID NO: 3927200 - RNA, 23 nt, Human adenovirus D
ugaagcaguguguguuugagaaa

SEQ ID NO: 3927201 - RNA, 12 nt, Human adenovirus D
ugaagcgccgcc

SEQ ID NO: 3927202 - RNA, 13 nt, Human adenovirus D
ugaaucucgguuu

SEQ ID NO: 3927203 - RNA, 18 nt, Human adenovirus D
ugacaauucagagccagg

SEQ ID NO: 3927204 - RNA, 18 nt, Human adenovirus D
ugacagaggcaacagcaa

SEQ ID NO: 3927205 - RNA, 17 nt, Human adenovirus D
ugacauccauggccagg

SEQ ID NO: 3927206 - RNA, 20 nt, Human adenovirus D
ugacaugcaaaaucuuacac

SEQ ID NO: 3927207 - RNA, 15 nt, Human adenovirus D
ugaccagacccaggc

SEQ ID NO: 3927208 - RNA, 19 nt, Human adenovirus D
ugaccgaggagcugagacc

SEQ ID NO: 3927209 - RNA, 13 nt, Human adenovirus D
ugacuacccacug

SEQ ID NO: 3927210 - RNA, 12 nt, Human adenovirus D
ugacucuccuga

SEQ ID NO: 3927211 - RNA, 15 nt, Human adenovirus D
cgcuggguggccggc

SEQ ID NO: 3927212 - RNA, 17 nt, Human adenovirus D
cgcugguagggggcgcc

SEQ ID NO: 3927213 - RNA, 15 nt, Human adenovirus D
cgcuguaccgcagcu

SEQ ID NO: 3927214 - RNA, 21 nt, Human adenovirus D
cgcuguccacgagcgccagcu

SEQ ID NO: 3927215 - RNA, 17 nt, Human adenovirus D
cgcuguggagccacugc

SEQ ID NO: 3927216 - RNA, 19 nt, Human adenovirus D
cgcuuccucgcgcgccacu

SEQ ID NO: 3927217 - RNA, 16 nt, Human adenovirus D
cgcuucuucgagaggg

SEQ ID NO: 3927218 - RNA, 14 nt, Human adenovirus D
cgcuugacagcacc

SEQ ID NO: 3927219 - RNA, 15 nt, Human adenovirus D
cggaccaccccaggc

SEQ ID NO: 3927220 - RNA, 18 nt, Human adenovirus D
cggacugccaccgccgcc

SEQ ID NO: 3927221 - RNA, 23 nt, Human adenovirus D
cggacuggguuaguaugucccug

SEQ ID NO: 3927222 - RNA, 20 nt, Human adenovirus D
cggacuugauuggccugucc

SEQ ID NO: 3927223 - RNA, 17 nt, Human adenovirus D
cggagaacaaggccauc

SEQ ID NO: 3927224 - RNA, 19 nt, Human adenovirus D
cggagaggcugacgagccc

SEQ ID NO: 3927225 - RNA, 14 nt, Human adenovirus D
cggagccucgcucc

SEQ ID NO: 3927226 - RNA, 22 nt, Human adenovirus D
cggagcgacacccccgcgugca

SEQ ID NO: 3927227 - RNA, 13 nt, Human adenovirus D
cggaggagccaag

SEQ ID NO: 3927228 - RNA, 18 nt, Human adenovirus D
cggaggccaucgugcaga

SEQ ID NO: 3927229 - RNA, 12 nt, Human adenovirus D
cggaggcuggcu

SEQ ID NO: 3927230 - RNA, 13 nt, Human adenovirus D
cggagugaugaau

SEQ ID NO: 3927231 - RNA, 21 nt, Human adenovirus D
cggcaaucaacuacucggugc

SEQ ID NO: 3927232 - RNA, 20 nt, Human adenovirus D
cggcacggucuggccgguga

SEQ ID NO: 3927233 - RNA, 18 nt, Human adenovirus D
cggcagcggggccuggug

SEQ ID NO: 3927234 - RNA, 18 nt, Human adenovirus D
cggcagcuuuuugagcuc

SEQ ID NO: 3927235 - RNA, 21 nt, Human adenovirus D
cggcaguuucgcacgccucgc

SEQ ID NO: 3927236 - RNA, 18 nt, Human adenovirus D
cggcaucuuccuggggca

SEQ ID NO: 3927237 - RNA, 19 nt, Human adenovirus D
cggcaugaaauugcgggug

SEQ ID NO: 3927238 - RNA, 16 nt, Human adenovirus D
cggccaaccuggugac

SEQ ID NO: 3927239 - RNA, 18 nt, Human adenovirus D
cggccaaucagcaguagc

SEQ ID NO: 3927240 - RNA, 17 nt, Human adenovirus D
cggccccgcgggcaggg

SEQ ID NO: 3927241 - RNA, 16 nt, Human adenovirus D
cggccguagcaggcgc

SEQ ID NO: 3927242 - RNA, 17 nt, Human adenovirus D
cggccguagcaggcgcc

SEQ ID NO: 3927243 - RNA, 21 nt, Human adenovirus D
cggccuacgagcagacgguga

SEQ ID NO: 3927244 - RNA, 18 nt, Human adenovirus D
cggccugaaccgccgccg

SEQ ID NO: 3927245 - RNA, 23 nt, Human adenovirus D
cggcgaacgugccgcgcgggcag

SEQ ID NO: 3927246 - RNA, 21 nt, Human adenovirus D
cggcgaacuuucuccacaccu

SEQ ID NO: 3927247 - RNA, 24 nt, Human adenovirus D
cggcgaggggcugcuagagugcca

SEQ ID NO: 3927248 - RNA, 19 nt, Human adenovirus D
cggcgccuccguccgcuuc

SEQ ID NO: 3927249 - RNA, 18 nt, Human adenovirus D
cggcgcgagcugagcgac

SEQ ID NO: 3927250 - RNA, 16 nt, Human adenovirus D
cggcgcgcccggggcc

SEQ ID NO: 3927251 - RNA, 14 nt, Human adenovirus D
cggcgcgcuccuug

SEQ ID NO: 3927252 - RNA, 23 nt, Human adenovirus D
cggcgcguggaggaagugcugga

SEQ ID NO: 3927253 - RNA, 13 nt, Human adenovirus D
cggcgggccaugc

SEQ ID NO: 3927254 - RNA, 16 nt, Human adenovirus D
cggcgggccaugcgca

SEQ ID NO: 3927255 - RNA, 15 nt, Human adenovirus D
cggcgggggcggaga

SEQ ID NO: 3927256 - RNA, 22 nt, Human adenovirus D
cggcgguuccggccccgcgggc

SEQ ID NO: 3927257 - RNA, 20 nt, Human adenovirus D
cggcguaguugcgcaggcgc

SEQ ID NO: 3927258 - RNA, 19 nt, Human adenovirus D
cggcuaccagggcuuccac

SEQ ID NO: 3927259 - RNA, 11 nt, Human adenovirus D
cggcugagcuc

SEQ ID NO: 3927260 - RNA, 19 nt, Human adenovirus D
cggcugcacgagcgccagg

SEQ ID NO: 3927261 - RNA, 21 nt, Human adenovirus D
cggcugggguauuacuaggcc

SEQ ID NO: 3927262 - RNA, 13 nt, Human adenovirus D
cggcuuuaacaau

SEQ ID NO: 3927263 - RNA, 21 nt, Human adenovirus D
cgggaccggggaggcaccacc

SEQ ID NO: 3927264 - RNA, 20 nt, Human adenovirus D
cgggacuuggucaccccgcc

SEQ ID NO: 3927265 - RNA, 14 nt, Human adenovirus D
cgggaucgccaggc

SEQ ID NO: 3927266 - RNA, 20 nt, Human adenovirus D
cgggaugaugaccgagcuga

SEQ ID NO: 3927267 - RNA, 15 nt, Human adenovirus D
cgggcagggagcugc

SEQ ID NO: 3927268 - RNA, 15 nt, Human adenovirus D
cgggccaugaggguc

SEQ ID NO: 3927269 - RNA, 17 nt, Human adenovirus D
cgggccgccgggccaug

SEQ ID NO: 3927270 - RNA, 16 nt, Human adenovirus D
cgggcgggcagggagc

SEQ ID NO: 3927271 - RNA, 19 nt, Human adenovirus D
cgggcuguggggcgugcag

SEQ ID NO: 3927272 - RNA, 20 nt, Human adenovirus D
cggggcauugcaggccgugc

SEQ ID NO: 3927273 - RNA, 22 nt, Human adenovirus D
cggggcgaaguuccccucgcag

SEQ ID NO: 3927274 - RNA, 24 nt, Human adenovirus D
cggggcgggggugaugagcugcga

SEQ ID NO: 3927275 - RNA, 21 nt, Human adenovirus D
cggggugaacaucccccgcaa

SEQ ID NO: 3927276 - RNA, 19 nt, Human adenovirus D
cgggguuguggacuuccgc

SEQ ID NO: 3927277 - RNA, 15 nt, Human adenovirus D
cgggucucccccagc

SEQ ID NO: 3927278 - RNA, 21 nt, Human adenovirus D
cgggugaccccgacgccccug

SEQ ID NO: 3927279 - RNA, 15 nt, Human adenovirus D
cgguauauggcuccu

SEQ ID NO: 3927280 - RNA, 20 nt, Human adenovirus D
cgguccucggucaggagcaa

SEQ ID NO: 3927281 - RNA, 21 nt, Human adenovirus D
cggucguuguccaccaggggg

SEQ ID NO: 3927282 - RNA, 17 nt, Human adenovirus D
cggucugcaggccgggc

SEQ ID NO: 3927283 - RNA, 13 nt, Human adenovirus D
cggugcugcugcc

SEQ ID NO: 3927284 - RNA, 18 nt, Human adenovirus D
cggugguggagauggaag

SEQ ID NO: 3927285 - RNA, 15 nt, Human adenovirus D
cgguguagcccgugc

SEQ ID NO: 3927286 - RNA, 20 nt, Human adenovirus D
cguaccugggucaccugcua

SEQ ID NO: 3927287 - RNA, 17 nt, Human adenovirus D
cguacuucugccagcag

SEQ ID NO: 3927288 - RNA, 16 nt, Human adenovirus D
cguagcagcccugugg

SEQ ID NO: 3927289 - RNA, 14 nt, Human adenovirus D
cgucaccugcggcg

SEQ ID NO: 3927290 - RNA, 18 nt, Human adenovirus D
cgucacggugaaggggug

SEQ ID NO: 3927291 - RNA, 22 nt, Human adenovirus D
cgucacuuuugcccuuacaugu

SEQ ID NO: 3927292 - RNA, 18 nt, Human adenovirus D
cgucauguccuuccaggg

SEQ ID NO: 3927293 - RNA, 16 nt, Human adenovirus D
cgucccggaggagggg

SEQ ID NO: 3927294 - RNA, 13 nt, Human adenovirus D
cguccgcaggcgg

SEQ ID NO: 3927295 - RNA, 20 nt, Human adenovirus D
cguccgcaguacucgcagcg

SEQ ID NO: 3927296 - RNA, 14 nt, Human adenovirus D
cgucggaagaggag

SEQ ID NO: 3927297 - RNA, 14 nt, Human adenovirus D
cgucuacaaggccc

SEQ ID NO: 3927298 - RNA, 14 nt, Human adenovirus D
gaaaaaauugagga

SEQ ID NO: 3927299 - RNA, 13 nt, Human adenovirus D
gaaaauuugcaaa

SEQ ID NO: 3927300 - RNA, 17 nt, Human adenovirus D
gaaacagauccugcugc

SEQ ID NO: 3927301 - RNA, 19 nt, Human adenovirus D
gaaaccccagacacccacg

SEQ ID NO: 3927302 - RNA, 15 nt, Human adenovirus D
gaaacgccccugcaa

SEQ ID NO: 3927303 - RNA, 20 nt, Human adenovirus D
gaaacgucccagcagcaccc

SEQ ID NO: 3927304 - RNA, 16 nt, Human adenovirus D
gaaagcaguucacuag

SEQ ID NO: 3927305 - RNA, 17 nt, Human adenovirus D
gaaaguaugucucuggu

SEQ ID NO: 3927306 - RNA, 13 nt, Human adenovirus D
gaaauaaaaaacc

SEQ ID NO: 3927307 - RNA, 20 nt, Human adenovirus D
gaaaugaggcaggccaugga

SEQ ID NO: 3927308 - RNA, 18 nt, Human adenovirus D
gaaaugguucacggccuu

SEQ ID NO: 3927309 - RNA, 19 nt, Human adenovirus D
gaacaaaacccaugaaaga

SEQ ID NO: 3927310 - RNA, 19 nt, Human adenovirus D
gaacagcauauaccccucc

SEQ ID NO: 3927311 - RNA, 16 nt, Human adenovirus D
gaacaguggcaaugca

SEQ ID NO: 3927312 - RNA, 21 nt, Human adenovirus D
gaaccccacaggaugaacagg

SEQ ID NO: 3927313 - RNA, 23 nt, Human adenovirus D
gaacccuccaguuuguggaggag

SEQ ID NO: 3927314 - RNA, 17 nt, Human adenovirus D
gaaccgccuggggcaga

SEQ ID NO: 3927315 - RNA, 22 nt, Human adenovirus D
gaaccucaaguaggugaagaaa

SEQ ID NO: 3927316 - RNA, 18 nt, Human adenovirus D
gaaccugcuccugcuccc

SEQ ID NO: 3927317 - RNA, 17 nt, Human adenovirus D
gaacgacucgcugcugc

SEQ ID NO: 3927318 - RNA, 22 nt, Human adenovirus D
gaacuccucuaucucgccuggu

SEQ ID NO: 3927319 - RNA, 13 nt, Human adenovirus D
gaacugaugaaaa

SEQ ID NO: 3927320 - RNA, 15 nt, Human adenovirus D
gaacugaugaaaaag

SEQ ID NO: 3927321 - RNA, 14 nt, Human adenovirus D
gaacuggcagagca

SEQ ID NO: 3927322 - RNA, 23 nt, Human adenovirus D
gaacuuccaaacuauugcuuccc

SEQ ID NO: 3927323 - RNA, 15 nt, Human adenovirus D
gaagaaaacuggcaa

SEQ ID NO: 3927324 - RNA, 21 nt, Human adenovirus D
gaagaaaugaggcaggccaug

SEQ ID NO: 3927325 - RNA, 14 nt, Human adenovirus D
gaagaacaggagcc

SEQ ID NO: 3927326 - RNA, 18 nt, Human adenovirus D
gaagaccauaguaaagaa

SEQ ID NO: 3927327 - RNA, 23 nt, Human adenovirus D
gaagacgaaugggaagaagagac

SEQ ID NO: 3927328 - RNA, 16 nt, Human adenovirus D
gaagacuauaaaguca

SEQ ID NO: 3927329 - RNA, 19 nt, Human adenovirus D
gaagagaaucuugccugcu

SEQ ID NO: 3927330 - RNA, 18 nt, Human adenovirus D
gaagaucagcugcagcgc

SEQ ID NO: 3927331 - RNA, 16 nt, Human adenovirus D
gaagauggggccccgc

SEQ ID NO: 3927332 - RNA, 18 nt, Human adenovirus D
gaagccaugcugcgcaac

SEQ ID NO: 3927333 - RNA, 21 nt, Human adenovirus D
gaagcccgugaccugcagcag

SEQ ID NO: 3927334 - RNA, 23 nt, Human adenovirus D
gaagcccgugaccugcagcaggu

SEQ ID NO: 3927335 - RNA, 22 nt, Human adenovirus D
gaagcccugagccgccagcugg

SEQ ID NO: 3927336 - RNA, 13 nt, Human adenovirus D
gaagcccugguuu

SEQ ID NO: 3927337 - RNA, 20 nt, Human adenovirus D
gaagccguggcgcagcgcga

SEQ ID NO: 3927338 - RNA, 20 nt, Human adenovirus D
gaagccuucuauggaggcag

SEQ ID NO: 3927339 - RNA, 19 nt, Human adenovirus D
gaaggaagcccagagcucg

SEQ ID NO: 3927340 - RNA, 17 nt, Human adenovirus D
gaaggcuuucacagcuu

SEQ ID NO: 3927341 - RNA, 22 nt, Human adenovirus D
gaagggcacagccucucugaag

SEQ ID NO: 3927342 - RNA, 15 nt, Human adenovirus D
gaagugcggcggcgg

SEQ ID NO: 3927343 - RNA, 15 nt, Human adenovirus D
gaagugcucaacccg

SEQ ID NO: 3927344 - RNA, 12 nt, Human adenovirus D
gaauaacaugcu

SEQ ID NO: 3927345 - RNA, 19 nt, Human adenovirus D
gaaucgcaagcgcccagag

SEQ ID NO: 3927346 - RNA, 23 nt, Human adenovirus D
gaaugagagccggagugaugaau

SEQ ID NO: 3927347 - RNA, 11 nt, Human adenovirus D
gaaugcugcua

SEQ ID NO: 3927348 - RNA, 20 nt, Human adenovirus D
gaauuuguauggaauaaaga

SEQ ID NO: 3927349 - RNA, 14 nt, Human adenovirus D
gacaaauggagcca

SEQ ID NO: 3927350 - RNA, 15 nt, Human adenovirus D
gacaacagccgcagg

SEQ ID NO: 3927351 - RNA, 14 nt, Human adenovirus D
gacaacgccaggcu

SEQ ID NO: 3927352 - RNA, 20 nt, Human adenovirus D
gacaaugauggauacuuggu

SEQ ID NO: 3927353 - RNA, 22 nt, Human adenovirus D
gacacagcaguccaugcccaac

SEQ ID NO: 3927354 - RNA, 14 nt, Human adenovirus D
gacaccacagugca

SEQ ID NO: 3927355 - RNA, 14 nt, Human adenovirus D
gacacugcagggag

SEQ ID NO: 3927356 - RNA, 11 nt, Human adenovirus D
gacagaagaag

SEQ ID NO: 3927357 - RNA, 18 nt, Human adenovirus D
gacagaggcaacagcaaa

SEQ ID NO: 3927358 - RNA, 23 nt, Human adenovirus D
gacagccaggucaaaacccacuc

SEQ ID NO: 3927359 - RNA, 18 nt, Human adenovirus D
gacagcgugguggcgacg

SEQ ID NO: 3927360 - RNA, 12 nt, Human adenovirus D
gacagggccugc

SEQ ID NO: 3927361 - RNA, 20 nt, Human adenovirus D
gacaguagcgucucaagaga

SEQ ID NO: 3927362 - RNA, 14 nt, Human adenovirus D
gaccaagcugcugu

SEQ ID NO: 3927363 - RNA, 16 nt, Human adenovirus D
gaccaauagacagcag

SEQ ID NO: 3927364 - RNA, 14 nt, Human adenovirus D
gaccacguccccgu

SEQ ID NO: 3927365 - RNA, 16 nt, Human adenovirus D
gaccaggcggcagagc

SEQ ID NO: 3927366 - RNA, 16 nt, Human adenovirus D
gaccagggguccccga

SEQ ID NO: 3927367 - RNA, 23 nt, Human adenovirus D
gaccagggguccccgacgggggg

SEQ ID NO: 3927368 - RNA, 15 nt, Human adenovirus D
gaccccauggaugag

SEQ ID NO: 3927369 - RNA, 14 nt, Human adenovirus D
gacccccaggcccu

SEQ ID NO: 3927370 - RNA, 22 nt, Human adenovirus D
gaccccgccauaagggcggcgc

SEQ ID NO: 3927371 - RNA, 17 nt, Human adenovirus D
gaccccuggcucccagc

SEQ ID NO: 3927372 - RNA, 18 nt, Human adenovirus D
gaccgccggcucaagcag

SEQ ID NO: 3927373 - RNA, 20 nt, Human adenovirus D
gaccgcggccguagcaggcg

SEQ ID NO: 3927374 - RNA, 21 nt, Human adenovirus D
gaccggaggcgugcacuggcu

SEQ ID NO: 3927375 - RNA, 15 nt, Human adenovirus D
gaccggggaggcacc

SEQ ID NO: 3927376 - RNA, 18 nt, Human adenovirus D
gaccguggcuucgagcag

SEQ ID NO: 3927377 - RNA, 14 nt, Human adenovirus D
gaccucggcacuca

SEQ ID NO: 3927378 - RNA, 15 nt, Human adenovirus D
gaccugaugaacaac

SEQ ID NO: 3927379 - RNA, 16 nt, Human adenovirus D
gaccuggcggaggcca

SEQ ID NO: 3927380 - RNA, 16 nt, Human adenovirus D
gaccugggcugcgggc

SEQ ID NO: 3927381 - RNA, 21 nt, Human adenovirus D
gaccuucaaccucaccaacca

SEQ ID NO: 3927382 - RNA, 18 nt, Human adenovirus D
gaccuugcagagcagcuc

SEQ ID NO: 3927383 - RNA, 14 nt, Human adenovirus D
gacgagaacccgag

SEQ ID NO: 3927384 - RNA, 22 nt, Human adenovirus D
gacgagaacguccauggcgcag

SEQ ID NO: 3927385 - RNA, 15 nt, Human adenovirus D
gacgagcggccgccg

SEQ ID NO: 3927386 - RNA, 16 nt, Human adenovirus D
gacgagcugcuugccg

SEQ ID NO: 3927387 - RNA, 13 nt, Human adenovirus D
gacgcagccggcg

SEQ ID NO: 3927388 - RNA, 14 nt, Human adenovirus D
gacgccccugagcg

SEQ ID NO: 3927389 - RNA, 16 nt, Human adenovirus D
gacggccuggccucgg

SEQ ID NO: 3927390 - RNA, 23 nt, Human adenovirus D
gacggcguaguugcgcaggcgcu

SEQ ID NO: 3927391 - RNA, 24 nt, Human adenovirus D
gacggcguaguugcgcaggcgcug

SEQ ID NO: 3927392 - RNA, 21 nt, Human adenovirus D
gacgggagcaauccuccagga

SEQ ID NO: 3927393 - RNA, 13 nt, Human adenovirus D
gacgguguagccc

SEQ ID NO: 3927394 - RNA, 19 nt, Human adenovirus D
gacgugcgcccggcguacg

SEQ ID NO: 3927395 - RNA, 17 nt, Human adenovirus D
gacguggacagcgcggu

SEQ ID NO: 3927396 - RNA, 15 nt, Human adenovirus D
gacguggugcugcug

SEQ ID NO: 3927397 - RNA, 19 nt, Human adenovirus D
gacuaccugcaucgcgcgg

SEQ ID NO: 3927398 - RNA, 22 nt, Human adenovirus D
gacuaucuaugaaagcauacag

SEQ ID NO: 3927399 - RNA, 15 nt, Human adenovirus D
gacuccgcgaccucc

SEQ ID NO: 3927400 - RNA, 20 nt, Human adenovirus D
gacucgcagacgagcggccg

SEQ ID NO: 3927401 - RNA, 14 nt, Human adenovirus D
gacucgcugcugca

SEQ ID NO: 3927402 - RNA, 14 nt, Human adenovirus D
gacucgggagcaaa

SEQ ID NO: 3927403 - RNA, 18 nt, Human adenovirus D
gacucgggggucugucau

SEQ ID NO: 3927404 - RNA, 13 nt, Human adenovirus D
gacugauggccac

SEQ ID NO: 3927405 - RNA, 19 nt, Human adenovirus D
gacuuccgcguaccugcgc

SEQ ID NO: 3927406 - RNA, 14 nt, Human adenovirus D
gacuugggcgggag

SEQ ID NO: 3927407 - RNA, 19 nt, Human adenovirus D
gagaaccgccuggggcaga

SEQ ID NO: 3927408 - RNA, 22 nt, Human adenovirus D
gagacaguagcgucucaagaga

SEQ ID NO: 3927409 - RNA, 18 nt, Human adenovirus D
gagaccaaguccagggug

SEQ ID NO: 3927410 - RNA, 18 nt, Human adenovirus D
gagaccagaggcagacuc

SEQ ID NO: 3927411 - RNA, 22 nt, Human adenovirus D
gagagcgggcaugaccucggca

SEQ ID NO: 3927412 - RNA, 24 nt, Human adenovirus D
gagaggcauggcaggcagcggccu

SEQ ID NO: 3927413 - RNA, 13 nt, Human adenovirus D
gagagucuggugg

SEQ ID NO: 3927414 - RNA, 14 nt, Human adenovirus D
gagauaugugcagc

SEQ ID NO: 3927415 - RNA, 17 nt, Human adenovirus D
gagauaugugcagcaga

SEQ ID NO: 3927416 - RNA, 22 nt, Human adenovirus D
gagaugucugugaagcagugug

SEQ ID NO: 3927417 - RNA, 12 nt, Human adenovirus D
gagcacagcagu

SEQ ID NO: 3927418 - RNA, 13 nt, Human adenovirus D
gagcagacgguga

SEQ ID NO: 3927419 - RNA, 22 nt, Human adenovirus D
gagcagacggugaagcaggagc

SEQ ID NO: 3927420 - RNA, 12 nt, Human adenovirus D
gagcagcacaga

SEQ ID NO: 3927421 - RNA, 20 nt, Human adenovirus D
gagcagcgcauccugcaacu

SEQ ID NO: 3927422 - RNA, 17 nt, Human adenovirus D
gagcaggaccugggcuu

SEQ ID NO: 3927423 - RNA, 23 nt, Human adenovirus D
gagcaggggcuacauucuggacu

SEQ ID NO: 3927424 - RNA, 21 nt, Human adenovirus D
gagcaggguaaagccagcagc

SEQ ID NO: 3927425 - RNA, 19 nt, Human adenovirus D
gagcagguuucucaacagc

SEQ ID NO: 3927426 - RNA, 15 nt, Human adenovirus D
gagccauagagggcg

SEQ ID NO: 3927427 - RNA, 20 nt, Human adenovirus D
gagccgcuaguggaagagau

SEQ ID NO: 3927428 - RNA, 17 nt, Human adenovirus D
gagccugcgcccgcgcc

SEQ ID NO: 3927429 - RNA, 15 nt, Human adenovirus D
gagcgacacccccgc

SEQ ID NO: 3927430 - RNA, 15 nt, Human adenovirus D
gagcuacagcaggag

SEQ ID NO: 3927431 - RNA, 23 nt, Human adenovirus D
gagcuacagcaggagugcaggga

SEQ ID NO: 3927432 - RNA, 13 nt, Human adenovirus D
gagcucacccacu

SEQ ID NO: 3927433 - RNA, 13 nt, Human adenovirus D
gagcucugcugcg

SEQ ID NO: 3927434 - RNA, 16 nt, Human adenovirus D
gagcucuuaagaaaga

SEQ ID NO: 3927435 - RNA, 20 nt, Human adenovirus D
gagcucuuaagaaagacaca

SEQ ID NO: 3927436 - RNA, 19 nt, Human adenovirus D
gagcugaugcugagccugc

SEQ ID NO: 3927437 - RNA, 15 nt, Human adenovirus D
gagcuggaagcccug

SEQ ID NO: 3927438 - RNA, 19 nt, Human adenovirus D
gagcuggaagcccugagcc

SEQ ID NO: 3927439 - RNA, 23 nt, Human adenovirus D
gaggaccagguccuugggucccg

SEQ ID NO: 3927440 - RNA, 12 nt, Human adenovirus D
gaggacggagag

SEQ ID NO: 3927441 - RNA, 15 nt, Human adenovirus D
gaggagguggcccug

SEQ ID NO: 3927442 - RNA, 23 nt, Human adenovirus D
gaggaguuugugcccucggucua

SEQ ID NO: 3927443 - RNA, 22 nt, Human adenovirus D
gaggaucgcggcgaacgagcca

SEQ ID NO: 3927444 - RNA, 18 nt, Human adenovirus D
gaggccaucgugcagaac

SEQ ID NO: 3927445 - RNA, 20 nt, Human adenovirus D
gaggccgccuacgguccaga

SEQ ID NO: 3927446 - RNA, 23 nt, Human adenovirus D
gaggcgaagauggggccccgcca

SEQ ID NO: 3927447 - RNA, 20 nt, Human adenovirus D
gaggcggagucuuccaugcg

SEQ ID NO: 3927448 - RNA, 21 nt, Human adenovirus D
gaggcggagucuuccaugcgg

SEQ ID NO: 3927449 - RNA, 14 nt, Human adenovirus D
gaggcgggugaggg

SEQ ID NO: 3927450 - RNA, 23 nt, Human adenovirus D
gaggcgggugagggcgugcuuga

SEQ ID NO: 3927451 - RNA, 14 nt, Human adenovirus D
gaggcgugcacugg

SEQ ID NO: 3927452 - RNA, 16 nt, Human adenovirus D
gaggcucgguuguuga

SEQ ID NO: 3927453 - RNA, 15 nt, Human adenovirus D
gagggaugcaugcgg

SEQ ID NO: 3927454 - RNA, 23 nt, Human adenovirus D
gagggaugcaugcggggggagau

SEQ ID NO: 3927455 - RNA, 17 nt, Human adenovirus D
gagggccucggcggcgu

SEQ ID NO: 3927456 - RNA, 20 nt, Human adenovirus D
gagggcgaagggcuggcgag

SEQ ID NO: 3927457 - RNA, 15 nt, Human adenovirus D
gagggcguuggagag

SEQ ID NO: 3927458 - RNA, 18 nt, Human adenovirus D
gagggcuacaaggaccgc

SEQ ID NO: 3927459 - RNA, 12 nt, Human adenovirus D
gaggggcagcaa

SEQ ID NO: 3927460 - RNA, 13 nt, Human adenovirus D
gagggucugcgag

SEQ ID NO: 3927461 - RNA, 22 nt, Human adenovirus D
gagguccucggggcauugcagg

SEQ ID NO: 3927462 - RNA, 19 nt, Human adenovirus D
gagguuccguuugugccuc

SEQ ID NO: 3927463 - RNA, 19 nt, Human adenovirus D
gaguaccugaacgacucgc

SEQ ID NO: 3927464 - RNA, 15 nt, Human adenovirus D
gaguacucauaaaga

SEQ ID NO: 3927465 - RNA, 18 nt, Human adenovirus D
gaguagucaaucucccac

SEQ ID NO: 3927466 - RNA, 22 nt, Human adenovirus D
gagucaaguuugacagcagaaa

SEQ ID NO: 3927467 - RNA, 22 nt, Human adenovirus D
gagugccacugccgcugcaacc

SEQ ID NO: 3927468 - RNA, 14 nt, Human adenovirus D
gaguggcggcccug

SEQ ID NO: 3927469 - RNA, 14 nt, Human adenovirus D
gagugggauaaaga

SEQ ID NO: 3927470 - RNA, 13 nt, Human adenovirus D
gaguugguggccg

SEQ ID NO: 3927471 - RNA, 12 nt, Human adenovirus D
gaguuguccugg

SEQ ID NO: 3927472 - RNA, 22 nt, Human adenovirus D
gauagcagcguguuggacuugg

SEQ ID NO: 3927473 - RNA, 20 nt, Human adenovirus D
gauauugcuucccuggaaga

SEQ ID NO: 3927474 - RNA, 20 nt, Human adenovirus D
gaucagucagugaagcccug

SEQ ID NO: 3927475 - RNA, 16 nt, Human adenovirus D
gaucaucuccccgcgg

SEQ ID NO: 3927476 - RNA, 21 nt, Human adenovirus D
gaucaucuccccgcggcggcg

SEQ ID NO: 3927477 - RNA, 22 nt, Human adenovirus D
gaucaucuccccgcggcggcga

SEQ ID NO: 3927478 - RNA, 17 nt, Human adenovirus D
gaucauguccaccugcg

SEQ ID NO: 3927479 - RNA, 12 nt, Human adenovirus D
gaucauugagag

SEQ ID NO: 3927480 - RNA, 21 nt, Human adenovirus D
gauccagucauagcaggggcg

SEQ ID NO: 3927481 - RNA, 18 nt, Human adenovirus D
gaucccaacagccuucag

SEQ ID NO: 3927482 - RNA, 14 nt, Human adenovirus D
gaucgccaggccuc

SEQ ID NO: 3927483 - RNA, 13 nt, Human adenovirus D
gaucgcgaggaca

SEQ ID NO: 3927484 - RNA, 20 nt, Human adenovirus D
gaucucggcgcggcgggggc

SEQ ID NO: 3927485 - RNA, 19 nt, Human adenovirus D
gaucucggucugcucgggc

SEQ ID NO: 3927486 - RNA, 12 nt, Human adenovirus D
gaucucugccau

SEQ ID NO: 3927487 - RNA, 16 nt, Human adenovirus D
gaucucugccauguuc

SEQ ID NO: 3927488 - RNA, 17 nt, Human adenovirus D
gaucugcaucucccagg

SEQ ID NO: 3927489 - RNA, 16 nt, Human adenovirus D
gaucugggaugcugcc

SEQ ID NO: 3927490 - RNA, 23 nt, Human adenovirus D
gaugauguccuugaggaggagac

SEQ ID NO: 3927491 - RNA, 23 nt, Human adenovirus D
gaugcaacgcaucauggcccuga

SEQ ID NO: 3927492 - RNA, 18 nt, Human adenovirus D
gaugccuucuccagggug

SEQ ID NO: 3927493 - RNA, 19 nt, Human adenovirus D
gaugcuucaacagcugugc

SEQ ID NO: 3927494 - RNA, 14 nt, Human adenovirus D
gaugggucugugcc

SEQ ID NO: 3927495 - RNA, 18 nt, Human adenovirus D
gauguaacaucaccacag

SEQ ID NO: 3927496 - RNA, 20 nt, Human adenovirus D
gaugucugugaagcagugug

SEQ ID NO: 3927497 - RNA, 20 nt, Human adenovirus D
gaugugcaguuuggccugga

SEQ ID NO: 3927498 - RNA, 15 nt, Human adenovirus D
gauuggccuguccug

SEQ ID NO: 3927499 - RNA, 18 nt, Human adenovirus D
gauuucaucaaucaucag

SEQ ID NO: 3927500 - RNA, 20 nt, Human adenovirus D
gauuuggcuuucuuugacac

SEQ ID NO: 3927501 - RNA, 19 nt, Human adenovirus D
gcaaaaaaaauuauaucua

SEQ ID NO: 3927502 - RNA, 15 nt, Human adenovirus D
gcaaacaauaaaaaa

SEQ ID NO: 3927503 - RNA, 19 nt, Human adenovirus D
gcaacaggggauguugauc

SEQ ID NO: 3927504 - RNA, 20 nt, Human adenovirus D
gcaacccaaaaucgagcagg

SEQ ID NO: 3927505 - RNA, 17 nt, Human adenovirus D
gcaacgaccggcugcuc

SEQ ID NO: 3927506 - RNA, 13 nt, Human adenovirus D
gcaacuuccagcc

SEQ ID NO: 3927507 - RNA, 11 nt, Human adenovirus D
gcaagaaggaa

SEQ ID NO: 3927508 - RNA, 20 nt, Human adenovirus D
gcaagaccuaccaaugaaaa

SEQ ID NO: 3927509 - RNA, 16 nt, Human adenovirus D
gcaagacgcaggccag

SEQ ID NO: 3927510 - RNA, 14 nt, Human adenovirus D
gcaaggugcugaca

SEQ ID NO: 3927511 - RNA, 17 nt, Human adenovirus D
gcaagucuacuggucgc

SEQ ID NO: 3927512 - RNA, 14 nt, Human adenovirus D
gcaauccuccagga

SEQ ID NO: 3927513 - RNA, 21 nt, Human adenovirus D
gcacaucgccgggcaggacgc

SEQ ID NO: 3927514 - RNA, 17 nt, Human adenovirus D
gcaccaccuacaccguc

SEQ ID NO: 3927515 - RNA, 23 nt, Human adenovirus D
gcaccacgcuucuuccccagcgg

SEQ ID NO: 3927516 - RNA, 18 nt, Human adenovirus D
gcaccaucacaggaggca

SEQ ID NO: 3927517 - RNA, 19 nt, Human adenovirus D
gcaccccccgcaggcagga

SEQ ID NO: 3927518 - RNA, 22 nt, Human adenovirus D
gcacccguccuccucgucccug

SEQ ID NO: 3927519 - RNA, 14 nt, Human adenovirus D
gcaccgcuccuggu

SEQ ID NO: 3927520 - RNA, 17 nt, Human adenovirus D
gcaccuagaccacugcc

SEQ ID NO: 3927521 - RNA, 18 nt, Human adenovirus D
gcaccugcgucugcagca

SEQ ID NO: 3927522 - RNA, 21 nt, Human adenovirus D
gcacgagcaagacgcaggcca

SEQ ID NO: 3927523 - RNA, 15 nt, Human adenovirus D
gcacgcccgccaugg

SEQ ID NO: 3927524 - RNA, 21 nt, Human adenovirus D
gcacgcccgcgagcgagggcg

SEQ ID NO: 3927525 - RNA, 22 nt, Human adenovirus D
gcacgcggccguucaugggcac

SEQ ID NO: 3927526 - RNA, 15 nt, Human adenovirus D
gcacgguaagagccc

SEQ ID NO: 3927527 - RNA, 21 nt, Human adenovirus D
gcacgucugacugccgccggc

SEQ ID NO: 3927528 - RNA, 22 nt, Human adenovirus D
gcacguggcggcggccaaccug

SEQ ID NO: 3927529 - RNA, 19 nt, Human adenovirus D
gcagaaauuucaagcuggg

SEQ ID NO: 3927530 - RNA, 23 nt, Human adenovirus D
gcagaacaacgauuucacccccg

SEQ ID NO: 3927531 - RNA, 18 nt, Human adenovirus D
gcagaagaagacgaaugg

SEQ ID NO: 3927532 - RNA, 19 nt, Human adenovirus D
gcagaagaucccggcgcag

SEQ ID NO: 3927533 - RNA, 14 nt, Human adenovirus D
gcagaagguggugg

SEQ ID NO: 3927534 - RNA, 16 nt, Human adenovirus D
gcagacacaccaggau

SEQ ID NO: 3927535 - RNA, 20 nt, Human adenovirus D
gcagacacauguccccuucc

SEQ ID NO: 3927536 - RNA, 14 nt, Human adenovirus D
gcagacagggccug

SEQ ID NO: 3927537 - RNA, 13 nt, Human adenovirus D
gcagagagauggc

SEQ ID NO: 3927538 - RNA, 17 nt, Human adenovirus D
gcagaggcacacagcuc

SEQ ID NO: 3927539 - RNA, 22 nt, Human adenovirus D
gcagcacauaaucaccauguua

SEQ ID NO: 3927540 - RNA, 15 nt, Human adenovirus D
gcagcaccucgguac

SEQ ID NO: 3927541 - RNA, 18 nt, Human adenovirus D
gcagcaggagcgugccgc

SEQ ID NO: 3927542 - RNA, 19 nt, Human adenovirus D
gcagcaggugcugccccag

SEQ ID NO: 3927543 - RNA, 16 nt, Human adenovirus D
gcagcaguagccccuc

SEQ ID NO: 3927544 - RNA, 22 nt, Human adenovirus D
gcagcggugguggaggcgcgcg

SEQ ID NO: 3927545 - RNA, 15 nt, Human adenovirus D
gcagcgugaagacgc

SEQ ID NO: 3927546 - RNA, 17 nt, Human adenovirus D
gcagcguguuggacuug

SEQ ID NO: 3927547 - RNA, 22 nt, Human adenovirus D
gcagcguugagcucacccacuu

SEQ ID NO: 3927548 - RNA, 17 nt, Human adenovirus D
gcagcugguaccugucc

SEQ ID NO: 3927549 - RNA, 16 nt, Human adenovirus D
gcagcuugcgcgcugg

SEQ ID NO: 3927550 - RNA, 16 nt, Human adenovirus D
gcaggaccaccaggac

SEQ ID NO: 3927551 - RNA, 14 nt, Human adenovirus D
gcaggagugcaggg

SEQ ID NO: 3927552 - RNA, 13 nt, Human adenovirus D
gcaggcagcggcc

SEQ ID NO: 3927553 - RNA, 21 nt, Human adenovirus D
gcaggcaggacucgcagacga

SEQ ID NO: 3927554 - RNA, 14 nt, Human adenovirus D
gcaggcgcuggaag

SEQ ID NO: 3927555 - RNA, 16 nt, Human adenovirus D
gcaggcgggacagagg

SEQ ID NO: 3927556 - RNA, 20 nt, Human adenovirus D
gcaggggcaucucgcugaug

SEQ ID NO: 3927557 - RNA, 19 nt, Human adenovirus D
gcaggguaaagccagcagc

SEQ ID NO: 3927558 - RNA, 18 nt, Human adenovirus D
gcaggugcugccccaggc

SEQ ID NO: 3927559 - RNA, 18 nt, Human adenovirus D
gcagguggacgagcagac

SEQ ID NO: 3927560 - RNA, 17 nt, Human adenovirus D
gcaguacucgcagcgcu

SEQ ID NO: 3927561 - RNA, 18 nt, Human adenovirus D
gcaguagccccucugugc

SEQ ID NO: 3927562 - RNA, 17 nt, Human adenovirus D
gcagugggcgcagacgg

SEQ ID NO: 3927563 - RNA, 21 nt, Human adenovirus D
gcagugggcgcagacggucuc

SEQ ID NO: 3927564 - RNA, 15 nt, Human adenovirus D
gcagugucucgagga

SEQ ID NO: 3927565 - RNA, 20 nt, Human adenovirus D
gcagugucucgaggacgaga

SEQ ID NO: 3927566 - RNA, 15 nt, Human adenovirus D
gcagugucuggagcg

SEQ ID NO: 3927567 - RNA, 15 nt, Human adenovirus D
gcaguugaccaugag

SEQ ID NO: 3927568 - RNA, 15 nt, Human adenovirus D
gcaguuggccaugag

SEQ ID NO: 3927569 - RNA, 19 nt, Human adenovirus D
gcauagucacacuuaguuc

SEQ ID NO: 3927570 - RNA, 20 nt, Human adenovirus D
gcaucaaaaauuaucuuuuu

SEQ ID NO: 3927571 - RNA, 18 nt, Human adenovirus D
gcaucagucuccuggugc

SEQ ID NO: 3927572 - RNA, 16 nt, Human adenovirus D
gcauccacugcuccug

SEQ ID NO: 3927573 - RNA, 23 nt, Human adenovirus D
gcauccugagauaugugcagcag

SEQ ID NO: 3927574 - RNA, 17 nt, Human adenovirus D
gcauccugcagcccaaa

SEQ ID NO: 3927575 - RNA, 16 nt, Human adenovirus D
gcaucgaggugcagac

SEQ ID NO: 3927576 - RNA, 15 nt, Human adenovirus D
gcaucgcgcaggccg

SEQ ID NO: 3927577 - RNA, 22 nt, Human adenovirus D
gcaugaaggggacgagcugcuu

SEQ ID NO: 3927578 - RNA, 13 nt, Human adenovirus D
gcaugagcggcuc

SEQ ID NO: 3927579 - RNA, 23 nt, Human adenovirus D
gcaugccgaagaagaacaggagc

SEQ ID NO: 3927580 - RNA, 18 nt, Human adenovirus D
gcaugccuucgugcacug

SEQ ID NO: 3927581 - RNA, 16 nt, Human adenovirus D
gcauggccucgugcuc

SEQ ID NO: 3927582 - RNA, 20 nt, Human adenovirus D
gcauggccucgugcucuggg

SEQ ID NO: 3927583 - RNA, 14 nt, Human adenovirus D
gcauggcuaccugg

SEQ ID NO: 3927584 - RNA, 16 nt, Human adenovirus D
gcauguacaacaugcu

SEQ ID NO: 3927585 - RNA, 19 nt, Human adenovirus D
gcauguacaacaugcugac

SEQ ID NO: 3927586 - RNA, 20 nt, Human adenovirus D
gcauguacgccgccaaccgg

SEQ ID NO: 3927587 - RNA, 13 nt, Human adenovirus D
gcauguucuugca

SEQ ID NO: 3927588 - RNA, 13 nt, Human adenovirus D
gccaagacaaagg

SEQ ID NO: 3927589 - RNA, 22 nt, Human adenovirus D
gccaagauagcccugcgcccag

SEQ ID NO: 3927590 - RNA, 13 nt, Human adenovirus D
gccaaucagcagu

SEQ ID NO: 3927591 - RNA, 17 nt, Human adenovirus D
gccacggucaccgagcc

SEQ ID NO: 3927592 - RNA, 18 nt, Human adenovirus D
gccacggucaccgagccu

SEQ ID NO: 3927593 - RNA, 23 nt, Human adenovirus D
gccagaaggggcaccuuccagcc

SEQ ID NO: 3927594 - RNA, 17 nt, Human adenovirus D
gccagcaaacgccgccg

SEQ ID NO: 3927595 - RNA, 11 nt, Human adenovirus D
gccagcagcac

SEQ ID NO: 3927596 - RNA, 17 nt, Human adenovirus D
gccagccacagccacag

SEQ ID NO: 3927597 - RNA, 21 nt, Human adenovirus D
gccagccgcgguuaugcaggg

SEQ ID NO: 3927598 - RNA, 18 nt, Human adenovirus D
gccagccuuacucagguu

SEQ ID NO: 3927599 - RNA, 20 nt, Human adenovirus D
gccagcgucauguccuucca

SEQ ID NO: 3927600 - RNA, 16 nt, Human adenovirus D
gccaggaggcggugcg

SEQ ID NO: 3927601 - RNA, 12 nt, Human adenovirus D
gccaggcccaga

SEQ ID NO: 3927602 - RNA, 22 nt, Human adenovirus D
gccaggccuccgagcagcgcau

SEQ ID NO: 3927603 - RNA, 22 nt, Human adenovirus D
gccaggccucuacccggacgag

SEQ ID NO: 3927604 - RNA, 13 nt, Human adenovirus D
gccaggcgcaggu

SEQ ID NO: 3927605 - RNA, 13 nt, Human adenovirus D
gccaggcuggccg

SEQ ID NO: 3927606 - RNA, 17 nt, Human adenovirus D
gccaggggaugaacagu

SEQ ID NO: 3927607 - RNA, 21 nt, Human adenovirus D
gccaguggaagaggggcagca

SEQ ID NO: 3927608 - RNA, 13 nt, Human adenovirus D
gccaguggcccug

SEQ ID NO: 3927609 - RNA, 23 nt, Human adenovirus D
gccauagagggcguuggagagaa

SEQ ID NO: 3927610 - RNA, 22 nt, Human adenovirus D
gccaucaacauccaccagugca

SEQ ID NO: 3927611 - RNA, 19 nt, Human adenovirus D
gccaucaagaaccugcucc

SEQ ID NO: 3927612 - RNA, 15 nt, Human adenovirus D
gccaugccccaggcc

SEQ ID NO: 3927613 - RNA, 16 nt, Human adenovirus D
gccaugcgcaggcgcc

SEQ ID NO: 3927614 - RNA, 22 nt, Human adenovirus D
gccauggggcgccgcccgagcu

SEQ ID NO: 3927615 - RNA, 20 nt, Human adenovirus D
gcccacggugguggagaugg

SEQ ID NO: 3927616 - RNA, 18 nt, Human adenovirus D
gcccagaacuggcagagc

SEQ ID NO: 3927617 - RNA, 14 nt, Human adenovirus D
gcccagagcucgcg

SEQ ID NO: 3927618 - RNA, 11 nt, Human adenovirus D
gcccaggcgcc

SEQ ID NO: 3927619 - RNA, 23 nt, Human adenovirus D
gcccaggcgccauucggagcacg

SEQ ID NO: 3927620 - RNA, 14 nt, Human adenovirus D
gcccaguuccauca

SEQ ID NO: 3927621 - RNA, 16 nt, Human adenovirus D
gccccacaucgaggcc

SEQ ID NO: 3927622 - RNA, 14 nt, Human adenovirus D
gccccgccaaccgg

SEQ ID NO: 3927623 - RNA, 21 nt, Human adenovirus D
gccccugagcggcugcacgag

SEQ ID NO: 3927624 - RNA, 19 nt, Human adenovirus D
gccccuucgaccguggacg

SEQ ID NO: 3927625 - RNA, 16 nt, Human adenovirus D
gcccgaccgacccaug

SEQ ID NO: 3927626 - RNA, 16 nt, Human adenovirus D
gcccgacuccgccgcc

SEQ ID NO: 3927627 - RNA, 17 nt, Human adenovirus D
gcccgagcucugcugcg

SEQ ID NO: 3927628 - RNA, 13 nt, Human adenovirus D
gcccgagggcaac

SEQ ID NO: 3927629 - RNA, 14 nt, Human adenovirus D
gcccgcgagcgagg

SEQ ID NO: 3927630 - RNA, 22 nt, Human adenovirus D
gcccgcgccgcggcgacagcgc

SEQ ID NO: 3927631 - RNA, 16 nt, Human adenovirus D
gcccgcgugcgccgcg

SEQ ID NO: 3927632 - RNA, 19 nt, Human adenovirus D
gcccguagcugcgcggggc

SEQ ID NO: 3927633 - RNA, 21 nt, Human adenovirus D
gcccguagcugcgcggggcca

SEQ ID NO: 3927634 - RNA, 14 nt, Human adenovirus D
gcccgucgccgcac

SEQ ID NO: 3927635 - RNA, 16 nt, Human adenovirus D
gcccuccgcccugagc

SEQ ID NO: 3927636 - RNA, 18 nt, Human adenovirus D
gcccugcucaccugcacc

SEQ ID NO: 3927637 - RNA, 13 nt, Human adenovirus D
gcccugcuggagc

SEQ ID NO: 3927638 - RNA, 13 nt, Human adenovirus D
gcccugcuggccg

SEQ ID NO: 3927639 - RNA, 15 nt, Human adenovirus D
gcccuugcgcgagca

SEQ ID NO: 3927640 - RNA, 17 nt, Human adenovirus D
gcccuugcgcgagcaga

SEQ ID NO: 3927641 - RNA, 16 nt, Human adenovirus D
gccgaagaagaacagg

SEQ ID NO: 3927642 - RNA, 14 nt, Human adenovirus D
gccgaagggcgaga

SEQ ID NO: 3927643 - RNA, 19 nt, Human adenovirus D
gccgacccguggccccggg

SEQ ID NO: 3927644 - RNA, 16 nt, Human adenovirus D
gccgagcuggaagccc

SEQ ID NO: 3927645 - RNA, 15 nt, Human adenovirus D
gccgcagcccggcgg

SEQ ID NO: 3927646 - RNA, 12 nt, Human adenovirus D
gccgcaggccaa

SEQ ID NO: 3927647 - RNA, 13 nt, Human adenovirus D
gccgcaggccaac

SEQ ID NO: 3927648 - RNA, 19 nt, Human adenovirus D
gccgccaggcccagaacug

SEQ ID NO: 3927649 - RNA, 21 nt, Human adenovirus D
gccgccaucgaacacgccacc

SEQ ID NO: 3927650 - RNA, 23 nt, Human adenovirus D
gccgccggcggcgggccaugcgc

SEQ ID NO: 3927651 - RNA, 15 nt, Human adenovirus D
gccgccgggccauga

SEQ ID NO: 3927652 - RNA, 18 nt, Human adenovirus D
gccgccggggcucggugc

SEQ ID NO: 3927653 - RNA, 18 nt, Human adenovirus D
gccgccucugcgugaaga

SEQ ID NO: 3927654 - RNA, 13 nt, Human adenovirus D
gccgcgccagacg

SEQ ID NO: 3927655 - RNA, 15 nt, Human adenovirus D
gccgcgcgggcagga

SEQ ID NO: 3927656 - RNA, 13 nt, Human adenovirus D
gccgcgcugggga

SEQ ID NO: 3927657 - RNA, 23 nt, Human adenovirus D
gccgcggcagccgcagccgccau

SEQ ID NO: 3927658 - RNA, 21 nt, Human adenovirus D
gccgcgggcgccucccaggac

SEQ ID NO: 3927659 - RNA, 22 nt, Human adenovirus D
gccgcuccgugcgaggaugaga

SEQ ID NO: 3927660 - RNA, 17 nt, Human adenovirus D
gccggcgaaccgagcac

SEQ ID NO: 3927661 - RNA, 20 nt, Human adenovirus D
gccggcgacaagcuggccug

SEQ ID NO: 3927662 - RNA, 22 nt, Human adenovirus D
gccggcgcgcccggggccaggu

SEQ ID NO: 3927663 - RNA, 21 nt, Human adenovirus D
gccggcggcgcgagcugagcg

SEQ ID NO: 3927664 - RNA, 15 nt, Human adenovirus D
gccgggguuguggac

SEQ ID NO: 3927665 - RNA, 14 nt, Human adenovirus D
gccggugcacuccc

SEQ ID NO: 3927666 - RNA, 14 nt, Human adenovirus D
gccguacaccaggc

SEQ ID NO: 3927667 - RNA, 19 nt, Human adenovirus D
gccguaccagugcaacuuu

SEQ ID NO: 3927668 - RNA, 15 nt, Human adenovirus D
gccgugcgcaccacc

SEQ ID NO: 3927669 - RNA, 20 nt, Human adenovirus D
gccgugcgccgcguccccgc

SEQ ID NO: 3927670 - RNA, 13 nt, Human adenovirus D
gccgugcucaagc

SEQ ID NO: 3927671 - RNA, 17 nt, Human adenovirus D
gccgugcugcucgagcg

SEQ ID NO: 3927672 - RNA, 18 nt, Human adenovirus D
gccgugggcgacaaccgg

SEQ ID NO: 3927673 - RNA, 13 nt, Human adenovirus D
gccuaccccgccg

SEQ ID NO: 3927674 - RNA, 18 nt, Human adenovirus D
gccuccccgcagaaauca

SEQ ID NO: 3927675 - RNA, 22 nt, Human adenovirus D
gccucgagcuacaugcccagca

SEQ ID NO: 3927676 - RNA, 12 nt, Human adenovirus D
gccugaggcaga

SEQ ID NO: 3927677 - RNA, 22 nt, Human adenovirus D
gccugccaggaugggccggagu

SEQ ID NO: 3927678 - RNA, 18 nt, Human adenovirus D
gccugcgcccgcgccgcg

SEQ ID NO: 3927679 - RNA, 18 nt, Human adenovirus D
gccuggaauaguagcacg

SEQ ID NO: 3927680 - RNA, 16 nt, Human adenovirus D
gccuggucaaacaggc

SEQ ID NO: 3927681 - RNA, 15 nt, Human adenovirus D
gccuggugaagggca

SEQ ID NO: 3927682 - RNA, 17 nt, Human adenovirus D
gccuggugaagggcaca

SEQ ID NO: 3927683 - RNA, 15 nt, Human adenovirus D
gccugguguacacag

SEQ ID NO: 3927684 - RNA, 15 nt, Human adenovirus D
gccuguccugcaggg

SEQ ID NO: 3927685 - RNA, 17 nt, Human adenovirus D
gccuguccugcaggggc

SEQ ID NO: 3927686 - RNA, 16 nt, Human adenovirus D
gccuuaccgccagaga

SEQ ID NO: 3927687 - RNA, 14 nt, Human adenovirus D
gccuucagcaucag

SEQ ID NO: 3927688 - RNA, 15 nt, Human adenovirus D
gccuucgugcacugg

SEQ ID NO: 3927689 - RNA, 15 nt, Human adenovirus D
gccuucuauggaggc

SEQ ID NO: 3927690 - RNA, 20 nt, Human adenovirus D
gccuucuauggaggcagagc

SEQ ID NO: 3927691 - RNA, 22 nt, Human adenovirus D
gccuugauuuuuccagcccagg

SEQ ID NO: 3927692 - RNA, 18 nt, Human adenovirus D
gccuuguagggacagcag

SEQ ID NO: 3927693 - RNA, 19 nt, Human adenovirus D
gccuuuccccaccuacucc

SEQ ID NO: 3927694 - RNA, 15 nt, Human adenovirus D
gcgaagaggagcuga

SEQ ID NO: 3927695 - RNA, 22 nt, Human adenovirus D
gcgacacccccgcgugcagcug

SEQ ID NO: 3927696 - RNA, 17 nt, Human adenovirus D
gcgacagcgccacgacc

SEQ ID NO: 3927697 - RNA, 21 nt, Human adenovirus D
gcgacccaugagcugcgagaa

SEQ ID NO: 3927698 - RNA, 17 nt, Human adenovirus D
gcgacccccaggcccug

SEQ ID NO: 3927699 - RNA, 17 nt, Human adenovirus D
gcgaccccgagaccugc

SEQ ID NO: 3927700 - RNA, 14 nt, Human adenovirus D
gcgaccugggcugc

SEQ ID NO: 3927701 - RNA, 18 nt, Human adenovirus D
gcgagaccaacggcugca

SEQ ID NO: 3927702 - RNA, 17 nt, Human adenovirus D
gcgagaggagcucuugc

SEQ ID NO: 3927703 - RNA, 15 nt, Human adenovirus D
gcgagcugagcgacc

SEQ ID NO: 3927704 - RNA, 21 nt, Human adenovirus D
gcgagcugaugcugagccugc

SEQ ID NO: 3927705 - RNA, 17 nt, Human adenovirus D
gcgaggacaccaguacu

SEQ ID NO: 3927706 - RNA, 15 nt, Human adenovirus D
gcgaggaggaccagg

SEQ ID NO: 3927707 - RNA, 15 nt, Human adenovirus D
gcgagggccuggacc

SEQ ID NO: 3927708 - RNA, 16 nt, Human adenovirus D
gcgaucccgcuguggc

SEQ ID NO: 3927709 - RNA, 17 nt, Human adenovirus D
gcgcacccguccuccuc

SEQ ID NO: 3927710 - RNA, 16 nt, Human adenovirus D
gcgcacguggcggcgg

SEQ ID NO: 3927711 - RNA, 15 nt, Human adenovirus D
gcgcagccugagcuu

SEQ ID NO: 3927712 - RNA, 23 nt, Human adenovirus D
gcgcagcguugagcucacccacu

SEQ ID NO: 3927713 - RNA, 20 nt, Human adenovirus D
gcgcagcuguuccugguggu

SEQ ID NO: 3927714 - RNA, 15 nt, Human adenovirus D
gcgcaggcgacccug

SEQ ID NO: 3927715 - RNA, 16 nt, Human adenovirus D
gcgcauccugcagccc

SEQ ID NO: 3927716 - RNA, 14 nt, Human adenovirus D
gcgccaagggcagc

SEQ ID NO: 3927717 - RNA, 13 nt, Human adenovirus D
gcgccacuggcca

SEQ ID NO: 3927718 - RNA, 16 nt, Human adenovirus D
gcgccagacgcacggg

SEQ ID NO: 3927719 - RNA, 13 nt, Human adenovirus D
gcgccccccgcgg

SEQ ID NO: 3927720 - RNA, 15 nt, Human adenovirus D
gcgcccguagucugg

SEQ ID NO: 3927721 - RNA, 15 nt, Human adenovirus D
gcgccgccggcggcg

SEQ ID NO: 3927722 - RNA, 17 nt, Human adenovirus D
gcgccgcgccagacgca

SEQ ID NO: 3927723 - RNA, 13 nt, Human adenovirus D
gcgccgcgccgcc

SEQ ID NO: 3927724 - RNA, 19 nt, Human adenovirus D
gcgccgggccugggcgugc

SEQ ID NO: 3927725 - RNA, 15 nt, Human adenovirus D
guagagguagcggga

SEQ ID NO: 3927726 - RNA, 17 nt, Human adenovirus D
guagcggggcacaggca

SEQ ID NO: 3927727 - RNA, 18 nt, Human adenovirus D
guagcggggcacaggcac

SEQ ID NO: 3927728 - RNA, 21 nt, Human adenovirus D
guaggccacgugaccaggggu

SEQ ID NO: 3927729 - RNA, 22 nt, Human adenovirus D
guaggcccugguccaccucucc

SEQ ID NO: 3927730 - RNA, 18 nt, Human adenovirus D
guagggguugaggggcgg

SEQ ID NO: 3927731 - RNA, 17 nt, Human adenovirus D
guagguguaggccacgu

SEQ ID NO: 3927732 - RNA, 15 nt, Human adenovirus D
guagucaugcaugag

SEQ ID NO: 3927733 - RNA, 13 nt, Human adenovirus D
guagucuggagaa

SEQ ID NO: 3927734 - RNA, 19 nt, Human adenovirus D
guauaaguguaagagcaag

SEQ ID NO: 3927735 - RNA, 16 nt, Human adenovirus D
guauugugggccuggg

SEQ ID NO: 3927736 - RNA, 22 nt, Human adenovirus D
gucacacuagcgcccugguaga

SEQ ID NO: 3927737 - RNA, 22 nt, Human adenovirus D
gucacccugcccuuccagcaca

SEQ ID NO: 3927738 - RNA, 19 nt, Human adenovirus D
gucaccgagccucccagga

SEQ ID NO: 3927739 - RNA, 16 nt, Human adenovirus D
gucacucucauuucag

SEQ ID NO: 3927740 - RNA, 16 nt, Human adenovirus D
gucagaaugugauggg

SEQ ID NO: 3927741 - RNA, 13 nt, Human adenovirus D
gucaguugcacca

SEQ ID NO: 3927742 - RNA, 21 nt, Human adenovirus D
gucauagcaggggcgcugggc

SEQ ID NO: 3927743 - RNA, 18 nt, Human adenovirus D
gucaucaccuuccugcag

SEQ ID NO: 3927744 - RNA, 21 nt, Human adenovirus D
gucaucaccuuccugcagcuc

SEQ ID NO: 3927745 - RNA, 16 nt, Human adenovirus D
gucaucacuggcggag

SEQ ID NO: 3927746 - RNA, 21 nt, Human adenovirus D
guccacgagcgccagcuguug

SEQ ID NO: 3927747 - RNA, 20 nt, Human adenovirus D
guccacgcugguggccaccu

SEQ ID NO: 3927748 - RNA, 15 nt, Human adenovirus D
guccagcgcggccag

SEQ ID NO: 3927749 - RNA, 21 nt, Human adenovirus D
guccaucgugcgcgaccuggg

SEQ ID NO: 3927750 - RNA, 23 nt, Human adenovirus D
guccaugggcgccuucaccgacc

SEQ ID NO: 3927751 - RNA, 20 nt, Human adenovirus D
gucccccgccgcuguggagc

SEQ ID NO: 3927752 - RNA, 16 nt, Human adenovirus D
guccccgcccgccgcc

SEQ ID NO: 3927753 - RNA, 20 nt, Human adenovirus D
guccgcaggaguccaccgcu

SEQ ID NO: 3927754 - RNA, 16 nt, Human adenovirus D
guccgcaggcgggaca

SEQ ID NO: 3927755 - RNA, 18 nt, Human adenovirus D
guccgcaggcgggacaga

SEQ ID NO: 3927756 - RNA, 13 nt, Human adenovirus D
guccgggggcagg

SEQ ID NO: 3927757 - RNA, 21 nt, Human adenovirus D
guccuucacucccaaccaggc

SEQ ID NO: 3927758 - RNA, 18 nt, Human adenovirus D
guccuugaggaggagacu

SEQ ID NO: 3927759 - RNA, 18 nt, Human adenovirus D
guccuuucgcugcugccg

SEQ ID NO: 3927760 - RNA, 15 nt, Human adenovirus D
gucgacggcgccucc

SEQ ID NO: 3927761 - RNA, 13 nt, Human adenovirus D
gucgcagccgccg

SEQ ID NO: 3927762 - RNA, 20 nt, Human adenovirus D
gucgccucggaccuggccga

SEQ ID NO: 3927763 - RNA, 15 nt, Human adenovirus D
gucgcgguggggcgg

SEQ ID NO: 3927764 - RNA, 23 nt, Human adenovirus D
gucgcuagacuugaaagcggccg

SEQ ID NO: 3927765 - RNA, 20 nt, Human adenovirus D
gucgcuugacagcaccgccg

SEQ ID NO: 3927766 - RNA, 19 nt, Human adenovirus D
gucggcacggucuggccgg

SEQ ID NO: 3927767 - RNA, 21 nt, Human adenovirus D
gucgucgcagccgccgugcuc

SEQ ID NO: 3927768 - RNA, 15 nt, Human adenovirus D
gucuacaaggcccug

SEQ ID NO: 3927769 - RNA, 17 nt, Human adenovirus D
gucuaccugcgcacgcc

SEQ ID NO: 3927770 - RNA, 15 nt, Human adenovirus D
gucugcaacccccag

SEQ ID NO: 3927771 - RNA, 10 nt, Human adenovirus D
gucugccccc

SEQ ID NO: 3927772 - RNA, 14 nt, Human adenovirus D
gucugcucgggcau

SEQ ID NO: 3927773 - RNA, 19 nt, Human adenovirus D
gucugcucgggcaugagcu

SEQ ID NO: 3927774 - RNA, 15 nt, Human adenovirus D
gucuggcacaucuuu

SEQ ID NO: 3927775 - RNA, 19 nt, Human adenovirus D
gucuggugcaguuugcccg

SEQ ID NO: 3927776 - RNA, 21 nt, Human adenovirus D
gugaacaaaacccaugaaaga

SEQ ID NO: 3927777 - RNA, 14 nt, Human adenovirus D
gugaacgcgcuggc

SEQ ID NO: 3927778 - RNA, 21 nt, Human adenovirus D
gugaaggccggcaugcccacc

SEQ ID NO: 3927779 - RNA, 19 nt, Human adenovirus D
gugaccugcagcaggugcu

SEQ ID NO: 3927780 - RNA, 18 nt, Human adenovirus D
gugacggccuacgagcag

SEQ ID NO: 3927781 - RNA, 23 nt, Human adenovirus D
gugagcucgucuuccaggagccu

SEQ ID NO: 3927782 - RNA, 15 nt, Human adenovirus D
gugagugauaaagcg

SEQ ID NO: 3927783 - RNA, 12 nt, Human adenovirus D
gugcaaugucag

SEQ ID NO: 3927784 - RNA, 18 nt, Human adenovirus D
gugcacucccaguucuug

SEQ ID NO: 3927785 - RNA, 18 nt, Human adenovirus D
gugcaguuggccaugagc

SEQ ID NO: 3927786 - RNA, 16 nt, Human adenovirus D
gugccagauuggggga

SEQ ID NO: 3927787 - RNA, 18 nt, Human adenovirus D
gugcccaacggcaugcua

SEQ ID NO: 3927788 - RNA, 20 nt, Human adenovirus D
gugccgccaaggagcuccuc

SEQ ID NO: 3927789 - RNA, 20 nt, Human adenovirus D
gugccuuuaucagcacugca

SEQ ID NO: 3927790 - RNA, 19 nt, Human adenovirus D
gugcuccagccaaagcuca

SEQ ID NO: 3927791 - RNA, 13 nt, Human adenovirus D
gugcucccauagc

SEQ ID NO: 3927792 - RNA, 20 nt, Human adenovirus D
gugcugacauccauggccag

SEQ ID NO: 3927793 - RNA, 22 nt, Human adenovirus D
gugcugacauccauggccaggg

SEQ ID NO: 3927794 - RNA, 20 nt, Human adenovirus D
gugcugcugaaacaccugca

SEQ ID NO: 3927795 - RNA, 11 nt, Human adenovirus D
gugcugcugcc

SEQ ID NO: 3927796 - RNA, 22 nt, Human adenovirus D
guggacaucgcgaaccaggcag

SEQ ID NO: 3927797 - RNA, 22 nt, Human adenovirus D
guggacauucagauccccaccg

SEQ ID NO: 3927798 - RNA, 13 nt, Human adenovirus D
guggacgagcaga

SEQ ID NO: 3927799 - RNA, 20 nt, Human adenovirus D
guggcaacaccugggcacug

SEQ ID NO: 3927800 - RNA, 16 nt, Human adenovirus D
guggcccugggccuga

SEQ ID NO: 3927801 - RNA, 18 nt, Human adenovirus D
guggccuuguaccugccc

SEQ ID NO: 3927802 - RNA, 12 nt, Human adenovirus D
guggcggggccc

SEQ ID NO: 3927803 - RNA, 12 nt, Human adenovirus D
gugggccccugg

SEQ ID NO: 3927804 - RNA, 23 nt, Human adenovirus D
guggucgacuugcaagacagaaa

SEQ ID NO: 3927805 - RNA, 21 nt, Human adenovirus D
gugguggcgacgcggcggcga

SEQ ID NO: 3927806 - RNA, 16 nt, Human adenovirus D
gugguuuuucugguug

SEQ ID NO: 3927807 - RNA, 20 nt, Human adenovirus D
guguacaacgcccugcugga

SEQ ID NO: 3927808 - RNA, 18 nt, Human adenovirus D
guguacuugguggacaac

SEQ ID NO: 3927809 - RNA, 15 nt, Human adenovirus D
guuacgcugcccgcc

SEQ ID NO: 3927810 - RNA, 15 nt, Human adenovirus D
guuacuguaaagcca

SEQ ID NO: 3927811 - RNA, 19 nt, Human adenovirus D
guuagguucuucacccagc

SEQ ID NO: 3927812 - RNA, 15 nt, Human adenovirus D
guuauggucugcucc

SEQ ID NO: 3927813 - RNA, 13 nt, Human adenovirus D
guuauucagcagc

SEQ ID NO: 3927814 - RNA, 21 nt, Human adenovirus D
guucaaaacaacaagauucaa

SEQ ID NO: 3927815 - RNA, 11 nt, Human adenovirus D
guucaccugca

SEQ ID NO: 3927816 - RNA, 16 nt, Human adenovirus D
guucaggagcgcagcc

SEQ ID NO: 3927817 - RNA, 16 nt, Human adenovirus D
guuccguuugugccuc

SEQ ID NO: 3927818 - RNA, 20 nt, Human adenovirus D
guucgagaucaagcgcagcg

SEQ ID NO: 3927819 - RNA, 13 nt, Human adenovirus D
guucugcccaccg

SEQ ID NO: 3927820 - RNA, 14 nt, Human adenovirus D
guucuucgaggacc

SEQ ID NO: 3927821 - RNA, 13 nt, Human adenovirus D
guugaacccagau

SEQ ID NO: 3927822 - RNA, 16 nt, Human adenovirus D
guugaccaugagcucg

SEQ ID NO: 3927823 - RNA, 20 nt, Human adenovirus D
guugaugaccugggcggcga

SEQ ID NO: 3927824 - RNA, 10 nt, Human adenovirus D
guugcaugag

SEQ ID NO: 3927825 - RNA, 13 nt, Human adenovirus D
guuggcuugcaug

SEQ ID NO: 3927826 - RNA, 14 nt, Human adenovirus D
guugggcagcgaga

SEQ ID NO: 3927827 - RNA, 13 nt, Human adenovirus D
guuuaauaaaagc

SEQ ID NO: 3927828 - RNA, 17 nt, Human adenovirus D
guuuauaaaucuuacac

SEQ ID NO: 3927829 - RNA, 13 nt, Human adenovirus D
guuuauguugauc

SEQ ID NO: 3927830 - RNA, 16 nt, Human adenovirus D
guuucgggcgggcagg

SEQ ID NO: 3927831 - RNA, 16 nt, Human adenovirus D
guuucgucaggcaggc

SEQ ID NO: 3927832 - RNA, 18 nt, Human adenovirus D
guuugagaauaacaugcu

SEQ ID NO: 3927833 - RNA, 15 nt, Human adenovirus D
guuugggcacugggg

SEQ ID NO: 3927834 - RNA, 16 nt, Human adenovirus D
guuuuccaugcacuca

SEQ ID NO: 3927835 - RNA, 19 nt, Human adenovirus D
uaaaaaugcaguugaauuu

SEQ ID NO: 3927836 - RNA, 17 nt, Human adenovirus D
uaaagccacaaccagag

SEQ ID NO: 3927837 - RNA, 17 nt, Human adenovirus D
uaaauauggccuggagc

SEQ ID NO: 3927838 - RNA, 15 nt, Human adenovirus D
uaacagggaaaggaa

SEQ ID NO: 3927839 - RNA, 16 nt, Human adenovirus D
uaacaucaccacaggc

SEQ ID NO: 3927840 - RNA, 14 nt, Human adenovirus D
uaacauuugaauuu

SEQ ID NO: 3927841 - RNA, 22 nt, Human adenovirus D
uaacuaugaucccaacagccuu

SEQ ID NO: 3927842 - RNA, 13 nt, Human adenovirus D
uaagaaucacauu

SEQ ID NO: 3927843 - RNA, 20 nt, Human adenovirus D
uaagcagaguacucauaaag

SEQ ID NO: 3927844 - RNA, 19 nt, Human adenovirus D
uaagcaggagcaggaggag

SEQ ID NO: 3927845 - RNA, 21 nt, Human adenovirus D
uaagcaggagcaggaggagga

SEQ ID NO: 3927846 - RNA, 20 nt, Human adenovirus D
uaagcaugagcggcuccagc

SEQ ID NO: 3927847 - RNA, 16 nt, Human adenovirus D
uaaggagaaggauuca

SEQ ID NO: 3927848 - RNA, 14 nt, Human adenovirus D
uaauagaaacagau

SEQ ID NO: 3927849 - RNA, 13 nt, Human adenovirus D
uaaugaagaagca

SEQ ID NO: 3927850 - RNA, 16 nt, Human adenovirus D
uaaugacaaacaaaag

SEQ ID NO: 3927851 - RNA, 17 nt, Human adenovirus D
uaaugaucaaaacuuaa

SEQ ID NO: 3927852 - RNA, 19 nt, Human adenovirus D
uaaugcuccaaagcuagca

SEQ ID NO: 3927853 - RNA, 16 nt, Human adenovirus D
uacaacagccuugccc

SEQ ID NO: 3927854 - RNA, 14 nt, Human adenovirus D
uacaagauccugag

SEQ ID NO: 3927855 - RNA, 19 nt, Human adenovirus D
uacaagcgccaacagcagc

SEQ ID NO: 3927856 - RNA, 21 nt, Human adenovirus D
uacacgggguugcagcacugg

SEQ ID NO: 3927857 - RNA, 22 nt, Human adenovirus D
uacacucgcagugcacgggcau

SEQ ID NO: 3927858 - RNA, 15 nt, Human adenovirus D
uacagagauucagcc

SEQ ID NO: 3927859 - RNA, 20 nt, Human adenovirus D
uacagccagcagcuccgggu

SEQ ID NO: 3927860 - RNA, 22 nt, Human adenovirus D
uacauccauucucgaagauucu

SEQ ID NO: 3927861 - RNA, 16 nt, Human adenovirus D
uaccaugggaaaugca

SEQ ID NO: 3927862 - RNA, 20 nt, Human adenovirus D
uacccagcaagucagcaacu

SEQ ID NO: 3927863 - RNA, 20 nt, Human adenovirus D
uaccccaucccggccaaggc

SEQ ID NO: 3927864 - RNA, 13 nt, Human adenovirus D
uaccgacagcagc

SEQ ID NO: 3927865 - RNA, 13 nt, Human adenovirus D
uaccucucggccg

SEQ ID NO: 3927866 - RNA, 23 nt, Human adenovirus D
uaccugcccgacuccuacaagua

SEQ ID NO: 3927867 - RNA, 20 nt, Human adenovirus D
uaccugggaggagaggagga

SEQ ID NO: 3927868 - RNA, 21 nt, Human adenovirus D
uaccugggaggagaggaggau

SEQ ID NO: 3927869 - RNA, 18 nt, Human adenovirus D
uaccugguacgagcuaca

SEQ ID NO: 3927870 - RNA, 16 nt, Human adenovirus D
uacgccaacucggccc

SEQ ID NO: 3927871 - RNA, 18 nt, Human adenovirus D
uacgccaacucggcccac

SEQ ID NO: 3927872 - RNA, 21 nt, Human adenovirus D
uacggcaucucgauccagcag

SEQ ID NO: 3927873 - RNA, 22 nt, Human adenovirus D
uacuacuccugaucagaaacac

SEQ ID NO: 3927874 - RNA, 20 nt, Human adenovirus D
uacucuacaauccuuuugua

SEQ ID NO: 3927875 - RNA, 14 nt, Human adenovirus D
uacuuuucugguug

SEQ ID NO: 3927876 - RNA, 12 nt, Human adenovirus D
uagaaacagauc

SEQ ID NO: 3927877 - RNA, 18 nt, Human adenovirus D
uagaaacagauccugcug

SEQ ID NO: 3927878 - RNA, 18 nt, Human adenovirus D
uagaagagcccccucccc

SEQ ID NO: 3927879 - RNA, 14 nt, Human adenovirus D
uagagggcaccacc

SEQ ID NO: 3927880 - RNA, 23 nt, Human adenovirus D
uagauggaucgagugaaggugac

SEQ ID NO: 3927881 - RNA, 23 nt, Human adenovirus D
uagaugggcuccgagaagaugcc

SEQ ID NO: 3927882 - RNA, 14 nt, Human adenovirus D
uagcaaggugcuga

SEQ ID NO: 3927883 - RNA, 16 nt, Human adenovirus D
uagccagaccaagcug

SEQ ID NO: 3927884 - RNA, 14 nt, Human adenovirus D
uagcuacuuucaca

SEQ ID NO: 3927885 - RNA, 18 nt, Human adenovirus D
uaggaaccagcacacuca

SEQ ID NO: 3927886 - RNA, 18 nt, Human adenovirus D
uagguuugaguagugggc

SEQ ID NO: 3927887 - RNA, 14 nt, Human adenovirus D
uagucaaucuccca

SEQ ID NO: 3927888 - RNA, 20 nt, Human adenovirus D
uagucccgaauacagggacg

SEQ ID NO: 3927889 - RNA, 20 nt, Human adenovirus D
uaguguacaacgcccugcug

SEQ ID NO: 3927890 - RNA, 16 nt, Human adenovirus D
uaguugaggguggugg

SEQ ID NO: 3927891 - RNA, 15 nt, Human adenovirus D
uauaaaucuuacaca

SEQ ID NO: 3927892 - RNA, 13 nt, Human adenovirus D
uauaauaagcaga

SEQ ID NO: 3927893 - RNA, 14 nt, Human adenovirus D
uaucagacaugcug

SEQ ID NO: 3927894 - RNA, 22 nt, Human adenovirus D
uauccagccuguacccagagcu

SEQ ID NO: 3927895 - RNA, 12 nt, Human adenovirus D
uauccccuuccu

SEQ ID NO: 3927896 - RNA, 14 nt, Human adenovirus D
uaucuaugaaagca

SEQ ID NO: 3927897 - RNA, 18 nt, Human adenovirus D
uaugacacgcgcacacuu

SEQ ID NO: 3927898 - RNA, 21 nt, Human adenovirus D
uaugacacgcgcacacuuugg

SEQ ID NO: 3927899 - RNA, 13 nt, Human adenovirus D
uaugaucccaaca

SEQ ID NO: 3927900 - RNA, 11 nt, Human adenovirus D
uaugccagggu

SEQ ID NO: 3927901 - RNA, 21 nt, Human adenovirus D
uaugguacuaaugacagaggc

SEQ ID NO: 3927902 - RNA, 12 nt, Human adenovirus D
uauuuccucugu

SEQ ID NO: 3927903 - RNA, 15 nt, Human adenovirus D
ucaaaaacaaaguga

SEQ ID NO: 3927904 - RNA, 19 nt, Human adenovirus D
ucaaacccuacucgggcac

SEQ ID NO: 3927905 - RNA, 16 nt, Human adenovirus D
ucaaagugugaaaauu

SEQ ID NO: 3927906 - RNA, 18 nt, Human adenovirus D
ucaacaaccaugugcgca

SEQ ID NO: 3927907 - RNA, 12 nt, Human adenovirus D
ucaagaaccugc

SEQ ID NO: 3927908 - RNA, 16 nt, Human adenovirus D
ucaagacaaaauucca

SEQ ID NO: 3927909 - RNA, 14 nt, Human adenovirus D
ucaagcugggcugg

SEQ ID NO: 3927910 - RNA, 19 nt, Human adenovirus D
ucaaggacaugcagcugcc

SEQ ID NO: 3927911 - RNA, 16 nt, Human adenovirus D
ucaaguaggugaagaa

SEQ ID NO: 3927912 - RNA, 14 nt, Human adenovirus D
ucaagugccacaug

SEQ ID NO: 3927913 - RNA, 18 nt, Human adenovirus D
ucaauaagguucugcccu

SEQ ID NO: 3927914 - RNA, 18 nt, Human adenovirus D
ucaaucucccaccaccag

SEQ ID NO: 3927915 - RNA, 21 nt, Human adenovirus D
ucaauguaacuaaacuuuaug

SEQ ID NO: 3927916 - RNA, 14 nt, Human adenovirus D
ucacaagucucucu

SEQ ID NO: 3927917 - RNA, 19 nt, Human adenovirus D
ucacaguaagugcagcaca

SEQ ID NO: 3927918 - RNA, 23 nt, Human adenovirus D
ucacaguuauaccaccuccuccu

SEQ ID NO: 3927919 - RNA, 15 nt, Human adenovirus D
ucacaucagccagga

SEQ ID NO: 3927920 - RNA, 13 nt, Human adenovirus D
ucacauuaaaggc

SEQ ID NO: 3927921 - RNA, 23 nt, Human adenovirus D
ucaccauguuauucagcagccca

SEQ ID NO: 3927922 - RNA, 12 nt, Human adenovirus D
ucacccagcagu

SEQ ID NO: 3927923 - RNA, 15 nt, Human adenovirus D
ucacccgcaguugcu

SEQ ID NO: 3927924 - RNA, 21 nt, Human adenovirus D
ucaccggcuaccuugcaccca

SEQ ID NO: 3927925 - RNA, 23 nt, Human adenovirus D
ucaccugcaccugcgucugcagc

SEQ ID NO: 3927926 - RNA, 13 nt, Human adenovirus D
ucacgcaggugac

SEQ ID NO: 3927927 - RNA, 23 nt, Human adenovirus D
ucacggccuuguagggacagcag

SEQ ID NO: 3927928 - RNA, 15 nt, Human adenovirus D
ucacggugaaggggu

SEQ ID NO: 3927929 - RNA, 17 nt, Human adenovirus D
ucacucaaacuggcuga

SEQ ID NO: 3927930 - RNA, 18 nt, Human adenovirus D
ucacucuggccgugggcg

SEQ ID NO: 3927931 - RNA, 15 nt, Human adenovirus D
ucacucuuuccagca

SEQ ID NO: 3927932 - RNA, 16 nt, Human adenovirus D
ucacucuuuccagcag

SEQ ID NO: 3927933 - RNA, 20 nt, Human adenovirus D
ucacugaaggaaaaaucacu

SEQ ID NO: 3927934 - RNA, 15 nt, Human adenovirus D
ucagacaugcugcua

SEQ ID NO: 3927935 - RNA, 13 nt, Human adenovirus D
ucagagccagggc

SEQ ID NO: 3927936 - RNA, 17 nt, Human adenovirus D
ucagcaguagccccgcc

SEQ ID NO: 3927937 - RNA, 15 nt, Human adenovirus D
ucagcaucagucucc

SEQ ID NO: 3927938 - RNA, 24 nt, Human adenovirus D
ucagcauguggaacucugcggugg

SEQ ID NO: 3927939 - RNA, 14 nt, Human adenovirus D
ucagccaggacucu

SEQ ID NO: 3927940 - RNA, 13 nt, Human adenovirus D
ucagccccuuccc

SEQ ID NO: 3927941 - RNA, 18 nt, Human adenovirus D
ucagcgcccucagcaguc

SEQ ID NO: 3927942 - RNA, 21 nt, Human adenovirus D
ucaggcagcggggacagagaa

SEQ ID NO: 3927943 - RNA, 15 nt, Human adenovirus D
ucagguauccagccu

SEQ ID NO: 3927944 - RNA, 18 nt, Human adenovirus D
ucaggugccugccccuca

SEQ ID NO: 3927945 - RNA, 20 nt, Human adenovirus D
ucauagcaggggcgcugggc

SEQ ID NO: 3927946 - RNA, 15 nt, Human adenovirus D
ucaucaaucaucagg

SEQ ID NO: 3927947 - RNA, 13 nt, Human adenovirus D
ucaucacccagca

SEQ ID NO: 3927948 - RNA, 21 nt, Human adenovirus D
ucaucgcgccacuggccacgg

SEQ ID NO: 3927949 - RNA, 15 nt, Human adenovirus D
ucaucucgcccagca

SEQ ID NO: 3927950 - RNA, 18 nt, Human adenovirus D
ucaucugcagggcgccca

SEQ ID NO: 3927951 - RNA, 23 nt, Human adenovirus D
ucaucugcagggcgcccagcaug

SEQ ID NO: 3927952 - RNA, 17 nt, Human adenovirus D
ucaugaccagcaugaag

SEQ ID NO: 3927953 - RNA, 17 nt, Human adenovirus D
ucaugcaacuuggaagg

SEQ ID NO: 3927954 - RNA, 11 nt, Human adenovirus D
ucaugcaagac

SEQ ID NO: 3927955 - RNA, 11 nt, Human adenovirus D
ucauggcccug

SEQ ID NO: 3927956 - RNA, 16 nt, Human adenovirus D
uccaacgccugcgcca

SEQ ID NO: 3927957 - RNA, 19 nt, Human adenovirus D
uccaacguggagcugacca

SEQ ID NO: 3927958 - RNA, 20 nt, Human adenovirus D
uccacgcugguggccaccuc

SEQ ID NO: 3927959 - RNA, 23 nt, Human adenovirus D
uccacggggaccacguccucucg

SEQ ID NO: 3927960 - RNA, 19 nt, Human adenovirus D
uccacuccgcacauguuga

SEQ ID NO: 3927961 - RNA, 13 nt, Human adenovirus D
uccagcaacuuca

SEQ ID NO: 3927962 - RNA, 18 nt, Human adenovirus D
uccagcagagucugccgc

SEQ ID NO: 3927963 - RNA, 13 nt, Human adenovirus D
cgcgugguagccc

SEQ ID NO: 3927964 - RNA, 23 nt, Human adenovirus D
cgcguguugcggcccggcacggc

SEQ ID NO: 3927965 - RNA, 14 nt, Human adenovirus D
cgcuaccgcuucca

SEQ ID NO: 3927966 - RNA, 21 nt, Human adenovirus D
cgcuacugcugauuacucuaa

SEQ ID NO: 3927967 - RNA, 19 nt, Human adenovirus D
cgcucagucauccaacuga

SEQ ID NO: 3927968 - RNA, 22 nt, Human adenovirus D
cgcuccaugaaccggcgcacgu

SEQ ID NO: 3927969 - RNA, 21 nt, Human adenovirus D
cgcuccaugcuucugggcaac

SEQ ID NO: 3927970 - RNA, 15 nt, Human adenovirus D
cgcucccaccgcgcc

SEQ ID NO: 3927971 - RNA, 15 nt, Human adenovirus D
cgcucgcgcaccugc

SEQ ID NO: 3927972 - RNA, 16 nt, Human adenovirus D
cgcucgcgcaccugcu

SEQ ID NO: 3927973 - RNA, 13 nt, Human adenovirus D
cgcucgcucaccc

SEQ ID NO: 3927974 - RNA, 20 nt, Human adenovirus D
cgcucuuaucccaugcccuc

SEQ ID NO: 3927975 - RNA, 19 nt, Human adenovirus D
cgcucuugucgcugaucug

SEQ ID NO: 3927976 - RNA, 13 nt, Human adenovirus D
cgcugaaagcaug

SEQ ID NO: 3927977 - RNA, 22 nt, Human adenovirus D
cgcugcaaccugugcucuccgc

SEQ ID NO: 3927978 - RNA, 21 nt, Human adenovirus D
cgcuggaagaccuacgcucag

SEQ ID NO: 3927979 - RNA, 17 nt, Human adenovirus D
cgcuggaccccauggac

SEQ ID NO: 3927980 - RNA, 21 nt, Human adenovirus D
cgcuggcggagaacaaggcca

SEQ ID NO: 3927981 - RNA, 23 nt, Human adenovirus D
cgcugggcucgagcauggcuacc

SEQ ID NO: 3927982 - RNA, 17 nt, Human adenovirus D
cgcuggggcugcucggc

SEQ ID NO: 3927983 - RNA, 19 nt, Human adenovirus D
ccaggagccugaugagcuc

SEQ ID NO: 3927984 - RNA, 10 nt, Human adenovirus D
ccaggaggag

SEQ ID NO: 3927985 - RNA, 16 nt, Human adenovirus D
ccaggcaaagcucaac

SEQ ID NO: 3927986 - RNA, 13 nt, Human adenovirus D
ccaggcagugcag

SEQ ID NO: 3927987 - RNA, 16 nt, Human adenovirus D
ccaggcagugcagcgc

SEQ ID NO: 3927988 - RNA, 17 nt, Human adenovirus D
ccaggcagugcagcgcg

SEQ ID NO: 3927989 - RNA, 17 nt, Human adenovirus D
ccaggcccagaacuggc

SEQ ID NO: 3927990 - RNA, 22 nt, Human adenovirus D
ccaggguugagucgcggcagaa

SEQ ID NO: 3927991 - RNA, 18 nt, Human adenovirus D
ccaggucaaaacccacuc

SEQ ID NO: 3927992 - RNA, 20 nt, Human adenovirus D
ccaggucacagucuggugga

SEQ ID NO: 3927993 - RNA, 23 nt, Human adenovirus D
ccagguccacgcugguggccacc

SEQ ID NO: 3927994 - RNA, 21 nt, Human adenovirus D
ccaguagacaaagagcacagc

SEQ ID NO: 3927995 - RNA, 22 nt, Human adenovirus D
ccaguagacaaagagcacagca

SEQ ID NO: 3927996 - RNA, 23 nt, Human adenovirus D
ccaguagacaaagagcacagcag

SEQ ID NO: 3927997 - RNA, 17 nt, Human adenovirus D
ccaguaggaaccagcac

SEQ ID NO: 3927998 - RNA, 22 nt, Human adenovirus D
ccagucccuuuuccaggaaagg

SEQ ID NO: 3927999 - RNA, 15 nt, Human adenovirus D
ccagugcuuccagca

SEQ ID NO: 3928000 - RNA, 23 nt, Human adenovirus D
ccaucaagcagguggcgccgggc

SEQ ID NO: 3928001 - RNA, 15 nt, Human adenovirus D
ccauccccauccagu

SEQ ID NO: 3928002 - RNA, 20 nt, Human adenovirus D
ccaucgugcgcgaccugggc

SEQ ID NO: 3928003 - RNA, 17 nt, Human adenovirus D
ccaucuaaacuaaagcc

SEQ ID NO: 3928004 - RNA, 19 nt, Human adenovirus D
ccaugcagaucauggugcc

SEQ ID NO: 3928005 - RNA, 23 nt, Human adenovirus D
ccauggacgggaaccccaccaug

SEQ ID NO: 3928006 - RNA, 22 nt, Human adenovirus D
ccauggcgcacaacaccgccuc

SEQ ID NO: 3928007 - RNA, 21 nt, Human adenovirus D
ccaugggcgccuucaccgacc

SEQ ID NO: 3928008 - RNA, 14 nt, Human adenovirus D
ccauguuggaggaa

SEQ ID NO: 3928009 - RNA, 20 nt, Human adenovirus D
ccauuaucccgacgccgggc

SEQ ID NO: 3928010 - RNA, 14 nt, Human adenovirus D
ccauuccuggagau

SEQ ID NO: 3928011 - RNA, 13 nt, Human adenovirus D
cccaacggcccug

SEQ ID NO: 3928012 - RNA, 18 nt, Human adenovirus D
cccaacuacguguugcau

SEQ ID NO: 3928013 - RNA, 15 nt, Human adenovirus D
cccaagagcgagaug

SEQ ID NO: 3928014 - RNA, 14 nt, Human adenovirus D
cccaccgcgccgcc

SEQ ID NO: 3928015 - RNA, 15 nt, Human adenovirus D
cccacgccgagccug

SEQ ID NO: 3928016 - RNA, 13 nt, Human adenovirus D
cccacggccaucu

SEQ ID NO: 3928017 - RNA, 17 nt, Human adenovirus D
cccacuacaacaucggc

SEQ ID NO: 3928018 - RNA, 16 nt, Human adenovirus D
cccacuacucagcuuc

SEQ ID NO: 3928019 - RNA, 21 nt, Human adenovirus D
cccacuucgccuaccccgccg

SEQ ID NO: 3928020 - RNA, 21 nt, Human adenovirus D
cccagagcuuagcaaggugcu

SEQ ID NO: 3928021 - RNA, 14 nt, Human adenovirus D
cccagcaacccuuc

SEQ ID NO: 3928022 - RNA, 22 nt, Human adenovirus D
cccagcaacccuuccuggucga

SEQ ID NO: 3928023 - RNA, 23 nt, Human adenovirus D
cccagcaauaacaccggcugggg

SEQ ID NO: 3928024 - RNA, 15 nt, Human adenovirus D
cccagcgaucccagc

SEQ ID NO: 3928025 - RNA, 17 nt, Human adenovirus D
cccagcguaagcgcgcg

SEQ ID NO: 3928026 - RNA, 17 nt, Human adenovirus D
cccagcucauccgcagc

SEQ ID NO: 3928027 - RNA, 19 nt, Human adenovirus D
cccaggaaacuaggcgcag

SEQ ID NO: 3928028 - RNA, 16 nt, Human adenovirus D
cccaggccuggcccug

SEQ ID NO: 3928029 - RNA, 13 nt, Human adenovirus D
cccaggcggugcu

SEQ ID NO: 3928030 - RNA, 17 nt, Human adenovirus D
cccaggcggugcugcug

SEQ ID NO: 3928031 - RNA, 15 nt, Human adenovirus D
cccagugcuuccagc

SEQ ID NO: 3928032 - RNA, 17 nt, Human adenovirus D
cccaugagcugcgagaa

SEQ ID NO: 3928033 - RNA, 15 nt, Human adenovirus D
cccauuucacagugu

SEQ ID NO: 3928034 - RNA, 18 nt, Human adenovirus D
ccccagaaagaaguggcc

SEQ ID NO: 3928035 - RNA, 19 nt, Human adenovirus D
ccccagaugggccuggccg

SEQ ID NO: 3928036 - RNA, 20 nt, Human adenovirus D
ccccaggcggugcugcugcc

SEQ ID NO: 3928037 - RNA, 22 nt, Human adenovirus D
cccccaggcccuggagcagcgg

SEQ ID NO: 3928038 - RNA, 23 nt, Human adenovirus D
cccccaggcccuggagcagcggc

SEQ ID NO: 3928039 - RNA, 23 nt, Human adenovirus D
ccccccucagcgucgaggagcug

SEQ ID NO: 3928040 - RNA, 22 nt, Human adenovirus D
ccccgcaggcaggacucgcaga

SEQ ID NO: 3928041 - RNA, 11 nt, Human adenovirus D
ccccgccgggu

SEQ ID NO: 3928042 - RNA, 23 nt, Human adenovirus D
ccccggacgucaccugcggcgcg

SEQ ID NO: 3928043 - RNA, 22 nt, Human adenovirus D
ccccucgaaucaggcuggagcc

SEQ ID NO: 3928044 - RNA, 23 nt, Human adenovirus D
ccccucgaaucaggcuggagccg

SEQ ID NO: 3928045 - RNA, 20 nt, Human adenovirus D
ccccuucaaccaccaccgca

SEQ ID NO: 3928046 - RNA, 22 nt, Human adenovirus D
ccccuucucgggaucgccaggc

SEQ ID NO: 3928047 - RNA, 15 nt, Human adenovirus D
cccgaccgcugucuc

SEQ ID NO: 3928048 - RNA, 15 nt, Human adenovirus D
cccgagcucugcugc

SEQ ID NO: 3928049 - RNA, 16 nt, Human adenovirus D
cccgagcucugcugcg

SEQ ID NO: 3928050 - RNA, 19 nt, Human adenovirus D
cccgagcucugcugcgccg

SEQ ID NO: 3928051 - RNA, 13 nt, Human adenovirus D
cccgcagcacgcg

SEQ ID NO: 3928052 - RNA, 22 nt, Human adenovirus D
cccgcaugaacuggcucagugc

SEQ ID NO: 3928053 - RNA, 12 nt, Human adenovirus D
cccgccacccuu

SEQ ID NO: 3928054 - RNA, 13 nt, Human adenovirus D
cccgccaccugca

SEQ ID NO: 3928055 - RNA, 20 nt, Human adenovirus D
cccgccauaagggcggcgcu

SEQ ID NO: 3928056 - RNA, 20 nt, Human adenovirus D
cccgccgcuaucugcucuuc

SEQ ID NO: 3928057 - RNA, 15 nt, Human adenovirus D
cccgcgcccaccauc

SEQ ID NO: 3928058 - RNA, 17 nt, Human adenovirus D
cccggcauccugcacgc

SEQ ID NO: 3928059 - RNA, 17 nt, Human adenovirus D
cccggccaaggccacca

SEQ ID NO: 3928060 - RNA, 21 nt, Human adenovirus D
cccggcgcaguacgcgcuguc

SEQ ID NO: 3928061 - RNA, 14 nt, Human adenovirus D
cccggcggcagcgg

SEQ ID NO: 3928062 - RNA, 20 nt, Human adenovirus D
cccggggcggaguggccucu

SEQ ID NO: 3928063 - RNA, 13 nt, Human adenovirus D
cccguccuccucg

SEQ ID NO: 3928064 - RNA, 13 nt, Human adenovirus D
cccgucuccugcc

SEQ ID NO: 3928065 - RNA, 17 nt, Human adenovirus D
cccgugaccugcagcag

SEQ ID NO: 3928066 - RNA, 20 nt, Human adenovirus D
cccucaggcgcaaccaggag

SEQ ID NO: 3928067 - RNA, 22 nt, Human adenovirus D
cccuccccgacccccuuccacu

SEQ ID NO: 3928068 - RNA, 16 nt, Human adenovirus D
cccuccgcccugagcu

SEQ ID NO: 3928069 - RNA, 19 nt, Human adenovirus D
cccucgaaucaggcuggag

SEQ ID NO: 3928070 - RNA, 20 nt, Human adenovirus D
cccucgcgcaacugggccgc

SEQ ID NO: 3928071 - RNA, 21 nt, Human adenovirus D
cccucgcgcaacugggccgcu

SEQ ID NO: 3928072 - RNA, 21 nt, Human adenovirus D
cccucggcaacgaccugcgcg

SEQ ID NO: 3928073 - RNA, 17 nt, Human adenovirus D
cccucucgagagcgggc

SEQ ID NO: 3928074 - RNA, 20 nt, Human adenovirus D
cccugaacuaucaaaacgac

SEQ ID NO: 3928075 - RNA, 19 nt, Human adenovirus D
cccugagagcgcuggcgug

SEQ ID NO: 3928076 - RNA, 16 nt, Human adenovirus D
cccugagcggcugcac

SEQ ID NO: 3928077 - RNA, 17 nt, Human adenovirus D
cccugcaagugcacaga

SEQ ID NO: 3928078 - RNA, 15 nt, Human adenovirus D
cccuggagguuccgu

SEQ ID NO: 3928079 - RNA, 14 nt, Human adenovirus D
cccugguccaccuc

SEQ ID NO: 3928080 - RNA, 22 nt, Human adenovirus D
cccuucucgggaucgccaggcc

SEQ ID NO: 3928081 - RNA, 22 nt, Human adenovirus D
ccgaaauuggugcgcuggggcu

SEQ ID NO: 3928082 - RNA, 19 nt, Human adenovirus D
ccgaagcgccguggccucu

SEQ ID NO: 3928083 - RNA, 13 nt, Human adenovirus D
ccgaaggacccca

SEQ ID NO: 3928084 - RNA, 12 nt, Human adenovirus D
ccgacacugcag

SEQ ID NO: 3928085 - RNA, 14 nt, Human adenovirus D
ccgacagcagcaca

SEQ ID NO: 3928086 - RNA, 22 nt, Human adenovirus D
ccgacuuugucccgcugagcua

SEQ ID NO: 3928087 - RNA, 22 nt, Human adenovirus D
ccgagcuccgcgaacagcagca

SEQ ID NO: 3928088 - RNA, 14 nt, Human adenovirus D
ccgaggaagauccc

SEQ ID NO: 3928089 - RNA, 20 nt, Human adenovirus D
ccgaggagcugagaccagac

SEQ ID NO: 3928090 - RNA, 16 nt, Human adenovirus D
ccgaggaggcgguccc

SEQ ID NO: 3928091 - RNA, 16 nt, Human adenovirus D
ccgagggucgcuggcu

SEQ ID NO: 3928092 - RNA, 15 nt, Human adenovirus D
ccgaguuguccuggu

SEQ ID NO: 3928093 - RNA, 20 nt, Human adenovirus D
ccgauggucgcuggacccca

SEQ ID NO: 3928094 - RNA, 14 nt, Human adenovirus D
ccgcaacuuccagc

SEQ ID NO: 3928095 - RNA, 15 nt, Human adenovirus D
ccgcaacuuccagcc

SEQ ID NO: 3928096 - RNA, 13 nt, Human adenovirus D
ccgcaccgcuccu

SEQ ID NO: 3928097 - RNA, 16 nt, Human adenovirus D
ccgcagccgcggcagc

SEQ ID NO: 3928098 - RNA, 14 nt, Human adenovirus D
ccgcagcucuuccc

SEQ ID NO: 3928099 - RNA, 13 nt, Human adenovirus D
ccgccaaccggcu

SEQ ID NO: 3928100 - RNA, 17 nt, Human adenovirus D
ccgccaaggagcuccuc

SEQ ID NO: 3928101 - RNA, 21 nt, Human adenovirus D
aaaucugaaaguaugucucug

SEQ ID NO: 3928102 - RNA, 17 nt, Human adenovirus D
aaaugcuaccugggagu

SEQ ID NO: 3928103 - RNA, 11 nt, Human adenovirus D
aacaaggccau

SEQ ID NO: 3928104 - RNA, 15 nt, Human adenovirus D
aacaauaugugcgca

SEQ ID NO: 3928105 - RNA, 20 nt, Human adenovirus D
aacaaucagccccuuccccu

SEQ ID NO: 3928106 - RNA, 13 nt, Human adenovirus D
aacagacagccag

SEQ ID NO: 3928107 - RNA, 18 nt, Human adenovirus D
aacagcaaaagauacaga

SEQ ID NO: 3928108 - RNA, 15 nt, Human adenovirus D
aacaugcucuacccc

SEQ ID NO: 3928109 - RNA, 16 nt, Human adenovirus D
aaccggaggcuggcug

SEQ ID NO: 3928110 - RNA, 23 nt, Human adenovirus D
aaccugcgcgggcuguggggcgu

SEQ ID NO: 3928111 - RNA, 21 nt, Human adenovirus D
aaccugugcucuccgcaccgc

SEQ ID NO: 3928112 - RNA, 14 nt, Human adenovirus D
aacgcgcgcugccc

SEQ ID NO: 3928113 - RNA, 13 nt, Human adenovirus D
aacggcaccugcg

SEQ ID NO: 3928114 - RNA, 12 nt, Human adenovirus D
aacuaaagccaa

SEQ ID NO: 3928115 - RNA, 22 nt, Human adenovirus D
aacuaucaaaacgaccacagca

SEQ ID NO: 3928116 - RNA, 15 nt, Human adenovirus D
aacucagucacucuc

SEQ ID NO: 3928117 - RNA, 21 nt, Human adenovirus D
aacucugauucaugugaacaa

SEQ ID NO: 3928118 - RNA, 21 nt, Human adenovirus D
aacugcgcguccgucagcagc

SEQ ID NO: 3928119 - RNA, 12 nt, Human adenovirus D
aacuuaacucug

SEQ ID NO: 3928120 - RNA, 19 nt, Human adenovirus D
aacuugugguuuuaacagg

SEQ ID NO: 3928121 - RNA, 18 nt, Human adenovirus D
aagaaacgucccagcagc

SEQ ID NO: 3928122 - RNA, 19 nt, Human adenovirus D
aagaaacgucccagcagca

SEQ ID NO: 3928123 - RNA, 16 nt, Human adenovirus D
aagaaguuagaggagg

SEQ ID NO: 3928124 - RNA, 15 nt, Human adenovirus D
aagacccacagccag

SEQ ID NO: 3928125 - RNA, 21 nt, Human adenovirus D
aagacgaaugggaagaagaga

SEQ ID NO: 3928126 - RNA, 15 nt, Human adenovirus D
aagagcccuuuuugc

SEQ ID NO: 3928127 - RNA, 20 nt, Human adenovirus D
aagaggcuccggguggaaga

SEQ ID NO: 3928128 - RNA, 13 nt, Human adenovirus D
aagaucagcugca

SEQ ID NO: 3928129 - RNA, 22 nt, Human adenovirus D
aagaugauaccaagagaaguua

SEQ ID NO: 3928130 - RNA, 17 nt, Human adenovirus D
aagcaaccuuuccaaga

SEQ ID NO: 3928131 - RNA, 17 nt, Human adenovirus D
aagcaggagcaggagga

SEQ ID NO: 3928132 - RNA, 15 nt, Human adenovirus D
aagccacaaccagag

SEQ ID NO: 3928133 - RNA, 12 nt, Human adenovirus D
aagccagcagca

SEQ ID NO: 3928134 - RNA, 20 nt, Human adenovirus D
aagccaggaaaagaggauga

SEQ ID NO: 3928135 - RNA, 20 nt, Human adenovirus D
aagcuaaugguccugcaaga

SEQ ID NO: 3928136 - RNA, 11 nt, Human adenovirus D
aagcugggcug

SEQ ID NO: 3928137 - RNA, 13 nt, Human adenovirus D
aagcugggcuggg

SEQ ID NO: 3928138 - RNA, 23 nt, Human adenovirus D
aaggauucaaaacucacuuuggu

SEQ ID NO: 3928139 - RNA, 15 nt, Human adenovirus D
aaggcucauaugacc

SEQ ID NO: 3928140 - RNA, 23 nt, Human adenovirus D
aagggauauagucuaugggaaca

SEQ ID NO: 3928141 - RNA, 15 nt, Human adenovirus D
aagggcggcgcugca

SEQ ID NO: 3928142 - RNA, 12 nt, Human adenovirus D
aaggggcgcagg

SEQ ID NO: 3928143 - RNA, 19 nt, Human adenovirus D
aaggugcugacauccaugg

SEQ ID NO: 3928144 - RNA, 14 nt, Human adenovirus D
aaggugugguuuau

SEQ ID NO: 3928145 - RNA, 13 nt, Human adenovirus D
aagguucugcccu

SEQ ID NO: 3928146 - RNA, 15 nt, Human adenovirus D
aaguacacgccggcc

SEQ ID NO: 3928147 - RNA, 19 nt, Human adenovirus D
aaguacuacugaacagaca

SEQ ID NO: 3928148 - RNA, 14 nt, Human adenovirus D
aaguaggugaagaa

SEQ ID NO: 3928149 - RNA, 21 nt, Human adenovirus D
aagucacuaggaccccaggga

SEQ ID NO: 3928150 - RNA, 22 nt, Human adenovirus D
aagucacuuaaguccugggcca

SEQ ID NO: 3928151 - RNA, 23 nt, Human adenovirus D
aagugccacaugcaccugggcgc

SEQ ID NO: 3928152 - RNA, 13 nt, Human adenovirus D
aauaacaugcuga

SEQ ID NO: 3928153 - RNA, 18 nt, Human adenovirus D
aauaucagacaugcugcu

SEQ ID NO: 3928154 - RNA, 12 nt, Human adenovirus D
aauauggccugg

SEQ ID NO: 3928155 - RNA, 18 nt, Human adenovirus D
aauaugggagagaacaaa

SEQ ID NO: 3928156 - RNA, 20 nt, Human adenovirus D
aauaugggagagaacaaaac

SEQ ID NO: 3928157 - RNA, 12 nt, Human adenovirus D
aauccacacagu

SEQ ID NO: 3928158 - RNA, 13 nt, Human adenovirus D
aauccuccaggac

SEQ ID NO: 3928159 - RNA, 21 nt, Human adenovirus D
aaucgagcaggaccugggcuu

SEQ ID NO: 3928160 - RNA, 15 nt, Human adenovirus D
aauuaugcuccuggg

SEQ ID NO: 3928161 - RNA, 16 nt, Human adenovirus D
aauucagggugcucca

SEQ ID NO: 3928162 - RNA, 13 nt, Human adenovirus D
aauucucaaagug

SEQ ID NO: 3928163 - RNA, 16 nt, Human adenovirus D
aauucucauuuuucca

SEQ ID NO: 3928164 - RNA, 14 nt, Human adenovirus D
aauuuuuauuuccu

SEQ ID NO: 3928165 - RNA, 17 nt, Human adenovirus D
acaaagcugaaagcuau

SEQ ID NO: 3928166 - RNA, 17 nt, Human adenovirus D
acaacaagauucaauaa

SEQ ID NO: 3928167 - RNA, 20 nt, Human adenovirus D
acaacaucggcuaccagggc

SEQ ID NO: 3928168 - RNA, 12 nt, Human adenovirus D
acaaggccugga

SEQ ID NO: 3928169 - RNA, 15 nt, Human adenovirus D
acaaguuuaggaacc

SEQ ID NO: 3928170 - RNA, 17 nt, Human adenovirus D
acaaucagccccuuccc

SEQ ID NO: 3928171 - RNA, 19 nt, Human adenovirus D
acaaucagccccuuccccu

SEQ ID NO: 3928172 - RNA, 23 nt, Human adenovirus D
acaaugauggauacuugguagca

SEQ ID NO: 3928173 - RNA, 15 nt, Human adenovirus D
acacacgcccugggu

SEQ ID NO: 3928174 - RNA, 14 nt, Human adenovirus D
acacccaacugagc

SEQ ID NO: 3928175 - RNA, 19 nt, Human adenovirus D
acaccugugacaugcaaaa

SEQ ID NO: 3928176 - RNA, 16 nt, Human adenovirus D
acacggucacugucca

SEQ ID NO: 3928177 - RNA, 17 nt, Human adenovirus D
acacgguucucucagca

SEQ ID NO: 3928178 - RNA, 18 nt, Human adenovirus D
acacuagaaagcaguuca

SEQ ID NO: 3928179 - RNA, 20 nt, Human adenovirus D
acacuuccuucgcagucucc

SEQ ID NO: 3928180 - RNA, 21 nt, Human adenovirus D
acacuuccuucgcagucucca

SEQ ID NO: 3928181 - RNA, 12 nt, Human adenovirus D
acagaaagcaug

SEQ ID NO: 3928182 - RNA, 14 nt, Human adenovirus D
acagacagccaggu

SEQ ID NO: 3928183 - RNA, 13 nt, Human adenovirus D
acagcacagcagg

SEQ ID NO: 3928184 - RNA, 17 nt, Human adenovirus D
acagcaggagugcaggg

SEQ ID NO: 3928185 - RNA, 18 nt, Human adenovirus D
acagcaggagugcaggga

SEQ ID NO: 3928186 - RNA, 23 nt, Human adenovirus D
acagcaguacaagcgccaacagc

SEQ ID NO: 3928187 - RNA, 23 nt, Human adenovirus D
acagccuucagcaucagucuccu

SEQ ID NO: 3928188 - RNA, 16 nt, Human adenovirus D
acagcgacgagacugg

SEQ ID NO: 3928189 - RNA, 14 nt, Human adenovirus D
acaggaggcacaga

SEQ ID NO: 3928190 - RNA, 18 nt, Human adenovirus D
acaggaugggucugugcc

SEQ ID NO: 3928191 - RNA, 20 nt, Human adenovirus D
aaauacagaugguagcagca

SEQ ID NO: 3928192 - RNA, 19 nt, Human adenovirus D
aaauccacuccgcacaugu

SEQ ID NO: 3928193 - RNA, 22 nt, Human adenovirus D
aaaucugcccugauauccagua

SEQ ID NO: 3928194 - RNA, 15 nt, Human adenovirus D
aaaucuuacacauga

SEQ ID NO: 3928195 - RNA, 22 nt, Human adenovirus D
aaaugaagccguccucugaaaa

SEQ ID NO: 3928196 - RNA, 23 nt, Human adenovirus D
aaauuguugguguaaauccacuc

SEQ ID NO: 3928197 - RNA, 12 nt, Human adenovirus D
aacacacugccc

SEQ ID NO: 3928198 - RNA, 22 nt, Human adenovirus D
aacaggagccgcuaguggaaga

SEQ ID NO: 3928199 - RNA, 14 nt, Human adenovirus D
aacaguacuggcaa

SEQ ID NO: 3928200 - RNA, 16 nt, Human adenovirus D
aacaucaccacaggca

SEQ ID NO: 3928201 - RNA, 19 nt, Human adenovirus D
aacauccccgcccugcugg

SEQ ID NO: 3928202 - RNA, 15 nt, Human adenovirus D
aacaucugugcugcc

SEQ ID NO: 3928203 - RNA, 14 nt, Human adenovirus D
aaccaaaaaaaaca

SEQ ID NO: 3928204 - RNA, 13 nt, Human adenovirus D
aacccaugaaaga

SEQ ID NO: 3928205 - RNA, 15 nt, Human adenovirus D
aaccccacaggauga

SEQ ID NO: 3928206 - RNA, 22 nt, Human adenovirus D
aacccgcgcucgcgcaccugcu

SEQ ID NO: 3928207 - RNA, 11 nt, Human adenovirus D
aacccugguga

SEQ ID NO: 3928208 - RNA, 13 nt, Human adenovirus D
aaccgccuggggc

SEQ ID NO: 3928209 - RNA, 14 nt, Human adenovirus D
aaccugcgcgggcu

SEQ ID NO: 3928210 - RNA, 17 nt, Human adenovirus D
aaccuuuggaccugagc

SEQ ID NO: 3928211 - RNA, 19 nt, Human adenovirus D
aacgacgaguuggugagcu

SEQ ID NO: 3928212 - RNA, 23 nt, Human adenovirus D
aacgaggcguucagggaggcgcu

SEQ ID NO: 3928213 - RNA, 13 nt, Human adenovirus D
aacgcccugcugg

SEQ ID NO: 3928214 - RNA, 14 nt, Human adenovirus D
aacgucccagcagc

SEQ ID NO: 3928215 - RNA, 20 nt, Human adenovirus D
aacuacuggcuucuacagcc

SEQ ID NO: 3928216 - RNA, 16 nt, Human adenovirus D
aacucagucacucuca

SEQ ID NO: 3928217 - RNA, 17 nt, Human adenovirus D
aacucgcggcugcugcu

SEQ ID NO: 3928218 - RNA, 22 nt, Human adenovirus D
aacucugauucaugugaacaaa

SEQ ID NO: 3928219 - RNA, 14 nt, Human adenovirus D
aacucuuaaaucau

SEQ ID NO: 3928220 - RNA, 16 nt, Human adenovirus D
aacugaugaaaaagcu

SEQ ID NO: 3928221 - RNA, 22 nt, Human adenovirus D
aacugcgcguccgucagcagca

SEQ ID NO: 3928222 - RNA, 11 nt, Human adenovirus D
aacugcuggcc

SEQ ID NO: 3928223 - RNA, 18 nt, Human adenovirus D
aacugcuggcccugcugg

SEQ ID NO: 3928224 - RNA, 22 nt, Human adenovirus D
aacugcuggcccugcuggccga

SEQ ID NO: 3928225 - RNA, 17 nt, Human adenovirus D
aacuuaguuuaaaagua

SEQ ID NO: 3928226 - RNA, 22 nt, Human adenovirus D
aagaagggcaucuucugccugg

SEQ ID NO: 3928227 - RNA, 20 nt, Human adenovirus D
aagaaucacauuaaaggcug

SEQ ID NO: 3928228 - RNA, 13 nt, Human adenovirus D
aagacccacagcc

SEQ ID NO: 3928229 - RNA, 15 nt, Human adenovirus D
aagaccgugaauauc

SEQ ID NO: 3928230 - RNA, 21 nt, Human adenovirus D
aagaggggcagcaaccuaaag

SEQ ID NO: 3928231 - RNA, 20 nt, Human adenovirus D
aagaucuccaacguggagcu

SEQ ID NO: 3928232 - RNA, 16 nt, Human adenovirus D
aagauggaggagcagc

SEQ ID NO: 3928233 - RNA, 23 nt, Human adenovirus D
aagcagguggcgccgggccuggg

SEQ ID NO: 3928234 - RNA, 22 nt, Human adenovirus D
aagcgccaggaggcggugcgca

SEQ ID NO: 3928235 - RNA, 12 nt, Human adenovirus D
aagcgccguggc

SEQ ID NO: 3928236 - RNA, 17 nt, Human adenovirus D
aagcgcugguugaacau

SEQ ID NO: 3928237 - RNA, 21 nt, Human adenovirus D
aagcuagcacccaaaaacugc

SEQ ID NO: 3928238 - RNA, 14 nt, Human adenovirus D
aagcugccaugggc

SEQ ID NO: 3928239 - RNA, 14 nt, Human adenovirus D
aaggaugaggugga

SEQ ID NO: 3928240 - RNA, 11 nt, Human adenovirus D
aagggcggcgc

SEQ ID NO: 3928241 - RNA, 15 nt, Human adenovirus D
aaggugaaaccagau

SEQ ID NO: 3928242 - RNA, 17 nt, Human adenovirus D
aagucacuuaaguccug

SEQ ID NO: 3928243 - RNA, 15 nt, Human adenovirus D
aagucuacuggucgc

SEQ ID NO: 3928244 - RNA, 23 nt, Human adenovirus D
aauaagcagaguacucauaaaga

SEQ ID NO: 3928245 - RNA, 20 nt, Human adenovirus D
aauacagaugguagcagcag

SEQ ID NO: 3928246 - RNA, 15 nt, Human adenovirus D
aaucaagacaaaauu

SEQ ID NO: 3928247 - RNA, 18 nt, Human adenovirus D
aaucagaguaagaggagu

SEQ ID NO: 3928248 - RNA, 14 nt, Human adenovirus D
aaucgcgggcggcc

SEQ ID NO: 3928249 - RNA, 15 nt, Human adenovirus D
aaucggaucuucccc

SEQ ID NO: 3928250 - RNA, 20 nt, Human adenovirus D
aaucuggcgguaccagggga

SEQ ID NO: 3928251 - RNA, 17 nt, Human adenovirus D
aaugggcccuugaacag

SEQ ID NO: 3928252 - RNA, 16 nt, Human adenovirus D
aaugucagcugcaaaa

SEQ ID NO: 3928253 - RNA, 17 nt, Human adenovirus D
aaugugagugauaaagc

SEQ ID NO: 3928254 - RNA, 14 nt, Human adenovirus D
aauucagagccagg

SEQ ID NO: 3928255 - RNA, 22 nt, Human adenovirus D
acaacaagauucaauaagguuc

SEQ ID NO: 3928256 - RNA, 17 nt, Human adenovirus D
acaacagccgcaggcca

SEQ ID NO: 3928257 - RNA, 21 nt, Human adenovirus D
acaacagccuugcccccaagg

SEQ ID NO: 3928258 - RNA, 17 nt, Human adenovirus D
acaacccgccugccagg

SEQ ID NO: 3928259 - RNA, 16 nt, Human adenovirus D
acaacgccaggcuggc

SEQ ID NO: 3928260 - RNA, 11 nt, Human adenovirus D
acaaggccugg

SEQ ID NO: 3928261 - RNA, 18 nt, Human adenovirus D
acaauaauugaacugccu

SEQ ID NO: 3928262 - RNA, 16 nt, Human adenovirus D
acacaaaaaugaagcc

SEQ ID NO: 3928263 - RNA, 20 nt, Human adenovirus D
acacaugauggagcuuaucu

SEQ ID NO: 3928264 - RNA, 22 nt, Human adenovirus D
acaccaacuuuaucagcgcgcu

SEQ ID NO: 3928265 - RNA, 15 nt, Human adenovirus D
acacccaacugagca

SEQ ID NO: 3928266 - RNA, 21 nt, Human adenovirus D
acacgccaccgcuuuugacaa

SEQ ID NO: 3928267 - RNA, 19 nt, Human adenovirus D
acacgcuguaccgcagcug

SEQ ID NO: 3928268 - RNA, 20 nt, Human adenovirus D
acacgcuguaccgcagcugg

SEQ ID NO: 3928269 - RNA, 15 nt, Human adenovirus D
acacggucacugucc

SEQ ID NO: 3928270 - RNA, 16 nt, Human adenovirus D
acacguagcagcccug

SEQ ID NO: 3928271 - RNA, 15 nt, Human adenovirus D
acacuacuaauucuc

SEQ ID NO: 3928272 - RNA, 18 nt, Human adenovirus D
acacuuaguucagcugca

SEQ ID NO: 3928273 - RNA, 20 nt, Human adenovirus D
acagaacaaaaacagacugg

SEQ ID NO: 3928274 - RNA, 19 nt, Human adenovirus D
acagaaccagauacuucag

SEQ ID NO: 3928275 - RNA, 12 nt, Human adenovirus D
acagacagccag

SEQ ID NO: 3928276 - RNA, 15 nt, Human adenovirus D
acagacccaccccag

SEQ ID NO: 3928277 - RNA, 15 nt, Human adenovirus D
acagcacagcaggga

SEQ ID NO: 3928278 - RNA, 15 nt, Human adenovirus D
acagcaccgccgcag

SEQ ID NO: 3928279 - RNA, 23 nt, Human adenovirus D
acagcaccgccgcagccgcggca

SEQ ID NO: 3928280 - RNA, 14 nt, Human adenovirus D
acagcagcgacuga

SEQ ID NO: 3928281 - RNA, 13 nt, Human adenovirus D
acagcaggagugc

SEQ ID NO: 3928282 - RNA, 14 nt, Human adenovirus D
acagccacaugacc

SEQ ID NO: 3928283 - RNA, 22 nt, Human adenovirus D
acagccgucuggacccgcggcc

SEQ ID NO: 3928284 - RNA, 13 nt, Human adenovirus D
acagccuucagca

SEQ ID NO: 3928285 - RNA, 21 nt, Human adenovirus D
acagccuugcccccaagggcg

SEQ ID NO: 3928286 - RNA, 21 nt, Human adenovirus D
acagcggcagggugagccggc

SEQ ID NO: 3928287 - RNA, 18 nt, Human adenovirus D
acagcuagacaccacagu

SEQ ID NO: 3928288 - RNA, 17 nt, Human adenovirus D
acaggcaaugagaggag

SEQ ID NO: 3928289 - RNA, 20 nt, Human adenovirus D
acaggccuaacuacauuggc

SEQ ID NO: 3928290 - RNA, 23 nt, Human adenovirus D
acaguagcgucucaagagagguu

SEQ ID NO: 3928291 - RNA, 19 nt, Human adenovirus D
acaguauugugggccuggg

SEQ ID NO: 3928292 - RNA, 20 nt, Human adenovirus D
acaguauugugggccuggga

SEQ ID NO: 3928293 - RNA, 21 nt, Human adenovirus D
acagucugagggccacccuga

SEQ ID NO: 3928294 - RNA, 17 nt, Human adenovirus D
acaguuauaccaccucc

SEQ ID NO: 3928295 - RNA, 12 nt, Human adenovirus D
acaucugugcug

SEQ ID NO: 3928296 - RNA, 14 nt, Human adenovirus D
acaugacccugcau

SEQ ID NO: 3928297 - RNA, 15 nt, Human adenovirus D
acaugcccagcagca

SEQ ID NO: 3928298 - RNA, 10 nt, Human adenovirus D
acauguggag

SEQ ID NO: 3928299 - RNA, 21 nt, Human adenovirus D
acauguggagcuaucagcccc

SEQ ID NO: 3928300 - RNA, 15 nt, Human adenovirus D
accaacaugcccaau

SEQ ID NO: 3928301 - RNA, 22 nt, Human adenovirus D
accaacggcugcauccacugcu

SEQ ID NO: 3928302 - RNA, 21 nt, Human adenovirus D
accaaggcacccaccacaguu

SEQ ID NO: 3928303 - RNA, 16 nt, Human adenovirus D
accaauagacagcaga

SEQ ID NO: 3928304 - RNA, 23 nt, Human adenovirus D
accacugccgccgccugcgcugc

SEQ ID NO: 3928305 - RNA, 14 nt, Human adenovirus D
accagaccaccugg

SEQ ID NO: 3928306 - RNA, 19 nt, Human adenovirus D
accaggaugcagccagugg

SEQ ID NO: 3928307 - RNA, 17 nt, Human adenovirus D
cuagagugccacugccg

SEQ ID NO: 3928308 - RNA, 19 nt, Human adenovirus D
cuagcaugaccagacccag

SEQ ID NO: 3928309 - RNA, 16 nt, Human adenovirus D
cuagccagccacagcc

SEQ ID NO: 3928310 - RNA, 14 nt, Human adenovirus D
cuagcccuuccugg

SEQ ID NO: 3928311 - RNA, 21 nt, Human adenovirus D
cuaggggaagauggaggagca

SEQ ID NO: 3928312 - RNA, 20 nt, Human adenovirus D
cuauaauccacacaguuucc

SEQ ID NO: 3928313 - RNA, 19 nt, Human adenovirus D
cuaucgcucuuaucccaug

SEQ ID NO: 3928314 - RNA, 14 nt, Human adenovirus D
cuaucugcucuucc

SEQ ID NO: 3928315 - RNA, 16 nt, Human adenovirus D
cuaugaaagcauacag

SEQ ID NO: 3928316 - RNA, 21 nt, Human adenovirus D
cuauucucaucucgcccagca

SEQ ID NO: 3928317 - RNA, 18 nt, Human adenovirus D
cuauugcuagcccuuccu

SEQ ID NO: 3928318 - RNA, 14 nt, Human adenovirus D
cucaaaaagcugug

SEQ ID NO: 3928319 - RNA, 14 nt, Human adenovirus D
cucaacgcccaggc

SEQ ID NO: 3928320 - RNA, 14 nt, Human adenovirus D
cucaaugucagcug

SEQ ID NO: 3928321 - RNA, 13 nt, Human adenovirus D
cucaccaaggcca

SEQ ID NO: 3928322 - RNA, 10 nt, Human adenovirus D
cucaccaccc

SEQ ID NO: 3928323 - RNA, 18 nt, Human adenovirus D
cucacucucuuccgcguc

SEQ ID NO: 3928324 - RNA, 18 nt, Human adenovirus D
cucagccacuccaagugg

SEQ ID NO: 3928325 - RNA, 21 nt, Human adenovirus D
cucagcugccaugggaggaag

SEQ ID NO: 3928326 - RNA, 21 nt, Human adenovirus D
cucaggaccauagggagccug

SEQ ID NO: 3928327 - RNA, 16 nt, Human adenovirus D
cucagguugucaguuu

SEQ ID NO: 3928328 - RNA, 17 nt, Human adenovirus D
cucaucacaucagccag

SEQ ID NO: 3928329 - RNA, 14 nt, Human adenovirus D
cucauccugcuggu

SEQ ID NO: 3928330 - RNA, 17 nt, Human adenovirus D
cucauuuuuccagccuu

SEQ ID NO: 3928331 - RNA, 17 nt, Human adenovirus D
cuccaacgccugcgcca

SEQ ID NO: 3928332 - RNA, 17 nt, Human adenovirus D
cuccaacguggagcuga

SEQ ID NO: 3928333 - RNA, 14 nt, Human adenovirus D
cuccacccuggugu

SEQ ID NO: 3928334 - RNA, 16 nt, Human adenovirus D
cuccacgccaccaccc

SEQ ID NO: 3928335 - RNA, 16 nt, Human adenovirus D
cucccacagcucgcgg

SEQ ID NO: 3928336 - RNA, 13 nt, Human adenovirus D
cucccaccaccag

SEQ ID NO: 3928337 - RNA, 18 nt, Human adenovirus D
cucccagcgccgcgcugg

SEQ ID NO: 3928338 - RNA, 22 nt, Human adenovirus D
cuccgagcagcgcauccugcaa

SEQ ID NO: 3928339 - RNA, 20 nt, Human adenovirus D
cuccgcacauguugaaaagc

SEQ ID NO: 3928340 - RNA, 15 nt, Human adenovirus D
cuccuccuccuggag

SEQ ID NO: 3928341 - RNA, 20 nt, Human adenovirus D
cuccugccugggaauccugc

SEQ ID NO: 3928342 - RNA, 23 nt, Human adenovirus D
cuccuggugcgucgagcacagca

SEQ ID NO: 3928343 - RNA, 17 nt, Human adenovirus D
cuccuucaacgcgcgcu

SEQ ID NO: 3928344 - RNA, 20 nt, Human adenovirus D
cucgaucuccuccuccugga

SEQ ID NO: 3928345 - RNA, 23 nt, Human adenovirus D
cucgcagaucugcaucucccagg

SEQ ID NO: 3928346 - RNA, 18 nt, Human adenovirus D
cucgccuucggcuggaac

SEQ ID NO: 3928347 - RNA, 17 nt, Human adenovirus D
cucgcgcaacugggccg

SEQ ID NO: 3928348 - RNA, 14 nt, Human adenovirus D
cucgcgcaccugcu

SEQ ID NO: 3928349 - RNA, 22 nt, Human adenovirus D
cucgcggacgcgguuccagaug

SEQ ID NO: 3928350 - RNA, 18 nt, Human adenovirus D
cucgcucgguugaggcac

SEQ ID NO: 3928351 - RNA, 13 nt, Human adenovirus D
cucgcugguggcg

SEQ ID NO: 3928352 - RNA, 15 nt, Human adenovirus D
cucggaccaacccca

SEQ ID NO: 3928353 - RNA, 16 nt, Human adenovirus D
cucggaguaccugagc

SEQ ID NO: 3928354 - RNA, 17 nt, Human adenovirus D
cucggaguaccugagcc

SEQ ID NO: 3928355 - RNA, 22 nt, Human adenovirus D
cucggccgacgauagcagcgug

SEQ ID NO: 3928356 - RNA, 16 nt, Human adenovirus D
cucggcugagcucgcu

SEQ ID NO: 3928357 - RNA, 19 nt, Human adenovirus D
cucguagaaauccacggcg

SEQ ID NO: 3928358 - RNA, 13 nt, Human adenovirus D
cucguagauggau

SEQ ID NO: 3928359 - RNA, 13 nt, Human adenovirus D
cucguaggugagg

SEQ ID NO: 3928360 - RNA, 14 nt, Human adenovirus D
cucgucuuccagga

SEQ ID NO: 3928361 - RNA, 16 nt, Human adenovirus D
cucguucauccagguc

SEQ ID NO: 3928362 - RNA, 20 nt, Human adenovirus D
cucguucugcccaccgugcg

SEQ ID NO: 3928363 - RNA, 18 nt, Human adenovirus D
cucuacgccaccuucuuc

SEQ ID NO: 3928364 - RNA, 14 nt, Human adenovirus D
cucuaucuucucuu

SEQ ID NO: 3928365 - RNA, 15 nt, Human adenovirus D
cucucguuccagacg

SEQ ID NO: 3928366 - RNA, 13 nt, Human adenovirus D
cucucucuucuug

SEQ ID NO: 3928367 - RNA, 16 nt, Human adenovirus D
cucugaaaagucaucc

SEQ ID NO: 3928368 - RNA, 17 nt, Human adenovirus D
cucugacggcgcagcug

SEQ ID NO: 3928369 - RNA, 13 nt, Human adenovirus D
cucugcgcgcgcg

SEQ ID NO: 3928370 - RNA, 23 nt, Human adenovirus D
cucugggggcgguggugguggcg

SEQ ID NO: 3928371 - RNA, 14 nt, Human adenovirus D
cucuuccgccgccg

SEQ ID NO: 3928372 - RNA, 18 nt, Human adenovirus D
cucuucgcagaaccauga

SEQ ID NO: 3928373 - RNA, 16 nt, Human adenovirus D
cucuucuuccaugaca

SEQ ID NO: 3928374 - RNA, 12 nt, Human adenovirus D
cucuuggagcag

SEQ ID NO: 3928375 - RNA, 23 nt, Human adenovirus D
cugaaaaacaggccgcagcucuu

SEQ ID NO: 3928376 - RNA, 18 nt, Human adenovirus D
cugaaccacacggccagc

SEQ ID NO: 3928377 - RNA, 22 nt, Human adenovirus D
cugaaccacacggccagcaggg

SEQ ID NO: 3928378 - RNA, 20 nt, Human adenovirus D
cugaacgacucgcugcugca

SEQ ID NO: 3928379 - RNA, 16 nt, Human adenovirus D
cugaagaacauccaug

SEQ ID NO: 3928380 - RNA, 20 nt, Human adenovirus D
cugaagauguaaccuugcaa

SEQ ID NO: 3928381 - RNA, 21 nt, Human adenovirus D
cugaagcccgugaccugcagc

SEQ ID NO: 3928382 - RNA, 22 nt, Human adenovirus D
cugaagcccgugaccugcagca

SEQ ID NO: 3928383 - RNA, 14 nt, Human adenovirus D
cugaaggagcugga

SEQ ID NO: 3928384 - RNA, 20 nt, Human adenovirus D
cugacaauucagagccaggg

SEQ ID NO: 3928385 - RNA, 15 nt, Human adenovirus D
cugacacaaaacuaa

SEQ ID NO: 3928386 - RNA, 19 nt, Human adenovirus D
cugacauccauggccaggg

SEQ ID NO: 3928387 - RNA, 21 nt, Human adenovirus D
cugacauccauggccagggga

SEQ ID NO: 3928388 - RNA, 17 nt, Human adenovirus D
cugacgagcccgcgcgg

SEQ ID NO: 3928389 - RNA, 22 nt, Human adenovirus D
cugacgcccaacucgcggcugc

SEQ ID NO: 3928390 - RNA, 14 nt, Human adenovirus D
cugacgcugagcga

SEQ ID NO: 3928391 - RNA, 19 nt, Human adenovirus D
cugagauacgaugagacca

SEQ ID NO: 3928392 - RNA, 17 nt, Human adenovirus D
cugagauaugugcagca

SEQ ID NO: 3928393 - RNA, 19 nt, Human adenovirus D
cugagauaugugcagcaga

SEQ ID NO: 3928394 - RNA, 15 nt, Human adenovirus D
cugagcaaccuccug

SEQ ID NO: 3928395 - RNA, 14 nt, Human adenovirus D
cugagccgccagcu

SEQ ID NO: 3928396 - RNA, 16 nt, Human adenovirus D
cugagcuuggccgaga

SEQ ID NO: 3928397 - RNA, 22 nt, Human adenovirus D
cugagguaaaauucaacugcag

SEQ ID NO: 3928398 - RNA, 22 nt, Human adenovirus D
cugaguggcggcuuucugcccg

SEQ ID NO: 3928399 - RNA, 15 nt, Human adenovirus D
cugaucagaaacaca

SEQ ID NO: 3928400 - RNA, 15 nt, Human adenovirus D
cugaugaaaaagcug

SEQ ID NO: 3928401 - RNA, 16 nt, Human adenovirus D
cugaugagcucggcga

SEQ ID NO: 3928402 - RNA, 16 nt, Human adenovirus D
cugcaagugcacagac

SEQ ID NO: 3928403 - RNA, 21 nt, Human adenovirus D
cugcacaccaacaugcccaau

SEQ ID NO: 3928404 - RNA, 16 nt, Human adenovirus D
cugcaccauccccagg

SEQ ID NO: 3928405 - RNA, 19 nt, Human adenovirus D
cugcaccccccgcaggcag

SEQ ID NO: 3928406 - RNA, 22 nt, Human adenovirus D
cugcacgagaaccgccuggggc

SEQ ID NO: 3928407 - RNA, 17 nt, Human adenovirus D
cugcacuuucuuugcca

SEQ ID NO: 3928408 - RNA, 14 nt, Human adenovirus D
cugcagacaucaug

SEQ ID NO: 3928409 - RNA, 19 nt, Human adenovirus D
cugcagaguucccucggca

SEQ ID NO: 3928410 - RNA, 22 nt, Human adenovirus D
cugcagcaggugcugccccagg

SEQ ID NO: 3928411 - RNA, 23 nt, Human adenovirus D
cugcagcauugucugccugguca

SEQ ID NO: 3928412 - RNA, 14 nt, Human adenovirus D
cugcagcgccaguc

SEQ ID NO: 3928413 - RNA, 16 nt, Human adenovirus D
cugcagggagccaggg

SEQ ID NO: 3928414 - RNA, 19 nt, Human adenovirus D
cugcagguggacgagccgc

SEQ ID NO: 3928415 - RNA, 22 nt, Human adenovirus D
cugcauauucggguagaggccu

SEQ ID NO: 3928416 - RNA, 18 nt, Human adenovirus D
cugcauccacugcuccug

SEQ ID NO: 3928417 - RNA, 19 nt, Human adenovirus D
cugcccguucucgcugguc

SEQ ID NO: 3928418 - RNA, 14 nt, Human adenovirus D
cugccgccggggcu

SEQ ID NO: 3928419 - RNA, 20 nt, Human adenovirus D
cugccgccggggcucggugc

SEQ ID NO: 3928420 - RNA, 21 nt, Human adenovirus D
cugccgguuucgggcgggcag

SEQ ID NO: 3928421 - RNA, 14 nt, Human adenovirus D
cugccuccaccacc

SEQ ID NO: 3928422 - RNA, 14 nt, Human adenovirus D
cugcuaaagcuaau

SEQ ID NO: 3928423 - RNA, 17 nt, Human adenovirus D
gaagaacauccauguga

SEQ ID NO: 3928424 - RNA, 12 nt, Human adenovirus D
gaagaagagaca

SEQ ID NO: 3928425 - RNA, 22 nt, Human adenovirus D
gaagaauuggaaaaguggaaga

SEQ ID NO: 3928426 - RNA, 18 nt, Human adenovirus D
gaagacgagggcgcgcag

SEQ ID NO: 3928427 - RNA, 22 nt, Human adenovirus D
gaagacggcguaguugcgcagg

SEQ ID NO: 3928428 - RNA, 18 nt, Human adenovirus D
gaagagccggcucgucua

SEQ ID NO: 3928429 - RNA, 23 nt, Human adenovirus D
gaagaggagcugaucucgcugcc

SEQ ID NO: 3928430 - RNA, 15 nt, Human adenovirus D
gaagccguggcgcag

SEQ ID NO: 3928431 - RNA, 20 nt, Human adenovirus D
gaagggcaucuucugccugg

SEQ ID NO: 3928432 - RNA, 19 nt, Human adenovirus D
gaagggguucucgcgcuca

SEQ ID NO: 3928433 - RNA, 21 nt, Human adenovirus D
gaaggugguggacggccuggc

SEQ ID NO: 3928434 - RNA, 18 nt, Human adenovirus D
gaauaggcacugaaaauu

SEQ ID NO: 3928435 - RNA, 16 nt, Human adenovirus D
gaauaucagacaugcu

SEQ ID NO: 3928436 - RNA, 14 nt, Human adenovirus D
gaauauccccuucc

SEQ ID NO: 3928437 - RNA, 23 nt, Human adenovirus D
gaauauccccuuccucacucccc

SEQ ID NO: 3928438 - RNA, 15 nt, Human adenovirus D
gaaucgcgggcggcc

SEQ ID NO: 3928439 - RNA, 19 nt, Human adenovirus D
gaaucuugaacuacuggcu

SEQ ID NO: 3928440 - RNA, 15 nt, Human adenovirus D
gacaacgccaggcug

SEQ ID NO: 3928441 - RNA, 18 nt, Human adenovirus D
gacaagauaucauaaaga

SEQ ID NO: 3928442 - RNA, 16 nt, Human adenovirus D
gacaauucagagccag

SEQ ID NO: 3928443 - RNA, 18 nt, Human adenovirus D
gacaauucagagccaggg

SEQ ID NO: 3928444 - RNA, 18 nt, Human adenovirus D
gacacaccuggaggcacc

SEQ ID NO: 3928445 - RNA, 11 nt, Human adenovirus D
gacaccacagu

SEQ ID NO: 3928446 - RNA, 18 nt, Human adenovirus D
gacacguacuucagccug

SEQ ID NO: 3928447 - RNA, 19 nt, Human adenovirus D
gacacguacuucagccugg

SEQ ID NO: 3928448 - RNA, 20 nt, Human adenovirus D
gacacugcagggagccaggg

SEQ ID NO: 3928449 - RNA, 22 nt, Human adenovirus D
gacagagauggacuuggaagag

SEQ ID NO: 3928450 - RNA, 12 nt, Human adenovirus D
gacagccagcag

SEQ ID NO: 3928451 - RNA, 11 nt, Human adenovirus D
gacagccaggu

SEQ ID NO: 3928452 - RNA, 13 nt, Human adenovirus D
gacagcguggugg

SEQ ID NO: 3928453 - RNA, 19 nt, Human adenovirus D
gacagcuuuuacaugcgca

SEQ ID NO: 3928454 - RNA, 12 nt, Human adenovirus D
gacaucaugaac

SEQ ID NO: 3928455 - RNA, 17 nt, Human adenovirus D
gaccacgguggugcaga

SEQ ID NO: 3928456 - RNA, 18 nt, Human adenovirus D
gaccagaccaccugguga

SEQ ID NO: 3928457 - RNA, 21 nt, Human adenovirus D
gaccaggcggcagagcgggcg

SEQ ID NO: 3928458 - RNA, 12 nt, Human adenovirus D
gacccaggcgcg

SEQ ID NO: 3928459 - RNA, 21 nt, Human adenovirus D
gaccccuggcucccagccucc

SEQ ID NO: 3928460 - RNA, 17 nt, Human adenovirus D
gacccugagaacggggu

SEQ ID NO: 3928461 - RNA, 15 nt, Human adenovirus D
gaccgacgcugggcu

SEQ ID NO: 3928462 - RNA, 14 nt, Human adenovirus D
gaccgcagcgggga

SEQ ID NO: 3928463 - RNA, 15 nt, Human adenovirus D
gaccggcagcggggc

SEQ ID NO: 3928464 - RNA, 21 nt, Human adenovirus D
gaccucggaguaccugagccg

SEQ ID NO: 3928465 - RNA, 20 nt, Human adenovirus D
gaccugcagcaggugcugcc

SEQ ID NO: 3928466 - RNA, 17 nt, Human adenovirus D
gacgacugggaggcugc

SEQ ID NO: 3928467 - RNA, 20 nt, Human adenovirus D
gacgagacuggccucgagcu

SEQ ID NO: 3928468 - RNA, 13 nt, Human adenovirus D
gacgagcucgccg

SEQ ID NO: 3928469 - RNA, 16 nt, Human adenovirus D
gacgcaagagccggcg

SEQ ID NO: 3928470 - RNA, 17 nt, Human adenovirus D
gacgcagccggcgaacg

SEQ ID NO: 3928471 - RNA, 21 nt, Human adenovirus D
gacgcagccggcgaacgugcc

SEQ ID NO: 3928472 - RNA, 21 nt, Human adenovirus D
gacgcccuggccgaccggagc

SEQ ID NO: 3928473 - RNA, 17 nt, Human adenovirus D
gacgcccuugugcccgc

SEQ ID NO: 3928474 - RNA, 13 nt, Human adenovirus D
gacgcgcuccucg

SEQ ID NO: 3928475 - RNA, 15 nt, Human adenovirus D
gacgcucuagaggca

SEQ ID NO: 3928476 - RNA, 16 nt, Human adenovirus D
gacggacuugauuggc

SEQ ID NO: 3928477 - RNA, 21 nt, Human adenovirus D
gacggccuacgagcagacggu

SEQ ID NO: 3928478 - RNA, 19 nt, Human adenovirus D
gacggcgcagcuguuccug

SEQ ID NO: 3928479 - RNA, 19 nt, Human adenovirus D
gacgggcugcuucugccug

SEQ ID NO: 3928480 - RNA, 19 nt, Human adenovirus D
gacgggcuuugacgagcgc

SEQ ID NO: 3928481 - RNA, 13 nt, Human adenovirus D
gacggugagcagc

SEQ ID NO: 3928482 - RNA, 12 nt, Human adenovirus D
gacgguggugcg

SEQ ID NO: 3928483 - RNA, 20 nt, Human adenovirus D
gacgucccagagcucgguga

SEQ ID NO: 3928484 - RNA, 14 nt, Human adenovirus D
gacuacaaggccgu

SEQ ID NO: 3928485 - RNA, 15 nt, Human adenovirus D
gacucacccuggggc

SEQ ID NO: 3928486 - RNA, 16 nt, Human adenovirus D
gacucacccuggggcu

SEQ ID NO: 3928487 - RNA, 21 nt, Human adenovirus D
gacuccgcgaccuccucccca

SEQ ID NO: 3928488 - RNA, 19 nt, Human adenovirus D
gacuccucggucagcuggc

SEQ ID NO: 3928489 - RNA, 20 nt, Human adenovirus D
gacucgcugcugcagccgcc

SEQ ID NO: 3928490 - RNA, 17 nt, Human adenovirus D
gacucugacacaccugg

SEQ ID NO: 3928491 - RNA, 15 nt, Human adenovirus D
gacugaccaccaccu

SEQ ID NO: 3928492 - RNA, 17 nt, Human adenovirus D
gacuggaaacucuugga

SEQ ID NO: 3928493 - RNA, 16 nt, Human adenovirus D
gacuucgcagccaugc

SEQ ID NO: 3928494 - RNA, 15 nt, Human adenovirus D
gacuugauuggccug

SEQ ID NO: 3928495 - RNA, 18 nt, Human adenovirus D
gagaaccgccuggggcag

SEQ ID NO: 3928496 - RNA, 22 nt, Human adenovirus D
gagaacugcuggcccugcuggc

SEQ ID NO: 3928497 - RNA, 16 nt, Human adenovirus D
gagaagcuuggcgaug

SEQ ID NO: 3928498 - RNA, 14 nt, Human adenovirus D
gagaaggugcuggc

SEQ ID NO: 3928499 - RNA, 18 nt, Human adenovirus D
gagaaguuccucugcauc

SEQ ID NO: 3928500 - RNA, 13 nt, Human adenovirus D
gagaccugcacua

SEQ ID NO: 3928501 - RNA, 18 nt, Human adenovirus D
gagacgcccuugugcccg

SEQ ID NO: 3928502 - RNA, 13 nt, Human adenovirus D
gagacgcgcgcag

SEQ ID NO: 3928503 - RNA, 16 nt, Human adenovirus D
gagagccgccugagca

SEQ ID NO: 3928504 - RNA, 17 nt, Human adenovirus D
gagaggagcucuugcag

SEQ ID NO: 3928505 - RNA, 16 nt, Human adenovirus D
gagauaugugcagcag

SEQ ID NO: 3928506 - RNA, 20 nt, Human adenovirus D
gagaucaaccuccaggccaa

SEQ ID NO: 3928507 - RNA, 23 nt, Human adenovirus D
gagauccagguccgggggcaggg

SEQ ID NO: 3928508 - RNA, 18 nt, Human adenovirus D
gagaucggcaccagccag

SEQ ID NO: 3928509 - RNA, 15 nt, Human adenovirus D
gagaugcgcgacugc

SEQ ID NO: 3928510 - RNA, 11 nt, Human adenovirus D
gagcaacccaa

SEQ ID NO: 3928511 - RNA, 17 nt, Human adenovirus D
gagcacgagcaagacgc

SEQ ID NO: 3928512 - RNA, 23 nt, Human adenovirus D
gagcacgagcaagacgcaggcca

SEQ ID NO: 3928513 - RNA, 22 nt, Human adenovirus D
gagcagacggggaucagccccg

SEQ ID NO: 3928514 - RNA, 15 nt, Human adenovirus D
gagcagcacagacac

SEQ ID NO: 3928515 - RNA, 21 nt, Human adenovirus D
gagcagcggcgcaagcucaug

SEQ ID NO: 3928516 - RNA, 13 nt, Human adenovirus D
gagcaggaccugg

SEQ ID NO: 3928517 - RNA, 22 nt, Human adenovirus D
gagcagugucuggagcgggcuu

SEQ ID NO: 3928518 - RNA, 23 nt, Human adenovirus D
gagccaagaaacgucccagcagc

SEQ ID NO: 3928519 - RNA, 16 nt, Human adenovirus D
gagccaggugagcucg

SEQ ID NO: 3928520 - RNA, 17 nt, Human adenovirus D
gagccaggugagcucgg

SEQ ID NO: 3928521 - RNA, 22 nt, Human adenovirus D
gagcccaacccgcgucucaacu

SEQ ID NO: 3928522 - RNA, 22 nt, Human adenovirus D
gagcccgagggucgcuggcugc

SEQ ID NO: 3928523 - RNA, 16 nt, Human adenovirus D
gagccgaacgagcaga

SEQ ID NO: 3928524 - RNA, 16 nt, Human adenovirus D
gagccugcgccgggcg

SEQ ID NO: 3928525 - RNA, 13 nt, Human adenovirus D
gagcgccagcugu

SEQ ID NO: 3928526 - RNA, 15 nt, Human adenovirus D
gagcgcgagccggcg

SEQ ID NO: 3928527 - RNA, 18 nt, Human adenovirus D
gagcgcgagccggcggcg

SEQ ID NO: 3928528 - RNA, 14 nt, Human adenovirus D
gagcggccagcgcu

SEQ ID NO: 3928529 - RNA, 19 nt, Human adenovirus D
gagcggcgaggggcugcua

SEQ ID NO: 3928530 - RNA, 14 nt, Human adenovirus D
gagcuacaugccca

SEQ ID NO: 3928531 - RNA, 12 nt, Human adenovirus D
gagcucacccac

SEQ ID NO: 3928532 - RNA, 14 nt, Human adenovirus D
gagcuccucgaugc

SEQ ID NO: 3928533 - RNA, 19 nt, Human adenovirus D
gagcucgucuuccaggagc

SEQ ID NO: 3928534 - RNA, 22 nt, Human adenovirus D
gagcucgucuuccaggagccug

SEQ ID NO: 3928535 - RNA, 20 nt, Human adenovirus D
gagcucuuaccaaguccagg

SEQ ID NO: 3928536 - RNA, 21 nt, Human adenovirus D
gagcucuugcagggaagcaaa

SEQ ID NO: 3928537 - RNA, 15 nt, Human adenovirus D
gagcugagcgaccgc

SEQ ID NO: 3928538 - RNA, 12 nt, Human adenovirus D
gagcuggcuccg

SEQ ID NO: 3928539 - RNA, 13 nt, Human adenovirus D
gagcuugcccuug

SEQ ID NO: 3928540 - RNA, 14 nt, Human adenovirus D
gcaggggcggcaga

SEQ ID NO: 3928541 - RNA, 18 nt, Human adenovirus D
gcaggguaaagccagcag

SEQ ID NO: 3928542 - RNA, 24 nt, Human adenovirus D
gcaggguaaagccagcagcacaug

SEQ ID NO: 3928543 - RNA, 22 nt, Human adenovirus D
gcaggugacagcguuccccucc

SEQ ID NO: 3928544 - RNA, 17 nt, Human adenovirus D
gcagguggacgagcaga

SEQ ID NO: 3928545 - RNA, 21 nt, Human adenovirus D
gcagguuucucaacagcuggg

SEQ ID NO: 3928546 - RNA, 23 nt, Human adenovirus D
gcagguuucucaacagcugggac

SEQ ID NO: 3928547 - RNA, 15 nt, Human adenovirus D
gcaguagccccgccc

SEQ ID NO: 3928548 - RNA, 14 nt, Human adenovirus D
gcaguccaaccugg

SEQ ID NO: 3928549 - RNA, 13 nt, Human adenovirus D
gcagugggcgcag

SEQ ID NO: 3928550 - RNA, 17 nt, Human adenovirus D
gcagugucucgaggacg

SEQ ID NO: 3928551 - RNA, 16 nt, Human adenovirus D
gcaguuggccaugagc

SEQ ID NO: 3928552 - RNA, 17 nt, Human adenovirus D
gcaguugggaccggugc

SEQ ID NO: 3928553 - RNA, 15 nt, Human adenovirus D
gcaguuuggccugga

SEQ ID NO: 3928554 - RNA, 16 nt, Human adenovirus D
gcauaauauggugaag

SEQ ID NO: 3928555 - RNA, 21 nt, Human adenovirus D
gcauacagagauucagccaua

SEQ ID NO: 3928556 - RNA, 14 nt, Human adenovirus D
gcauaucagccagu

SEQ ID NO: 3928557 - RNA, 20 nt, Human adenovirus D
gcaucagcaucauccccgcg

SEQ ID NO: 3928558 - RNA, 15 nt, Human adenovirus D
gcaucagucuccugg

SEQ ID NO: 3928559 - RNA, 16 nt, Human adenovirus D
gcaucagucuccuggu

SEQ ID NO: 3928560 - RNA, 15 nt, Human adenovirus D
gcaucucccaggcuu

SEQ ID NO: 3928561 - RNA, 19 nt, Human adenovirus D
gcaucugaugaaauaaaaa

SEQ ID NO: 3928562 - RNA, 17 nt, Human adenovirus D
gcaugaccagacccagg

SEQ ID NO: 3928563 - RNA, 16 nt, Human adenovirus D
gcaugaccucggcacu

SEQ ID NO: 3928564 - RNA, 22 nt, Human adenovirus D
gcaugcaagaucuccaacgugg

SEQ ID NO: 3928565 - RNA, 14 nt, Human adenovirus D
gcauggcaggcagc

SEQ ID NO: 3928566 - RNA, 21 nt, Human adenovirus D
gccaaacacaccugacacaaa

SEQ ID NO: 3928567 - RNA, 21 nt, Human adenovirus D
gccaagaaacgucccagcagc

SEQ ID NO: 3928568 - RNA, 23 nt, Human adenovirus D
gccaagaaacgucccagcagcac

SEQ ID NO: 3928569 - RNA, 21 nt, Human adenovirus D
gccaagacaaaggaggccacg

SEQ ID NO: 3928570 - RNA, 22 nt, Human adenovirus D
gccaagacaaaggaggccacgu

SEQ ID NO: 3928571 - RNA, 15 nt, Human adenovirus D
gccaaucgcagucgc

SEQ ID NO: 3928572 - RNA, 19 nt, Human adenovirus D
gccaauguuacgcugcccg

SEQ ID NO: 3928573 - RNA, 17 nt, Human adenovirus D
gccacaugcaccugggc

SEQ ID NO: 3928574 - RNA, 22 nt, Human adenovirus D
gccaccacccacaccgccuccc

SEQ ID NO: 3928575 - RNA, 22 nt, Human adenovirus D
gccacccuugaccugccuccac

SEQ ID NO: 3928576 - RNA, 18 nt, Human adenovirus D
gccaccuaucacaucuuu

SEQ ID NO: 3928577 - RNA, 15 nt, Human adenovirus D
gccaccuucuucccc

SEQ ID NO: 3928578 - RNA, 17 nt, Human adenovirus D
gccacgaccggcagcgg

SEQ ID NO: 3928579 - RNA, 14 nt, Human adenovirus D
gccacgugaccagg

SEQ ID NO: 3928580 - RNA, 20 nt, Human adenovirus D
gccacgugaccagggguccc

SEQ ID NO: 3928581 - RNA, 22 nt, Human adenovirus D
gccacugcaccccccgcaggca

SEQ ID NO: 3928582 - RNA, 20 nt, Human adenovirus D
gccacugccgcugcaaccug

SEQ ID NO: 3928583 - RNA, 18 nt, Human adenovirus D
gccagaaggggcaccuuc

SEQ ID NO: 3928584 - RNA, 22 nt, Human adenovirus D
gccagcaaacgccgccgccgca

SEQ ID NO: 3928585 - RNA, 13 nt, Human adenovirus D
gccagcacgcucu

SEQ ID NO: 3928586 - RNA, 13 nt, Human adenovirus D
gccagcagcacau

SEQ ID NO: 3928587 - RNA, 16 nt, Human adenovirus D
gccagcagggugccuc

SEQ ID NO: 3928588 - RNA, 18 nt, Human adenovirus D
gccagcugaacgggggcg

SEQ ID NO: 3928589 - RNA, 20 nt, Human adenovirus D
gccagcugaacgggggcgcc

SEQ ID NO: 3928590 - RNA, 12 nt, Human adenovirus D
gccaggaggaga

SEQ ID NO: 3928591 - RNA, 19 nt, Human adenovirus D
gccaggauacgcgggaaga

SEQ ID NO: 3928592 - RNA, 16 nt, Human adenovirus D
gccaggccuccgagca

SEQ ID NO: 3928593 - RNA, 22 nt, Human adenovirus D
gccaggggagugaagagggaga

SEQ ID NO: 3928594 - RNA, 18 nt, Human adenovirus D
gccaggucaaaacccacu

SEQ ID NO: 3928595 - RNA, 20 nt, Human adenovirus D
gccagguccucgagcaugag

SEQ ID NO: 3928596 - RNA, 19 nt, Human adenovirus D
gccaggugagcucgggcug

SEQ ID NO: 3928597 - RNA, 15 nt, Human adenovirus D
gccagucugaugaau

SEQ ID NO: 3928598 - RNA, 16 nt, Human adenovirus D
gccauagcucagcccg

SEQ ID NO: 3928599 - RNA, 14 nt, Human adenovirus D
gccaucaagaaccu

SEQ ID NO: 3928600 - RNA, 20 nt, Human adenovirus D
gccaucuaaacuaaagccaa

SEQ ID NO: 3928601 - RNA, 14 nt, Human adenovirus D
gccaugcgcaggcg

SEQ ID NO: 3928602 - RNA, 20 nt, Human adenovirus D
gccaugggcguguggcagca

SEQ ID NO: 3928603 - RNA, 13 nt, Human adenovirus D
gcccaacccgcgu

SEQ ID NO: 3928604 - RNA, 22 nt, Human adenovirus D
gcccaacucgcggcugcugcug

SEQ ID NO: 3928605 - RNA, 17 nt, Human adenovirus D
gcccacggugguggaga

SEQ ID NO: 3928606 - RNA, 21 nt, Human adenovirus D
gcccagcgagaggagcucuug

SEQ ID NO: 3928607 - RNA, 17 nt, Human adenovirus D
gccccaggcggugcugc

SEQ ID NO: 3928608 - RNA, 23 nt, Human adenovirus D
gccccgccaaccggcugaugccc

SEQ ID NO: 3928609 - RNA, 19 nt, Human adenovirus D
gccccugcaagugcacaga

SEQ ID NO: 3928610 - RNA, 20 nt, Human adenovirus D
gccccugcaagugcacagac

SEQ ID NO: 3928611 - RNA, 15 nt, Human adenovirus D
gccccuggcugggcg

SEQ ID NO: 3928612 - RNA, 17 nt, Human adenovirus D
gccccuggcugggcgcu

SEQ ID NO: 3928613 - RNA, 13 nt, Human adenovirus D
gcccgagcucugc

SEQ ID NO: 3928614 - RNA, 16 nt, Human adenovirus D
gcccgagcucugcugc

SEQ ID NO: 3928615 - RNA, 13 nt, Human adenovirus D
gcccgccaccugc

SEQ ID NO: 3928616 - RNA, 16 nt, Human adenovirus D
gcccgccaccugcaac

SEQ ID NO: 3928617 - RNA, 13 nt, Human adenovirus D
gcccgcuccaccg

SEQ ID NO: 3928618 - RNA, 15 nt, Human adenovirus D
gcccgugggcugcgg

SEQ ID NO: 3928619 - RNA, 22 nt, Human adenovirus D
gcccuaaauuuaaaaccucauu

SEQ ID NO: 3928620 - RNA, 14 nt, Human adenovirus D
gcccuccacccugg

SEQ ID NO: 3928621 - RNA, 20 nt, Human adenovirus D
gcccucgaugaaagucagga

SEQ ID NO: 3928622 - RNA, 16 nt, Human adenovirus D
gcccucucaacaucac

SEQ ID NO: 3928623 - RNA, 14 nt, Human adenovirus D
gcccugacccagca

SEQ ID NO: 3928624 - RNA, 16 nt, Human adenovirus D
gcccugagagcgcugg

SEQ ID NO: 3928625 - RNA, 22 nt, Human adenovirus D
gcccugagccgccagcuggccg

SEQ ID NO: 3928626 - RNA, 22 nt, Human adenovirus D
gcccugcgauauggaugauggc

SEQ ID NO: 3928627 - RNA, 21 nt, Human adenovirus D
gcccuugcggacauacaaaaa

SEQ ID NO: 3928628 - RNA, 17 nt, Human adenovirus D
gccgaacgagcagacgg

SEQ ID NO: 3928629 - RNA, 14 nt, Human adenovirus D
gccgagcccgaggg

SEQ ID NO: 3928630 - RNA, 23 nt, Human adenovirus D
gccgagcuggaagcccugagccg

SEQ ID NO: 3928631 - RNA, 18 nt, Human adenovirus D
gccgaggagaacugcugg

SEQ ID NO: 3928632 - RNA, 15 nt, Human adenovirus D
gccgaggcucuguuc

SEQ ID NO: 3928633 - RNA, 20 nt, Human adenovirus D
gccgauuuaaagacccacag

SEQ ID NO: 3928634 - RNA, 17 nt, Human adenovirus D
gccgcaccgccacccgc

SEQ ID NO: 3928635 - RNA, 16 nt, Human adenovirus D
gccgccagcuggccgc

SEQ ID NO: 3928636 - RNA, 19 nt, Human adenovirus D
gccgccgaagggcgagaag

SEQ ID NO: 3928637 - RNA, 14 nt, Human adenovirus D
gccgccgccgugcg

SEQ ID NO: 3928638 - RNA, 22 nt, Human adenovirus D
gccgccugagcaaccuccuggg

SEQ ID NO: 3928639 - RNA, 20 nt, Human adenovirus D
gccgcgccaaccgcacccgc

SEQ ID NO: 3928640 - RNA, 17 nt, Human adenovirus D
gccgcgccagacgcacg

SEQ ID NO: 3928641 - RNA, 19 nt, Human adenovirus D
gccgcgcuugcugggcgag

SEQ ID NO: 3928642 - RNA, 18 nt, Human adenovirus D
gccgcggcagccgcagcc

SEQ ID NO: 3928643 - RNA, 12 nt, Human adenovirus D
gccgcggccaga

SEQ ID NO: 3928644 - RNA, 17 nt, Human adenovirus D
gccgcguaagcaggagc

SEQ ID NO: 3928645 - RNA, 15 nt, Human adenovirus D
gccgcguccccgccc

SEQ ID NO: 3928646 - RNA, 14 nt, Human adenovirus D
gccgcucagucauc

SEQ ID NO: 3928647 - RNA, 15 nt, Human adenovirus D
gccgcuguggagcca

SEQ ID NO: 3928648 - RNA, 16 nt, Human adenovirus D
gccgggcgcugguagg

SEQ ID NO: 3928649 - RNA, 21 nt, Human adenovirus D
gccggggguucauguugugca

SEQ ID NO: 3928650 - RNA, 15 nt, Human adenovirus D
gccguagagguagcg

SEQ ID NO: 3928651 - RNA, 19 nt, Human adenovirus D
gccguagagguagcgggac

SEQ ID NO: 3928652 - RNA, 19 nt, Human adenovirus D
gccgucgucccggaggagg

SEQ ID NO: 3928653 - RNA, 15 nt, Human adenovirus D
gccgucuggacccgc

SEQ ID NO: 3928654 - RNA, 16 nt, Human adenovirus D
gccuacgguccagagg

SEQ ID NO: 3928655 - RNA, 18 nt, Human adenovirus D
gccuacuuuuugggcacc

SEQ ID NO: 3928656 - RNA, 18 nt, Human adenovirus D
aaaaacagacuggucaaa

SEQ ID NO: 3928657 - RNA, 12 nt, Human adenovirus D
aaaacuggcaag

SEQ ID NO: 3928658 - RNA, 13 nt, Human adenovirus D
aaaagaaacaagu

SEQ ID NO: 3928659 - RNA, 13 nt, Human adenovirus D
aaaauacagaugg

SEQ ID NO: 3928660 - RNA, 23 nt, Human adenovirus D
aaaaucacucuuuccagcagcag

SEQ ID NO: 3928661 - RNA, 17 nt, Human adenovirus D
aaaaucagaagagauga

SEQ ID NO: 3928662 - RNA, 20 nt, Human adenovirus D
aaaaucuuacacuguuguuu

SEQ ID NO: 3928663 - RNA, 13 nt, Human adenovirus D
aaaauuugcaaaa

SEQ ID NO: 3928664 - RNA, 13 nt, Human adenovirus D
aaacaggcugucg

SEQ ID NO: 3928665 - RNA, 22 nt, Human adenovirus D
aaaccacuuccuuuaccuucuc

SEQ ID NO: 3928666 - RNA, 18 nt, Human adenovirus D
aaacgaagaucagcugca

SEQ ID NO: 3928667 - RNA, 13 nt, Human adenovirus D
aaacucagucacu

SEQ ID NO: 3928668 - RNA, 17 nt, Human adenovirus D
aaacucuuggagcaggg

SEQ ID NO: 3928669 - RNA, 18 nt, Human adenovirus D
aaacuuuaaugcuccaaa

SEQ ID NO: 3928670 - RNA, 20 nt, Human adenovirus D
aaagugacgucauugaagag

SEQ ID NO: 3928671 - RNA, 23 nt, Human adenovirus D
aaagugcuggaggguugaaagau

SEQ ID NO: 3928672 - RNA, 13 nt, Human adenovirus D
aaaguuuuucagg

SEQ ID NO: 3928673 - RNA, 14 nt, Human adenovirus D
aaauauggccugga

SEQ ID NO: 3928674 - RNA, 12 nt, Human adenovirus D
aaauuugcaaaa

SEQ ID NO: 3928675 - RNA, 18 nt, Human adenovirus D
aaauuuuuauuuccucug

SEQ ID NO: 3928676 - RNA, 20 nt, Human adenovirus D
aacaaccuuaccaguggacu

SEQ ID NO: 3928677 - RNA, 20 nt, Human adenovirus D
aacacacacgcccugggugu

SEQ ID NO: 3928678 - RNA, 23 nt, Human adenovirus D
aacagacuggucaaaaacaaagu

SEQ ID NO: 3928679 - RNA, 22 nt, Human adenovirus D
aacagauccugcugcuccacca

SEQ ID NO: 3928680 - RNA, 13 nt, Human adenovirus D
aacagcagaggaa

SEQ ID NO: 3928681 - RNA, 19 nt, Human adenovirus D
aacauccaccagugcaaga

SEQ ID NO: 3928682 - RNA, 20 nt, Human adenovirus D
aaccagcacacucacuuuua

SEQ ID NO: 3928683 - RNA, 19 nt, Human adenovirus D
aacccgccugccaggaugg

SEQ ID NO: 3928684 - RNA, 19 nt, Human adenovirus D
aaccugaaagacaguucaa

SEQ ID NO: 3928685 - RNA, 23 nt, Human adenovirus D
ggaggacuuaaccacccacgagc

SEQ ID NO: 3928686 - RNA, 16 nt, Human adenovirus D
ggaggagacugauggc

SEQ ID NO: 3928687 - RNA, 18 nt, Human adenovirus D
ggaggagauggugggccg

SEQ ID NO: 3928688 - RNA, 18 nt, Human adenovirus D
ggaggcacagacgaagaa

SEQ ID NO: 3928689 - RNA, 12 nt, Human adenovirus D
ggagggcagaaa

SEQ ID NO: 3928690 - RNA, 14 nt, Human adenovirus D
ggaggggggccacc

SEQ ID NO: 3928691 - RNA, 17 nt, Human adenovirus D
ggaguccaccgcuccgc

SEQ ID NO: 3928692 - RNA, 12 nt, Human adenovirus D
ggaucagccccg

SEQ ID NO: 3928693 - RNA, 14 nt, Human adenovirus D
ggaucgccaggccu

SEQ ID NO: 3928694 - RNA, 13 nt, Human adenovirus D
ggaugcagccagu

SEQ ID NO: 3928695 - RNA, 20 nt, Human adenovirus D
ggaugcgugagggcggaggc

SEQ ID NO: 3928696 - RNA, 22 nt, Human adenovirus D
ggauuaucucuacaaauuguug

SEQ ID NO: 3928697 - RNA, 19 nt, Human adenovirus D
ggauugcagggcguagagc

SEQ ID NO: 3928698 - RNA, 22 nt, Human adenovirus D
ggcaaucaacuacucggugcuu

SEQ ID NO: 3928699 - RNA, 20 nt, Human adenovirus D
ggcacagccucucugaagca

SEQ ID NO: 3928700 - RNA, 13 nt, Human adenovirus D
ggcaccagccagc

SEQ ID NO: 3928701 - RNA, 15 nt, Human adenovirus D
ggcacccaccacagu

SEQ ID NO: 3928702 - RNA, 22 nt, Human adenovirus D
ggcacucagguugucaguuucu

SEQ ID NO: 3928703 - RNA, 22 nt, Human adenovirus D
ggcacugcucuucccuggagac

SEQ ID NO: 3928704 - RNA, 11 nt, Human adenovirus D
ggcacuggcac

SEQ ID NO: 3928705 - RNA, 21 nt, Human adenovirus D
ggcagcuccgguugugcagcc

SEQ ID NO: 3928706 - RNA, 16 nt, Human adenovirus D
ggcagggugagccggc

SEQ ID NO: 3928707 - RNA, 22 nt, Human adenovirus D
ggcauagcuuccguugcgcugc

SEQ ID NO: 3928708 - RNA, 17 nt, Human adenovirus D
ggcauccugcacgcagc

SEQ ID NO: 3928709 - RNA, 20 nt, Human adenovirus D
ggccaaucagcaguagcccc

SEQ ID NO: 3928710 - RNA, 20 nt, Human adenovirus D
ggccacgaccgugccgcggu

SEQ ID NO: 3928711 - RNA, 13 nt, Human adenovirus D
ggccacggggagc

SEQ ID NO: 3928712 - RNA, 19 nt, Human adenovirus D
ggccacucccagcgccgcg

SEQ ID NO: 3928713 - RNA, 17 nt, Human adenovirus D
ggccauaaaucugcccu

SEQ ID NO: 3928714 - RNA, 18 nt, Human adenovirus D
ggccauaaaucugcccug

SEQ ID NO: 3928715 - RNA, 14 nt, Human adenovirus D
ggccauaggccagg

SEQ ID NO: 3928716 - RNA, 17 nt, Human adenovirus D
ggccaugaugcgagccg

SEQ ID NO: 3928717 - RNA, 18 nt, Human adenovirus D
ggccaugaugcgagccgc

SEQ ID NO: 3928718 - RNA, 19 nt, Human adenovirus D
ggccaugccccaggccugg

SEQ ID NO: 3928719 - RNA, 20 nt, Human adenovirus D
ggccaugccccaggccuggc

SEQ ID NO: 3928720 - RNA, 17 nt, Human adenovirus D
ggccaugcgcaggcgcc

SEQ ID NO: 3928721 - RNA, 15 nt, Human adenovirus D
ggccaugcugcgccg

SEQ ID NO: 3928722 - RNA, 21 nt, Human adenovirus D
ggccauucuggaggcgguggu

SEQ ID NO: 3928723 - RNA, 14 nt, Human adenovirus D
ggccccgcgggcag

SEQ ID NO: 3928724 - RNA, 14 nt, Human adenovirus D
ggccccggggcgaa

SEQ ID NO: 3928725 - RNA, 13 nt, Human adenovirus D
ggcccggcacggc

SEQ ID NO: 3928726 - RNA, 20 nt, Human adenovirus D
ggcccugcuggccgagcugg

SEQ ID NO: 3928727 - RNA, 18 nt, Human adenovirus D
ggccgaaauuggugcgcu

SEQ ID NO: 3928728 - RNA, 22 nt, Human adenovirus D
ggccgaaauuggugcgcugggg

SEQ ID NO: 3928729 - RNA, 19 nt, Human adenovirus D
ggccgagaagguggcggca

SEQ ID NO: 3928730 - RNA, 19 nt, Human adenovirus D
ggccgagaccgugagcucg

SEQ ID NO: 3928731 - RNA, 12 nt, Human adenovirus D
ggccgagcugga

SEQ ID NO: 3928732 - RNA, 14 nt, Human adenovirus D
ggccgaggaggagc

SEQ ID NO: 3928733 - RNA, 17 nt, Human adenovirus D
ggccgcagcucuucccg

SEQ ID NO: 3928734 - RNA, 19 nt, Human adenovirus D
ggccgcgauguugagcugg

SEQ ID NO: 3928735 - RNA, 14 nt, Human adenovirus D
ggccgcggccagau

SEQ ID NO: 3928736 - RNA, 19 nt, Human adenovirus D
ggccggcgcgcccggggcc

SEQ ID NO: 3928737 - RNA, 14 nt, Human adenovirus D
ggccggugagacgc

SEQ ID NO: 3928738 - RNA, 20 nt, Human adenovirus D
ggccguccuuucgcugcugc

SEQ ID NO: 3928739 - RNA, 20 nt, Human adenovirus D
ggccgugagcgcgagccggc

SEQ ID NO: 3928740 - RNA, 16 nt, Human adenovirus D
ggccguuggaagaugu

SEQ ID NO: 3928741 - RNA, 23 nt, Human adenovirus D
ggccuacgagcucaaccucuucu

SEQ ID NO: 3928742 - RNA, 24 nt, Human adenovirus D
ggccuccgagcagcgcauccugca

SEQ ID NO: 3928743 - RNA, 18 nt, Human adenovirus D
ggccucgagcuacaugcc

SEQ ID NO: 3928744 - RNA, 22 nt, Human adenovirus D
ggccucucaauugaaugcugug

SEQ ID NO: 3928745 - RNA, 13 nt, Human adenovirus D
ggccucucgcucc

SEQ ID NO: 3928746 - RNA, 19 nt, Human adenovirus D
ggccucuucgcccgaccgc

SEQ ID NO: 3928747 - RNA, 17 nt, Human adenovirus D
ggccugaaccgccgccg

SEQ ID NO: 3928748 - RNA, 20 nt, Human adenovirus D
ggccugcgucaucacccagg

SEQ ID NO: 3928749 - RNA, 14 nt, Human adenovirus D
ggcgaacgugccgc

SEQ ID NO: 3928750 - RNA, 17 nt, Human adenovirus D
ggcgaagggcuggcgag

SEQ ID NO: 3928751 - RNA, 15 nt, Human adenovirus D
ggcgacaagcuggcc

SEQ ID NO: 3928752 - RNA, 18 nt, Human adenovirus D
ggcgacaagcuggccugc

SEQ ID NO: 3928753 - RNA, 14 nt, Human adenovirus D
ggcgaccaccgcga

SEQ ID NO: 3928754 - RNA, 20 nt, Human adenovirus D
ggcgaccagcucuggguccc

SEQ ID NO: 3928755 - RNA, 15 nt, Human adenovirus D
ggcgacgcagccggc

SEQ ID NO: 3928756 - RNA, 18 nt, Human adenovirus D
ggcgagaggcgagcagcu

SEQ ID NO: 3928757 - RNA, 19 nt, Human adenovirus D
ggcgauguugccacccaga

SEQ ID NO: 3928758 - RNA, 22 nt, Human adenovirus D
ggcgcagcugcgcuuagucaug

SEQ ID NO: 3928759 - RNA, 23 nt, Human adenovirus D
ggcgcagcuguuccuggugguac

SEQ ID NO: 3928760 - RNA, 21 nt, Human adenovirus D
ggcgccauucggagcacgccc

SEQ ID NO: 3928761 - RNA, 14 nt, Human adenovirus D
ggcgcccagccagc

SEQ ID NO: 3928762 - RNA, 17 nt, Human adenovirus D
ggcgccggcgcuagcca

SEQ ID NO: 3928763 - RNA, 22 nt, Human adenovirus D
gcgggccucacaguccagguca

SEQ ID NO: 3928764 - RNA, 12 nt, Human adenovirus D
gcgggcuguggg

SEQ ID NO: 3928765 - RNA, 21 nt, Human adenovirus D
gcggggaggagcccgaggaga

SEQ ID NO: 3928766 - RNA, 23 nt, Human adenovirus D
gcggggggagaugaugugcaguu

SEQ ID NO: 3928767 - RNA, 16 nt, Human adenovirus D
gcgggugaugguggcu

SEQ ID NO: 3928768 - RNA, 17 nt, Human adenovirus D
gcgguagagcggccagc

SEQ ID NO: 3928769 - RNA, 14 nt, Human adenovirus D
gcggucgcgguggg

SEQ ID NO: 3928770 - RNA, 19 nt, Human adenovirus D
gcgguguaggggacgugag

SEQ ID NO: 3928771 - RNA, 18 nt, Human adenovirus D
gcgucccuugaggaggaa

SEQ ID NO: 3928772 - RNA, 14 nt, Human adenovirus D
gcgucgagcacagc

SEQ ID NO: 3928773 - RNA, 14 nt, Human adenovirus D
gcgucgaggagcug

SEQ ID NO: 3928774 - RNA, 16 nt, Human adenovirus D
gcguggcgcucgggca

SEQ ID NO: 3928775 - RNA, 18 nt, Human adenovirus D
gcuaagaaaaaaucagag

SEQ ID NO: 3928776 - RNA, 20 nt, Human adenovirus D
gcuacagcaggagugcaggg

SEQ ID NO: 3928777 - RNA, 15 nt, Human adenovirus D
gcuacaugcccagca

SEQ ID NO: 3928778 - RNA, 19 nt, Human adenovirus D
gcuaccucuugcagcuggc

SEQ ID NO: 3928779 - RNA, 20 nt, Human adenovirus D
gcuagaaaacacccacaggg

SEQ ID NO: 3928780 - RNA, 17 nt, Human adenovirus D
gcuagacauggccagca

SEQ ID NO: 3928781 - RNA, 19 nt, Human adenovirus D
gcuagacauggccagcacg

SEQ ID NO: 3928782 - RNA, 21 nt, Human adenovirus D
gcuaguguacaacgcccugcu

SEQ ID NO: 3928783 - RNA, 15 nt, Human adenovirus D
gcuauaaaucuuuuc

SEQ ID NO: 3928784 - RNA, 16 nt, Human adenovirus D
gcuaucugcucuucca

SEQ ID NO: 3928785 - RNA, 21 nt, Human adenovirus D
gcucaacccgggucuccccca

SEQ ID NO: 3928786 - RNA, 23 nt, Human adenovirus D
gcucaccaucugagcucuuacca

SEQ ID NO: 3928787 - RNA, 13 nt, Human adenovirus D
gcucagcugccau

SEQ ID NO: 3928788 - RNA, 15 nt, Human adenovirus D
gcucaggaccauagg

SEQ ID NO: 3928789 - RNA, 14 nt, Human adenovirus D
gcucaucggccaga

SEQ ID NO: 3928790 - RNA, 11 nt, Human adenovirus D
gcuccaaagcu

SEQ ID NO: 3928791 - RNA, 16 nt, Human adenovirus D
gcuccaaagcuagcac

SEQ ID NO: 3928792 - RNA, 12 nt, Human adenovirus D
gcuccagccaaa

SEQ ID NO: 3928793 - RNA, 22 nt, Human adenovirus D
gcuccagcgaaagagagcucgc

SEQ ID NO: 3928794 - RNA, 19 nt, Human adenovirus D
gcucccacagugcccccuc

SEQ ID NO: 3928795 - RNA, 17 nt, Human adenovirus D
gcucccagccuccaccg

SEQ ID NO: 3928796 - RNA, 17 nt, Human adenovirus D
gcuccgcgaacagcagc

SEQ ID NO: 3928797 - RNA, 20 nt, Human adenovirus D
gcuccguuguacgacaccac

SEQ ID NO: 3928798 - RNA, 17 nt, Human adenovirus D
gcuccuggucugcaacc

SEQ ID NO: 3928799 - RNA, 15 nt, Human adenovirus D
gcucgaucuccuccu

SEQ ID NO: 3928800 - RNA, 18 nt, Human adenovirus D
gcucgcgccucaauguca

SEQ ID NO: 3928801 - RNA, 17 nt, Human adenovirus D
gcucggugacgaagaag

SEQ ID NO: 3928802 - RNA, 16 nt, Human adenovirus D
gcucggugacgugcuc

SEQ ID NO: 3928803 - RNA, 21 nt, Human adenovirus D
gcucguagggguugaggggcg

SEQ ID NO: 3928804 - RNA, 21 nt, Human adenovirus D
gcucgucuagaaccccacagg

SEQ ID NO: 3928805 - RNA, 16 nt, Human adenovirus D
gcucgucuuccaggag

SEQ ID NO: 3928806 - RNA, 16 nt, Human adenovirus D
gcucugcugcgccgcg

SEQ ID NO: 3928807 - RNA, 19 nt, Human adenovirus D
gcucuuaccaaguccaggg

SEQ ID NO: 3928808 - RNA, 13 nt, Human adenovirus D
gcugaaagcaugg

SEQ ID NO: 3928809 - RNA, 21 nt, Human adenovirus D
gcugacauccauggccagggg

SEQ ID NO: 3928810 - RNA, 20 nt, Human adenovirus D
gcugaccaauagacagcaga

SEQ ID NO: 3928811 - RNA, 21 nt, Human adenovirus D
gcugaucaacaucuugcagag

SEQ ID NO: 3928812 - RNA, 15 nt, Human adenovirus D
gcugaugcugagccu

SEQ ID NO: 3928813 - RNA, 20 nt, Human adenovirus D
gcugauuacucuaaaugcaa

SEQ ID NO: 3928814 - RNA, 17 nt, Human adenovirus D
gcugcaagguccgcagg

SEQ ID NO: 3928815 - RNA, 15 nt, Human adenovirus D
gcugccccaggcggu

SEQ ID NO: 3928816 - RNA, 18 nt, Human adenovirus D
gcugcccgccaccugcaa

SEQ ID NO: 3928817 - RNA, 24 nt, Human adenovirus D
gcugccggaccucaugcaagaccc

SEQ ID NO: 3928818 - RNA, 16 nt, Human adenovirus D
gcugcgaggagagcag

SEQ ID NO: 3928819 - RNA, 16 nt, Human adenovirus D
gcugcuagagugccac

SEQ ID NO: 3928820 - RNA, 19 nt, Human adenovirus D
gcugcuagagugccacugc

SEQ ID NO: 3928821 - RNA, 14 nt, Human adenovirus D
gcugcucaccaccc

SEQ ID NO: 3928822 - RNA, 20 nt, Human adenovirus D
gcugcucaccaccccggacg

SEQ ID NO: 3928823 - RNA, 20 nt, Human adenovirus D
gcugcugaaacaccugcagc

SEQ ID NO: 3928824 - RNA, 20 nt, Human adenovirus D
gcugcuucugccuggugaag

SEQ ID NO: 3928825 - RNA, 16 nt, Human adenovirus D
gcuggacaagcuucuu

SEQ ID NO: 3928826 - RNA, 13 nt, Human adenovirus D
gcuggccagcacg

SEQ ID NO: 3928827 - RNA, 14 nt, Human adenovirus D
gcuggcccugcugg

SEQ ID NO: 3928828 - RNA, 22 nt, Human adenovirus D
gcuggcugaaucccacucccac

SEQ ID NO: 3928829 - RNA, 22 nt, Human adenovirus D
gcuggcuugguacccgcgaccc

SEQ ID NO: 3928830 - RNA, 19 nt, Human adenovirus D
gcugggacccugugaccaa

SEQ ID NO: 3928831 - RNA, 14 nt, Human adenovirus D
gcugggcucgagca

SEQ ID NO: 3928832 - RNA, 18 nt, Human adenovirus D
gcuggggagggccacguu

SEQ ID NO: 3928833 - RNA, 22 nt, Human adenovirus D
gcuggucacauccaucuccacc

SEQ ID NO: 3928834 - RNA, 14 nt, Human adenovirus D
gcuggucaggccuc

SEQ ID NO: 3928835 - RNA, 16 nt, Human adenovirus D
gcugguggccaccucg

SEQ ID NO: 3928836 - RNA, 20 nt, Human adenovirus D
cucgaacaguccacccagac

SEQ ID NO: 3928837 - RNA, 20 nt, Human adenovirus D
cucgagcuacaugcccagca

SEQ ID NO: 3928838 - RNA, 16 nt, Human adenovirus D
cucgauccccuaccuu

SEQ ID NO: 3928839 - RNA, 20 nt, Human adenovirus D
cucgcacucgacgagccagg

SEQ ID NO: 3928840 - RNA, 22 nt, Human adenovirus D
cucgcagaucugcaucucccag

SEQ ID NO: 3928841 - RNA, 17 nt, Human adenovirus D
cucgcgcccguagucug

SEQ ID NO: 3928842 - RNA, 23 nt, Human adenovirus D
cucgcgcucaucguugugcgccg

SEQ ID NO: 3928843 - RNA, 14 nt, Human adenovirus D
cucgcuacugcuga

SEQ ID NO: 3928844 - RNA, 15 nt, Human adenovirus D
cucgcuacugcugau

SEQ ID NO: 3928845 - RNA, 16 nt, Human adenovirus D
cucgcugcugcagccg

SEQ ID NO: 3928846 - RNA, 13 nt, Human adenovirus D
cucggaguaccug

SEQ ID NO: 3928847 - RNA, 18 nt, Human adenovirus D
cucggcaacgaccugcgc

SEQ ID NO: 3928848 - RNA, 19 nt, Human adenovirus D
cucggccaaucagcaguag

SEQ ID NO: 3928849 - RNA, 17 nt, Human adenovirus D
cucggcgaugguggcgc

SEQ ID NO: 3928850 - RNA, 15 nt, Human adenovirus D
cucggggaucaccag

SEQ ID NO: 3928851 - RNA, 15 nt, Human adenovirus D
cucggucaggagcaa

SEQ ID NO: 3928852 - RNA, 16 nt, Human adenovirus D
cucggucaggagcaag

SEQ ID NO: 3928853 - RNA, 17 nt, Human adenovirus D
cucggugcggcugcugc

SEQ ID NO: 3928854 - RNA, 15 nt, Human adenovirus D
cucgguugaggcacc

SEQ ID NO: 3928855 - RNA, 20 nt, Human adenovirus D
cucguacccgcucaccaucu

SEQ ID NO: 3928856 - RNA, 15 nt, Human adenovirus D
cucguaccuggguca

SEQ ID NO: 3928857 - RNA, 17 nt, Human adenovirus D
cucguuaguccagcaga

SEQ ID NO: 3928858 - RNA, 16 nt, Human adenovirus D
cucucgcuccaugaac

SEQ ID NO: 3928859 - RNA, 20 nt, Human adenovirus D
cucucggccauucuggaggc

SEQ ID NO: 3928860 - RNA, 22 nt, Human adenovirus D
cucucugaagcauaauauggug

SEQ ID NO: 3928861 - RNA, 15 nt, Human adenovirus D
cucugccgccggggc

SEQ ID NO: 3928862 - RNA, 15 nt, Human adenovirus D
cucugcgugaagacc

SEQ ID NO: 3928863 - RNA, 19 nt, Human adenovirus D
cucugguacuccagucucc

SEQ ID NO: 3928864 - RNA, 15 nt, Human adenovirus D
cucuucuuccaugac

SEQ ID NO: 3928865 - RNA, 13 nt, Human adenovirus D
cugaaaaacagaa

SEQ ID NO: 3928866 - RNA, 15 nt, Human adenovirus D
cugaaaaacagaaag

SEQ ID NO: 3928867 - RNA, 20 nt, Human adenovirus D
cugaaacaccugcagcgcca

SEQ ID NO: 3928868 - RNA, 15 nt, Human adenovirus D
cugaacgggggcgcc

SEQ ID NO: 3928869 - RNA, 18 nt, Human adenovirus D
cugaaggagcuggacaag

SEQ ID NO: 3928870 - RNA, 15 nt, Human adenovirus D
cugaccaacuggucu

SEQ ID NO: 3928871 - RNA, 13 nt, Human adenovirus D
cugaccaccaccu

SEQ ID NO: 3928872 - RNA, 13 nt, Human adenovirus D
cugacccagcagg

SEQ ID NO: 3928873 - RNA, 20 nt, Human adenovirus D
cugacgacccgcaaccccga

SEQ ID NO: 3928874 - RNA, 15 nt, Human adenovirus D
cugacgccuccguga

SEQ ID NO: 3928875 - RNA, 15 nt, Human adenovirus D
cugacggcgcagcug

SEQ ID NO: 3928876 - RNA, 16 nt, Human adenovirus D
cugacggcgcagcugu

SEQ ID NO: 3928877 - RNA, 19 nt, Human adenovirus D
cugagcaaccuccugggca

SEQ ID NO: 3928878 - RNA, 18 nt, Human adenovirus D
cugagccgccagcuggcc

SEQ ID NO: 3928879 - RNA, 13 nt, Human adenovirus D
cugagcucgcucg

SEQ ID NO: 3928880 - RNA, 13 nt, Human adenovirus D
cugauaagacaca

SEQ ID NO: 3928881 - RNA, 14 nt, Human adenovirus D
cugaucugauccuu

SEQ ID NO: 3928882 - RNA, 17 nt, Human adenovirus D
cugaucugauccuuguc

SEQ ID NO: 3928883 - RNA, 16 nt, Human adenovirus D
cugauggccacgggga

SEQ ID NO: 3928884 - RNA, 16 nt, Human adenovirus D
cugcaaaaagucacuu

SEQ ID NO: 3928885 - RNA, 22 nt, Human adenovirus D
cugcaaacggugaaccugagcc

SEQ ID NO: 3928886 - RNA, 15 nt, Human adenovirus D
cugcaacccccagcu

SEQ ID NO: 3928887 - RNA, 20 nt, Human adenovirus D
cugcaacccccagcuccuga

SEQ ID NO: 3928888 - RNA, 19 nt, Human adenovirus D
cugcaacugcgcguccguc

SEQ ID NO: 3928889 - RNA, 13 nt, Human adenovirus D
cugcaagaggaga

SEQ ID NO: 3928890 - RNA, 19 nt, Human adenovirus D
cugcaccauccccagguaa

SEQ ID NO: 3928891 - RNA, 19 nt, Human adenovirus D
cugcacgagaaccgccugg

SEQ ID NO: 3928892 - RNA, 21 nt, Human adenovirus D
cugcacgagaaccgccugggg

SEQ ID NO: 3928893 - RNA, 18 nt, Human adenovirus D
cugcagcguguucaaaac

SEQ ID NO: 3928894 - RNA, 20 nt, Human adenovirus D
cugccacuugaacucgggga

SEQ ID NO: 3928895 - RNA, 14 nt, Human adenovirus D
cugcccaccgugcg

SEQ ID NO: 3928896 - RNA, 15 nt, Human adenovirus D
cugcccgccaacacc

SEQ ID NO: 3928897 - RNA, 17 nt, Human adenovirus D
cugccgccgccugcgcu

SEQ ID NO: 3928898 - RNA, 15 nt, Human adenovirus D
cugccggugcacucc

SEQ ID NO: 3928899 - RNA, 22 nt, Human adenovirus D
cugccuggugaagggcacagcc

SEQ ID NO: 3928900 - RNA, 23 nt, Human adenovirus D
cugcgcaaaaccuguucagggac

SEQ ID NO: 3928901 - RNA, 13 nt, Human adenovirus D
cugcgccgggcgc

SEQ ID NO: 3928902 - RNA, 13 nt, Human adenovirus D
cugcgcggggcca

SEQ ID NO: 3928903 - RNA, 20 nt, Human adenovirus D
cugcgcuuugugcccgugga

SEQ ID NO: 3928904 - RNA, 20 nt, Human adenovirus D
cugcgucaucacccagggcg

SEQ ID NO: 3928905 - RNA, 22 nt, Human adenovirus D
cugcuaaacaucgccgagcccg

SEQ ID NO: 3928906 - RNA, 16 nt, Human adenovirus D
cugcuacaucucgggg

SEQ ID NO: 3928907 - RNA, 18 nt, Human adenovirus D
cugcuagagugccacugc

SEQ ID NO: 3928908 - RNA, 17 nt, Human adenovirus D
cugcucaccaccccgga

SEQ ID NO: 3928909 - RNA, 19 nt, Human adenovirus D
cugcucccgggcuccuaca

SEQ ID NO: 3928910 - RNA, 14 nt, Human adenovirus D
cugcucucucuucu

SEQ ID NO: 3928911 - RNA, 16 nt, Human adenovirus D
cugcugccgcucaguc

SEQ ID NO: 3928912 - RNA, 22 nt, Human adenovirus D
cugcugcugaucgcgcccuuca

SEQ ID NO: 3928913 - RNA, 17 nt, Human adenovirus D
cugcuggcccugcuggc

SEQ ID NO: 3928914 - RNA, 17 nt, Human adenovirus D
cugcuguaaagccagaa

SEQ ID NO: 3928915 - RNA, 14 nt, Human adenovirus D
cuggaagcccugag

SEQ ID NO: 3928916 - RNA, 22 nt, Human adenovirus D
cuggaagcccugagccgccagc

SEQ ID NO: 3928917 - RNA, 15 nt, Human adenovirus D
cuggagacgggcugc

SEQ ID NO: 3928918 - RNA, 22 nt, Human adenovirus D
cuggagauguggguuggcuugc

SEQ ID NO: 3928919 - RNA, 20 nt, Human adenovirus D
cuggauuuccugccaccagu

SEQ ID NO: 3928920 - RNA, 22 nt, Human adenovirus D
cuggcacauacaaagcugaaag

SEQ ID NO: 3928921 - RNA, 14 nt, Human adenovirus D
cuggccgagcugga

SEQ ID NO: 3928922 - RNA, 17 nt, Human adenovirus D
cuggccucgggcauuaa

SEQ ID NO: 3928923 - RNA, 19 nt, Human adenovirus D
cuggcgacgcagccggcga

SEQ ID NO: 3928924 - RNA, 17 nt, Human adenovirus D
cuggcgagacugggggc

SEQ ID NO: 3928925 - RNA, 13 nt, Human adenovirus D
cuggcucccagcc

SEQ ID NO: 3928926 - RNA, 18 nt, Human adenovirus D
cuggcucccagccuccac

SEQ ID NO: 3928927 - RNA, 19 nt, Human adenovirus D
cugggcaacggccgcuacg

SEQ ID NO: 3928928 - RNA, 19 nt, Human adenovirus D
cugggcauagucgcgccgc

SEQ ID NO: 3928929 - RNA, 20 nt, Human adenovirus D
cugggcguggugcuggauga

SEQ ID NO: 3928930 - RNA, 18 nt, Human adenovirus D
cugggcguugcgggccga

SEQ ID NO: 3928931 - RNA, 15 nt, Human adenovirus D
cugggcugggacccu

SEQ ID NO: 3928932 - RNA, 21 nt, Human adenovirus D
cugggguacuuuacgcuggcc

SEQ ID NO: 3928933 - RNA, 14 nt, Human adenovirus D
cugggugacagaac

SEQ ID NO: 3928934 - RNA, 13 nt, Human adenovirus D
cuggguggcccuu

SEQ ID NO: 3928935 - RNA, 21 nt, Human adenovirus D
cugguagggggcgccgccggc

SEQ ID NO: 3928936 - RNA, 19 nt, Human adenovirus D
cuggucugcaacccccagc

SEQ ID NO: 3928937 - RNA, 15 nt, Human adenovirus D
cugguggaaacagac

SEQ ID NO: 3928938 - RNA, 22 nt, Human adenovirus D
cugguggaaacagacagccagg

SEQ ID NO: 3928939 - RNA, 18 nt, Human adenovirus D
cugguggcgcugaacgcc

SEQ ID NO: 3928940 - RNA, 22 nt, Human adenovirus D
cuguccaugguagcaauggaaa

SEQ ID NO: 3928941 - RNA, 17 nt, Human adenovirus D
cugucuuaccagcucuu

SEQ ID NO: 3928942 - RNA, 18 nt, Human adenovirus D
cuguggucgacuugcaag

SEQ ID NO: 3928943 - RNA, 19 nt, Human adenovirus D
cuguguccgcgcucgguga

SEQ ID NO: 3928944 - RNA, 20 nt, Human adenovirus D
cuguugcauguucuugcaug

SEQ ID NO: 3928945 - RNA, 14 nt, Human adenovirus D
cuguuggagaacga

SEQ ID NO: 3928946 - RNA, 13 nt, Human adenovirus D
cuuaaccacccac

SEQ ID NO: 3928947 - RNA, 17 nt, Human adenovirus D
cuuacucagguuuggau

SEQ ID NO: 3928948 - RNA, 21 nt, Human adenovirus D
cuuacucuauaacauuugaau

SEQ ID NO: 3928949 - RNA, 13 nt, Human adenovirus D
cuuauccacaaac

SEQ ID NO: 3928950 - RNA, 16 nt, Human adenovirus D
cuucaaccccuucucg

SEQ ID NO: 3928951 - RNA, 16 nt, Human adenovirus D
cuucaccgaccugggu

SEQ ID NO: 3928952 - RNA, 19 nt, Human adenovirus D
cuucaccggcuaccuugca

SEQ ID NO: 3928953 - RNA, 20 nt, Human adenovirus D
cuucagcaucagucuccugg

SEQ ID NO: 3928954 - RNA, 18 nt, Human adenovirus D
cuucagccugggcaacaa

SEQ ID NO: 3928955 - RNA, 20 nt, Human adenovirus D
aaaaacccucgaccagcauc

SEQ ID NO: 3928956 - RNA, 19 nt, Human adenovirus D
aaaaacugcaugcuggaau

SEQ ID NO: 3928957 - RNA, 18 nt, Human adenovirus D
aaaaagaaacaagucaaa

SEQ ID NO: 3928958 - RNA, 13 nt, Human adenovirus D
aaaaagucacuua

SEQ ID NO: 3928959 - RNA, 19 nt, Human adenovirus D
aaaaaucacucuuuccagc

SEQ ID NO: 3928960 - RNA, 11 nt, Human adenovirus D
aaaacccacuc

SEQ ID NO: 3928961 - RNA, 14 nt, Human adenovirus D
aaaacugcaugcug

SEQ ID NO: 3928962 - RNA, 21 nt, Human adenovirus D
aaaagcagcacaguaaguucc

SEQ ID NO: 3928963 - RNA, 16 nt, Human adenovirus D
aaaccuaccacuggcu

SEQ ID NO: 3928964 - RNA, 12 nt, Human adenovirus D
aaacuaaagcca

SEQ ID NO: 3928965 - RNA, 15 nt, Human adenovirus D
aaacuaaagccaaac

SEQ ID NO: 3928966 - RNA, 23 nt, Human adenovirus D
aaacuaaugacaaacaaaagcca

SEQ ID NO: 3928967 - RNA, 20 nt, Human adenovirus D
aaagaucacuuacuugaaau

SEQ ID NO: 3928968 - RNA, 11 nt, Human adenovirus D
aaagcaugguu

SEQ ID NO: 3928969 - RNA, 13 nt, Human adenovirus D
aaagcgccaggag

SEQ ID NO: 3928970 - RNA, 16 nt, Human adenovirus D
aaagcucccacagugc

SEQ ID NO: 3928971 - RNA, 20 nt, Human adenovirus D
aaaucgagcaggaccugggc

SEQ ID NO: 3928972 - RNA, 14 nt, Human adenovirus D
aaaucuuacacaug

SEQ ID NO: 3928973 - RNA, 12 nt, Human adenovirus D
aaaucuuuaucu

SEQ ID NO: 3928974 - RNA, 23 nt, Human adenovirus D
aaaugaagccguccucugaaaag

SEQ ID NO: 3928975 - RNA, 18 nt, Human adenovirus D
aacaaaacccaugaaaga

SEQ ID NO: 3928976 - RNA, 15 nt, Human adenovirus D
aacaauaaaaaacuu

SEQ ID NO: 3928977 - RNA, 14 nt, Human adenovirus D
aacagacagccagg

SEQ ID NO: 3928978 - RNA, 10 nt, Human adenovirus D
aacagcagca

SEQ ID NO: 3928979 - RNA, 16 nt, Human adenovirus D
aacagcauauaccccu

SEQ ID NO: 3928980 - RNA, 23 nt, Human adenovirus D
aacaggaugggucugugccucuc

SEQ ID NO: 3928981 - RNA, 22 nt, Human adenovirus D
aacaggcugucgguguccccgu

SEQ ID NO: 3928982 - RNA, 17 nt, Human adenovirus D
aacauuacuucuggcac

SEQ ID NO: 3928983 - RNA, 15 nt, Human adenovirus D
aaccggaggcuggcu

SEQ ID NO: 3928984 - RNA, 12 nt, Human adenovirus D
aaccucagccac

SEQ ID NO: 3928985 - RNA, 15 nt, Human adenovirus D
aaccugcgcgggcug

SEQ ID NO: 3928986 - RNA, 21 nt, Human adenovirus D
cuggugguuuucauguucgcc

SEQ ID NO: 3928987 - RNA, 21 nt, Human adenovirus D
cugucccuacgucuacaaggc

SEQ ID NO: 3928988 - RNA, 13 nt, Human adenovirus D
cugucggccgagg

SEQ ID NO: 3928989 - RNA, 14 nt, Human adenovirus D
cuguucagggaccg

SEQ ID NO: 3928990 - RNA, 18 nt, Human adenovirus D
cuuaagaaagacacaaaa

SEQ ID NO: 3928991 - RNA, 22 nt, Human adenovirus D
cuuacauguccaguuacgccuc

SEQ ID NO: 3928992 - RNA, 14 nt, Human adenovirus D
cuuagacugcuauc

SEQ ID NO: 3928993 - RNA, 16 nt, Human adenovirus D
cuuaguucagcugcaa

SEQ ID NO: 3928994 - RNA, 15 nt, Human adenovirus D
cuucaacaucugugc

SEQ ID NO: 3928995 - RNA, 19 nt, Human adenovirus D
cuucaaccccuucucggga

SEQ ID NO: 3928996 - RNA, 22 nt, Human adenovirus D
cuucaagaaagucuccaucaug

SEQ ID NO: 3928997 - RNA, 17 nt, Human adenovirus D
cuucaccgaccuggguc

SEQ ID NO: 3928998 - RNA, 20 nt, Human adenovirus D
cuuccacgugcccgagggcu

SEQ ID NO: 3928999 - RNA, 20 nt, Human adenovirus D
cuuccacuguuagcuacuuu

SEQ ID NO: 3929000 - RNA, 22 nt, Human adenovirus D
cuucccauugaauggcacuggc

SEQ ID NO: 3929001 - RNA, 13 nt, Human adenovirus D
cuuccgcgccaag

SEQ ID NO: 3929002 - RNA, 19 nt, Human adenovirus D
cuuccguucuacccagcaa

SEQ ID NO: 3929003 - RNA, 17 nt, Human adenovirus D
cuuccuccguagccugg

SEQ ID NO: 3929004 - RNA, 15 nt, Human adenovirus D
cuuccugcagcucau

SEQ ID NO: 3929005 - RNA, 12 nt, Human adenovirus D
cuuccuggggca

SEQ ID NO: 3929006 - RNA, 17 nt, Human adenovirus D
cuucgaguacgaggcca

SEQ ID NO: 3929007 - RNA, 12 nt, Human adenovirus D
cuucgcccugcg

SEQ ID NO: 3929008 - RNA, 13 nt, Human adenovirus D
cuucgugcacugg

SEQ ID NO: 3929009 - RNA, 20 nt, Human adenovirus D
cuucuacagccagcagcucc

SEQ ID NO: 3929010 - RNA, 20 nt, Human adenovirus D
cuucucgccgcgcgugcccc

SEQ ID NO: 3929011 - RNA, 21 nt, Human adenovirus D
cuucuuccccauggcgcacaa

SEQ ID NO: 3929012 - RNA, 21 nt, Human adenovirus D
cuucuuccggcaaaaaucaca

SEQ ID NO: 3929013 - RNA, 23 nt, Human adenovirus D
cuugacagcaccgccgcagccgc

SEQ ID NO: 3929014 - RNA, 15 nt, Human adenovirus D
cuugcaacuugcaaa

SEQ ID NO: 3929015 - RNA, 13 nt, Human adenovirus D
cuugcacaguugg

SEQ ID NO: 3929016 - RNA, 14 nt, Human adenovirus D
cuugcugggcgagg

SEQ ID NO: 3929017 - RNA, 17 nt, Human adenovirus D
cuugguaugagguugua

SEQ ID NO: 3929018 - RNA, 18 nt, Human adenovirus D
cuuggugggcagaggagg

SEQ ID NO: 3929019 - RNA, 21 nt, Human adenovirus D
cuuguaccugcccgacuccua

SEQ ID NO: 3929020 - RNA, 17 nt, Human adenovirus D
cuuguagggacagcagc

SEQ ID NO: 3929021 - RNA, 17 nt, Human adenovirus D
cuugugcccgcccaggu

SEQ ID NO: 3929022 - RNA, 16 nt, Human adenovirus D
cuugugguucuucugu

SEQ ID NO: 3929023 - RNA, 17 nt, Human adenovirus D
cuugugguuuuaacagg

SEQ ID NO: 3929024 - RNA, 19 nt, Human adenovirus D
cuugugguuuuaacaggga

SEQ ID NO: 3929025 - RNA, 16 nt, Human adenovirus D
cuuuacgcuggccagc

SEQ ID NO: 3929026 - RNA, 22 nt, Human adenovirus D
cuuuaguugguccagauggaaa

SEQ ID NO: 3929027 - RNA, 18 nt, Human adenovirus D
cuuugaaccugaaagaca

SEQ ID NO: 3929028 - RNA, 16 nt, Human adenovirus D
cuuugcggcaguuucg

SEQ ID NO: 3929029 - RNA, 12 nt, Human adenovirus D
cuuuggcaaaga

SEQ ID NO: 3929030 - RNA, 19 nt, Human adenovirus D
cuuuguaacucuaaucauu

SEQ ID NO: 3929031 - RNA, 14 nt, Human adenovirus D
cuuuuccaggaaag

SEQ ID NO: 3929032 - RNA, 15 nt, Human adenovirus D
cuuuuccgagaccau

SEQ ID NO: 3929033 - RNA, 20 nt, Human adenovirus D
gaaaaauugcuauaaaucuu

SEQ ID NO: 3929034 - RNA, 17 nt, Human adenovirus D
gaaaacuuuaaugcucc

SEQ ID NO: 3929035 - RNA, 14 nt, Human adenovirus D
gaaaagucauccaa

SEQ ID NO: 3929036 - RNA, 17 nt, Human adenovirus D
gaaacaagucaaaagaa

SEQ ID NO: 3929037 - RNA, 23 nt, Human adenovirus D
gaaacagcagaggaagaggguca

SEQ ID NO: 3929038 - RNA, 17 nt, Human adenovirus D
gaaacgucccagcagca

SEQ ID NO: 3929039 - RNA, 17 nt, Human adenovirus D
gaaacgucccaggaaac

SEQ ID NO: 3929040 - RNA, 15 nt, Human adenovirus D
gaaacucagucacuc

SEQ ID NO: 3929041 - RNA, 20 nt, Human adenovirus D
gaaagggcccgggacggagg

SEQ ID NO: 3929042 - RNA, 15 nt, Human adenovirus D
gaaaucacacuuuug

SEQ ID NO: 3929043 - RNA, 20 nt, Human adenovirus D
gaacaaaacccaugaaagaa

SEQ ID NO: 3929044 - RNA, 23 nt, Human adenovirus D
gaacaacgauuucacccccgccg

SEQ ID NO: 3929045 - RNA, 23 nt, Human adenovirus D
gaacccgcgcucgcgcaccugcu

SEQ ID NO: 3929046 - RNA, 20 nt, Human adenovirus D
gaaccugaaggagcuggaca

SEQ ID NO: 3929047 - RNA, 16 nt, Human adenovirus D
gaacgcgcgaagaugg

SEQ ID NO: 3929048 - RNA, 12 nt, Human adenovirus D
gaacgggggcag

SEQ ID NO: 3929049 - RNA, 17 nt, Human adenovirus D
gaacugauaagacacau

SEQ ID NO: 3929050 - RNA, 14 nt, Human adenovirus D
gaacuuuagaagug

SEQ ID NO: 3929051 - RNA, 22 nt, Human adenovirus D
gaagaaccauuuuuauuccaaa

SEQ ID NO: 3929052 - RNA, 14 nt, Human adenovirus D
gaagaagagcagca

SEQ ID NO: 3929053 - RNA, 18 nt, Human adenovirus D
gaagaaugggacagccag

SEQ ID NO: 3929054 - RNA, 17 nt, Human adenovirus D
gaagaauuuggagacgc

SEQ ID NO: 3929055 - RNA, 16 nt, Human adenovirus D
gaagagcguccgcagg

SEQ ID NO: 3929056 - RNA, 14 nt, Human adenovirus D
gaagaucagcugca

SEQ ID NO: 3929057 - RNA, 15 nt, Human adenovirus D
gaagauggaggagca

SEQ ID NO: 3929058 - RNA, 19 nt, Human adenovirus D
gaagcccagagcucgcggg

SEQ ID NO: 3929059 - RNA, 23 nt, Human adenovirus D
gaagccuucuauggaggcagagc

SEQ ID NO: 3929060 - RNA, 23 nt, Human adenovirus D
gaagcgcucgaucaucuccccgc

SEQ ID NO: 3929061 - RNA, 21 nt, Human adenovirus D
gaagggcucggucgggacgag

SEQ ID NO: 3929062 - RNA, 16 nt, Human adenovirus D
gaaguaaauuugacac

SEQ ID NO: 3929063 - RNA, 18 nt, Human adenovirus D
gaagugcggcggcggcug

SEQ ID NO: 3929064 - RNA, 23 nt, Human adenovirus D
gaagugcggcggcggcuggcggu

SEQ ID NO: 3929065 - RNA, 13 nt, Human adenovirus D
gaauaaagccucu

SEQ ID NO: 3929066 - RNA, 17 nt, Human adenovirus D
gaauaacaugcugauca

SEQ ID NO: 3929067 - RNA, 22 nt, Human adenovirus D
gaauaucagacaugcugcuaca

SEQ ID NO: 3929068 - RNA, 20 nt, Human adenovirus D
gaauauccccuuccucacuc

SEQ ID NO: 3929069 - RNA, 17 nt, Human adenovirus D
ucaaggacaugcagcug

SEQ ID NO: 3929070 - RNA, 18 nt, Human adenovirus D
ucaaguuugacagcagaa

SEQ ID NO: 3929071 - RNA, 17 nt, Human adenovirus D
ucaaucucccaccacca

SEQ ID NO: 3929072 - RNA, 19 nt, Human adenovirus D
ucacacuuaguucagcugc

SEQ ID NO: 3929073 - RNA, 23 nt, Human adenovirus D
ucacacuuaguucagcugcaaug

SEQ ID NO: 3929074 - RNA, 23 nt, Human adenovirus D
ucacagcuaagaaaaaaucagag

SEQ ID NO: 3929075 - RNA, 14 nt, Human adenovirus D
ucacaggaggcaca

SEQ ID NO: 3929076 - RNA, 19 nt, Human adenovirus D
ucaccauguuauucagcag

SEQ ID NO: 3929077 - RNA, 13 nt, Human adenovirus D
ucacccagcaguc

SEQ ID NO: 3929078 - RNA, 17 nt, Human adenovirus D
ucacccugcccuuccag

SEQ ID NO: 3929079 - RNA, 18 nt, Human adenovirus D
ucaccucaacgcccaggc

SEQ ID NO: 3929080 - RNA, 18 nt, Human adenovirus D
ucaccuuccugcagcuca

SEQ ID NO: 3929081 - RNA, 19 nt, Human adenovirus D
ucaccuuggcuuugcuggg

SEQ ID NO: 3929082 - RNA, 22 nt, Human adenovirus D
ucacuccccccuuugucuccuc

SEQ ID NO: 3929083 - RNA, 19 nt, Human adenovirus D
ucacuuugguacuuacaaa

SEQ ID NO: 3929084 - RNA, 13 nt, Human adenovirus D
ucagagugcacca

SEQ ID NO: 3929085 - RNA, 13 nt, Human adenovirus D
ucagauauuccag

SEQ ID NO: 3929086 - RNA, 23 nt, Human adenovirus D
ucagaucgugguaaacgggcccu

SEQ ID NO: 3929087 - RNA, 14 nt, Human adenovirus D
ucagcugcagcgca

SEQ ID NO: 3929088 - RNA, 16 nt, Human adenovirus D
ucaggagcgcagccug

SEQ ID NO: 3929089 - RNA, 18 nt, Human adenovirus D
ucaggagcgcagccugag

SEQ ID NO: 3929090 - RNA, 15 nt, Human adenovirus D
ucagguguccagcug

SEQ ID NO: 3929091 - RNA, 17 nt, Human adenovirus D
ucagguuuggauauuca

SEQ ID NO: 3929092 - RNA, 15 nt, Human adenovirus D
ucagucuccuggugc

SEQ ID NO: 3929093 - RNA, 17 nt, Human adenovirus D
ucauaugguagacccac

SEQ ID NO: 3929094 - RNA, 17 nt, Human adenovirus D
ucaucacaucagccagg

SEQ ID NO: 3929095 - RNA, 16 nt, Human adenovirus D
ucaucacccagcaguc

SEQ ID NO: 3929096 - RNA, 21 nt, Human adenovirus D
ucaucaccguuccaugcagac

SEQ ID NO: 3929097 - RNA, 21 nt, Human adenovirus D
ucauccuuccaguacucccgg

SEQ ID NO: 3929098 - RNA, 14 nt, Human adenovirus D
ucaucgacuggugc

SEQ ID NO: 3929099 - RNA, 20 nt, Human adenovirus D
ucaucgccugcuugcaagac

SEQ ID NO: 3929100 - RNA, 16 nt, Human adenovirus D
ucaucucgcccagcaa

SEQ ID NO: 3929101 - RNA, 19 nt, Human adenovirus D
ucaugaucuaccccuguuu

SEQ ID NO: 3929102 - RNA, 16 nt, Human adenovirus D
ucaugcaacuuggaag

SEQ ID NO: 3929103 - RNA, 15 nt, Human adenovirus D
ucauguacuacaaca

SEQ ID NO: 3929104 - RNA, 19 nt, Human adenovirus D
ucauguuggggaugaugga

SEQ ID NO: 3929105 - RNA, 18 nt, Human adenovirus D
ucauucaaggccauaaau

SEQ ID NO: 3929106 - RNA, 24 nt, Human adenovirus D
ucauucucgagcgaucugggaugc

SEQ ID NO: 3929107 - RNA, 18 nt, Human adenovirus D
uccaagcgggccucacag

SEQ ID NO: 3929108 - RNA, 20 nt, Human adenovirus D
uccacaaacuacauggacaa

SEQ ID NO: 3929109 - RNA, 18 nt, Human adenovirus D
uccaccgaaggcagcucc

SEQ ID NO: 3929110 - RNA, 21 nt, Human adenovirus D
uccaccgaaggcagcuccggu

SEQ ID NO: 3929111 - RNA, 16 nt, Human adenovirus D
uccaccucggugcagc

SEQ ID NO: 3929112 - RNA, 21 nt, Human adenovirus D
uccaccucucccgaucauuga

SEQ ID NO: 3929113 - RNA, 15 nt, Human adenovirus D
uccacgagcgccagc

SEQ ID NO: 3929114 - RNA, 17 nt, Human adenovirus D
uccacgagcgccagcug

SEQ ID NO: 3929115 - RNA, 20 nt, Human adenovirus D
uccagaggacuuggaugagg

SEQ ID NO: 3929116 - RNA, 22 nt, Human adenovirus D
uccagauggaaaggucacuugg

SEQ ID NO: 3929117 - RNA, 19 nt, Human adenovirus D
uccagcagcaggguaccca

SEQ ID NO: 3929118 - RNA, 23 nt, Human adenovirus D
uccagcagcaggguacccacugg

SEQ ID NO: 3929119 - RNA, 19 nt, Human adenovirus D
uccagggucucaggguccg

SEQ ID NO: 3929120 - RNA, 12 nt, Human adenovirus D
uccagggugcgc

SEQ ID NO: 3929121 - RNA, 20 nt, Human adenovirus D
uccaggucuggcacaucuuu

SEQ ID NO: 3929122 - RNA, 15 nt, Human adenovirus D
uccaguacucccgga

SEQ ID NO: 3929123 - RNA, 20 nt, Human adenovirus D
uccaguaggaaccagcacac

SEQ ID NO: 3929124 - RNA, 23 nt, Human adenovirus D
uccaguuacgggagcgagccccc

SEQ ID NO: 3929125 - RNA, 22 nt, Human adenovirus D
uccaucagcgcccucagcaguc

SEQ ID NO: 3929126 - RNA, 22 nt, Human adenovirus D
uccaucgugcgcgaccugggcu

SEQ ID NO: 3929127 - RNA, 17 nt, Human adenovirus D
ucccaacagccuucagc

SEQ ID NO: 3929128 - RNA, 17 nt, Human adenovirus D
ucccagcgccgcgcugg

SEQ ID NO: 3929129 - RNA, 13 nt, Human adenovirus D
ucccaggacgaga

SEQ ID NO: 3929130 - RNA, 15 nt, Human adenovirus D
ucccaggucauacaa

SEQ ID NO: 3929131 - RNA, 12 nt, Human adenovirus D
ucccccagcaug

SEQ ID NO: 3929132 - RNA, 18 nt, Human adenovirus D
uccccgaggcccuugcca

SEQ ID NO: 3929133 - RNA, 13 nt, Human adenovirus D
uccccgcgccgcg

SEQ ID NO: 3929134 - RNA, 22 nt, Human adenovirus D
uccccucaucacaucagccagg

SEQ ID NO: 3929135 - RNA, 22 nt, Human adenovirus D
uccccucgcgcaacugggccgc

SEQ ID NO: 3929136 - RNA, 20 nt, Human adenovirus D
ggggugaugagcugcgagga

SEQ ID NO: 3929137 - RNA, 14 nt, Human adenovirus D
ggggugguccuggg

SEQ ID NO: 3929138 - RNA, 21 nt, Human adenovirus D
gggucaucuugcacaguuggc

SEQ ID NO: 3929139 - RNA, 14 nt, Human adenovirus D
gggugcgcgacucc

SEQ ID NO: 3929140 - RNA, 22 nt, Human adenovirus D
ggguguuuuugcgaaaacacuu

SEQ ID NO: 3929141 - RNA, 18 nt, Human adenovirus D
gguaauccacggacagaa

SEQ ID NO: 3929142 - RNA, 16 nt, Human adenovirus D
gguacuugggcugcca

SEQ ID NO: 3929143 - RNA, 21 nt, Human adenovirus D
gguagcaccacugcauggccu

SEQ ID NO: 3929144 - RNA, 17 nt, Human adenovirus D
ggucacacuagcgcccu

SEQ ID NO: 3929145 - RNA, 23 nt, Human adenovirus D
ggucacauccaucuccaccacgu

SEQ ID NO: 3929146 - RNA, 13 nt, Human adenovirus D
ggucagagugcac

SEQ ID NO: 3929147 - RNA, 18 nt, Human adenovirus D
ggucagcgaugagcagcu

SEQ ID NO: 3929148 - RNA, 15 nt, Human adenovirus D
gguccccgaggcccu

SEQ ID NO: 3929149 - RNA, 13 nt, Human adenovirus D
ggucgcugccgga

SEQ ID NO: 3929150 - RNA, 14 nt, Human adenovirus D
ggucggagccccuu

SEQ ID NO: 3929151 - RNA, 18 nt, Human adenovirus D
ggucggcgacgacgcgcu

SEQ ID NO: 3929152 - RNA, 15 nt, Human adenovirus D
ggucgucgccccgga

SEQ ID NO: 3929153 - RNA, 15 nt, Human adenovirus D
ggucugcuccugcac

SEQ ID NO: 3929154 - RNA, 16 nt, Human adenovirus D
ggugaagcaggagcgc

SEQ ID NO: 3929155 - RNA, 23 nt, Human adenovirus D
ggugaggaucauaucccagggga

SEQ ID NO: 3929156 - RNA, 15 nt, Human adenovirus D
ggugagggggucccg

SEQ ID NO: 3929157 - RNA, 16 nt, Human adenovirus D
ggugaguugguggccg

SEQ ID NO: 3929158 - RNA, 19 nt, Human adenovirus D
ggugcagucguggacgcug

SEQ ID NO: 3929159 - RNA, 17 nt, Human adenovirus D
ggugcaguuugcccgcg

SEQ ID NO: 3929160 - RNA, 14 nt, Human adenovirus D
ggugcgcuggggcu

SEQ ID NO: 3929161 - RNA, 17 nt, Human adenovirus D
ggugcgucgagcacagc

SEQ ID NO: 3929162 - RNA, 15 nt, Human adenovirus D
ggugcuaaagcucuu

SEQ ID NO: 3929163 - RNA, 19 nt, Human adenovirus D
ggugcugaaacgggcacgg

SEQ ID NO: 3929164 - RNA, 20 nt, Human adenovirus D
ggugcugccccaggcggugc

SEQ ID NO: 3929165 - RNA, 23 nt, Human adenovirus D
gguggaaacagacagccagguca

SEQ ID NO: 3929166 - RNA, 16 nt, Human adenovirus D
gguggacgagcagacc

SEQ ID NO: 3929167 - RNA, 20 nt, Human adenovirus D
gguggacuucacagagagcc

SEQ ID NO: 3929168 - RNA, 23 nt, Human adenovirus D
gguguaccagucgggcccggacu

SEQ ID NO: 3929169 - RNA, 14 nt, Human adenovirus D
ggugucccugacca

SEQ ID NO: 3929170 - RNA, 15 nt, Human adenovirus D
ggugucuuccucucc

SEQ ID NO: 3929171 - RNA, 18 nt, Human adenovirus D
gguucaagaacgagggcc

SEQ ID NO: 3929172 - RNA, 19 nt, Human adenovirus D
gguucauguugugcaggac

SEQ ID NO: 3929173 - RNA, 15 nt, Human adenovirus D
gguucuucacccagc

SEQ ID NO: 3929174 - RNA, 17 nt, Human adenovirus D
guaaagccagcagcaca

SEQ ID NO: 3929175 - RNA, 17 nt, Human adenovirus D
guaaaugacucuccuga

SEQ ID NO: 3929176 - RNA, 18 nt, Human adenovirus D
guacaacaugcugacugc

SEQ ID NO: 3929177 - RNA, 18 nt, Human adenovirus D
guacaacgcccugcugga

SEQ ID NO: 3929178 - RNA, 15 nt, Human adenovirus D
guacacgguucucuc

SEQ ID NO: 3929179 - RNA, 17 nt, Human adenovirus D
guacagcacagcaggga

SEQ ID NO: 3929180 - RNA, 17 nt, Human adenovirus D
guaccaugggaaaugca

SEQ ID NO: 3929181 - RNA, 13 nt, Human adenovirus D
guacccgaggacu

SEQ ID NO: 3929182 - RNA, 18 nt, Human adenovirus D
guacgagagcgugauggc

SEQ ID NO: 3929183 - RNA, 22 nt, Human adenovirus D
guacgagagcgugauggcgcag

SEQ ID NO: 3929184 - RNA, 18 nt, Human adenovirus D
guacuaaugacagaggca

SEQ ID NO: 3929185 - RNA, 22 nt, Human adenovirus D
guacuacaacaguacuggcaac

SEQ ID NO: 3929186 - RNA, 13 nt, Human adenovirus D
guacucauaaaga

SEQ ID NO: 3929187 - RNA, 16 nt, Human adenovirus D
guacuucugccagcag

SEQ ID NO: 3929188 - RNA, 23 nt, Human adenovirus D
guagaagcaacagauuuaagcaa

SEQ ID NO: 3929189 - RNA, 14 nt, Human adenovirus D
guagagcggccagc

SEQ ID NO: 3929190 - RNA, 15 nt, Human adenovirus D
guagcagcagaggaa

SEQ ID NO: 3929191 - RNA, 20 nt, Human adenovirus D
guagcccgugcacuugggga

SEQ ID NO: 3929192 - RNA, 15 nt, Human adenovirus D
guagcugcgcggggc

SEQ ID NO: 3929193 - RNA, 21 nt, Human adenovirus D
guagguauucccucucgagag

SEQ ID NO: 3929194 - RNA, 16 nt, Human adenovirus D
guaguggcucgcgccc

SEQ ID NO: 3929195 - RNA, 17 nt, Human adenovirus D
guaguugcgcaggcgcu

SEQ ID NO: 3929196 - RNA, 19 nt, Human adenovirus D
guaugccaagauagcccug

SEQ ID NO: 3929197 - RNA, 22 nt, Human adenovirus D
gucaaccuugaaaccccagaca

SEQ ID NO: 3929198 - RNA, 16 nt, Human adenovirus D
gucacacuuaguucag

SEQ ID NO: 3929199 - RNA, 21 nt, Human adenovirus D
gucacacuuaguucagcugca

SEQ ID NO: 3929200 - RNA, 19 nt, Human adenovirus D
gucagacccaguggcgaga

SEQ ID NO: 3929201 - RNA, 20 nt, Human adenovirus D
gucaggcagcggggacagag

SEQ ID NO: 3929202 - RNA, 14 nt, Human adenovirus D
gucaggcaggcaug

SEQ ID NO: 3929203 - RNA, 15 nt, Human adenovirus D
gucagggaacugaua

SEQ ID NO: 3929204 - RNA, 13 nt, Human adenovirus D
gucagugaagccc

SEQ ID NO: 3929205 - RNA, 13 nt, Human adenovirus D
gucaucgacucgg

SEQ ID NO: 3929206 - RNA, 15 nt, Human adenovirus D
gucauugauacccug

SEQ ID NO: 3929207 - RNA, 17 nt, Human adenovirus D
guccacgagcgccagcu

SEQ ID NO: 3929208 - RNA, 23 nt, Human adenovirus D
guccaugguagcaauggaaauca

SEQ ID NO: 3929209 - RNA, 13 nt, Human adenovirus D
gucccagcagcac

SEQ ID NO: 3929210 - RNA, 22 nt, Human adenovirus D
gucccgguguugcgcccugaga

SEQ ID NO: 3929211 - RNA, 18 nt, Human adenovirus D
gucccucauccuccggga

SEQ ID NO: 3929212 - RNA, 19 nt, Human adenovirus D
gucccuucucggaccaacc

SEQ ID NO: 3929213 - RNA, 15 nt, Human adenovirus D
gucccuuuuccagga

SEQ ID NO: 3929214 - RNA, 17 nt, Human adenovirus D
guccgccaagcuccucg

SEQ ID NO: 3929215 - RNA, 16 nt, Human adenovirus D
guccucccccgagcgc

SEQ ID NO: 3929216 - RNA, 21 nt, Human adenovirus D
guccucugaaaagucauccaa

SEQ ID NO: 3929217 - RNA, 12 nt, Human adenovirus D
guccuggucacc

SEQ ID NO: 3929218 - RNA, 19 nt, Human adenovirus D
guccuucacucccaaccag

SEQ ID NO: 3929219 - RNA, 17 nt, Human adenovirus D
guccuugaggaggagac

SEQ ID NO: 3929220 - RNA, 14 nt, Human adenovirus D
guccuugccuuccu

SEQ ID NO: 3929221 - RNA, 21 nt, Human adenovirus D
guccuuuagacaacagccgca

SEQ ID NO: 3929222 - RNA, 14 nt, Human adenovirus D
gucgaggagaccug

SEQ ID NO: 3929223 - RNA, 22 nt, Human adenovirus D
gucgccacggucaccgagccuc

SEQ ID NO: 3929224 - RNA, 14 nt, Human adenovirus D
gucgccggaggagg

SEQ ID NO: 3929225 - RNA, 15 nt, Human adenovirus D
gucgccucggaccug

SEQ ID NO: 3929226 - RNA, 18 nt, Human adenovirus D
gucgcggacgcgcucccg

SEQ ID NO: 3929227 - RNA, 21 nt, Human adenovirus D
gucggcgcgcuccuuggccgc

SEQ ID NO: 3929228 - RNA, 19 nt, Human adenovirus D
gucguacuucugccagcag

SEQ ID NO: 3929229 - RNA, 15 nt, Human adenovirus D
gucuacuucaacccc

SEQ ID NO: 3929230 - RNA, 16 nt, Human adenovirus D
gucuagaaccccacag

SEQ ID NO: 3929231 - RNA, 21 nt, Human adenovirus D
gucuccugccugggaauccug

SEQ ID NO: 3929232 - RNA, 14 nt, Human adenovirus D
gucugaagcgccgc

SEQ ID NO: 3929233 - RNA, 19 nt, Human adenovirus D
agcugcgcgagggccugga

SEQ ID NO: 3929234 - RNA, 16 nt, Human adenovirus D
agcugcgcggggccac

SEQ ID NO: 3929235 - RNA, 13 nt, Human adenovirus D
agcuggcccggca

SEQ ID NO: 3929236 - RNA, 15 nt, Human adenovirus D
agcuggccgcccuga

SEQ ID NO: 3929237 - RNA, 23 nt, Human adenovirus D
agcuucuugcuagaaaccucaaa

SEQ ID NO: 3929238 - RNA, 23 nt, Human adenovirus D
agcuuggcgacgaacucggcggu

SEQ ID NO: 3929239 - RNA, 17 nt, Human adenovirus D
agcuugggcgcaagaaa

SEQ ID NO: 3929240 - RNA, 18 nt, Human adenovirus D
aggaaccccacgguggcc

SEQ ID NO: 3929241 - RNA, 22 nt, Human adenovirus D
aggaacuucaggaguggcggcc

SEQ ID NO: 3929242 - RNA, 16 nt, Human adenovirus D
aggaagugcggcggcg

SEQ ID NO: 3929243 - RNA, 20 nt, Human adenovirus D
aggaagugcggcggcggcug

SEQ ID NO: 3929244 - RNA, 15 nt, Human adenovirus D
aggaagugcuggaca

SEQ ID NO: 3929245 - RNA, 20 nt, Human adenovirus D
aggacacuaaagggagagcu

SEQ ID NO: 3929246 - RNA, 15 nt, Human adenovirus D
aggacaugcagcugc

SEQ ID NO: 3929247 - RNA, 16 nt, Human adenovirus D
aggagaacugcuggcc

SEQ ID NO: 3929248 - RNA, 20 nt, Human adenovirus D
aggagaccgacgcugggcuc

SEQ ID NO: 3929249 - RNA, 22 nt, Human adenovirus D
aggagcagcgccccgaggacac

SEQ ID NO: 3929250 - RNA, 19 nt, Human adenovirus D
aggagcugaucucgcugcc

SEQ ID NO: 3929251 - RNA, 22 nt, Human adenovirus D
aggagcugaucucgcugccgcu

SEQ ID NO: 3929252 - RNA, 23 nt, Human adenovirus D
aggagcuggacaagcuucuugcu

SEQ ID NO: 3929253 - RNA, 15 nt, Human adenovirus D
aggaggaugugcugc

SEQ ID NO: 3929254 - RNA, 16 nt, Human adenovirus D
aggagucgccggagga

SEQ ID NO: 3929255 - RNA, 20 nt, Human adenovirus D
aggauaaauauggccuggag

SEQ ID NO: 3929256 - RNA, 17 nt, Human adenovirus D
aggaugaacaggagcac

SEQ ID NO: 3929257 - RNA, 14 nt, Human adenovirus D
aggaugucaacaug

SEQ ID NO: 3929258 - RNA, 18 nt, Human adenovirus D
aggaugugcugcugaaac

SEQ ID NO: 3929259 - RNA, 13 nt, Human adenovirus D
aggcaaagcucaa

SEQ ID NO: 3929260 - RNA, 17 nt, Human adenovirus D
aggcaaagcucaacccg

SEQ ID NO: 3929261 - RNA, 22 nt, Human adenovirus D
aggcacugcucuucccuggaga

SEQ ID NO: 3929262 - RNA, 22 nt, Human adenovirus D
aggcagacgcugaaaggcgggc

SEQ ID NO: 3929263 - RNA, 22 nt, Human adenovirus D
aggcagaggcacacagcucaac

SEQ ID NO: 3929264 - RNA, 16 nt, Human adenovirus D
aggcauauaaaaaugc

SEQ ID NO: 3929265 - RNA, 14 nt, Human adenovirus D
aggcauggcaggca

SEQ ID NO: 3929266 - RNA, 16 nt, Human adenovirus D
aggcauggcaggcagc

SEQ ID NO: 3929267 - RNA, 20 nt, Human adenovirus D
aggcauggcaggcagcggcc

SEQ ID NO: 3929268 - RNA, 15 nt, Human adenovirus D
aggccaacagacucu

SEQ ID NO: 3929269 - RNA, 12 nt, Human adenovirus D
aggccaggagga

SEQ ID NO: 3929270 - RNA, 18 nt, Human adenovirus D
aggccaggcgcaggugga

SEQ ID NO: 3929271 - RNA, 17 nt, Human adenovirus D
aggccauaaaucugccc

SEQ ID NO: 3929272 - RNA, 14 nt, Human adenovirus D
aggcccuggagcag

SEQ ID NO: 3929273 - RNA, 18 nt, Human adenovirus D
aggccuuucacccggacg

SEQ ID NO: 3929274 - RNA, 19 nt, Human adenovirus D
aggcgaaacgccccugcaa

SEQ ID NO: 3929275 - RNA, 16 nt, Human adenovirus D
aggcgcccaggccgcu

SEQ ID NO: 3929276 - RNA, 14 nt, Human adenovirus D
aggcgcccgugggc

SEQ ID NO: 3929277 - RNA, 16 nt, Human adenovirus D
aggcgcgcccacccgg

SEQ ID NO: 3929278 - RNA, 14 nt, Human adenovirus D
aggcgcuggaagag

SEQ ID NO: 3929279 - RNA, 15 nt, Human adenovirus D
aggcgcuggaagagg

SEQ ID NO: 3929280 - RNA, 18 nt, Human adenovirus D
aggcgggacagaggaggg

SEQ ID NO: 3929281 - RNA, 15 nt, Human adenovirus D
aggcggugcugcugc

SEQ ID NO: 3929282 - RNA, 20 nt, Human adenovirus D
aggcguuuuugaggcggcgg

SEQ ID NO: 3929283 - RNA, 23 nt, Human adenovirus D
aggcuaccugaccuugcagagca

SEQ ID NO: 3929284 - RNA, 21 nt, Human adenovirus D
aggcucauaugaccaugcaga

SEQ ID NO: 3929285 - RNA, 14 nt, Human adenovirus D
aggcuuucacagcu

SEQ ID NO: 3929286 - RNA, 15 nt, Human adenovirus D
agggaacugaaagaa

SEQ ID NO: 3929287 - RNA, 18 nt, Human adenovirus D
agggagcugcgcgagggc

SEQ ID NO: 3929288 - RNA, 19 nt, Human adenovirus D
agggcagcccuaccccgcc

SEQ ID NO: 3929289 - RNA, 14 nt, Human adenovirus D
agggccucggcggc

SEQ ID NO: 3929290 - RNA, 12 nt, Human adenovirus D
agggccugggcu

SEQ ID NO: 3929291 - RNA, 22 nt, Human adenovirus D
aggggccaagaaggccggggcc

SEQ ID NO: 3929292 - RNA, 22 nt, Human adenovirus D
aggggcucguuaguccagcaga

SEQ ID NO: 3929293 - RNA, 17 nt, Human adenovirus D
agggggcgguggcagga

SEQ ID NO: 3929294 - RNA, 17 nt, Human adenovirus D
aggggguuaggcagagc

SEQ ID NO: 3929295 - RNA, 23 nt, Human adenovirus D
aggggucuaucuggacccccaga

SEQ ID NO: 3929296 - RNA, 19 nt, Human adenovirus D
aggggugggccccuggcug

SEQ ID NO: 3929297 - RNA, 13 nt, Human adenovirus D
agggguugagggg

SEQ ID NO: 3929298 - RNA, 14 nt, Human adenovirus D
agggucuggagcuc

SEQ ID NO: 3929299 - RNA, 20 nt, Human adenovirus D
agguaauucucauuuuucca

SEQ ID NO: 3929300 - RNA, 15 nt, Human adenovirus D
agguaguugagggug

SEQ ID NO: 3929301 - RNA, 21 nt, Human adenovirus D
aggucuaaaaaccccgccaaa

SEQ ID NO: 3929302 - RNA, 13 nt, Human adenovirus D
aggugagcucugg

SEQ ID NO: 3929303 - RNA, 21 nt, Human adenovirus D
aggugagggggucccgcuccc

SEQ ID NO: 3929304 - RNA, 22 nt, Human adenovirus D
aggugaugccggcagcgguggu

SEQ ID NO: 3929305 - RNA, 15 nt, Human adenovirus D
aggugauuggcuugu

SEQ ID NO: 3929306 - RNA, 12 nt, Human adenovirus D
aggugcagaccg

SEQ ID NO: 3929307 - RNA, 18 nt, Human adenovirus D
agguggcccugggccuga

SEQ ID NO: 3929308 - RNA, 16 nt, Human adenovirus D
agguguccgagcuccg

SEQ ID NO: 3929309 - RNA, 20 nt, Human adenovirus D
agguuuggcauaucagccag

SEQ ID NO: 3929310 - RNA, 20 nt, Human adenovirus D
aguaccugagccgcgagaag

SEQ ID NO: 3929311 - RNA, 18 nt, Human adenovirus D
agucaaguuugacagcag

SEQ ID NO: 3929312 - RNA, 23 nt, Human adenovirus D
agucacaguuauaccaccuccuc

SEQ ID NO: 3929313 - RNA, 22 nt, Human adenovirus D
agucagcaacuaccccgugguc

SEQ ID NO: 3929314 - RNA, 21 nt, Human adenovirus D
aguccuuuagacaacagccgc

SEQ ID NO: 3929315 - RNA, 23 nt, Human adenovirus D
agucgaggucagcagcaagagcu

SEQ ID NO: 3929316 - RNA, 11 nt, Human adenovirus D
agucuccuggu

SEQ ID NO: 3929317 - RNA, 23 nt, Human adenovirus D
agucuccuggugcgucgagcaca

SEQ ID NO: 3929318 - RNA, 16 nt, Human adenovirus D
agucugaagcgccgcc

SEQ ID NO: 3929319 - RNA, 14 nt, Human adenovirus D
agucugagggccac

SEQ ID NO: 3929320 - RNA, 15 nt, Human adenovirus D
agucugccgcccuug

SEQ ID NO: 3929321 - RNA, 23 nt, Human adenovirus D
agugaucgcgggcuuuguaacuc

SEQ ID NO: 3929322 - RNA, 13 nt, Human adenovirus D
agugcaagaaggg

SEQ ID NO: 3929323 - RNA, 20 nt, Human adenovirus D
agugccuuuaucagcacugc

SEQ ID NO: 3929324 - RNA, 15 nt, Human adenovirus D
aguggaagagaugga

SEQ ID NO: 3929325 - RNA, 21 nt, Human adenovirus D
aguggcaacaccugggcacug

SEQ ID NO: 3929326 - RNA, 15 nt, Human adenovirus D
aguggcccuggaugu

SEQ ID NO: 3929327 - RNA, 16 nt, Human adenovirus D
aguggccucucgcucc

SEQ ID NO: 3929328 - RNA, 14 nt, Human adenovirus D
aguggggcggcaaa

SEQ ID NO: 3929329 - RNA, 14 nt, Human adenovirus D
aguuaaugcugccu

SEQ ID NO: 3929330 - RNA, 19 nt, Human adenovirus D
aguuauggucugcuccugc

SEQ ID NO: 3929331 - RNA, 13 nt, Human adenovirus D
aguucagcuccag

SEQ ID NO: 3929332 - RNA, 18 nt, Human adenovirus D
aguuccugauggaugugu

SEQ ID NO: 3929333 - RNA, 19 nt, Human adenovirus D
aguucgcuccgcggcggcg

SEQ ID NO: 3929334 - RNA, 22 nt, Human adenovirus D
aguugcaccacgcuucuucccc

SEQ ID NO: 3929335 - RNA, 17 nt, Human adenovirus D
aguuuacccugcccgag

SEQ ID NO: 3929336 - RNA, 20 nt, Human adenovirus D
auaaaagggggcgggucugu

SEQ ID NO: 3929337 - RNA, 14 nt, Human adenovirus D
auaaagaagacuau

SEQ ID NO: 3929338 - RNA, 22 nt, Human adenovirus D
auaaagaucacuuacuugaaau

SEQ ID NO: 3929339 - RNA, 17 nt, Human adenovirus D
auaauaaagguguacuu

SEQ ID NO: 3929340 - RNA, 18 nt, Human adenovirus D
auacauccucuggcuuuu

SEQ ID NO: 3929341 - RNA, 13 nt, Human adenovirus D
auaccaucaaugc

SEQ ID NO: 3929342 - RNA, 16 nt, Human adenovirus D
auacucggaaaacagg

SEQ ID NO: 3929343 - RNA, 19 nt, Human adenovirus D
auagcuuccguugcgcugc

SEQ ID NO: 3929344 - RNA, 23 nt, Human adenovirus D
auaggcacugaaaauuugcaaaa

SEQ ID NO: 3929345 - RNA, 16 nt, Human adenovirus D
auaggccaggcgcagg

SEQ ID NO: 3929346 - RNA, 23 nt, Human adenovirus D
auagucacacuuaguucagcugc

SEQ ID NO: 3929347 - RNA, 22 nt, Human adenovirus D
auaucauaaagauggauggaaa

SEQ ID NO: 3929348 - RNA, 15 nt, Human adenovirus D
auaugaccaugcaga

SEQ ID NO: 3929349 - RNA, 17 nt, Human adenovirus D
cacucuuuccagcagca

SEQ ID NO: 3929350 - RNA, 21 nt, Human adenovirus D
cacugcaccccccgcaggcag

SEQ ID NO: 3929351 - RNA, 14 nt, Human adenovirus D
cacugccggugcac

SEQ ID NO: 3929352 - RNA, 21 nt, Human adenovirus D
cacuguuguuuauaaaucuua

SEQ ID NO: 3929353 - RNA, 17 nt, Human adenovirus D
cacuuaaguccugggcc

SEQ ID NO: 3929354 - RNA, 12 nt, Human adenovirus D
cagaaacagcau

SEQ ID NO: 3929355 - RNA, 17 nt, Human adenovirus D
cagaacccggacagcaa

SEQ ID NO: 3929356 - RNA, 17 nt, Human adenovirus D
cagaaccggaggcuggc

SEQ ID NO: 3929357 - RNA, 13 nt, Human adenovirus D
cagacagccaggu

SEQ ID NO: 3929358 - RNA, 14 nt, Human adenovirus D
cagacgagcggccg

SEQ ID NO: 3929359 - RNA, 23 nt, Human adenovirus D
cagacgggcgaagugcucaaccc

SEQ ID NO: 3929360 - RNA, 17 nt, Human adenovirus D
cagacggugaagcagga

SEQ ID NO: 3929361 - RNA, 19 nt, Human adenovirus D
cagacggugaagcaggagc

SEQ ID NO: 3929362 - RNA, 21 nt, Human adenovirus D
cagagccagggcuaagcgugg

SEQ ID NO: 3929363 - RNA, 15 nt, Human adenovirus D
cagagcgggcgggcg

SEQ ID NO: 3929364 - RNA, 15 nt, Human adenovirus D
cagaguaagaggagu

SEQ ID NO: 3929365 - RNA, 19 nt, Human adenovirus D
cagagucgaggucagcagc

SEQ ID NO: 3929366 - RNA, 14 nt, Human adenovirus D
cagagucugccgcc

SEQ ID NO: 3929367 - RNA, 17 nt, Human adenovirus D
cagauacuucagcaugu

SEQ ID NO: 3929368 - RNA, 19 nt, Human adenovirus D
cagauagugcuuacucuau

SEQ ID NO: 3929369 - RNA, 16 nt, Human adenovirus D
cagauauuccagauca

SEQ ID NO: 3929370 - RNA, 14 nt, Human adenovirus D
cagauccugcugcu

SEQ ID NO: 3929371 - RNA, 23 nt, Human adenovirus D
cagauccugcugcuccaccaccu

SEQ ID NO: 3929372 - RNA, 13 nt, Human adenovirus D
cagaugcggagga

SEQ ID NO: 3929373 - RNA, 17 nt, Human adenovirus D
cagaugguagcagcaga

SEQ ID NO: 3929374 - RNA, 20 nt, Human adenovirus D
cagauguugcgcagcggcag

SEQ ID NO: 3929375 - RNA, 16 nt, Human adenovirus D
cagcaacccuuccugg

SEQ ID NO: 3929376 - RNA, 19 nt, Human adenovirus D
cagcaacccuuccuggucg

SEQ ID NO: 3929377 - RNA, 22 nt, Human adenovirus D
cagcacaacaacucgggcuuca

SEQ ID NO: 3929378 - RNA, 12 nt, Human adenovirus D
cagcacaguaag

SEQ ID NO: 3929379 - RNA, 24 nt, Human adenovirus D
cagcacaugguaauccacggacag

SEQ ID NO: 3929380 - RNA, 22 nt, Human adenovirus D
cagcacgcggaucucacggccu

SEQ ID NO: 3929381 - RNA, 12 nt, Human adenovirus D
cagcacgguggc

SEQ ID NO: 3929382 - RNA, 21 nt, Human adenovirus D
cagcagaagaucccggcgcag

SEQ ID NO: 3929383 - RNA, 18 nt, Human adenovirus D
cagcagagucgaggucag

SEQ ID NO: 3929384 - RNA, 19 nt, Human adenovirus D
cagcagcaaaauaaaugau

SEQ ID NO: 3929385 - RNA, 23 nt, Human adenovirus D
cagcagcaccucgguacccuccu

SEQ ID NO: 3929386 - RNA, 15 nt, Human adenovirus D
cagcagcgacugacu

SEQ ID NO: 3929387 - RNA, 22 nt, Human adenovirus D
cagcaguacaagcgccaacagc

SEQ ID NO: 3929388 - RNA, 24 nt, Human adenovirus D
cagcaguagccccucugugcccag

SEQ ID NO: 3929389 - RNA, 21 nt, Human adenovirus D
cagcaguauccgcggagucca

SEQ ID NO: 3929390 - RNA, 18 nt, Human adenovirus D
cagcaucauccccgcgcc

SEQ ID NO: 3929391 - RNA, 16 nt, Human adenovirus D
cagcauguacggagga

SEQ ID NO: 3929392 - RNA, 20 nt, Human adenovirus D
cagcauguacggaggagcca

SEQ ID NO: 3929393 - RNA, 17 nt, Human adenovirus D
cagcauugucugccugg

SEQ ID NO: 3929394 - RNA, 17 nt, Human adenovirus D
cagccauagcucagccc

SEQ ID NO: 3929395 - RNA, 23 nt, Human adenovirus D
cagcccagggcgcacuacagccg

SEQ ID NO: 3929396 - RNA, 15 nt, Human adenovirus D
cagcccuaccccgcc

SEQ ID NO: 3929397 - RNA, 16 nt, Human adenovirus D
cagccgcagccgccau

SEQ ID NO: 3929398 - RNA, 13 nt, Human adenovirus D
cagccgcaggcgc

SEQ ID NO: 3929399 - RNA, 20 nt, Human adenovirus D
cagccgcguaagcaggagca

SEQ ID NO: 3929400 - RNA, 19 nt, Human adenovirus D
cagccggcgaacgugccgc

SEQ ID NO: 3929401 - RNA, 17 nt, Human adenovirus D
cagccgucuggacccgc

SEQ ID NO: 3929402 - RNA, 22 nt, Human adenovirus D
cagccgugaucccacagggcac

SEQ ID NO: 3929403 - RNA, 13 nt, Human adenovirus D
cagccuccaccgc

SEQ ID NO: 3929404 - RNA, 14 nt, Human adenovirus D
cagccuccaccgcu

SEQ ID NO: 3929405 - RNA, 16 nt, Human adenovirus D
cagccuguacccagag

SEQ ID NO: 3929406 - RNA, 19 nt, Human adenovirus D
cagccuucagcaucagucu

SEQ ID NO: 3929407 - RNA, 15 nt, Human adenovirus D
cagccuugcccccaa

SEQ ID NO: 3929408 - RNA, 23 nt, Human adenovirus D
cagccuuggauuaucucuacaaa

SEQ ID NO: 3929409 - RNA, 19 nt, Human adenovirus D
cagccuuuccauggccucg

SEQ ID NO: 3929410 - RNA, 15 nt, Human adenovirus D
cagcgccacgaccgg

SEQ ID NO: 3929411 - RNA, 23 nt, Human adenovirus D
cagcgccccgaggacacccggcc

SEQ ID NO: 3929412 - RNA, 15 nt, Human adenovirus D
cagcgcggccagcgu

SEQ ID NO: 3929413 - RNA, 14 nt, Human adenovirus D
cagcgcgugcugcg

SEQ ID NO: 3929414 - RNA, 17 nt, Human adenovirus D
cagcgcuggguggccgg

SEQ ID NO: 3929415 - RNA, 20 nt, Human adenovirus D
cagcggccugaaccgccgcc

SEQ ID NO: 3929416 - RNA, 14 nt, Human adenovirus D
cagcucauccgcag

SEQ ID NO: 3929417 - RNA, 23 nt, Human adenovirus D
cagcucaucgacuggugcugcgc

SEQ ID NO: 3929418 - RNA, 15 nt, Human adenovirus D
cagcuccagugggga

SEQ ID NO: 3929419 - RNA, 21 nt, Human adenovirus D
cagcuccgguugugcagcccc

SEQ ID NO: 3929420 - RNA, 23 nt, Human adenovirus D
cagcuccugagcgagacccaggu

SEQ ID NO: 3929421 - RNA, 15 nt, Human adenovirus D
cagcucugggucccc

SEQ ID NO: 3929422 - RNA, 22 nt, Human adenovirus D
cagcugacaauucagagccagg

SEQ ID NO: 3929423 - RNA, 18 nt, Human adenovirus D
cagcugcagcgcacucuc

SEQ ID NO: 3929424 - RNA, 14 nt, Human adenovirus D
cagcugccauggga

SEQ ID NO: 3929425 - RNA, 20 nt, Human adenovirus D
cagcugccaugggaggaagc

SEQ ID NO: 3929426 - RNA, 11 nt, Human adenovirus D
caggagaggca

SEQ ID NO: 3929427 - RNA, 21 nt, Human adenovirus D
caggagaucacuagcgugagc

SEQ ID NO: 3929428 - RNA, 13 nt, Human adenovirus D
caggagcacgagc

SEQ ID NO: 3929429 - RNA, 17 nt, Human adenovirus D
caggagcaggaggagga

SEQ ID NO: 3929430 - RNA, 22 nt, Human adenovirus D
caggaggagaccgacgcugggc

SEQ ID NO: 3929431 - RNA, 23 nt, Human adenovirus D
caggauaaauauggccuggagca

SEQ ID NO: 3929432 - RNA, 15 nt, Human adenovirus D
caggaucauugaaaa

SEQ ID NO: 3929433 - RNA, 14 nt, Human adenovirus D
caggaugaacagga

SEQ ID NO: 3929434 - RNA, 16 nt, Human adenovirus D
caggaugaacaggagc

SEQ ID NO: 3929435 - RNA, 22 nt, Human adenovirus D
caggaugcagccaguggcccug

SEQ ID NO: 3929436 - RNA, 23 nt, Human adenovirus D
caggcccagaacuggcagagcac

SEQ ID NO: 3929437 - RNA, 17 nt, Human adenovirus D
caggccgcagcucuucc

SEQ ID NO: 3929438 - RNA, 15 nt, Human adenovirus D
caggccgggcugcac

SEQ ID NO: 3929439 - RNA, 16 nt, Human adenovirus D
caggccgggcugcacg

SEQ ID NO: 3929440 - RNA, 16 nt, Human adenovirus D
caggcgcccagccagc

SEQ ID NO: 3929441 - RNA, 13 nt, Human adenovirus D
caggcgccugagu

SEQ ID NO: 3929442 - RNA, 16 nt, Human adenovirus D
caggcggugcugcugc

SEQ ID NO: 3929443 - RNA, 17 nt, Human adenovirus D
caggcggugcugcugcc

SEQ ID NO: 3929444 - RNA, 18 nt, Human adenovirus D
caggcggugcugcugccg

SEQ ID NO: 3929445 - RNA, 17 nt, Human adenovirus D
cagggaguuccugaugg

SEQ ID NO: 3929446 - RNA, 17 nt, Human adenovirus D
cagggcgaagguguccc

SEQ ID NO: 3929447 - RNA, 18 nt, Human adenovirus D
cagggcgcacuacagccg

SEQ ID NO: 3929448 - RNA, 17 nt, Human adenovirus D
caggggagugaagaggg

SEQ ID NO: 3929449 - RNA, 18 nt, Human adenovirus D
caggguacccacugggug

SEQ ID NO: 3929450 - RNA, 22 nt, Human adenovirus D
caggguagcggggcacaggcac

SEQ ID NO: 3929451 - RNA, 15 nt, Human adenovirus D
cagggucucaggguc

SEQ ID NO: 3929452 - RNA, 22 nt, Human adenovirus D
caggguugagucgcggcagaac

SEQ ID NO: 3929453 - RNA, 14 nt, Human adenovirus D
cagguauccagccu

SEQ ID NO: 3929454 - RNA, 17 nt, Human adenovirus D
caggucaaaacccacuc

SEQ ID NO: 3929455 - RNA, 12 nt, Human adenovirus D
caggucugcugg

SEQ ID NO: 3929456 - RNA, 17 nt, Human adenovirus D
caggugaugccggcagc

SEQ ID NO: 3929457 - RNA, 17 nt, Human adenovirus D
caggugcugccccaggc

SEQ ID NO: 3929458 - RNA, 20 nt, Human adenovirus D
cagguuacauuccugcacca

SEQ ID NO: 3929459 - RNA, 19 nt, Human adenovirus D
caguacucccggagcggga

SEQ ID NO: 3929460 - RNA, 14 nt, Human adenovirus D
caguagaaggugag

SEQ ID NO: 3929461 - RNA, 15 nt, Human adenovirus D
caguagaaggugagg

SEQ ID NO: 3929462 - RNA, 20 nt, Human adenovirus D
caguagacaaagagcacagc

SEQ ID NO: 3929463 - RNA, 19 nt, Human adenovirus D
caguauggugaucagccau

SEQ ID NO: 3929464 - RNA, 15 nt, Human adenovirus D
cagucaacuguuaag

SEQ ID NO: 3929465 - RNA, 23 nt, Human adenovirus D
cagucacucucauuucagaacca

SEQ ID NO: 3929466 - RNA, 20 nt, Human adenovirus D
cagucagacccaguggcgag

SEQ ID NO: 3929467 - RNA, 19 nt, Human adenovirus D
caguccaugcccaacaggc

SEQ ID NO: 3929468 - RNA, 13 nt, Human adenovirus D
cagucgcaccuuc

SEQ ID NO: 3929469 - RNA, 13 nt, Human adenovirus D
cagucuccuggug

SEQ ID NO: 3929470 - RNA, 21 nt, Human adenovirus D
cagugaaaacgugccugcucu

SEQ ID NO: 3929471 - RNA, 14 nt, Human adenovirus D
cagugcccccucca

SEQ ID NO: 3929472 - RNA, 16 nt, Human adenovirus D
caguggcccuggaugu

SEQ ID NO: 3929473 - RNA, 14 nt, Human adenovirus D
cagugucucgagga

SEQ ID NO: 3929474 - RNA, 19 nt, Human adenovirus D
caguuauaccaccuccucc

SEQ ID NO: 3929475 - RNA, 15 nt, Human adenovirus D
caguugggagcuguc

SEQ ID NO: 3929476 - RNA, 14 nt, Human adenovirus D
cauaaaucugcccu

SEQ ID NO: 3929477 - RNA, 16 nt, Human adenovirus D
cauacaaagcugaaag

SEQ ID NO: 3929478 - RNA, 20 nt, Human adenovirus D
cauaccugauauugcuuccc

SEQ ID NO: 3929479 - RNA, 12 nt, Human adenovirus D
cauacugcuauc

SEQ ID NO: 3929480 - RNA, 14 nt, Human adenovirus D
cauagucaucaccc

SEQ ID NO: 3929481 - RNA, 23 nt, Human adenovirus D
cauauaucuuggagguuuggcau

SEQ ID NO: 3929482 - RNA, 17 nt, Human adenovirus D
caucaagcaagaugaua

SEQ ID NO: 3929483 - RNA, 17 nt, Human adenovirus D
caucaccaccgucagug

SEQ ID NO: 3929484 - RNA, 20 nt, Human adenovirus D
caucauccaaggccaucugc

SEQ ID NO: 3929485 - RNA, 14 nt, Human adenovirus D
caucauggcccuga

SEQ ID NO: 3929486 - RNA, 23 nt, Human adenovirus D
cauccaagcgggccucacagucc

SEQ ID NO: 3929487 - RNA, 22 nt, Human adenovirus D
cauccacgagauacacagcgcg

SEQ ID NO: 3929488 - RNA, 18 nt, Human adenovirus D
cauccgcgccgcagcccg

SEQ ID NO: 3929489 - RNA, 20 nt, Human adenovirus D
cauccuggaccaggcggcag

SEQ ID NO: 3929490 - RNA, 22 nt, Human adenovirus D
cauccuggaccaggcggcagag

SEQ ID NO: 3929491 - RNA, 16 nt, Human adenovirus D
caucgccgagcccgag

SEQ ID NO: 3929492 - RNA, 20 nt, Human adenovirus D
caucgcgaaccaggcagugc

SEQ ID NO: 3929493 - RNA, 16 nt, Human adenovirus D
caucgcgcaggaggcc

SEQ ID NO: 3929494 - RNA, 20 nt, Human adenovirus D
caucgcggggugaacauccc

SEQ ID NO: 3929495 - RNA, 19 nt, Human adenovirus D
caucggacgacugggaggc

SEQ ID NO: 3929496 - RNA, 20 nt, Human adenovirus D
caucgugcgcgaccugggcu

SEQ ID NO: 3929497 - RNA, 17 nt, Human adenovirus D
caucguugugcgccgcg

SEQ ID NO: 3929498 - RNA, 15 nt, Human adenovirus D
caucuucugccuggu

SEQ ID NO: 3929499 - RNA, 17 nt, Human adenovirus D
caucuuugacauggaug

SEQ ID NO: 3929500 - RNA, 20 nt, Human adenovirus D
caugaaauugcgggugaugc

SEQ ID NO: 3929501 - RNA, 16 nt, Human adenovirus D
caugaacacacugccc

SEQ ID NO: 3929502 - RNA, 21 nt, Human adenovirus D
caugaaggggacgagcugcuu

SEQ ID NO: 3929503 - RNA, 20 nt, Human adenovirus D
caugaaguucaauggagaga

SEQ ID NO: 3929504 - RNA, 18 nt, Human adenovirus D
caugacauggguggggau

SEQ ID NO: 3929505 - RNA, 15 nt, Human adenovirus D
caugaccgcgcgcaa

SEQ ID NO: 3929506 - RNA, 14 nt, Human adenovirus D
caugagcaggcagg

SEQ ID NO: 3929507 - RNA, 16 nt, Human adenovirus D
caugagcugcgagaag

SEQ ID NO: 3929508 - RNA, 17 nt, Human adenovirus D
caugcacaucgccgggc

SEQ ID NO: 3929509 - RNA, 21 nt, Human adenovirus D
caugcagacacuugagcuggc

SEQ ID NO: 3929510 - RNA, 17 nt, Human adenovirus D
caugcccaaugugaacg

SEQ ID NO: 3929511 - RNA, 17 nt, Human adenovirus D
caugccccaggccuggc

SEQ ID NO: 3929512 - RNA, 13 nt, Human adenovirus D
caugcccuuuucc

SEQ ID NO: 3929513 - RNA, 22 nt, Human adenovirus D
caugcgacgcuuuuucagcgac

SEQ ID NO: 3929514 - RNA, 19 nt, Human adenovirus D
caugcgcaggcgccugagu

SEQ ID NO: 3929515 - RNA, 19 nt, Human adenovirus D
caugcucuaccccaucccg

SEQ ID NO: 3929516 - RNA, 13 nt, Human adenovirus D
caugcuggaauaa

SEQ ID NO: 3929517 - RNA, 16 nt, Human adenovirus D
cauggcaggcagcggc

SEQ ID NO: 3929518 - RNA, 22 nt, Human adenovirus D
cauggccagcacguacuuugac

SEQ ID NO: 3929519 - RNA, 21 nt, Human adenovirus D
cauggcccugacgacccgcaa

SEQ ID NO: 3929520 - RNA, 18 nt, Human adenovirus D
cauggccucgugcucugg

SEQ ID NO: 3929521 - RNA, 18 nt, Human adenovirus D
cauggcgcacaacaccgc

SEQ ID NO: 3929522 - RNA, 16 nt, Human adenovirus D
cauggcuaccugggag

SEQ ID NO: 3929523 - RNA, 16 nt, Human adenovirus D
caugggugugcuggcu

SEQ ID NO: 3929524 - RNA, 20 nt, Human adenovirus D
caugugaacaaaacccauga

SEQ ID NO: 3929525 - RNA, 23 nt, Human adenovirus D
caugugugauaucacacugcaug

SEQ ID NO: 3929526 - RNA, 17 nt, Human adenovirus D
cauguuauucagcagcc

SEQ ID NO: 3929527 - RNA, 20 nt, Human adenovirus D
cauguugaaaagcucccaca

SEQ ID NO: 3929528 - RNA, 21 nt, Human adenovirus D
cauucucgaagauucuggaga

SEQ ID NO: 3929529 - RNA, 22 nt, Human adenovirus D
cauugauacccuggacaaggcc

SEQ ID NO: 3929530 - RNA, 20 nt, Human adenovirus D
cauuuaauaaagaucacuua

SEQ ID NO: 3929531 - RNA, 12 nt, Human adenovirus D
ccaaaaucagaa

SEQ ID NO: 3929532 - RNA, 18 nt, Human adenovirus D
ccaacagccuucagcauc

SEQ ID NO: 3929533 - RNA, 15 nt, Human adenovirus D
ccaacggcaaacagc

SEQ ID NO: 3929534 - RNA, 14 nt, Human adenovirus D
ccaacgugcccauc

SEQ ID NO: 3929535 - RNA, 15 nt, Human adenovirus D
ccaagcgggccucac

SEQ ID NO: 3929536 - RNA, 14 nt, Human adenovirus D
ccaaggauaacaug

SEQ ID NO: 3929537 - RNA, 18 nt, Human adenovirus D
ccaaggcacccaccacag

SEQ ID NO: 3929538 - RNA, 18 nt, Human adenovirus D
ccaaucgcgcccgcagca

SEQ ID NO: 3929539 - RNA, 21 nt, Human adenovirus D
ccacaaugugguagcuuacac

SEQ ID NO: 3929540 - RNA, 23 nt, Human adenovirus D
ccacagccuugauuuuuccagcc

SEQ ID NO: 3929541 - RNA, 16 nt, Human adenovirus D
ccacaggugcugccca

SEQ ID NO: 3929542 - RNA, 18 nt, Human adenovirus D
ccacaugacccugcaugg

SEQ ID NO: 3929543 - RNA, 12 nt, Human adenovirus D
ccaccaccugca

SEQ ID NO: 3929544 - RNA, 22 nt, Human adenovirus D
ccaccaugcgccaagggcagcc

SEQ ID NO: 3929545 - RNA, 21 nt, Human adenovirus D
ccaccccuuacauguggagcu

SEQ ID NO: 3929546 - RNA, 18 nt, Human adenovirus D
ccacccuggaagccaugc

SEQ ID NO: 3929547 - RNA, 22 nt, Human adenovirus D
ccacccuugaccugccuccacc

SEQ ID NO: 3929548 - RNA, 16 nt, Human adenovirus D
ccaccgcuaccgcuuc

SEQ ID NO: 3929549 - RNA, 20 nt, Human adenovirus D
ccaccgugugcagacacaug

SEQ ID NO: 3929550 - RNA, 14 nt, Human adenovirus D
ccaccugcggggcg

SEQ ID NO: 3929551 - RNA, 16 nt, Human adenovirus D
ccacgaccggcagcgg

SEQ ID NO: 3929552 - RNA, 23 nt, Human adenovirus D
ccacgaccggcagcggggccugg

SEQ ID NO: 3929553 - RNA, 16 nt, Human adenovirus D
ccacgcccgcuccacc

SEQ ID NO: 3929554 - RNA, 22 nt, Human adenovirus D
ccacgcgcaucaucgcgccacu

SEQ ID NO: 3929555 - RNA, 14 nt, Human adenovirus D
ccacgcgcucgaca

SEQ ID NO: 3929556 - RNA, 14 nt, Human adenovirus D
ccacggggagggcg

SEQ ID NO: 3929557 - RNA, 13 nt, Human adenovirus D
ccacgguggcggc

SEQ ID NO: 3929558 - RNA, 13 nt, Human adenovirus D
ccacgguggugga

SEQ ID NO: 3929559 - RNA, 22 nt, Human adenovirus D
ccacgugguauacaagccagga

SEQ ID NO: 3929560 - RNA, 16 nt, Human adenovirus D
ccacucuauuuucaag

SEQ ID NO: 3929561 - RNA, 12 nt, Human adenovirus D
ccacugcauggc

SEQ ID NO: 3929562 - RNA, 21 nt, Human adenovirus D
ccacugcauggccucgugcuc

SEQ ID NO: 3929563 - RNA, 23 nt, Human adenovirus D
ccacugcuaccucuugcagcugg

SEQ ID NO: 3929564 - RNA, 14 nt, Human adenovirus D
ccacugcuccugcg

SEQ ID NO: 3929565 - RNA, 17 nt, Human adenovirus D
ccacuuccgcgcuccgu

SEQ ID NO: 3929566 - RNA, 12 nt, Human adenovirus D
ccacuuccuuua

SEQ ID NO: 3929567 - RNA, 15 nt, Human adenovirus D
ccagaaaccccgcaa

SEQ ID NO: 3929568 - RNA, 15 nt, Human adenovirus D
ccagaacuuccagca

SEQ ID NO: 3929569 - RNA, 11 nt, Human adenovirus D
ccagaauucaa

SEQ ID NO: 3929570 - RNA, 13 nt, Human adenovirus D
ccagaccaccugg

SEQ ID NO: 3929571 - RNA, 13 nt, Human adenovirus D
ccagaggcagacu

SEQ ID NO: 3929572 - RNA, 15 nt, Human adenovirus D
ccagauugggggacg

SEQ ID NO: 3929573 - RNA, 18 nt, Human adenovirus D
ccagcaauaacaccggcu

SEQ ID NO: 3929574 - RNA, 17 nt, Human adenovirus D
ccagcagaagguggugg

SEQ ID NO: 3929575 - RNA, 17 nt, Human adenovirus D
ccagcaucgaggugcag

SEQ ID NO: 3929576 - RNA, 22 nt, Human adenovirus D
ccagcaugccgaagaagaacag

SEQ ID NO: 3929577 - RNA, 16 nt, Human adenovirus D
ccagccaaagcucaug

SEQ ID NO: 3929578 - RNA, 20 nt, Human adenovirus D
ccagcccaugagcaggcagg

SEQ ID NO: 3929579 - RNA, 22 nt, Human adenovirus D
ccagccgcgguuaugcagggug

SEQ ID NO: 3929580 - RNA, 17 nt, Human adenovirus D
ccagccguaccagugca

SEQ ID NO: 3929581 - RNA, 18 nt, Human adenovirus D
gcuccuggucugcaaccc

SEQ ID NO: 3929582 - RNA, 22 nt, Human adenovirus D
gcuccuucaacgcgcgcugccc

SEQ ID NO: 3929583 - RNA, 23 nt, Human adenovirus D
gcucgaucuccuccuccuggaga

SEQ ID NO: 3929584 - RNA, 19 nt, Human adenovirus D
gcucgccgaggaggcgguc

SEQ ID NO: 3929585 - RNA, 20 nt, Human adenovirus D
gcucgcgcccguagucugga

SEQ ID NO: 3929586 - RNA, 16 nt, Human adenovirus D
gcucgcucguucugcc

SEQ ID NO: 3929587 - RNA, 15 nt, Human adenovirus D
gcucgguuguugaug

SEQ ID NO: 3929588 - RNA, 15 nt, Human adenovirus D
gcucguucugcccac

SEQ ID NO: 3929589 - RNA, 23 nt, Human adenovirus D
gcucucacuugccgccugcgcau

SEQ ID NO: 3929590 - RNA, 18 nt, Human adenovirus D
gcucuucccgcugaacug

SEQ ID NO: 3929591 - RNA, 14 nt, Human adenovirus D
gcucuugcagggaa

SEQ ID NO: 3929592 - RNA, 20 nt, Human adenovirus D
gcugaaacaccugcagcgcc

SEQ ID NO: 3929593 - RNA, 15 nt, Human adenovirus D
gcugaacgccuuccu

SEQ ID NO: 3929594 - RNA, 16 nt, Human adenovirus D
gcugagaccagaccac

SEQ ID NO: 3929595 - RNA, 23 nt, Human adenovirus D
gcugagaccagaccaccugguga

SEQ ID NO: 3929596 - RNA, 22 nt, Human adenovirus D
gcugagcgaccgcgagcugaug

SEQ ID NO: 3929597 - RNA, 22 nt, Human adenovirus D
gcugaggaaucggaucuucccc

SEQ ID NO: 3929598 - RNA, 13 nt, Human adenovirus D
gcugaugcccaac

SEQ ID NO: 3929599 - RNA, 12 nt, Human adenovirus D
gcugauggugac

SEQ ID NO: 3929600 - RNA, 22 nt, Human adenovirus D
gcugaugucgccgauggccucc

SEQ ID NO: 3929601 - RNA, 20 nt, Human adenovirus D
gcugcaaccugugcucuccg

SEQ ID NO: 3929602 - RNA, 17 nt, Human adenovirus D
gcugcacgagcgccagg

SEQ ID NO: 3929603 - RNA, 19 nt, Human adenovirus D
gcugcccgacuucaugagc

SEQ ID NO: 3929604 - RNA, 22 nt, Human adenovirus D
gcugcccguucucgcuggucac

SEQ ID NO: 3929605 - RNA, 14 nt, Human adenovirus D
gcugccgcuggacg

SEQ ID NO: 3929606 - RNA, 14 nt, Human adenovirus D
gcugccggaccuca

SEQ ID NO: 3929607 - RNA, 21 nt, Human adenovirus D
gcugccuugucuaucauucag

SEQ ID NO: 3929608 - RNA, 16 nt, Human adenovirus D
gcugcugaucgcgccc

SEQ ID NO: 3929609 - RNA, 21 nt, Human adenovirus D
gcugcugccgggcugcggggu

SEQ ID NO: 3929610 - RNA, 13 nt, Human adenovirus D
gcugcuggagcug

SEQ ID NO: 3929611 - RNA, 15 nt, Human adenovirus D
gcugcuucugccugg

SEQ ID NO: 3929612 - RNA, 16 nt, Human adenovirus D
gcuggaugcggagccg

SEQ ID NO: 3929613 - RNA, 16 nt, Human adenovirus D
gcuggaugugcccaag

SEQ ID NO: 3929614 - RNA, 12 nt, Human adenovirus D
gcuggcccugcu

SEQ ID NO: 3929615 - RNA, 16 nt, Human adenovirus D
gcuggccgagcuggaa

SEQ ID NO: 3929616 - RNA, 17 nt, Human adenovirus D
gcuggccgagcuggaag

SEQ ID NO: 3929617 - RNA, 15 nt, Human adenovirus D
gcuggcgaucgugaa

SEQ ID NO: 3929618 - RNA, 21 nt, Human adenovirus D
gcuggcgguagagcggccagc

SEQ ID NO: 3929619 - RNA, 14 nt, Human adenovirus D
gcuggcugcuggag

SEQ ID NO: 3929620 - RNA, 14 nt, Human adenovirus D
gcugggcguggugc

SEQ ID NO: 3929621 - RNA, 15 nt, Human adenovirus D
gcugggcguggugcu

SEQ ID NO: 3929622 - RNA, 13 nt, Human adenovirus D
gcugggcugggac

SEQ ID NO: 3929623 - RNA, 13 nt, Human adenovirus D
gcuguaaagccag

SEQ ID NO: 3929624 - RNA, 13 nt, Human adenovirus D
gcuguccacgggg

SEQ ID NO: 3929625 - RNA, 15 nt, Human adenovirus D
gcuuccguugcgcug

SEQ ID NO: 3929626 - RNA, 16 nt, Human adenovirus D
gcuucgaagagccggc

SEQ ID NO: 3929627 - RNA, 15 nt, Human adenovirus D
gcuucuacagccagc

SEQ ID NO: 3929628 - RNA, 19 nt, Human adenovirus D
gcuucugccuggugaaggg

SEQ ID NO: 3929629 - RNA, 15 nt, Human adenovirus D
gcuugccgggcucug

SEQ ID NO: 3929630 - RNA, 17 nt, Human adenovirus D
gcuugcuggaugcggag

SEQ ID NO: 3929631 - RNA, 23 nt, Human adenovirus D
gcuugguacccgcgacccccagg

SEQ ID NO: 3929632 - RNA, 18 nt, Human adenovirus D
ggaaacagacagccaggu

SEQ ID NO: 3929633 - RNA, 20 nt, Human adenovirus D
ggaaaggaauaggcacugaa

SEQ ID NO: 3929634 - RNA, 19 nt, Human adenovirus D
ggaaauguucugauuauug

SEQ ID NO: 3929635 - RNA, 22 nt, Human adenovirus D
ggaacucgucgcuugacagcac

SEQ ID NO: 3929636 - RNA, 14 nt, Human adenovirus D
ggaacugaugaaaa

SEQ ID NO: 3929637 - RNA, 18 nt, Human adenovirus D
ggaagaaaugaggcaggc

SEQ ID NO: 3929638 - RNA, 11 nt, Human adenovirus D
ggaagaagagc

SEQ ID NO: 3929639 - RNA, 14 nt, Human adenovirus D
ggaagauggaggag

SEQ ID NO: 3929640 - RNA, 16 nt, Human adenovirus D
ggaaggcuacaacgug

SEQ ID NO: 3929641 - RNA, 15 nt, Human adenovirus D
ggaauggcacgcucu

SEQ ID NO: 3929642 - RNA, 15 nt, Human adenovirus D
ggaauuaccucaucg

SEQ ID NO: 3929643 - RNA, 21 nt, Human adenovirus D
ggacacgcuguaccgcagcug

SEQ ID NO: 3929644 - RNA, 17 nt, Human adenovirus D
ggaccaaccccacgcac

SEQ ID NO: 3929645 - RNA, 15 nt, Human adenovirus D
ggaccaccccaggcg

SEQ ID NO: 3929646 - RNA, 17 nt, Human adenovirus D
ggaccaggcggcagagc

SEQ ID NO: 3929647 - RNA, 19 nt, Human adenovirus D
ggacccugugaccaagcug

SEQ ID NO: 3929648 - RNA, 14 nt, Human adenovirus D
ggaccgccagcgcg

SEQ ID NO: 3929649 - RNA, 23 nt, Human adenovirus D
ggacgccucggaguaccugagcc

SEQ ID NO: 3929650 - RNA, 22 nt, Human adenovirus D
ggacggccaggccuccgagcag

SEQ ID NO: 3929651 - RNA, 22 nt, Human adenovirus D
ggagaacgaugccuucuccagg

SEQ ID NO: 3929652 - RNA, 14 nt, Human adenovirus D
ggagacgggcugcu

SEQ ID NO: 3929653 - RNA, 14 nt, Human adenovirus D
ggagaggcauggca

SEQ ID NO: 3929654 - RNA, 15 nt, Human adenovirus D
ggagauggaagaugc

SEQ ID NO: 3929655 - RNA, 15 nt, Human adenovirus D
ggagcacgcccgcca

SEQ ID NO: 3929656 - RNA, 23 nt, Human adenovirus D
ggagcagccgcguaagcaggagc

SEQ ID NO: 3929657 - RNA, 22 nt, Human adenovirus D
ggagcagugucuggagcgggcu

SEQ ID NO: 3929658 - RNA, 21 nt, Human adenovirus D
ggagccaggggaugaacagug

SEQ ID NO: 3929659 - RNA, 14 nt, Human adenovirus D
ggagcgaggugugc

SEQ ID NO: 3929660 - RNA, 13 nt, Human adenovirus D
ggagcggucugga

SEQ ID NO: 3929661 - RNA, 15 nt, Human adenovirus D
ggagcucuugcaggg

SEQ ID NO: 3929662 - RNA, 19 nt, Human adenovirus D
ggagcugaucucgcugccg

SEQ ID NO: 3929663 - RNA, 11 nt, Human adenovirus D
ggaggcagagc

SEQ ID NO: 3929664 - RNA, 16 nt, Human adenovirus D
ggaggccacgugcgag

SEQ ID NO: 3929665 - RNA, 20 nt, Human adenovirus D
ggaggccgugaaggccggca

SEQ ID NO: 3929666 - RNA, 19 nt, Human adenovirus D
ggaggcgaagauggggccc

SEQ ID NO: 3929667 - RNA, 20 nt, Human adenovirus D
ggaggcgguccccgcccagc

SEQ ID NO: 3929668 - RNA, 19 nt, Human adenovirus D
ggaggcggugcgcacgccc

SEQ ID NO: 3929669 - RNA, 18 nt, Human adenovirus D
ggagggauugcagggcgu

SEQ ID NO: 3929670 - RNA, 22 nt, Human adenovirus D
ggagggggggaucauguccacc

SEQ ID NO: 3929671 - RNA, 20 nt, Human adenovirus D
  misc_feature (7)..(7): n is a, c, g or u
ggagucnuacuucgacaugg

SEQ ID NO: 3929672 - RNA, 23 nt, Human adenovirus D
ggaucgacgguggacgggcgccc

SEQ ID NO: 3929673 - RNA, 13 nt, Human adenovirus D
ggaucgccaggcc

SEQ ID NO: 3929674 - RNA, 17 nt, Human adenovirus D
ggaugaugaccgagcug

SEQ ID NO: 3929675 - RNA, 20 nt, Human adenovirus D
ggaugcagccaguggcccug

SEQ ID NO: 3929676 - RNA, 13 nt, Human adenovirus D
ggaugcaugcggg

SEQ ID NO: 3929677 - RNA, 15 nt, Human adenovirus D
ggaugcggagccgcu

SEQ ID NO: 3929678 - RNA, 21 nt, Human adenovirus D
ggauguaaguuuuauggcugc

SEQ ID NO: 3929679 - RNA, 15 nt, Human adenovirus D
ggaugugcccaagua

SEQ ID NO: 3929680 - RNA, 17 nt, Human adenovirus D
ggcaaagcgguugagcu

SEQ ID NO: 3929681 - RNA, 19 nt, Human adenovirus D
ggcaaagcucaacccgcgu

SEQ ID NO: 3929682 - RNA, 21 nt, Human adenovirus D
ggcaacaccugggcacuggag

SEQ ID NO: 3929683 - RNA, 23 nt, Human adenovirus D
ggcaaugcuagagugaggcacug

SEQ ID NO: 3929684 - RNA, 20 nt, Human adenovirus D
ggcacggucuucgcccugcg

SEQ ID NO: 3929685 - RNA, 21 nt, Human adenovirus D
ggcacugcucuucccuggaga

SEQ ID NO: 3929686 - RNA, 20 nt, Human adenovirus D
ggcagacgcugaaaggcggg

SEQ ID NO: 3929687 - RNA, 17 nt, Human adenovirus D
ggcagagcucuuaagaa

SEQ ID NO: 3929688 - RNA, 15 nt, Human adenovirus D
ggcagccgagccggc

SEQ ID NO: 3929689 - RNA, 21 nt, Human adenovirus D
ggcagccgagccggcgcgccu

SEQ ID NO: 3929690 - RNA, 17 nt, Human adenovirus D
ggcagccgcagccgcca

SEQ ID NO: 3929691 - RNA, 15 nt, Human adenovirus D
ggcagcggggccugg

SEQ ID NO: 3929692 - RNA, 18 nt, Human adenovirus D
ggcagcggggccuggugu

SEQ ID NO: 3929693 - RNA, 18 nt, Human adenovirus D
ggcagcggugguggaggc

SEQ ID NO: 3929694 - RNA, 18 nt, Human adenovirus D
ggcaggccauggacgaga

SEQ ID NO: 3929695 - RNA, 13 nt, Human adenovirus D
ggcagggugagcc

SEQ ID NO: 3929696 - RNA, 18 nt, Human adenovirus D
ggcaucucgauccagcag

SEQ ID NO: 3929697 - RNA, 18 nt, Human adenovirus D
gugaugagcugcgaggag

SEQ ID NO: 3929698 - RNA, 14 nt, Human adenovirus D
gugaugccuuccaa

SEQ ID NO: 3929699 - RNA, 18 nt, Human adenovirus D
gugaugcuucaacagcug

SEQ ID NO: 3929700 - RNA, 17 nt, Human adenovirus D
gugcacucccaguucuu

SEQ ID NO: 3929701 - RNA, 18 nt, Human adenovirus D
gugcagaacccggacagc

SEQ ID NO: 3929702 - RNA, 11 nt, Human adenovirus D
gugcagcugca

SEQ ID NO: 3929703 - RNA, 22 nt, Human adenovirus D
gugccucccgcccgacacugca

SEQ ID NO: 3929704 - RNA, 14 nt, Human adenovirus D
gugcgaggaugaga

SEQ ID NO: 3929705 - RNA, 14 nt, Human adenovirus D
gugcgaggggccaa

SEQ ID NO: 3929706 - RNA, 16 nt, Human adenovirus D
gugcgaguuggaggag

SEQ ID NO: 3929707 - RNA, 22 nt, Human adenovirus D
gugcgcccggcguacgugccug

SEQ ID NO: 3929708 - RNA, 16 nt, Human adenovirus D
gugcgcgaccugggcu

SEQ ID NO: 3929709 - RNA, 17 nt, Human adenovirus D
gugcgcgaccugggcug

SEQ ID NO: 3929710 - RNA, 22 nt, Human adenovirus D
gugcgcgacuccgucacgggcg

SEQ ID NO: 3929711 - RNA, 12 nt, Human adenovirus D
gugcgcuggggc

SEQ ID NO: 3929712 - RNA, 22 nt, Human adenovirus D
gugcgucgagcacagcaccgca

SEQ ID NO: 3929713 - RNA, 14 nt, Human adenovirus D
gugcugacauccau

SEQ ID NO: 3929714 - RNA, 19 nt, Human adenovirus D
gugcugccccaggcggugc

SEQ ID NO: 3929715 - RNA, 14 nt, Human adenovirus D
gugcuggagagcga

SEQ ID NO: 3929716 - RNA, 17 nt, Human adenovirus D
gugcuggaggguugaaa

SEQ ID NO: 3929717 - RNA, 20 nt, Human adenovirus D
guggaaacagacagccaggu

SEQ ID NO: 3929718 - RNA, 15 nt, Human adenovirus D
guggacgcugcucac

SEQ ID NO: 3929719 - RNA, 17 nt, Human adenovirus D
guggacuauccuugcag

SEQ ID NO: 3929720 - RNA, 22 nt, Human adenovirus D
guggacuuccgcguaccugcgc

SEQ ID NO: 3929721 - RNA, 14 nt, Human adenovirus D
guggagccacugcu

SEQ ID NO: 3929722 - RNA, 16 nt, Human adenovirus D
guggagcccgagguca

SEQ ID NO: 3929723 - RNA, 22 nt, Human adenovirus D
guggagcugaccaacuggucuc

SEQ ID NO: 3929724 - RNA, 18 nt, Human adenovirus D
guggagggcaugggucag

SEQ ID NO: 3929725 - RNA, 17 nt, Human adenovirus D
guggccuuguaccugcc

SEQ ID NO: 3929726 - RNA, 16 nt, Human adenovirus D
guggcgcucgggcagg

SEQ ID NO: 3929727 - RNA, 19 nt, Human adenovirus D
guggcuagaaaacacccac

SEQ ID NO: 3929728 - RNA, 23 nt, Human adenovirus D
guggcuauuuucacugaaggaaa

SEQ ID NO: 3929729 - RNA, 19 nt, Human adenovirus D
gugggaccuggcggaggcc

SEQ ID NO: 3929730 - RNA, 15 nt, Human adenovirus D
gugggccccuggcug

SEQ ID NO: 3929731 - RNA, 16 nt, Human adenovirus D
gugggcguacaugcac

SEQ ID NO: 3929732 - RNA, 14 nt, Human adenovirus D
gugggcguggggca

SEQ ID NO: 3929733 - RNA, 16 nt, Human adenovirus D
gugggcguggggcaag

SEQ ID NO: 3929734 - RNA, 16 nt, Human adenovirus D
guggucagcgaugagc

SEQ ID NO: 3929735 - RNA, 22 nt, Human adenovirus D
guggucauugauacccuggaca

SEQ ID NO: 3929736 - RNA, 23 nt, Human adenovirus D
guguaucucaauaaacagcacuu

SEQ ID NO: 3929737 - RNA, 17 nt, Human adenovirus D
gugucccugaccaugac

SEQ ID NO: 3929738 - RNA, 14 nt, Human adenovirus D
gugucuuccucucc

SEQ ID NO: 3929739 - RNA, 19 nt, Human adenovirus D
gugucuuccucuccuccuc

SEQ ID NO: 3929740 - RNA, 22 nt, Human adenovirus D
gugugauuaaaaagcagcacag

SEQ ID NO: 3929741 - RNA, 16 nt, Human adenovirus D
guguugcggcccggca

SEQ ID NO: 3929742 - RNA, 16 nt, Human adenovirus D
guuacuguaaagccac

SEQ ID NO: 3929743 - RNA, 18 nt, Human adenovirus D
guuagguucuucacccag

SEQ ID NO: 3929744 - RNA, 20 nt, Human adenovirus D
guucaagaacgagggccugg

SEQ ID NO: 3929745 - RNA, 19 nt, Human adenovirus D
guuccagacgcggcuguag

SEQ ID NO: 3929746 - RNA, 22 nt, Human adenovirus D
guuccagauguugcgcagcggc

SEQ ID NO: 3929747 - RNA, 19 nt, Human adenovirus D
guuccccuccgcugugcug

SEQ ID NO: 3929748 - RNA, 19 nt, Human adenovirus D
guuccgaauuaccgaggaa

SEQ ID NO: 3929749 - RNA, 16 nt, Human adenovirus D
guucgacguggucaga

SEQ ID NO: 3929750 - RNA, 16 nt, Human adenovirus D
guucuacccagcaagu

SEQ ID NO: 3929751 - RNA, 16 nt, Human adenovirus D
guucucgcuggucaca

SEQ ID NO: 3929752 - RNA, 14 nt, Human adenovirus D
guugaggguggugg

SEQ ID NO: 3929753 - RNA, 14 nt, Human adenovirus D
guuggcuugcccug

SEQ ID NO: 3929754 - RNA, 19 nt, Human adenovirus D
guugucugugggaucuuua

SEQ ID NO: 3929755 - RNA, 18 nt, Human adenovirus D
guuuaugacucaugggcg

SEQ ID NO: 3929756 - RNA, 16 nt, Human adenovirus D
guuucucaacagcugg

SEQ ID NO: 3929757 - RNA, 19 nt, Human adenovirus D
guuucucaacagcugggac

SEQ ID NO: 3929758 - RNA, 15 nt, Human adenovirus D
guuugcccgcgccac

SEQ ID NO: 3929759 - RNA, 18 nt, Human adenovirus D
uaaaaacaacaaaaccac

SEQ ID NO: 3929760 - RNA, 12 nt, Human adenovirus D
uaaaaacccugg

SEQ ID NO: 3929761 - RNA, 20 nt, Human adenovirus D
uaaacuaaagccaaacacac

SEQ ID NO: 3929762 - RNA, 18 nt, Human adenovirus D
uaaauuuaaaaccucauu

SEQ ID NO: 3929763 - RNA, 16 nt, Human adenovirus D
uaacaccggcuggggu

SEQ ID NO: 3929764 - RNA, 18 nt, Human adenovirus D
uaaccaucgaaaccagau

SEQ ID NO: 3929765 - RNA, 22 nt, Human adenovirus D
uaagaauccacagaucagacau

SEQ ID NO: 3929766 - RNA, 23 nt, Human adenovirus D
uaagacauaacugggugaugcuu

SEQ ID NO: 3929767 - RNA, 16 nt, Human adenovirus D
uaauuaagguuacuuu

SEQ ID NO: 3929768 - RNA, 21 nt, Human adenovirus D
uaauucagggugcuccagcca

SEQ ID NO: 3929769 - RNA, 17 nt, Human adenovirus D
uaauucucaaaguguga

SEQ ID NO: 3929770 - RNA, 16 nt, Human adenovirus D
uacaaagcugaaagcu

SEQ ID NO: 3929771 - RNA, 19 nt, Human adenovirus D
uacaacaguacuggcaaca

SEQ ID NO: 3929772 - RNA, 17 nt, Human adenovirus D
uacaaccaaggcaccca

SEQ ID NO: 3929773 - RNA, 21 nt, Human adenovirus D
uacaagagagaugcuccaggu

SEQ ID NO: 3929774 - RNA, 18 nt, Human adenovirus D
uacaagcgccaacagcag

SEQ ID NO: 3929775 - RNA, 16 nt, Human adenovirus D
uacacacuagaaagca

SEQ ID NO: 3929776 - RNA, 21 nt, Human adenovirus D
uacaccaggccuacuacuccu

SEQ ID NO: 3929777 - RNA, 14 nt, Human adenovirus D
uacacucgcagugc

SEQ ID NO: 3929778 - RNA, 14 nt, Human adenovirus D
uacaugcccagcag

SEQ ID NO: 3929779 - RNA, 20 nt, Human adenovirus D
uacaugcccucucaacauca

SEQ ID NO: 3929780 - RNA, 22 nt, Human adenovirus D
uaccauugcaaggcagaaucaa

SEQ ID NO: 3929781 - RNA, 18 nt, Human adenovirus D
uacccaacaaccuuacca

SEQ ID NO: 3929782 - RNA, 22 nt, Human adenovirus D
uaccccgguucgaguccccucg

SEQ ID NO: 3929783 - RNA, 13 nt, Human adenovirus D
uaccuucgagcug

SEQ ID NO: 3929784 - RNA, 14 nt, Human adenovirus D
uacgugcccuucca

SEQ ID NO: 3929785 - RNA, 15 nt, Human adenovirus D
uacgugcccuuccac

SEQ ID NO: 3929786 - RNA, 22 nt, Human adenovirus D
uacuuuuaaugaagaagcagau

SEQ ID NO: 3929787 - RNA, 23 nt, Human adenovirus D
uagaaacagauccugcugcucca

SEQ ID NO: 3929788 - RNA, 15 nt, Human adenovirus D
uagaagugacaauuu

SEQ ID NO: 3929789 - RNA, 19 nt, Human adenovirus D
uagacaaagagcacagcag

SEQ ID NO: 3929790 - RNA, 21 nt, Human adenovirus D
uagacaaagagcacagcagua

SEQ ID NO: 3929791 - RNA, 15 nt, Human adenovirus D
uagacauggccagca

SEQ ID NO: 3929792 - RNA, 13 nt, Human adenovirus D
uagagcggccagc

SEQ ID NO: 3929793 - RNA, 20 nt, Human adenovirus D
uagagggcguuggagagaag

SEQ ID NO: 3929794 - RNA, 15 nt, Human adenovirus D
uagcacggggcaguu

SEQ ID NO: 3929795 - RNA, 19 nt, Human adenovirus D
uagcacguuucgucaggca

SEQ ID NO: 3929796 - RNA, 18 nt, Human adenovirus D
uagcagcccuguggacgc

SEQ ID NO: 3929797 - RNA, 16 nt, Human adenovirus D
uaggggacgugagcgc

SEQ ID NO: 3929798 - RNA, 19 nt, Human adenovirus D
uagguucuucacccagcaa

SEQ ID NO: 3929799 - RNA, 16 nt, Human adenovirus D
uaguaaagaaacagaa

SEQ ID NO: 3929800 - RNA, 19 nt, Human adenovirus D
uagucaucacccagcaguc

SEQ ID NO: 3929801 - RNA, 13 nt, Human adenovirus D
uaguccagcagag

SEQ ID NO: 3929802 - RNA, 22 nt, Human adenovirus D
uagugggcguggcuaaggugac

SEQ ID NO: 3929803 - RNA, 16 nt, Human adenovirus D
uaguuguucagcagca

SEQ ID NO: 3929804 - RNA, 13 nt, Human adenovirus D
uaucauucagagg

SEQ ID NO: 3929805 - RNA, 15 nt, Human adenovirus D
uauggccuggagcag

SEQ ID NO: 3929806 - RNA, 18 nt, Human adenovirus D
uauggugaucagccauga

SEQ ID NO: 3929807 - RNA, 17 nt, Human adenovirus D
uauuacuaggcccagca

SEQ ID NO: 3929808 - RNA, 15 nt, Human adenovirus D
uauuagaugacaaaa

SEQ ID NO: 3929809 - RNA, 16 nt, Human adenovirus D
ucaaaacucacuuugg

SEQ ID NO: 3929810 - RNA, 22 nt, Human adenovirus D
ucaaagaccagaacuuccagca

SEQ ID NO: 3929811 - RNA, 16 nt, Human adenovirus D
ucaaaguaaaaaaccg

SEQ ID NO: 3929812 - RNA, 21 nt, Human adenovirus D
ucaacagcugggacuugccgc

SEQ ID NO: 3929813 - RNA, 22 nt, Human adenovirus D
ucaacaucacauucaaaaaccg

SEQ ID NO: 3929814 - RNA, 15 nt, Human adenovirus D
ucaaccccuucaacc

SEQ ID NO: 3929815 - RNA, 17 nt, Human adenovirus D
ucaaccuccaggccaac

SEQ ID NO: 3929816 - RNA, 20 nt, Human adenovirus D
ucaacguuucucggccaauc

SEQ ID NO: 3929817 - RNA, 17 nt, Human adenovirus D
ucaaguuugacagcaga

SEQ ID NO: 3929818 - RNA, 22 nt, Human adenovirus D
ucacacuacacagcuagacacc

SEQ ID NO: 3929819 - RNA, 14 nt, Human adenovirus D
ucacagucuggugg

SEQ ID NO: 3929820 - RNA, 18 nt, Human adenovirus D
ucacaguuauaccaccuc

SEQ ID NO: 3929821 - RNA, 20 nt, Human adenovirus D
ucacauuaaaggcuggcccu

SEQ ID NO: 3929822 - RNA, 12 nt, Human adenovirus D
ucaccaaggcca

SEQ ID NO: 3929823 - RNA, 20 nt, Human adenovirus D
ucaccauguuauucagcagc

SEQ ID NO: 3929824 - RNA, 21 nt, Human adenovirus D
ucaccauguuauucagcagcc

SEQ ID NO: 3929825 - RNA, 18 nt, Human adenovirus D
ucacccggacguggugcu

SEQ ID NO: 3929826 - RNA, 19 nt, Human adenovirus D
ucaccgagccucccaggag

SEQ ID NO: 3929827 - RNA, 23 nt, Human adenovirus D
ucaccuaugagaugccccagcag

SEQ ID NO: 3929828 - RNA, 16 nt, Human adenovirus D
ucaccuuccugcagcu

SEQ ID NO: 3929829 - RNA, 17 nt, Human adenovirus D
ucaccuuccugcagcuc

SEQ ID NO: 3929830 - RNA, 15 nt, Human adenovirus D
ucacucuggccgugg

SEQ ID NO: 3929831 - RNA, 17 nt, Human adenovirus D
ucacucuggccgugggc

SEQ ID NO: 3929832 - RNA, 20 nt, Human adenovirus D
ucacucuggccgugggcgac

SEQ ID NO: 3929833 - RNA, 17 nt, Human adenovirus D
ucacucuuuccagcagc

SEQ ID NO: 3929834 - RNA, 18 nt, Human adenovirus D
ucacucuuuccagcagca

SEQ ID NO: 3929835 - RNA, 15 nt, Human adenovirus D
ucacuugccgccugc

SEQ ID NO: 3929836 - RNA, 16 nt, Human adenovirus D
ucagagugcaccagcc

SEQ ID NO: 3929837 - RNA, 13 nt, Human adenovirus D
ucagcacugcaaa

SEQ ID NO: 3929838 - RNA, 17 nt, Human adenovirus D
ucagcagucucugccgc

SEQ ID NO: 3929839 - RNA, 15 nt, Human adenovirus D
ucagccauagcucag

SEQ ID NO: 3929840 - RNA, 20 nt, Human adenovirus D
ucagcuaaucaugccccaca

SEQ ID NO: 3929841 - RNA, 18 nt, Human adenovirus D
ucaggcgcaaccaggagg

SEQ ID NO: 3929842 - RNA, 19 nt, Human adenovirus D
ucaggcgcaaccaggagga

SEQ ID NO: 3929843 - RNA, 13 nt, Human adenovirus D
ucagggugcucca

SEQ ID NO: 3929844 - RNA, 14 nt, Human adenovirus D
ucaucacccagcag

SEQ ID NO: 3929845 - RNA, 19 nt, Human adenovirus D
ucaucgcgccacuggccac

SEQ ID NO: 3929846 - RNA, 18 nt, Human adenovirus D
ucaucguugugcgccgcg

SEQ ID NO: 3929847 - RNA, 23 nt, Human adenovirus D
ucaucguugugcgccgcgcuggg

SEQ ID NO: 3929848 - RNA, 17 nt, Human adenovirus D
ucaugaacacacugccc

SEQ ID NO: 3929849 - RNA, 19 nt, Human adenovirus D
ucaugccacgaacagccac

SEQ ID NO: 3929850 - RNA, 18 nt, Human adenovirus D
ucauggaggcccacaaag

SEQ ID NO: 3929851 - RNA, 20 nt, Human adenovirus D
ucauggccaacagccacaug

SEQ ID NO: 3929852 - RNA, 21 nt, Human adenovirus D
ucauggccaacagccacauga

SEQ ID NO: 3929853 - RNA, 18 nt, Human adenovirus D
ucauugacggcgggcuga

SEQ ID NO: 3929854 - RNA, 20 nt, Human adenovirus D
uccaaaauggcuuacauguc

SEQ ID NO: 3929855 - RNA, 14 nt, Human adenovirus D
uccaacguggagcu

SEQ ID NO: 3929856 - RNA, 17 nt, Human adenovirus D
uccaacucuuaaaucau

SEQ ID NO: 3929857 - RNA, 18 nt, Human adenovirus D
uccaaggccaucugccac

SEQ ID NO: 3929858 - RNA, 17 nt, Human adenovirus D
uccacagaucagacaua

SEQ ID NO: 3929859 - RNA, 22 nt, Human adenovirus D
uccaccacccacgcccgcucca

SEQ ID NO: 3929860 - RNA, 15 nt, Human adenovirus D
uccaccugcggggcg

SEQ ID NO: 3929861 - RNA, 16 nt, Human adenovirus D
uccacgcauugcauga

SEQ ID NO: 3929862 - RNA, 18 nt, Human adenovirus D
uccacgccaagacaaagg

SEQ ID NO: 3929863 - RNA, 12 nt, Human adenovirus D
uccacugcuccu

SEQ ID NO: 3929864 - RNA, 21 nt, Human adenovirus D
uccagcagcaggguacccacu

SEQ ID NO: 3929865 - RNA, 22 nt, Human adenovirus D
uccagcagcaggguacccacug

SEQ ID NO: 3929866 - RNA, 15 nt, Human adenovirus D
uccagcccagggcgc

SEQ ID NO: 3929867 - RNA, 14 nt, Human adenovirus D
uccagcuggccggc

SEQ ID NO: 3929868 - RNA, 14 nt, Human adenovirus D
uccaguaggaacca

SEQ ID NO: 3929869 - RNA, 17 nt, Human adenovirus D
uccaguaggaaccagca

SEQ ID NO: 3929870 - RNA, 17 nt, Human adenovirus D
uccaucgauuucaucaa

SEQ ID NO: 3929871 - RNA, 24 nt, Human adenovirus D
uccaucgugcgcgaccugggcugc

SEQ ID NO: 3929872 - RNA, 16 nt, Human adenovirus D
uccaugaucuuuauga

SEQ ID NO: 3929873 - RNA, 19 nt, Human adenovirus D
uccaugcgaauuccccuca

SEQ ID NO: 3929874 - RNA, 15 nt, Human adenovirus D
ucccacagggcacug

SEQ ID NO: 3929875 - RNA, 19 nt, Human adenovirus D
ucccacagugcccccucca

SEQ ID NO: 3929876 - RNA, 16 nt, Human adenovirus D
ucccacgccgagccug

SEQ ID NO: 3929877 - RNA, 17 nt, Human adenovirus D
ucccaggcuuucaucuc

SEQ ID NO: 3929878 - RNA, 12 nt, Human adenovirus D
uccccccugggg

SEQ ID NO: 3929879 - RNA, 18 nt, Human adenovirus D
uccccccuuugucuccuc

SEQ ID NO: 3929880 - RNA, 16 nt, Human adenovirus D
uccccgcccugcugga

SEQ ID NO: 3929881 - RNA, 15 nt, Human adenovirus D
ucccgacgaggccgg

SEQ ID NO: 3929882 - RNA, 20 nt, Human adenovirus D
ucccgcccgacacugcaggg

SEQ ID NO: 3929883 - RNA, 15 nt, Human adenovirus D
ucccgccgcaggaga

SEQ ID NO: 3929884 - RNA, 13 nt, Human adenovirus D
ucccgcucccagc

SEQ ID NO: 3929885 - RNA, 23 nt, Human adenovirus D
ucccggaggaggggggccaccuc

SEQ ID NO: 3929886 - RNA, 13 nt, Human adenovirus D
ucccucccucggc

SEQ ID NO: 3929887 - RNA, 19 nt, Human adenovirus D
ucccucccucggcucgggu

SEQ ID NO: 3929888 - RNA, 13 nt, Human adenovirus D
uccgcaccgcucc

SEQ ID NO: 3929889 - RNA, 22 nt, Human adenovirus D
uccgcagcuacaccucccucac

SEQ ID NO: 3929890 - RNA, 18 nt, Human adenovirus D
uccgcagugggcgcagac

SEQ ID NO: 3929891 - RNA, 22 nt, Human adenovirus D
uccgcggccacuuccgcgcucc

SEQ ID NO: 3929892 - RNA, 20 nt, Human adenovirus D
uccgguugugcagcccccuc

SEQ ID NO: 3929893 - RNA, 20 nt, Human adenovirus D
uccugaaccacacggccagc

SEQ ID NO: 3929894 - RNA, 16 nt, Human adenovirus D
uccugaagaacaucca

SEQ ID NO: 3929895 - RNA, 16 nt, Human adenovirus D
uccugcacgcagcagc

SEQ ID NO: 3929896 - RNA, 13 nt, Human adenovirus D
uccugccugggaa

SEQ ID NO: 3929897 - RNA, 18 nt, Human adenovirus D
uccuggacgggagcaauc

SEQ ID NO: 3929898 - RNA, 14 nt, Human adenovirus D
uccuggucacccuc

SEQ ID NO: 3929899 - RNA, 15 nt, Human adenovirus D
uccuggucugcaacc

SEQ ID NO: 3929900 - RNA, 19 nt, Human adenovirus D
uccuggugguacagcacag

SEQ ID NO: 3929901 - RNA, 22 nt, Human adenovirus D
uccugucacucaaacuggcuga

SEQ ID NO: 3929902 - RNA, 20 nt, Human adenovirus D
uccuucaacgacuaccucuc

SEQ ID NO: 3929903 - RNA, 22 nt, Human adenovirus D
ucgaagauucuggagaaguucc

SEQ ID NO: 3929904 - RNA, 23 nt, Human adenovirus D
ucgacagcgucaaccucuacgcc

SEQ ID NO: 3929905 - RNA, 21 nt, Human adenovirus D
ucgacggggaaggcuacaacg

SEQ ID NO: 3929906 - RNA, 19 nt, Human adenovirus D
ucgagccgaacgagcagac

SEQ ID NO: 3929907 - RNA, 15 nt, Human adenovirus D
ucgaggacggagagg

SEQ ID NO: 3929908 - RNA, 17 nt, Human adenovirus D
ucgcaagcgcccagagc

SEQ ID NO: 3929909 - RNA, 24 nt, Human adenovirus D
ucgcacucgacgagccaggugagc

SEQ ID NO: 3929910 - RNA, 13 nt, Human adenovirus D
ucgccgagcccga

SEQ ID NO: 3929911 - RNA, 15 nt, Human adenovirus D
ucgccgcgcaggggc

SEQ ID NO: 3929912 - RNA, 18 nt, Human adenovirus D
ucgccgucuacucccagc

SEQ ID NO: 3929913 - RNA, 16 nt, Human adenovirus D
ucgccucggaccuggc

SEQ ID NO: 3929914 - RNA, 18 nt, Human adenovirus D
ucgcgcaacugggccgcu

SEQ ID NO: 3929915 - RNA, 17 nt, Human adenovirus D
ucgcgcaggaggccauc

SEQ ID NO: 3929916 - RNA, 13 nt, Human adenovirus D
ucgcgcaggccgc

SEQ ID NO: 3929917 - RNA, 17 nt, Human adenovirus D
ucgcugccgcuggacga

SEQ ID NO: 3929918 - RNA, 14 nt, Human adenovirus D
ucgcuggcugcugg

SEQ ID NO: 3929919 - RNA, 16 nt, Human adenovirus D
ucggaaaacaggaugg

SEQ ID NO: 3929920 - RNA, 16 nt, Human adenovirus D
ucggagggggggauca

SEQ ID NO: 3929921 - RNA, 18 nt, Human adenovirus D
ucggaguaccugagccgc

SEQ ID NO: 3929922 - RNA, 19 nt, Human adenovirus D
ucggccgaggaggagcgca

SEQ ID NO: 3929923 - RNA, 19 nt, Human adenovirus D
ucggcgcuuggugggcaga

SEQ ID NO: 3929924 - RNA, 17 nt, Human adenovirus D
ucggcucgacgcuccgg

SEQ ID NO: 3929925 - RNA, 15 nt, Human adenovirus D
ucggggcauugcagg

SEQ ID NO: 3929926 - RNA, 15 nt, Human adenovirus D
ucgguacccuccucc

SEQ ID NO: 3929927 - RNA, 16 nt, Human adenovirus D
ucguacuucugccagc

SEQ ID NO: 3929928 - RNA, 17 nt, Human adenovirus D
ucguacuucugccagca

SEQ ID NO: 3929929 - RNA, 14 nt, Human adenovirus D
uuacucuaaaugca

SEQ ID NO: 3929930 - RNA, 12 nt, Human adenovirus D
uuaucugcuggg

SEQ ID NO: 3929931 - RNA, 17 nt, Human adenovirus D
uucaaaacucacuuugg

SEQ ID NO: 3929932 - RNA, 18 nt, Human adenovirus D
uucaauaagguucugccc

SEQ ID NO: 3929933 - RNA, 12 nt, Human adenovirus D
uucacagagagc

SEQ ID NO: 3929934 - RNA, 14 nt, Human adenovirus D
uucagauccccacc

SEQ ID NO: 3929935 - RNA, 19 nt, Human adenovirus D
uucagccauagcucagccc

SEQ ID NO: 3929936 - RNA, 13 nt, Human adenovirus D
uuccagcccaggg

SEQ ID NO: 3929937 - RNA, 19 nt, Human adenovirus D
uuccaggagaucacuagcg

SEQ ID NO: 3929938 - RNA, 21 nt, Human adenovirus D
uuccccucaucacaucagcca

SEQ ID NO: 3929939 - RNA, 17 nt, Human adenovirus D
uuccgcaaggaugucaa

SEQ ID NO: 3929940 - RNA, 19 nt, Human adenovirus D
uuccguuugugccuccgcg

SEQ ID NO: 3929941 - RNA, 11 nt, Human adenovirus D
uuccucugugg

SEQ ID NO: 3929942 - RNA, 16 nt, Human adenovirus D
uucgaguacgaggcca

SEQ ID NO: 3929943 - RNA, 16 nt, Human adenovirus D
uucgcagaaccaugaa

SEQ ID NO: 3929944 - RNA, 13 nt, Human adenovirus D
uucgcugcugccg

SEQ ID NO: 3929945 - RNA, 16 nt, Human adenovirus D
uucuacagccagcagc

SEQ ID NO: 3929946 - RNA, 19 nt, Human adenovirus D
uucucaucucgcccagcaa

SEQ ID NO: 3929947 - RNA, 16 nt, Human adenovirus D
uucugggucaccuugg

SEQ ID NO: 3929948 - RNA, 16 nt, Human adenovirus D
uucuuuggcuuuugug

SEQ ID NO: 3929949 - RNA, 15 nt, Human adenovirus D
uugaaaucugaaagu

SEQ ID NO: 3929950 - RNA, 13 nt, Human adenovirus D
uugaagauucugg

SEQ ID NO: 3929951 - RNA, 13 nt, Human adenovirus D
uugaauugcaaau

SEQ ID NO: 3929952 - RNA, 14 nt, Human adenovirus D
uugacauccuggau

SEQ ID NO: 3929953 - RNA, 22 nt, Human adenovirus D
uugacuuccggguucccacguu

SEQ ID NO: 3929954 - RNA, 19 nt, Human adenovirus D
uugagacucauccugcugg

SEQ ID NO: 3929955 - RNA, 15 nt, Human adenovirus D
uugagagagaggaag

SEQ ID NO: 3929956 - RNA, 21 nt, Human adenovirus D
uugaugcgcuucuuaccucgc

SEQ ID NO: 3929957 - RNA, 22 nt, Human adenovirus D
uugcaugccuucgugcacuggc

SEQ ID NO: 3929958 - RNA, 21 nt, Human adenovirus D
uugcugacgggggugcccaac

SEQ ID NO: 3929959 - RNA, 23 nt, Human adenovirus D
uuggaggaagaaaugaggcaggc

SEQ ID NO: 3929960 - RNA, 20 nt, Human adenovirus D
uuggcagccgagccggcgcg

SEQ ID NO: 3929961 - RNA, 14 nt, Human adenovirus D
uugggaagaacugg

SEQ ID NO: 3929962 - RNA, 15 nt, Human adenovirus D
uugucuucccucuca

SEQ ID NO: 3929963 - RNA, 14 nt, Human adenovirus D
uuuacaugcacugg

SEQ ID NO: 3929964 - RNA, 19 nt, Human adenovirus D
uuuagguguugcaugaugg

SEQ ID NO: 3929965 - RNA, 15 nt, Human adenovirus D
uuuauggcugcugga

SEQ ID NO: 3929966 - RNA, 14 nt, Human adenovirus D
uuucacagcuugcg

SEQ ID NO: 3929967 - RNA, 21 nt, Human adenovirus D
uuucgugacuugacuuccggg

SEQ ID NO: 3929968 - RNA, 23 nt, Human adenovirus D
uuucuacgggugaguugguggcc

SEQ ID NO: 3929969 - RNA, 13 nt, Human adenovirus D
uuucuccacaccu

SEQ ID NO: 3929970 - RNA, 12 nt, Human adenovirus D
uuucuucuccca

SEQ ID NO: 3929971 - RNA, 22 nt, Human adenovirus D
uuugacaacccgccugccagga

SEQ ID NO: 3929972 - RNA, 20 nt, Human adenovirus D
uuuuaggagacuuucaucca

SEQ ID NO: 3929973 - RNA, 21 nt, Human adenovirus D
uuuuugaggaugcaucaucca

SEQ ID NO: 3929974 - RNA, 13 nt, Human adenovirus E
aaaaccagcagcu

SEQ ID NO: 3929975 - RNA, 13 nt, Human adenovirus E
aaaaucagaccca

SEQ ID NO: 3929976 - RNA, 13 nt, Human adenovirus E
aaaauccuccagg

SEQ ID NO: 3929977 - RNA, 16 nt, Human adenovirus E
aaacugccgucauuuc

SEQ ID NO: 3929978 - RNA, 23 nt, Human adenovirus E
aaagaagacgauaaacucacuuu

SEQ ID NO: 3929979 - RNA, 20 nt, Human adenovirus E
aaagcccccgaucccuccag

SEQ ID NO: 3929980 - RNA, 20 nt, Human adenovirus E
aaagcgggaggguucucuaa

SEQ ID NO: 3929981 - RNA, 12 nt, Human adenovirus E
aaauacuggggg

SEQ ID NO: 3929982 - RNA, 12 nt, Human adenovirus E
aaauccacagcg

SEQ ID NO: 3929983 - RNA, 23 nt, Human adenovirus E
aaaugaugcaaaacuaacacuuu

SEQ ID NO: 3929984 - RNA, 20 nt, Human adenovirus E
aaaugugguagucaaauacu

SEQ ID NO: 3929985 - RNA, 21 nt, Human adenovirus E
aacaacagcccccuccacagc

SEQ ID NO: 3929986 - RNA, 18 nt, Human adenovirus E
aacaguccauaguucaac

SEQ ID NO: 3929987 - RNA, 23 nt, Human adenovirus E
aacccacauuacacagacaacca

SEQ ID NO: 3929988 - RNA, 18 nt, Human adenovirus E
aaccccaccacccagacc

SEQ ID NO: 3929989 - RNA, 15 nt, Human adenovirus E
aacccgggagcugag

SEQ ID NO: 3929990 - RNA, 21 nt, Human adenovirus E
aacccguucgcucaccugcgc

SEQ ID NO: 3929991 - RNA, 14 nt, Human adenovirus E
aacccuucccaccc

SEQ ID NO: 3929992 - RNA, 14 nt, Human adenovirus E
aaccugacacacca

SEQ ID NO: 3929993 - RNA, 22 nt, Human adenovirus E
aaccugacacaccaccacagca

SEQ ID NO: 3929994 - RNA, 20 nt, Human adenovirus E
aaccugagccaggcuuucaa

SEQ ID NO: 3929995 - RNA, 19 nt, Human adenovirus E
aacgagggcguggcugccc

SEQ ID NO: 3929996 - RNA, 20 nt, Human adenovirus E
aacuacccgguggugggcgc

SEQ ID NO: 3929997 - RNA, 22 nt, Human adenovirus E
aacucaccccggggcuguggac

SEQ ID NO: 3929998 - RNA, 16 nt, Human adenovirus E
aagaggcagcagcagc

SEQ ID NO: 3929999 - RNA, 21 nt, Human adenovirus E
aagagggcgaggggcuggcgc

SEQ ID NO: 3930000 - RNA, 15 nt, Human adenovirus E
aagaguuccaggcgg

SEQ ID NO: 3930001 - RNA, 14 nt, Human adenovirus E
aagaugagccgcug

SEQ ID NO: 3930002 - RNA, 19 nt, Human adenovirus E
aagauguugaagugggcgu

SEQ ID NO: 3930003 - RNA, 14 nt, Human adenovirus E
aagcaacugcagcc

SEQ ID NO: 3930004 - RNA, 13 nt, Human adenovirus E
aagcagcagcagc

SEQ ID NO: 3930005 - RNA, 13 nt, Human adenovirus E
aagccacagaagu

SEQ ID NO: 3930006 - RNA, 12 nt, Human adenovirus E
aagccacccuga

SEQ ID NO: 3930007 - RNA, 19 nt, Human adenovirus E
aagcccccgaucccuccag

SEQ ID NO: 3930008 - RNA, 15 nt, Human adenovirus E
aagccuccacgcgca

SEQ ID NO: 3930009 - RNA, 18 nt, Human adenovirus E
aagccugguggacaagau

SEQ ID NO: 3930010 - RNA, 13 nt, Human adenovirus E
aagcgccagccca

SEQ ID NO: 3930011 - RNA, 20 nt, Human adenovirus E
aagcggccacagugcucgca

SEQ ID NO: 3930012 - RNA, 13 nt, Human adenovirus E
aagcgugggccug

SEQ ID NO: 3930013 - RNA, 13 nt, Human adenovirus E
aaguaccucaccu

SEQ ID NO: 3930014 - RNA, 23 nt, Human adenovirus E
aagucuauguuggcacagcacag

SEQ ID NO: 3930015 - RNA, 16 nt, Human adenovirus E
aaguggagcugccgcc

SEQ ID NO: 3930016 - RNA, 23 nt, Human adenovirus E
aauacucgcagaaaaugaugcaa

SEQ ID NO: 3930017 - RNA, 21 nt, Human adenovirus E
aaucaucugcauguucauuuu

SEQ ID NO: 3930018 - RNA, 18 nt, Human adenovirus E
aauccaagccagccauga

SEQ ID NO: 3930019 - RNA, 22 nt, Human adenovirus E
aaucccaacaaaugccagcuga

SEQ ID NO: 3930020 - RNA, 20 nt, Human adenovirus E
aaucccauccgcccaaggcc

SEQ ID NO: 3930021 - RNA, 14 nt, Human adenovirus E
aaucuucucuucuc

SEQ ID NO: 3930022 - RNA, 12 nt, Human adenovirus E
aaugccaccuca

SEQ ID NO: 3930023 - RNA, 21 nt, Human adenovirus E
aauuacuuggcgguggggcgg

SEQ ID NO: 3930024 - RNA, 13 nt, Human adenovirus E
aauuauauaugca

SEQ ID NO: 3930025 - RNA, 20 nt, Human adenovirus E
aauuugaagauggagccaua

SEQ ID NO: 3930026 - RNA, 14 nt, Human adenovirus E
aauuuuuaagaaaa

SEQ ID NO: 3930027 - RNA, 11 nt, Human adenovirus E
acaaaaaugaa

SEQ ID NO: 3930028 - RNA, 13 nt, Human adenovirus E
acaaaaaugaaca

SEQ ID NO: 3930029 - RNA, 16 nt, Human adenovirus E
acaaagccucagcguc

SEQ ID NO: 3930030 - RNA, 15 nt, Human adenovirus E
acaacaagcauggag

SEQ ID NO: 3930031 - RNA, 20 nt, Human adenovirus E
acaaccacaaaaacuacacc

SEQ ID NO: 3930032 - RNA, 15 nt, Human adenovirus E
acaacgcgcugcugg

SEQ ID NO: 3930033 - RNA, 23 nt, Human adenovirus E
acaccaccuggacaaaauaccac

SEQ ID NO: 3930034 - RNA, 18 nt, Human adenovirus E
acaccgccuaccgcagcu

SEQ ID NO: 3930035 - RNA, 20 nt, Human adenovirus E
acaccuggaccacugccgcc

SEQ ID NO: 3930036 - RNA, 13 nt, Human adenovirus E
acaccuggcagac

SEQ ID NO: 3930037 - RNA, 15 nt, Human adenovirus E
acacggccaccaagg

SEQ ID NO: 3930038 - RNA, 18 nt, Human adenovirus E
acacgguuuccggggcgg

SEQ ID NO: 3930039 - RNA, 16 nt, Human adenovirus E
acagcaaccucaggca

SEQ ID NO: 3930040 - RNA, 16 nt, Human adenovirus E
acagcacucaggcaga

SEQ ID NO: 3930041 - RNA, 18 nt, Human adenovirus E
acagccagagcaggaagc

SEQ ID NO: 3930042 - RNA, 15 nt, Human adenovirus E
acagccgccuggacc

SEQ ID NO: 3930043 - RNA, 22 nt, Human adenovirus E
acagcucgugcgagggggcgag

SEQ ID NO: 3930044 - RNA, 15 nt, Human adenovirus E
acagcugaggauugu

SEQ ID NO: 3930045 - RNA, 15 nt, Human adenovirus E
acaggcagcaaagcc

SEQ ID NO: 3930046 - RNA, 22 nt, Human adenovirus E
gaaccugacacaccaccacagc

SEQ ID NO: 3930047 - RNA, 19 nt, Human adenovirus E
gaaccugccccccaaaguc

SEQ ID NO: 3930048 - RNA, 14 nt, Human adenovirus E
gaacgcucugcaag

SEQ ID NO: 3930049 - RNA, 16 nt, Human adenovirus E
gaacucuucgcggucc

SEQ ID NO: 3930050 - RNA, 19 nt, Human adenovirus E
gaacucuucgcgguccuuc

SEQ ID NO: 3930051 - RNA, 19 nt, Human adenovirus E
gaacugcugcccgacggcc

SEQ ID NO: 3930052 - RNA, 14 nt, Human adenovirus E
gaacuugcagggcc

SEQ ID NO: 3930053 - RNA, 15 nt, Human adenovirus E
gaacuugcagggccu

SEQ ID NO: 3930054 - RNA, 14 nt, Human adenovirus E
gaagaaucgccagg

SEQ ID NO: 3930055 - RNA, 21 nt, Human adenovirus E
gaagacgaggaggaggcagag

SEQ ID NO: 3930056 - RNA, 15 nt, Human adenovirus E
gaagacgcgcgccgg

SEQ ID NO: 3930057 - RNA, 18 nt, Human adenovirus E
gaagacgcgcgccgggcg

SEQ ID NO: 3930058 - RNA, 14 nt, Human adenovirus E
gaagacguggucag

SEQ ID NO: 3930059 - RNA, 20 nt, Human adenovirus E
gaagagccuuucggugcgag

SEQ ID NO: 3930060 - RNA, 16 nt, Human adenovirus E
gaagcaguaguacaga

SEQ ID NO: 3930061 - RNA, 17 nt, Human adenovirus E
gaagcgcucgauggucu

SEQ ID NO: 3930062 - RNA, 15 nt, Human adenovirus E
gaagcgugggccugu

SEQ ID NO: 3930063 - RNA, 16 nt, Human adenovirus E
gaagcguucagggagg

SEQ ID NO: 3930064 - RNA, 16 nt, Human adenovirus E
gaagcugaaaguggag

SEQ ID NO: 3930065 - RNA, 19 nt, Human adenovirus E
gaagcugaaaguggagcug

SEQ ID NO: 3930066 - RNA, 16 nt, Human adenovirus E
gaagggcgugcgcucc

SEQ ID NO: 3930067 - RNA, 20 nt, Human adenovirus E
gaagggcgugcgcuccugga

SEQ ID NO: 3930068 - RNA, 16 nt, Human adenovirus E
gaaggguaugcuuucg

SEQ ID NO: 3930069 - RNA, 15 nt, Human adenovirus E
gaaguccagagaucc

SEQ ID NO: 3930070 - RNA, 20 nt, Human adenovirus E
gaauccugcccgccaccugc

SEQ ID NO: 3930071 - RNA, 15 nt, Human adenovirus E
gaaucgcggacggcc

SEQ ID NO: 3930072 - RNA, 20 nt, Human adenovirus E
gaaucgcggacggcccuuga

SEQ ID NO: 3930073 - RNA, 14 nt, Human adenovirus E
gaaugccgcggugc

SEQ ID NO: 3930074 - RNA, 18 nt, Human adenovirus E
gacagaaaaucgcccagg

SEQ ID NO: 3930075 - RNA, 15 nt, Human adenovirus E
gacagaugugggacg

SEQ ID NO: 3930076 - RNA, 14 nt, Human adenovirus E
gacagcacucaggc

SEQ ID NO: 3930077 - RNA, 13 nt, Human adenovirus E
gacagcggcagca

SEQ ID NO: 3930078 - RNA, 16 nt, Human adenovirus E
gacaggcagcggggac

SEQ ID NO: 3930079 - RNA, 20 nt, Human adenovirus E
gacaugcuuuuggucuccac

SEQ ID NO: 3930080 - RNA, 14 nt, Human adenovirus E
gaccaccguccccc

SEQ ID NO: 3930081 - RNA, 16 nt, Human adenovirus E
gaccaggagcugaugc

SEQ ID NO: 3930082 - RNA, 17 nt, Human adenovirus E
gaccccauagccagccg

SEQ ID NO: 3930083 - RNA, 22 nt, Human adenovirus E
gacccccggucccccacccagu

SEQ ID NO: 3930084 - RNA, 14 nt, Human adenovirus E
gacccgagcgggag

SEQ ID NO: 3930085 - RNA, 20 nt, Human adenovirus E
gacccggacgugcagcccga

SEQ ID NO: 3930086 - RNA, 18 nt, Human adenovirus E
gacccugccaucacaccu

SEQ ID NO: 3930087 - RNA, 15 nt, Human adenovirus E
gaccggggccgggac

SEQ ID NO: 3930088 - RNA, 21 nt, Human adenovirus E
gaccguacuacuuccgcgaga

SEQ ID NO: 3930089 - RNA, 14 nt, Human adenovirus E
gaccuaccaggaga

SEQ ID NO: 3930090 - RNA, 14 nt, Human adenovirus E
gaccucggcacuca

SEQ ID NO: 3930091 - RNA, 15 nt, Human adenovirus E
gaccugggcggcgag

SEQ ID NO: 3930092 - RNA, 22 nt, Human adenovirus E
gaccuggugaacauucugcaga

SEQ ID NO: 3930093 - RNA, 20 nt, Human adenovirus E
gaccuuccgcgagugccccc

SEQ ID NO: 3930094 - RNA, 19 nt, Human adenovirus E
gacgcgcgccgggcggcag

SEQ ID NO: 3930095 - RNA, 21 nt, Human adenovirus E
gacgcgcgccgggcggcaggg

SEQ ID NO: 3930096 - RNA, 23 nt, Human adenovirus E
gacggcccuugacguggggcagu

SEQ ID NO: 3930097 - RNA, 15 nt, Human adenovirus E
gacguagaggggcuc

SEQ ID NO: 3930098 - RNA, 20 nt, Human adenovirus E
gacguagaggggcuccucga

SEQ ID NO: 3930099 - RNA, 15 nt, Human adenovirus E
gacguaugcgcagga

SEQ ID NO: 3930100 - RNA, 22 nt, Human adenovirus E
gacgucagcggcgagggccugc

SEQ ID NO: 3930101 - RNA, 13 nt, Human adenovirus E
gacucccucagca

SEQ ID NO: 3930102 - RNA, 21 nt, Human adenovirus E
gacucccucagcaugaugccc

SEQ ID NO: 3930103 - RNA, 15 nt, Human adenovirus E
gacuccguggccugg

SEQ ID NO: 3930104 - RNA, 15 nt, Human adenovirus E
gacuccguggcucug

SEQ ID NO: 3930105 - RNA, 18 nt, Human adenovirus E
gacuccguggcucugccu

SEQ ID NO: 3930106 - RNA, 17 nt, Human adenovirus E
gacucugacgcuccugg

SEQ ID NO: 3930107 - RNA, 17 nt, Human adenovirus E
gacuucacccccacgga

SEQ ID NO: 3930108 - RNA, 19 nt, Human adenovirus E
gagaacagcagucaggcag

SEQ ID NO: 3930109 - RNA, 15 nt, Human adenovirus E
gagaagccccugggg

SEQ ID NO: 3930110 - RNA, 13 nt, Human adenovirus E
gagacagcugccg

SEQ ID NO: 3930111 - RNA, 16 nt, Human adenovirus E
gagacccgagcgggag

SEQ ID NO: 3930112 - RNA, 15 nt, Human adenovirus E
gagacgcccaggccg

SEQ ID NO: 3930113 - RNA, 23 nt, Human adenovirus E
gagacgcugcggagucaggucag

SEQ ID NO: 3930114 - RNA, 13 nt, Human adenovirus E
gagagcaugagca

SEQ ID NO: 3930115 - RNA, 16 nt, Human adenovirus E
gagagccgccucagca

SEQ ID NO: 3930116 - RNA, 16 nt, Human adenovirus E
gagaugaaacccuccg

SEQ ID NO: 3930117 - RNA, 17 nt, Human adenovirus E
gagcagaccuaccagga

SEQ ID NO: 3930118 - RNA, 15 nt, Human adenovirus E
gagcagcagcacaca

SEQ ID NO: 3930119 - RNA, 16 nt, Human adenovirus E
gagcaggaagcagaga

SEQ ID NO: 3930120 - RNA, 14 nt, Human adenovirus E
gagccaaagcaugu

SEQ ID NO: 3930121 - RNA, 20 nt, Human adenovirus E
gagccacaccacagcuaccu

SEQ ID NO: 3930122 - RNA, 13 nt, Human adenovirus E
gagccaggugagg

SEQ ID NO: 3930123 - RNA, 18 nt, Human adenovirus E
gagccaggugaggucggg

SEQ ID NO: 3930124 - RNA, 22 nt, Human adenovirus E
gagccgcgcccugggccaggac

SEQ ID NO: 3930125 - RNA, 16 nt, Human adenovirus E
gagccggcggcggcgc

SEQ ID NO: 3930126 - RNA, 22 nt, Human adenovirus E
gagccuuguugcgcagggccag

SEQ ID NO: 3930127 - RNA, 13 nt, Human adenovirus E
gagcgaccaggag

SEQ ID NO: 3930128 - RNA, 15 nt, Human adenovirus E
gagcgaccaggagcu

SEQ ID NO: 3930129 - RNA, 13 nt, Human adenovirus E
gagcgcauggucu

SEQ ID NO: 3930130 - RNA, 23 nt, Human adenovirus E
gagcgccucggccgcguggccuu

SEQ ID NO: 3930131 - RNA, 23 nt, Human adenovirus E
gagcgcggucauggaccaggugc

SEQ ID NO: 3930132 - RNA, 23 nt, Human adenovirus E
gagcgcucgcgguggggcggcca

SEQ ID NO: 3930133 - RNA, 13 nt, Human adenovirus E
gagcgugaugcag

SEQ ID NO: 3930134 - RNA, 17 nt, Human adenovirus E
gagcgugaugcagcagg

SEQ ID NO: 3930135 - RNA, 15 nt, Human adenovirus E
gagcucagccgcgcc

SEQ ID NO: 3930136 - RNA, 20 nt, Human adenovirus E
gagcuccucguaggugagcu

SEQ ID NO: 3930137 - RNA, 22 nt, Human adenovirus E
gagcucugcaagcuccugcaga

SEQ ID NO: 3930138 - RNA, 16 nt, Human adenovirus E
gagcugcccgaggagc

SEQ ID NO: 3930139 - RNA, 15 nt, Human adenovirus E
gagcuguaccugagu

SEQ ID NO: 3930140 - RNA, 15 nt, Human adenovirus E
gagcuugggggcgag

SEQ ID NO: 3930141 - RNA, 13 nt, Human adenovirus E
gaggaagacuggg

SEQ ID NO: 3930142 - RNA, 18 nt, Human adenovirus E
gaggaagacugggacagc

SEQ ID NO: 3930143 - RNA, 20 nt, Human adenovirus E
gaggaagacugggacagcac

SEQ ID NO: 3930144 - RNA, 15 nt, Human adenovirus E
gaggaagacugggag

SEQ ID NO: 3930145 - RNA, 16 nt, Human adenovirus E
gaggaagacugggaga

SEQ ID NO: 3930146 - RNA, 23 nt, Human adenovirus E
gaggacgcgcucaucaagcaucu

SEQ ID NO: 3930147 - RNA, 14 nt, Human adenovirus E
gaggagagcaugag

SEQ ID NO: 3930148 - RNA, 13 nt, Human adenovirus E
gaggccagcaccc

SEQ ID NO: 3930149 - RNA, 18 nt, Human adenovirus E
gaggccaucggccaggcg

SEQ ID NO: 3930150 - RNA, 15 nt, Human adenovirus E
gagggaagaacagga

SEQ ID NO: 3930151 - RNA, 16 nt, Human adenovirus E
gagggcguggcugccc

SEQ ID NO: 3930152 - RNA, 14 nt, Human adenovirus E
gagggucuccugga

SEQ ID NO: 3930153 - RNA, 15 nt, Human adenovirus E
gagggucugggcagc

SEQ ID NO: 3930154 - RNA, 13 nt, Human adenovirus E
gagggugcugccg

SEQ ID NO: 3930155 - RNA, 18 nt, Human adenovirus E
gagguaaauccaagccag

SEQ ID NO: 3930156 - RNA, 16 nt, Human adenovirus E
gaggucaaggugcggc

SEQ ID NO: 3930157 - RNA, 15 nt, Human adenovirus E
gagucgcggaugaag

SEQ ID NO: 3930158 - RNA, 13 nt, Human adenovirus E
gaguucgcccccc

SEQ ID NO: 3930159 - RNA, 21 nt, Human adenovirus E
gaguucgccccccggcggcgc

SEQ ID NO: 3930160 - RNA, 12 nt, Human adenovirus E
gaguuuggaaga

SEQ ID NO: 3930161 - RNA, 22 nt, Human adenovirus E
gauaaaccgaaguccuccccag

SEQ ID NO: 3930162 - RNA, 20 nt, Human adenovirus E
gauacaccaagaacagccag

SEQ ID NO: 3930163 - RNA, 20 nt, Human adenovirus E
gcucacccgcaguugucugu

SEQ ID NO: 3930164 - RNA, 20 nt, Human adenovirus E
gcucaccgccacgccccgca

SEQ ID NO: 3930165 - RNA, 21 nt, Human adenovirus E
gcucaucaagcaucuggcccg

SEQ ID NO: 3930166 - RNA, 15 nt, Human adenovirus E
gcuccacgguggccg

SEQ ID NO: 3930167 - RNA, 12 nt, Human adenovirus E
gcuccagcucca

SEQ ID NO: 3930168 - RNA, 15 nt, Human adenovirus E
gcucccuggggcgcc

SEQ ID NO: 3930169 - RNA, 12 nt, Human adenovirus E
gcuccgcuugcc

SEQ ID NO: 3930170 - RNA, 20 nt, Human adenovirus E
gcuccgcuugccguccuucu

SEQ ID NO: 3930171 - RNA, 22 nt, Human adenovirus E
gcucgacuccguggccuggagg

SEQ ID NO: 3930172 - RNA, 16 nt, Human adenovirus E
gcucgcaacgcugcac

SEQ ID NO: 3930173 - RNA, 21 nt, Human adenovirus E
gcucggcuucgacaccuggac

SEQ ID NO: 3930174 - RNA, 22 nt, Human adenovirus E
gcucugcaagcuccugcagaag

SEQ ID NO: 3930175 - RNA, 19 nt, Human adenovirus E
gcucugguacugcaggccc

SEQ ID NO: 3930176 - RNA, 21 nt, Human adenovirus E
gcugaaaguggagcugccgcc

SEQ ID NO: 3930177 - RNA, 14 nt, Human adenovirus E
gcugaccaaccugg

SEQ ID NO: 3930178 - RNA, 16 nt, Human adenovirus E
gcugacguccugcagg

SEQ ID NO: 3930179 - RNA, 17 nt, Human adenovirus E
gcugagcgaccaggagc

SEQ ID NO: 3930180 - RNA, 19 nt, Human adenovirus E
gcugaucguguucgcgacc

SEQ ID NO: 3930181 - RNA, 15 nt, Human adenovirus E
gcugauggaaguggc

SEQ ID NO: 3930182 - RNA, 15 nt, Human adenovirus E
gcugcagagccagcc

SEQ ID NO: 3930183 - RNA, 24 nt, Human adenovirus E
gcugcccgacaugaugcaagaccc

SEQ ID NO: 3930184 - RNA, 18 nt, Human adenovirus E
gcugccgaccgcggcgcc

SEQ ID NO: 3930185 - RNA, 22 nt, Human adenovirus E
gcugccgcggcggugcccgagg

SEQ ID NO: 3930186 - RNA, 14 nt, Human adenovirus E
gcugccgcuguccg

SEQ ID NO: 3930187 - RNA, 22 nt, Human adenovirus E
gcugcuggagcgcguggcccgc

SEQ ID NO: 3930188 - RNA, 16 nt, Human adenovirus E
gcugcugguggccccc

SEQ ID NO: 3930189 - RNA, 14 nt, Human adenovirus E
gcuggaccacggca

SEQ ID NO: 3930190 - RNA, 23 nt, Human adenovirus E
gcuggaggccaucgugcagaacc

SEQ ID NO: 3930191 - RNA, 18 nt, Human adenovirus E
gcuggcagagccccuucc

SEQ ID NO: 3930192 - RNA, 22 nt, Human adenovirus E
gcuggccuuggaagagggcgag

SEQ ID NO: 3930193 - RNA, 19 nt, Human adenovirus E
gcuggcgggcggcgccacc

SEQ ID NO: 3930194 - RNA, 21 nt, Human adenovirus E
gcuggcgggcggcgccacccu

SEQ ID NO: 3930195 - RNA, 13 nt, Human adenovirus E
gcuggcggugcuc

SEQ ID NO: 3930196 - RNA, 19 nt, Human adenovirus E
gcugggacuugccgcagcc

SEQ ID NO: 3930197 - RNA, 19 nt, Human adenovirus E
gcugggucugcgaccugac

SEQ ID NO: 3930198 - RNA, 14 nt, Human adenovirus E
  misc_feature (5)..(5): n is a, c, g or u
gcugnugagcgaga

SEQ ID NO: 3930199 - RNA, 18 nt, Human adenovirus E
gcuguuccugguggugca

SEQ ID NO: 3930200 - RNA, 14 nt, Human adenovirus E
gcuugcaggccugc

SEQ ID NO: 3930201 - RNA, 22 nt, Human adenovirus E
gcuugccauucgcgcacggcca

SEQ ID NO: 3930202 - RNA, 21 nt, Human adenovirus E
gcuugccguccuucucgguga

SEQ ID NO: 3930203 - RNA, 22 nt, Human adenovirus E
gcuuuaccgacaaaaaucagac

SEQ ID NO: 3930204 - RNA, 20 nt, Human adenovirus E
ggaacgagaccgagcuccag

SEQ ID NO: 3930205 - RNA, 23 nt, Human adenovirus E
ggaacucuugcaggacagcgaac

SEQ ID NO: 3930206 - RNA, 13 nt, Human adenovirus E
ggaagaagaaagu

SEQ ID NO: 3930207 - RNA, 15 nt, Human adenovirus E
ggaagaagcagaaga

SEQ ID NO: 3930208 - RNA, 19 nt, Human adenovirus E
ggaagaaggaaggcagcga

SEQ ID NO: 3930209 - RNA, 21 nt, Human adenovirus E
ggaagacguaugcgcaggagc

SEQ ID NO: 3930210 - RNA, 15 nt, Human adenovirus E
ggaagacugggagaa

SEQ ID NO: 3930211 - RNA, 13 nt, Human adenovirus E
ggaaucuucucuu

SEQ ID NO: 3930212 - RNA, 23 nt, Human adenovirus E
ggaauggcuguugaugugaugga

SEQ ID NO: 3930213 - RNA, 20 nt, Human adenovirus E
ggaauuucagugggaagugg

SEQ ID NO: 3930214 - RNA, 14 nt, Human adenovirus E
ggacagcacucagg

SEQ ID NO: 3930215 - RNA, 22 nt, Human adenovirus E
ggacgacccgggcaaccuggaa

SEQ ID NO: 3930216 - RNA, 13 nt, Human adenovirus E
ggacgagcugacg

SEQ ID NO: 3930217 - RNA, 16 nt, Human adenovirus E
ggacgauguggacagc

SEQ ID NO: 3930218 - RNA, 12 nt, Human adenovirus E
ggacgugcagcc

SEQ ID NO: 3930219 - RNA, 23 nt, Human adenovirus E
ggacuccgcgcaaggaccugagc

SEQ ID NO: 3930220 - RNA, 14 nt, Human adenovirus E
ggacugggcggugc

SEQ ID NO: 3930221 - RNA, 18 nt, Human adenovirus E
ggagaaagcaagcagcac

SEQ ID NO: 3930222 - RNA, 16 nt, Human adenovirus E
ggagaaggaggagagc

SEQ ID NO: 3930223 - RNA, 20 nt, Human adenovirus E
ggagagacagcugccguccu

SEQ ID NO: 3930224 - RNA, 14 nt, Human adenovirus E
ggagauagcauaga

SEQ ID NO: 3930225 - RNA, 19 nt, Human adenovirus E
ggagaugacugacccacug

SEQ ID NO: 3930226 - RNA, 13 nt, Human adenovirus E
ggagauggaggaa

SEQ ID NO: 3930227 - RNA, 15 nt, Human adenovirus E
ggagauggaggaaga

SEQ ID NO: 3930228 - RNA, 17 nt, Human adenovirus E
ggagcccgaggagaugc

SEQ ID NO: 3930229 - RNA, 19 nt, Human adenovirus E
ggagcuaccagccccagau

SEQ ID NO: 3930230 - RNA, 17 nt, Human adenovirus E
ggagcuccuggagcgag

SEQ ID NO: 3930231 - RNA, 20 nt, Human adenovirus E
ggaggaagacugggagaaca

SEQ ID NO: 3930232 - RNA, 16 nt, Human adenovirus E
ggaggagacugauggc

SEQ ID NO: 3930233 - RNA, 20 nt, Human adenovirus E
ggaggagcucagccgcgccu

SEQ ID NO: 3930234 - RNA, 11 nt, Human adenovirus E
ggaggcagagg

SEQ ID NO: 3930235 - RNA, 20 nt, Human adenovirus E
ggagggcgaguaccuggaag

SEQ ID NO: 3930236 - RNA, 14 nt, Human adenovirus E
ggaggugugcguga

SEQ ID NO: 3930237 - RNA, 18 nt, Human adenovirus E
ggaggugugcgugagggc

SEQ ID NO: 3930238 - RNA, 22 nt, Human adenovirus E
ggaguauggcaccagacgaugg

SEQ ID NO: 3930239 - RNA, 21 nt, Human adenovirus E
ggaucaucugggagcugaaca

SEQ ID NO: 3930240 - RNA, 16 nt, Human adenovirus E
ggaugcacgugcugca

SEQ ID NO: 3930241 - RNA, 15 nt, Human adenovirus E
ggaugcagcagcuga

SEQ ID NO: 3930242 - RNA, 16 nt, Human adenovirus E
ggcaccgcagcuugcc

SEQ ID NO: 3930243 - RNA, 21 nt, Human adenovirus E
ggcaccggagcacccccgcca

SEQ ID NO: 3930244 - RNA, 16 nt, Human adenovirus E
ggcacgacaggcagcg

SEQ ID NO: 3930245 - RNA, 18 nt, Human adenovirus E
ggcacgauucugaccugc

SEQ ID NO: 3930246 - RNA, 15 nt, Human adenovirus E
ggcagaacgugcugc

SEQ ID NO: 3930247 - RNA, 16 nt, Human adenovirus E
ggcagcccagccgccg

SEQ ID NO: 3930248 - RNA, 20 nt, Human adenovirus E
ggcagcggccgaggcggcug

SEQ ID NO: 3930249 - RNA, 15 nt, Human adenovirus E
ggcagcggggacaga

SEQ ID NO: 3930250 - RNA, 21 nt, Human adenovirus E
ggcaggccacggggucuccgg

SEQ ID NO: 3930251 - RNA, 15 nt, Human adenovirus E
ggcagugguggcggg

SEQ ID NO: 3930252 - RNA, 13 nt, Human adenovirus E
ggcaucagcugga

SEQ ID NO: 3930253 - RNA, 16 nt, Human adenovirus E
ggcaucucgauccagc

SEQ ID NO: 3930254 - RNA, 21 nt, Human adenovirus E
ggcaucucgauccagcagacc

SEQ ID NO: 3930255 - RNA, 14 nt, Human adenovirus E
ggccaaccaggccg

SEQ ID NO: 3930256 - RNA, 20 nt, Human adenovirus E
ggccagaucguccagggcag

SEQ ID NO: 3930257 - RNA, 19 nt, Human adenovirus E
ggccaggcgcacguggacg

SEQ ID NO: 3930258 - RNA, 13 nt, Human adenovirus E
ggccaucggccag

SEQ ID NO: 3930259 - RNA, 21 nt, Human adenovirus E
ggccauguucagggcggccag

SEQ ID NO: 3930260 - RNA, 17 nt, Human adenovirus E
ggcccggaugcaggggc

SEQ ID NO: 3930261 - RNA, 16 nt, Human adenovirus E
ggcccggcaggccacc

SEQ ID NO: 3930262 - RNA, 22 nt, Human adenovirus E
ggcccgguuguugaugaccugg

SEQ ID NO: 3930263 - RNA, 12 nt, Human adenovirus E
ggcccucagcau

SEQ ID NO: 3930264 - RNA, 13 nt, Human adenovirus E
ggccgaccgcgau

SEQ ID NO: 3930265 - RNA, 17 nt, Human adenovirus E
ggccgagcugucggccu

SEQ ID NO: 3930266 - RNA, 17 nt, Human adenovirus E
ggccgcgaacgcucugc

SEQ ID NO: 3930267 - RNA, 16 nt, Human adenovirus E
ggccgcggccaaccug

SEQ ID NO: 3930268 - RNA, 18 nt, Human adenovirus E
ggccgucuacucgcagca

SEQ ID NO: 3930269 - RNA, 17 nt, Human adenovirus E
ggccugcacccucaucu

SEQ ID NO: 3930270 - RNA, 18 nt, Human adenovirus E
ggccugcgucaucaccca

SEQ ID NO: 3930271 - RNA, 20 nt, Human adenovirus E
ggccugcgucaucacccagg

SEQ ID NO: 3930272 - RNA, 22 nt, Human adenovirus E
ggccugcucgagugccacugcc

SEQ ID NO: 3930273 - RNA, 22 nt, Human adenovirus E
ggccugguguacaacgcgcugc

SEQ ID NO: 3930274 - RNA, 14 nt, Human adenovirus E
ggccuuggaggcgg

SEQ ID NO: 3930275 - RNA, 18 nt, Human adenovirus E
ggcgagggccugcucgag

SEQ ID NO: 3930276 - RNA, 24 nt, Human adenovirus E
ggcgaguuugcuuacggcaagcgc

SEQ ID NO: 3930277 - RNA, 17 nt, Human adenovirus E
ggcgcaaacccgggagc

SEQ ID NO: 3930278 - RNA, 20 nt, Human adenovirus E
ggcgccuacggaggggcgga

SEQ ID NO: 3930279 - RNA, 20 nt, Human adenovirus E
ggcgccuucaauuggagcag

SEQ ID NO: 3930280 - RNA, 12 nt, Human adenovirus E
ggcgcgcaggcc

SEQ ID NO: 3930281 - RNA, 15 nt, Human adenovirus E
ggcgcgcaggccgga

SEQ ID NO: 3930282 - RNA, 12 nt, Human adenovirus E
ggcgcggccagc

SEQ ID NO: 3930283 - RNA, 13 nt, Human adenovirus E
ggcgcggccagcc

SEQ ID NO: 3930284 - RNA, 13 nt, Human adenovirus E
ggcgcgggcggaa

SEQ ID NO: 3930285 - RNA, 20 nt, Human adenovirus E
ggcgcgugcaguggcgcggg

SEQ ID NO: 3930286 - RNA, 17 nt, Human adenovirus E
ggcgcuaaucaccgcua

SEQ ID NO: 3930287 - RNA, 13 nt, Human adenovirus E
ggcgcugcagagc

SEQ ID NO: 3930288 - RNA, 19 nt, Human adenovirus E
ggcgcugcagagccagccg

SEQ ID NO: 3930289 - RNA, 20 nt, Human adenovirus E
ggcgcuguccggccgcgagg

SEQ ID NO: 3930290 - RNA, 23 nt, Human adenovirus E
ggcggagaugccuuucaagagcc

SEQ ID NO: 3930291 - RNA, 11 nt, Human adenovirus E
ggcggccagcu

SEQ ID NO: 3930292 - RNA, 22 nt, Human adenovirus E
ggcggcgaagacgcgcgccggg

SEQ ID NO: 3930293 - RNA, 16 nt, Human adenovirus E
ggcggcgcugcagagc

SEQ ID NO: 3930294 - RNA, 14 nt, Human adenovirus E
ggcggcggcggcga

SEQ ID NO: 3930295 - RNA, 14 nt, Human adenovirus E
ggcgggcggcgcca

SEQ ID NO: 3930296 - RNA, 15 nt, Human adenovirus E
ggcguacaugccgca

SEQ ID NO: 3930297 - RNA, 19 nt, Human adenovirus E
ggcgugccccagggcaugg

SEQ ID NO: 3930298 - RNA, 16 nt, Human adenovirus E
ggcgugcgcuccugga

SEQ ID NO: 3930299 - RNA, 18 nt, Human adenovirus E
  misc_feature (4)..(4): n is a, c, g or u
ggcnugggcgugcagacc

SEQ ID NO: 3930300 - RNA, 20 nt, Human adenovirus E
ggcucgacuccguggccugg

SEQ ID NO: 3930301 - RNA, 14 nt, Human adenovirus E
ggcugacguccugc

SEQ ID NO: 3930302 - RNA, 20 nt, Human adenovirus E
ggcugcaaacuuccuccaca

SEQ ID NO: 3930303 - RNA, 12 nt, Human adenovirus E
ggcuggagccgc

SEQ ID NO: 3930304 - RNA, 16 nt, Human adenovirus E
ggcuggagccgcagcu

SEQ ID NO: 3930305 - RNA, 12 nt, Human adenovirus E
ggcuggcagagc

SEQ ID NO: 3930306 - RNA, 17 nt, Human adenovirus E
ggcuggcggggaacggg

SEQ ID NO: 3930307 - RNA, 16 nt, Human adenovirus E
ggcuguggaccucggc

SEQ ID NO: 3930308 - RNA, 23 nt, Human adenovirus E
ggcuuuaccgacaaaaaucagac

SEQ ID NO: 3930309 - RNA, 23 nt, Human adenovirus E
ggcuuucaagaacuugcagggcc

SEQ ID NO: 3930310 - RNA, 13 nt, Human adenovirus E
ggcuuugagcucg

SEQ ID NO: 3930311 - RNA, 21 nt, Human adenovirus E
gggacagaugugggacgauga

SEQ ID NO: 3930312 - RNA, 16 nt, Human adenovirus E
gggaccugcuggaggc

SEQ ID NO: 3930313 - RNA, 19 nt, Human adenovirus E
gggaccugcuggaggccau

SEQ ID NO: 3930314 - RNA, 14 nt, Human adenovirus E
gggacgcagggcca

SEQ ID NO: 3930315 - RNA, 21 nt, Human adenovirus E
gggagcugcggcgcggccugg

SEQ ID NO: 3930316 - RNA, 12 nt, Human adenovirus E
gggaggcgcugc

SEQ ID NO: 3930317 - RNA, 22 nt, Human adenovirus E
gggaggcuuccugcccgcgcug

SEQ ID NO: 3930318 - RNA, 15 nt, Human adenovirus E
gggaguugcgcgccg

SEQ ID NO: 3930319 - RNA, 21 nt, Human adenovirus E
gggauggguaagcgcggaggc

SEQ ID NO: 3930320 - RNA, 16 nt, Human adenovirus E
gggcacgauucugacc

SEQ ID NO: 3930321 - RNA, 15 nt, Human adenovirus E
gggcagaagcacaca

SEQ ID NO: 3930322 - RNA, 23 nt, Human adenovirus E
  misc_feature (6)..(6): n is a, c, g or u
gggcancggcggcgcgcgguuga

SEQ ID NO: 3930323 - RNA, 20 nt, Human adenovirus E
gggcaucaacgggguggugg

SEQ ID NO: 3930324 - RNA, 20 nt, Human adenovirus E
gggcaugagcccgucccggg

SEQ ID NO: 3930325 - RNA, 13 nt, Human adenovirus E
gggccacccccag

SEQ ID NO: 3930326 - RNA, 14 nt, Human adenovirus E
gggccacgagccgg

SEQ ID NO: 3930327 - RNA, 16 nt, Human adenovirus E
gggcccagguuggugc

SEQ ID NO: 3930328 - RNA, 16 nt, Human adenovirus E
gggcccggaugcaggg

SEQ ID NO: 3930329 - RNA, 18 nt, Human adenovirus E
gggcccggaugcaggggc

SEQ ID NO: 3930330 - RNA, 22 nt, Human adenovirus E
gggcccgugggcggcggccugg

SEQ ID NO: 3930331 - RNA, 17 nt, Human adenovirus E
gggccugcgcgcgccca

SEQ ID NO: 3930332 - RNA, 22 nt, Human adenovirus E
gggccuuggaggcggcggcagg

SEQ ID NO: 3930333 - RNA, 20 nt, Human adenovirus E
gggcgaaagugucccugacc

SEQ ID NO: 3930334 - RNA, 16 nt, Human adenovirus E
gggcgagaucgagggc

SEQ ID NO: 3930335 - RNA, 20 nt, Human adenovirus E
gggcgaggaagacggacucg

SEQ ID NO: 3930336 - RNA, 19 nt, Human adenovirus E
gggcggcagaacggggugc

SEQ ID NO: 3930337 - RNA, 12 nt, Human adenovirus E
gggcggcagcgg

SEQ ID NO: 3930338 - RNA, 21 nt, Human adenovirus E
gggcggccgccaugaacucug

SEQ ID NO: 3930339 - RNA, 18 nt, Human adenovirus E
gggcgugccccagggcau

SEQ ID NO: 3930340 - RNA, 17 nt, Human adenovirus E
gggcuggcgcgccuggg

SEQ ID NO: 3930341 - RNA, 21 nt, Human adenovirus E
ggggaacccguccugaucugc

SEQ ID NO: 3930342 - RNA, 14 nt, Human adenovirus E
ggggaacgggaugc

SEQ ID NO: 3930343 - RNA, 19 nt, Human adenovirus E
ggggaacucuugcaggaca

SEQ ID NO: 3930344 - RNA, 13 nt, Human adenovirus E
ggggacgagcugc

SEQ ID NO: 3930345 - RNA, 15 nt, Human adenovirus E
ggggagaugagcugg

SEQ ID NO: 3930346 - RNA, 16 nt, Human adenovirus E
ggggagaugaggugca

SEQ ID NO: 3930347 - RNA, 14 nt, Human adenovirus E
ggggaucagccccg

SEQ ID NO: 3930348 - RNA, 22 nt, Human adenovirus E
ggggaugaugauauucuggagc

SEQ ID NO: 3930349 - RNA, 18 nt, Human adenovirus E
ggggcagaacgugcugca

SEQ ID NO: 3930350 - RNA, 14 nt, Human adenovirus E
ggggcaguccgacc

SEQ ID NO: 3930351 - RNA, 20 nt, Human adenovirus E
ggggccacgagccggggcag

SEQ ID NO: 3930352 - RNA, 15 nt, Human adenovirus E
ggggcgaggaagacg

SEQ ID NO: 3930353 - RNA, 13 nt, Human adenovirus E
ggggcggccagcu

SEQ ID NO: 3930354 - RNA, 13 nt, Human adenovirus E
ggggcgggggaga

SEQ ID NO: 3930355 - RNA, 22 nt, Human adenovirus E
ggggggucggcaucgaugguga

SEQ ID NO: 3930356 - RNA, 21 nt, Human adenovirus E
ggggugcgcucccggcggcgc

SEQ ID NO: 3930357 - RNA, 22 nt, Human adenovirus E
ggguaaaucguucucuccagca

SEQ ID NO: 3930358 - RNA, 12 nt, Human adenovirus E
gggucuccugga

SEQ ID NO: 3930359 - RNA, 17 nt, Human adenovirus E
gggugacaaagagcugu

SEQ ID NO: 3930360 - RNA, 20 nt, Human adenovirus E
gggugcgcucccggcggcgc

SEQ ID NO: 3930361 - RNA, 17 nt, Human adenovirus E
gggugcuucacgcucgc

SEQ ID NO: 3930362 - RNA, 19 nt, Human adenovirus E
gguaaaucguucucuccag

SEQ ID NO: 3930363 - RNA, 20 nt, Human adenovirus E
gguacacgggguugcagcac

SEQ ID NO: 3930364 - RNA, 20 nt, Human adenovirus E
ggucaucuugcaggucugcc

SEQ ID NO: 3930365 - RNA, 16 nt, Human adenovirus E
ggucccggcgcccgcc

SEQ ID NO: 3930366 - RNA, 12 nt, Human adenovirus E
gguccuggguga

SEQ ID NO: 3930367 - RNA, 21 nt, Human adenovirus E
ggucgcugagcccgugcugcu

SEQ ID NO: 3930368 - RNA, 17 nt, Human adenovirus E
ggucucccgcaagaccc

SEQ ID NO: 3930369 - RNA, 19 nt, Human adenovirus E
ggucucggcauggcccgcg

SEQ ID NO: 3930370 - RNA, 19 nt, Human adenovirus E
ggugaaggggugcgcgccg

SEQ ID NO: 3930371 - RNA, 16 nt, Human adenovirus E
ggugaggucgggcugg

SEQ ID NO: 3930372 - RNA, 18 nt, Human adenovirus E
ggugauaucuuccagaua

SEQ ID NO: 3930373 - RNA, 17 nt, Human adenovirus E
ggugauccuccaccaga

SEQ ID NO: 3930374 - RNA, 22 nt, Human adenovirus E
ggugccccucagcguggaggag

SEQ ID NO: 3930375 - RNA, 23 nt, Human adenovirus E
ggugcccucgcgcuccaacccca

SEQ ID NO: 3930376 - RNA, 15 nt, Human adenovirus E
ggugcgggggucccc

SEQ ID NO: 3930377 - RNA, 14 nt, Human adenovirus E
ggugcguuccagca

SEQ ID NO: 3930378 - RNA, 19 nt, Human adenovirus E
gguggcacgacaggcagcg

SEQ ID NO: 3930379 - RNA, 17 nt, Human adenovirus E
ggugggguagcagcgcc

SEQ ID NO: 3930380 - RNA, 11 nt, Human adenovirus E
ggugugccccg

SEQ ID NO: 3930381 - RNA, 22 nt, Human adenovirus E
gguuuaaaauuugaagauggag

SEQ ID NO: 3930382 - RNA, 14 nt, Human adenovirus E
guaccagauccuca

SEQ ID NO: 3930383 - RNA, 16 nt, Human adenovirus E
guacggcgcggccagc

SEQ ID NO: 3930384 - RNA, 18 nt, Human adenovirus E
guacgugcaacacagaac

SEQ ID NO: 3930385 - RNA, 16 nt, Human adenovirus E
guagaggugggcuugg

SEQ ID NO: 3930386 - RNA, 20 nt, Human adenovirus E
guagcuccauugcagggccu

SEQ ID NO: 3930387 - RNA, 20 nt, Human adenovirus E
guauacaugaauggagaugu

SEQ ID NO: 3930388 - RNA, 20 nt, Human adenovirus E
guauccggggaguccagcgc

SEQ ID NO: 3930389 - RNA, 19 nt, Human adenovirus E
gucaaaaccauaucccagg

SEQ ID NO: 3930390 - RNA, 23 nt, Human adenovirus E
gucaaaaccauaucccagggcac

SEQ ID NO: 3930391 - RNA, 18 nt, Human adenovirus E
gucaagcugcugcucagg

SEQ ID NO: 3930392 - RNA, 16 nt, Human adenovirus E
gucaccuccacagccc

SEQ ID NO: 3930393 - RNA, 23 nt, Human adenovirus E
gucagcgacgagcagcuggcccg

SEQ ID NO: 3930394 - RNA, 13 nt, Human adenovirus E
gucaggcagagga

SEQ ID NO: 3930395 - RNA, 19 nt, Human adenovirus E
aggagauggugggccuuug

SEQ ID NO: 3930396 - RNA, 20 nt, Human adenovirus E
  misc_feature (11)..(11): n is a, c, g or u
aggagccguanagggcguug

SEQ ID NO: 3930397 - RNA, 13 nt, Human adenovirus E
aggagcgcgggcu

SEQ ID NO: 3930398 - RNA, 13 nt, Human adenovirus E
aggaggagcuggc

SEQ ID NO: 3930399 - RNA, 22 nt, Human adenovirus E
aggagggacuugagggcguaga

SEQ ID NO: 3930400 - RNA, 20 nt, Human adenovirus E
aggauagcaagaacaggagc

SEQ ID NO: 3930401 - RNA, 20 nt, Human adenovirus E
aggaucuugcccgcgcgggg

SEQ ID NO: 3930402 - RNA, 14 nt, Human adenovirus E
aggaugcgagccga

SEQ ID NO: 3930403 - RNA, 22 nt, Human adenovirus E
aggcaauuuuuaagaaaaucaa

SEQ ID NO: 3930404 - RNA, 17 nt, Human adenovirus E
aggccacaauacaugcc

SEQ ID NO: 3930405 - RNA, 17 nt, Human adenovirus E
aggccacgugggacggg

SEQ ID NO: 3930406 - RNA, 12 nt, Human adenovirus E
aggccagcaccc

SEQ ID NO: 3930407 - RNA, 16 nt, Human adenovirus E
aggccaucggccaggc

SEQ ID NO: 3930408 - RNA, 22 nt, Human adenovirus E
aggccguccugacuuuggagag

SEQ ID NO: 3930409 - RNA, 23 nt, Human adenovirus E
aggccgucuacucgcagcagcug

SEQ ID NO: 3930410 - RNA, 22 nt, Human adenovirus E
aggcggcagugguggcggggga

SEQ ID NO: 3930411 - RNA, 15 nt, Human adenovirus E
aggcggcggcaggac

SEQ ID NO: 3930412 - RNA, 17 nt, Human adenovirus E
aggcggucccagagcuc

SEQ ID NO: 3930413 - RNA, 17 nt, Human adenovirus E
aggcguacaugccgcag

SEQ ID NO: 3930414 - RNA, 11 nt, Human adenovirus E
aggcugagcuc

SEQ ID NO: 3930415 - RNA, 21 nt, Human adenovirus E
agggauaagcugaaagagcag

SEQ ID NO: 3930416 - RNA, 17 nt, Human adenovirus E
agggcgaguaccuggaa

SEQ ID NO: 3930417 - RNA, 13 nt, Human adenovirus E
agggcgcgcggga

SEQ ID NO: 3930418 - RNA, 14 nt, Human adenovirus E
agggcggccagacg

SEQ ID NO: 3930419 - RNA, 17 nt, Human adenovirus E
agggcguuggagaggag

SEQ ID NO: 3930420 - RNA, 18 nt, Human adenovirus E
agggcguuggagaggagc

SEQ ID NO: 3930421 - RNA, 15 nt, Human adenovirus E
agggggccaccccca

SEQ ID NO: 3930422 - RNA, 18 nt, Human adenovirus E
agggggcgauccuggccc

SEQ ID NO: 3930423 - RNA, 21 nt, Human adenovirus E
aggguaucgcaaucaggcagc

SEQ ID NO: 3930424 - RNA, 14 nt, Human adenovirus E
agggucugggcagc

SEQ ID NO: 3930425 - RNA, 18 nt, Human adenovirus E
agggucuuguugcuagug

SEQ ID NO: 3930426 - RNA, 16 nt, Human adenovirus E
agggugcugagggacg

SEQ ID NO: 3930427 - RNA, 23 nt, Human adenovirus E
agguccagcgaaggguaugcuuu

SEQ ID NO: 3930428 - RNA, 13 nt, Human adenovirus E
aggucgaggagaa

SEQ ID NO: 3930429 - RNA, 17 nt, Human adenovirus E
agguggacgaggagggc

SEQ ID NO: 3930430 - RNA, 19 nt, Human adenovirus E
agguuggugcgacugggcu

SEQ ID NO: 3930431 - RNA, 19 nt, Human adenovirus E
aguacgugcaacacagaac

SEQ ID NO: 3930432 - RNA, 22 nt, Human adenovirus E
aguagucgagggucuccuggau

SEQ ID NO: 3930433 - RNA, 11 nt, Human adenovirus E
aguccccagag

SEQ ID NO: 3930434 - RNA, 20 nt, Human adenovirus E
  misc_feature (8)..(8): n is a, c, g or u
aguccugnugagcggcccug

SEQ ID NO: 3930435 - RNA, 17 nt, Human adenovirus E
agucgggggcaggagca

SEQ ID NO: 3930436 - RNA, 21 nt, Human adenovirus E
agucuaaaaauacccgccaaa

SEQ ID NO: 3930437 - RNA, 16 nt, Human adenovirus E
agucucauugccguca

SEQ ID NO: 3930438 - RNA, 12 nt, Human adenovirus E
agucuggaggaa

SEQ ID NO: 3930439 - RNA, 17 nt, Human adenovirus E
agucuggaggaagacga

SEQ ID NO: 3930440 - RNA, 18 nt, Human adenovirus E
agugccacugccgcugca

SEQ ID NO: 3930441 - RNA, 11 nt, Human adenovirus E
aguuccuccac

SEQ ID NO: 3930442 - RNA, 19 nt, Human adenovirus E
aguucgccccccggcggcg

SEQ ID NO: 3930443 - RNA, 14 nt, Human adenovirus E
aguucguggaggag

SEQ ID NO: 3930444 - RNA, 14 nt, Human adenovirus E
aguugcagaggcgc

SEQ ID NO: 3930445 - RNA, 14 nt, Human adenovirus E
aguuggcuuucagg

SEQ ID NO: 3930446 - RNA, 13 nt, Human adenovirus E
aguuuuacaggau

SEQ ID NO: 3930447 - RNA, 12 nt, Human adenovirus E
auaaaguucaag

SEQ ID NO: 3930448 - RNA, 21 nt, Human adenovirus E
auacagcucgugcgagggggc

SEQ ID NO: 3930449 - RNA, 12 nt, Human adenovirus E
auaccagcagcc

SEQ ID NO: 3930450 - RNA, 15 nt, Human adenovirus E
auacuuuuaucuaug

SEQ ID NO: 3930451 - RNA, 17 nt, Human adenovirus E
auagcacucaacccacc

SEQ ID NO: 3930452 - RNA, 14 nt, Human adenovirus E
auauucugcuccug

SEQ ID NO: 3930453 - RNA, 13 nt, Human adenovirus E
auauucuggagca

SEQ ID NO: 3930454 - RNA, 16 nt, Human adenovirus E
aucacaccuuccaccu

SEQ ID NO: 3930455 - RNA, 14 nt, Human adenovirus E
aucaccagcuggcc

SEQ ID NO: 3930456 - RNA, 16 nt, Human adenovirus E
aucacccucaagcugg

SEQ ID NO: 3930457 - RNA, 14 nt, Human adenovirus E
aucaccgagcccga

SEQ ID NO: 3930458 - RNA, 13 nt, Human adenovirus E
aucagacccacug

SEQ ID NO: 3930459 - RNA, 13 nt, Human adenovirus E
aucagcgccccgc

SEQ ID NO: 3930460 - RNA, 21 nt, Human adenovirus E
auccacagcggcggcagcagg

SEQ ID NO: 3930461 - RNA, 17 nt, Human adenovirus E
auccacggccagggcgg

SEQ ID NO: 3930462 - RNA, 21 nt, Human adenovirus E
auccaucgagauugaccuggg

SEQ ID NO: 3930463 - RNA, 22 nt, Human adenovirus E
auccaugguggcgcugaacgcc

SEQ ID NO: 3930464 - RNA, 15 nt, Human adenovirus E
auccccagauaauuu

SEQ ID NO: 3930465 - RNA, 18 nt, Human adenovirus E
auccgcccaaggccgagc

SEQ ID NO: 3930466 - RNA, 21 nt, Human adenovirus E
auccucagguaaaucaagugg

SEQ ID NO: 3930467 - RNA, 19 nt, Human adenovirus E
aucgagauugaccugggcu

SEQ ID NO: 3930468 - RNA, 15 nt, Human adenovirus E
aucgccaaccucgcc

SEQ ID NO: 3930469 - RNA, 16 nt, Human adenovirus E
aucgcccaggcaauuu

SEQ ID NO: 3930470 - RNA, 23 nt, Human adenovirus E
aucgcgcgcgaggaggugacccu

SEQ ID NO: 3930471 - RNA, 19 nt, Human adenovirus E
aucgcuuacagccugugca

SEQ ID NO: 3930472 - RNA, 15 nt, Human adenovirus E
aucucuccucgcuuu

SEQ ID NO: 3930473 - RNA, 16 nt, Human adenovirus E
aucugcccccaccgcc

SEQ ID NO: 3930474 - RNA, 16 nt, Human adenovirus E
aucuggcccggcaggc

SEQ ID NO: 3930475 - RNA, 16 nt, Human adenovirus E
aucugggagcugaaca

SEQ ID NO: 3930476 - RNA, 19 nt, Human adenovirus E
aucugggccuggucggcgu

SEQ ID NO: 3930477 - RNA, 22 nt, Human adenovirus E
aucuguagaaaaaacaaaaaug

SEQ ID NO: 3930478 - RNA, 10 nt, Human adenovirus E
augaacauua

SEQ ID NO: 3930479 - RNA, 16 nt, Human adenovirus E
augaagauccuaggcc

SEQ ID NO: 3930480 - RNA, 19 nt, Human adenovirus E
augaaguaaaugcaagcgg

SEQ ID NO: 3930481 - RNA, 19 nt, Human adenovirus E
augaccaucgaccugauga

SEQ ID NO: 3930482 - RNA, 15 nt, Human adenovirus E
augagcaccacagcg

SEQ ID NO: 3930483 - RNA, 18 nt, Human adenovirus E
augauccagcggcggagc

SEQ ID NO: 3930484 - RNA, 15 nt, Human adenovirus E
augauugaaaaccau

SEQ ID NO: 3930485 - RNA, 21 nt, Human adenovirus E
augcaagacccggucaccuuc

SEQ ID NO: 3930486 - RNA, 21 nt, Human adenovirus E
gugccccucagcguggaggag

SEQ ID NO: 3930487 - RNA, 20 nt, Human adenovirus E
gugcccgaggcccuggccac

SEQ ID NO: 3930488 - RNA, 23 nt, Human adenovirus E
gugcccucgcgcuccaaccccac

SEQ ID NO: 3930489 - RNA, 14 nt, Human adenovirus E
gugccugcgccgcu

SEQ ID NO: 3930490 - RNA, 18 nt, Human adenovirus E
gugcggugagcgccagca

SEQ ID NO: 3930491 - RNA, 15 nt, Human adenovirus E
gugcguuccagcaug

SEQ ID NO: 3930492 - RNA, 20 nt, Human adenovirus E
gugcugaaaacaccaccugg

SEQ ID NO: 3930493 - RNA, 14 nt, Human adenovirus E
guggaagaagcagc

SEQ ID NO: 3930494 - RNA, 20 nt, Human adenovirus E
guggaagaaggaaggcagcg

SEQ ID NO: 3930495 - RNA, 16 nt, Human adenovirus E
guggaauuugagcugc

SEQ ID NO: 3930496 - RNA, 23 nt, Human adenovirus E
guggacaacaccugauccaucac

SEQ ID NO: 3930497 - RNA, 17 nt, Human adenovirus E
guggagaacaaggccau

SEQ ID NO: 3930498 - RNA, 20 nt, Human adenovirus E
guggagccacugcuaccugc

SEQ ID NO: 3930499 - RNA, 20 nt, Human adenovirus E
guggcagcagugucuggagg

SEQ ID NO: 3930500 - RNA, 18 nt, Human adenovirus E
guggccagaucguccagg

SEQ ID NO: 3930501 - RNA, 16 nt, Human adenovirus E
guggcggugcaggccu

SEQ ID NO: 3930502 - RNA, 15 nt, Human adenovirus E
gugggaccugcugga

SEQ ID NO: 3930503 - RNA, 17 nt, Human adenovirus E
gugggaccugcuggagg

SEQ ID NO: 3930504 - RNA, 21 nt, Human adenovirus E
gugggaccugcuggaggccau

SEQ ID NO: 3930505 - RNA, 17 nt, Human adenovirus E
  misc_feature (8)..(8): n is a, c, g or u
gugggcancggcggcgc

SEQ ID NO: 3930506 - RNA, 16 nt, Human adenovirus E
gugggcggcggccugg

SEQ ID NO: 3930507 - RNA, 15 nt, Human adenovirus E
gugggcguggggcag

SEQ ID NO: 3930508 - RNA, 19 nt, Human adenovirus E
gugguccugggugagguca

SEQ ID NO: 3930509 - RNA, 20 nt, Human adenovirus E
guguacaacgcgcugcugga

SEQ ID NO: 3930510 - RNA, 20 nt, Human adenovirus E
guuaccacuaugcagcucac

SEQ ID NO: 3930511 - RNA, 20 nt, Human adenovirus E
guuauuuuaaugaaucagau

SEQ ID NO: 3930512 - RNA, 11 nt, Human adenovirus E
guucagccgcc

SEQ ID NO: 3930513 - RNA, 19 nt, Human adenovirus E
guuccagacgcggcuguag

SEQ ID NO: 3930514 - RNA, 20 nt, Human adenovirus E
guuccaggcggucccagagc

SEQ ID NO: 3930515 - RNA, 19 nt, Human adenovirus E
guucgcucaccugcgcccc

SEQ ID NO: 3930516 - RNA, 15 nt, Human adenovirus E
guucucuccagcacc

SEQ ID NO: 3930517 - RNA, 16 nt, Human adenovirus E
guugaagugggcgugg

SEQ ID NO: 3930518 - RNA, 20 nt, Human adenovirus E
guugcagggcgcccagcagg

SEQ ID NO: 3930519 - RNA, 13 nt, Human adenovirus E
augcagcagcuga

SEQ ID NO: 3930520 - RNA, 14 nt, Human adenovirus E
augcagccccggau

SEQ ID NO: 3930521 - RNA, 18 nt, Human adenovirus E
augcauagucugcagcgg

SEQ ID NO: 3930522 - RNA, 20 nt, Human adenovirus E
augcauagucugcagcgggc

SEQ ID NO: 3930523 - RNA, 16 nt, Human adenovirus E
augccaccucagcuca

SEQ ID NO: 3930524 - RNA, 22 nt, Human adenovirus E
augccagcugaguuuucagccc

SEQ ID NO: 3930525 - RNA, 14 nt, Human adenovirus E
augcuacccacgug

SEQ ID NO: 3930526 - RNA, 18 nt, Human adenovirus E
augcuuacccaauccaag

SEQ ID NO: 3930527 - RNA, 13 nt, Human adenovirus E
auggaacuacagc

SEQ ID NO: 3930528 - RNA, 16 nt, Human adenovirus E
auggaacuacagcagg

SEQ ID NO: 3930529 - RNA, 18 nt, Human adenovirus E
auggcagcaaggcgugga

SEQ ID NO: 3930530 - RNA, 20 nt, Human adenovirus E
auggcaugcgaguuggagga

SEQ ID NO: 3930531 - RNA, 23 nt, Human adenovirus E
auggcaugcgaguuggaggagau

SEQ ID NO: 3930532 - RNA, 23 nt, Human adenovirus E
auggcggcggcggcgaugcagcc

SEQ ID NO: 3930533 - RNA, 16 nt, Human adenovirus E
augggcaccuggagcg

SEQ ID NO: 3930534 - RNA, 18 nt, Human adenovirus E
augggcauuuuggagagg

SEQ ID NO: 3930535 - RNA, 18 nt, Human adenovirus E
ccgguccuuccagggucg

SEQ ID NO: 3930536 - RNA, 14 nt, Human adenovirus E
ccggugacacacuc

SEQ ID NO: 3930537 - RNA, 17 nt, Human adenovirus E
ccggugccgcccaggac

SEQ ID NO: 3930538 - RNA, 19 nt, Human adenovirus E
ccguccucuucccacuccc

SEQ ID NO: 3930539 - RNA, 15 nt, Human adenovirus E
ccgucggccaugggc

SEQ ID NO: 3930540 - RNA, 20 nt, Human adenovirus E
ccgugagcggggcuggacag

SEQ ID NO: 3930541 - RNA, 21 nt, Human adenovirus E
ccgugcggugagcgccagcag

SEQ ID NO: 3930542 - RNA, 11 nt, Human adenovirus E
ccguggagcug

SEQ ID NO: 3930543 - RNA, 17 nt, Human adenovirus E
ccguggagcuggagugc

SEQ ID NO: 3930544 - RNA, 23 nt, Human adenovirus E
ccguggucagcgacgagcagcug

SEQ ID NO: 3930545 - RNA, 20 nt, Human adenovirus E
ccguuucuucuugggcggcu

SEQ ID NO: 3930546 - RNA, 22 nt, Human adenovirus E
ccuauuccuaaaguuagcuuua

SEQ ID NO: 3930547 - RNA, 13 nt, Human adenovirus E
ccucaaaugcuac

SEQ ID NO: 3930548 - RNA, 20 nt, Human adenovirus E
ccucauuuuccccgagcgcc

SEQ ID NO: 3930549 - RNA, 13 nt, Human adenovirus E
ccuccaccugagc

SEQ ID NO: 3930550 - RNA, 22 nt, Human adenovirus E
ccuccacuuccucuucuuccuc

SEQ ID NO: 3930551 - RNA, 15 nt, Human adenovirus E
ccucgacccccagac

SEQ ID NO: 3930552 - RNA, 15 nt, Human adenovirus E
ccucggaccuggccg

SEQ ID NO: 3930553 - RNA, 22 nt, Human adenovirus E
ccucggacgauuggacccaggc

SEQ ID NO: 3930554 - RNA, 18 nt, Human adenovirus E
cgccggcggcggucucgg

SEQ ID NO: 3930555 - RNA, 20 nt, Human adenovirus E
cgccguugucaaccacugcg

SEQ ID NO: 3930556 - RNA, 13 nt, Human adenovirus E
cgccucuggguga

SEQ ID NO: 3930557 - RNA, 24 nt, Human adenovirus E
cgccucugggugaaggccacggga

SEQ ID NO: 3930558 - RNA, 18 nt, Human adenovirus E
cgccugcugggccuuggc

SEQ ID NO: 3930559 - RNA, 21 nt, Human adenovirus E
cgccuggccaacuaccuggcc

SEQ ID NO: 3930560 - RNA, 22 nt, Human adenovirus E
cgccuggccaacuaccuggccu

SEQ ID NO: 3930561 - RNA, 17 nt, Human adenovirus E
cgccuuccucagcaccc

SEQ ID NO: 3930562 - RNA, 21 nt, Human adenovirus E
cgcgacggugucgagccugcu

SEQ ID NO: 3930563 - RNA, 23 nt, Human adenovirus E
cgcgacugcgucuaccucuaccu

SEQ ID NO: 3930564 - RNA, 17 nt, Human adenovirus E
cgcgaguucucgcucac

SEQ ID NO: 3930565 - RNA, 21 nt, Human adenovirus E
cgcgaucccugagcuccuccc

SEQ ID NO: 3930566 - RNA, 16 nt, Human adenovirus E
cgcgcaucuccaggug

SEQ ID NO: 3930567 - RNA, 18 nt, Human adenovirus E
cgcgcaucuccagguggc

SEQ ID NO: 3930568 - RNA, 14 nt, Human adenovirus E
cgcgcccgcgcuug

SEQ ID NO: 3930569 - RNA, 16 nt, Human adenovirus E
cgcgcccugggccagg

SEQ ID NO: 3930570 - RNA, 20 nt, Human adenovirus E
cgcgcgcaacaugguagccc

SEQ ID NO: 3930571 - RNA, 20 nt, Human adenovirus E
cgcgcgcgaggaggugaccc

SEQ ID NO: 3930572 - RNA, 20 nt, Human adenovirus E
cgcgcgggaguugcgguaca

SEQ ID NO: 3930573 - RNA, 14 nt, Human adenovirus E
cgcgcuccacggug

SEQ ID NO: 3930574 - RNA, 18 nt, Human adenovirus E
cgcgcucccuggggcgcc

SEQ ID NO: 3930575 - RNA, 12 nt, Human adenovirus E
cgcgcuggugga

SEQ ID NO: 3930576 - RNA, 13 nt, Human adenovirus E
cgcggccacggcg

SEQ ID NO: 3930577 - RNA, 22 nt, Human adenovirus E
aaugcgcgugcacgaagcccug

SEQ ID NO: 3930578 - RNA, 19 nt, Human adenovirus E
aauuccuccugucccucaa

SEQ ID NO: 3930579 - RNA, 15 nt, Human adenovirus E
aauuuuuagccauag

SEQ ID NO: 3930580 - RNA, 19 nt, Human adenovirus E
acaaaauaaaauaaaguuc

SEQ ID NO: 3930581 - RNA, 14 nt, Human adenovirus E
acaaguacugcgcg

SEQ ID NO: 3930582 - RNA, 16 nt, Human adenovirus E
acaaguuucuccacca

SEQ ID NO: 3930583 - RNA, 13 nt, Human adenovirus E
acaauaucuuuga

SEQ ID NO: 3930584 - RNA, 18 nt, Human adenovirus E
acacacagaucaaaccgc

SEQ ID NO: 3930585 - RNA, 18 nt, Human adenovirus E
acacauacaaagccucag

SEQ ID NO: 3930586 - RNA, 14 nt, Human adenovirus E
acaccaccacagca

SEQ ID NO: 3930587 - RNA, 13 nt, Human adenovirus E
acacgcuccagcc

SEQ ID NO: 3930588 - RNA, 17 nt, Human adenovirus E
acacuaaaaaaauacug

SEQ ID NO: 3930589 - RNA, 16 nt, Human adenovirus E
  misc_feature (7)..(7): n is a, c, g or u
acacucnugcaccauc

SEQ ID NO: 3930590 - RNA, 17 nt, Human adenovirus E
acagcacucaggcagag

SEQ ID NO: 3930591 - RNA, 13 nt, Human adenovirus E
acagcagccccag

SEQ ID NO: 3930592 - RNA, 20 nt, Human adenovirus E
acagcagucaggcagaggag

SEQ ID NO: 3930593 - RNA, 15 nt, Human adenovirus E
acagcgcccuggucg

SEQ ID NO: 3930594 - RNA, 19 nt, Human adenovirus E
acagcuaccuccagugccu

SEQ ID NO: 3930595 - RNA, 22 nt, Human adenovirus E
acagcuaccuccagugccuucu

SEQ ID NO: 3930596 - RNA, 18 nt, Human adenovirus E
acaguuuuacaggauucg

SEQ ID NO: 3930597 - RNA, 14 nt, Human adenovirus E
acauaaagcuuacc

SEQ ID NO: 3930598 - RNA, 17 nt, Human adenovirus E
acauccgcgacugcguc

SEQ ID NO: 3930599 - RNA, 15 nt, Human adenovirus E
accaagaacagccag

SEQ ID NO: 3930600 - RNA, 20 nt, Human adenovirus E
accaagaacggggaaaucac

SEQ ID NO: 3930601 - RNA, 22 nt, Human adenovirus E
accaaggccauggcgaccagcg

SEQ ID NO: 3930602 - RNA, 13 nt, Human adenovirus E
accaccggcggcg

SEQ ID NO: 3930603 - RNA, 17 nt, Human adenovirus E
accagaacgaccacagc

SEQ ID NO: 3930604 - RNA, 14 nt, Human adenovirus E
accagauccucagg

SEQ ID NO: 3930605 - RNA, 19 nt, Human adenovirus E
accaggccgugcagcggca

SEQ ID NO: 3930606 - RNA, 17 nt, Human adenovirus E
accaggugcucaucaag

SEQ ID NO: 3930607 - RNA, 19 nt, Human adenovirus E
accaucgucaaggaugcgc

SEQ ID NO: 3930608 - RNA, 22 nt, Human adenovirus E
accaucgucaaggaugcgcugc

SEQ ID NO: 3930609 - RNA, 15 nt, Human adenovirus E
accaucuccgcuccg

SEQ ID NO: 3930610 - RNA, 19 nt, Human adenovirus E
accaugaagauccuaggcc

SEQ ID NO: 3930611 - RNA, 19 nt, Human adenovirus E
accccauuacuggcaccgu

SEQ ID NO: 3930612 - RNA, 15 nt, Human adenovirus E
acccccacggaggcc

SEQ ID NO: 3930613 - RNA, 21 nt, Human adenovirus E
acccccacggaggccagcacc

SEQ ID NO: 3930614 - RNA, 15 nt, Human adenovirus E
accccguacgugccc

SEQ ID NO: 3930615 - RNA, 18 nt, Human adenovirus E
accccgucaccaccaaga

SEQ ID NO: 3930616 - RNA, 17 nt, Human adenovirus E
acccuagugagcugcgg

SEQ ID NO: 3930617 - RNA, 16 nt, Human adenovirus E
acccugaaagugcuga

SEQ ID NO: 3930618 - RNA, 14 nt, Human adenovirus E
acccugccgcugcg

SEQ ID NO: 3930619 - RNA, 19 nt, Human adenovirus E
accgaaagagggugcugag

SEQ ID NO: 3930620 - RNA, 15 nt, Human adenovirus E
accgaggaggagcgc

SEQ ID NO: 3930621 - RNA, 13 nt, Human adenovirus E
accgaggugcccc

SEQ ID NO: 3930622 - RNA, 20 nt, Human adenovirus E
accgcagcagaggaggcagc

SEQ ID NO: 3930623 - RNA, 20 nt, Human adenovirus E
accgcagcuugcccucggcc

SEQ ID NO: 3930624 - RNA, 23 nt, Human adenovirus E
accgccaaaaaucagacaugcau

SEQ ID NO: 3930625 - RNA, 22 nt, Human adenovirus E
accgcccagaucccgccugggg

SEQ ID NO: 3930626 - RNA, 14 nt, Human adenovirus E
accgccgcggccgc

SEQ ID NO: 3930627 - RNA, 18 nt, Human adenovirus E
accgccucggaccuggcc

SEQ ID NO: 3930628 - RNA, 22 nt, Human adenovirus E
accgccucggaccuggccgacc

SEQ ID NO: 3930629 - RNA, 14 nt, Human adenovirus E
accgcucccuggcc

SEQ ID NO: 3930630 - RNA, 18 nt, Human adenovirus E
accgguaagaaggagcgg

SEQ ID NO: 3930631 - RNA, 18 nt, Human adenovirus E
accgucaccuccacagcc

SEQ ID NO: 3930632 - RNA, 16 nt, Human adenovirus E
accgucguccucggcg

SEQ ID NO: 3930633 - RNA, 17 nt, Human adenovirus E
accuccaccaacgccac

SEQ ID NO: 3930634 - RNA, 12 nt, Human adenovirus E
accuccacccac

SEQ ID NO: 3930635 - RNA, 22 nt, Human adenovirus E
accucccgguaccacaucaccc

SEQ ID NO: 3930636 - RNA, 16 nt, Human adenovirus E
accucccuugcuguuc

SEQ ID NO: 3930637 - RNA, 17 nt, Human adenovirus E
accucgacccccagacc

SEQ ID NO: 3930638 - RNA, 14 nt, Human adenovirus E
accucgcccugcuc

SEQ ID NO: 3930639 - RNA, 20 nt, Human adenovirus E
accucgccgcgcaggggcuc

SEQ ID NO: 3930640 - RNA, 14 nt, Human adenovirus E
accucugccacacc

SEQ ID NO: 3930641 - RNA, 23 nt, Human adenovirus E
accugaucccgaauaccacagcg

SEQ ID NO: 3930642 - RNA, 15 nt, Human adenovirus E
accugcaucugcugc

SEQ ID NO: 3930643 - RNA, 15 nt, Human adenovirus E
accugcgccaccacc

SEQ ID NO: 3930644 - RNA, 18 nt, Human adenovirus E
accugcugcgccuggcca

SEQ ID NO: 3930645 - RNA, 17 nt, Human adenovirus E
accuggcagacgggcau

SEQ ID NO: 3930646 - RNA, 13 nt, Human adenovirus E
acgacaggcagcg

SEQ ID NO: 3930647 - RNA, 16 nt, Human adenovirus E
acgagaagcagcagca

SEQ ID NO: 3930648 - RNA, 11 nt, Human adenovirus E
acgagcugacg

SEQ ID NO: 3930649 - RNA, 14 nt, Human adenovirus E
acgaggaccaaucc

SEQ ID NO: 3930650 - RNA, 14 nt, Human adenovirus E
acgcacuaccacca

SEQ ID NO: 3930651 - RNA, 21 nt, Human adenovirus E
acgcacuaccaccacuacagc

SEQ ID NO: 3930652 - RNA, 23 nt, Human adenovirus E
acgcccgcggagcacgaggagga

SEQ ID NO: 3930653 - RNA, 18 nt, Human adenovirus E
acgcccguccucggcgcu

SEQ ID NO: 3930654 - RNA, 17 nt, Human adenovirus E
acgccuagaaugaccac

SEQ ID NO: 3930655 - RNA, 14 nt, Human adenovirus E
acgccugcugggcc

SEQ ID NO: 3930656 - RNA, 12 nt, Human adenovirus E
acgcgcacuucc

SEQ ID NO: 3930657 - RNA, 14 nt, Human adenovirus E
acgcgcacuuccuc

SEQ ID NO: 3930658 - RNA, 20 nt, Human adenovirus E
acgcgcccgcgcuugcuggg

SEQ ID NO: 3930659 - RNA, 15 nt, Human adenovirus E
acgcucugcaaggag

SEQ ID NO: 3930660 - RNA, 16 nt, Human adenovirus E
acggaucccuggaugc

SEQ ID NO: 3930661 - RNA, 15 nt, Human adenovirus E
acggcaagcgcagcc

SEQ ID NO: 3930662 - RNA, 12 nt, Human adenovirus E
acggcccucagc

SEQ ID NO: 3930663 - RNA, 19 nt, Human adenovirus E
acggccuuguaggcgcagc

SEQ ID NO: 3930664 - RNA, 16 nt, Human adenovirus E
acggugccggcggaga

SEQ ID NO: 3930665 - RNA, 17 nt, Human adenovirus E
acguacucgcgcgccac

SEQ ID NO: 3930666 - RNA, 22 nt, Human adenovirus E
acgucagcggcgagggccugcu

SEQ ID NO: 3930667 - RNA, 18 nt, Human adenovirus E
acgucgagguccucggcg

SEQ ID NO: 3930668 - RNA, 21 nt, Human adenovirus E
acgucuacaaggcccugggca

SEQ ID NO: 3930669 - RNA, 22 nt, Human adenovirus E
acgugagccgcgcccugggcca

SEQ ID NO: 3930670 - RNA, 18 nt, Human adenovirus E
acgugcccaagcagaacc

SEQ ID NO: 3930671 - RNA, 22 nt, Human adenovirus E
acgugcccccgcgguaccuggc

SEQ ID NO: 3930672 - RNA, 18 nt, Human adenovirus E
acgugccccggggccagg

SEQ ID NO: 3930673 - RNA, 19 nt, Human adenovirus E
acgugccccggggccagga

SEQ ID NO: 3930674 - RNA, 20 nt, Human adenovirus E
acgugccccggggccaggag

SEQ ID NO: 3930675 - RNA, 22 nt, Human adenovirus E
acgugccccggggccaggagga

SEQ ID NO: 3930676 - RNA, 12 nt, Human adenovirus E
acgugcucuuug

SEQ ID NO: 3930677 - RNA, 11 nt, Human adenovirus E
acgugcuggag

SEQ ID NO: 3930678 - RNA, 20 nt, Human adenovirus E
acguggccgcggccaaccug

SEQ ID NO: 3930679 - RNA, 17 nt, Human adenovirus E
acuaccaccacuacagc

SEQ ID NO: 3930680 - RNA, 16 nt, Human adenovirus E
acuaccgucaccucca

SEQ ID NO: 3930681 - RNA, 23 nt, Human adenovirus E
acuacuuccgcgagacgcccagg

SEQ ID NO: 3930682 - RNA, 19 nt, Human adenovirus E
acuaggacguccagagcgc

SEQ ID NO: 3930683 - RNA, 13 nt, Human adenovirus E
acucacaccacac

SEQ ID NO: 3930684 - RNA, 19 nt, Human adenovirus E
acucaccccggggcugugg

SEQ ID NO: 3930685 - RNA, 15 nt, Human adenovirus E
acucaggcagaggag

SEQ ID NO: 3930686 - RNA, 18 nt, Human adenovirus E
acucagguguccagcugg

SEQ ID NO: 3930687 - RNA, 20 nt, Human adenovirus E
acucccucagcaugaugccc

SEQ ID NO: 3930688 - RNA, 14 nt, Human adenovirus E
acuccguggcucug

SEQ ID NO: 3930689 - RNA, 19 nt, Human adenovirus E
acucgcagaaaaugaugca

SEQ ID NO: 3930690 - RNA, 13 nt, Human adenovirus E
acucgcagcagcu

SEQ ID NO: 3930691 - RNA, 17 nt, Human adenovirus E
acucgcgccugcugcug

SEQ ID NO: 3930692 - RNA, 22 nt, Human adenovirus E
acucggacgugaucgaggacgu

SEQ ID NO: 3930693 - RNA, 20 nt, Human adenovirus E
acucuuucauauccucuccg

SEQ ID NO: 3930694 - RNA, 23 nt, Human adenovirus E
cuucagcgcgcgcugcccguucu

SEQ ID NO: 3930695 - RNA, 13 nt, Human adenovirus E
cuuccagcaaagc

SEQ ID NO: 3930696 - RNA, 13 nt, Human adenovirus E
cuucccccaggau

SEQ ID NO: 3930697 - RNA, 21 nt, Human adenovirus E
cuuccccgagaaccagauccu

SEQ ID NO: 3930698 - RNA, 15 nt, Human adenovirus E
cuuccguggcggugc

SEQ ID NO: 3930699 - RNA, 17 nt, Human adenovirus E
cuucgcggugcccgagg

SEQ ID NO: 3930700 - RNA, 19 nt, Human adenovirus E
cuucggaucuucagccagc

SEQ ID NO: 3930701 - RNA, 18 nt, Human adenovirus E
cuucugccucgauggugg

SEQ ID NO: 3930702 - RNA, 17 nt, Human adenovirus E
cuugcagggccuguggg

SEQ ID NO: 3930703 - RNA, 21 nt, Human adenovirus E
cuugcugaaaaagggccgcgg

SEQ ID NO: 3930704 - RNA, 17 nt, Human adenovirus E
cuuggaagagggcgagg

SEQ ID NO: 3930705 - RNA, 14 nt, Human adenovirus E
cuuggcaguacagu

SEQ ID NO: 3930706 - RNA, 17 nt, Human adenovirus E
cuuguugcgcagggcca

SEQ ID NO: 3930707 - RNA, 16 nt, Human adenovirus E
cuuuaccgacaaaaau

SEQ ID NO: 3930708 - RNA, 18 nt, Human adenovirus E
cuuuagguuuuggaucag

SEQ ID NO: 3930709 - RNA, 17 nt, Human adenovirus E
cuuucauauccucuccg

SEQ ID NO: 3930710 - RNA, 18 nt, Human adenovirus E
cuuucauauccucuccga

SEQ ID NO: 3930711 - RNA, 14 nt, Human adenovirus E
cuuucauuuuugcg

SEQ ID NO: 3930712 - RNA, 15 nt, Human adenovirus E
cuuugacaguacagg

SEQ ID NO: 3930713 - RNA, 13 nt, Human adenovirus E
cuuugacuuuggu

SEQ ID NO: 3930714 - RNA, 22 nt, Human adenovirus E
cuuuggaagauguugaaguggg

SEQ ID NO: 3930715 - RNA, 20 nt, Human adenovirus E
cuuuugguucucugcuaccu

SEQ ID NO: 3930716 - RNA, 15 nt, Human adenovirus E
gaaaccgaaaguaag

SEQ ID NO: 3930717 - RNA, 15 nt, Human adenovirus E
gaacaacaagcaugg

SEQ ID NO: 3930718 - RNA, 19 nt, Human adenovirus E
gaacagcagucaggcagag

SEQ ID NO: 3930719 - RNA, 15 nt, Human adenovirus E
gaacagccagagcag

SEQ ID NO: 3930720 - RNA, 17 nt, Human adenovirus E
gaaccccaccacccaga

SEQ ID NO: 3930721 - RNA, 14 nt, Human adenovirus E
gaacgccugcuggg

SEQ ID NO: 3930722 - RNA, 17 nt, Human adenovirus E
gaacgccugcugggccu

SEQ ID NO: 3930723 - RNA, 23 nt, Human adenovirus E
gaacuccauggcuugcagggucc

SEQ ID NO: 3930724 - RNA, 22 nt, Human adenovirus E
gaacucuguggaaacaauaaca

SEQ ID NO: 3930725 - RNA, 13 nt, Human adenovirus E
gaacucuugcagg

SEQ ID NO: 3930726 - RNA, 18 nt, Human adenovirus E
gaacugguacuuggccag

SEQ ID NO: 3930727 - RNA, 19 nt, Human adenovirus E
gaagacugggacagcacuc

SEQ ID NO: 3930728 - RNA, 22 nt, Human adenovirus E
gaagaggaucuugcccgcgcgg

SEQ ID NO: 3930729 - RNA, 16 nt, Human adenovirus E
gaagcaacugcagccg

SEQ ID NO: 3930730 - RNA, 14 nt, Human adenovirus E
gaagcaagcuccag

SEQ ID NO: 3930731 - RNA, 18 nt, Human adenovirus E
gaagcagagaaugagcag

SEQ ID NO: 3930732 - RNA, 12 nt, Human adenovirus E
gaagcagcagca

SEQ ID NO: 3930733 - RNA, 17 nt, Human adenovirus E
gaagcagcagcagcaga

SEQ ID NO: 3930734 - RNA, 13 nt, Human adenovirus E
gaagcguucaggg

SEQ ID NO: 3930735 - RNA, 17 nt, Human adenovirus E
gaaggagaacaucgugg

SEQ ID NO: 3930736 - RNA, 12 nt, Human adenovirus E
gaaggggggcag

SEQ ID NO: 3930737 - RNA, 20 nt, Human adenovirus E
gaaggugcggggguccccgu

SEQ ID NO: 3930738 - RNA, 14 nt, Human adenovirus E
gaaguccgugcgcu

SEQ ID NO: 3930739 - RNA, 22 nt, Human adenovirus E
gaaugagcagagucaggcuggg

SEQ ID NO: 3930740 - RNA, 19 nt, Human adenovirus E
gacaaaaaucagacccacu

SEQ ID NO: 3930741 - RNA, 12 nt, Human adenovirus E
gacaacccacau

SEQ ID NO: 3930742 - RNA, 16 nt, Human adenovirus E
gacaagcuggaacacu

SEQ ID NO: 3930743 - RNA, 16 nt, Human adenovirus E
gacacaccaccacagc

SEQ ID NO: 3930744 - RNA, 14 nt, Human adenovirus E
gacagaugugggac

SEQ ID NO: 3930745 - RNA, 18 nt, Human adenovirus E
gacagcacucaggcagag

SEQ ID NO: 3930746 - RNA, 15 nt, Human adenovirus E
gacaucggcaccagc

SEQ ID NO: 3930747 - RNA, 17 nt, Human adenovirus E
gacaugcaucccagcug

SEQ ID NO: 3930748 - RNA, 19 nt, Human adenovirus E
gacaugcaucccagcugga

SEQ ID NO: 3930749 - RNA, 15 nt, Human adenovirus E
gaccaccguggugca

SEQ ID NO: 3930750 - RNA, 19 nt, Human adenovirus E
gaccacggcaaccccacgc

SEQ ID NO: 3930751 - RNA, 14 nt, Human adenovirus E
gaccaggagcugau

SEQ ID NO: 3930752 - RNA, 14 nt, Human adenovirus E
gaccaggugcucau

SEQ ID NO: 3930753 - RNA, 14 nt, Human adenovirus E
gacccggugccgcc

SEQ ID NO: 3930754 - RNA, 19 nt, Human adenovirus E
gacccugaaagugcugacc

SEQ ID NO: 3930755 - RNA, 12 nt, Human adenovirus E
gacccugggccu

SEQ ID NO: 3930756 - RNA, 19 nt, Human adenovirus E
gaccgagcuccagcuccag

SEQ ID NO: 3930757 - RNA, 16 nt, Human adenovirus E
gaccgccgcggccgcc

SEQ ID NO: 3930758 - RNA, 21 nt, Human adenovirus E
gaccgccgcggccgccgugag

SEQ ID NO: 3930759 - RNA, 21 nt, Human adenovirus E
gaccuaccaggagaucaccca

SEQ ID NO: 3930760 - RNA, 22 nt, Human adenovirus E
gaccuaccaggagaucacccac

SEQ ID NO: 3930761 - RNA, 14 nt, Human adenovirus E
gaccucggcgcgag

SEQ ID NO: 3930762 - RNA, 21 nt, Human adenovirus E
gaccugcacuggcagcccagc

SEQ ID NO: 3930763 - RNA, 19 nt, Human adenovirus E
gaccuggccaaccaggccg

SEQ ID NO: 3930764 - RNA, 13 nt, Human adenovirus E
gacgagcgcacca

SEQ ID NO: 3930765 - RNA, 22 nt, Human adenovirus E
gacgauccccgggcgucgcagg

SEQ ID NO: 3930766 - RNA, 15 nt, Human adenovirus E
gacgauguggacagc

SEQ ID NO: 3930767 - RNA, 16 nt, Human adenovirus E
gacgauguggacagca

SEQ ID NO: 3930768 - RNA, 16 nt, Human adenovirus E
gacgccaucagcgagu

SEQ ID NO: 3930769 - RNA, 23 nt, Human adenovirus E
gacgcccuuuucaaccugggucc

SEQ ID NO: 3930770 - RNA, 14 nt, Human adenovirus E
gacggaucccugga

SEQ ID NO: 3930771 - RNA, 13 nt, Human adenovirus E
gacggaugagcuc

SEQ ID NO: 3930772 - RNA, 22 nt, Human adenovirus E
gacggcccuugacguggggcag

SEQ ID NO: 3930773 - RNA, 16 nt, Human adenovirus E
gacggugucgagccug

SEQ ID NO: 3930774 - RNA, 19 nt, Human adenovirus E
gacggugucgagccugcug

SEQ ID NO: 3930775 - RNA, 16 nt, Human adenovirus E
gacguccuggaucuga

SEQ ID NO: 3930776 - RNA, 23 nt, Human adenovirus E
gacguggggcaguuucuugagcu

SEQ ID NO: 3930777 - RNA, 17 nt, Human adenovirus E
gacuccguggccuggag

SEQ ID NO: 3930778 - RNA, 19 nt, Human adenovirus E
gacuccguggccuggaggc

SEQ ID NO: 3930779 - RNA, 21 nt, Human adenovirus E
gacuuggcggauggcuggcag

SEQ ID NO: 3930780 - RNA, 14 nt, Human adenovirus E
gacuugggugggag

SEQ ID NO: 3930781 - RNA, 18 nt, Human adenovirus E
gagaaccgccuggggcag

SEQ ID NO: 3930782 - RNA, 16 nt, Human adenovirus E
gagaagcuggcggcca

SEQ ID NO: 3930783 - RNA, 15 nt, Human adenovirus E
gagaaggauagcaag

SEQ ID NO: 3930784 - RNA, 17 nt, Human adenovirus E
gagaccgagcuccagcu

SEQ ID NO: 3930785 - RNA, 18 nt, Human adenovirus E
gagagacguucccggugg

SEQ ID NO: 3930786 - RNA, 11 nt, Human adenovirus E
gagagccacac

SEQ ID NO: 3930787 - RNA, 18 nt, Human adenovirus E
gagagcgugaugcagcag

SEQ ID NO: 3930788 - RNA, 18 nt, Human adenovirus E
gagaucgagggcgagcuc

SEQ ID NO: 3930789 - RNA, 15 nt, Human adenovirus E
gagauggugggccuu

SEQ ID NO: 3930790 - RNA, 20 nt, Human adenovirus E
gagcaucguggugcaggagc

SEQ ID NO: 3930791 - RNA, 14 nt, Human adenovirus E
gagccacaccacag

SEQ ID NO: 3930792 - RNA, 16 nt, Human adenovirus E
gagccacaccacagcu

SEQ ID NO: 3930793 - RNA, 19 nt, Human adenovirus E
gagcccgcgcgggaggcag

SEQ ID NO: 3930794 - RNA, 22 nt, Human adenovirus E
gagcccgugcugcucgagcgcc

SEQ ID NO: 3930795 - RNA, 14 nt, Human adenovirus E
gagccgccucagca

SEQ ID NO: 3930796 - RNA, 20 nt, Human adenovirus E
gagccgcgcccugggccagg

SEQ ID NO: 3930797 - RNA, 13 nt, Human adenovirus E
gagccgcuggaag

SEQ ID NO: 3930798 - RNA, 14 nt, Human adenovirus E
gagcgaccaggagc

SEQ ID NO: 3930799 - RNA, 16 nt, Human adenovirus E
gagcgaccaggagcug

SEQ ID NO: 3930800 - RNA, 18 nt, Human adenovirus E
gagcgcggucauggacca

SEQ ID NO: 3930801 - RNA, 19 nt, Human adenovirus E
gagcgcggucauggaccag

SEQ ID NO: 3930802 - RNA, 20 nt, Human adenovirus E
gagcgcucgcgguggggcgg

SEQ ID NO: 3930803 - RNA, 23 nt, Human adenovirus E
gagcucgugucuccgcuggguga

SEQ ID NO: 3930804 - RNA, 17 nt, Human adenovirus E
gaggacagccugcaaga

SEQ ID NO: 3930805 - RNA, 15 nt, Human adenovirus E
gaggagaaccugcac

SEQ ID NO: 3930806 - RNA, 22 nt, Human adenovirus E
gaggaggugacccugggccuga

SEQ ID NO: 3930807 - RNA, 14 nt, Human adenovirus E
gaggaugcagcagc

SEQ ID NO: 3930808 - RNA, 16 nt, Human adenovirus E
gaggaugcagcagcug

SEQ ID NO: 3930809 - RNA, 19 nt, Human adenovirus E
gaggaugcagcagcugaag

SEQ ID NO: 3930810 - RNA, 16 nt, Human adenovirus E
gaggauuguccucggu

SEQ ID NO: 3930811 - RNA, 19 nt, Human adenovirus E
acugccgcugcaaccucug

SEQ ID NO: 3930812 - RNA, 14 nt, Human adenovirus E
acugcuaccugcug

SEQ ID NO: 3930813 - RNA, 21 nt, Human adenovirus E
acugggacagcacucaggcag

SEQ ID NO: 3930814 - RNA, 20 nt, Human adenovirus E
acugggagaacagcagucag

SEQ ID NO: 3930815 - RNA, 23 nt, Human adenovirus E
acugucuuccggaucgcugucca

SEQ ID NO: 3930816 - RNA, 24 nt, Human adenovirus E
acugucuuccggaucgcuguccac

SEQ ID NO: 3930817 - RNA, 21 nt, Human adenovirus E
acuucaaccccuucuccggcu

SEQ ID NO: 3930818 - RNA, 22 nt, Human adenovirus E
acuuccucaaacgcccaaaacu

SEQ ID NO: 3930819 - RNA, 20 nt, Human adenovirus E
acuuccucuucuuccuccuc

SEQ ID NO: 3930820 - RNA, 22 nt, Human adenovirus E
  misc_feature (8)..(8): n is a, c, g or u
acuugcangaguuuuuccaggg

SEQ ID NO: 3930821 - RNA, 18 nt, Human adenovirus E
acuugcuguagcagaacc

SEQ ID NO: 3930822 - RNA, 13 nt, Human adenovirus E
acuuuuuccaccc

SEQ ID NO: 3930823 - RNA, 14 nt, Human adenovirus E
agaacagccagagc

SEQ ID NO: 3930824 - RNA, 16 nt, Human adenovirus E
agaagaggcagcagca

SEQ ID NO: 3930825 - RNA, 14 nt, Human adenovirus E
agaagcagcagcag

SEQ ID NO: 3930826 - RNA, 16 nt, Human adenovirus E
agaagcgugggccugu

SEQ ID NO: 3930827 - RNA, 23 nt, Human adenovirus E
agaagcugaaaguggagcugccg

SEQ ID NO: 3930828 - RNA, 21 nt, Human adenovirus E
agaagggcgugcgcuccugga

SEQ ID NO: 3930829 - RNA, 23 nt, Human adenovirus E
agacagcugccguccucccggag

SEQ ID NO: 3930830 - RNA, 14 nt, Human adenovirus E
agacaggagcggcg

SEQ ID NO: 3930831 - RNA, 18 nt, Human adenovirus E
agacaugcaagagaugga

SEQ ID NO: 3930832 - RNA, 16 nt, Human adenovirus E
agaccaaccuggaccg

SEQ ID NO: 3930833 - RNA, 11 nt, Human adenovirus E
agaccgagccc

SEQ ID NO: 3930834 - RNA, 17 nt, Human adenovirus E
agaccgagcuccagcuc

SEQ ID NO: 3930835 - RNA, 15 nt, Human adenovirus E
agaccuaccaggaga

SEQ ID NO: 3930836 - RNA, 18 nt, Human adenovirus E
agagacagcugccguccu

SEQ ID NO: 3930837 - RNA, 22 nt, Human adenovirus E
agagacagcugccguccucccg

SEQ ID NO: 3930838 - RNA, 12 nt, Human adenovirus E
agagcggcgcaa

SEQ ID NO: 3930839 - RNA, 14 nt, Human adenovirus E
agagcgugaugcag

SEQ ID NO: 3930840 - RNA, 23 nt, Human adenovirus E
agagcucgcgcagagcgcccucc

SEQ ID NO: 3930841 - RNA, 13 nt, Human adenovirus E
agaggcagcagca

SEQ ID NO: 3930842 - RNA, 20 nt, Human adenovirus E
agagucgggggcaggagcag

SEQ ID NO: 3930843 - RNA, 14 nt, Human adenovirus E
agauauuugcaauu

SEQ ID NO: 3930844 - RNA, 24 nt, Human adenovirus E
agaucaaaccgcagcagaggaggc

SEQ ID NO: 3930845 - RNA, 16 nt, Human adenovirus E
agauccuaggccuuuu

SEQ ID NO: 3930846 - RNA, 20 nt, Human adenovirus E
agauccucagguaaaucaag

SEQ ID NO: 3930847 - RNA, 14 nt, Human adenovirus E
agauggaggaagac

SEQ ID NO: 3930848 - RNA, 14 nt, Human adenovirus E
agauguacggaggc

SEQ ID NO: 3930849 - RNA, 18 nt, Human adenovirus E
agcaaaguuagccuugca

SEQ ID NO: 3930850 - RNA, 11 nt, Human adenovirus E
agcaaggagga

SEQ ID NO: 3930851 - RNA, 23 nt, Human adenovirus E
agcacagggacgauccccgggcg

SEQ ID NO: 3930852 - RNA, 20 nt, Human adenovirus E
agcagaaaaccagcagcuag

SEQ ID NO: 3930853 - RNA, 17 nt, Human adenovirus E
agcagagaaugagcaga

SEQ ID NO: 3930854 - RNA, 23 nt, Human adenovirus E
agcagauugacaagcggaauauc

SEQ ID NO: 3930855 - RNA, 22 nt, Human adenovirus E
agcagcagaaaaagaccagcag

SEQ ID NO: 3930856 - RNA, 13 nt, Human adenovirus E
agcagcgagcugg

SEQ ID NO: 3930857 - RNA, 22 nt, Human adenovirus E
agcagcuagaaaauccacagcg

SEQ ID NO: 3930858 - RNA, 15 nt, Human adenovirus E
agcagucccacugcu

SEQ ID NO: 3930859 - RNA, 21 nt, Human adenovirus E
agcagugucuggaggagcaga

SEQ ID NO: 3930860 - RNA, 15 nt, Human adenovirus E
agcaucaucugggcc

SEQ ID NO: 3930861 - RNA, 23 nt, Human adenovirus E
agcaucuggcccggcaggccacc

SEQ ID NO: 3930862 - RNA, 18 nt, Human adenovirus E
agcaugagcaccacagcg

SEQ ID NO: 3930863 - RNA, 23 nt, Human adenovirus E
agcaugaugcccacggcccucag

SEQ ID NO: 3930864 - RNA, 22 nt, Human adenovirus E
agcaugguuaguuagcugaucu

SEQ ID NO: 3930865 - RNA, 17 nt, Human adenovirus E
agccagcguccgauccu

SEQ ID NO: 3930866 - RNA, 21 nt, Human adenovirus E
agcccacggccgccagcuccu

SEQ ID NO: 3930867 - RNA, 14 nt, Human adenovirus E
agcccagcaccagc

SEQ ID NO: 3930868 - RNA, 23 nt, Human adenovirus E
agcccaugaucaagcccagcacc

SEQ ID NO: 3930869 - RNA, 18 nt, Human adenovirus E
agcccgccaacgugcccc

SEQ ID NO: 3930870 - RNA, 23 nt, Human adenovirus E
agcccggggaccccgagugguac

SEQ ID NO: 3930871 - RNA, 18 nt, Human adenovirus E
agcccggguccaggccag

SEQ ID NO: 3930872 - RNA, 16 nt, Human adenovirus E
agcccgucccgggggu

SEQ ID NO: 3930873 - RNA, 14 nt, Human adenovirus E
agccgccuccaccc

SEQ ID NO: 3930874 - RNA, 13 nt, Human adenovirus E
agccgccuggacc

SEQ ID NO: 3930875 - RNA, 16 nt, Human adenovirus E
agccgcgcccugggcc

SEQ ID NO: 3930876 - RNA, 23 nt, Human adenovirus E
agccgguggagaaggauagcaag

SEQ ID NO: 3930877 - RNA, 23 nt, Human adenovirus E
agccguuccgcaccgaaggaaga

SEQ ID NO: 3930878 - RNA, 14 nt, Human adenovirus E
agccuaggccacaa

SEQ ID NO: 3930879 - RNA, 21 nt, Human adenovirus E
agccuuguugcgcagggccag

SEQ ID NO: 3930880 - RNA, 17 nt, Human adenovirus E
agccuuuagacagcagc

SEQ ID NO: 3930881 - RNA, 22 nt, Human adenovirus E
agcgaaccccgcagaacagggc

SEQ ID NO: 3930882 - RNA, 18 nt, Human adenovirus E
agcgaagagaccccgggu

SEQ ID NO: 3930883 - RNA, 19 nt, Human adenovirus E
agcgaucccauuugagcug

SEQ ID NO: 3930884 - RNA, 14 nt, Human adenovirus E
agcgccagcaggcg

SEQ ID NO: 3930885 - RNA, 14 nt, Human adenovirus E
agcgccgcagcagu

SEQ ID NO: 3930886 - RNA, 16 nt, Human adenovirus E
agcgccucggccgcgu

SEQ ID NO: 3930887 - RNA, 17 nt, Human adenovirus E
agcgccucggccgcgug

SEQ ID NO: 3930888 - RNA, 22 nt, Human adenovirus E
agcgcgagcgguuccaccgcga

SEQ ID NO: 3930889 - RNA, 21 nt, Human adenovirus E
agcgcgcgucgcccaucuccg

SEQ ID NO: 3930890 - RNA, 21 nt, Human adenovirus E
agcgcgggucucggucuccuc

SEQ ID NO: 3930891 - RNA, 21 nt, Human adenovirus E
agcgcggucauggaccaggug

SEQ ID NO: 3930892 - RNA, 19 nt, Human adenovirus E
agcgcucgcgguggggcgg

SEQ ID NO: 3930893 - RNA, 21 nt, Human adenovirus E
agcgcucgcgguggggcggcc

SEQ ID NO: 3930894 - RNA, 15 nt, Human adenovirus E
agcgcucuaguuuuu

SEQ ID NO: 3930895 - RNA, 14 nt, Human adenovirus E
agcggccaucgcca

SEQ ID NO: 3930896 - RNA, 15 nt, Human adenovirus E
agcuaccuccagugc

SEQ ID NO: 3930897 - RNA, 20 nt, Human adenovirus E
agcuaccuccagugccuucu

SEQ ID NO: 3930898 - RNA, 22 nt, Human adenovirus E
agcuaccuccagugccuucucu

SEQ ID NO: 3930899 - RNA, 13 nt, Human adenovirus E
agcuccagcucca

SEQ ID NO: 3930900 - RNA, 18 nt, Human adenovirus E
agcucggcgaugguggcg

SEQ ID NO: 3930901 - RNA, 21 nt, Human adenovirus E
agcucugcaagcuccugcaga

SEQ ID NO: 3930902 - RNA, 14 nt, Human adenovirus E
agcugaaaguggag

SEQ ID NO: 3930903 - RNA, 22 nt, Human adenovirus E
agcugaaguaugaaugggugga

SEQ ID NO: 3930904 - RNA, 19 nt, Human adenovirus E
agcugagcgaccaggagcu

SEQ ID NO: 3930905 - RNA, 16 nt, Human adenovirus E
agcugcccgaggagca

SEQ ID NO: 3930906 - RNA, 19 nt, Human adenovirus E
agcugcccgaggagcaccc

SEQ ID NO: 3930907 - RNA, 13 nt, Human adenovirus E
agcuggcagugcg

SEQ ID NO: 3930908 - RNA, 21 nt, Human adenovirus E
agcuguuccugguggugcagc

SEQ ID NO: 3930909 - RNA, 21 nt, Human adenovirus E
  misc_feature (5)..(5): n is a, c, g or u
agcunuuccaacccuuccucc

SEQ ID NO: 3930910 - RNA, 14 nt, Human adenovirus E
agcuuaccuuugga

SEQ ID NO: 3930911 - RNA, 12 nt, Human adenovirus E
agcuucuucaac

SEQ ID NO: 3930912 - RNA, 16 nt, Human adenovirus E
agcuugcccucggccu

SEQ ID NO: 3930913 - RNA, 12 nt, Human adenovirus E
cggcgcgugcag

SEQ ID NO: 3930914 - RNA, 17 nt, Human adenovirus E
cggcgcgugcaguggcg

SEQ ID NO: 3930915 - RNA, 19 nt, Human adenovirus E
cggcgcuucugcccccgcc

SEQ ID NO: 3930916 - RNA, 14 nt, Human adenovirus E
cggcggccugggca

SEQ ID NO: 3930917 - RNA, 21 nt, Human adenovirus E
cggcggcgaagacgcgcgccg

SEQ ID NO: 3930918 - RNA, 14 nt, Human adenovirus E
cggcggcgaugcag

SEQ ID NO: 3930919 - RNA, 15 nt, Human adenovirus E
cggcggcggcgaugc

SEQ ID NO: 3930920 - RNA, 18 nt, Human adenovirus E
cggcgggcgcagcagcgc

SEQ ID NO: 3930921 - RNA, 14 nt, Human adenovirus E
cggcggugacuagg

SEQ ID NO: 3930922 - RNA, 16 nt, Human adenovirus E
cggcuccccgcgcacc

SEQ ID NO: 3930923 - RNA, 16 nt, Human adenovirus E
cggcucggggcccgga

SEQ ID NO: 3930924 - RNA, 16 nt, Human adenovirus E
cgggacgcagggccau

SEQ ID NO: 3930925 - RNA, 16 nt, Human adenovirus E
cgggcaaccuggaagc

SEQ ID NO: 3930926 - RNA, 23 nt, Human adenovirus E
cgggcacucccgcaucugcaccu

SEQ ID NO: 3930927 - RNA, 22 nt, Human adenovirus E
cgggccuuggaggcggcggcag

SEQ ID NO: 3930928 - RNA, 12 nt, Human adenovirus E
cgggcggcaggg

SEQ ID NO: 3930929 - RNA, 14 nt, Human adenovirus E
cgggcggcaggggc

SEQ ID NO: 3930930 - RNA, 21 nt, Human adenovirus E
cggggaguccagcgcgugacc

SEQ ID NO: 3930931 - RNA, 14 nt, Human adenovirus E
cggggcagcgccgc

SEQ ID NO: 3930932 - RNA, 12 nt, Human adenovirus E
cgggggcggugc

SEQ ID NO: 3930933 - RNA, 16 nt, Human adenovirus E
cggggucgcugagccc

SEQ ID NO: 3930934 - RNA, 14 nt, Human adenovirus E
cggggugcuggaga

SEQ ID NO: 3930935 - RNA, 23 nt, Human adenovirus E
cgggguggacuucaccgagagcc

SEQ ID NO: 3930936 - RNA, 20 nt, Human adenovirus E
cgggugcuucacgcucgcca

SEQ ID NO: 3930937 - RNA, 14 nt, Human adenovirus E
cggucauguggaug

SEQ ID NO: 3930938 - RNA, 19 nt, Human adenovirus E
cggucgcccgucucucagc

SEQ ID NO: 3930939 - RNA, 22 nt, Human adenovirus E
cggugaggagcucaaccccggc

SEQ ID NO: 3930940 - RNA, 14 nt, Human adenovirus E
cggugaugcucucc

SEQ ID NO: 3930941 - RNA, 14 nt, Human adenovirus E
cggugcccgaggcc

SEQ ID NO: 3930942 - RNA, 17 nt, Human adenovirus E
cggugccgcccaggacu

SEQ ID NO: 3930943 - RNA, 20 nt, Human adenovirus E
cggugcugacggcuccccgc

SEQ ID NO: 3930944 - RNA, 23 nt, Human adenovirus E
cgguggugucgcaucaggccccg

SEQ ID NO: 3930945 - RNA, 22 nt, Human adenovirus E
cggugugccccgguucgaggcc

SEQ ID NO: 3930946 - RNA, 20 nt, Human adenovirus E
cgguguucuuuuaacagaac

SEQ ID NO: 3930947 - RNA, 13 nt, Human adenovirus E
cgguuccaccgcg

SEQ ID NO: 3930948 - RNA, 17 nt, Human adenovirus E
cgguuguaccuggugga

SEQ ID NO: 3930949 - RNA, 21 nt, Human adenovirus E
cguagaggaaccccgcccacu

SEQ ID NO: 3930950 - RNA, 13 nt, Human adenovirus E
cguaggccugggc

SEQ ID NO: 3930951 - RNA, 14 nt, Human adenovirus E
cguaguugagcgcc

SEQ ID NO: 3930952 - RNA, 18 nt, Human adenovirus E
cgucaagcugcugcucag

SEQ ID NO: 3930953 - RNA, 12 nt, Human adenovirus E
cgucacccgccc

SEQ ID NO: 3930954 - RNA, 15 nt, Human adenovirus E
acagggcaggcgcug

SEQ ID NO: 3930955 - RNA, 23 nt, Human adenovirus E
acaguagaugggacgagaccgga

SEQ ID NO: 3930956 - RNA, 13 nt, Human adenovirus E
acaguauccgcag

SEQ ID NO: 3930957 - RNA, 18 nt, Human adenovirus E
acaguauccgcagcagcg

SEQ ID NO: 3930958 - RNA, 22 nt, Human adenovirus E
acaguuagucucuccacuuaca

SEQ ID NO: 3930959 - RNA, 15 nt, Human adenovirus E
acauccagaaacaag

SEQ ID NO: 3930960 - RNA, 16 nt, Human adenovirus E
acauguggagcuacca

SEQ ID NO: 3930961 - RNA, 18 nt, Human adenovirus E
accacaauuacucacacc

SEQ ID NO: 3930962 - RNA, 14 nt, Human adenovirus E
accacacacacaga

SEQ ID NO: 3930963 - RNA, 16 nt, Human adenovirus E
accaccacagcaaccu

SEQ ID NO: 3930964 - RNA, 14 nt, Human adenovirus E
accaccacuacagc

SEQ ID NO: 3930965 - RNA, 14 nt, Human adenovirus E
accacuacagcagc

SEQ ID NO: 3930966 - RNA, 18 nt, Human adenovirus E
accacucgccgcucgccg

SEQ ID NO: 3930967 - RNA, 13 nt, Human adenovirus E
accacuucacucc

SEQ ID NO: 3930968 - RNA, 16 nt, Human adenovirus E
accagcaagccgcuga

SEQ ID NO: 3930969 - RNA, 22 nt, Human adenovirus E
accagcaccauggaggugcaga

SEQ ID NO: 3930970 - RNA, 13 nt, Human adenovirus E
accaggagcugau

SEQ ID NO: 3930971 - RNA, 15 nt, Human adenovirus E
accaggccgugcagc

SEQ ID NO: 3930972 - RNA, 19 nt, Human adenovirus E
accaguuccgccaggaggc

SEQ ID NO: 3930973 - RNA, 13 nt, Human adenovirus E
accaugcagcuga

SEQ ID NO: 3930974 - RNA, 22 nt, Human adenovirus E
accauuaccaccgucagugaaa

SEQ ID NO: 3930975 - RNA, 21 nt, Human adenovirus E
acccacgugagccgcgcccug

SEQ ID NO: 3930976 - RNA, 22 nt, Human adenovirus E
acccagccagaugaugcaauuu

SEQ ID NO: 3930977 - RNA, 21 nt, Human adenovirus E
acccagcccgccaacgugccc

SEQ ID NO: 3930978 - RNA, 12 nt, Human adenovirus E
accccacccagu

SEQ ID NO: 3930979 - RNA, 15 nt, Human adenovirus E
accccacgccgagcc

SEQ ID NO: 3930980 - RNA, 14 nt, Human adenovirus E
acccccaguaccgc

SEQ ID NO: 3930981 - RNA, 23 nt, Human adenovirus E
acccccgccaugcgcgcggcgcg

SEQ ID NO: 3930982 - RNA, 13 nt, Human adenovirus E
accccugccgccc

SEQ ID NO: 3930983 - RNA, 15 nt, Human adenovirus E
acccgagcaucgcca

SEQ ID NO: 3930984 - RNA, 17 nt, Human adenovirus E
acccgcucucugcucaa

SEQ ID NO: 3930985 - RNA, 14 nt, Human adenovirus E
acccggacgugcag

SEQ ID NO: 3930986 - RNA, 17 nt, Human adenovirus E
acccggacgugcagccc

SEQ ID NO: 3930987 - RNA, 21 nt, Human adenovirus E
acccggcgcuaccugcucuuc

SEQ ID NO: 3930988 - RNA, 15 nt, Human adenovirus E
acccucaucuccuuu

SEQ ID NO: 3930989 - RNA, 13 nt, Human adenovirus E
accgagcccauga

SEQ ID NO: 3930990 - RNA, 19 nt, Human adenovirus E
accgagggggagagcuacu

SEQ ID NO: 3930991 - RNA, 19 nt, Human adenovirus E
accgcaccgaggugccccu

SEQ ID NO: 3930992 - RNA, 19 nt, Human adenovirus E
accgcagcuugcccucggc

SEQ ID NO: 3930993 - RNA, 19 nt, Human adenovirus E
accgccccgccgcccagcc

SEQ ID NO: 3930994 - RNA, 14 nt, Human adenovirus E
accgccgacgagaa

SEQ ID NO: 3930995 - RNA, 23 nt, Human adenovirus E
accgccgacgagaagcagcagca

SEQ ID NO: 3930996 - RNA, 19 nt, Human adenovirus E
accgccucggaccuggccg

SEQ ID NO: 3930997 - RNA, 19 nt, Human adenovirus E
accgcgaguccaaccuggg

SEQ ID NO: 3930998 - RNA, 11 nt, Human adenovirus E
accgcggcgcc

SEQ ID NO: 3930999 - RNA, 15 nt, Human adenovirus E
accggggccgggacc

SEQ ID NO: 3931000 - RNA, 19 nt, Human adenovirus E
accgugaaccugagccagg

SEQ ID NO: 3931001 - RNA, 13 nt, Human adenovirus E
accguggugcaga

SEQ ID NO: 3931002 - RNA, 17 nt, Human adenovirus E
accucauuuuccccgag

SEQ ID NO: 3931003 - RNA, 12 nt, Human adenovirus E
accuccacagcc

SEQ ID NO: 3931004 - RNA, 16 nt, Human adenovirus E
accucgacccccagac

SEQ ID NO: 3931005 - RNA, 19 nt, Human adenovirus E
accucugccacaccuggca

SEQ ID NO: 3931006 - RNA, 18 nt, Human adenovirus E
accugaaagagcucugca

SEQ ID NO: 3931007 - RNA, 19 nt, Human adenovirus E
accugcacuaccucuucag

SEQ ID NO: 3931008 - RNA, 17 nt, Human adenovirus E
accugcaucugcugcug

SEQ ID NO: 3931009 - RNA, 14 nt, Human adenovirus E
accugcggggcgau

SEQ ID NO: 3931010 - RNA, 18 nt, Human adenovirus E
accuggaagccacccuga

SEQ ID NO: 3931011 - RNA, 12 nt, Human adenovirus E
accuggccaacc

SEQ ID NO: 3931012 - RNA, 17 nt, Human adenovirus E
accuggccaaccaggcc

SEQ ID NO: 3931013 - RNA, 22 nt, Human adenovirus E
accugggauccaugguggcgcu

SEQ ID NO: 3931014 - RNA, 22 nt, Human adenovirus E
accuguuaccacuaugcagcuc

SEQ ID NO: 3931015 - RNA, 21 nt, Human adenovirus E
accuguucagagacaggagcg

SEQ ID NO: 3931016 - RNA, 23 nt, Human adenovirus E
acgaaggcgcgcaggccggagcu

SEQ ID NO: 3931017 - RNA, 16 nt, Human adenovirus E
acgacccgcaaccccg

SEQ ID NO: 3931018 - RNA, 16 nt, Human adenovirus E
acgagcagcuggcccg

SEQ ID NO: 3931019 - RNA, 19 nt, Human adenovirus E
acgauauguggccccccac

SEQ ID NO: 3931020 - RNA, 15 nt, Human adenovirus E
acgauuggacccagg

SEQ ID NO: 3931021 - RNA, 21 nt, Human adenovirus E
acgcacgagaagguccuggcc

SEQ ID NO: 3931022 - RNA, 16 nt, Human adenovirus E
acgcccguccucggcg

SEQ ID NO: 3931023 - RNA, 19 nt, Human adenovirus E
acgcccuuuucaaccuggg

SEQ ID NO: 3931024 - RNA, 12 nt, Human adenovirus E
acgccgcaccgc

SEQ ID NO: 3931025 - RNA, 18 nt, Human adenovirus E
acgccugcugggccuugg

SEQ ID NO: 3931026 - RNA, 19 nt, Human adenovirus E
acgccugcugggccuuggc

SEQ ID NO: 3931027 - RNA, 20 nt, Human adenovirus E
acgccugcugggccuuggcu

SEQ ID NO: 3931028 - RNA, 14 nt, Human adenovirus E
acgcugcccacgua

SEQ ID NO: 3931029 - RNA, 15 nt, Human adenovirus E
acggaacugcugccc

SEQ ID NO: 3931030 - RNA, 17 nt, Human adenovirus E
acggacagcggcagcau

SEQ ID NO: 3931031 - RNA, 14 nt, Human adenovirus E
acggaggccagcac

SEQ ID NO: 3931032 - RNA, 22 nt, Human adenovirus E
acggcgcagcuguuccuggugg

SEQ ID NO: 3931033 - RNA, 21 nt, Human adenovirus E
acggcgcggccagccugcuga

SEQ ID NO: 3931034 - RNA, 19 nt, Human adenovirus E
acggcguacgagcagaccg

SEQ ID NO: 3931035 - RNA, 17 nt, Human adenovirus E
acgggcagcccuuuggu

SEQ ID NO: 3931036 - RNA, 19 nt, Human adenovirus E
acggggugguggaccuggc

SEQ ID NO: 3931037 - RNA, 15 nt, Human adenovirus E
acgucaccugcggcg

SEQ ID NO: 3931038 - RNA, 19 nt, Human adenovirus E
acgucagcggcgagggccu

SEQ ID NO: 3931039 - RNA, 14 nt, Human adenovirus E
acgucguggugguc

SEQ ID NO: 3931040 - RNA, 21 nt, Human adenovirus E
acgugagccgcgcccugggcc

SEQ ID NO: 3931041 - RNA, 18 nt, Human adenovirus E
acgugcgcgaggccgugg

SEQ ID NO: 3931042 - RNA, 18 nt, Human adenovirus E
acgugcucuuugccuuca

SEQ ID NO: 3931043 - RNA, 18 nt, Human adenovirus E
acguggacgagcagaccu

SEQ ID NO: 3931044 - RNA, 14 nt, Human adenovirus E
acuacaaugcucag

SEQ ID NO: 3931045 - RNA, 19 nt, Human adenovirus E
acuacaaugcucagucuca

SEQ ID NO: 3931046 - RNA, 14 nt, Human adenovirus E
acucaaaaaaauac

SEQ ID NO: 3931047 - RNA, 14 nt, Human adenovirus E
acucaagggucugu

SEQ ID NO: 3931048 - RNA, 18 nt, Human adenovirus E
acucagccaucgccaacc

SEQ ID NO: 3931049 - RNA, 12 nt, Human adenovirus E
acuccaccucca

SEQ ID NO: 3931050 - RNA, 22 nt, Human adenovirus E
acuccaccuccacccaccacaa

SEQ ID NO: 3931051 - RNA, 16 nt, Human adenovirus E
acuccccuccugcaca

SEQ ID NO: 3931052 - RNA, 14 nt, Human adenovirus E
acuccccugaagca

SEQ ID NO: 3931053 - RNA, 19 nt, Human adenovirus E
acuccuagccccguccucu

SEQ ID NO: 3931054 - RNA, 12 nt, Human adenovirus E
acuccuccucca

SEQ ID NO: 3931055 - RNA, 14 nt, Human adenovirus E
acucgcagcagcug

SEQ ID NO: 3931056 - RNA, 15 nt, Human adenovirus E
acucgccagaggcgc

SEQ ID NO: 3931057 - RNA, 18 nt, Human adenovirus E
acucucaacuccucgggg

SEQ ID NO: 3931058 - RNA, 15 nt, Human adenovirus E
acugaaagucaagaa

SEQ ID NO: 3931059 - RNA, 21 nt, Human adenovirus E
acugaacgacaagcuggaaca

SEQ ID NO: 3931060 - RNA, 20 nt, Human adenovirus E
acugcuaguaccaaugagca

SEQ ID NO: 3931061 - RNA, 21 nt, Human adenovirus E
acugguagguguagagggugc

SEQ ID NO: 3931062 - RNA, 22 nt, Human adenovirus E
acuucaaccccuucuccggcuc

SEQ ID NO: 3931063 - RNA, 17 nt, Human adenovirus E
acuucaucagcgcccug

SEQ ID NO: 3931064 - RNA, 14 nt, Human adenovirus E
acuuccaagaagag

SEQ ID NO: 3931065 - RNA, 13 nt, Human adenovirus E
acuucgugccgcu

SEQ ID NO: 3931066 - RNA, 15 nt, Human adenovirus E
acuucucggugcuga

SEQ ID NO: 3931067 - RNA, 17 nt, Human adenovirus E
acuuggccagccacuug

SEQ ID NO: 3931068 - RNA, 18 nt, Human adenovirus E
acuuugagcugcccgagg

SEQ ID NO: 3931069 - RNA, 14 nt, Human adenovirus E
agaaagcaagcagc

SEQ ID NO: 3931070 - RNA, 16 nt, Human adenovirus E
agaaagcaagcagcac

SEQ ID NO: 3931071 - RNA, 15 nt, Human adenovirus E
aggcuggagccgcag

SEQ ID NO: 3931072 - RNA, 22 nt, Human adenovirus E
agggcccagcgaaggcgagggu

SEQ ID NO: 3931073 - RNA, 22 nt, Human adenovirus E
agggccgcuggcuccuggaccu

SEQ ID NO: 3931074 - RNA, 20 nt, Human adenovirus E
agggcgaguaccuggaagac

SEQ ID NO: 3931075 - RNA, 14 nt, Human adenovirus E
aggggacgagcugc

SEQ ID NO: 3931076 - RNA, 19 nt, Human adenovirus E
agggggcgauccuggccca

SEQ ID NO: 3931077 - RNA, 18 nt, Human adenovirus E
agggggucaucuugcagg

SEQ ID NO: 3931078 - RNA, 20 nt, Human adenovirus E
aggguucucuaauuccucaa

SEQ ID NO: 3931079 - RNA, 13 nt, Human adenovirus E
agguacaugggca

SEQ ID NO: 3931080 - RNA, 23 nt, Human adenovirus E
  misc_feature (14)..(14): n is a, c, g or u
aggucagugggcancggcggcgc

SEQ ID NO: 3931081 - RNA, 18 nt, Human adenovirus E
aggucgaggagaaccugc

SEQ ID NO: 3931082 - RNA, 13 nt, Human adenovirus E
aggugaggaagag

SEQ ID NO: 3931083 - RNA, 14 nt, Human adenovirus E
aggugaggaagagc

SEQ ID NO: 3931084 - RNA, 16 nt, Human adenovirus E
agguuguucaacaguc

SEQ ID NO: 3931085 - RNA, 17 nt, Human adenovirus E
agucgaagaccccggcg

SEQ ID NO: 3931086 - RNA, 15 nt, Human adenovirus E
agucgcugccgccgc

SEQ ID NO: 3931087 - RNA, 15 nt, Human adenovirus E
agucgguccacagcu

SEQ ID NO: 3931088 - RNA, 19 nt, Human adenovirus E
agucugcagcgggcccuga

SEQ ID NO: 3931089 - RNA, 15 nt, Human adenovirus E
agucuggaggaagac

SEQ ID NO: 3931090 - RNA, 12 nt, Human adenovirus E
agugccacugcc

SEQ ID NO: 3931091 - RNA, 23 nt, Human adenovirus E
agugcgucucgggacccugccau

SEQ ID NO: 3931092 - RNA, 13 nt, Human adenovirus E
agugcucaggugu

SEQ ID NO: 3931093 - RNA, 20 nt, Human adenovirus E
aguggccagaucguccaggg

SEQ ID NO: 3931094 - RNA, 16 nt, Human adenovirus E
aguggcgcggcugcuc

SEQ ID NO: 3931095 - RNA, 23 nt, Human adenovirus E
aguguuuuauugauucaacaguu

SEQ ID NO: 3931096 - RNA, 17 nt, Human adenovirus E
aguucauguacagcaac

SEQ ID NO: 3931097 - RNA, 21 nt, Human adenovirus E
aguucgugagguaaauccaag

SEQ ID NO: 3931098 - RNA, 18 nt, Human adenovirus E
aguuugcuuacggcaagc

SEQ ID NO: 3931099 - RNA, 22 nt, Human adenovirus E
aguuuggaagcaguaguacaga

SEQ ID NO: 3931100 - RNA, 15 nt, Human adenovirus E
auaacuguaaguacu

SEQ ID NO: 3931101 - RNA, 22 nt, Human adenovirus E
auacccgccaaauaaucacaca

SEQ ID NO: 3931102 - RNA, 19 nt, Human adenovirus E
auacgcgcacuuccucaaa

SEQ ID NO: 3931103 - RNA, 20 nt, Human adenovirus E
auacucaccaaggccauggc

SEQ ID NO: 3931104 - RNA, 14 nt, Human adenovirus E
auauaccaaugcug

SEQ ID NO: 3931105 - RNA, 19 nt, Human adenovirus E
aucacacacgcccagcaca

SEQ ID NO: 3931106 - RNA, 18 nt, Human adenovirus E
aucagacaugcaucccag

SEQ ID NO: 3931107 - RNA, 15 nt, Human adenovirus E
aucagacccacugcu

SEQ ID NO: 3931108 - RNA, 19 nt, Human adenovirus E
aucagcaucaucugggccu

SEQ ID NO: 3931109 - RNA, 17 nt, Human adenovirus E
aucagcgccccgcaucc

SEQ ID NO: 3931110 - RNA, 19 nt, Human adenovirus E
aucaugccugauggcucug

SEQ ID NO: 3931111 - RNA, 14 nt, Human adenovirus E
aucauugagcaccc

SEQ ID NO: 3931112 - RNA, 23 nt, Human adenovirus E
auccaucgagauugaccugggcu

SEQ ID NO: 3931113 - RNA, 14 nt, Human adenovirus E
aucccgcuggacca

SEQ ID NO: 3931114 - RNA, 19 nt, Human adenovirus E
auccgcagcagcgagcugg

SEQ ID NO: 3931115 - RNA, 23 nt, Human adenovirus E
auccgcagcagcgagcugggcag

SEQ ID NO: 3931116 - RNA, 23 nt, Human adenovirus E
auccugcccgccaccugcuccgc

SEQ ID NO: 3931117 - RNA, 13 nt, Human adenovirus E
aucgcccaagaau

SEQ ID NO: 3931118 - RNA, 20 nt, Human adenovirus E
aucucuucuacuuccuccuc

SEQ ID NO: 3931119 - RNA, 13 nt, Human adenovirus E
aucugccuccucc

SEQ ID NO: 3931120 - RNA, 16 nt, Human adenovirus E
aucuguugagcuggga

SEQ ID NO: 3931121 - RNA, 16 nt, Human adenovirus E
aucuucucuucucuuu

SEQ ID NO: 3931122 - RNA, 15 nt, Human adenovirus E
augacagcaacagua

SEQ ID NO: 3931123 - RNA, 15 nt, Human adenovirus E
augacugacccacug

SEQ ID NO: 3931124 - RNA, 11 nt, Human adenovirus E
augagcugggc

SEQ ID NO: 3931125 - RNA, 22 nt, Human adenovirus E
augauucgacaagaugaauaca

SEQ ID NO: 3931126 - RNA, 15 nt, Human adenovirus E
augcaagagauggag

SEQ ID NO: 3931127 - RNA, 12 nt, Human adenovirus E
augcagcagcug

SEQ ID NO: 3931128 - RNA, 16 nt, Human adenovirus E
augcagcugauggugc

SEQ ID NO: 3931129 - RNA, 17 nt, Human adenovirus E
augcccacggcccucag

SEQ ID NO: 3931130 - RNA, 14 nt, Human adenovirus E
augccccgaggaaa

SEQ ID NO: 3931131 - RNA, 22 nt, Human adenovirus E
augcugacgagcccgcgcggga

SEQ ID NO: 3931132 - RNA, 17 nt, Human adenovirus E
auggaggaagacuggga

SEQ ID NO: 3931133 - RNA, 13 nt, Human adenovirus E
auggcgaccagcg

SEQ ID NO: 3931134 - RNA, 13 nt, Human adenovirus E
augggccuggccg

SEQ ID NO: 3931135 - RNA, 16 nt, Human adenovirus E
augggcgcggaccugc

SEQ ID NO: 3931136 - RNA, 14 nt, Human adenovirus E
augguacugaucug

SEQ ID NO: 3931137 - RNA, 19 nt, Human adenovirus E
auguccaccugcggggcga

SEQ ID NO: 3931138 - RNA, 21 nt, Human adenovirus E
augucguagacguagaggggc

SEQ ID NO: 3931139 - RNA, 13 nt, Human adenovirus E
augugacacuggu

SEQ ID NO: 3931140 - RNA, 16 nt, Human adenovirus E
augugucccagcggcg

SEQ ID NO: 3931141 - RNA, 23 nt, Human adenovirus E
auguuuucugccaacaccacuuc

SEQ ID NO: 3931142 - RNA, 17 nt, Human adenovirus E
auuaccucugcucuaug

SEQ ID NO: 3931143 - RNA, 17 nt, Human adenovirus E
auuacuccccuccugca

SEQ ID NO: 3931144 - RNA, 16 nt, Human adenovirus E
auuagggcaagccaca

SEQ ID NO: 3931145 - RNA, 19 nt, Human adenovirus E
auuccuaaaguuagcuuua

SEQ ID NO: 3931146 - RNA, 22 nt, Human adenovirus E
auucuacacuaaaaaaauacug

SEQ ID NO: 3931147 - RNA, 14 nt, Human adenovirus E
auucugcagagcau

SEQ ID NO: 3931148 - RNA, 21 nt, Human adenovirus E
auugaaagcaacauaagcugg

SEQ ID NO: 3931149 - RNA, 22 nt, Human adenovirus E
auugaacuaugauuccuagaca

SEQ ID NO: 3931150 - RNA, 17 nt, Human adenovirus E
auuuuaaugaaucagau

SEQ ID NO: 3931151 - RNA, 17 nt, Human adenovirus E
caaaaaguuugagguau

SEQ ID NO: 3931152 - RNA, 13 nt, Human adenovirus E
caaacgcccaaaa

SEQ ID NO: 3931153 - RNA, 15 nt, Human adenovirus E
caaacuaaccuccac

SEQ ID NO: 3931154 - RNA, 20 nt, Human adenovirus E
caaacucaugauggccgugg

SEQ ID NO: 3931155 - RNA, 13 nt, Human adenovirus E
caaagagcugucc

SEQ ID NO: 3931156 - RNA, 14 nt, Human adenovirus E
caaagagcuguccg

SEQ ID NO: 3931157 - RNA, 17 nt, Human adenovirus E
caaagcauguugcaaaa

SEQ ID NO: 3931158 - RNA, 23 nt, Human adenovirus E
caacaaaagaaaaauccuccagg

SEQ ID NO: 3931159 - RNA, 14 nt, Human adenovirus E
caacacgcuccagc

SEQ ID NO: 3931160 - RNA, 19 nt, Human adenovirus E
caacagcccccuccacagc

SEQ ID NO: 3931161 - RNA, 14 nt, Human adenovirus E
caacagcugaggau

SEQ ID NO: 3931162 - RNA, 14 nt, Human adenovirus E
caaccaaccucugg

SEQ ID NO: 3931163 - RNA, 19 nt, Human adenovirus E
caacccuuccuccccggga

SEQ ID NO: 3931164 - RNA, 22 nt, Human adenovirus E
caaccgcaacucguaccugggc

SEQ ID NO: 3931165 - RNA, 17 nt, Human adenovirus E
caaccuggaagccaccc

SEQ ID NO: 3931166 - RNA, 19 nt, Human adenovirus E
caaccuggaagccacccug

SEQ ID NO: 3931167 - RNA, 12 nt, Human adenovirus E
caacggccugcc

SEQ ID NO: 3931168 - RNA, 19 nt, Human adenovirus E
caacgugcagaccaaccug

SEQ ID NO: 3931169 - RNA, 20 nt, Human adenovirus E
caacgugcagaccaaccugg

SEQ ID NO: 3931170 - RNA, 19 nt, Human adenovirus E
caacgugccccggggccag

SEQ ID NO: 3931171 - RNA, 22 nt, Human adenovirus E
caacguggagcugaccaaccug

SEQ ID NO: 3931172 - RNA, 16 nt, Human adenovirus E
caagaagaggcagcag

SEQ ID NO: 3931173 - RNA, 17 nt, Human adenovirus E
caagaagaggcagcagc

SEQ ID NO: 3931174 - RNA, 15 nt, Human adenovirus E
caagaagcugaaagu

SEQ ID NO: 3931175 - RNA, 22 nt, Human adenovirus E
caagagcuucuucaacgagcag

SEQ ID NO: 3931176 - RNA, 23 nt, Human adenovirus E
caagcagaaccuguucagagaca

SEQ ID NO: 3931177 - RNA, 12 nt, Human adenovirus E
caagcauggaga

SEQ ID NO: 3931178 - RNA, 11 nt, Human adenovirus E
caagcgccgca

SEQ ID NO: 3931179 - RNA, 15 nt, Human adenovirus E
caagcgccgcagcag

SEQ ID NO: 3931180 - RNA, 17 nt, Human adenovirus E
caagcuggaacacuuac

SEQ ID NO: 3931181 - RNA, 14 nt, Human adenovirus E
caaggagaaggagg

SEQ ID NO: 3931182 - RNA, 14 nt, Human adenovirus E
caaggaggaugcag

SEQ ID NO: 3931183 - RNA, 21 nt, Human adenovirus E
caaggaggaugcagcagcuga

SEQ ID NO: 3931184 - RNA, 16 nt, Human adenovirus E
caaggcguggaacagc

SEQ ID NO: 3931185 - RNA, 15 nt, Human adenovirus E
caagggucuguggac

SEQ ID NO: 3931186 - RNA, 18 nt, Human adenovirus E
caaguacggcgcggccag

SEQ ID NO: 3931187 - RNA, 19 nt, Human adenovirus E
caaguccuggcgggggcac

SEQ ID NO: 3931188 - RNA, 15 nt, Human adenovirus E
cagccgaaacucauc

SEQ ID NO: 3931189 - RNA, 22 nt, Human adenovirus E
cagccgccuggacccggugccg

SEQ ID NO: 3931190 - RNA, 15 nt, Human adenovirus E
cagccgcggccaggg

SEQ ID NO: 3931191 - RNA, 13 nt, Human adenovirus E
cagccguuccgca

SEQ ID NO: 3931192 - RNA, 20 nt, Human adenovirus E
cagcgaaccccgcagaacag

SEQ ID NO: 3931193 - RNA, 15 nt, Human adenovirus E
cagcgacgagcagcu

SEQ ID NO: 3931194 - RNA, 17 nt, Human adenovirus E
cagcgccggcaggaccc

SEQ ID NO: 3931195 - RNA, 14 nt, Human adenovirus E
cagcgccuccaaac

SEQ ID NO: 3931196 - RNA, 12 nt, Human adenovirus E
cagcggcagcau

SEQ ID NO: 3931197 - RNA, 12 nt, Human adenovirus E
cagcggcggcag

SEQ ID NO: 3931198 - RNA, 13 nt, Human adenovirus E
cagcggcggcagc

SEQ ID NO: 3931199 - RNA, 21 nt, Human adenovirus E
cagcggcucgacuccguggcc

SEQ ID NO: 3931200 - RNA, 22 nt, Human adenovirus E
cagcggcuugaguccgucggcc

SEQ ID NO: 3931201 - RNA, 18 nt, Human adenovirus E
cagcggggugucggggaa

SEQ ID NO: 3931202 - RNA, 12 nt, Human adenovirus E
cagcgugguggc

SEQ ID NO: 3931203 - RNA, 22 nt, Human adenovirus E
cagcugaagcaacugcagccgu

SEQ ID NO: 3931204 - RNA, 21 nt, Human adenovirus E
cagcugcaccacgcugcgccc

SEQ ID NO: 3931205 - RNA, 22 nt, Human adenovirus E
cagcugccguccucccggagga

SEQ ID NO: 3931206 - RNA, 20 nt, Human adenovirus E
cagcuggccuuggaagaggg

SEQ ID NO: 3931207 - RNA, 23 nt, Human adenovirus E
cagcugggacuugccgcagccgg

SEQ ID NO: 3931208 - RNA, 17 nt, Human adenovirus E
caggaaauuccccagcc

SEQ ID NO: 3931209 - RNA, 14 nt, Human adenovirus E
caggaacugaaagu

SEQ ID NO: 3931210 - RNA, 13 nt, Human adenovirus E
caggaccaccagc

SEQ ID NO: 3931211 - RNA, 19 nt, Human adenovirus E
caggacccgguagaggugg

SEQ ID NO: 3931212 - RNA, 16 nt, Human adenovirus E
caggacuacuccaccc

SEQ ID NO: 3931213 - RNA, 17 nt, Human adenovirus E
caggagcgcgggcugcc

SEQ ID NO: 3931214 - RNA, 20 nt, Human adenovirus E
caggagcgcgggcugccgcu

SEQ ID NO: 3931215 - RNA, 23 nt, Human adenovirus E
caggcagaggaggaggagaugga

SEQ ID NO: 3931216 - RNA, 13 nt, Human adenovirus E
caggcagcaaagc

SEQ ID NO: 3931217 - RNA, 12 nt, Human adenovirus E
caggcagcaccg

SEQ ID NO: 3931218 - RNA, 16 nt, Human adenovirus E
caggccccgcagcagu

SEQ ID NO: 3931219 - RNA, 21 nt, Human adenovirus E
caggccucucagcgccacuga

SEQ ID NO: 3931220 - RNA, 16 nt, Human adenovirus E
caggcgauggcggcgg

SEQ ID NO: 3931221 - RNA, 23 nt, Human adenovirus E
caggcgcacgggacgcagggcca

SEQ ID NO: 3931222 - RNA, 10 nt, Human adenovirus E
caggcggcag

SEQ ID NO: 3931223 - RNA, 20 nt, Human adenovirus E
caggcggcgcgagcugagcg

SEQ ID NO: 3931224 - RNA, 13 nt, Human adenovirus E
caggcggucccag

SEQ ID NO: 3931225 - RNA, 16 nt, Human adenovirus E
caggcuggagccgcag

SEQ ID NO: 3931226 - RNA, 19 nt, Human adenovirus E
caggcugggcugggacccc

SEQ ID NO: 3931227 - RNA, 18 nt, Human adenovirus E
caggcuuugagcucggag

SEQ ID NO: 3931228 - RNA, 21 nt, Human adenovirus E
caggcuuugagcucggagggg

SEQ ID NO: 3931229 - RNA, 19 nt, Human adenovirus E
cagggacucccucagcaug

SEQ ID NO: 3931230 - RNA, 15 nt, Human adenovirus E
cagggaggcgcugcu

SEQ ID NO: 3931231 - RNA, 17 nt, Human adenovirus E
cagggccagcaccgccc

SEQ ID NO: 3931232 - RNA, 20 nt, Human adenovirus E
cagggccauguucagggcgg

SEQ ID NO: 3931233 - RNA, 14 nt, Human adenovirus E
cagggcggccagac

SEQ ID NO: 3931234 - RNA, 16 nt, Human adenovirus E
caggggguccagcaug

SEQ ID NO: 3931235 - RNA, 23 nt, Human adenovirus E
caggguauaaagcggcuggugau

SEQ ID NO: 3931236 - RNA, 21 nt, Human adenovirus E
caggguaucgcaaucaggcag

SEQ ID NO: 3931237 - RNA, 20 nt, Human adenovirus E
caggugcugccgaccgcggc

SEQ ID NO: 3931238 - RNA, 18 nt, Human adenovirus E
cagguucuacgaggacca

SEQ ID NO: 3931239 - RNA, 14 nt, Human adenovirus E
caguaguacagaaa

SEQ ID NO: 3931240 - RNA, 16 nt, Human adenovirus E
cagucaggcagaggag

SEQ ID NO: 3931241 - RNA, 16 nt, Human adenovirus E
caguccuuucccgagc

SEQ ID NO: 3931242 - RNA, 18 nt, Human adenovirus E
cagucuggaggaagacga

SEQ ID NO: 3931243 - RNA, 14 nt, Human adenovirus E
cagugucuggagga

SEQ ID NO: 3931244 - RNA, 18 nt, Human adenovirus E
caguuacaccugcccugg

SEQ ID NO: 3931245 - RNA, 16 nt, Human adenovirus E
caguuagucucuccac

SEQ ID NO: 3931246 - RNA, 17 nt, Human adenovirus E
caguuagucucuccacu

SEQ ID NO: 3931247 - RNA, 18 nt, Human adenovirus E
caguuauuuuuccuccac

SEQ ID NO: 3931248 - RNA, 12 nt, Human adenovirus E
cauacuccaccu

SEQ ID NO: 3931249 - RNA, 15 nt, Human adenovirus E
cauagcaaccaacau

SEQ ID NO: 3931250 - RNA, 20 nt, Human adenovirus E
cauagcuuaccgagcagcag

SEQ ID NO: 3931251 - RNA, 21 nt, Human adenovirus E
cauagcuuaccgagcagcagc

SEQ ID NO: 3931252 - RNA, 16 nt, Human adenovirus E
cauaggaccaccagga

SEQ ID NO: 3931253 - RNA, 21 nt, Human adenovirus E
cauagucugcagcgggcccug

SEQ ID NO: 3931254 - RNA, 15 nt, Human adenovirus E
cauagucugccugcu

SEQ ID NO: 3931255 - RNA, 21 nt, Human adenovirus E
cauaguugugguccuggguga

SEQ ID NO: 3931256 - RNA, 18 nt, Human adenovirus E
caucagucgucuggugcg

SEQ ID NO: 3931257 - RNA, 18 nt, Human adenovirus E
cauccccgcgcuccugga

SEQ ID NO: 3931258 - RNA, 14 nt, Human adenovirus E
cauccccggguaca

SEQ ID NO: 3931259 - RNA, 21 nt, Human adenovirus E
caucccuucgagaucagguuc

SEQ ID NO: 3931260 - RNA, 22 nt, Human adenovirus E
cauccuggccguguugcucuac

SEQ ID NO: 3931261 - RNA, 17 nt, Human adenovirus E
caucguaggugaggaag

SEQ ID NO: 3931262 - RNA, 18 nt, Human adenovirus E
caugaucaagcccagcac

SEQ ID NO: 3931263 - RNA, 20 nt, Human adenovirus E
caugaucaagcccagcacca

SEQ ID NO: 3931264 - RNA, 21 nt, Human adenovirus E
caugauggccgugguccuggu

SEQ ID NO: 3931265 - RNA, 18 nt, Human adenovirus E
caugcaacuuggaaggga

SEQ ID NO: 3931266 - RNA, 16 nt, Human adenovirus E
caugcaucccagcugg

SEQ ID NO: 3931267 - RNA, 22 nt, Human adenovirus E
caugcaucucuucagcacucuc

SEQ ID NO: 3931268 - RNA, 16 nt, Human adenovirus E
caugcugacgagcccg

SEQ ID NO: 3931269 - RNA, 18 nt, Human adenovirus E
cauggaauacaccacccu

SEQ ID NO: 3931270 - RNA, 14 nt, Human adenovirus E
cauggagacucagc

SEQ ID NO: 3931271 - RNA, 23 nt, Human adenovirus E
cauggaggugcagacggaucccu

SEQ ID NO: 3931272 - RNA, 20 nt, Human adenovirus E
cauggcccgcgggcagggac

SEQ ID NO: 3931273 - RNA, 19 nt, Human adenovirus E
caugggcgcggaccugcac

SEQ ID NO: 3931274 - RNA, 21 nt, Human adenovirus E
cauguccaccugcggggcgau

SEQ ID NO: 3931275 - RNA, 16 nt, Human adenovirus E
caugucccccucgucc

SEQ ID NO: 3931276 - RNA, 19 nt, Human adenovirus E
cauguggagcuaccagccc

SEQ ID NO: 3931277 - RNA, 21 nt, Human adenovirus E
cauguggagcuaccagcccca

SEQ ID NO: 3931278 - RNA, 15 nt, Human adenovirus E
cauguuuucugccaa

SEQ ID NO: 3931279 - RNA, 22 nt, Human adenovirus E
  misc_feature (13)..(13): n is a, c, g or u
cauuaaaucagcnuaccaccac

SEQ ID NO: 3931280 - RNA, 19 nt, Human adenovirus E
cauuacuaccgucaccucc

SEQ ID NO: 3931281 - RNA, 12 nt, Human adenovirus E
cauuggugaugg

SEQ ID NO: 3931282 - RNA, 17 nt, Human adenovirus E
cauugucaaugccaccu

SEQ ID NO: 3931283 - RNA, 22 nt, Human adenovirus E
cauuucccuuaacauggaucac

SEQ ID NO: 3931284 - RNA, 13 nt, Human adenovirus E
ccaaaaaucagac

SEQ ID NO: 3931285 - RNA, 15 nt, Human adenovirus E
ccaaaagauccccgu

SEQ ID NO: 3931286 - RNA, 18 nt, Human adenovirus E
ccaaacuaaccuccacca

SEQ ID NO: 3931287 - RNA, 18 nt, Human adenovirus E
ccaaagucaugagcgcgg

SEQ ID NO: 3931288 - RNA, 16 nt, Human adenovirus E
ccaacccuccaggaua

SEQ ID NO: 3931289 - RNA, 21 nt, Human adenovirus E
ccaacgaggcuuuccaucccg

SEQ ID NO: 3931290 - RNA, 17 nt, Human adenovirus E
ccaacgccauccugaau

SEQ ID NO: 3931291 - RNA, 15 nt, Human adenovirus E
ccaacgcuccacgca

SEQ ID NO: 3931292 - RNA, 15 nt, Human adenovirus E
ccaacgugcagacca

SEQ ID NO: 3931293 - RNA, 19 nt, Human adenovirus E
ccaagaauucuugcugaaa

SEQ ID NO: 3931294 - RNA, 15 nt, Human adenovirus E
ccaagcgccagccca

SEQ ID NO: 3931295 - RNA, 16 nt, Human adenovirus E
ccaagcgccagcccaa

SEQ ID NO: 3931296 - RNA, 22 nt, Human adenovirus E
ccaaggccgccgccccucucag

SEQ ID NO: 3931297 - RNA, 23 nt, Human adenovirus E
ccaaggccgccgccccucucagu

SEQ ID NO: 3931298 - RNA, 17 nt, Human adenovirus E
ccacaauuacucacacc

SEQ ID NO: 3931299 - RNA, 13 nt, Human adenovirus E
ccacacagacaac

SEQ ID NO: 3931300 - RNA, 15 nt, Human adenovirus E
ccacagaaguuucau

SEQ ID NO: 3931301 - RNA, 20 nt, Human adenovirus E
ccacagcaacuuccugacca

SEQ ID NO: 3931302 - RNA, 22 nt, Human adenovirus E
ccacagcgacccaugcuccccg

SEQ ID NO: 3931303 - RNA, 16 nt, Human adenovirus E
ccacagcgcgcacccg

SEQ ID NO: 3931304 - RNA, 14 nt, Human adenovirus E
ccgauccuggucga

SEQ ID NO: 3931305 - RNA, 19 nt, Human adenovirus E
ccgcaacucguaccugggc

SEQ ID NO: 3931306 - RNA, 11 nt, Human adenovirus E
ccgcaccugcc

SEQ ID NO: 3931307 - RNA, 18 nt, Human adenovirus E
ccgcauccccaaauucaa

SEQ ID NO: 3931308 - RNA, 22 nt, Human adenovirus E
ccgcaucugcaccucacagcuc

SEQ ID NO: 3931309 - RNA, 13 nt, Human adenovirus E
ccgccccgccgcc

SEQ ID NO: 3931310 - RNA, 16 nt, Human adenovirus E
ccgccgccgcuccguc

SEQ ID NO: 3931311 - RNA, 15 nt, Human adenovirus E
ccgccgcgcaucucc

SEQ ID NO: 3931312 - RNA, 14 nt, Human adenovirus E
ccgccgcuguggag

SEQ ID NO: 3931313 - RNA, 20 nt, Human adenovirus E
ccgccgugagcggggcugga

SEQ ID NO: 3931314 - RNA, 18 nt, Human adenovirus E
ccgccuccacccaucauc

SEQ ID NO: 3931315 - RNA, 16 nt, Human adenovirus E
ccgcgccgcagugggc

SEQ ID NO: 3931316 - RNA, 15 nt, Human adenovirus E
ccgcgcugcccucgg

SEQ ID NO: 3931317 - RNA, 21 nt, Human adenovirus E
ccgcguaauuggcccgccgcc

SEQ ID NO: 3931318 - RNA, 15 nt, Human adenovirus E
ccgcucccuggccug

SEQ ID NO: 3931319 - RNA, 15 nt, Human adenovirus E
ccgcucucugcucaa

SEQ ID NO: 3931320 - RNA, 11 nt, Human adenovirus E
ccgcuguggag

SEQ ID NO: 3931321 - RNA, 14 nt, Human adenovirus E
ccggacgugcagcc

SEQ ID NO: 3931322 - RNA, 16 nt, Human adenovirus E
ccggaugcaggggcgg

SEQ ID NO: 3931323 - RNA, 17 nt, Human adenovirus E
ccggcgcgacuacaucc

SEQ ID NO: 3931324 - RNA, 19 nt, Human adenovirus E
ccggcgcgcuccacggugg

SEQ ID NO: 3931325 - RNA, 16 nt, Human adenovirus E
ccggcggcgcgugcag

SEQ ID NO: 3931326 - RNA, 22 nt, Human adenovirus E
ccggcgucgugcacgcagcagc

SEQ ID NO: 3931327 - RNA, 17 nt, Human adenovirus E
ccgggcggcaggggcgg

SEQ ID NO: 3931328 - RNA, 16 nt, Human adenovirus E
ccgggcuaccgcggca

SEQ ID NO: 3931329 - RNA, 17 nt, Human adenovirus E
ccgucaccuccacagcc

SEQ ID NO: 3931330 - RNA, 13 nt, Human adenovirus E
ccgucgccgcacc

SEQ ID NO: 3931331 - RNA, 13 nt, Human adenovirus E
ccgugcagcagau

SEQ ID NO: 3931332 - RNA, 21 nt, Human adenovirus E
ccguguugcucuacuacaucu

SEQ ID NO: 3931333 - RNA, 22 nt, Human adenovirus E
ccguucaugggcaccuggagcg

SEQ ID NO: 3931334 - RNA, 19 nt, Human adenovirus E
ccguugggcagggagaggg

SEQ ID NO: 3931335 - RNA, 14 nt, Human adenovirus E
ccuaccgcagcugg

SEQ ID NO: 3931336 - RNA, 14 nt, Human adenovirus E
ccuagccgccucca

SEQ ID NO: 3931337 - RNA, 16 nt, Human adenovirus E
ccucaagcccgugacc

SEQ ID NO: 3931338 - RNA, 22 nt, Human adenovirus E
ccucaagcccgugaccuugcag

SEQ ID NO: 3931339 - RNA, 15 nt, Human adenovirus E
ccucagcguggagga

SEQ ID NO: 3931340 - RNA, 19 nt, Human adenovirus E
ccucagggcccggcccacg

SEQ ID NO: 3931341 - RNA, 16 nt, Human adenovirus E
ccuccaccaacgccac

SEQ ID NO: 3931342 - RNA, 15 nt, Human adenovirus E
ccuccacccucccag

SEQ ID NO: 3931343 - RNA, 17 nt, Human adenovirus E
ccuccacuaacaucucu

SEQ ID NO: 3931344 - RNA, 15 nt, Human adenovirus E
ccuccagaacacgcu

SEQ ID NO: 3931345 - RNA, 14 nt, Human adenovirus E
ccucccggaggagg

SEQ ID NO: 3931346 - RNA, 22 nt, Human adenovirus E
ccuccucaggcggcaguggugg

SEQ ID NO: 3931347 - RNA, 22 nt, Human adenovirus E
ccucggccgcguggccuuuggc

SEQ ID NO: 3931348 - RNA, 20 nt, Human adenovirus E
ccucguagaggaaccccgcc

SEQ ID NO: 3931349 - RNA, 12 nt, Human adenovirus E
ccucuauguuua

SEQ ID NO: 3931350 - RNA, 16 nt, Human adenovirus E
ccucugccacaccugg

SEQ ID NO: 3931351 - RNA, 17 nt, Human adenovirus E
ccucuucucgccgcgcg

SEQ ID NO: 3931352 - RNA, 17 nt, Human adenovirus E
ccugacacaccaccaca

SEQ ID NO: 3931353 - RNA, 21 nt, Human adenovirus E
ccugacacaccaccacagcaa

SEQ ID NO: 3931354 - RNA, 16 nt, Human adenovirus E
ccugacuuuggagagu

SEQ ID NO: 3931355 - RNA, 19 nt, Human adenovirus E
ccugagcuccucccucagc

SEQ ID NO: 3931356 - RNA, 20 nt, Human adenovirus E
ccugaguuccuuugacgagg

SEQ ID NO: 3931357 - RNA, 15 nt, Human adenovirus E
ccugcacuggcagcc

SEQ ID NO: 3931358 - RNA, 17 nt, Human adenovirus E
ccugcacuggcagccca

SEQ ID NO: 3931359 - RNA, 14 nt, Human adenovirus E
ccugcaugccaacc

SEQ ID NO: 3931360 - RNA, 15 nt, Human adenovirus E
ccugcgcaaggucga

SEQ ID NO: 3931361 - RNA, 20 nt, Human adenovirus E
ccugcgcaaggucgaggaga

SEQ ID NO: 3931362 - RNA, 11 nt, Human adenovirus E
ccugcgccgcu

SEQ ID NO: 3931363 - RNA, 17 nt, Human adenovirus E
ccugcucgagugccacu

SEQ ID NO: 3931364 - RNA, 15 nt, Human adenovirus E
ccugcugcgccuggc

SEQ ID NO: 3931365 - RNA, 15 nt, Human adenovirus E
ccuggaagacugaug

SEQ ID NO: 3931366 - RNA, 14 nt, Human adenovirus E
ccuggaccacugcc

SEQ ID NO: 3931367 - RNA, 19 nt, Human adenovirus E
ccuggacuaauggaagcua

SEQ ID NO: 3931368 - RNA, 22 nt, Human adenovirus E
ccuggcgccuacggaggggcgg

SEQ ID NO: 3931369 - RNA, 20 nt, Human adenovirus E
ccuggcuccgcgacacggca

SEQ ID NO: 3931370 - RNA, 17 nt, Human adenovirus E
ccuggcugacguccugc

SEQ ID NO: 3931371 - RNA, 16 nt, Human adenovirus E
ccugggcggcgagcac

SEQ ID NO: 3931372 - RNA, 13 nt, Human adenovirus E
ccuggggcgcccu

SEQ ID NO: 3931373 - RNA, 14 nt, Human adenovirus E
ccugguccgggcgc

SEQ ID NO: 3931374 - RNA, 17 nt, Human adenovirus E
ccuggucgaguuggaag

SEQ ID NO: 3931375 - RNA, 22 nt, Human adenovirus E
ccuggucggcguucauccccgg

SEQ ID NO: 3931376 - RNA, 20 nt, Human adenovirus E
ccuguccacccgcucucugc

SEQ ID NO: 3931377 - RNA, 22 nt, Human adenovirus E
ccugugggacgauguggacagc

SEQ ID NO: 3931378 - RNA, 21 nt, Human adenovirus E
ccuuagcuuugacaguacagg

SEQ ID NO: 3931379 - RNA, 16 nt, Human adenovirus E
ccuuccaggaaggcuu

SEQ ID NO: 3931380 - RNA, 20 nt, Human adenovirus E
ccuuccucagcacccagccc

SEQ ID NO: 3931381 - RNA, 13 nt, Human adenovirus E
ccuucgccuccua

SEQ ID NO: 3931382 - RNA, 15 nt, Human adenovirus E
ccuucgucucuucag

SEQ ID NO: 3931383 - RNA, 16 nt, Human adenovirus E
ccuuucaagagccccu

SEQ ID NO: 3931384 - RNA, 17 nt, Human adenovirus E
cgaacuccauggcuugc

SEQ ID NO: 3931385 - RNA, 16 nt, Human adenovirus E
cgaagcguucagggag

SEQ ID NO: 3931386 - RNA, 20 nt, Human adenovirus E
cgacaaaaaucagacccacu

SEQ ID NO: 3931387 - RNA, 18 nt, Human adenovirus E
cgacaggaugcaccgugc

SEQ ID NO: 3931388 - RNA, 18 nt, Human adenovirus E
cgaccucauuuuccccga

SEQ ID NO: 3931389 - RNA, 18 nt, Human adenovirus E
cgacgagcgcaccaccgc

SEQ ID NO: 3931390 - RNA, 18 nt, Human adenovirus E
cgacgagcucggcgguga

SEQ ID NO: 3931391 - RNA, 20 nt, Human adenovirus E
cgacgugaucgaccaggugg

SEQ ID NO: 3931392 - RNA, 16 nt, Human adenovirus E
cgagaaccgccugggg

SEQ ID NO: 3931393 - RNA, 14 nt, Human adenovirus E
cgagaagcagcagc

SEQ ID NO: 3931394 - RNA, 16 nt, Human adenovirus E
cgagacgaugggcagg

SEQ ID NO: 3931395 - RNA, 17 nt, Human adenovirus E
cgagacgaugggcaggc

SEQ ID NO: 3931396 - RNA, 16 nt, Human adenovirus E
cgagagcgugaugcag

SEQ ID NO: 3931397 - RNA, 18 nt, Human adenovirus E
cgagagcgugaugcagca

SEQ ID NO: 3931398 - RNA, 19 nt, Human adenovirus E
cgagcagaaggggggcagg

SEQ ID NO: 3931399 - RNA, 12 nt, Human adenovirus E
cgagcaggccgu

SEQ ID NO: 3931400 - RNA, 21 nt, Human adenovirus E
cgagcaguuauuuuuccucca

SEQ ID NO: 3931401 - RNA, 15 nt, Human adenovirus E
cgagccggggcagcg

SEQ ID NO: 3931402 - RNA, 16 nt, Human adenovirus E
cgagcgcaccaccgcc

SEQ ID NO: 3931403 - RNA, 16 nt, Human adenovirus E
cgagcgccccuugugg

SEQ ID NO: 3931404 - RNA, 18 nt, Human adenovirus E
cgagcgcgagcaaggaca

SEQ ID NO: 3931405 - RNA, 14 nt, Human adenovirus E
cgagcugggcagga

SEQ ID NO: 3931406 - RNA, 17 nt, Human adenovirus E
cgaggaauuucaguggg

SEQ ID NO: 3931407 - RNA, 20 nt, Human adenovirus E
cgaggacgagggcaugcaag

SEQ ID NO: 3931408 - RNA, 13 nt, Human adenovirus E
cgaggaggaggca

SEQ ID NO: 3931409 - RNA, 16 nt, Human adenovirus E
cgaggaggaggcagag

SEQ ID NO: 3931410 - RNA, 21 nt, Human adenovirus E
cgaggaggauguccaagcgca

SEQ ID NO: 3931411 - RNA, 14 nt, Human adenovirus E
cgaggcauacgugc

SEQ ID NO: 3931412 - RNA, 17 nt, Human adenovirus E
cgaggccaucggccagg

SEQ ID NO: 3931413 - RNA, 18 nt, Human adenovirus E
cgaggccaucggccaggc

SEQ ID NO: 3931414 - RNA, 16 nt, Human adenovirus E
cgaggcccuggccacc

SEQ ID NO: 3931415 - RNA, 16 nt, Human adenovirus E
cgagggcaugcaagac

SEQ ID NO: 3931416 - RNA, 18 nt, Human adenovirus E
cgagggggcgaggagccc

SEQ ID NO: 3931417 - RNA, 18 nt, Human adenovirus E
cgaggugccccagagcga

SEQ ID NO: 3931418 - RNA, 15 nt, Human adenovirus E
cgaguaccuggaaga

SEQ ID NO: 3931419 - RNA, 18 nt, Human adenovirus E
cgaguucgccccccggcg

SEQ ID NO: 3931420 - RNA, 21 nt, Human adenovirus E
cgaguugaaccucuucucgcc

SEQ ID NO: 3931421 - RNA, 13 nt, Human adenovirus E
ucucuucagcacu

SEQ ID NO: 3931422 - RNA, 19 nt, Human adenovirus E
ucugccuucccaugguggg

SEQ ID NO: 3931423 - RNA, 20 nt, Human adenovirus E
ucugggugaucuuggcccgg

SEQ ID NO: 3931424 - RNA, 14 nt, Human adenovirus E
ucuucgagggggaa

SEQ ID NO: 3931425 - RNA, 13 nt, Human adenovirus E
ucuuugaggagga

SEQ ID NO: 3931426 - RNA, 18 nt, Human adenovirus E
ugaacauuaaaccaugcu

SEQ ID NO: 3931427 - RNA, 21 nt, Human adenovirus E
ugaacauucugcagagcaucg

SEQ ID NO: 3931428 - RNA, 15 nt, Human adenovirus E
ugaaccugagccagg

SEQ ID NO: 3931429 - RNA, 17 nt, Human adenovirus E
ugaacgccugcugggcc

SEQ ID NO: 3931430 - RNA, 23 nt, Human adenovirus E
ugaagacgccgccgcgcaucucc

SEQ ID NO: 3931431 - RNA, 17 nt, Human adenovirus E
ugaagaugccgggcagg

SEQ ID NO: 3931432 - RNA, 22 nt, Human adenovirus E
ugaagcccacggccgccagcuc

SEQ ID NO: 3931433 - RNA, 17 nt, Human adenovirus E
ugacacuacagaaacug

SEQ ID NO: 3931434 - RNA, 20 nt, Human adenovirus E
ugacccugggccugaugcac

SEQ ID NO: 3931435 - RNA, 14 nt, Human adenovirus E
ugacggcgcagcug

SEQ ID NO: 3931436 - RNA, 15 nt, Human adenovirus E
ugacugacccacugg

SEQ ID NO: 3931437 - RNA, 16 nt, Human adenovirus E
ugagcaaagagauucc

SEQ ID NO: 3931438 - RNA, 18 nt, Human adenovirus E
ugagcagagucaggcugg

SEQ ID NO: 3931439 - RNA, 19 nt, Human adenovirus E
ugagcagagucaggcuggg

SEQ ID NO: 3931440 - RNA, 15 nt, Human adenovirus E
ugagcccgucccggg

SEQ ID NO: 3931441 - RNA, 18 nt, Human adenovirus E
ugagccgcgcccugggcc

SEQ ID NO: 3931442 - RNA, 20 nt, Human adenovirus E
ugagccgcgcccugggccag

SEQ ID NO: 3931443 - RNA, 15 nt, Human adenovirus E
ugagcgaccaggagc

SEQ ID NO: 3931444 - RNA, 23 nt, Human adenovirus E
ugagcgaccaggagcugaugcau

SEQ ID NO: 3931445 - RNA, 16 nt, Human adenovirus E
ugaggccgagccacag

SEQ ID NO: 3931446 - RNA, 17 nt, Human adenovirus E
ugagggagagacagcug

SEQ ID NO: 3931447 - RNA, 11 nt, Human adenovirus E
ugauccuccac

SEQ ID NO: 3931448 - RNA, 21 nt, Human adenovirus E
ugaugucauacuugagcuguc

SEQ ID NO: 3931449 - RNA, 16 nt, Human adenovirus E
ugauuuaccccugcuu

SEQ ID NO: 3931450 - RNA, 20 nt, Human adenovirus E
ugcaacacagaaccaccagg

SEQ ID NO: 3931451 - RNA, 21 nt, Human adenovirus E
ugcaacacagaaccaccaggu

SEQ ID NO: 3931452 - RNA, 20 nt, Human adenovirus E
ugcacaauaucuuugaggag

SEQ ID NO: 3931453 - RNA, 12 nt, Human adenovirus E
ugcaccucacag

SEQ ID NO: 3931454 - RNA, 14 nt, Human adenovirus E
ugcaccucacagcu

SEQ ID NO: 3931455 - RNA, 21 nt, Human adenovirus E
ugcacgagaaccgccuggggc

SEQ ID NO: 3931456 - RNA, 14 nt, Human adenovirus E
ugcacuaccucuuc

SEQ ID NO: 3931457 - RNA, 15 nt, Human adenovirus E
ugcagcaggcgaugg

SEQ ID NO: 3931458 - RNA, 20 nt, Human adenovirus E
ugcagcgaagagaccccggg

SEQ ID NO: 3931459 - RNA, 18 nt, Human adenovirus E
ugcaggagcgcgggcugc

SEQ ID NO: 3931460 - RNA, 23 nt, Human adenovirus E
ugcauagucugcagcgggcccug

SEQ ID NO: 3931461 - RNA, 22 nt, Human adenovirus E
ugcaucucgugcuguacuacgu

SEQ ID NO: 3931462 - RNA, 15 nt, Human adenovirus E
ugcaucuuggccugg

SEQ ID NO: 3931463 - RNA, 18 nt, Human adenovirus E
ugccaacccuucccaccc

SEQ ID NO: 3931464 - RNA, 22 nt, Human adenovirus E
  misc_feature (9)..(9): n is a, c, g or u
ugccaaccnuacuuuuuccacc

SEQ ID NO: 3931465 - RNA, 14 nt, Human adenovirus E
ugccagccccgauu

SEQ ID NO: 3931466 - RNA, 20 nt, Human adenovirus E
ugccagcugaguuuucagcc

SEQ ID NO: 3931467 - RNA, 19 nt, Human adenovirus E
ugccaucacaccuuccacc

SEQ ID NO: 3931468 - RNA, 20 nt, Human adenovirus E
ugccaucacaccuuccaccu

SEQ ID NO: 3931469 - RNA, 19 nt, Human adenovirus E
ugcccaacgugaacgaguu

SEQ ID NO: 3931470 - RNA, 19 nt, Human adenovirus E
ugcccaagcagaaccuguu

SEQ ID NO: 3931471 - RNA, 19 nt, Human adenovirus E
ugcccccgccccagcagca

SEQ ID NO: 3931472 - RNA, 15 nt, Human adenovirus E
ugccccggggccagg

SEQ ID NO: 3931473 - RNA, 21 nt, Human adenovirus E
ugccccuacgucuacaaggcc

SEQ ID NO: 3931474 - RNA, 15 nt, Human adenovirus E
ugcccgaggcccugg

SEQ ID NO: 3931475 - RNA, 20 nt, Human adenovirus E
ugcccgucuacuccaagagc

SEQ ID NO: 3931476 - RNA, 21 nt, Human adenovirus E
ugcccucggacuucgugccgc

SEQ ID NO: 3931477 - RNA, 18 nt, Human adenovirus E
ugcccucggccucggugc

SEQ ID NO: 3931478 - RNA, 17 nt, Human adenovirus E
ugcccuucgcccuagcc

SEQ ID NO: 3931479 - RNA, 21 nt, Human adenovirus E
ugccugaacgccugcugggcc

SEQ ID NO: 3931480 - RNA, 18 nt, Human adenovirus E
ugcgcaacggccugcccg

SEQ ID NO: 3931481 - RNA, 12 nt, Human adenovirus E
ugcgcagggagg

SEQ ID NO: 3931482 - RNA, 13 nt, Human adenovirus E
ugcgccaggccug

SEQ ID NO: 3931483 - RNA, 14 nt, Human adenovirus E
ugcgccaggccugc

SEQ ID NO: 3931484 - RNA, 16 nt, Human adenovirus E
ugcgccgcuucuucgc

SEQ ID NO: 3931485 - RNA, 21 nt, Human adenovirus E
ugcgcuccuggacgcugcuca

SEQ ID NO: 3931486 - RNA, 14 nt, Human adenovirus E
ugcggaugaagcac

SEQ ID NO: 3931487 - RNA, 18 nt, Human adenovirus E
ugcggcgcggccuggacc

SEQ ID NO: 3931488 - RNA, 19 nt, Human adenovirus E
ugcggcgguacaccucgcc

SEQ ID NO: 3931489 - RNA, 15 nt, Human adenovirus E
ugcgggcggcgcugc

SEQ ID NO: 3931490 - RNA, 17 nt, Human adenovirus E
ugcggggggagaugagg

SEQ ID NO: 3931491 - RNA, 23 nt, Human adenovirus E
ugcgucucgggacccugccauca

SEQ ID NO: 3931492 - RNA, 21 nt, Human adenovirus E
ugcuacagaaagcacagacug

SEQ ID NO: 3931493 - RNA, 17 nt, Human adenovirus E
ugcuaccuauaccuccc

SEQ ID NO: 3931494 - RNA, 18 nt, Human adenovirus E
ugcuagaugcaacaacaa

SEQ ID NO: 3931495 - RNA, 15 nt, Human adenovirus E
ugcuaguccccagag

SEQ ID NO: 3931496 - RNA, 18 nt, Human adenovirus E
ugcucaggggguccgggu

SEQ ID NO: 3931497 - RNA, 14 nt, Human adenovirus E
ugcucgagugccac

SEQ ID NO: 3931498 - RNA, 18 nt, Human adenovirus E
ugcucgggcaucagcugg

SEQ ID NO: 3931499 - RNA, 16 nt, Human adenovirus E
ugcucuauacgggcaa

SEQ ID NO: 3931500 - RNA, 13 nt, Human adenovirus E
ugcucuuugccuu

SEQ ID NO: 3931501 - RNA, 17 nt, Human adenovirus E
ugcugcacgagcuguac

SEQ ID NO: 3931502 - RNA, 14 nt, Human adenovirus E
ugcuguaggauuca

SEQ ID NO: 3931503 - RNA, 15 nt, Human adenovirus E
uggaacagcaccaca

SEQ ID NO: 3931504 - RNA, 21 nt, Human adenovirus E
uggaagagggcgaggggcugg

SEQ ID NO: 3931505 - RNA, 24 nt, Human adenovirus E
uggaaggcgacaacgcgcggcugg

SEQ ID NO: 3931506 - RNA, 22 nt, Human adenovirus E
uggaauacaccacccucucccc

SEQ ID NO: 3931507 - RNA, 19 nt, Human adenovirus E
uggacaacaccugauccau

SEQ ID NO: 3931508 - RNA, 22 nt, Human adenovirus E
uggaccacggcaaccccacgcc

SEQ ID NO: 3931509 - RNA, 21 nt, Human adenovirus E
uggacguuuagagccucggga

SEQ ID NO: 3931510 - RNA, 23 nt, Human adenovirus E
uggacuacuugcaucgggcggcc

SEQ ID NO: 3931511 - RNA, 12 nt, Human adenovirus E
uggacugaggau

SEQ ID NO: 3931512 - RNA, 22 nt, Human adenovirus E
uggagaguucguccucgcagcc

SEQ ID NO: 3931513 - RNA, 15 nt, Human adenovirus E
uggagccacugcuac

SEQ ID NO: 3931514 - RNA, 16 nt, Human adenovirus E
uggagcuaccagcccc

SEQ ID NO: 3931515 - RNA, 18 nt, Human adenovirus E
uggaggaauggcuguuga

SEQ ID NO: 3931516 - RNA, 17 nt, Human adenovirus E
uggaucuggccuuagcu

SEQ ID NO: 3931517 - RNA, 15 nt, Human adenovirus E
uggaucuuuuccagg

SEQ ID NO: 3931518 - RNA, 13 nt, Human adenovirus E
uggcagcccagcc

SEQ ID NO: 3931519 - RNA, 20 nt, Human adenovirus E
uggcaugcgaguuggaggag

SEQ ID NO: 3931520 - RNA, 18 nt, Human adenovirus E
uggccaacuaccuggccu

SEQ ID NO: 3931521 - RNA, 16 nt, Human adenovirus E
uggccagaucguccag

SEQ ID NO: 3931522 - RNA, 19 nt, Human adenovirus E
uggccgccggugccgccca

SEQ ID NO: 3931523 - RNA, 19 nt, Human adenovirus E
uggccuuggaagagggcga

SEQ ID NO: 3931524 - RNA, 22 nt, Human adenovirus E
uggcggcgauguugagcugcac

SEQ ID NO: 3931525 - RNA, 23 nt, Human adenovirus E
uggcggcggcggcgaugcagccc

SEQ ID NO: 3931526 - RNA, 22 nt, Human adenovirus E
uggcuuccagcaaagccuccac

SEQ ID NO: 3931527 - RNA, 19 nt, Human adenovirus E
ugggcauagucgcgccgcg

SEQ ID NO: 3931528 - RNA, 20 nt, Human adenovirus E
ugggccuguuccugaugcag

SEQ ID NO: 3931529 - RNA, 17 nt, Human adenovirus E
ugggccuuuggaagaug

SEQ ID NO: 3931530 - RNA, 19 nt, Human adenovirus E
ugggcgugcagaccgugga

SEQ ID NO: 3931531 - RNA, 14 nt, Human adenovirus E
uggggaagaacugg

SEQ ID NO: 3931532 - RNA, 21 nt, Human adenovirus E
uggggcaguuucuugagcucc

SEQ ID NO: 3931533 - RNA, 13 nt, Human adenovirus E
uggggcggccagc

SEQ ID NO: 3931534 - RNA, 17 nt, Human adenovirus E
ugggugcgcgacgccgc

SEQ ID NO: 3931535 - RNA, 18 nt, Human adenovirus E
uggucagcgacgagcagc

SEQ ID NO: 3931536 - RNA, 16 nt, Human adenovirus E
uggucuccaugagcuc

SEQ ID NO: 3931537 - RNA, 19 nt, Human adenovirus E
cagcggaaugccgcggugc

SEQ ID NO: 3931538 - RNA, 16 nt, Human adenovirus E
cagcguggaggagcuc

SEQ ID NO: 3931539 - RNA, 18 nt, Human adenovirus E
cagcguggaggagcucag

SEQ ID NO: 3931540 - RNA, 13 nt, Human adenovirus E
cagcucaacagcu

SEQ ID NO: 3931541 - RNA, 17 nt, Human adenovirus E
cagcuggcccgguggcu

SEQ ID NO: 3931542 - RNA, 16 nt, Human adenovirus E
cagcuguuccuggugg

SEQ ID NO: 3931543 - RNA, 16 nt, Human adenovirus E
cagcuugcccucggcc

SEQ ID NO: 3931544 - RNA, 17 nt, Human adenovirus E
cagcuugcccucggccu

SEQ ID NO: 3931545 - RNA, 13 nt, Human adenovirus E
caggaagcagaga

SEQ ID NO: 3931546 - RNA, 20 nt, Human adenovirus E
caggacccgguagagguggg

SEQ ID NO: 3931547 - RNA, 22 nt, Human adenovirus E
caggagcgcgggcugccgcugu

SEQ ID NO: 3931548 - RNA, 20 nt, Human adenovirus E
caggagcggcgaggagcccg

SEQ ID NO: 3931549 - RNA, 15 nt, Human adenovirus E
caggaggcgcucucc

SEQ ID NO: 3931550 - RNA, 14 nt, Human adenovirus E
caggauucgagcag

SEQ ID NO: 3931551 - RNA, 21 nt, Human adenovirus E
caggcacacgcacuaccacca

SEQ ID NO: 3931552 - RNA, 13 nt, Human adenovirus E
caggcagaggagg

SEQ ID NO: 3931553 - RNA, 16 nt, Human adenovirus E
caggcagcggggacag

SEQ ID NO: 3931554 - RNA, 16 nt, Human adenovirus E
caggccgaaguccagc

SEQ ID NO: 3931555 - RNA, 14 nt, Human adenovirus E
caggccgugcagcg

SEQ ID NO: 3931556 - RNA, 16 nt, Human adenovirus E
caggcucauccggcug

SEQ ID NO: 3931557 - RNA, 22 nt, Human adenovirus E
caggcuuucaagaacuugcagg

SEQ ID NO: 3931558 - RNA, 10 nt, Human adenovirus E
cagggagaua

SEQ ID NO: 3931559 - RNA, 22 nt, Human adenovirus E
cagggagaugaaacccuccggg

SEQ ID NO: 3931560 - RNA, 15 nt, Human adenovirus E
cagggauaggagcuc

SEQ ID NO: 3931561 - RNA, 20 nt, Human adenovirus E
cagggauaggagcuccugga

SEQ ID NO: 3931562 - RNA, 21 nt, Human adenovirus E
cagggcaauccucgcacagaa

SEQ ID NO: 3931563 - RNA, 16 nt, Human adenovirus E
cagggcaugggauggg

SEQ ID NO: 3931564 - RNA, 17 nt, Human adenovirus E
cagggcaugggaugggu

SEQ ID NO: 3931565 - RNA, 13 nt, Human adenovirus E
cagggccagcacc

SEQ ID NO: 3931566 - RNA, 16 nt, Human adenovirus E
cagggcccggcccacg

SEQ ID NO: 3931567 - RNA, 15 nt, Human adenovirus E
cagggcgcccagcag

SEQ ID NO: 3931568 - RNA, 15 nt, Human adenovirus E
cagggcuugcagacc

SEQ ID NO: 3931569 - RNA, 16 nt, Human adenovirus E
caggggcgcagggcau

SEQ ID NO: 3931570 - RNA, 14 nt, Human adenovirus E
caggucaucgcgcc

SEQ ID NO: 3931571 - RNA, 21 nt, Human adenovirus E
caggugcugccgaccgcggcg

SEQ ID NO: 3931572 - RNA, 15 nt, Human adenovirus E
cagguggacugagga

SEQ ID NO: 3931573 - RNA, 19 nt, Human adenovirus E
caguacgcgcucagcaccg

SEQ ID NO: 3931574 - RNA, 12 nt, Human adenovirus E
caguaguacaga

SEQ ID NO: 3931575 - RNA, 16 nt, Human adenovirus E
caguaguacagaaaca

SEQ ID NO: 3931576 - RNA, 18 nt, Human adenovirus E
caguauccgcagcagcga

SEQ ID NO: 3931577 - RNA, 20 nt, Human adenovirus E
caguauccggggaguccagc

SEQ ID NO: 3931578 - RNA, 13 nt, Human adenovirus E
cagucucuggagc

SEQ ID NO: 3931579 - RNA, 19 nt, Human adenovirus E
cagucuggaggaagacgag

SEQ ID NO: 3931580 - RNA, 14 nt, Human adenovirus E
caguggcagcggcc

SEQ ID NO: 3931581 - RNA, 14 nt, Human adenovirus E
caguuacaccugcc

SEQ ID NO: 3931582 - RNA, 22 nt, Human adenovirus E
caguuauuuuuccuccacccuc

SEQ ID NO: 3931583 - RNA, 15 nt, Human adenovirus E
caguuuuuccaacaa

SEQ ID NO: 3931584 - RNA, 16 nt, Human adenovirus E
cauagcaggggcgcag

SEQ ID NO: 3931585 - RNA, 14 nt, Human adenovirus E
cauauccucuccga

SEQ ID NO: 3931586 - RNA, 18 nt, Human adenovirus E
caucaacgggguggugga

SEQ ID NO: 3931587 - RNA, 13 nt, Human adenovirus E
caucaggccccgc

SEQ ID NO: 3931588 - RNA, 18 nt, Human adenovirus E
caucaggccccgcagcag

SEQ ID NO: 3931589 - RNA, 17 nt, Human adenovirus E
caucagggccgggugcu

SEQ ID NO: 3931590 - RNA, 21 nt, Human adenovirus E
cauccccgcgcuccuggaugu

SEQ ID NO: 3931591 - RNA, 16 nt, Human adenovirus E
cauccgcccaaggccg

SEQ ID NO: 3931592 - RNA, 19 nt, Human adenovirus E
cauccuggccguguugcuc

SEQ ID NO: 3931593 - RNA, 14 nt, Human adenovirus E
caucgaccugauga

SEQ ID NO: 3931594 - RNA, 20 nt, Human adenovirus E
caucgagauugaccugggcu

SEQ ID NO: 3931595 - RNA, 17 nt, Human adenovirus E
caucggcacucuccagu

SEQ ID NO: 3931596 - RNA, 12 nt, Human adenovirus E
caucggccaggc

SEQ ID NO: 3931597 - RNA, 14 nt, Human adenovirus E
caucgugcagaacc

SEQ ID NO: 3931598 - RNA, 17 nt, Human adenovirus E
caucguggugcaggagc

SEQ ID NO: 3931599 - RNA, 13 nt, Human adenovirus E
caucuccaacacg

SEQ ID NO: 3931600 - RNA, 20 nt, Human adenovirus E
caucucuucuacuuccuccu

SEQ ID NO: 3931601 - RNA, 14 nt, Human adenovirus E
caucuuccagcaga

SEQ ID NO: 3931602 - RNA, 19 nt, Human adenovirus E
caugagcgcggucauggac

SEQ ID NO: 3931603 - RNA, 23 nt, Human adenovirus E
caugauuggcauuauuguugcug

SEQ ID NO: 3931604 - RNA, 17 nt, Human adenovirus E
caugccgcagaugucgu

SEQ ID NO: 3931605 - RNA, 17 nt, Human adenovirus E
caugcgcaugacccuga

SEQ ID NO: 3931606 - RNA, 20 nt, Human adenovirus E
caugcggaucucgcucaggu

SEQ ID NO: 3931607 - RNA, 19 nt, Human adenovirus E
cauggaauacaccacccuc

SEQ ID NO: 3931608 - RNA, 17 nt, Human adenovirus E
cauggaccaggugcuca

SEQ ID NO: 3931609 - RNA, 19 nt, Human adenovirus E
cauggcuugcagggucccg

SEQ ID NO: 3931610 - RNA, 17 nt, Human adenovirus E
caugguggcgcugaacg

SEQ ID NO: 3931611 - RNA, 16 nt, Human adenovirus E
caugguggucaggguc

SEQ ID NO: 3931612 - RNA, 18 nt, Human adenovirus E
cauguacgaggaucugga

SEQ ID NO: 3931613 - RNA, 17 nt, Human adenovirus E
cauguagaacugguuga

SEQ ID NO: 3931614 - RNA, 18 nt, Human adenovirus E
cauguggagcuaccagcc

SEQ ID NO: 3931615 - RNA, 22 nt, Human adenovirus E
cauguggcgguucaccaccucc

SEQ ID NO: 3931616 - RNA, 16 nt, Human adenovirus E
cauuacacagacaacc

SEQ ID NO: 3931617 - RNA, 19 nt, Human adenovirus E
cauuaccacacagacaacc

SEQ ID NO: 3931618 - RNA, 15 nt, Human adenovirus E
  misc_feature (6)..(6): n is a, c, g or u
cauuanuccagcaga

SEQ ID NO: 3931619 - RNA, 16 nt, Human adenovirus E
cauuugagcuggaggg

SEQ ID NO: 3931620 - RNA, 14 nt, Human adenovirus E
ccaacaaaugccag

SEQ ID NO: 3931621 - RNA, 13 nt, Human adenovirus E
ccaaccgcacccg

SEQ ID NO: 3931622 - RNA, 19 nt, Human adenovirus E
ccaaccgcacccgcgccga

SEQ ID NO: 3931623 - RNA, 13 nt, Human adenovirus E
ccaacgugcagac

SEQ ID NO: 3931624 - RNA, 20 nt, Human adenovirus E
ccaacgugcagaccaaccug

SEQ ID NO: 3931625 - RNA, 14 nt, Human adenovirus E
ccaacguggagcug

SEQ ID NO: 3931626 - RNA, 15 nt, Human adenovirus E
ccaacguggagcuga

SEQ ID NO: 3931627 - RNA, 23 nt, Human adenovirus E
ccaacguggagcugaccaaccug

SEQ ID NO: 3931628 - RNA, 20 nt, Human adenovirus E
ccaagaacagccagagcagg

SEQ ID NO: 3931629 - RNA, 17 nt, Human adenovirus E
ccaagaagaggcagcag

SEQ ID NO: 3931630 - RNA, 15 nt, Human adenovirus E
ccaaggccgagcugu

SEQ ID NO: 3931631 - RNA, 21 nt, Human adenovirus E
ccaaugacggguuccuguggg

SEQ ID NO: 3931632 - RNA, 22 nt, Human adenovirus E
ccaauugcaagccauccagaaa

SEQ ID NO: 3931633 - RNA, 15 nt, Human adenovirus E
ccacaccacagcuac

SEQ ID NO: 3931634 - RNA, 18 nt, Human adenovirus E
ccacagaaguuucauggu

SEQ ID NO: 3931635 - RNA, 15 nt, Human adenovirus E
ccacagcaaccucag

SEQ ID NO: 3931636 - RNA, 21 nt, Human adenovirus E
ccacagcaaccucaggcacac

SEQ ID NO: 3931637 - RNA, 17 nt, Human adenovirus E
ccacagggccagcaccg

SEQ ID NO: 3931638 - RNA, 20 nt, Human adenovirus E
ccaccacagcaaccucaggc

SEQ ID NO: 3931639 - RNA, 20 nt, Human adenovirus E
ccaccacuacagccuaggcc

SEQ ID NO: 3931640 - RNA, 16 nt, Human adenovirus E
ccaccccacccaguga

SEQ ID NO: 3931641 - RNA, 13 nt, Human adenovirus E
ccaccccugccgc

SEQ ID NO: 3931642 - RNA, 14 nt, Human adenovirus E
ccacccuccaccgc

SEQ ID NO: 3931643 - RNA, 15 nt, Human adenovirus E
ccacccucgcucugg

SEQ ID NO: 3931644 - RNA, 21 nt, Human adenovirus E
ccaccgcgaguccaaccuggg

SEQ ID NO: 3931645 - RNA, 16 nt, Human adenovirus E
ccaccguggugcagaa

SEQ ID NO: 3931646 - RNA, 13 nt, Human adenovirus E
ccaccucagcuca

SEQ ID NO: 3931647 - RNA, 14 nt, Human adenovirus E
ccaccucagcucaa

SEQ ID NO: 3931648 - RNA, 22 nt, Human adenovirus E
ccaccugggcgagguugagcuc

SEQ ID NO: 3931649 - RNA, 20 nt, Human adenovirus E
ccacgccccgcaaucaccuc

SEQ ID NO: 3931650 - RNA, 19 nt, Human adenovirus E
ccacgcgcacauccagaaa

SEQ ID NO: 3931651 - RNA, 22 nt, Human adenovirus E
ccacggcaaccccacgccgagc

SEQ ID NO: 3931652 - RNA, 15 nt, Human adenovirus E
ccacggccagggcgg

SEQ ID NO: 3931653 - RNA, 14 nt, Human adenovirus E
ccacggcccucagc

SEQ ID NO: 3931654 - RNA, 17 nt, Human adenovirus E
ccacgguggcuuccagc

SEQ ID NO: 3931655 - RNA, 19 nt, Human adenovirus E
ccacgguggcuuccagcaa

SEQ ID NO: 3931656 - RNA, 13 nt, Human adenovirus E
cggcagugguggc

SEQ ID NO: 3931657 - RNA, 14 nt, Human adenovirus E
cggcaucucgcuga

SEQ ID NO: 3931658 - RNA, 21 nt, Human adenovirus E
cggcauggcccgcgggcaggg

SEQ ID NO: 3931659 - RNA, 23 nt, Human adenovirus E
cggcauugcuuccguggcggugc

SEQ ID NO: 3931660 - RNA, 20 nt, Human adenovirus E
cggcauugucggugugcuuu

SEQ ID NO: 3931661 - RNA, 18 nt, Human adenovirus E
cggccaucgccagcaugu

SEQ ID NO: 3931662 - RNA, 17 nt, Human adenovirus E
cggcccugcggugguga

SEQ ID NO: 3931663 - RNA, 17 nt, Human adenovirus E
cggccuuguaggcgcag

SEQ ID NO: 3931664 - RNA, 16 nt, Human adenovirus E
cggcgacgaggccggc

SEQ ID NO: 3931665 - RNA, 18 nt, Human adenovirus E
cggcgacuaccuccaccu

SEQ ID NO: 3931666 - RNA, 14 nt, Human adenovirus E
cggcgaggagcccg

SEQ ID NO: 3931667 - RNA, 19 nt, Human adenovirus E
cggcgagggccugcucgag

SEQ ID NO: 3931668 - RNA, 14 nt, Human adenovirus E
cggcgaugcagccc

SEQ ID NO: 3931669 - RNA, 18 nt, Human adenovirus E
cggcgauguugagcugca

SEQ ID NO: 3931670 - RNA, 22 nt, Human adenovirus E
cggcgcgagcugagcgaccagg

SEQ ID NO: 3931671 - RNA, 14 nt, Human adenovirus E
cggcgcugcagagc

SEQ ID NO: 3931672 - RNA, 12 nt, Human adenovirus E
cggcggagauga

SEQ ID NO: 3931673 - RNA, 15 nt, Human adenovirus E
cggcggcagcaggug

SEQ ID NO: 3931674 - RNA, 13 nt, Human adenovirus E
cggcggccugggc

SEQ ID NO: 3931675 - RNA, 17 nt, Human adenovirus E
cggcggcgaugcagccc

SEQ ID NO: 3931676 - RNA, 15 nt, Human adenovirus E
cggcggcggcagcgg

SEQ ID NO: 3931677 - RNA, 19 nt, Human adenovirus E
cggcggugcccgaggccgc

SEQ ID NO: 3931678 - RNA, 14 nt, Human adenovirus E
cggcucccccggcc

SEQ ID NO: 3931679 - RNA, 23 nt, Human adenovirus E
cggcucucggccauccuggaggc

SEQ ID NO: 3931680 - RNA, 14 nt, Human adenovirus E
cggcuucccccagg

SEQ ID NO: 3931681 - RNA, 16 nt, Human adenovirus E
cgggacccugccgcug

SEQ ID NO: 3931682 - RNA, 23 nt, Human adenovirus E
cgggacccugccgcugcgcagca

SEQ ID NO: 3931683 - RNA, 15 nt, Human adenovirus E
cgggcaucagcugga

SEQ ID NO: 3931684 - RNA, 15 nt, Human adenovirus E
cgggcgcgcaugacc

SEQ ID NO: 3931685 - RNA, 20 nt, Human adenovirus E
cgggcggcgcugcagagcca

SEQ ID NO: 3931686 - RNA, 15 nt, Human adenovirus E
cucaggcggcagugg

SEQ ID NO: 3931687 - RNA, 21 nt, Human adenovirus E
cucaggcuccucugauaagca

SEQ ID NO: 3931688 - RNA, 16 nt, Human adenovirus E
cucagguugucaguuu

SEQ ID NO: 3931689 - RNA, 22 nt, Human adenovirus E
cucaugcaucucuucagcacuc

SEQ ID NO: 3931690 - RNA, 17 nt, Human adenovirus E
cuccaacguggagcuga

SEQ ID NO: 3931691 - RNA, 19 nt, Human adenovirus E
cuccaagagcuucuucaac

SEQ ID NO: 3931692 - RNA, 14 nt, Human adenovirus E
cuccacccucccag

SEQ ID NO: 3931693 - RNA, 17 nt, Human adenovirus E
cuccacgagccagguga

SEQ ID NO: 3931694 - RNA, 23 nt, Human adenovirus E
cuccacgcaacaccccgugcgcg

SEQ ID NO: 3931695 - RNA, 22 nt, Human adenovirus E
cuccacgucgagguccucggcg

SEQ ID NO: 3931696 - RNA, 17 nt, Human adenovirus E
cuccacguuccacacag

SEQ ID NO: 3931697 - RNA, 22 nt, Human adenovirus E
  misc_feature (9)..(9): n is a, c, g or u
cuccagcunuuccaacccuucc

SEQ ID NO: 3931698 - RNA, 20 nt, Human adenovirus E
cuccagugccuucucuagca

SEQ ID NO: 3931699 - RNA, 15 nt, Human adenovirus E
cuccauugcagggcc

SEQ ID NO: 3931700 - RNA, 16 nt, Human adenovirus E
cucccccggccacuac

SEQ ID NO: 3931701 - RNA, 15 nt, Human adenovirus E
cucccgccugaaccu

SEQ ID NO: 3931702 - RNA, 14 nt, Human adenovirus E
cucccggaggaggg

SEQ ID NO: 3931703 - RNA, 21 nt, Human adenovirus E
cuccgagacgaaagcccgggu

SEQ ID NO: 3931704 - RNA, 18 nt, Human adenovirus E
cuccgaggagggcaagcc

SEQ ID NO: 3931705 - RNA, 24 nt, Human adenovirus E
cuccggcucccccggccacuaccc

SEQ ID NO: 3931706 - RNA, 17 nt, Human adenovirus E
cuccgggcacucccgca

SEQ ID NO: 3931707 - RNA, 14 nt, Human adenovirus E
cuccugcacaggca

SEQ ID NO: 3931708 - RNA, 17 nt, Human adenovirus E
cuccugcacaggcagca

SEQ ID NO: 3931709 - RNA, 13 nt, Human adenovirus E
cuccuggaccugg

SEQ ID NO: 3931710 - RNA, 20 nt, Human adenovirus E
cuccugguccugugaugugu

SEQ ID NO: 3931711 - RNA, 14 nt, Human adenovirus E
cuccuuacgugccc

SEQ ID NO: 3931712 - RNA, 17 nt, Human adenovirus E
cucgacucccaccugcu

SEQ ID NO: 3931713 - RNA, 19 nt, Human adenovirus E
cucgagugccacugccgcu

SEQ ID NO: 3931714 - RNA, 20 nt, Human adenovirus E
cucgaucaugugcuccuucu

SEQ ID NO: 3931715 - RNA, 18 nt, Human adenovirus E
cucgccaucugcccccac

SEQ ID NO: 3931716 - RNA, 19 nt, Human adenovirus E
cucgccgcgcgugcccccc

SEQ ID NO: 3931717 - RNA, 21 nt, Human adenovirus E
cucgcgcagagcgcccuccac

SEQ ID NO: 3931718 - RNA, 14 nt, Human adenovirus E
cucgcgcuucugcu

SEQ ID NO: 3931719 - RNA, 21 nt, Human adenovirus E
cucgcgguggggcggccagcu

SEQ ID NO: 3931720 - RNA, 19 nt, Human adenovirus E
cuguggggcgugcaggccc

SEQ ID NO: 3931721 - RNA, 14 nt, Human adenovirus E
cugugucugaaccc

SEQ ID NO: 3931722 - RNA, 15 nt, Human adenovirus E
cuguuccugaugcag

SEQ ID NO: 3931723 - RNA, 15 nt, Human adenovirus E
cuuaacauggaucac

SEQ ID NO: 3931724 - RNA, 21 nt, Human adenovirus E
cuuaaccgccccgccgcccag

SEQ ID NO: 3931725 - RNA, 15 nt, Human adenovirus E
cuuaccauugucaau

SEQ ID NO: 3931726 - RNA, 14 nt, Human adenovirus E
cuuaccgagcagca

SEQ ID NO: 3931727 - RNA, 18 nt, Human adenovirus E
cuuagcgcuagcagccgc

SEQ ID NO: 3931728 - RNA, 21 nt, Human adenovirus E
cuuaucaccuucuuccaguuc

SEQ ID NO: 3931729 - RNA, 16 nt, Human adenovirus E
cuucacccccacggag

SEQ ID NO: 3931730 - RNA, 21 nt, Human adenovirus E
cuucacccccacggaggccag

SEQ ID NO: 3931731 - RNA, 15 nt, Human adenovirus E
cuucacgccucguca

SEQ ID NO: 3931732 - RNA, 19 nt, Human adenovirus E
cuucacgccucgucaggcc

SEQ ID NO: 3931733 - RNA, 18 nt, Human adenovirus E
cuuccagauaacuggaca

SEQ ID NO: 3931734 - RNA, 20 nt, Human adenovirus E
cuuccagauaacuggacaga

SEQ ID NO: 3931735 - RNA, 23 nt, Human adenovirus E
cuuccagauaacuggacagaaaa

SEQ ID NO: 3931736 - RNA, 16 nt, Human adenovirus E
cuuccauucggggaag

SEQ ID NO: 3931737 - RNA, 15 nt, Human adenovirus E
cuucccccaggaugc

SEQ ID NO: 3931738 - RNA, 19 nt, Human adenovirus E
cuuccgcgagacgcccagg

SEQ ID NO: 3931739 - RNA, 17 nt, Human adenovirus E
cuuccguggcggugcag

SEQ ID NO: 3931740 - RNA, 19 nt, Human adenovirus E
cuucgagggucugggcagc

SEQ ID NO: 3931741 - RNA, 19 nt, Human adenovirus E
cuucgcgauguugaugugu

SEQ ID NO: 3931742 - RNA, 18 nt, Human adenovirus E
cuucggaucuucagccag

SEQ ID NO: 3931743 - RNA, 17 nt, Human adenovirus E
cuucucccaggccgaga

SEQ ID NO: 3931744 - RNA, 14 nt, Human adenovirus E
cuucuuccuccucc

SEQ ID NO: 3931745 - RNA, 13 nt, Human adenovirus E
cuugagcuguccc

SEQ ID NO: 3931746 - RNA, 19 nt, Human adenovirus E
cuugcacgagaaccgccug

SEQ ID NO: 3931747 - RNA, 23 nt, Human adenovirus E
cuugccauucgcgcacggccagc

SEQ ID NO: 3931748 - RNA, 24 nt, Human adenovirus E
cuugcgcaaguucgugcccgagga

SEQ ID NO: 3931749 - RNA, 22 nt, Human adenovirus E
cuugcugcuauagaaggcuuua

SEQ ID NO: 3931750 - RNA, 16 nt, Human adenovirus E
cuugggggcgaggaag

SEQ ID NO: 3931751 - RNA, 22 nt, Human adenovirus E
cuuuagacagcagccccaggcc

SEQ ID NO: 3931752 - RNA, 16 nt, Human adenovirus E
cuuucauauccucucc

SEQ ID NO: 3931753 - RNA, 13 nt, Human adenovirus E
cuuugaggaggag

SEQ ID NO: 3931754 - RNA, 21 nt, Human adenovirus E
cuuuggaagauguugaagugg

SEQ ID NO: 3931755 - RNA, 18 nt, Human adenovirus E
cuuuugguucucugcuac

SEQ ID NO: 3931756 - RNA, 17 nt, Human adenovirus E
gaaaaauccuccaggug

SEQ ID NO: 3931757 - RNA, 13 nt, Human adenovirus E
gaaaauaacagcc

SEQ ID NO: 3931758 - RNA, 20 nt, Human adenovirus E
gaaacagguguugaugaugc

SEQ ID NO: 3931759 - RNA, 14 nt, Human adenovirus E
gaaagagcagaacu

SEQ ID NO: 3931760 - RNA, 17 nt, Human adenovirus E
gagaugcaauugaaagc

SEQ ID NO: 3931761 - RNA, 21 nt, Human adenovirus E
gagaugcgcgcggcccgguuc

SEQ ID NO: 3931762 - RNA, 14 nt, Human adenovirus E
gagauugaccuggg

SEQ ID NO: 3931763 - RNA, 13 nt, Human adenovirus E
gagcaaggacaga

SEQ ID NO: 3931764 - RNA, 17 nt, Human adenovirus E
gagcagaccgugaagga

SEQ ID NO: 3931765 - RNA, 14 nt, Human adenovirus E
gagcagaccuacca

SEQ ID NO: 3931766 - RNA, 13 nt, Human adenovirus E
gagcagcagcaca

SEQ ID NO: 3931767 - RNA, 21 nt, Human adenovirus E
gagcagucucuggagcgggcu

SEQ ID NO: 3931768 - RNA, 20 nt, Human adenovirus E
gagcauugccaaaugcaaga

SEQ ID NO: 3931769 - RNA, 16 nt, Human adenovirus E
gagcccaacccgcgcc

SEQ ID NO: 3931770 - RNA, 15 nt, Human adenovirus E
gagccccgggcccag

SEQ ID NO: 3931771 - RNA, 24 nt, Human adenovirus E
gagcccgaggagaugcgcgcggcc

SEQ ID NO: 3931772 - RNA, 15 nt, Human adenovirus E
gagcccgcgcgggag

SEQ ID NO: 3931773 - RNA, 23 nt, Human adenovirus E
gagccgccucagcaaccugcugg

SEQ ID NO: 3931774 - RNA, 21 nt, Human adenovirus E
gagccgcgcccugggccagga

SEQ ID NO: 3931775 - RNA, 21 nt, Human adenovirus E
gagccuuguugcgcagggcca

SEQ ID NO: 3931776 - RNA, 19 nt, Human adenovirus E
gagcgccagcaggcggcgc

SEQ ID NO: 3931777 - RNA, 15 nt, Human adenovirus E
gagcgcgggcugccg

SEQ ID NO: 3931778 - RNA, 16 nt, Human adenovirus E
gagcuccagcuccagu

SEQ ID NO: 3931779 - RNA, 16 nt, Human adenovirus E
gagcucgacgagccgg

SEQ ID NO: 3931780 - RNA, 17 nt, Human adenovirus E
gagcugcccgaaggcaa

SEQ ID NO: 3931781 - RNA, 19 nt, Human adenovirus E
gagcuggagugccugcgcc

SEQ ID NO: 3931782 - RNA, 21 nt, Human adenovirus E
gagcuugggggcgaggaagac

SEQ ID NO: 3931783 - RNA, 23 nt, Human adenovirus E
gagcuugggggcgaggaagacgg

SEQ ID NO: 3931784 - RNA, 20 nt, Human adenovirus E
gaggaacaacaagcauggag

SEQ ID NO: 3931785 - RNA, 19 nt, Human adenovirus E
gaggaaccccgcccacucc

SEQ ID NO: 3931786 - RNA, 14 nt, Human adenovirus E
gaggagguggaaga

SEQ ID NO: 3931787 - RNA, 17 nt, Human adenovirus E
gaggccaucggccaggc

SEQ ID NO: 3931788 - RNA, 15 nt, Human adenovirus E
gaggccgagccacag

SEQ ID NO: 3931789 - RNA, 14 nt, Human adenovirus E
gaggcgcgcgcagu

SEQ ID NO: 3931790 - RNA, 15 nt, Human adenovirus E
gaggggcggaacagc

SEQ ID NO: 3931791 - RNA, 14 nt, Human adenovirus E
gagggucugggcag

SEQ ID NO: 3931792 - RNA, 18 nt, Human adenovirus E
gagggucugggcagcgac

SEQ ID NO: 3931793 - RNA, 17 nt, Human adenovirus E
gagggugccggacuggg

SEQ ID NO: 3931794 - RNA, 15 nt, Human adenovirus E
gaggucaggggcgau

SEQ ID NO: 3931795 - RNA, 20 nt, Human adenovirus E
gagguccacacugguggcca

SEQ ID NO: 3931796 - RNA, 19 nt, Human adenovirus E
gaguacuucaaaaugaaga

SEQ ID NO: 3931797 - RNA, 17 nt, Human adenovirus E
gaguccaaccugggauc

SEQ ID NO: 3931798 - RNA, 24 nt, Human adenovirus E
gaguuaaucuuaccauugucaaug

SEQ ID NO: 3931799 - RNA, 13 nt, Human adenovirus E
gaguuuuuccagg

SEQ ID NO: 3931800 - RNA, 21 nt, Human adenovirus E
gauacucaccaaggccauggc

SEQ ID NO: 3931801 - RNA, 21 nt, Human adenovirus E
gauaucgccuccuuggaagag

SEQ ID NO: 3931802 - RNA, 17 nt, Human adenovirus E
gauauucugcuccuggu

SEQ ID NO: 3931803 - RNA, 21 nt, Human adenovirus E
gaucagcaucaucugggccug

SEQ ID NO: 3931804 - RNA, 15 nt, Human adenovirus E
gaucccgaauaccac

SEQ ID NO: 3931805 - RNA, 18 nt, Human adenovirus E
ucggcgcuguccggccgc

SEQ ID NO: 3931806 - RNA, 16 nt, Human adenovirus E
ucgggcaucagcugga

SEQ ID NO: 3931807 - RNA, 12 nt, Human adenovirus E
ucgggcggccgc

SEQ ID NO: 3931808 - RNA, 13 nt, Human adenovirus E
ucgggggcagagg

SEQ ID NO: 3931809 - RNA, 15 nt, Human adenovirus E
ucgggggcaggagca

SEQ ID NO: 3931810 - RNA, 21 nt, Human adenovirus E
ucggugaagaagaccccgcag

SEQ ID NO: 3931811 - RNA, 11 nt, Human adenovirus E
ucguaccuggg

SEQ ID NO: 3931812 - RNA, 21 nt, Human adenovirus E
ucguacgagagcgugaugcag

SEQ ID NO: 3931813 - RNA, 19 nt, Human adenovirus E
ucguccacauccaggaagg

SEQ ID NO: 3931814 - RNA, 21 nt, Human adenovirus E
ucguggaugcucuauacgggc

SEQ ID NO: 3931815 - RNA, 21 nt, Human adenovirus E
ucuaaccggcggagaugacug

SEQ ID NO: 3931816 - RNA, 20 nt, Human adenovirus E
ucuacacuaaaaaaauacug

SEQ ID NO: 3931817 - RNA, 14 nt, Human adenovirus E
ucuaccucgacccc

SEQ ID NO: 3931818 - RNA, 13 nt, Human adenovirus E
ucuaccucugcca

SEQ ID NO: 3931819 - RNA, 20 nt, Human adenovirus E
ucuccaccauuaaauauacu

SEQ ID NO: 3931820 - RNA, 19 nt, Human adenovirus E
ucuccaguucguggaggag

SEQ ID NO: 3931821 - RNA, 21 nt, Human adenovirus E
ucuccuucagcgcgcgcugcc

SEQ ID NO: 3931822 - RNA, 23 nt, Human adenovirus E
ucucgauccagcagaccuccucg

SEQ ID NO: 3931823 - RNA, 16 nt, Human adenovirus E
ucucgcucgccacauc

SEQ ID NO: 3931824 - RNA, 21 nt, Human adenovirus E
ucucugcucaauauauagccc

SEQ ID NO: 3931825 - RNA, 17 nt, Human adenovirus E
ucugauaccaggucucu

SEQ ID NO: 3931826 - RNA, 16 nt, Human adenovirus E
ucugcaagcuccugca

SEQ ID NO: 3931827 - RNA, 11 nt, Human adenovirus E
ucugccuccuc

SEQ ID NO: 3931828 - RNA, 14 nt, Human adenovirus E
ucuggaagaagcag

SEQ ID NO: 3931829 - RNA, 21 nt, Human adenovirus E
ucuggaggaagacgaggagga

SEQ ID NO: 3931830 - RNA, 22 nt, Human adenovirus E
ucuggaggaagacgaggaggag

SEQ ID NO: 3931831 - RNA, 18 nt, Human adenovirus E
ucugggugaucuuggccc

SEQ ID NO: 3931832 - RNA, 12 nt, Human adenovirus E
ucuuccuccucc

SEQ ID NO: 3931833 - RNA, 22 nt, Human adenovirus E
ucuucuccaucgcuuacagccu

SEQ ID NO: 3931834 - RNA, 14 nt, Human adenovirus E
ugaaacccuccggg

SEQ ID NO: 3931835 - RNA, 24 nt, Human adenovirus E
ugaacaagucuauguuggcacagc

SEQ ID NO: 3931836 - RNA, 17 nt, Human adenovirus E
ugaaccugacacaccac

SEQ ID NO: 3931837 - RNA, 17 nt, Human adenovirus E
ugaaccugagccaggcu

SEQ ID NO: 3931838 - RNA, 17 nt, Human adenovirus E
ugaagcaacugcagccg

SEQ ID NO: 3931839 - RNA, 18 nt, Human adenovirus E
ugaaggaggaaagaaagc

SEQ ID NO: 3931840 - RNA, 16 nt, Human adenovirus E
ugaauccccacuggcu

SEQ ID NO: 3931841 - RNA, 19 nt, Human adenovirus E
ugacacuacagaaacugaa

SEQ ID NO: 3931842 - RNA, 14 nt, Human adenovirus E
ugacagcaacagua

SEQ ID NO: 3931843 - RNA, 21 nt, Human adenovirus E
uggcgacgagcucggcgguga

SEQ ID NO: 3931844 - RNA, 18 nt, Human adenovirus E
uggcgaugugcucgguga

SEQ ID NO: 3931845 - RNA, 16 nt, Human adenovirus E
uggcggauggcuggca

SEQ ID NO: 3931846 - RNA, 21 nt, Human adenovirus E
uggcggcgauguugagcugca

SEQ ID NO: 3931847 - RNA, 17 nt, Human adenovirus E
uggcgguggggcggcag

SEQ ID NO: 3931848 - RNA, 17 nt, Human adenovirus E
uggcuccuggaccuggu

SEQ ID NO: 3931849 - RNA, 22 nt, Human adenovirus E
ugggacagcacucaggcagagg

SEQ ID NO: 3931850 - RNA, 12 nt, Human adenovirus E
ugggcagggaga

SEQ ID NO: 3931851 - RNA, 14 nt, Human adenovirus E
ugggcccgugggcg

SEQ ID NO: 3931852 - RNA, 15 nt, Human adenovirus E
ugggcgugcagaccg

SEQ ID NO: 3931853 - RNA, 17 nt, Human adenovirus E
ugggcguguggcagcag

SEQ ID NO: 3931854 - RNA, 23 nt, Human adenovirus E
uggggccguagaugaccccgaug

SEQ ID NO: 3931855 - RNA, 22 nt, Human adenovirus E
ugguaguugagggagagacagc

SEQ ID NO: 3931856 - RNA, 19 nt, Human adenovirus E
uggucagcgacgagcagcu

SEQ ID NO: 3931857 - RNA, 22 nt, Human adenovirus E
uggucgaaaaccgcucccgauc

SEQ ID NO: 3931858 - RNA, 13 nt, Human adenovirus E
uggucgcugcccg

SEQ ID NO: 3931859 - RNA, 13 nt, Human adenovirus E
uggugaaggagga

SEQ ID NO: 3931860 - RNA, 19 nt, Human adenovirus E
uggugaccguggagcugga

SEQ ID NO: 3931861 - RNA, 22 nt, Human adenovirus E
ugguggacaagaugagccgcug

SEQ ID NO: 3931862 - RNA, 16 nt, Human adenovirus E
ugguggcgaaggagcc

SEQ ID NO: 3931863 - RNA, 18 nt, Human adenovirus E
uggugggccuuuggaaga

SEQ ID NO: 3931864 - RNA, 13 nt, Human adenovirus E
uguaccccgguuc

SEQ ID NO: 3931865 - RNA, 18 nt, Human adenovirus E
uguaccgcgaggccaucg

SEQ ID NO: 3931866 - RNA, 22 nt, Human adenovirus E
uguauuauggaacuacagcagg

SEQ ID NO: 3931867 - RNA, 21 nt, Human adenovirus E
uguccacccgcucucugcuca

SEQ ID NO: 3931868 - RNA, 19 nt, Human adenovirus E
ugucucuucgggggcagag

SEQ ID NO: 3931869 - RNA, 13 nt, Human adenovirus E
uguggagccacug

SEQ ID NO: 3931870 - RNA, 21 nt, Human adenovirus E
uguggagccacugcuaccugc

SEQ ID NO: 3931871 - RNA, 18 nt, Human adenovirus E
uguggagcuaccagcccc

SEQ ID NO: 3931872 - RNA, 19 nt, Human adenovirus E
uguuaccacuaugcagcuc

SEQ ID NO: 3931873 - RNA, 23 nt, Human adenovirus E
uguuacugaggggggcaauguga

SEQ ID NO: 3931874 - RNA, 23 nt, Human adenovirus E
uuaacagaacauucuacacuaaa

SEQ ID NO: 3931875 - RNA, 19 nt, Human adenovirus E
uuaacaucacuagagacua

SEQ ID NO: 3931876 - RNA, 18 nt, Human adenovirus E
uuaagaaaaucaacaaaa

SEQ ID NO: 3931877 - RNA, 12 nt, Human adenovirus E
uuaccucugcuc

SEQ ID NO: 3931878 - RNA, 16 nt, Human adenovirus E
uuacuacggccccugg

SEQ ID NO: 3931879 - RNA, 12 nt, Human adenovirus E
uuauacauguga

SEQ ID NO: 3931880 - RNA, 16 nt, Human adenovirus E
uucaagaacuugcagg

SEQ ID NO: 3931881 - RNA, 12 nt, Human adenovirus E
uucaccaccugc

SEQ ID NO: 3931882 - RNA, 12 nt, Human adenovirus E
uucccccaggau

SEQ ID NO: 3931883 - RNA, 16 nt, Human adenovirus E
uuccgcgcucccuggg

SEQ ID NO: 3931884 - RNA, 13 nt, Human adenovirus E
uuccggagcagcu

SEQ ID NO: 3931885 - RNA, 13 nt, Human adenovirus E
uuccuccacccuc

SEQ ID NO: 3931886 - RNA, 12 nt, Human adenovirus E
uuccugaugcag

SEQ ID NO: 3931887 - RNA, 19 nt, Human adenovirus E
  misc_feature (6)..(6): n is a, c, g or u
uuccunuacaccaaucagu

SEQ ID NO: 3931888 - RNA, 13 nt, Human adenovirus E
uucucuccagcac

SEQ ID NO: 3931889 - RNA, 22 nt, Human adenovirus E
uucugacaaugaggacguuacu

SEQ ID NO: 3931890 - RNA, 16 nt, Human adenovirus E
uucuuaucugccuccu

SEQ ID NO: 3931891 - RNA, 13 nt, Human adenovirus E
uucuuccuccucc

SEQ ID NO: 3931892 - RNA, 17 nt, Human adenovirus E
uugaucuccaccgcgcc

SEQ ID NO: 3931893 - RNA, 14 nt, Human adenovirus E
uugcaagcgccgca

SEQ ID NO: 3931894 - RNA, 16 nt, Human adenovirus E
uugcagggccuguggg

SEQ ID NO: 3931895 - RNA, 13 nt, Human adenovirus E
uugcgcgagcaga

SEQ ID NO: 3931896 - RNA, 14 nt, Human adenovirus E
uuggcauuguuuuu

SEQ ID NO: 3931897 - RNA, 15 nt, Human adenovirus E
uuggcgcggaggaag

SEQ ID NO: 3931898 - RNA, 15 nt, Human adenovirus E
uuggggcaccucggc

SEQ ID NO: 3931899 - RNA, 17 nt, Human adenovirus E
uuguugcgcagggccag

SEQ ID NO: 3931900 - RNA, 19 nt, Human adenovirus E
uuuaccgacaaaaaucaga

SEQ ID NO: 3931901 - RNA, 14 nt, Human adenovirus E
uuuccuccacccuc

SEQ ID NO: 3931902 - RNA, 9 nt, Human adenovirus E
uuugccaga

SEQ ID NO: 3931903 - RNA, 16 nt, Human adenovirus E
uuugguucucugcuac

SEQ ID NO: 3931904 - RNA, 18 nt, Human adenovirus E
uuuucauuuuuccagccu

SEQ ID NO: 3931905 - RNA, 13 nt, Human adenovirus E
uuuuccuccaccc

SEQ ID NO: 3931906 - RNA, 15 nt, Human adenovirus E
aaaaacgucacccgc

SEQ ID NO: 3931907 - RNA, 14 nt, Human adenovirus E
aaaauaacagccag

SEQ ID NO: 3931908 - RNA, 12 nt, Human adenovirus E
aaaauccacagc

SEQ ID NO: 3931909 - RNA, 13 nt, Human adenovirus E
aaaccagcagcua

SEQ ID NO: 3931910 - RNA, 15 nt, Human adenovirus E
aaacugucaaauacu

SEQ ID NO: 3931911 - RNA, 21 nt, Human adenovirus E
aaagcccccgaucccuccagg

SEQ ID NO: 3931912 - RNA, 21 nt, Human adenovirus E
aaaucacccucaagcugggag

SEQ ID NO: 3931913 - RNA, 21 nt, Human adenovirus E
aaaucguucucuccagcacca

SEQ ID NO: 3931914 - RNA, 15 nt, Human adenovirus E
aacaacaagcaugga

SEQ ID NO: 3931915 - RNA, 19 nt, Human adenovirus E
aacacaaaauaaaauaaag

SEQ ID NO: 3931916 - RNA, 15 nt, Human adenovirus E
aacacgacuuucaaa

SEQ ID NO: 3931917 - RNA, 17 nt, Human adenovirus E
aacacuguaucccaccc

SEQ ID NO: 3931918 - RNA, 19 nt, Human adenovirus E
aacagcagucaggcagagg

SEQ ID NO: 3931919 - RNA, 12 nt, Human adenovirus E
aacagccagagc

SEQ ID NO: 3931920 - RNA, 13 nt, Human adenovirus E
aacaggaagaacc

SEQ ID NO: 3931921 - RNA, 17 nt, Human adenovirus E
aacagguggguaaaucg

SEQ ID NO: 3931922 - RNA, 19 nt, Human adenovirus E
aacaguauccgcagcagcg

SEQ ID NO: 3931923 - RNA, 13 nt, Human adenovirus E
aaccagcagcuag

SEQ ID NO: 3931924 - RNA, 20 nt, Human adenovirus E
aaccaugaagauccuaggcc

SEQ ID NO: 3931925 - RNA, 20 nt, Human adenovirus E
aacccaccccacccagugag

SEQ ID NO: 3931926 - RNA, 12 nt, Human adenovirus E
aacccccagcug

SEQ ID NO: 3931927 - RNA, 11 nt, Human adenovirus E
accugcuggag

SEQ ID NO: 3931928 - RNA, 13 nt, Human adenovirus E
accuggaccacug

SEQ ID NO: 3931929 - RNA, 22 nt, Human adenovirus E
accuggccuaccacucggacgu

SEQ ID NO: 3931930 - RNA, 12 nt, Human adenovirus E
accugggcggcg

SEQ ID NO: 3931931 - RNA, 18 nt, Human adenovirus E
accugugggaccugcugg

SEQ ID NO: 3931932 - RNA, 19 nt, Human adenovirus E
accugugggaccugcugga

SEQ ID NO: 3931933 - RNA, 16 nt, Human adenovirus E
accuguucagagacag

SEQ ID NO: 3931934 - RNA, 17 nt, Human adenovirus E
accuucuuccaguucau

SEQ ID NO: 3931935 - RNA, 19 nt, Human adenovirus E
acgaagcccugcaggaagc

SEQ ID NO: 3931936 - RNA, 12 nt, Human adenovirus E
acgacagcagcg

SEQ ID NO: 3931937 - RNA, 13 nt, Human adenovirus E
acgagaagcagca

SEQ ID NO: 3931938 - RNA, 20 nt, Human adenovirus E
acgagcagaccuaccaggag

SEQ ID NO: 3931939 - RNA, 14 nt, Human adenovirus E
acgagcagcuggcc

SEQ ID NO: 3931940 - RNA, 21 nt, Human adenovirus E
acgagccggggcagcgccgcc

SEQ ID NO: 3931941 - RNA, 13 nt, Human adenovirus E
acgaggaggaggc

SEQ ID NO: 3931942 - RNA, 17 nt, Human adenovirus E
acgaggaggaggcagag

SEQ ID NO: 3931943 - RNA, 14 nt, Human adenovirus E
acgauccccgggcg

SEQ ID NO: 3931944 - RNA, 18 nt, Human adenovirus E
acgauguggacagcagcg

SEQ ID NO: 3931945 - RNA, 22 nt, Human adenovirus E
acgcacgagaagguccuggcca

SEQ ID NO: 3931946 - RNA, 15 nt, Human adenovirus E
acgcacgucuucaac

SEQ ID NO: 3931947 - RNA, 23 nt, Human adenovirus E
acgcacuaccaccacuacagccu

SEQ ID NO: 3931948 - RNA, 20 nt, Human adenovirus E
acgccuaugagaaaagcaag

SEQ ID NO: 3931949 - RNA, 19 nt, Human adenovirus E
acgcgcccgcgcuugcugg

SEQ ID NO: 3931950 - RNA, 24 nt, Human adenovirus E
acgcgcucagcaccgaggaggagc

SEQ ID NO: 3931951 - RNA, 14 nt, Human adenovirus E
acgcgcugguggag

SEQ ID NO: 3931952 - RNA, 13 nt, Human adenovirus E
acgcggagacccu

SEQ ID NO: 3931953 - RNA, 20 nt, Human adenovirus E
acgcgucaaguuagcaacua

SEQ ID NO: 3931954 - RNA, 11 nt, Human adenovirus E
acggaggccag

SEQ ID NO: 3931955 - RNA, 15 nt, Human adenovirus E
acggcccucagcauc

SEQ ID NO: 3931956 - RNA, 16 nt, Human adenovirus E
acggcccugcgguggu

SEQ ID NO: 3931957 - RNA, 19 nt, Human adenovirus E
acggcgacuaccuccaccu

SEQ ID NO: 3931958 - RNA, 17 nt, Human adenovirus E
acgggacgcagggccau

SEQ ID NO: 3931959 - RNA, 23 nt, Human adenovirus E
acggggaucagccccgcgcgcgc

SEQ ID NO: 3931960 - RNA, 14 nt, Human adenovirus E
acggggugcuggag

SEQ ID NO: 3931961 - RNA, 17 nt, Human adenovirus E
acggucaacuccuccuc

SEQ ID NO: 3931962 - RNA, 19 nt, Human adenovirus E
acgucaccugcggcgugga

SEQ ID NO: 3931963 - RNA, 12 nt, Human adenovirus E
acgugagccgcg

SEQ ID NO: 3931964 - RNA, 12 nt, Human adenovirus E
acgugcagacca

SEQ ID NO: 3931965 - RNA, 17 nt, Human adenovirus E
acgugcagaccaaccug

SEQ ID NO: 3931966 - RNA, 19 nt, Human adenovirus E
acgugcagaccaaccugga

SEQ ID NO: 3931967 - RNA, 23 nt, Human adenovirus E
acgugccccggggccaggaggac

SEQ ID NO: 3931968 - RNA, 14 nt, Human adenovirus E
acguggagcugacc

SEQ ID NO: 3931969 - RNA, 18 nt, Human adenovirus E
acguggccgcggccaacc

SEQ ID NO: 3931970 - RNA, 22 nt, Human adenovirus E
acguggccgcggccaaccuggu

SEQ ID NO: 3931971 - RNA, 22 nt, Human adenovirus E
acguggccgucguaccagaucc

SEQ ID NO: 3931972 - RNA, 14 nt, Human adenovirus E
acuaccuccaccug

SEQ ID NO: 3931973 - RNA, 18 nt, Human adenovirus E
acuaccuccaccugagcg

SEQ ID NO: 3931974 - RNA, 16 nt, Human adenovirus E
acuaccuggccuacca

SEQ ID NO: 3931975 - RNA, 22 nt, Human adenovirus E
acuaggaacuucaggcugggcu

SEQ ID NO: 3931976 - RNA, 22 nt, Human adenovirus E
acuaugaggccgagccacagcg

SEQ ID NO: 3931977 - RNA, 17 nt, Human adenovirus E
acucagguguccagcug

SEQ ID NO: 3931978 - RNA, 23 nt, Human adenovirus E
acucaucgcgggaaggaugcuac

SEQ ID NO: 3931979 - RNA, 19 nt, Human adenovirus E
acuccccuccugcacaggc

SEQ ID NO: 3931980 - RNA, 13 nt, Human adenovirus E
acuccguggccug

SEQ ID NO: 3931981 - RNA, 15 nt, Human adenovirus E
acuccguggccugga

SEQ ID NO: 3931982 - RNA, 22 nt, Human adenovirus E
acuccuagaacagucagcgcuc

SEQ ID NO: 3931983 - RNA, 16 nt, Human adenovirus E
acucgcagaaaaugau

SEQ ID NO: 3931984 - RNA, 15 nt, Human adenovirus E
acucguaccugggcu

SEQ ID NO: 3931985 - RNA, 13 nt, Human adenovirus E
acugacgccagac

SEQ ID NO: 3931986 - RNA, 17 nt, Human adenovirus E
acugacgccagacgccg

SEQ ID NO: 3931987 - RNA, 15 nt, Human adenovirus E
acugccgcugcaacc

SEQ ID NO: 3931988 - RNA, 22 nt, Human adenovirus E
acugcgucuaccucuaccucug

SEQ ID NO: 3931989 - RNA, 18 nt, Human adenovirus E
acugcuaccugcugcgcc

SEQ ID NO: 3931990 - RNA, 19 nt, Human adenovirus E
acugcucgaucuccuccuc

SEQ ID NO: 3931991 - RNA, 16 nt, Human adenovirus E
acuuccagccacgacc

SEQ ID NO: 3931992 - RNA, 20 nt, Human adenovirus E
acuuccgcgcucccuggggc

SEQ ID NO: 3931993 - RNA, 16 nt, Human adenovirus E
acuuccuccgcggccg

SEQ ID NO: 3931994 - RNA, 19 nt, Human adenovirus E
acuucuuccagaccagucg

SEQ ID NO: 3931995 - RNA, 13 nt, Human adenovirus E
acuuggcgguggg

SEQ ID NO: 3931996 - RNA, 21 nt, Human adenovirus E
acuuggcgguggggcggcaga

SEQ ID NO: 3931997 - RNA, 17 nt, Human adenovirus E
agaacagccagagcagg

SEQ ID NO: 3931998 - RNA, 20 nt, Human adenovirus E
agaaccuguucagagacagg

SEQ ID NO: 3931999 - RNA, 23 nt, Human adenovirus E
agaacuuacauugugcauggaca

SEQ ID NO: 3932000 - RNA, 15 nt, Human adenovirus E
agaagccccuggggg

SEQ ID NO: 3932001 - RNA, 11 nt, Human adenovirus E
agaagcuggcg

SEQ ID NO: 3932002 - RNA, 16 nt, Human adenovirus E
agacagcagccccagg

SEQ ID NO: 3932003 - RNA, 23 nt, Human adenovirus E
agaccagcagaaaaccagcagcu

SEQ ID NO: 3932004 - RNA, 15 nt, Human adenovirus E
agacccgagcgggag

SEQ ID NO: 3932005 - RNA, 14 nt, Human adenovirus E
agacccggcaccac

SEQ ID NO: 3932006 - RNA, 23 nt, Human adenovirus E
agaccgacuuuaugggccggucc

SEQ ID NO: 3932007 - RNA, 16 nt, Human adenovirus E
agaccggugaggagcu

SEQ ID NO: 3932008 - RNA, 17 nt, Human adenovirus E
agaccgucguccucggc

SEQ ID NO: 3932009 - RNA, 19 nt, Human adenovirus E
agacgaaggcgcgcaggcc

SEQ ID NO: 3932010 - RNA, 19 nt, Human adenovirus E
agacgcgcgccgggcggca

SEQ ID NO: 3932011 - RNA, 17 nt, Human adenovirus E
agacgcgcggccacggc

SEQ ID NO: 3932012 - RNA, 18 nt, Human adenovirus E
agagcaucguggugcagg

SEQ ID NO: 3932013 - RNA, 11 nt, Human adenovirus E
agagccacacc

SEQ ID NO: 3932014 - RNA, 17 nt, Human adenovirus E
agagccacaccacagcu

SEQ ID NO: 3932015 - RNA, 13 nt, Human adenovirus E
agagccggcggcg

SEQ ID NO: 3932016 - RNA, 19 nt, Human adenovirus E
agagcucugcaagcuccug

SEQ ID NO: 3932017 - RNA, 22 nt, Human adenovirus E
agagcuucuucaacgagcaggc

SEQ ID NO: 3932018 - RNA, 14 nt, Human adenovirus E
agaggcagcagcag

SEQ ID NO: 3932019 - RNA, 20 nt, Human adenovirus E
agaggcggaggcgacgggcu

SEQ ID NO: 3932020 - RNA, 13 nt, Human adenovirus E
agaggugggcuug

SEQ ID NO: 3932021 - RNA, 19 nt, Human adenovirus E
agaguguaccgccgcggcc

SEQ ID NO: 3932022 - RNA, 15 nt, Human adenovirus E
agaguuuggaagagc

SEQ ID NO: 3932023 - RNA, 22 nt, Human adenovirus E
agaguuuggaagagcggcgcaa

SEQ ID NO: 3932024 - RNA, 15 nt, Human adenovirus E
agaucaacagccgcc

SEQ ID NO: 3932025 - RNA, 14 nt, Human adenovirus E
agaucacccugcuc

SEQ ID NO: 3932026 - RNA, 13 nt, Human adenovirus E
agauccucaggua

SEQ ID NO: 3932027 - RNA, 15 nt, Human adenovirus E
agcaccgccccgccc

SEQ ID NO: 3932028 - RNA, 13 nt, Human adenovirus E
agcacgaggagga

SEQ ID NO: 3932029 - RNA, 18 nt, Human adenovirus E
agcacgaggaggagcugg

SEQ ID NO: 3932030 - RNA, 21 nt, Human adenovirus E
agcacgaggaggagcuggcag

SEQ ID NO: 3932031 - RNA, 15 nt, Human adenovirus E
agcagaagcgugggc

SEQ ID NO: 3932032 - RNA, 13 nt, Human adenovirus E
agcagcagcacac

SEQ ID NO: 3932033 - RNA, 18 nt, Human adenovirus E
agcagccccaggccaacc

SEQ ID NO: 3932034 - RNA, 17 nt, Human adenovirus E
agcaggaagcagagaau

SEQ ID NO: 3932035 - RNA, 14 nt, Human adenovirus E
agcaggcggcgcga

SEQ ID NO: 3932036 - RNA, 17 nt, Human adenovirus E
agcaggggcgcagggca

SEQ ID NO: 3932037 - RNA, 14 nt, Human adenovirus E
agcaguaguacaga

SEQ ID NO: 3932038 - RNA, 17 nt, Human adenovirus E
agcagucaggcagagga

SEQ ID NO: 3932039 - RNA, 21 nt, Human adenovirus E
agcaguggcagcggccgaggc

SEQ ID NO: 3932040 - RNA, 17 nt, Human adenovirus E
agcaguuugggcagcgg

SEQ ID NO: 3932041 - RNA, 14 nt, Human adenovirus E
agcaucuggcccgg

SEQ ID NO: 3932042 - RNA, 22 nt, Human adenovirus E
agcaucuggcccggcaggccac

SEQ ID NO: 3932043 - RNA, 17 nt, Human adenovirus E
agcaugaugcccacggc

SEQ ID NO: 3932044 - RNA, 18 nt, Human adenovirus E
agcauugccaaaugcaag

SEQ ID NO: 3932045 - RNA, 18 nt, Human adenovirus E
agccacugcuaccugcug

SEQ ID NO: 3932046 - RNA, 14 nt, Human adenovirus E
agccagaugaugca

SEQ ID NO: 3932047 - RNA, 19 nt, Human adenovirus E
agcccaauggcaccugcga

SEQ ID NO: 3932048 - RNA, 20 nt, Human adenovirus E
agcccaucauguacgccagc

SEQ ID NO: 3932049 - RNA, 20 nt, Human adenovirus E
agcccaugaucaagcccagc

SEQ ID NO: 3932050 - RNA, 12 nt, Human adenovirus E
agccccaggcca

SEQ ID NO: 3932051 - RNA, 13 nt, Human adenovirus E
agccccaggccaa

SEQ ID NO: 3932052 - RNA, 23 nt, Human adenovirus E
agccccccugcucccagagcugg

SEQ ID NO: 3932053 - RNA, 23 nt, Human adenovirus E
agcccgaggucaaggugcggccc

SEQ ID NO: 3932054 - RNA, 23 nt, Human adenovirus E
agcccgcgcccgcccagucgcag

SEQ ID NO: 3932055 - RNA, 24 nt, Human adenovirus E
agcccgcgcgggaggcagguccag

SEQ ID NO: 3932056 - RNA, 15 nt, Human adenovirus E
agcccuuccaggaag

SEQ ID NO: 3932057 - RNA, 14 nt, Human adenovirus E
agccgaaacucauc

SEQ ID NO: 3932058 - RNA, 14 nt, Human adenovirus E
agccgcggccaggg

SEQ ID NO: 3932059 - RNA, 16 nt, Human adenovirus E
agccggcggcggcgca

SEQ ID NO: 3932060 - RNA, 22 nt, Human adenovirus E
agccggcggcggcgcaucgccc

SEQ ID NO: 3932061 - RNA, 23 nt, Human adenovirus E
agccguugauguuguggcccacg

SEQ ID NO: 3932062 - RNA, 17 nt, Human adenovirus E
agccuacaacuauggcg

SEQ ID NO: 3932063 - RNA, 15 nt, Human adenovirus E
agccugcugaugccc

SEQ ID NO: 3932064 - RNA, 18 nt, Human adenovirus E
agccuuguugcgcagggc

SEQ ID NO: 3932065 - RNA, 19 nt, Human adenovirus E
agccuuuagacagcagccc

SEQ ID NO: 3932066 - RNA, 18 nt, Human adenovirus E
agcgaacggguugggcug

SEQ ID NO: 3932067 - RNA, 15 nt, Human adenovirus E
agcgacgagcagcug

SEQ ID NO: 3932068 - RNA, 12 nt, Human adenovirus E
agcgcauccugc

SEQ ID NO: 3932069 - RNA, 15 nt, Human adenovirus E
agcgccgcagcagug

SEQ ID NO: 3932070 - RNA, 14 nt, Human adenovirus E
agcggcccugccaa

SEQ ID NO: 3932071 - RNA, 24 nt, Human adenovirus E
agcggcucgacuccguggccugga

SEQ ID NO: 3932072 - RNA, 23 nt, Human adenovirus E
agcggcuggugauccggggcaga

SEQ ID NO: 3932073 - RNA, 14 nt, Human adenovirus E
agcggggcuggaca

SEQ ID NO: 3932074 - RNA, 17 nt, Human adenovirus E
agcgggggggaggacgc

SEQ ID NO: 3932075 - RNA, 22 nt, Human adenovirus E
agcguguucuccccccgaccgg

SEQ ID NO: 3932076 - RNA, 17 nt, Human adenovirus E
agcuaccagccccagau

SEQ ID NO: 3932077 - RNA, 17 nt, Human adenovirus E
agcuccagcuccagugu

SEQ ID NO: 3932078 - RNA, 21 nt, Human adenovirus E
agcuccaguguaagccccaca

SEQ ID NO: 3932079 - RNA, 17 nt, Human adenovirus E
agcuccucccucagcaa

SEQ ID NO: 3932080 - RNA, 19 nt, Human adenovirus E
agcucugcaagcuccugca

SEQ ID NO: 3932081 - RNA, 17 nt, Human adenovirus E
agcugauggugcccaag

SEQ ID NO: 3932082 - RNA, 19 nt, Human adenovirus E
agcugcggcgcggccugga

SEQ ID NO: 3932083 - RNA, 16 nt, Human adenovirus E
agcuggaucaugauca

SEQ ID NO: 3932084 - RNA, 12 nt, Human adenovirus E
agcugucggccu

SEQ ID NO: 3932085 - RNA, 19 nt, Human adenovirus E
agcuugcccucggccucgg

SEQ ID NO: 3932086 - RNA, 19 nt, Human adenovirus E
aggaagacugggacagcac

SEQ ID NO: 3932087 - RNA, 21 nt, Human adenovirus E
aggaaucuucucuucucuuuu

SEQ ID NO: 3932088 - RNA, 12 nt, Human adenovirus E
aggacgagggca

SEQ ID NO: 3932089 - RNA, 17 nt, Human adenovirus E
aggagcuccuggagcga

SEQ ID NO: 3932090 - RNA, 14 nt, Human adenovirus E
aggagcugaugcau

SEQ ID NO: 3932091 - RNA, 15 nt, Human adenovirus E
aggaggcagaggagg

SEQ ID NO: 3932092 - RNA, 18 nt, Human adenovirus E
aggaggcagaggaggagg

SEQ ID NO: 3932093 - RNA, 24 nt, Human adenovirus E
aggaggcgcucuccccccagggau

SEQ ID NO: 3932094 - RNA, 16 nt, Human adenovirus E
aggagguggaagaagc

SEQ ID NO: 3932095 - RNA, 13 nt, Human adenovirus E
aggauuuggagga

SEQ ID NO: 3932096 - RNA, 15 nt, Human adenovirus E
aggcaccgcagcuug

SEQ ID NO: 3932097 - RNA, 17 nt, Human adenovirus E
aggcagcgaccgacgcc

SEQ ID NO: 3932098 - RNA, 13 nt, Human adenovirus E
aggccgugcagcg

SEQ ID NO: 3932099 - RNA, 14 nt, Human adenovirus E
aggccgugcagcgg

SEQ ID NO: 3932100 - RNA, 20 nt, Human adenovirus E
aggccguggcccagcgcgag

SEQ ID NO: 3932101 - RNA, 14 nt, Human adenovirus E
aggccugggcggcc

SEQ ID NO: 3932102 - RNA, 17 nt, Human adenovirus E
aggcgauggcggcggcg

SEQ ID NO: 3932103 - RNA, 18 nt, Human adenovirus E
aggcgcgcaggccggagc

SEQ ID NO: 3932104 - RNA, 22 nt, Human adenovirus E
aggcgcgcgcagucguggaugc

SEQ ID NO: 3932105 - RNA, 18 nt, Human adenovirus E
aggcgcucuccccccagg

SEQ ID NO: 3932106 - RNA, 17 nt, Human adenovirus E
aggcguccgcgccgcag

SEQ ID NO: 3932107 - RNA, 14 nt, Human adenovirus E
agggacucccucag

SEQ ID NO: 3932108 - RNA, 15 nt, Human adenovirus E
agggacucccucagc

SEQ ID NO: 3932109 - RNA, 14 nt, Human adenovirus E
agggacugaggggc

SEQ ID NO: 3932110 - RNA, 16 nt, Human adenovirus E
agggagagacagcugc

SEQ ID NO: 3932111 - RNA, 19 nt, Human adenovirus E
agggcgagaucgagggcga

SEQ ID NO: 3932112 - RNA, 16 nt, Human adenovirus E
agggcgaguaccugga

SEQ ID NO: 3932113 - RNA, 21 nt, Human adenovirus E
agggcgugcgcuccuggacgc

SEQ ID NO: 3932114 - RNA, 15 nt, Human adenovirus E
agggcguuggagagg

SEQ ID NO: 3932115 - RNA, 15 nt, Human adenovirus E
agggcuugcagaccg

SEQ ID NO: 3932116 - RNA, 14 nt, Human adenovirus E
aggggcggaacagc

SEQ ID NO: 3932117 - RNA, 16 nt, Human adenovirus E
aggggggcaaugugac

SEQ ID NO: 3932118 - RNA, 17 nt, Human adenovirus E
agggucucaaagcuccg

SEQ ID NO: 3932119 - RNA, 21 nt, Human adenovirus E
agguacacauacaaagccuca

SEQ ID NO: 3932120 - RNA, 16 nt, Human adenovirus E
aggugacccugggccu

SEQ ID NO: 3932121 - RNA, 18 nt, Human adenovirus E
aggugacccugggccuga

SEQ ID NO: 3932122 - RNA, 22 nt, Human adenovirus E
aggugccccucagcguggagga

SEQ ID NO: 3932123 - RNA, 18 nt, Human adenovirus E
aggugcggcccaucaagc

SEQ ID NO: 3932124 - RNA, 22 nt, Human adenovirus E
agguggaagaagcagccgccgc

SEQ ID NO: 3932125 - RNA, 21 nt, Human adenovirus E
agguggacccggacgugcagc

SEQ ID NO: 3932126 - RNA, 15 nt, Human adenovirus E
agguguagagggugc

SEQ ID NO: 3932127 - RNA, 20 nt, Human adenovirus E
agguuuaaaauuugaagaug

SEQ ID NO: 3932128 - RNA, 22 nt, Human adenovirus E
aguaauaacaccgguuggggcc

SEQ ID NO: 3932129 - RNA, 14 nt, Human adenovirus E
aguacaggagccau

SEQ ID NO: 3932130 - RNA, 20 nt, Human adenovirus E
aguacaguuagucucuccac

SEQ ID NO: 3932131 - RNA, 16 nt, Human adenovirus E
gaucccugagcuccuc

SEQ ID NO: 3932132 - RNA, 12 nt, Human adenovirus E
gauccgcaccgg

SEQ ID NO: 3932133 - RNA, 16 nt, Human adenovirus E
gaucuccuccucuuga

SEQ ID NO: 3932134 - RNA, 22 nt, Human adenovirus E
gaugaggugcaucuuggccugg

SEQ ID NO: 3932135 - RNA, 21 nt, Human adenovirus E
gaugauauucuggagcaggcg

SEQ ID NO: 3932136 - RNA, 11 nt, Human adenovirus E
gaugaugcuga

SEQ ID NO: 3932137 - RNA, 14 nt, Human adenovirus E
gaugcaccuguggg

SEQ ID NO: 3932138 - RNA, 17 nt, Human adenovirus E
gaugcagcccccgcugg

SEQ ID NO: 3932139 - RNA, 15 nt, Human adenovirus E
gaugccgggcaggag

SEQ ID NO: 3932140 - RNA, 13 nt, Human adenovirus E
gaugcgcgcggcc

SEQ ID NO: 3932141 - RNA, 22 nt, Human adenovirus E
gauggacuacuugcaucgggcg

SEQ ID NO: 3932142 - RNA, 12 nt, Human adenovirus E
gaugggacgaga

SEQ ID NO: 3932143 - RNA, 18 nt, Human adenovirus E
gauugaaaaccaucacag

SEQ ID NO: 3932144 - RNA, 15 nt, Human adenovirus E
gcaaacccgggagcu

SEQ ID NO: 3932145 - RNA, 21 nt, Human adenovirus E
gcaacauccccgcgcuccugg

SEQ ID NO: 3932146 - RNA, 13 nt, Human adenovirus E
gcaaccccacgcc

SEQ ID NO: 3932147 - RNA, 21 nt, Human adenovirus E
gcaacucguaccugggcuacc

SEQ ID NO: 3932148 - RNA, 15 nt, Human adenovirus E
gcaagagauggagga

SEQ ID NO: 3932149 - RNA, 16 nt, Human adenovirus E
gcaagagauggaggaa

SEQ ID NO: 3932150 - RNA, 20 nt, Human adenovirus E
gcaagccgcugacggcgcag

SEQ ID NO: 3932151 - RNA, 22 nt, Human adenovirus E
gcaagcggugcguuccagcaug

SEQ ID NO: 3932152 - RNA, 14 nt, Human adenovirus E
gcaagcuccugcag

SEQ ID NO: 3932153 - RNA, 23 nt, Human adenovirus E
gcaaggucgaggagaaccugcac

SEQ ID NO: 3932154 - RNA, 17 nt, Human adenovirus E
gcaagucuacuggucgc

SEQ ID NO: 3932155 - RNA, 17 nt, Human adenovirus E
gcaaucaggcagcaccg

SEQ ID NO: 3932156 - RNA, 16 nt, Human adenovirus E
gcaauugaccaugagu

SEQ ID NO: 3932157 - RNA, 18 nt, Human adenovirus E
gcacaaaauucucaggug

SEQ ID NO: 3932158 - RNA, 12 nt, Human adenovirus E
gcacacagcuca

SEQ ID NO: 3932159 - RNA, 15 nt, Human adenovirus E
gcacagcacaggcau

SEQ ID NO: 3932160 - RNA, 16 nt, Human adenovirus E
gcaccaacgugcagac

SEQ ID NO: 3932161 - RNA, 19 nt, Human adenovirus E
gcaccauggaggugcagac

SEQ ID NO: 3932162 - RNA, 18 nt, Human adenovirus E
gcacccgccccccucgca

SEQ ID NO: 3932163 - RNA, 22 nt, Human adenovirus E
gcacccggcgucgugcacgcag

SEQ ID NO: 3932164 - RNA, 19 nt, Human adenovirus E
gcacccgugcagccacagc

SEQ ID NO: 3932165 - RNA, 13 nt, Human adenovirus E
gcacccucagggc

SEQ ID NO: 3932166 - RNA, 17 nt, Human adenovirus E
gcaccgccccgcccgcc

SEQ ID NO: 3932167 - RNA, 20 nt, Human adenovirus E
gcaccgcucccuggccugca

SEQ ID NO: 3932168 - RNA, 21 nt, Human adenovirus E
gcaccgggugauccuccacca

SEQ ID NO: 3932169 - RNA, 13 nt, Human adenovirus E
gcacgacaggcag

SEQ ID NO: 3932170 - RNA, 15 nt, Human adenovirus E
gcacgaggaggagcu

SEQ ID NO: 3932171 - RNA, 23 nt, Human adenovirus E
gcacggauaccaucuccgcuccg

SEQ ID NO: 3932172 - RNA, 14 nt, Human adenovirus E
gcacggccagcgcg

SEQ ID NO: 3932173 - RNA, 18 nt, Human adenovirus E
gcacgggacgcagggcca

SEQ ID NO: 3932174 - RNA, 14 nt, Human adenovirus E
gcacuaccucuuca

SEQ ID NO: 3932175 - RNA, 18 nt, Human adenovirus E
gcacuccauauaccaaug

SEQ ID NO: 3932176 - RNA, 18 nt, Human adenovirus E
gcacucccgcaucugcac

SEQ ID NO: 3932177 - RNA, 19 nt, Human adenovirus E
gcacucucaacuccucggg

SEQ ID NO: 3932178 - RNA, 18 nt, Human adenovirus E
gcagaaggggggcagggg

SEQ ID NO: 3932179 - RNA, 18 nt, Human adenovirus E
gcagacaacgcaccgacc

SEQ ID NO: 3932180 - RNA, 14 nt, Human adenovirus E
gcagaccaaccugg

SEQ ID NO: 3932181 - RNA, 21 nt, Human adenovirus E
gcagaccgugaaccugagcca

SEQ ID NO: 3932182 - RNA, 14 nt, Human adenovirus E
gcagagaaugagca

SEQ ID NO: 3932183 - RNA, 21 nt, Human adenovirus E
gcagaggaggaggagauggag

SEQ ID NO: 3932184 - RNA, 20 nt, Human adenovirus E
gcagcaaaguuagccuugca

SEQ ID NO: 3932185 - RNA, 13 nt, Human adenovirus E
gcagcagcacaca

SEQ ID NO: 3932186 - RNA, 16 nt, Human adenovirus E
gcagcaggugcugccg

SEQ ID NO: 3932187 - RNA, 18 nt, Human adenovirus E
gcagcagguggacugagg

SEQ ID NO: 3932188 - RNA, 24 nt, Human adenovirus E
gcagcaguauccggggaguccagc

SEQ ID NO: 3932189 - RNA, 18 nt, Human adenovirus E
gcagcagugucuggagga

SEQ ID NO: 3932190 - RNA, 17 nt, Human adenovirus E
gcagccccaggccaacc

SEQ ID NO: 3932191 - RNA, 16 nt, Human adenovirus E
gcagccccgcucgggu

SEQ ID NO: 3932192 - RNA, 17 nt, Human adenovirus E
gcagccguagcuaccgc

SEQ ID NO: 3932193 - RNA, 15 nt, Human adenovirus E
gcagcgaagagaccc

SEQ ID NO: 3932194 - RNA, 17 nt, Human adenovirus E
gcagcgggcccugaccg

SEQ ID NO: 3932195 - RNA, 17 nt, Human adenovirus E
gcagcguguuggacuug

SEQ ID NO: 3932196 - RNA, 19 nt, Human adenovirus E
gcccaggacuacuccaccc

SEQ ID NO: 3932197 - RNA, 22 nt, Human adenovirus E
gcccaggccgaaguccagcuga

SEQ ID NO: 3932198 - RNA, 21 nt, Human adenovirus E
gcccagucggcgagauggggg

SEQ ID NO: 3932199 - RNA, 21 nt, Human adenovirus E
gcccaucauguacgccagcaa

SEQ ID NO: 3932200 - RNA, 20 nt, Human adenovirus E
gcccauggaaacgcagaccg

SEQ ID NO: 3932201 - RNA, 21 nt, Human adenovirus E
gccccaguacgcgcucagcac

SEQ ID NO: 3932202 - RNA, 21 nt, Human adenovirus E
  misc_feature (8)..(8): n is a, c, g or u
gccccaunuagcagucccacu

SEQ ID NO: 3932203 - RNA, 13 nt, Human adenovirus E
gcccccgccccag

SEQ ID NO: 3932204 - RNA, 19 nt, Human adenovirus E
gccccgcccgccaugcagc

SEQ ID NO: 3932205 - RNA, 21 nt, Human adenovirus E
gccccgccgcccagccccgcc

SEQ ID NO: 3932206 - RNA, 19 nt, Human adenovirus E
gccccguccucuucccacu

SEQ ID NO: 3932207 - RNA, 22 nt, Human adenovirus E
gccccgucguuuccaagacccc

SEQ ID NO: 3932208 - RNA, 20 nt, Human adenovirus E
gccccuacgucuacaaggcc

SEQ ID NO: 3932209 - RNA, 19 nt, Human adenovirus E
gccccucagcguggaggag

SEQ ID NO: 3932210 - RNA, 14 nt, Human adenovirus E
gccccucguccauc

SEQ ID NO: 3932211 - RNA, 15 nt, Human adenovirus E
gccccuuguggaaga

SEQ ID NO: 3932212 - RNA, 14 nt, Human adenovirus E
gcccgaggaagcaa

SEQ ID NO: 3932213 - RNA, 15 nt, Human adenovirus E
gcccgaggacuacca

SEQ ID NO: 3932214 - RNA, 16 nt, Human adenovirus E
gcccgaggcccuggcc

SEQ ID NO: 3932215 - RNA, 16 nt, Human adenovirus E
gcccgccaccugcucc

SEQ ID NO: 3932216 - RNA, 23 nt, Human adenovirus E
gcccgcggagcacgaggaggagc

SEQ ID NO: 3932217 - RNA, 14 nt, Human adenovirus E
gcccggcaggccac

SEQ ID NO: 3932218 - RNA, 17 nt, Human adenovirus E
gcccggcaggccaccau

SEQ ID NO: 3932219 - RNA, 20 nt, Human adenovirus E
gcccggcgagcgcuccggca

SEQ ID NO: 3932220 - RNA, 13 nt, Human adenovirus E
gcccggcgcgacu

SEQ ID NO: 3932221 - RNA, 18 nt, Human adenovirus E
gcccgugcugcucgagcg

SEQ ID NO: 3932222 - RNA, 13 nt, Human adenovirus E
gcccguggaggau

SEQ ID NO: 3932223 - RNA, 19 nt, Human adenovirus E
gcccuagccgccuccaccc

SEQ ID NO: 3932224 - RNA, 15 nt, Human adenovirus E
gcccugggccaggac

SEQ ID NO: 3932225 - RNA, 17 nt, Human adenovirus E
gcccuugcgcgagcaga

SEQ ID NO: 3932226 - RNA, 22 nt, Human adenovirus E
gccgaaaaagaaaaacagccau

SEQ ID NO: 3932227 - RNA, 18 nt, Human adenovirus E
gccgagcugucggccugc

SEQ ID NO: 3932228 - RNA, 13 nt, Human adenovirus E
gccgaggcucucu

SEQ ID NO: 3932229 - RNA, 22 nt, Human adenovirus E
gccgaucccugcuugcauuuca

SEQ ID NO: 3932230 - RNA, 20 nt, Human adenovirus E
gccgccagaccgucguccuc

SEQ ID NO: 3932231 - RNA, 17 nt, Human adenovirus E
gccgccagcuccuccuc

SEQ ID NO: 3932232 - RNA, 17 nt, Human adenovirus E
gccgcccagccccgcca

SEQ ID NO: 3932233 - RNA, 15 nt, Human adenovirus E
gccgccgccagaccg

SEQ ID NO: 3932234 - RNA, 17 nt, Human adenovirus E
gccgccgggccuuggag

SEQ ID NO: 3932235 - RNA, 14 nt, Human adenovirus E
gccgcgcccugggc

SEQ ID NO: 3932236 - RNA, 18 nt, Human adenovirus E
gccgcgcgcgcgcuacca

SEQ ID NO: 3932237 - RNA, 13 nt, Human adenovirus E
gccgcgcgcgggu

SEQ ID NO: 3932238 - RNA, 18 nt, Human adenovirus E
gccgcggcggugcccgag

SEQ ID NO: 3932239 - RNA, 15 nt, Human adenovirus E
gccgcgguccuccuc

SEQ ID NO: 3932240 - RNA, 18 nt, Human adenovirus E
gccgcugacggcgcagcu

SEQ ID NO: 3932241 - RNA, 18 nt, Human adenovirus E
gccgggcggcaggggcgg

SEQ ID NO: 3932242 - RNA, 16 nt, Human adenovirus E
gccggggcagcgccgc

SEQ ID NO: 3932243 - RNA, 17 nt, Human adenovirus E
gccggggcagcgccgcc

SEQ ID NO: 3932244 - RNA, 22 nt, Human adenovirus E
gccgggguucuacacgggcgag

SEQ ID NO: 3932245 - RNA, 18 nt, Human adenovirus E
gccgguauacaagcccau

SEQ ID NO: 3932246 - RNA, 21 nt, Human adenovirus E
gccgucaucgacagcguggug

SEQ ID NO: 3932247 - RNA, 14 nt, Human adenovirus E
gccgugagcggggc

SEQ ID NO: 3932248 - RNA, 22 nt, Human adenovirus E
gccgugagcggggcuggacaga

SEQ ID NO: 3932249 - RNA, 20 nt, Human adenovirus E
gccuccaaacguuccauggc

SEQ ID NO: 3932250 - RNA, 13 nt, Human adenovirus E
gccuccacccauc

SEQ ID NO: 3932251 - RNA, 22 nt, Human adenovirus E
gccucgacucccaccugcuucg

SEQ ID NO: 3932252 - RNA, 17 nt, Human adenovirus E
gccucgcugaacuacca

SEQ ID NO: 3932253 - RNA, 14 nt, Human adenovirus E
gccucggaccuggc

SEQ ID NO: 3932254 - RNA, 16 nt, Human adenovirus E
gccugcgucaucaccc

SEQ ID NO: 3932255 - RNA, 16 nt, Human adenovirus E
ggacgcucgcgaggca

SEQ ID NO: 3932256 - RNA, 23 nt, Human adenovirus E
ggacggcccuugacguggggcag

SEQ ID NO: 3932257 - RNA, 16 nt, Human adenovirus E
ggacucgggggcguag

SEQ ID NO: 3932258 - RNA, 22 nt, Human adenovirus E
ggacugggggacaaagguaccc

SEQ ID NO: 3932259 - RNA, 13 nt, Human adenovirus E
ggagaaccugcac

SEQ ID NO: 3932260 - RNA, 19 nt, Human adenovirus E
ggagaaccugcacuaccuc

SEQ ID NO: 3932261 - RNA, 17 nt, Human adenovirus E
ggagacgcgcggccacg

SEQ ID NO: 3932262 - RNA, 16 nt, Human adenovirus E
ggagagacagcugccg

SEQ ID NO: 3932263 - RNA, 18 nt, Human adenovirus E
ggagaugacugacccacu

SEQ ID NO: 3932264 - RNA, 23 nt, Human adenovirus E
ggagcacgaggaggagcuggcag

SEQ ID NO: 3932265 - RNA, 12 nt, Human adenovirus E
ggagcagcuggg

SEQ ID NO: 3932266 - RNA, 20 nt, Human adenovirus E
ggagccccgggcccagguug

SEQ ID NO: 3932267 - RNA, 22 nt, Human adenovirus E
ggagccuuguugcgcagggcca

SEQ ID NO: 3932268 - RNA, 16 nt, Human adenovirus E
ggagcuaccagcccca

SEQ ID NO: 3932269 - RNA, 14 nt, Human adenovirus E
ggagcugaggaacc

SEQ ID NO: 3932270 - RNA, 14 nt, Human adenovirus E
ggagcuggcagugc

SEQ ID NO: 3932271 - RNA, 13 nt, Human adenovirus E
ggaggaagacugg

SEQ ID NO: 3932272 - RNA, 14 nt, Human adenovirus E
ggaggagcagaacc

SEQ ID NO: 3932273 - RNA, 14 nt, Human adenovirus E
ggaggagcucagcc

SEQ ID NO: 3932274 - RNA, 14 nt, Human adenovirus E
ggaggaggcagagg

SEQ ID NO: 3932275 - RNA, 21 nt, Human adenovirus E
ggaggccagcacccagaccau

SEQ ID NO: 3932276 - RNA, 17 nt, Human adenovirus E
ggaggccaucgugcaga

SEQ ID NO: 3932277 - RNA, 14 nt, Human adenovirus E
ggaggcgcucgcca

SEQ ID NO: 3932278 - RNA, 13 nt, Human adenovirus E
ggagggaagaaca

SEQ ID NO: 3932279 - RNA, 13 nt, Human adenovirus E
ggagggugccgga

SEQ ID NO: 3932280 - RNA, 15 nt, Human adenovirus E
ggauaggagcuccug

SEQ ID NO: 3932281 - RNA, 22 nt, Human adenovirus E
ggauccaugguggcgcugaacg

SEQ ID NO: 3932282 - RNA, 18 nt, Human adenovirus E
ggaucgcuguccacgagc

SEQ ID NO: 3932283 - RNA, 11 nt, Human adenovirus E
ggaucuucagc

SEQ ID NO: 3932284 - RNA, 18 nt, Human adenovirus E
ggaucuucagccagcguc

SEQ ID NO: 3932285 - RNA, 20 nt, Human adenovirus E
ggaugauccugcggaaccac

SEQ ID NO: 3932286 - RNA, 19 nt, Human adenovirus E
ggaugcaggggcggcaggg

SEQ ID NO: 3932287 - RNA, 15 nt, Human adenovirus E
ggaugcaugcggggg

SEQ ID NO: 3932288 - RNA, 19 nt, Human adenovirus E
ggaugcgucgccaccacca

SEQ ID NO: 3932289 - RNA, 16 nt, Human adenovirus E
ggcaacauccccgcgc

SEQ ID NO: 3932290 - RNA, 23 nt, Human adenovirus E
ggcaacauccccgcgcuccugga

SEQ ID NO: 3932291 - RNA, 13 nt, Human adenovirus E
ggcacagcacagg

SEQ ID NO: 3932292 - RNA, 14 nt, Human adenovirus E
ggcacagcacaggc

SEQ ID NO: 3932293 - RNA, 14 nt, Human adenovirus E
ggcagaggaggaca

SEQ ID NO: 3932294 - RNA, 16 nt, Human adenovirus E
ggcagaugcgccccca

SEQ ID NO: 3932295 - RNA, 16 nt, Human adenovirus E
ggcagcaccgggugau

SEQ ID NO: 3932296 - RNA, 23 nt, Human adenovirus E
ggcagcaccgggugauccuccac

SEQ ID NO: 3932297 - RNA, 20 nt, Human adenovirus E
ggcagcagguggacugagga

SEQ ID NO: 3932298 - RNA, 22 nt, Human adenovirus E
ggcaggacccggagacgcgcgg

SEQ ID NO: 3932299 - RNA, 14 nt, Human adenovirus E
ggcaugaccucggc

SEQ ID NO: 3932300 - RNA, 23 nt, Human adenovirus E
ggcauuaccccuacacaugauca

SEQ ID NO: 3932301 - RNA, 16 nt, Human adenovirus E
ggccaacuaccuggcc

SEQ ID NO: 3932302 - RNA, 17 nt, Human adenovirus E
ggccaccuaccacaucu

SEQ ID NO: 3932303 - RNA, 14 nt, Human adenovirus E
ggccacgagccggg

SEQ ID NO: 3932304 - RNA, 23 nt, Human adenovirus E
ggccagacccagccagaugaugc

SEQ ID NO: 3932305 - RNA, 18 nt, Human adenovirus E
ggccagaucguccagggc

SEQ ID NO: 3932306 - RNA, 13 nt, Human adenovirus E
ggccaggcgcacg

SEQ ID NO: 3932307 - RNA, 15 nt, Human adenovirus E
ggccauccuggaggc

SEQ ID NO: 3932308 - RNA, 16 nt, Human adenovirus E
ggccaucgccagcaug

SEQ ID NO: 3932309 - RNA, 16 nt, Human adenovirus E
ggccaucgugcagaac

SEQ ID NO: 3932310 - RNA, 16 nt, Human adenovirus E
ggccauggcgaccagc

SEQ ID NO: 3932311 - RNA, 13 nt, Human adenovirus E
ggcccuggccacc

SEQ ID NO: 3932312 - RNA, 19 nt, Human adenovirus E
ggcccuugacguggggcag

SEQ ID NO: 3932313 - RNA, 21 nt, Human adenovirus E
ggccgccgugagcggggcugg

SEQ ID NO: 3932314 - RNA, 22 nt, Human adenovirus E
ggccgcgcaccucugacccugc

SEQ ID NO: 3932315 - RNA, 23 nt, Human adenovirus E
ggccgucccagacaugcaagaga

SEQ ID NO: 3932316 - RNA, 17 nt, Human adenovirus E
gcaccucugacccugcc

SEQ ID NO: 3932317 - RNA, 16 nt, Human adenovirus E
gcaccugugggaccug

SEQ ID NO: 3932318 - RNA, 19 nt, Human adenovirus E
gcaccuucgaguugcaagg

SEQ ID NO: 3932319 - RNA, 17 nt, Human adenovirus E
  misc_feature (8)..(8): n is a, c, g or u
gcacgaangaggccacg

SEQ ID NO: 3932320 - RNA, 16 nt, Human adenovirus E
gcacgaggaggagcug

SEQ ID NO: 3932321 - RNA, 20 nt, Human adenovirus E
gcacgaggaggagcuggcag

SEQ ID NO: 3932322 - RNA, 12 nt, Human adenovirus E
gcacggauacca

SEQ ID NO: 3932323 - RNA, 24 nt, Human adenovirus E
gcacguacucgcgcgccacgcacu

SEQ ID NO: 3932324 - RNA, 21 nt, Human adenovirus E
gcacgugcauguucucgcgca

SEQ ID NO: 3932325 - RNA, 19 nt, Human adenovirus E
gcacucaacccaccccacc

SEQ ID NO: 3932326 - RNA, 15 nt, Human adenovirus E
gcacucaggcagagg

SEQ ID NO: 3932327 - RNA, 13 nt, Human adenovirus E
gcacucccaguuc

SEQ ID NO: 3932328 - RNA, 21 nt, Human adenovirus E
gcacucccgcaucugcaccuc

SEQ ID NO: 3932329 - RNA, 16 nt, Human adenovirus E
gcacuggcagcccagc

SEQ ID NO: 3932330 - RNA, 17 nt, Human adenovirus E
gcagaaaaccagcagcu

SEQ ID NO: 3932331 - RNA, 14 nt, Human adenovirus E
gcagaaccuggucc

SEQ ID NO: 3932332 - RNA, 16 nt, Human adenovirus E
gcagaccgagcccaug

SEQ ID NO: 3932333 - RNA, 17 nt, Human adenovirus E
gcagaccuaccaggaga

SEQ ID NO: 3932334 - RNA, 18 nt, Human adenovirus E
gcagagcgcccuccaccg

SEQ ID NO: 3932335 - RNA, 13 nt, Human adenovirus E
gcagaggaggagg

SEQ ID NO: 3932336 - RNA, 23 nt, Human adenovirus E
gcagaggaggaggagauggagga

SEQ ID NO: 3932337 - RNA, 20 nt, Human adenovirus E
gcagagucgggggcaggagc

SEQ ID NO: 3932338 - RNA, 21 nt, Human adenovirus E
gcagagucgggggcaggagca

SEQ ID NO: 3932339 - RNA, 20 nt, Human adenovirus E
gcagaucaauggcccucaca

SEQ ID NO: 3932340 - RNA, 23 nt, Human adenovirus E
gcagcaaagcccccgaucccucc

SEQ ID NO: 3932341 - RNA, 12 nt, Human adenovirus E
gcagcaacuucc

SEQ ID NO: 3932342 - RNA, 19 nt, Human adenovirus E
gcagcagaaaaagaccagc

SEQ ID NO: 3932343 - RNA, 19 nt, Human adenovirus E
  misc_feature (10)..(10): n is a, c, g or u
gcagcagccnuucuccacg

SEQ ID NO: 3932344 - RNA, 14 nt, Human adenovirus E
gcagcagugucugg

SEQ ID NO: 3932345 - RNA, 19 nt, Human adenovirus E
gcagcagugucuggaggag

SEQ ID NO: 3932346 - RNA, 19 nt, Human adenovirus E
gcagccacagcgcgcaccc

SEQ ID NO: 3932347 - RNA, 24 nt, Human adenovirus E
gcagccaggguccgguccuuccag

SEQ ID NO: 3932348 - RNA, 15 nt, Human adenovirus E
gcagccccaggccaa

SEQ ID NO: 3932349 - RNA, 20 nt, Human adenovirus E
gcagccccccugcucccaga

SEQ ID NO: 3932350 - RNA, 17 nt, Human adenovirus E
  misc_feature (7)..(7): n is a, c, g or u
gcagccnuucuccacgg

SEQ ID NO: 3932351 - RNA, 20 nt, Human adenovirus E
gcagcgacgagacucgggcc

SEQ ID NO: 3932352 - RNA, 13 nt, Human adenovirus E
gcagcgagcuggg

SEQ ID NO: 3932353 - RNA, 19 nt, Human adenovirus E
gcagcggccaucgccagca

SEQ ID NO: 3932354 - RNA, 20 nt, Human adenovirus E
gcagcggccaucgccagcau

SEQ ID NO: 3932355 - RNA, 19 nt, Human adenovirus E
gcagcggccgaggcggcug

SEQ ID NO: 3932356 - RNA, 17 nt, Human adenovirus E
gcagcguccgcgucagg

SEQ ID NO: 3932357 - RNA, 18 nt, Human adenovirus E
gcagcguccgcgucaggg

SEQ ID NO: 3932358 - RNA, 23 nt, Human adenovirus E
gcagcguguucuccccccgaccg

SEQ ID NO: 3932359 - RNA, 16 nt, Human adenovirus E
gcaggccccggcgggc

SEQ ID NO: 3932360 - RNA, 13 nt, Human adenovirus E
gcaggccggagcu

SEQ ID NO: 3932361 - RNA, 21 nt, Human adenovirus E
gcaggccggagcuguccaggg

SEQ ID NO: 3932362 - RNA, 19 nt, Human adenovirus E
gcaggcggcgcgagcugag

SEQ ID NO: 3932363 - RNA, 17 nt, Human adenovirus E
gcagggccaggcgcacg

SEQ ID NO: 3932364 - RNA, 19 nt, Human adenovirus E
gcagggccuguggggcgug

SEQ ID NO: 3932365 - RNA, 16 nt, Human adenovirus E
gcagggcgcccagcag

SEQ ID NO: 3932366 - RNA, 13 nt, Human adenovirus E
gcaggggcggcuc

SEQ ID NO: 3932367 - RNA, 19 nt, Human adenovirus E
gcagggugaugagguccac

SEQ ID NO: 3932368 - RNA, 22 nt, Human adenovirus E
gcagguccagaccucggcgcga

SEQ ID NO: 3932369 - RNA, 15 nt, Human adenovirus E
gcagguggacugagg

SEQ ID NO: 3932370 - RNA, 19 nt, Human adenovirus E
gcagucauaaucaucugca

SEQ ID NO: 3932371 - RNA, 16 nt, Human adenovirus E
gcagugucuggaggag

SEQ ID NO: 3932372 - RNA, 18 nt, Human adenovirus E
gcagugucuggaggagca

SEQ ID NO: 3932373 - RNA, 18 nt, Human adenovirus E
gcaguuagcgcucuaguu

SEQ ID NO: 3932374 - RNA, 19 nt, Human adenovirus E
gcaucaggccccgcagcag

SEQ ID NO: 3932375 - RNA, 15 nt, Human adenovirus E
gcaucaucugggccu

SEQ ID NO: 3932376 - RNA, 14 nt, Human adenovirus E
gcaucugcaccuca

SEQ ID NO: 3932377 - RNA, 16 nt, Human adenovirus E
gcaugaccucggcacu

SEQ ID NO: 3932378 - RNA, 19 nt, Human adenovirus E
gcaugagcaccacagcgcc

SEQ ID NO: 3932379 - RNA, 13 nt, Human adenovirus E
gcaugcaauggca

SEQ ID NO: 3932380 - RNA, 15 nt, Human adenovirus E
gcauggucucgguga

SEQ ID NO: 3932381 - RNA, 21 nt, Human adenovirus E
gggagggggccugcgucgccg

SEQ ID NO: 3932382 - RNA, 18 nt, Human adenovirus E
gggauaggagcuccugga

SEQ ID NO: 3932383 - RNA, 22 nt, Human adenovirus E
gggaucagcaguuugggcagcg

SEQ ID NO: 3932384 - RNA, 23 nt, Human adenovirus E
gggaucagcaguuugggcagcgg

SEQ ID NO: 3932385 - RNA, 13 nt, Human adenovirus E
gggcaccuggagc

SEQ ID NO: 3932386 - RNA, 18 nt, Human adenovirus E
gggcacgcacccgggcuu

SEQ ID NO: 3932387 - RNA, 19 nt, Human adenovirus E
gggcagaacgugcugcaca

SEQ ID NO: 3932388 - RNA, 21 nt, Human adenovirus E
gggcaucaacgggguggugga

SEQ ID NO: 3932389 - RNA, 20 nt, Human adenovirus E
gggcauucgcaagaggcagc

SEQ ID NO: 3932390 - RNA, 21 nt, Human adenovirus E
gggccacgagccggggcagcg

SEQ ID NO: 3932391 - RNA, 23 nt, Human adenovirus E
gggcccggaugcaggggcggcag

SEQ ID NO: 3932392 - RNA, 13 nt, Human adenovirus E
gggccgggaccga

SEQ ID NO: 3932393 - RNA, 15 nt, Human adenovirus E
gggccgguccucgag

SEQ ID NO: 3932394 - RNA, 20 nt, Human adenovirus E
gggccuguggggcgugcagg

SEQ ID NO: 3932395 - RNA, 17 nt, Human adenovirus E
gggcgagguugagcucc

SEQ ID NO: 3932396 - RNA, 20 nt, Human adenovirus E
gggcggccuugcgcagggag

SEQ ID NO: 3932397 - RNA, 15 nt, Human adenovirus E
gggcggcggccuggg

SEQ ID NO: 3932398 - RNA, 22 nt, Human adenovirus E
gggcgucgcagggggccacgag

SEQ ID NO: 3932399 - RNA, 18 nt, Human adenovirus E
gggcgucgucgccggagc

SEQ ID NO: 3932400 - RNA, 13 nt, Human adenovirus E
gggcguggggcag

SEQ ID NO: 3932401 - RNA, 21 nt, Human adenovirus E
gggcguuggagaggagcuugg

SEQ ID NO: 3932402 - RNA, 22 nt, Human adenovirus E
gggcugccgcuguccgagaagc

SEQ ID NO: 3932403 - RNA, 18 nt, Human adenovirus E
ggggaacccguccugauc

SEQ ID NO: 3932404 - RNA, 16 nt, Human adenovirus E
ggggaagacgugguca

SEQ ID NO: 3932405 - RNA, 22 nt, Human adenovirus E
ggggaucagcaguuugggcagc

SEQ ID NO: 3932406 - RNA, 17 nt, Human adenovirus E
ggggcaccucggcccgg

SEQ ID NO: 3932407 - RNA, 16 nt, Human adenovirus E
ggggcagaggcggagg

SEQ ID NO: 3932408 - RNA, 23 nt, Human adenovirus E
ggggcccggaugcaggggcggca

SEQ ID NO: 3932409 - RNA, 22 nt, Human adenovirus E
ggggccgggaccgagggggaga

SEQ ID NO: 3932410 - RNA, 16 nt, Human adenovirus E
ggggcgauccuggccc

SEQ ID NO: 3932411 - RNA, 18 nt, Human adenovirus E
ggggcgauccuggcccaa

SEQ ID NO: 3932412 - RNA, 14 nt, Human adenovirus E
ggggcgcagggcau

SEQ ID NO: 3932413 - RNA, 14 nt, Human adenovirus E
ggggcggcagaacg

SEQ ID NO: 3932414 - RNA, 16 nt, Human adenovirus E
gggggcagggggucca

SEQ ID NO: 3932415 - RNA, 16 nt, Human adenovirus E
gggucccgcucgacca

SEQ ID NO: 3932416 - RNA, 14 nt, Human adenovirus E
gggucggagagcga

SEQ ID NO: 3932417 - RNA, 19 nt, Human adenovirus E
gggucuaccucgaccccca

SEQ ID NO: 3932418 - RNA, 18 nt, Human adenovirus E
ggguuggcgcggaggaag

SEQ ID NO: 3932419 - RNA, 13 nt, Human adenovirus E
gguacaugggcau

SEQ ID NO: 3932420 - RNA, 13 nt, Human adenovirus E
gguacuuggccag

SEQ ID NO: 3932421 - RNA, 20 nt, Human adenovirus E
gguagcuccauugcagggcc

SEQ ID NO: 3932422 - RNA, 20 nt, Human adenovirus E
gguaucgcaaucaggcagca

SEQ ID NO: 3932423 - RNA, 14 nt, Human adenovirus E
gguauugcuauuuu

SEQ ID NO: 3932424 - RNA, 20 nt, Human adenovirus E
ggucacggcguacgagcaga

SEQ ID NO: 3932425 - RNA, 15 nt, Human adenovirus E
ggucccggccggggg

SEQ ID NO: 3932426 - RNA, 19 nt, Human adenovirus E
gguccucggcguuggccau

SEQ ID NO: 3932427 - RNA, 14 nt, Human adenovirus E
gguccugggugagg

SEQ ID NO: 3932428 - RNA, 15 nt, Human adenovirus E
ggucgagcugaccca

SEQ ID NO: 3932429 - RNA, 22 nt, Human adenovirus E
ggucgcagaagaucccgcccca

SEQ ID NO: 3932430 - RNA, 14 nt, Human adenovirus E
ggucucgccgcgcc

SEQ ID NO: 3932431 - RNA, 15 nt, Human adenovirus E
ggucugcgaccugac

SEQ ID NO: 3932432 - RNA, 15 nt, Human adenovirus E
ggucuucgcggugcc

SEQ ID NO: 3932433 - RNA, 19 nt, Human adenovirus E
ggucuucgcggugcccgag

SEQ ID NO: 3932434 - RNA, 20 nt, Human adenovirus E
ggugaacauucugcagagca

SEQ ID NO: 3932435 - RNA, 20 nt, Human adenovirus E
ggugauaucuuccagauaac

SEQ ID NO: 3932436 - RNA, 13 nt, Human adenovirus E
ggugaugaggucc

SEQ ID NO: 3932437 - RNA, 14 nt, Human adenovirus E
ggugcccaagcgcc

SEQ ID NO: 3932438 - RNA, 20 nt, Human adenovirus E
ggugcccgaggcccuggcca

SEQ ID NO: 3932439 - RNA, 16 nt, Human adenovirus E
ggugccggcggagaug

SEQ ID NO: 3932440 - RNA, 16 nt, Human adenovirus E
ggugggcgccgagcuc

SEQ ID NO: 3932441 - RNA, 22 nt, Human adenovirus E
ggugggcuuggauguugaggua

SEQ ID NO: 3932442 - RNA, 15 nt, Human adenovirus E
gguguccagcuggcg

SEQ ID NO: 3932443 - RNA, 12 nt, Human adenovirus E
ggugugcuuucg

SEQ ID NO: 3932444 - RNA, 16 nt, Human adenovirus E
gguucaccugcagcag

SEQ ID NO: 3932445 - RNA, 15 nt, Human adenovirus E
gguuccaccgcgagu

SEQ ID NO: 3932446 - RNA, 13 nt, Human adenovirus E
gguuccuguggga

SEQ ID NO: 3932447 - RNA, 13 nt, Human adenovirus E
augguggcgcagc

SEQ ID NO: 3932448 - RNA, 23 nt, Human adenovirus E
augugaauguuacugaggggggc

SEQ ID NO: 3932449 - RNA, 15 nt, Human adenovirus E
augugauggaaguag

SEQ ID NO: 3932450 - RNA, 20 nt, Human adenovirus E
augugcuccuucuggaucau

SEQ ID NO: 3932451 - RNA, 12 nt, Human adenovirus E
auuacacagaca

SEQ ID NO: 3932452 - RNA, 15 nt, Human adenovirus E
auuaccacacagaca

SEQ ID NO: 3932453 - RNA, 21 nt, Human adenovirus E
auuagcagucauaaucaucug

SEQ ID NO: 3932454 - RNA, 16 nt, Human adenovirus E
auuauggaacuacagc

SEQ ID NO: 3932455 - RNA, 22 nt, Human adenovirus E
auucaaacaccucauuugcaua

SEQ ID NO: 3932456 - RNA, 16 nt, Human adenovirus E
auucgcaagaggcagc

SEQ ID NO: 3932457 - RNA, 12 nt, Human adenovirus E
auucucaggugc

SEQ ID NO: 3932458 - RNA, 17 nt, Human adenovirus E
auucuggagcaggcggc

SEQ ID NO: 3932459 - RNA, 13 nt, Human adenovirus E
auucuggccugca

SEQ ID NO: 3932460 - RNA, 12 nt, Human adenovirus E
auugacaagcgg

SEQ ID NO: 3932461 - RNA, 16 nt, Human adenovirus E
auuguuuuuugcaauc

SEQ ID NO: 3932462 - RNA, 13 nt, Human adenovirus E
auuuacacuggca

SEQ ID NO: 3932463 - RNA, 14 nt, Human adenovirus E
auuuggaggaagac

SEQ ID NO: 3932464 - RNA, 15 nt, Human adenovirus E
auuuggaggaagacu

SEQ ID NO: 3932465 - RNA, 19 nt, Human adenovirus E
auuuggaggaagacuggga

SEQ ID NO: 3932466 - RNA, 18 nt, Human adenovirus E
auuuuccccgagcgccuc

SEQ ID NO: 3932467 - RNA, 21 nt, Human adenovirus E
auuuuugccaugcgucaaaug

SEQ ID NO: 3932468 - RNA, 15 nt, Human adenovirus E
caaaauucucaggug

SEQ ID NO: 3932469 - RNA, 22 nt, Human adenovirus E
caaagucuaaaaauacccgcca

SEQ ID NO: 3932470 - RNA, 16 nt, Human adenovirus E
caacaaaugccagcug

SEQ ID NO: 3932471 - RNA, 15 nt, Human adenovirus E
caacaacagccaccu

SEQ ID NO: 3932472 - RNA, 16 nt, Human adenovirus E
caacagcaccaacgug

SEQ ID NO: 3932473 - RNA, 12 nt, Human adenovirus E
caacagccgccu

SEQ ID NO: 3932474 - RNA, 13 nt, Human adenovirus E
caacaggagaugc

SEQ ID NO: 3932475 - RNA, 20 nt, Human adenovirus E
caacauccccgcgcuccugg

SEQ ID NO: 3932476 - RNA, 14 nt, Human adenovirus E
caaccaaacuaacc

SEQ ID NO: 3932477 - RNA, 13 nt, Human adenovirus E
caaccacaaaaac

SEQ ID NO: 3932478 - RNA, 21 nt, Human adenovirus E
caaccaccccugccgcccugg

SEQ ID NO: 3932479 - RNA, 16 nt, Human adenovirus E
caaccaggccgugcag

SEQ ID NO: 3932480 - RNA, 17 nt, Human adenovirus E
caaccaggccgugcagc

SEQ ID NO: 3932481 - RNA, 17 nt, Human adenovirus E
caacccacauuacacag

SEQ ID NO: 3932482 - RNA, 17 nt, Human adenovirus E
caaccgcacccgcgccg

SEQ ID NO: 3932483 - RNA, 22 nt, Human adenovirus E
caaccuggaagccacccugaac

SEQ ID NO: 3932484 - RNA, 17 nt, Human adenovirus E
caacucguaccugggcu

SEQ ID NO: 3932485 - RNA, 13 nt, Human adenovirus E
caacuuccugacc

SEQ ID NO: 3932486 - RNA, 14 nt, Human adenovirus E
caacuuggaaggga

SEQ ID NO: 3932487 - RNA, 20 nt, Human adenovirus E
caagaacagccagagcagga

SEQ ID NO: 3932488 - RNA, 18 nt, Human adenovirus E
caagaagaggcagcagca

SEQ ID NO: 3932489 - RNA, 13 nt, Human adenovirus E
caagcagcacgga

SEQ ID NO: 3932490 - RNA, 14 nt, Human adenovirus E
caagccacaguaca

SEQ ID NO: 3932491 - RNA, 13 nt, Human adenovirus E
caagccgcugacg

SEQ ID NO: 3932492 - RNA, 16 nt, Human adenovirus E
caagcggccacagugc

SEQ ID NO: 3932493 - RNA, 19 nt, Human adenovirus E
caagcggugcguuccagca

SEQ ID NO: 3932494 - RNA, 16 nt, Human adenovirus E
caagcuccugcagaag

SEQ ID NO: 3932495 - RNA, 12 nt, Human adenovirus E
caaggaggaugc

SEQ ID NO: 3932496 - RNA, 19 nt, Human adenovirus E
caaggaugcgcugcucgac

SEQ ID NO: 3932497 - RNA, 12 nt, Human adenovirus E
caaggccauccg

SEQ ID NO: 3932498 - RNA, 22 nt, Human adenovirus E
caagggcccagcgaaggcgagg

SEQ ID NO: 3932499 - RNA, 13 nt, Human adenovirus E
caaguccagcaaa

SEQ ID NO: 3932500 - RNA, 22 nt, Human adenovirus E
caagucuauguuggcacagcac

SEQ ID NO: 3932501 - RNA, 19 nt, Human adenovirus E
caaguggugcccccuccag

SEQ ID NO: 3932502 - RNA, 21 nt, Human adenovirus E
caaguggugcccccuccagaa

SEQ ID NO: 3932503 - RNA, 23 nt, Human adenovirus E
caauaaggcacuacaaugcucag

SEQ ID NO: 3932504 - RNA, 15 nt, Human adenovirus E
caauauauagcccag

SEQ ID NO: 3932505 - RNA, 14 nt, Human adenovirus E
caaucaggcagcac

SEQ ID NO: 3932506 - RNA, 16 nt, Human adenovirus E
caaucaggcagcaccg

SEQ ID NO: 3932507 - RNA, 22 nt, Human adenovirus E
caaucucgguaucguugacggc

SEQ ID NO: 3932508 - RNA, 15 nt, Human adenovirus E
caaugguacugaucu

SEQ ID NO: 3932509 - RNA, 22 nt, Human adenovirus E
caauuacucacaccacacacac

SEQ ID NO: 3932510 - RNA, 18 nt, Human adenovirus E
caauuauauaugcaaugg

SEQ ID NO: 3932511 - RNA, 21 nt, Human adenovirus E
cacacauugaaagguccagaa

SEQ ID NO: 3932512 - RNA, 13 nt, Human adenovirus E
cacaccaccacag

SEQ ID NO: 3932513 - RNA, 14 nt, Human adenovirus E
cacacgcacuacca

SEQ ID NO: 3932514 - RNA, 17 nt, Human adenovirus E
cacacugguggccaccu

SEQ ID NO: 3932515 - RNA, 14 nt, Human adenovirus E
cacagaaccaccag

SEQ ID NO: 3932516 - RNA, 15 nt, Human adenovirus E
cacagaaccaccagg

SEQ ID NO: 3932517 - RNA, 19 nt, Human adenovirus E
cacagcaacuuccugacca

SEQ ID NO: 3932518 - RNA, 13 nt, Human adenovirus E
cacagccggcgcu

SEQ ID NO: 3932519 - RNA, 15 nt, Human adenovirus E
cacagggcaggcgcu

SEQ ID NO: 3932520 - RNA, 16 nt, Human adenovirus E
cacagggccagcaccg

SEQ ID NO: 3932521 - RNA, 17 nt, Human adenovirus E
cacauacaaagccucag

SEQ ID NO: 3932522 - RNA, 16 nt, Human adenovirus E
caccaacccuccagga

SEQ ID NO: 3932523 - RNA, 17 nt, Human adenovirus E
caccaagaacagccaga

SEQ ID NO: 3932524 - RNA, 18 nt, Human adenovirus E
caccacccuccaccgcaa

SEQ ID NO: 3932525 - RNA, 13 nt, Human adenovirus E
caccaucgucaag

SEQ ID NO: 3932526 - RNA, 14 nt, Human adenovirus E
caccaugcagcuga

SEQ ID NO: 3932527 - RNA, 18 nt, Human adenovirus E
cacccagucauagcaggg

SEQ ID NO: 3932528 - RNA, 19 nt, Human adenovirus E
cacccccacggaggccagc

SEQ ID NO: 3932529 - RNA, 21 nt, Human adenovirus E
cacccgguuguaccuggugga

SEQ ID NO: 3932530 - RNA, 15 nt, Human adenovirus E
cacccucgcucuggu

SEQ ID NO: 3932531 - RNA, 14 nt, Human adenovirus E
caccgcucccuggc

SEQ ID NO: 3932532 - RNA, 16 nt, Human adenovirus E
caccggcggcggcgcg

SEQ ID NO: 3932533 - RNA, 20 nt, Human adenovirus E
caccgggugauccuccacca

SEQ ID NO: 3932534 - RNA, 23 nt, Human adenovirus E
caccggugugcgcgugcccgugc

SEQ ID NO: 3932535 - RNA, 14 nt, Human adenovirus E
caccgugcggugag

SEQ ID NO: 3932536 - RNA, 17 nt, Human adenovirus E
caccuccgacgcggccg

SEQ ID NO: 3932537 - RNA, 19 nt, Human adenovirus E
caccucgcuuacgcacguc

SEQ ID NO: 3932538 - RNA, 13 nt, Human adenovirus E
caccugcagcaga

SEQ ID NO: 3932539 - RNA, 17 nt, Human adenovirus E
cacgaagcccugcagga

SEQ ID NO: 3932540 - RNA, 12 nt, Human adenovirus E
cacgaggaggag

SEQ ID NO: 3932541 - RNA, 23 nt, Human adenovirus E
cacgccgagccucaagcccguga

SEQ ID NO: 3932542 - RNA, 16 nt, Human adenovirus E
cacgccgcaccgcucc

SEQ ID NO: 3932543 - RNA, 22 nt, Human adenovirus E
cacggccaccaaggccgccgcc

SEQ ID NO: 3932544 - RNA, 15 nt, Human adenovirus E
cacggcggcggcagc

SEQ ID NO: 3932545 - RNA, 18 nt, Human adenovirus E
cacgucuucaaccgcuuc

SEQ ID NO: 3932546 - RNA, 20 nt, Human adenovirus E
cacgugagccgcgcccuggg

SEQ ID NO: 3932547 - RNA, 16 nt, Human adenovirus E
cacgugcugcacgagc

SEQ ID NO: 3932548 - RNA, 15 nt, Human adenovirus E
cacguggccgcggcc

SEQ ID NO: 3932549 - RNA, 12 nt, Human adenovirus E
cacuacccggac

SEQ ID NO: 3932550 - RNA, 22 nt, Human adenovirus E
cacuccauauaccaaugcugua

SEQ ID NO: 3932551 - RNA, 15 nt, Human adenovirus E
cagugacagaggauu

SEQ ID NO: 3932552 - RNA, 20 nt, Human adenovirus E
caguuauuuuuccuccaccc

SEQ ID NO: 3932553 - RNA, 14 nt, Human adenovirus E
caguuccgccagga

SEQ ID NO: 3932554 - RNA, 16 nt, Human adenovirus E
caguuccgccaggagg

SEQ ID NO: 3932555 - RNA, 20 nt, Human adenovirus E
caguugcuuucggacauuuu

SEQ ID NO: 3932556 - RNA, 19 nt, Human adenovirus E
caguuuuuccaacaacacc

SEQ ID NO: 3932557 - RNA, 19 nt, Human adenovirus E
cauaaucaucugcauguuc

SEQ ID NO: 3932558 - RNA, 15 nt, Human adenovirus E
cauacaaagccucag

SEQ ID NO: 3932559 - RNA, 20 nt, Human adenovirus E
cauaguucaacacgcuccag

SEQ ID NO: 3932560 - RNA, 15 nt, Human adenovirus E
caucaggccccgcag

SEQ ID NO: 3932561 - RNA, 17 nt, Human adenovirus E
caucaggccccgcagca

SEQ ID NO: 3932562 - RNA, 22 nt, Human adenovirus E
caucauaguugugguccugggu

SEQ ID NO: 3932563 - RNA, 15 nt, Human adenovirus E
caucaugccugaugg

SEQ ID NO: 3932564 - RNA, 18 nt, Human adenovirus E
caucauguacgccagcaa

SEQ ID NO: 3932565 - RNA, 21 nt, Human adenovirus E
cauccagaaacaagacaauag

SEQ ID NO: 3932566 - RNA, 18 nt, Human adenovirus E
cauccccaaauucaaaca

SEQ ID NO: 3932567 - RNA, 22 nt, Human adenovirus E
cauccgcggcgacgaggccggc

SEQ ID NO: 3932568 - RNA, 13 nt, Human adenovirus E
caucgccgcggcg

SEQ ID NO: 3932569 - RNA, 17 nt, Human adenovirus E
caucgccucgcugaacu

SEQ ID NO: 3932570 - RNA, 13 nt, Human adenovirus E
caucggcaccagc

SEQ ID NO: 3932571 - RNA, 15 nt, Human adenovirus E
caucguugaagagga

SEQ ID NO: 3932572 - RNA, 17 nt, Human adenovirus E
caucuccgcuccggguc

SEQ ID NO: 3932573 - RNA, 14 nt, Human adenovirus E
caucugcauguuca

SEQ ID NO: 3932574 - RNA, 19 nt, Human adenovirus E
caucuggcccggcaggcca

SEQ ID NO: 3932575 - RNA, 15 nt, Human adenovirus E
caugcaagagaugga

SEQ ID NO: 3932576 - RNA, 19 nt, Human adenovirus E
caugcaucucuucagcacu

SEQ ID NO: 3932577 - RNA, 17 nt, Human adenovirus E
caugcccaacgugaacg

SEQ ID NO: 3932578 - RNA, 17 nt, Human adenovirus E
caugcccgccucguucc

SEQ ID NO: 3932579 - RNA, 16 nt, Human adenovirus E
caugcggggggagaug

SEQ ID NO: 3932580 - RNA, 20 nt, Human adenovirus E
caugcggggggagaugaggu

SEQ ID NO: 3932581 - RNA, 17 nt, Human adenovirus E
caugcuuggucuugcgg

SEQ ID NO: 3932582 - RNA, 17 nt, Human adenovirus E
cauggaauacaccaccc

SEQ ID NO: 3932583 - RNA, 22 nt, Human adenovirus E
cauggaauacaccacccucucc

SEQ ID NO: 3932584 - RNA, 15 nt, Human adenovirus E
cauggagacucagcc

SEQ ID NO: 3932585 - RNA, 18 nt, Human adenovirus E
cauggagacucagccauc

SEQ ID NO: 3932586 - RNA, 13 nt, Human adenovirus E
cauggcgaccagc

SEQ ID NO: 3932587 - RNA, 17 nt, Human adenovirus E
cauggcuugcagggucc

SEQ ID NO: 3932588 - RNA, 18 nt, Human adenovirus E
caugguggucccgugcag

SEQ ID NO: 3932589 - RNA, 19 nt, Human adenovirus E
caugguggucccgugcagg

SEQ ID NO: 3932590 - RNA, 18 nt, Human adenovirus E
cauguucagggcggccag

SEQ ID NO: 3932591 - RNA, 17 nt, Human adenovirus E
cauguuuucugccaaca

SEQ ID NO: 3932592 - RNA, 19 nt, Human adenovirus E
cauguuuucugccaacacc

SEQ ID NO: 3932593 - RNA, 13 nt, Human adenovirus E
cauuaccacacag

SEQ ID NO: 3932594 - RNA, 15 nt, Human adenovirus E
cauuaccucugcucu

SEQ ID NO: 3932595 - RNA, 19 nt, Human adenovirus E
cauucggggaagacguggu

SEQ ID NO: 3932596 - RNA, 14 nt, Human adenovirus E
cauucuacacuaaa

SEQ ID NO: 3932597 - RNA, 14 nt, Human adenovirus E
cauucugcagagca

SEQ ID NO: 3932598 - RNA, 13 nt, Human adenovirus E
cauucuggccugc

SEQ ID NO: 3932599 - RNA, 23 nt, Human adenovirus E
cauugccaaaugcaagacugcua

SEQ ID NO: 3932600 - RNA, 22 nt, Human adenovirus E
cauugucaaugccaccucagcu

SEQ ID NO: 3932601 - RNA, 19 nt, Human adenovirus E
cauuucgcguacccggcuc

SEQ ID NO: 3932602 - RNA, 15 nt, Human adenovirus E
cauuuuuccagccuu

SEQ ID NO: 3932603 - RNA, 23 nt, Human adenovirus E
ccaaaaaucagacaugcauccca

SEQ ID NO: 3932604 - RNA, 15 nt, Human adenovirus E
ccaacgcgcaccgca

SEQ ID NO: 3932605 - RNA, 22 nt, Human adenovirus E
ccaacgugccccggggccagga

SEQ ID NO: 3932606 - RNA, 20 nt, Human adenovirus E
ccaacuucaucagcgcccug

SEQ ID NO: 3932607 - RNA, 14 nt, Human adenovirus E
ccaagaacagccag

SEQ ID NO: 3932608 - RNA, 18 nt, Human adenovirus E
ccaagaagaggcagcagc

SEQ ID NO: 3932609 - RNA, 18 nt, Human adenovirus E
ccaagagaagccccuggg

SEQ ID NO: 3932610 - RNA, 14 nt, Human adenovirus E
ccaagagccggcgg

SEQ ID NO: 3932611 - RNA, 19 nt, Human adenovirus E
ccacaagaaguaccucacc

SEQ ID NO: 3932612 - RNA, 14 nt, Human adenovirus E
ccacagcgacccau

SEQ ID NO: 3932613 - RNA, 14 nt, Human adenovirus E
ccacagcgcccugg

SEQ ID NO: 3932614 - RNA, 18 nt, Human adenovirus E
ccacagcgucgcuccccg

SEQ ID NO: 3932615 - RNA, 15 nt, Human adenovirus E
ccacagggccagcac

SEQ ID NO: 3932616 - RNA, 17 nt, Human adenovirus E
ccaccacuacagcagca

SEQ ID NO: 3932617 - RNA, 20 nt, Human adenovirus E
ccacccucuccccccgcaca

SEQ ID NO: 3932618 - RNA, 21 nt, Human adenovirus E
ccacccugugucgucaccgcc

SEQ ID NO: 3932619 - RNA, 14 nt, Human adenovirus E
ccaccguggugcag

SEQ ID NO: 3932620 - RNA, 15 nt, Human adenovirus E
ccaccucgccgcgca

SEQ ID NO: 3932621 - RNA, 21 nt, Human adenovirus E
ccacgccgggcuaccgcggca

SEQ ID NO: 3932622 - RNA, 14 nt, Human adenovirus E
ccacgcgcacaucc

SEQ ID NO: 3932623 - RNA, 18 nt, Human adenovirus E
ccacggaggccagcaccc

SEQ ID NO: 3932624 - RNA, 15 nt, Human adenovirus E
ccacggcccucagca

SEQ ID NO: 3932625 - RNA, 14 nt, Human adenovirus E
ccacgugagccgcg

SEQ ID NO: 3932626 - RNA, 16 nt, Human adenovirus E
ccacgugcgcacccug

SEQ ID NO: 3932627 - RNA, 21 nt, Human adenovirus E
ccacugcuaccugcugcgccu

SEQ ID NO: 3932628 - RNA, 22 nt, Human adenovirus E
ccacuuccucuucuuccuccuc

SEQ ID NO: 3932629 - RNA, 17 nt, Human adenovirus E
ccagaaaaagccacaga

SEQ ID NO: 3932630 - RNA, 19 nt, Human adenovirus E
ccagaaaaagccacagaag

SEQ ID NO: 3932631 - RNA, 16 nt, Human adenovirus E
ccagaguuuggaagag

SEQ ID NO: 3932632 - RNA, 13 nt, Human adenovirus E
ccagaugaugcaa

SEQ ID NO: 3932633 - RNA, 23 nt, Human adenovirus E
ccagcagagucgggggcaggagc

SEQ ID NO: 3932634 - RNA, 9 nt, Human adenovirus E
ccagcagca

SEQ ID NO: 3932635 - RNA, 20 nt, Human adenovirus E
ccagcagcaacuuccagcca

SEQ ID NO: 3932636 - RNA, 18 nt, Human adenovirus E
ccagcagccgccgccgca

SEQ ID NO: 3932637 - RNA, 21 nt, Human adenovirus E
ccagcaggcggcgcgagcuga

SEQ ID NO: 3932638 - RNA, 21 nt, Human adenovirus E
ccagcucgucugggguccgag

SEQ ID NO: 3932639 - RNA, 21 nt, Human adenovirus E
ccagcuggaucaugaucauug

SEQ ID NO: 3932640 - RNA, 18 nt, Human adenovirus E
ccaggacuacuccacccg

SEQ ID NO: 3932641 - RNA, 17 nt, Human adenovirus E
ccaggaggcgcucuccc

SEQ ID NO: 3932642 - RNA, 18 nt, Human adenovirus E
ccaggauacggaggcggg

SEQ ID NO: 3932643 - RNA, 12 nt, Human adenovirus E
ccaggcaggcca

SEQ ID NO: 3932644 - RNA, 20 nt, Human adenovirus E
ccaggccgaaguccagcuga

SEQ ID NO: 3932645 - RNA, 18 nt, Human adenovirus E
ccaggccgugcagcggca

SEQ ID NO: 3932646 - RNA, 19 nt, Human adenovirus E
ccaggccgugcagcggcag

SEQ ID NO: 3932647 - RNA, 17 nt, Human adenovirus E
ccagggacucccucagc

SEQ ID NO: 3932648 - RNA, 16 nt, Human adenovirus E
ccagggauaggagcuc

SEQ ID NO: 3932649 - RNA, 22 nt, Human adenovirus E
ccagggauaggagcuccuggag

SEQ ID NO: 3932650 - RNA, 11 nt, Human adenovirus E
ccaggugcuca

SEQ ID NO: 3932651 - RNA, 17 nt, Human adenovirus E
ccauacuccaccuccac

SEQ ID NO: 3932652 - RNA, 12 nt, Human adenovirus E
ccauagccagcc

SEQ ID NO: 3932653 - RNA, 19 nt, Human adenovirus E
ccauccagaaaucccgcca

SEQ ID NO: 3932654 - RNA, 13 nt, Human adenovirus E
ccaucgccagcau

SEQ ID NO: 3932655 - RNA, 15 nt, Human adenovirus E
ccucggcgcuguccg

SEQ ID NO: 3932656 - RNA, 21 nt, Human adenovirus E
ccucggcguuggccaucccga

SEQ ID NO: 3932657 - RNA, 20 nt, Human adenovirus E
ccucguuucgcggguuggga

SEQ ID NO: 3932658 - RNA, 14 nt, Human adenovirus E
ccucuaccucugcc

SEQ ID NO: 3932659 - RNA, 19 nt, Human adenovirus E
ccucuccccccgcacagcc

SEQ ID NO: 3932660 - RNA, 16 nt, Human adenovirus E
ccucugacccugccgc

SEQ ID NO: 3932661 - RNA, 22 nt, Human adenovirus E
ccucugggugaaggccacggga

SEQ ID NO: 3932662 - RNA, 19 nt, Human adenovirus E
ccucuucuuccuccuccac

SEQ ID NO: 3932663 - RNA, 15 nt, Human adenovirus E
ccugaccaccguggu

SEQ ID NO: 3932664 - RNA, 18 nt, Human adenovirus E
ccugaccggggccgggac

SEQ ID NO: 3932665 - RNA, 20 nt, Human adenovirus E
ccugcacaggcagcaaagcc

SEQ ID NO: 3932666 - RNA, 14 nt, Human adenovirus E
ccugcacuggcagc

SEQ ID NO: 3932667 - RNA, 21 nt, Human adenovirus E
ccugcacuggcagcccagccg

SEQ ID NO: 3932668 - RNA, 11 nt, Human adenovirus E
ccugcaucucg

SEQ ID NO: 3932669 - RNA, 15 nt, Human adenovirus E
ccugccgcgcgcgcg

SEQ ID NO: 3932670 - RNA, 19 nt, Human adenovirus E
ccugccgcugcgcagcagu

SEQ ID NO: 3932671 - RNA, 14 nt, Human adenovirus E
ccugcgccgcuucu

SEQ ID NO: 3932672 - RNA, 18 nt, Human adenovirus E
ccugcggaaccacagggc

SEQ ID NO: 3932673 - RNA, 20 nt, Human adenovirus E
ccugcggaaccacagggcca

SEQ ID NO: 3932674 - RNA, 20 nt, Human adenovirus E
ccugcguuacgugcagcaga

SEQ ID NO: 3932675 - RNA, 18 nt, Human adenovirus E
ccugcuccgcgcugcccu

SEQ ID NO: 3932676 - RNA, 19 nt, Human adenovirus E
ccugcucgagugccacugc

SEQ ID NO: 3932677 - RNA, 22 nt, Human adenovirus E
ccugcucgagugccacugccgc

SEQ ID NO: 3932678 - RNA, 17 nt, Human adenovirus E
ccugcugcgccuggcca

SEQ ID NO: 3932679 - RNA, 12 nt, Human adenovirus E
ccugcugggccu

SEQ ID NO: 3932680 - RNA, 18 nt, Human adenovirus E
ccugcuugcaggccugcg

SEQ ID NO: 3932681 - RNA, 17 nt, Human adenovirus E
ccuggacaaaauaccac

SEQ ID NO: 3932682 - RNA, 22 nt, Human adenovirus E
ccuggaugucgacgccuaugag

SEQ ID NO: 3932683 - RNA, 20 nt, Human adenovirus E
ccuggcagacgggcaugggc

SEQ ID NO: 3932684 - RNA, 12 nt, Human adenovirus E
ccugggccagga

SEQ ID NO: 3932685 - RNA, 16 nt, Human adenovirus E
ccugggccugaugcac

SEQ ID NO: 3932686 - RNA, 23 nt, Human adenovirus E
ccugggccugaugcaccuguggg

SEQ ID NO: 3932687 - RNA, 15 nt, Human adenovirus E
ccuggucgagcgcga

SEQ ID NO: 3932688 - RNA, 21 nt, Human adenovirus E
ccuggugaccguggagcugga

SEQ ID NO: 3932689 - RNA, 23 nt, Human adenovirus E
ccugguguacaacgcgcugcugg

SEQ ID NO: 3932690 - RNA, 18 nt, Human adenovirus E
ccugugggaccugcugga

SEQ ID NO: 3932691 - RNA, 22 nt, Human adenovirus E
ccuguucagagacaggagcggc

SEQ ID NO: 3932692 - RNA, 14 nt, Human adenovirus E
ccuuacgugccccc

SEQ ID NO: 3932693 - RNA, 22 nt, Human adenovirus E
ccuuccgcgagugccccccgcc

SEQ ID NO: 3932694 - RNA, 20 nt, Human adenovirus E
ccuucgcccuagccgccucc

SEQ ID NO: 3932695 - RNA, 21 nt, Human adenovirus E
ccuuggaagagggcgaggggc

SEQ ID NO: 3932696 - RNA, 19 nt, Human adenovirus E
ccuuguacgauaccacccg

SEQ ID NO: 3932697 - RNA, 20 nt, Human adenovirus E
cgaacgggaucggccggugg

SEQ ID NO: 3932698 - RNA, 20 nt, Human adenovirus E
cgaaggaccccauccaggug

SEQ ID NO: 3932699 - RNA, 15 nt, Human adenovirus E
cgaaguccuccccag

SEQ ID NO: 3932700 - RNA, 13 nt, Human adenovirus E
cgacaccuggacc

SEQ ID NO: 3932701 - RNA, 14 nt, Human adenovirus E
cgacagcguggugg

SEQ ID NO: 3932702 - RNA, 22 nt, Human adenovirus E
cgaccaccguggaaugggccag

SEQ ID NO: 3932703 - RNA, 22 nt, Human adenovirus E
cgacccccggucccccacccag

SEQ ID NO: 3932704 - RNA, 19 nt, Human adenovirus E
cgacccgggcaaccuggaa

SEQ ID NO: 3932705 - RNA, 14 nt, Human adenovirus E
cgacucccaccugc

SEQ ID NO: 3932706 - RNA, 18 nt, Human adenovirus E
cgagcaaggacagacccu

SEQ ID NO: 3932707 - RNA, 19 nt, Human adenovirus E
cgagcagcuggcccggugg

SEQ ID NO: 3932708 - RNA, 17 nt, Human adenovirus E
cgagcccaacccgcgcc

SEQ ID NO: 3932709 - RNA, 14 nt, Human adenovirus E
cgagcggugugccg

SEQ ID NO: 3932710 - RNA, 18 nt, Human adenovirus E
cgaggacgucagcggcga

SEQ ID NO: 3932711 - RNA, 19 nt, Human adenovirus E
cgaggagccccgggcccag

SEQ ID NO: 3932712 - RNA, 20 nt, Human adenovirus E
cgaggaggaggcagaggagg

SEQ ID NO: 3932713 - RNA, 18 nt, Human adenovirus E
cgaggccguggcccagcg

SEQ ID NO: 3932714 - RNA, 23 nt, Human adenovirus E
cgaggcggacgagcugacgggga

SEQ ID NO: 3932715 - RNA, 16 nt, Human adenovirus E
cgaguccaaccuggga

SEQ ID NO: 3932716 - RNA, 12 nt, Human adenovirus E
cgauaaacucac

SEQ ID NO: 3932717 - RNA, 19 nt, Human adenovirus E
cgauauugucuugcugccc

SEQ ID NO: 3932718 - RNA, 21 nt, Human adenovirus E
cgaucaugugcuccuucugga

SEQ ID NO: 3932719 - RNA, 13 nt, Human adenovirus E
cgaucccuccagg

SEQ ID NO: 3932720 - RNA, 17 nt, Human adenovirus E
cgaugaaguaaaugcaa

SEQ ID NO: 3932721 - RNA, 22 nt, Human adenovirus E
cgaugcagcccccgcuggaggc

SEQ ID NO: 3932722 - RNA, 22 nt, Human adenovirus E
cgcaaggucgaggagaaccugc

SEQ ID NO: 3932723 - RNA, 12 nt, Human adenovirus E
cgcaccaccgcc

SEQ ID NO: 3932724 - RNA, 21 nt, Human adenovirus E
cgcaccaguuccgccaggagg

SEQ ID NO: 3932725 - RNA, 24 nt, Human adenovirus E
cgcaccgaggugccccucagcgug

SEQ ID NO: 3932726 - RNA, 22 nt, Human adenovirus E
cgcaccgcucccuggccugcaa

SEQ ID NO: 3932727 - RNA, 19 nt, Human adenovirus E
cgcacgggacgcagggcca

SEQ ID NO: 3932728 - RNA, 16 nt, Human adenovirus E
cgcacggucgagcuga

SEQ ID NO: 3932729 - RNA, 20 nt, Human adenovirus E
cgcacguagucauacagcuc

SEQ ID NO: 3932730 - RNA, 18 nt, Human adenovirus E
cgcacguggacgagcaga

SEQ ID NO: 3932731 - RNA, 19 nt, Human adenovirus E
cgcagcagaggaggcagca

SEQ ID NO: 3932732 - RNA, 22 nt, Human adenovirus E
cgcagcagcugcgcgccuucac

SEQ ID NO: 3932733 - RNA, 17 nt, Human adenovirus E
cgcaggcgggacagagg

SEQ ID NO: 3932734 - RNA, 15 nt, Human adenovirus E
cgcagugcaggggga

SEQ ID NO: 3932735 - RNA, 15 nt, Human adenovirus E
cgcagugggcgcaga

SEQ ID NO: 3932736 - RNA, 11 nt, Human adenovirus E
cgccaccaccc

SEQ ID NO: 3932737 - RNA, 15 nt, Human adenovirus E
cgccagacgccgcac

SEQ ID NO: 3932738 - RNA, 15 nt, Human adenovirus E
cgccagggcuugcag

SEQ ID NO: 3932739 - RNA, 17 nt, Human adenovirus E
cgccaucgucuccugcu

SEQ ID NO: 3932740 - RNA, 10 nt, Human adenovirus E
cgcccagccc

SEQ ID NO: 3932741 - RNA, 22 nt, Human adenovirus E
cgcccaggacuacuccacccgc

SEQ ID NO: 3932742 - RNA, 12 nt, Human adenovirus E
cgccccagcagc

SEQ ID NO: 3932743 - RNA, 19 nt, Human adenovirus E
cgcccguaaacgccggugg

SEQ ID NO: 3932744 - RNA, 19 nt, Human adenovirus E
cgcccuuuucaaccugggu

SEQ ID NO: 3932745 - RNA, 16 nt, Human adenovirus E
cgccgacgacagcagc

SEQ ID NO: 3932746 - RNA, 23 nt, Human adenovirus E
cgccgagacggucaacuccuccu

SEQ ID NO: 3932747 - RNA, 14 nt, Human adenovirus E
cgccgcccuggugu

SEQ ID NO: 3932748 - RNA, 21 nt, Human adenovirus E
cgccgcucgccgucgccgcac

SEQ ID NO: 3932749 - RNA, 14 nt, Human adenovirus E
cgccggcaggaccc

SEQ ID NO: 3932750 - RNA, 20 nt, Human adenovirus E
gaucccauuugagcuggagg

SEQ ID NO: 3932751 - RNA, 18 nt, Human adenovirus E
gaucccgaauaccacagc

SEQ ID NO: 3932752 - RNA, 15 nt, Human adenovirus E
gauccuccaccagag

SEQ ID NO: 3932753 - RNA, 18 nt, Human adenovirus E
gauccugcggaaccacag

SEQ ID NO: 3932754 - RNA, 23 nt, Human adenovirus E
gauccugcggaaccacagggcca

SEQ ID NO: 3932755 - RNA, 24 nt, Human adenovirus E
gauccugcggaaccacagggccag

SEQ ID NO: 3932756 - RNA, 17 nt, Human adenovirus E
gaucguccagggcagcu

SEQ ID NO: 3932757 - RNA, 17 nt, Human adenovirus E
gaucgugaacauucugg

SEQ ID NO: 3932758 - RNA, 20 nt, Human adenovirus E
gaucucgucgaagccguuga

SEQ ID NO: 3932759 - RNA, 20 nt, Human adenovirus E
gaucugacgccucuggguga

SEQ ID NO: 3932760 - RNA, 15 nt, Human adenovirus E
gaugacugacccacu

SEQ ID NO: 3932761 - RNA, 15 nt, Human adenovirus E
gaugaggcgugcgua

SEQ ID NO: 3932762 - RNA, 20 nt, Human adenovirus E
gaugaugucauacuugagcu

SEQ ID NO: 3932763 - RNA, 22 nt, Human adenovirus E
gaugcaccugugggaccugcug

SEQ ID NO: 3932764 - RNA, 19 nt, Human adenovirus E
gaugcaggggcggcagggg

SEQ ID NO: 3932765 - RNA, 17 nt, Human adenovirus E
gaugccgggcaggaggu

SEQ ID NO: 3932766 - RNA, 17 nt, Human adenovirus E
gaugccuuucaagagcc

SEQ ID NO: 3932767 - RNA, 15 nt, Human adenovirus E
gauggaaguggccag

SEQ ID NO: 3932768 - RNA, 17 nt, Human adenovirus E
gauggcaccucucgccc

SEQ ID NO: 3932769 - RNA, 16 nt, Human adenovirus E
gauggccacgggcagc

SEQ ID NO: 3932770 - RNA, 23 nt, Human adenovirus E
gauggcggcggcggcgaugcagc

SEQ ID NO: 3932771 - RNA, 14 nt, Human adenovirus E
gauggcuggcagag

SEQ ID NO: 3932772 - RNA, 18 nt, Human adenovirus E
gauguacagguggcagau

SEQ ID NO: 3932773 - RNA, 13 nt, Human adenovirus E
gauguugaagugg

SEQ ID NO: 3932774 - RNA, 18 nt, Human adenovirus E
gauguuggagauggcgag

SEQ ID NO: 3932775 - RNA, 19 nt, Human adenovirus E
gauucccacggagcccaug

SEQ ID NO: 3932776 - RNA, 23 nt, Human adenovirus E
gcaaacacaugucccccucgucc

SEQ ID NO: 3932777 - RNA, 19 nt, Human adenovirus E
gcaaccuggaagccacccu

SEQ ID NO: 3932778 - RNA, 17 nt, Human adenovirus E
gcaacucguaccugggc

SEQ ID NO: 3932779 - RNA, 16 nt, Human adenovirus E
gcaagacagucuggag

SEQ ID NO: 3932780 - RNA, 15 nt, Human adenovirus E
gcaagaggcagcccu

SEQ ID NO: 3932781 - RNA, 15 nt, Human adenovirus E
gcaagaguuccaggc

SEQ ID NO: 3932782 - RNA, 14 nt, Human adenovirus E
gcaagcagcacgga

SEQ ID NO: 3932783 - RNA, 17 nt, Human adenovirus E
gcaagccacaguacaga

SEQ ID NO: 3932784 - RNA, 14 nt, Human adenovirus E
gcaagcgcagccgu

SEQ ID NO: 3932785 - RNA, 21 nt, Human adenovirus E
gcaaggcguggaacagcacca

SEQ ID NO: 3932786 - RNA, 13 nt, Human adenovirus E
gcaagggcccagc

SEQ ID NO: 3932787 - RNA, 15 nt, Human adenovirus E
gcaaucaggcagcac

SEQ ID NO: 3932788 - RNA, 18 nt, Human adenovirus E
gcaauccucgcacagaac

SEQ ID NO: 3932789 - RNA, 12 nt, Human adenovirus E
gcacagcacagg

SEQ ID NO: 3932790 - RNA, 18 nt, Human adenovirus E
gcacaggcagcaaagccc

SEQ ID NO: 3932791 - RNA, 17 nt, Human adenovirus E
gcaccaacccuccagga

SEQ ID NO: 3932792 - RNA, 18 nt, Human adenovirus E
gcaccaacgugcagacca

SEQ ID NO: 3932793 - RNA, 19 nt, Human adenovirus E
gcaccacagggcaggcgcu

SEQ ID NO: 3932794 - RNA, 21 nt, Human adenovirus E
gcaccaccgccucggaccugg

SEQ ID NO: 3932795 - RNA, 19 nt, Human adenovirus E
gcacccuuguacgauacca

SEQ ID NO: 3932796 - RNA, 23 nt, Human adenovirus E
gcacccuuguacgauaccacccg

SEQ ID NO: 3932797 - RNA, 18 nt, Human adenovirus E
gcaccgcucccuggccug

SEQ ID NO: 3932798 - RNA, 13 nt, Human adenovirus E
gcaccggagcacc

SEQ ID NO: 3932799 - RNA, 16 nt, Human adenovirus E
gcgccgggcggcaggg

SEQ ID NO: 3932800 - RNA, 19 nt, Human adenovirus E
gcgcgccgguacgcccgcg

SEQ ID NO: 3932801 - RNA, 15 nt, Human adenovirus E
gcgcugcccucggac

SEQ ID NO: 3932802 - RNA, 13 nt, Human adenovirus E
gcggaaccacagg

SEQ ID NO: 3932803 - RNA, 22 nt, Human adenovirus E
gcggaaccacagggccagcacc

SEQ ID NO: 3932804 - RNA, 13 nt, Human adenovirus E
gcggaugaagcac

SEQ ID NO: 3932805 - RNA, 21 nt, Human adenovirus E
gcggccacggcggcggcagcg

SEQ ID NO: 3932806 - RNA, 23 nt, Human adenovirus E
gcggccagccugcugaugcccaa

SEQ ID NO: 3932807 - RNA, 20 nt, Human adenovirus E
gcggccagcugaaaaccauc

SEQ ID NO: 3932808 - RNA, 21 nt, Human adenovirus E
  misc_feature (9)..(9): n is a, c, g or u
gcggccgancgccugggcgag

SEQ ID NO: 3932809 - RNA, 15 nt, Human adenovirus E
gcggccgccaugaac

SEQ ID NO: 3932810 - RNA, 15 nt, Human adenovirus E
gcggccgccgugagc

SEQ ID NO: 3932811 - RNA, 15 nt, Human adenovirus E
gcggcgaugcagccc

SEQ ID NO: 3932812 - RNA, 14 nt, Human adenovirus E
gcggcgcacgggca

SEQ ID NO: 3932813 - RNA, 17 nt, Human adenovirus E
gcggcgcgagcugagcg

SEQ ID NO: 3932814 - RNA, 23 nt, Human adenovirus E
gcggcgcgagcugagcgaccagg

SEQ ID NO: 3932815 - RNA, 16 nt, Human adenovirus E
gcggcgcgccaucagc

SEQ ID NO: 3932816 - RNA, 14 nt, Human adenovirus E
gcggcgcugcagag

SEQ ID NO: 3932817 - RNA, 12 nt, Human adenovirus E
gcggcggcagca

SEQ ID NO: 3932818 - RNA, 19 nt, Human adenovirus E
gcggcgguacaccucgccc

SEQ ID NO: 3932819 - RNA, 18 nt, Human adenovirus E
gcgggacgcggcugaucg

SEQ ID NO: 3932820 - RNA, 14 nt, Human adenovirus E
gcggggcgggagcu

SEQ ID NO: 3932821 - RNA, 13 nt, Human adenovirus E
gcgggggagauga

SEQ ID NO: 3932822 - RNA, 20 nt, Human adenovirus E
gcggggggagaugaggugca

SEQ ID NO: 3932823 - RNA, 22 nt, Human adenovirus E
gcgggguuucuucuugggcggc

SEQ ID NO: 3932824 - RNA, 19 nt, Human adenovirus E
gcgguacaccucgcccugc

SEQ ID NO: 3932825 - RNA, 14 nt, Human adenovirus E
gcggucauggacca

SEQ ID NO: 3932826 - RNA, 18 nt, Human adenovirus E
gcgguggggcggccagcu

SEQ ID NO: 3932827 - RNA, 20 nt, Human adenovirus E
gcgucgcagggggccacgag

SEQ ID NO: 3932828 - RNA, 19 nt, Human adenovirus E
gcgucguuguuggccagcu

SEQ ID NO: 3932829 - RNA, 20 nt, Human adenovirus E
gcgucuaccucuaccucugc

SEQ ID NO: 3932830 - RNA, 23 nt, Human adenovirus E
gcgugcacgaagcccugcaggaa

SEQ ID NO: 3932831 - RNA, 22 nt, Human adenovirus E
gcguggccuuuggcgcggagcu

SEQ ID NO: 3932832 - RNA, 13 nt, Human adenovirus E
gcuaccuccagug

SEQ ID NO: 3932833 - RNA, 15 nt, Human adenovirus E
gcuaccugcucuucc

SEQ ID NO: 3932834 - RNA, 17 nt, Human adenovirus E
gcucacuaccaauaaca

SEQ ID NO: 3932835 - RNA, 19 nt, Human adenovirus E
gcuccacgcaacaccccgu

SEQ ID NO: 3932836 - RNA, 20 nt, Human adenovirus E
gcuccacgguggccgcgaag

SEQ ID NO: 3932837 - RNA, 14 nt, Human adenovirus E
gcucccuggggcgc

SEQ ID NO: 3932838 - RNA, 16 nt, Human adenovirus E
gcuccgcgacacggca

SEQ ID NO: 3932839 - RNA, 14 nt, Human adenovirus E
gcuccucccucagc

SEQ ID NO: 3932840 - RNA, 15 nt, Human adenovirus E
gcuccucccucagca

SEQ ID NO: 3932841 - RNA, 15 nt, Human adenovirus E
gcuccuccucggccu

SEQ ID NO: 3932842 - RNA, 23 nt, Human adenovirus E
gcuccugcagaagaacucaaggg

SEQ ID NO: 3932843 - RNA, 12 nt, Human adenovirus E
gcuccugguccu

SEQ ID NO: 3932844 - RNA, 20 nt, Human adenovirus E
gcuccugguucaccugcagc

SEQ ID NO: 3932845 - RNA, 21 nt, Human adenovirus E
gcuccugguucaccugcagca

SEQ ID NO: 3932846 - RNA, 22 nt, Human adenovirus E
gcucgagugccacugccgcugc

SEQ ID NO: 3932847 - RNA, 20 nt, Human adenovirus E
gcucgcaacgcugcacggga

SEQ ID NO: 3932848 - RNA, 14 nt, Human adenovirus E
gcucgccucgggca

SEQ ID NO: 3932849 - RNA, 22 nt, Human adenovirus E
gcucgcgcagagcgcccuccac

SEQ ID NO: 3932850 - RNA, 23 nt, Human adenovirus E
gcucgucugccguagucuggaga

SEQ ID NO: 3932851 - RNA, 15 nt, Human adenovirus E
gcucugaaccugccc

SEQ ID NO: 3932852 - RNA, 21 nt, Human adenovirus E
gcucugcaaggagaaggagga

SEQ ID NO: 3932853 - RNA, 23 nt, Human adenovirus E
gcugaacgccuuccucagcaccc

SEQ ID NO: 3932854 - RNA, 23 nt, Human adenovirus E
gcugacaguaugauuuuuuacaa

SEQ ID NO: 3932855 - RNA, 17 nt, Human adenovirus E
gcugaccaaccuggucu

SEQ ID NO: 3932856 - RNA, 19 nt, Human adenovirus E
gcugacggggaucagcccc

SEQ ID NO: 3932857 - RNA, 15 nt, Human adenovirus E
gcugacguccugcag

SEQ ID NO: 3932858 - RNA, 18 nt, Human adenovirus E
gcugcaccacgcugcgcc

SEQ ID NO: 3932859 - RNA, 15 nt, Human adenovirus E
gcugcugcugguggc

SEQ ID NO: 3932860 - RNA, 18 nt, Human adenovirus E
gcuggagcgcguggcccg

SEQ ID NO: 3932861 - RNA, 18 nt, Human adenovirus E
gcuggagugccugcgccg

SEQ ID NO: 3932862 - RNA, 23 nt, Human adenovirus E
gcuggagugccugcgccgcuucu

SEQ ID NO: 3932863 - RNA, 15 nt, Human adenovirus E
gcuggcgcgcacgua

SEQ ID NO: 3932864 - RNA, 16 nt, Human adenovirus E
gcugggcgaagaggag

SEQ ID NO: 3932865 - RNA, 21 nt, Human adenovirus E
gcuggguccuaaugcuagucc

SEQ ID NO: 3932866 - RNA, 19 nt, Human adenovirus E
gcuguaguggugugcaugu

SEQ ID NO: 3932867 - RNA, 20 nt, Human adenovirus E
gcuguggagccacugcuacc

SEQ ID NO: 3932868 - RNA, 19 nt, Human adenovirus E
gcuguugaugugauggaag

SEQ ID NO: 3932869 - RNA, 21 nt, Human adenovirus E
gcuuaccgagcagcagcacac

SEQ ID NO: 3932870 - RNA, 12 nt, Human adenovirus E
gcuucaggcgcc

SEQ ID NO: 3932871 - RNA, 22 nt, Human adenovirus E
gcuucuucaacgagcaggccgu

SEQ ID NO: 3932872 - RNA, 19 nt, Human adenovirus E
gcuugcauuucaaucccaa

SEQ ID NO: 3932873 - RNA, 16 nt, Human adenovirus E
ggaaagguuggggcac

SEQ ID NO: 3932874 - RNA, 20 nt, Human adenovirus E
ggaaccacagggccagcacc

SEQ ID NO: 3932875 - RNA, 19 nt, Human adenovirus E
ggaacucuugcaggacagc

SEQ ID NO: 3932876 - RNA, 15 nt, Human adenovirus E
ggaagacgugcugga

SEQ ID NO: 3932877 - RNA, 15 nt, Human adenovirus E
ggaagagcggcgcaa

SEQ ID NO: 3932878 - RNA, 21 nt, Human adenovirus E
ggaagcagagaaugagcagag

SEQ ID NO: 3932879 - RNA, 17 nt, Human adenovirus E
ggaagcuauguuggagc

SEQ ID NO: 3932880 - RNA, 23 nt, Human adenovirus E
ggaaugggccagacccagccaga

SEQ ID NO: 3932881 - RNA, 20 nt, Human adenovirus E
ggacaagauaaacaccgccu

SEQ ID NO: 3932882 - RNA, 14 nt, Human adenovirus E
ggacagauguggga

SEQ ID NO: 3932883 - RNA, 14 nt, Human adenovirus E
ggaccaccagcacg

SEQ ID NO: 3932884 - RNA, 21 nt, Human adenovirus E
ggaccacggcaaccccacgcc

SEQ ID NO: 3932885 - RNA, 16 nt, Human adenovirus E
ggaccccauccaggug

SEQ ID NO: 3932886 - RNA, 17 nt, Human adenovirus E
ggaccccgugaccgagc

SEQ ID NO: 3932887 - RNA, 14 nt, Human adenovirus E
ggacccgugaguuu

SEQ ID NO: 3932888 - RNA, 13 nt, Human adenovirus E
ggaccugcuggag

SEQ ID NO: 3932889 - RNA, 17 nt, Human adenovirus E
ggacgaugaggacuccg

SEQ ID NO: 3932890 - RNA, 20 nt, Human adenovirus E
ggacguccagagcgcaguag

SEQ ID NO: 3932891 - RNA, 21 nt, Human adenovirus E
ggacuacuucuuccagaccag

SEQ ID NO: 3932892 - RNA, 19 nt, Human adenovirus E
ggacuccguggcucugccu

SEQ ID NO: 3932893 - RNA, 15 nt, Human adenovirus E
ggacugaggggcgug

SEQ ID NO: 3932894 - RNA, 21 nt, Human adenovirus E
ggagaaagcaagcagcacgga

SEQ ID NO: 3932895 - RNA, 23 nt, Human adenovirus E
ggagaacagcagucaggcagagg

SEQ ID NO: 3932896 - RNA, 13 nt, Human adenovirus E
ggagacucagcca

SEQ ID NO: 3932897 - RNA, 15 nt, Human adenovirus E
ggagagcaugagcac

SEQ ID NO: 3932898 - RNA, 16 nt, Human adenovirus E
ggagaucuuccuucac

SEQ ID NO: 3932899 - RNA, 19 nt, Human adenovirus E
ggagaugcggcccaugagc

SEQ ID NO: 3932900 - RNA, 21 nt, Human adenovirus E
ggagcacgaggaggagcuggc

SEQ ID NO: 3932901 - RNA, 12 nt, Human adenovirus E
ggagccacugcu

SEQ ID NO: 3932902 - RNA, 22 nt, Human adenovirus E
ggagcgacaucggcaccagcca

SEQ ID NO: 3932903 - RNA, 15 nt, Human adenovirus E
ggagcggcgaggagc

SEQ ID NO: 3932904 - RNA, 16 nt, Human adenovirus E
ggagcucagccgcgcc

SEQ ID NO: 3932905 - RNA, 17 nt, Human adenovirus E
ggagcuggagugccugc

SEQ ID NO: 3932906 - RNA, 13 nt, Human adenovirus E
ggagcuggcagug

SEQ ID NO: 3932907 - RNA, 13 nt, Human adenovirus E
ggaggagcuggca

SEQ ID NO: 3932908 - RNA, 16 nt, Human adenovirus E
ggaggagguggaagaa

SEQ ID NO: 3932909 - RNA, 13 nt, Human adenovirus E
ggaggaugcagca

SEQ ID NO: 3932910 - RNA, 23 nt, Human adenovirus E
ggaggcagaggaggagguggaag

SEQ ID NO: 3932911 - RNA, 20 nt, Human adenovirus E
ggaggccaucgugcagaacc

SEQ ID NO: 3932912 - RNA, 13 nt, Human adenovirus E
ggaggucgggguc

SEQ ID NO: 3932913 - RNA, 18 nt, Human adenovirus E
ggagucaggucagugggc

SEQ ID NO: 3932914 - RNA, 22 nt, Human adenovirus E
ggagucgguccacagcuuccgc

SEQ ID NO: 3932915 - RNA, 21 nt, Human adenovirus E
uccagcuggcgggcggcgcca

SEQ ID NO: 3932916 - RNA, 21 nt, Human adenovirus E
  misc_feature (8)..(8): n is a, c, g or u
uccagcunuuccaacccuucc

SEQ ID NO: 3932917 - RNA, 19 nt, Human adenovirus E
uccagggacucccucagca

SEQ ID NO: 3932918 - RNA, 14 nt, Human adenovirus E
uccagggcuccccg

SEQ ID NO: 3932919 - RNA, 18 nt, Human adenovirus E
uccaguguaagccccaca

SEQ ID NO: 3932920 - RNA, 21 nt, Human adenovirus E
uccauguuuucugccaacacc

SEQ ID NO: 3932921 - RNA, 16 nt, Human adenovirus E
ucccauacuccaccuc

SEQ ID NO: 3932922 - RNA, 21 nt, Human adenovirus E
ucccgcaucugcaccucacag

SEQ ID NO: 3932923 - RNA, 14 nt, Human adenovirus E
ucccgccugaaccu

SEQ ID NO: 3932924 - RNA, 20 nt, Human adenovirus E
uccgaccgagucgcggauga

SEQ ID NO: 3932925 - RNA, 19 nt, Human adenovirus E
uccgccgacgacagcagcg

SEQ ID NO: 3932926 - RNA, 13 nt, Human adenovirus E
uccgcgcccaccg

SEQ ID NO: 3932927 - RNA, 14 nt, Human adenovirus E
uccgcuccacgcgu

SEQ ID NO: 3932928 - RNA, 15 nt, Human adenovirus E
uccggaauccugccc

SEQ ID NO: 3932929 - RNA, 13 nt, Human adenovirus E
uccggagcagcug

SEQ ID NO: 3932930 - RNA, 22 nt, Human adenovirus E
uccgggucucggcauggcccgc

SEQ ID NO: 3932931 - RNA, 11 nt, Human adenovirus E
uccuccuccag

SEQ ID NO: 3932932 - RNA, 13 nt, Human adenovirus E
uccucgcagcccc

SEQ ID NO: 3932933 - RNA, 12 nt, Human adenovirus E
uccugcacaggc

SEQ ID NO: 3932934 - RNA, 16 nt, Human adenovirus E
uccugcccgccaccug

SEQ ID NO: 3932935 - RNA, 19 nt, Human adenovirus E
uccugcggaaccacagggc

SEQ ID NO: 3932936 - RNA, 15 nt, Human adenovirus E
uccugcguuacgugc

SEQ ID NO: 3932937 - RNA, 21 nt, Human adenovirus E
uccuuacaaguuucuccacca

SEQ ID NO: 3932938 - RNA, 15 nt, Human adenovirus E
uccuuugacgaggaa

SEQ ID NO: 3932939 - RNA, 23 nt, Human adenovirus E
ucgaaggcgggcaugaccucggc

SEQ ID NO: 3932940 - RNA, 19 nt, Human adenovirus E
ucgacaagaugaauacacc

SEQ ID NO: 3932941 - RNA, 13 nt, Human adenovirus E
ccgcucucugcuc

SEQ ID NO: 3932942 - RNA, 13 nt, Human adenovirus E
ccgcugaacgaag

SEQ ID NO: 3932943 - RNA, 15 nt, Human adenovirus E
ccgcuguggagccac

SEQ ID NO: 3932944 - RNA, 23 nt, Human adenovirus E
ccggaauccugcccgccaccugc

SEQ ID NO: 3932945 - RNA, 23 nt, Human adenovirus E
ccggagacgcgcggccacggcgg

SEQ ID NO: 3932946 - RNA, 13 nt, Human adenovirus E
ccggagcagcugg

SEQ ID NO: 3932947 - RNA, 15 nt, Human adenovirus E
ccggaucgcugucca

SEQ ID NO: 3932948 - RNA, 20 nt, Human adenovirus E
ccggaucgcuguccacgagc

SEQ ID NO: 3932949 - RNA, 15 nt, Human adenovirus E
ccggaugcaggggcg

SEQ ID NO: 3932950 - RNA, 19 nt, Human adenovirus E
ccggcauuaacuccucgga

SEQ ID NO: 3932951 - RNA, 18 nt, Human adenovirus E
ccggcggcgcacgggcag

SEQ ID NO: 3932952 - RNA, 17 nt, Human adenovirus E
ccggcgggcugcaaacu

SEQ ID NO: 3932953 - RNA, 15 nt, Human adenovirus E
ccgggcccagguugg

SEQ ID NO: 3932954 - RNA, 18 nt, Human adenovirus E
  misc_feature (7)..(7): n is a, c, g or u
ccgggcnugggcgugcag

SEQ ID NO: 3932955 - RNA, 18 nt, Human adenovirus E
ccgggcuaccgcggcacg

SEQ ID NO: 3932956 - RNA, 13 nt, Human adenovirus E
ccggggaguccag

SEQ ID NO: 3932957 - RNA, 22 nt, Human adenovirus E
ccggggcagaagcacacagcuc

SEQ ID NO: 3932958 - RNA, 18 nt, Human adenovirus E
ccgggugauccuccacca

SEQ ID NO: 3932959 - RNA, 13 nt, Human adenovirus E
ccggucaccuucc

SEQ ID NO: 3932960 - RNA, 20 nt, Human adenovirus E
ccggucccccacccaguccc

SEQ ID NO: 3932961 - RNA, 21 nt, Human adenovirus E
ccgguggcacgacaggcagcg

SEQ ID NO: 3932962 - RNA, 19 nt, Human adenovirus E
ccgucaccuccacagcccc

SEQ ID NO: 3932963 - RNA, 14 nt, Human adenovirus E
ccguccucccggag

SEQ ID NO: 3932964 - RNA, 18 nt, Human adenovirus E
ccgugaccuugcagcagg

SEQ ID NO: 3932965 - RNA, 23 nt, Human adenovirus E
ccgugcggugagcgccagcaggc

SEQ ID NO: 3932966 - RNA, 11 nt, Human adenovirus E
ccguggcucug

SEQ ID NO: 3932967 - RNA, 14 nt, Human adenovirus E
ccuagaaugaccac

SEQ ID NO: 3932968 - RNA, 13 nt, Human adenovirus E
ccuagccgccucc

SEQ ID NO: 3932969 - RNA, 16 nt, Human adenovirus E
ccuagccgccuccacc

SEQ ID NO: 3932970 - RNA, 16 nt, Human adenovirus E
ccucaagcugggagag

SEQ ID NO: 3932971 - RNA, 20 nt, Human adenovirus E
ccucacagaucugcaucucc

SEQ ID NO: 3932972 - RNA, 19 nt, Human adenovirus E
ccucagcaugaugcccacg

SEQ ID NO: 3932973 - RNA, 21 nt, Human adenovirus E
ccucaggcggcagugguggcg

SEQ ID NO: 3932974 - RNA, 21 nt, Human adenovirus E
ccucauuuuccccgagcgccu

SEQ ID NO: 3932975 - RNA, 19 nt, Human adenovirus E
ccuccagugccuucucuag

SEQ ID NO: 3932976 - RNA, 15 nt, Human adenovirus E
ccuccgggcacuccc

SEQ ID NO: 3932977 - RNA, 14 nt, Human adenovirus E
ccuccugcacaggc

SEQ ID NO: 3932978 - RNA, 17 nt, Human adenovirus E
ccucgacccccagaccg

SEQ ID NO: 3932979 - RNA, 12 nt, Human adenovirus E
ccucgcagcccc

SEQ ID NO: 3932980 - RNA, 22 nt, Human adenovirus E
ccucgcucugguggccaacgcc

SEQ ID NO: 3932981 - RNA, 23 nt, Human adenovirus E
ccucgcucugguggccaacgcca

SEQ ID NO: 3932982 - RNA, 21 nt, Human adenovirus E
ccucggacgucaccugcggcg

SEQ ID NO: 3932983 - RNA, 16 nt, Human adenovirus E
ccucggcgggggagaa

SEQ ID NO: 3932984 - RNA, 19 nt, Human adenovirus E
ccucgggggucaaaaccau

SEQ ID NO: 3932985 - RNA, 18 nt, Human adenovirus E
ccucguaaaaguccacgg

SEQ ID NO: 3932986 - RNA, 20 nt, Human adenovirus E
ccucgucaggccguccugac

SEQ ID NO: 3932987 - RNA, 17 nt, Human adenovirus E
ccucugcacgccgcacc

SEQ ID NO: 3932988 - RNA, 13 nt, Human adenovirus E
ccugacacaccac

SEQ ID NO: 3932989 - RNA, 15 nt, Human adenovirus E
ccugauaucgccucc

SEQ ID NO: 3932990 - RNA, 22 nt, Human adenovirus E
ccugaucccgaauaccacagcg

SEQ ID NO: 3932991 - RNA, 15 nt, Human adenovirus E
ccugcccgccaccug

SEQ ID NO: 3932992 - RNA, 20 nt, Human adenovirus E
ccugcgucaucacccagggg

SEQ ID NO: 3932993 - RNA, 16 nt, Human adenovirus E
ccugcucuuccaccgc

SEQ ID NO: 3932994 - RNA, 16 nt, Human adenovirus E
ccugcugcgccuggcc

SEQ ID NO: 3932995 - RNA, 16 nt, Human adenovirus E
ccugcuggaggccauc

SEQ ID NO: 3932996 - RNA, 16 nt, Human adenovirus E
ccuggaagccacccug

SEQ ID NO: 3932997 - RNA, 17 nt, Human adenovirus E
ccuggaccgaaagaggg

SEQ ID NO: 3932998 - RNA, 18 nt, Human adenovirus E
ccuggagcgacaucggca

SEQ ID NO: 3932999 - RNA, 21 nt, Human adenovirus E
ccuggaggccguggugcccuc

SEQ ID NO: 3933000 - RNA, 23 nt, Human adenovirus E
ccuggaugccaucggcuccuagu

SEQ ID NO: 3933001 - RNA, 23 nt, Human adenovirus E
ccuggccaaccaggccgugcagc

SEQ ID NO: 3933002 - RNA, 14 nt, Human adenovirus E
ccuggccaccuacc

SEQ ID NO: 3933003 - RNA, 19 nt, Human adenovirus E
ccuggccaccuaccacauc

SEQ ID NO: 3933004 - RNA, 14 nt, Human adenovirus E
ccuggcgccuacgg

SEQ ID NO: 3933005 - RNA, 19 nt, Human adenovirus E
ccugggcauagucgcgccg

SEQ ID NO: 3933006 - RNA, 20 nt, Human adenovirus E
ccuggggcagaacgugcugc

SEQ ID NO: 3933007 - RNA, 16 nt, Human adenovirus E
ccuggugaccguggag

SEQ ID NO: 3933008 - RNA, 17 nt, Human adenovirus E
ccugugggaccugcugg

SEQ ID NO: 3933009 - RNA, 16 nt, Human adenovirus E
ccuguggggcgugcag

SEQ ID NO: 3933010 - RNA, 17 nt, Human adenovirus E
ccuuagcuuugacagua

SEQ ID NO: 3933011 - RNA, 14 nt, Human adenovirus E
ccuucaccaccugc

SEQ ID NO: 3933012 - RNA, 20 nt, Human adenovirus E
ccuuccaggaaggcuuccag

SEQ ID NO: 3933013 - RNA, 18 nt, Human adenovirus E
ccuucccaccccacucug

SEQ ID NO: 3933014 - RNA, 22 nt, Human adenovirus E
ccuucuccggcucccccggcca

SEQ ID NO: 3933015 - RNA, 22 nt, Human adenovirus E
ccuuuagacagcagccccaggc

SEQ ID NO: 3933016 - RNA, 19 nt, Human adenovirus E
cgaagccuuuagacagcag

SEQ ID NO: 3933017 - RNA, 18 nt, Human adenovirus E
cgacaacgcgcggcuggc

SEQ ID NO: 3933018 - RNA, 20 nt, Human adenovirus E
cgacaauuacuuggcggugg

SEQ ID NO: 3933019 - RNA, 19 nt, Human adenovirus E
cgacaggaugcaccgugcg

SEQ ID NO: 3933020 - RNA, 19 nt, Human adenovirus E
aaaacgucacccgccccgc

SEQ ID NO: 3933021 - RNA, 13 nt, Human adenovirus E
aaaagcuuaucca

SEQ ID NO: 3933022 - RNA, 17 nt, Human adenovirus E
aaacaagaagcugaaag

SEQ ID NO: 3933023 - RNA, 18 nt, Human adenovirus E
aaaccauaucccagggca

SEQ ID NO: 3933024 - RNA, 22 nt, Human adenovirus E
aaagcaaggaggaugcagcagc

SEQ ID NO: 3933025 - RNA, 22 nt, Human adenovirus E
aaagcgcccgaggaagcaauaa

SEQ ID NO: 3933026 - RNA, 23 nt, Human adenovirus E
aaauuccucaaaugcuaccgcca

SEQ ID NO: 3933027 - RNA, 12 nt, Human adenovirus E
aaauuuuugcuu

SEQ ID NO: 3933028 - RNA, 20 nt, Human adenovirus E
aacaccgccuaccgcagcug

SEQ ID NO: 3933029 - RNA, 18 nt, Human adenovirus E
aacagcccccuccacagc

SEQ ID NO: 3933030 - RNA, 15 nt, Human adenovirus E
aacaggagcuacaac

SEQ ID NO: 3933031 - RNA, 15 nt, Human adenovirus E
aacaguauccgcagc

SEQ ID NO: 3933032 - RNA, 18 nt, Human adenovirus E
aacccaccacgccuagaa

SEQ ID NO: 3933033 - RNA, 17 nt, Human adenovirus E
aaccccaccagcaagcc

SEQ ID NO: 3933034 - RNA, 14 nt, Human adenovirus E
aacccuuccucccc

SEQ ID NO: 3933035 - RNA, 10 nt, Human adenovirus E
aacucuugca

SEQ ID NO: 3933036 - RNA, 21 nt, Human adenovirus E
aacuguaaguacucuuucaua

SEQ ID NO: 3933037 - RNA, 18 nt, Human adenovirus E
aagacagucuggaggaag

SEQ ID NO: 3933038 - RNA, 12 nt, Human adenovirus E
aagacaguucau

SEQ ID NO: 3933039 - RNA, 20 nt, Human adenovirus E
aagacgaggaggaggcagag

SEQ ID NO: 3933040 - RNA, 17 nt, Human adenovirus E
aagagauggaggaaucc

SEQ ID NO: 3933041 - RNA, 16 nt, Human adenovirus E
aagauauuugcaauug

SEQ ID NO: 3933042 - RNA, 20 nt, Human adenovirus E
aagaucuccaacguggagcu

SEQ ID NO: 3933043 - RNA, 20 nt, Human adenovirus E
aagaucuucgagggucuggg

SEQ ID NO: 3933044 - RNA, 12 nt, Human adenovirus E
aagcaacauaag

SEQ ID NO: 3933045 - RNA, 16 nt, Human adenovirus E
aagccagccaugauaa

SEQ ID NO: 3933046 - RNA, 14 nt, Human adenovirus E
aagcccggguccag

SEQ ID NO: 3933047 - RNA, 23 nt, Human adenovirus E
aagccuccacgcgcacauccaga

SEQ ID NO: 3933048 - RNA, 20 nt, Human adenovirus E
aagcguucagggaggcgcug

SEQ ID NO: 3933049 - RNA, 19 nt, Human adenovirus E
aagcuauguuggagcaaca

SEQ ID NO: 3933050 - RNA, 16 nt, Human adenovirus E
aaggaggaaagaaagc

SEQ ID NO: 3933051 - RNA, 19 nt, Human adenovirus E
aaggccgccgccccucuca

SEQ ID NO: 3933052 - RNA, 15 nt, Human adenovirus E
aagggccgcgggguc

SEQ ID NO: 3933053 - RNA, 13 nt, Human adenovirus E
aagguccuggcca

SEQ ID NO: 3933054 - RNA, 18 nt, Human adenovirus E
aaguccuggcgggggcac

SEQ ID NO: 3933055 - RNA, 19 nt, Human adenovirus E
aaguugaaaaacugggagu

SEQ ID NO: 3933056 - RNA, 14 nt, Human adenovirus E
aauaacauuuuugc

SEQ ID NO: 3933057 - RNA, 17 nt, Human adenovirus E
aauaauacuuucauuuu

SEQ ID NO: 3933058 - RNA, 12 nt, Human adenovirus E
aauaccaccuca

SEQ ID NO: 3933059 - RNA, 13 nt, Human adenovirus E
aaucucuccucgc

SEQ ID NO: 3933060 - RNA, 19 nt, Human adenovirus E
aaucuucauuuuaucuucu

SEQ ID NO: 3933061 - RNA, 16 nt, Human adenovirus E
ccgccaccugcuccgc

SEQ ID NO: 3933062 - RNA, 11 nt, Human adenovirus E
ccgccagaccg

SEQ ID NO: 3933063 - RNA, 13 nt, Human adenovirus E
ccgccagcuccuc

SEQ ID NO: 3933064 - RNA, 22 nt, Human adenovirus E
ccgccccuaacggucgcccguc

SEQ ID NO: 3933065 - RNA, 14 nt, Human adenovirus E
ccgcccguggagga

SEQ ID NO: 3933066 - RNA, 13 nt, Human adenovirus E
ccgcccuggugcg

SEQ ID NO: 3933067 - RNA, 12 nt, Human adenovirus E
ccgccgccagac

SEQ ID NO: 3933068 - RNA, 15 nt, Human adenovirus E
ccgccgcccagcccc

SEQ ID NO: 3933069 - RNA, 21 nt, Human adenovirus E
ccgccgcgcaucuccaggugg

SEQ ID NO: 3933070 - RNA, 16 nt, Human adenovirus E
ccgccgugagcggggc

SEQ ID NO: 3933071 - RNA, 15 nt, Human adenovirus E
ccgccuaccgcagcu

SEQ ID NO: 3933072 - RNA, 16 nt, Human adenovirus E
ccgccucggaccuggc

SEQ ID NO: 3933073 - RNA, 13 nt, Human adenovirus E
ccgcgaggccauc

SEQ ID NO: 3933074 - RNA, 13 nt, Human adenovirus E
ccgcgcaccucug

SEQ ID NO: 3933075 - RNA, 23 nt, Human adenovirus E
ccgcgccaaccgcacccgcgccg

SEQ ID NO: 3933076 - RNA, 15 nt, Human adenovirus E
ccgcgcccugggcca

SEQ ID NO: 3933077 - RNA, 14 nt, Human adenovirus E
ccgcgcgugcagau

SEQ ID NO: 3933078 - RNA, 16 nt, Human adenovirus E
ccgcgcuugcugggcg

SEQ ID NO: 3933079 - RNA, 15 nt, Human adenovirus E
ccgcggccaaccugg

SEQ ID NO: 3933080 - RNA, 12 nt, Human adenovirus E
ccgcggugcucc

SEQ ID NO: 3933081 - RNA, 17 nt, Human adenovirus E
ccgcuacaacagcacca

SEQ ID NO: 3933082 - RNA, 14 nt, Human adenovirus E
ccgcucccuggccu

SEQ ID NO: 3933083 - RNA, 16 nt, Human adenovirus E
ccgcuggaccacggca

SEQ ID NO: 3933084 - RNA, 19 nt, Human adenovirus E
ccggagaaaacuggcguga

SEQ ID NO: 3933085 - RNA, 15 nt, Human adenovirus E
ccggagcagcuggga

SEQ ID NO: 3933086 - RNA, 13 nt, Human adenovirus E
ccggaugcagggg

SEQ ID NO: 3933087 - RNA, 16 nt, Human adenovirus E
ccggcgcgacccucgu

SEQ ID NO: 3933088 - RNA, 16 nt, Human adenovirus E
ccggcggcgcacgggc

SEQ ID NO: 3933089 - RNA, 19 nt, Human adenovirus E
ccggggccaggaggacuac

SEQ ID NO: 3933090 - RNA, 17 nt, Human adenovirus E
ccggggcgggggagaug

SEQ ID NO: 3933091 - RNA, 15 nt, Human adenovirus E
ccggguccaggccag

SEQ ID NO: 3933092 - RNA, 20 nt, Human adenovirus E
ccggguccagggacucccuc

SEQ ID NO: 3933093 - RNA, 16 nt, Human adenovirus E
ccgggugauccuccac

SEQ ID NO: 3933094 - RNA, 13 nt, Human adenovirus E
ccggucucgauca

SEQ ID NO: 3933095 - RNA, 18 nt, Human adenovirus E
ccgguuguaccuggugga

SEQ ID NO: 3933096 - RNA, 13 nt, Human adenovirus E
ccgucaccuccac

SEQ ID NO: 3933097 - RNA, 16 nt, Human adenovirus E
ccgucacggugaaggg

SEQ ID NO: 3933098 - RNA, 22 nt, Human adenovirus E
ccgucgcgaccuuucugaaucu

SEQ ID NO: 3933099 - RNA, 17 nt, Human adenovirus E
ccgugaaggaggagagc

SEQ ID NO: 3933100 - RNA, 18 nt, Human adenovirus E
ccguggaaugggccagac

SEQ ID NO: 3933101 - RNA, 21 nt, Human adenovirus E
ccguggaaugggccagaccca

SEQ ID NO: 3933102 - RNA, 15 nt, Human adenovirus E
ccguugggcagggag

SEQ ID NO: 3933103 - RNA, 16 nt, Human adenovirus E
ccuacuuugagcugcc

SEQ ID NO: 3933104 - RNA, 19 nt, Human adenovirus E
ccucaaaggccgcgugcgg

SEQ ID NO: 3933105 - RNA, 14 nt, Human adenovirus E
ccucaagcccguga

SEQ ID NO: 3933106 - RNA, 10 nt, Human adenovirus E
ccucacagcg

SEQ ID NO: 3933107 - RNA, 12 nt, Human adenovirus E
ccucacaugacc

SEQ ID NO: 3933108 - RNA, 12 nt, Human adenovirus E
ccucagcaauaa

SEQ ID NO: 3933109 - RNA, 14 nt, Human adenovirus E
ccucagcacccagc

SEQ ID NO: 3933110 - RNA, 21 nt, Human adenovirus E
ccucagcaugaugcccacggc

SEQ ID NO: 3933111 - RNA, 19 nt, Human adenovirus E
ccucagcguggaggagcuc

SEQ ID NO: 3933112 - RNA, 15 nt, Human adenovirus E
ccucauuuuccccga

SEQ ID NO: 3933113 - RNA, 14 nt, Human adenovirus E
ccuccaccaacgcc

SEQ ID NO: 3933114 - RNA, 15 nt, Human adenovirus E
ccuccuuggaagagg

SEQ ID NO: 3933115 - RNA, 14 nt, Human adenovirus E
ccucgacucccacc

SEQ ID NO: 3933116 - RNA, 22 nt, Human adenovirus E
ccucgcgcucgaaggcccccgg

SEQ ID NO: 3933117 - RNA, 21 nt, Human adenovirus E
ccucuaccgaggucaggggcg

SEQ ID NO: 3933118 - RNA, 15 nt, Human adenovirus E
ccucugcacgccgca

SEQ ID NO: 3933119 - RNA, 20 nt, Human adenovirus E
ccucugggugaaggccacgg

SEQ ID NO: 3933120 - RNA, 21 nt, Human adenovirus E
ccucugguugaacaugcagcc

SEQ ID NO: 3933121 - RNA, 12 nt, Human adenovirus E
ccucuucuuggu

SEQ ID NO: 3933122 - RNA, 18 nt, Human adenovirus E
ccugaacgccugcugggc

SEQ ID NO: 3933123 - RNA, 18 nt, Human adenovirus E
ccugaucccgaauaccac

SEQ ID NO: 3933124 - RNA, 13 nt, Human adenovirus E
ccugauggcucug

SEQ ID NO: 3933125 - RNA, 20 nt, Human adenovirus E
ccugcaagacagucuggagg

SEQ ID NO: 3933126 - RNA, 12 nt, Human adenovirus E
ccugcacaggca

SEQ ID NO: 3933127 - RNA, 17 nt, Human adenovirus E
ccugcccgccaccugcu

SEQ ID NO: 3933128 - RNA, 15 nt, Human adenovirus E
ccugccgcgccaacc

SEQ ID NO: 3933129 - RNA, 15 nt, Human adenovirus E
ccugccgcugcgcag

SEQ ID NO: 3933130 - RNA, 21 nt, Human adenovirus E
ccugcgcaaggucgaggagaa

SEQ ID NO: 3933131 - RNA, 20 nt, Human adenovirus E
ccugcucgagugccacugcc

SEQ ID NO: 3933132 - RNA, 21 nt, Human adenovirus E
ccugcucgggcaucagcugga

SEQ ID NO: 3933133 - RNA, 16 nt, Human adenovirus E
ccugcucguccucacu

SEQ ID NO: 3933134 - RNA, 17 nt, Human adenovirus E
ccugcuuaucaccuucu

SEQ ID NO: 3933135 - RNA, 20 nt, Human adenovirus E
ccuggccaacuaccuggccu

SEQ ID NO: 3933136 - RNA, 16 nt, Human adenovirus E
ccuggccguguugcuc

SEQ ID NO: 3933137 - RNA, 20 nt, Human adenovirus E
ccuggcgccuacggaggggc

SEQ ID NO: 3933138 - RNA, 23 nt, Human adenovirus E
ccugggcuaugugacgcccgcgg

SEQ ID NO: 3933139 - RNA, 22 nt, Human adenovirus E
ccugguccgggcgcugcacacc

SEQ ID NO: 3933140 - RNA, 22 nt, Human adenovirus E
ccuggugaacauucugcagagc

SEQ ID NO: 3933141 - RNA, 20 nt, Human adenovirus E
ccuggugaccguggagcugg

SEQ ID NO: 3933142 - RNA, 18 nt, Human adenovirus E
ccugucuuucguccucgc

SEQ ID NO: 3933143 - RNA, 15 nt, Human adenovirus E
ccugugggaccugcu

SEQ ID NO: 3933144 - RNA, 21 nt, Human adenovirus E
ccugugggaccugcuggaggc

SEQ ID NO: 3933145 - RNA, 21 nt, Human adenovirus E
ccugugucgucaccgccccgc

SEQ ID NO: 3933146 - RNA, 15 nt, Human adenovirus E
ccuuccucagcaccc

SEQ ID NO: 3933147 - RNA, 17 nt, Human adenovirus E
ccuucucuagcaccgcc

SEQ ID NO: 3933148 - RNA, 15 nt, Human adenovirus E
ccuuggcaguacagu

SEQ ID NO: 3933149 - RNA, 16 nt, Human adenovirus E
ccuuguaggcgcagca

SEQ ID NO: 3933150 - RNA, 20 nt, Human adenovirus E
cgaaaaagaaaaacagccau

SEQ ID NO: 3933151 - RNA, 15 nt, Human adenovirus E
cgaacucgcgccugc

SEQ ID NO: 3933152 - RNA, 13 nt, Human adenovirus E
cgaagaccccggc

SEQ ID NO: 3933153 - RNA, 17 nt, Human adenovirus E
cgaaggguaugcuuucg

SEQ ID NO: 3933154 - RNA, 14 nt, Human adenovirus E
cgaaguccagcuga

SEQ ID NO: 3933155 - RNA, 15 nt, Human adenovirus E
cgacaaaaaucagac

SEQ ID NO: 3933156 - RNA, 14 nt, Human adenovirus E
cgaccaggagcuga

SEQ ID NO: 3933157 - RNA, 13 nt, Human adenovirus E
cgacgagcagcug

SEQ ID NO: 3933158 - RNA, 15 nt, Human adenovirus E
cgacgagcagcuggc

SEQ ID NO: 3933159 - RNA, 14 nt, Human adenovirus E
cgacgagcgcacca

SEQ ID NO: 3933160 - RNA, 22 nt, Human adenovirus E
cgacgcggagacccugcgcaag

SEQ ID NO: 3933161 - RNA, 15 nt, Human adenovirus E
cgacucccaccugcu

SEQ ID NO: 3933162 - RNA, 23 nt, Human adenovirus E
cgacugggcuuuucggcgcggua

SEQ ID NO: 3933163 - RNA, 13 nt, Human adenovirus E
cgagaagcagcag

SEQ ID NO: 3933164 - RNA, 15 nt, Human adenovirus E
cgagaagcagcagca

SEQ ID NO: 3933165 - RNA, 17 nt, Human adenovirus E
cgagaagcagcagcagc

SEQ ID NO: 3933166 - RNA, 16 nt, Human adenovirus E
cgagaccgagcuccag

SEQ ID NO: 3933167 - RNA, 14 nt, Human adenovirus E
cgagauccacggga

SEQ ID NO: 3933168 - RNA, 16 nt, Human adenovirus E
cgagcccgagggccgc

SEQ ID NO: 3933169 - RNA, 16 nt, Human adenovirus E
cgagccggggcagcgc

SEQ ID NO: 3933170 - RNA, 16 nt, Human adenovirus E
cgagccugcugacgcc

SEQ ID NO: 3933171 - RNA, 23 nt, Human adenovirus E
gcagcugaagcaacugcagccgu

SEQ ID NO: 3933172 - RNA, 18 nt, Human adenovirus E
gcagcuguuccugguggu

SEQ ID NO: 3933173 - RNA, 21 nt, Human adenovirus E
gcagcuugccauucgcgcacg

SEQ ID NO: 3933174 - RNA, 20 nt, Human adenovirus E
gcaggagggggccaccccca

SEQ ID NO: 3933175 - RNA, 20 nt, Human adenovirus E
gcaggcaccgcagcuugccc

SEQ ID NO: 3933176 - RNA, 18 nt, Human adenovirus E
gcagggcaugguguugca

SEQ ID NO: 3933177 - RNA, 13 nt, Human adenovirus E
gcagggggccacg

SEQ ID NO: 3933178 - RNA, 22 nt, Human adenovirus E
gcaguagucgagggucuccugg

SEQ ID NO: 3933179 - RNA, 23 nt, Human adenovirus E
gcaguagucgagggucuccugga

SEQ ID NO: 3933180 - RNA, 15 nt, Human adenovirus E
gcagucaggcagagg

SEQ ID NO: 3933181 - RNA, 21 nt, Human adenovirus E
gcagucaggcagaggaggagg

SEQ ID NO: 3933182 - RNA, 21 nt, Human adenovirus E
gcagucauaaucaucugcaug

SEQ ID NO: 3933183 - RNA, 13 nt, Human adenovirus E
gcagucccacugc

SEQ ID NO: 3933184 - RNA, 14 nt, Human adenovirus E
gcagucccacugcu

SEQ ID NO: 3933185 - RNA, 15 nt, Human adenovirus E
gcagucucuggagcg

SEQ ID NO: 3933186 - RNA, 13 nt, Human adenovirus E
gcagugcucaggu

SEQ ID NO: 3933187 - RNA, 13 nt, Human adenovirus E
gcagugggcgcag

SEQ ID NO: 3933188 - RNA, 17 nt, Human adenovirus E
gcauagauggcacucca

SEQ ID NO: 3933189 - RNA, 17 nt, Human adenovirus E
gcaucgcccggcggcac

SEQ ID NO: 3933190 - RNA, 15 nt, Human adenovirus E
gcaucucccaggcuu

SEQ ID NO: 3933191 - RNA, 17 nt, Human adenovirus E
gcaucuggcccggcagg

SEQ ID NO: 3933192 - RNA, 15 nt, Human adenovirus E
gcaucuuggccugga

SEQ ID NO: 3933193 - RNA, 23 nt, Human adenovirus E
gcaucuuggccuggaucuugaga

SEQ ID NO: 3933194 - RNA, 18 nt, Human adenovirus E
gcaugaccaccugggcga

SEQ ID NO: 3933195 - RNA, 16 nt, Human adenovirus E
gcaugagcaccacagc

SEQ ID NO: 3933196 - RNA, 20 nt, Human adenovirus E
gcaugagcaccacagcgccc

SEQ ID NO: 3933197 - RNA, 15 nt, Human adenovirus E
gcaugcgaguuggag

SEQ ID NO: 3933198 - RNA, 19 nt, Human adenovirus E
gcaugcgaguuggaggaga

SEQ ID NO: 3933199 - RNA, 21 nt, Human adenovirus E
gcaugguguacuaugccuucu

SEQ ID NO: 3933200 - RNA, 21 nt, Human adenovirus E
gcauguucauuuuugcuugcu

SEQ ID NO: 3933201 - RNA, 19 nt, Human adenovirus E
gcauuaccacacagacaac

SEQ ID NO: 3933202 - RNA, 20 nt, Human adenovirus E
gcauuaccccuacacaugau

SEQ ID NO: 3933203 - RNA, 20 nt, Human adenovirus E
gcauuauuguugcuguagug

SEQ ID NO: 3933204 - RNA, 23 nt, Human adenovirus E
gcauucguuacucggagcuggca

SEQ ID NO: 3933205 - RNA, 14 nt, Human adenovirus E
gccaaaaaucagac

SEQ ID NO: 3933206 - RNA, 23 nt, Human adenovirus E
gccaaccaggccgugcagcggca

SEQ ID NO: 3933207 - RNA, 23 nt, Human adenovirus E
gccaaccggcucucggccauccu

SEQ ID NO: 3933208 - RNA, 23 nt, Human adenovirus E
gccaacgcuccacgcaacacccc

SEQ ID NO: 3933209 - RNA, 14 nt, Human adenovirus E
gccaccacccccag

SEQ ID NO: 3933210 - RNA, 12 nt, Human adenovirus E
gccaccucagcu

SEQ ID NO: 3933211 - RNA, 13 nt, Human adenovirus E
gccagacgcgcgg

SEQ ID NO: 3933212 - RNA, 15 nt, Human adenovirus E
gccagaucguccagg

SEQ ID NO: 3933213 - RNA, 19 nt, Human adenovirus E
gccagaucguccagggcag

SEQ ID NO: 3933214 - RNA, 24 nt, Human adenovirus E
gccagcccaauggcaccugcgagc

SEQ ID NO: 3933215 - RNA, 13 nt, Human adenovirus E
gccagccgacuuc

SEQ ID NO: 3933216 - RNA, 15 nt, Human adenovirus E
gccagcgccggcagg

SEQ ID NO: 3933217 - RNA, 18 nt, Human adenovirus E
gccagcgccggcaggacc

SEQ ID NO: 3933218 - RNA, 15 nt, Human adenovirus E
gccaggacgacccgg

SEQ ID NO: 3933219 - RNA, 19 nt, Human adenovirus E
gccaggccugcaagaucuc

SEQ ID NO: 3933220 - RNA, 20 nt, Human adenovirus E
gccaggcgcacguggacgag

SEQ ID NO: 3933221 - RNA, 18 nt, Human adenovirus E
gccagggcuugcagaccg

SEQ ID NO: 3933222 - RNA, 20 nt, Human adenovirus E
gccaucacaccuuccaccug

SEQ ID NO: 3933223 - RNA, 16 nt, Human adenovirus E
gccaucgccaaccucg

SEQ ID NO: 3933224 - RNA, 12 nt, Human adenovirus E
gccugcugcugc

SEQ ID NO: 3933225 - RNA, 18 nt, Human adenovirus E
gccuggccaacuaccugg

SEQ ID NO: 3933226 - RNA, 23 nt, Human adenovirus E
gccugggcggccuugcgcaggga

SEQ ID NO: 3933227 - RNA, 20 nt, Human adenovirus E
gccuuuagacagcagcccca

SEQ ID NO: 3933228 - RNA, 21 nt, Human adenovirus E
gcgaaagugucccugaccaug

SEQ ID NO: 3933229 - RNA, 16 nt, Human adenovirus E
gcgaacgcucugcaag

SEQ ID NO: 3933230 - RNA, 15 nt, Human adenovirus E
gcgaccaggagcuga

SEQ ID NO: 3933231 - RNA, 15 nt, Human adenovirus E
gcgagacgcccaggc

SEQ ID NO: 3933232 - RNA, 18 nt, Human adenovirus E
gcgaguuggaggagaugg

SEQ ID NO: 3933233 - RNA, 16 nt, Human adenovirus E
gcgaugcagcccccgc

SEQ ID NO: 3933234 - RNA, 18 nt, Human adenovirus E
gcgcaagagucagagaaa

SEQ ID NO: 3933235 - RNA, 15 nt, Human adenovirus E
gcgcacauccagaaa

SEQ ID NO: 3933236 - RNA, 17 nt, Human adenovirus E
gcgcacccgccccccuc

SEQ ID NO: 3933237 - RNA, 22 nt, Human adenovirus E
gcgcacguggacgagcagaccu

SEQ ID NO: 3933238 - RNA, 18 nt, Human adenovirus E
gcgcacguggccgcggcc

SEQ ID NO: 3933239 - RNA, 14 nt, Human adenovirus E
gcgcaggccggagc

SEQ ID NO: 3933240 - RNA, 19 nt, Human adenovirus E
gcgcagggaggugugcgug

SEQ ID NO: 3933241 - RNA, 14 nt, Human adenovirus E
gcgccaccaccccc

SEQ ID NO: 3933242 - RNA, 12 nt, Human adenovirus E
gcgccagcaggc

SEQ ID NO: 3933243 - RNA, 13 nt, Human adenovirus E
gcgccaggccugc

SEQ ID NO: 3933244 - RNA, 14 nt, Human adenovirus E
gcgccauugguggc

SEQ ID NO: 3933245 - RNA, 16 nt, Human adenovirus E
gcgcccccaccacccu

SEQ ID NO: 3933246 - RNA, 18 nt, Human adenovirus E
gcgcccgcgcuugcuggg

SEQ ID NO: 3933247 - RNA, 16 nt, Human adenovirus E
gcgcccuccaccggca

SEQ ID NO: 3933248 - RNA, 15 nt, Human adenovirus E
gcgccggcaggaccc

SEQ ID NO: 3933249 - RNA, 14 nt, Human adenovirus E
gcgcgaggagguga

SEQ ID NO: 3933250 - RNA, 14 nt, Human adenovirus E
gcgcgcgcccagca

SEQ ID NO: 3933251 - RNA, 12 nt, Human adenovirus E
gcgcgcuaccac

SEQ ID NO: 3933252 - RNA, 14 nt, Human adenovirus E
gcgcggccagccug

SEQ ID NO: 3933253 - RNA, 22 nt, Human adenovirus E
gcgcgggugauggucucccgca

SEQ ID NO: 3933254 - RNA, 22 nt, Human adenovirus E
gcgcggucauggaccaggugcu

SEQ ID NO: 3933255 - RNA, 11 nt, Human adenovirus E
gcgcuccugga

SEQ ID NO: 3933256 - RNA, 14 nt, Human adenovirus E
gcgcugcagagcca

SEQ ID NO: 3933257 - RNA, 15 nt, Human adenovirus E
gcgcugcagagccag

SEQ ID NO: 3933258 - RNA, 15 nt, Human adenovirus E
gcgcugcucgaccgc

SEQ ID NO: 3933259 - RNA, 18 nt, Human adenovirus E
gcgcuguccggccgcgag

SEQ ID NO: 3933260 - RNA, 12 nt, Human adenovirus E
gcggaacagcau

SEQ ID NO: 3933261 - RNA, 20 nt, Human adenovirus E
gcggaccugcacuggcagcc

SEQ ID NO: 3933262 - RNA, 22 nt, Human adenovirus E
gcggagacccugcgcaaggucg

SEQ ID NO: 3933263 - RNA, 14 nt, Human adenovirus E
gcggcagcggccau

SEQ ID NO: 3933264 - RNA, 14 nt, Human adenovirus E
gcggccagacgcgc

SEQ ID NO: 3933265 - RNA, 12 nt, Human adenovirus E
gcggccagcuga

SEQ ID NO: 3933266 - RNA, 13 nt, Human adenovirus E
gcggcccaugagc

SEQ ID NO: 3933267 - RNA, 13 nt, Human adenovirus E
gcggccuggaccg

SEQ ID NO: 3933268 - RNA, 14 nt, Human adenovirus E
gcggccuugcgcag

SEQ ID NO: 3933269 - RNA, 16 nt, Human adenovirus E
gcggcgcacgggcaga

SEQ ID NO: 3933270 - RNA, 13 nt, Human adenovirus E
gcggcggcagcag

SEQ ID NO: 3933271 - RNA, 15 nt, Human adenovirus E
gcggcggcgcgccau

SEQ ID NO: 3933272 - RNA, 21 nt, Human adenovirus E
gcggcucgacuccguggccug

SEQ ID NO: 3933273 - RNA, 14 nt, Human adenovirus E
gcggcuggggcgac

SEQ ID NO: 3933274 - RNA, 22 nt, Human adenovirus E
gcggcuggugauccggggcaga

SEQ ID NO: 3933275 - RNA, 19 nt, Human adenovirus E
gcgggcacuuccgcgcucc

SEQ ID NO: 3933276 - RNA, 18 nt, Human adenovirus E
gcgggcaugaccucggca

SEQ ID NO: 3933277 - RNA, 15 nt, Human adenovirus E
gcgggcggcgccacc

SEQ ID NO: 3933278 - RNA, 14 nt, Human adenovirus E
gcggggggagauga

SEQ ID NO: 3933279 - RNA, 21 nt, Human adenovirus E
gcgguacaccucgcccugcuc

SEQ ID NO: 3933280 - RNA, 18 nt, Human adenovirus E
gcggucauaccagcagcc

SEQ ID NO: 3933281 - RNA, 14 nt, Human adenovirus E
gcggugcaggccuc

SEQ ID NO: 3933282 - RNA, 24 nt, Human adenovirus E
gcggugcccgaggcccuggccacc

SEQ ID NO: 3933283 - RNA, 20 nt, Human adenovirus E
gcgugccccagggcauggga

SEQ ID NO: 3933284 - RNA, 15 nt, Human adenovirus E
gcguggaggagcuca

SEQ ID NO: 3933285 - RNA, 15 nt, Human adenovirus E
gcuacaacagcacca

SEQ ID NO: 3933286 - RNA, 15 nt, Human adenovirus E
gcuaccuccagugcc

SEQ ID NO: 3933287 - RNA, 15 nt, Human adenovirus E
gcuaccugcugcgcc

SEQ ID NO: 3933288 - RNA, 20 nt, Human adenovirus E
gcuauguuggagcaacauuu

SEQ ID NO: 3933289 - RNA, 12 nt, Human adenovirus E
gcucaacagcug

SEQ ID NO: 3933290 - RNA, 11 nt, Human adenovirus E
gcucagccgcg

SEQ ID NO: 3933291 - RNA, 17 nt, Human adenovirus E
gcuccauugcagggccu

SEQ ID NO: 3933292 - RNA, 13 nt, Human adenovirus E
gcucccucgguga

SEQ ID NO: 3933293 - RNA, 15 nt, Human adenovirus E
gcucccuggccugca

SEQ ID NO: 3933294 - RNA, 17 nt, Human adenovirus E
gcucccuggccugcaac

SEQ ID NO: 3933295 - RNA, 21 nt, Human adenovirus E
gcuccgcgacacggcacgcgg

SEQ ID NO: 3933296 - RNA, 18 nt, Human adenovirus E
gcuccggaauccugcccg

SEQ ID NO: 3933297 - RNA, 20 nt, Human adenovirus E
gcuccggaauccugcccgcc

SEQ ID NO: 3933298 - RNA, 16 nt, Human adenovirus E
gcucgaccacacagua

SEQ ID NO: 3933299 - RNA, 21 nt, Human adenovirus E
gcucgcgguggggcggccagc

SEQ ID NO: 3933300 - RNA, 14 nt, Human adenovirus E
gcucggggcccgga

SEQ ID NO: 3933301 - RNA, 20 nt, Human adenovirus E
gcucguagggacugaggggc

SEQ ID NO: 3933302 - RNA, 19 nt, Human adenovirus E
gcucucacagaucacggga

SEQ ID NO: 3933303 - RNA, 16 nt, Human adenovirus E
gcucugaaccugcccc

SEQ ID NO: 3933304 - RNA, 20 nt, Human adenovirus E
gcucugcaagcuccugcaga

SEQ ID NO: 3933305 - RNA, 23 nt, Human adenovirus E
gcucugcaaggagaaggaggaga

SEQ ID NO: 3933306 - RNA, 18 nt, Human adenovirus E
gcugacguccugcaggac

SEQ ID NO: 3933307 - RNA, 19 nt, Human adenovirus E
gcugacguccugcaggacc

SEQ ID NO: 3933308 - RNA, 14 nt, Human adenovirus E
gcugcacaccaccc

SEQ ID NO: 3933309 - RNA, 18 nt, Human adenovirus E
gcugcccgaggagcaccc

SEQ ID NO: 3933310 - RNA, 19 nt, Human adenovirus E
gcugcgcaacggccugccc

SEQ ID NO: 3933311 - RNA, 14 nt, Human adenovirus E
gcugcggcgcggcc

SEQ ID NO: 3933312 - RNA, 15 nt, Human adenovirus E
gcugcugcugcuggu

SEQ ID NO: 3933313 - RNA, 22 nt, Human adenovirus E
gcuggcgggcggcgccacccug

SEQ ID NO: 3933314 - RNA, 14 nt, Human adenovirus E
gcuggcggugcuca

SEQ ID NO: 3933315 - RNA, 15 nt, Human adenovirus E
gcuggcggugcucaa

SEQ ID NO: 3933316 - RNA, 23 nt, Human adenovirus E
gcuggggcgacgggggcggugcc

SEQ ID NO: 3933317 - RNA, 19 nt, Human adenovirus E
gcugguggcgguguugcuu

SEQ ID NO: 3933318 - RNA, 13 nt, Human adenovirus E
gcuguaguggugu

SEQ ID NO: 3933319 - RNA, 19 nt, Human adenovirus E
gcuguccacgagcgccagc

SEQ ID NO: 3933320 - RNA, 17 nt, Human adenovirus E
gcuguccaggguccuga

SEQ ID NO: 3933321 - RNA, 21 nt, Human adenovirus E
gcuguucguacuuaguggugc

SEQ ID NO: 3933322 - RNA, 17 nt, Human adenovirus E
gcuuaaaaccuauggca

SEQ ID NO: 3933323 - RNA, 21 nt, Human adenovirus E
gcuuacggcaagcgcagccgu

SEQ ID NO: 3933324 - RNA, 20 nt, Human adenovirus E
gcuucacgcucgccagcacc

SEQ ID NO: 3933325 - RNA, 21 nt, Human adenovirus E
gcuuccgcgucaguugcaggg

SEQ ID NO: 3933326 - RNA, 18 nt, Human adenovirus E
gcuucuucaacgagcagg

SEQ ID NO: 3933327 - RNA, 14 nt, Human adenovirus E
gcuugcccucggcc

SEQ ID NO: 3933328 - RNA, 21 nt, Human adenovirus E
gcuugcccucggccucggugc

SEQ ID NO: 3933329 - RNA, 22 nt, Human adenovirus E
ggaagacgaggaggaggcagag

SEQ ID NO: 3933330 - RNA, 23 nt, Human adenovirus E
ggaaguggccagaucguccaggg

SEQ ID NO: 3933331 - RNA, 16 nt, Human adenovirus E
ggaauggcuguugaug

SEQ ID NO: 3933332 - RNA, 16 nt, Human adenovirus E
ggacaaaaaggaagaa

SEQ ID NO: 3933333 - RNA, 18 nt, Human adenovirus E
ggacagaggagggacuug

SEQ ID NO: 3933334 - RNA, 15 nt, Human adenovirus E
ggacagccugcaaga

SEQ ID NO: 3933335 - RNA, 14 nt, Human adenovirus E
ggacagcggcagca

SEQ ID NO: 3933336 - RNA, 20 nt, Human adenovirus E
ggaccugcacuggcagccca

SEQ ID NO: 3933337 - RNA, 22 nt, Human adenovirus E
ggaccugcacuggcagcccagc

SEQ ID NO: 3933338 - RNA, 23 nt, Human adenovirus E
ggacgacccgggcaaccuggaag

SEQ ID NO: 3933339 - RNA, 17 nt, Human adenovirus E
ggacgauuggacccagg

SEQ ID NO: 3933340 - RNA, 22 nt, Human adenovirus E
ggacgccgaggcucucuucaac

SEQ ID NO: 3933341 - RNA, 22 nt, Human adenovirus E
gguucugggugaucuuggcccg

SEQ ID NO: 3933342 - RNA, 16 nt, Human adenovirus E
gguugcaaucgcagug

SEQ ID NO: 3933343 - RNA, 19 nt, Human adenovirus E
guacaugggcaucuugcac

SEQ ID NO: 3933344 - RNA, 18 nt, Human adenovirus E
guaccaguccgggccgga

SEQ ID NO: 3933345 - RNA, 20 nt, Human adenovirus E
guaccccaccaugcagcuga

SEQ ID NO: 3933346 - RNA, 13 nt, Human adenovirus E
guaccucaccugg

SEQ ID NO: 3933347 - RNA, 14 nt, Human adenovirus E
guaccucaccuggc

SEQ ID NO: 3933348 - RNA, 15 nt, Human adenovirus E
guacggaggcgcucg

SEQ ID NO: 3933349 - RNA, 19 nt, Human adenovirus E
guacucuucgagggggaac

SEQ ID NO: 3933350 - RNA, 16 nt, Human adenovirus E
guagacguagaggggc

SEQ ID NO: 3933351 - RNA, 18 nt, Human adenovirus E
guagagcuugggggcgag

SEQ ID NO: 3933352 - RNA, 23 nt, Human adenovirus E
guaggcguccgcgccgcaguggg

SEQ ID NO: 3933353 - RNA, 13 nt, Human adenovirus E
guaggugagcucg

SEQ ID NO: 3933354 - RNA, 15 nt, Human adenovirus E
guaggugggguagca

SEQ ID NO: 3933355 - RNA, 19 nt, Human adenovirus E
guagucaaauacuggccac

SEQ ID NO: 3933356 - RNA, 13 nt, Human adenovirus E
guagucuggagaa

SEQ ID NO: 3933357 - RNA, 14 nt, Human adenovirus E
gucaaauacuggcc

SEQ ID NO: 3933358 - RNA, 16 nt, Human adenovirus E
gucaagcugcugcuca

SEQ ID NO: 3933359 - RNA, 17 nt, Human adenovirus E
gucaagcugcugcucag

SEQ ID NO: 3933360 - RNA, 18 nt, Human adenovirus E
gucaaugccaccucagcu

SEQ ID NO: 3933361 - RNA, 18 nt, Human adenovirus E
gucacggcguacgagcag

SEQ ID NO: 3933362 - RNA, 19 nt, Human adenovirus E
gucagcgacgagcagcugg

SEQ ID NO: 3933363 - RNA, 20 nt, Human adenovirus E
gucagcgacgagcagcuggc

SEQ ID NO: 3933364 - RNA, 16 nt, Human adenovirus E
gucaggcagaggagga

SEQ ID NO: 3933365 - RNA, 17 nt, Human adenovirus E
gucaggcagaggaggag

SEQ ID NO: 3933366 - RNA, 12 nt, Human adenovirus E
gucaggcugggc

SEQ ID NO: 3933367 - RNA, 13 nt, Human adenovirus E
gucaggcugggcu

SEQ ID NO: 3933368 - RNA, 19 nt, Human adenovirus E
gucauggaccaggugcuca

SEQ ID NO: 3933369 - RNA, 17 nt, Human adenovirus E
guccaccuuuuccaggg

SEQ ID NO: 3933370 - RNA, 20 nt, Human adenovirus E
guccacugucgagagccaca

SEQ ID NO: 3933371 - RNA, 20 nt, Human adenovirus E
guccauaguucaacacgcuc

SEQ ID NO: 3933372 - RNA, 22 nt, Human adenovirus E
guccccggugcugacggcuccc

SEQ ID NO: 3933373 - RNA, 15 nt, Human adenovirus E
gucccggcgcccgcc

SEQ ID NO: 3933374 - RNA, 15 nt, Human adenovirus E
gucccgucgaccccc

SEQ ID NO: 3933375 - RNA, 18 nt, Human adenovirus E
guccgcgucagggugguc

SEQ ID NO: 3933376 - RNA, 22 nt, Human adenovirus E
guccucccggaggaggggggcc

SEQ ID NO: 3933377 - RNA, 15 nt, Human adenovirus E
guccucgcagccccg

SEQ ID NO: 3933378 - RNA, 15 nt, Human adenovirus E
gucgccgcaccgccg

SEQ ID NO: 3933379 - RNA, 13 nt, Human adenovirus E
gucggggaaggag

SEQ ID NO: 3933380 - RNA, 13 nt, Human adenovirus E
gucgggggcagga

SEQ ID NO: 3933381 - RNA, 20 nt, Human adenovirus E
gucgggggcaggagcaggaa

SEQ ID NO: 3933382 - RNA, 12 nt, Human adenovirus E
gucuaccucgac

SEQ ID NO: 3933383 - RNA, 15 nt, Human adenovirus E
gucucaaagcuccgc

SEQ ID NO: 3933384 - RNA, 23 nt, Human adenovirus E
gucuccgcggccggcgcgcucca

SEQ ID NO: 3933385 - RNA, 16 nt, Human adenovirus E
gucucuucagauggau

SEQ ID NO: 3933386 - RNA, 12 nt, Human adenovirus E
gucuggaggagc

SEQ ID NO: 3933387 - RNA, 18 nt, Human adenovirus E
gucugggcagcgacgaga

SEQ ID NO: 3933388 - RNA, 17 nt, Human adenovirus E
gugaacauucugcagag

SEQ ID NO: 3933389 - RNA, 17 nt, Human adenovirus E
ggccguggcccagcgcg

SEQ ID NO: 3933390 - RNA, 22 nt, Human adenovirus E
ggccucuguuaaauuuuugcuu

SEQ ID NO: 3933391 - RNA, 16 nt, Human adenovirus E
ggccugaugcaccugu

SEQ ID NO: 3933392 - RNA, 14 nt, Human adenovirus E
ggccugggcggccu

SEQ ID NO: 3933393 - RNA, 12 nt, Human adenovirus E
ggccuuggaaga

SEQ ID NO: 3933394 - RNA, 18 nt, Human adenovirus E
ggccuuguaggcgcagca

SEQ ID NO: 3933395 - RNA, 17 nt, Human adenovirus E
ggcgacuaccuccaccu

SEQ ID NO: 3933396 - RNA, 15 nt, Human adenovirus E
ggcgagguugagcuc

SEQ ID NO: 3933397 - RNA, 12 nt, Human adenovirus E
ggcgauccuggc

SEQ ID NO: 3933398 - RNA, 15 nt, Human adenovirus E
ggcgauccuggccca

SEQ ID NO: 3933399 - RNA, 12 nt, Human adenovirus E
ggcgaugcagcc

SEQ ID NO: 3933400 - RNA, 17 nt, Human adenovirus E
ggcgaugcagcccccgc

SEQ ID NO: 3933401 - RNA, 14 nt, Human adenovirus E
ggcgauggagcgca

SEQ ID NO: 3933402 - RNA, 20 nt, Human adenovirus E
ggcgcacguggacgagcaga

SEQ ID NO: 3933403 - RNA, 21 nt, Human adenovirus E
ggcgcagggcaugguguugca

SEQ ID NO: 3933404 - RNA, 23 nt, Human adenovirus E
ggcgcaucgcccggcggcaccgg

SEQ ID NO: 3933405 - RNA, 18 nt, Human adenovirus E
ggcgccagcgccggcagg

SEQ ID NO: 3933406 - RNA, 20 nt, Human adenovirus E
ggcgcgagcgggucggagag

SEQ ID NO: 3933407 - RNA, 16 nt, Human adenovirus E
ggcgcgcaggccggag

SEQ ID NO: 3933408 - RNA, 18 nt, Human adenovirus E
ggcgcugcagagccagcc

SEQ ID NO: 3933409 - RNA, 19 nt, Human adenovirus E
ggcgcuguccggccgcgag

SEQ ID NO: 3933410 - RNA, 14 nt, Human adenovirus E
ggcggacgagcuga

SEQ ID NO: 3933411 - RNA, 15 nt, Human adenovirus E
ggcggacgcgcgccg

SEQ ID NO: 3933412 - RNA, 18 nt, Human adenovirus E
ggcggauggcuggcagag

SEQ ID NO: 3933413 - RNA, 11 nt, Human adenovirus E
ggcggcagcag

SEQ ID NO: 3933414 - RNA, 22 nt, Human adenovirus E
ggcggcgcaucgcccggcggca

SEQ ID NO: 3933415 - RNA, 17 nt, Human adenovirus E
ggcggcgcgugcagugg

SEQ ID NO: 3933416 - RNA, 14 nt, Human adenovirus E
ggcggcggcagcgg

SEQ ID NO: 3933417 - RNA, 14 nt, Human adenovirus E
ggcggcucggggcc

SEQ ID NO: 3933418 - RNA, 12 nt, Human adenovirus E
ggcggcuggggc

SEQ ID NO: 3933419 - RNA, 15 nt, Human adenovirus E
ggcgggagcugcggc

SEQ ID NO: 3933420 - RNA, 20 nt, Human adenovirus E
ggcgggagcugcggcgcggc

SEQ ID NO: 3933421 - RNA, 13 nt, Human adenovirus E
ggcgggcggcgcc

SEQ ID NO: 3933422 - RNA, 15 nt, Human adenovirus E
ggcgguggggcggca

SEQ ID NO: 3933423 - RNA, 13 nt, Human adenovirus E
ggcgugcagaccg

SEQ ID NO: 3933424 - RNA, 21 nt, Human adenovirus E
ggcgugccccagggcauggga

SEQ ID NO: 3933425 - RNA, 22 nt, Human adenovirus E
  misc_feature (10)..(10): n is a, c, g or u
ggcucauuanuccagcagaggc

SEQ ID NO: 3933426 - RNA, 20 nt, Human adenovirus E
ggcucucggccauccuggag

SEQ ID NO: 3933427 - RNA, 16 nt, Human adenovirus E
ggcucugaaccugccc

SEQ ID NO: 3933428 - RNA, 19 nt, Human adenovirus E
ggcugaaaccgaaaguaag

SEQ ID NO: 3933429 - RNA, 14 nt, Human adenovirus E
ggcugacgcugcgc

SEQ ID NO: 3933430 - RNA, 19 nt, Human adenovirus E
ggcugacguccugcaggac

SEQ ID NO: 3933431 - RNA, 19 nt, Human adenovirus E
ggcugcaaacuuccuccac

SEQ ID NO: 3933432 - RNA, 13 nt, Human adenovirus E
ggcuggcagagcc

SEQ ID NO: 3933433 - RNA, 15 nt, Human adenovirus E
ggcuggcgcgccugg

SEQ ID NO: 3933434 - RNA, 15 nt, Human adenovirus E
ggcuggcggugcuca

SEQ ID NO: 3933435 - RNA, 12 nt, Human adenovirus E
ggcuggggcgac

SEQ ID NO: 3933436 - RNA, 23 nt, Human adenovirus E
gggaagacguggucagcucgucg

SEQ ID NO: 3933437 - RNA, 22 nt, Human adenovirus E
gggaagaucacccuagugagcu

SEQ ID NO: 3933438 - RNA, 22 nt, Human adenovirus E
gggacagcacucaggcagagga

SEQ ID NO: 3933439 - RNA, 20 nt, Human adenovirus E
gggaccccgugaccgagcug

SEQ ID NO: 3933440 - RNA, 15 nt, Human adenovirus E
gggagaugagcuggg

SEQ ID NO: 3933441 - RNA, 17 nt, Human adenovirus E
gggaggcuuccugcccg

SEQ ID NO: 3933442 - RNA, 18 nt, Human adenovirus E
  misc_feature (6)..(6): n is a, c, g or u
cgggcnugggcgugcaga

SEQ ID NO: 3933443 - RNA, 18 nt, Human adenovirus E
cgggcuaccgcggcacgc

SEQ ID NO: 3933444 - RNA, 23 nt, Human adenovirus E
cggggaucagcaguuugggcagc

SEQ ID NO: 3933445 - RNA, 19 nt, Human adenovirus E
cgggggagaugagcugggc

SEQ ID NO: 3933446 - RNA, 18 nt, Human adenovirus E
cgggggcaggagcaggaa

SEQ ID NO: 3933447 - RNA, 14 nt, Human adenovirus E
cgggggucccggcc

SEQ ID NO: 3933448 - RNA, 11 nt, Human adenovirus E
cgggguugggc

SEQ ID NO: 3933449 - RNA, 17 nt, Human adenovirus E
cgggugauccuccacca

SEQ ID NO: 3933450 - RNA, 19 nt, Human adenovirus E
cgggugcuucacgcucgcc

SEQ ID NO: 3933451 - RNA, 14 nt, Human adenovirus E
cggguuccuguggg

SEQ ID NO: 3933452 - RNA, 14 nt, Human adenovirus E
cggucaccuuccgc

SEQ ID NO: 3933453 - RNA, 14 nt, Human adenovirus E
cgguccuuccaggg

SEQ ID NO: 3933454 - RNA, 13 nt, Human adenovirus E
cggucgcagaaga

SEQ ID NO: 3933455 - RNA, 24 nt, Human adenovirus E
cggucgcccgucucucagccaauc

SEQ ID NO: 3933456 - RNA, 22 nt, Human adenovirus E
cggucuucgcggugcccgaggc

SEQ ID NO: 3933457 - RNA, 18 nt, Human adenovirus E
cggugcaggccucucagc

SEQ ID NO: 3933458 - RNA, 21 nt, Human adenovirus E
cggugcccgaggcccuggcca

SEQ ID NO: 3933459 - RNA, 17 nt, Human adenovirus E
cgguggcacgacaggca

SEQ ID NO: 3933460 - RNA, 22 nt, Human adenovirus E
cggugugccgcgguccuccucg

SEQ ID NO: 3933461 - RNA, 14 nt, Human adenovirus E
cgguguugcuuucg

SEQ ID NO: 3933462 - RNA, 19 nt, Human adenovirus E
cguaagcagugcucaggug

SEQ ID NO: 3933463 - RNA, 13 nt, Human adenovirus E
cguaccagauccu

SEQ ID NO: 3933464 - RNA, 16 nt, Human adenovirus E
cguaggugagcucguc

SEQ ID NO: 3933465 - RNA, 20 nt, Human adenovirus E
cguaugcgcaggagcacagg

SEQ ID NO: 3933466 - RNA, 15 nt, Human adenovirus E
cgucaagcugcugcu

SEQ ID NO: 3933467 - RNA, 18 nt, Human adenovirus E
cgucaaggaugcgcugcu

SEQ ID NO: 3933468 - RNA, 14 nt, Human adenovirus E
cgucaccugcggcg

SEQ ID NO: 3933469 - RNA, 14 nt, Human adenovirus E
cgucaucaaaacac

SEQ ID NO: 3933470 - RNA, 13 nt, Human adenovirus E
cgucccuggcucc

SEQ ID NO: 3933471 - RNA, 22 nt, Human adenovirus E
cguccggcauuaacuccucgga

SEQ ID NO: 3933472 - RNA, 18 nt, Human adenovirus E
cguccguguggcagcccg

SEQ ID NO: 3933473 - RNA, 15 nt, Human adenovirus E
cguccucggcgcugu

SEQ ID NO: 3933474 - RNA, 19 nt, Human adenovirus E
cguccucucgagccgcacc

SEQ ID NO: 3933475 - RNA, 21 nt, Human adenovirus E
cgucuggugcggcgggcgcag

SEQ ID NO: 3933476 - RNA, 17 nt, Human adenovirus E
cgugaaccugagccagg

SEQ ID NO: 3933477 - RNA, 14 nt, Human adenovirus E
cgugcacgcagcag

SEQ ID NO: 3933478 - RNA, 13 nt, Human adenovirus E
cgugcagcagaag

SEQ ID NO: 3933479 - RNA, 15 nt, Human adenovirus E
cgugccccagggcau

SEQ ID NO: 3933480 - RNA, 17 nt, Human adenovirus E
cgugccccggggccagg

SEQ ID NO: 3933481 - RNA, 18 nt, Human adenovirus E
cgugccccggggccagga

SEQ ID NO: 3933482 - RNA, 13 nt, Human adenovirus E
cgugcgcuccugg

SEQ ID NO: 3933483 - RNA, 17 nt, Human adenovirus E
cgugcgcuccuggacgc

SEQ ID NO: 3933484 - RNA, 19 nt, Human adenovirus E
cgugcugcacaccacccug

SEQ ID NO: 3933485 - RNA, 15 nt, Human adenovirus E
cguggaacagcacca

SEQ ID NO: 3933486 - RNA, 20 nt, Human adenovirus E
cguggaggauuuggaggaag

SEQ ID NO: 3933487 - RNA, 14 nt, Human adenovirus E
cgugggcggcggcc

SEQ ID NO: 3933488 - RNA, 19 nt, Human adenovirus E
cgugggcggcggccugggc

SEQ ID NO: 3933489 - RNA, 14 nt, Human adenovirus E
cgugguccugguga

SEQ ID NO: 3933490 - RNA, 18 nt, Human adenovirus E
cguggucuucuccaucgc

SEQ ID NO: 3933491 - RNA, 19 nt, Human adenovirus E
cguguucuccccccgaccg

SEQ ID NO: 3933492 - RNA, 15 nt, Human adenovirus E
cguuacgugcagcag

SEQ ID NO: 3933493 - RNA, 16 nt, Human adenovirus E
cguuacgugcagcaga

SEQ ID NO: 3933494 - RNA, 21 nt, Human adenovirus E
cguuccugcucucacagauca

SEQ ID NO: 3933495 - RNA, 21 nt, Human adenovirus E
cguugauguuguggcccacga

SEQ ID NO: 3933496 - RNA, 23 nt, Human adenovirus E
cguugauguuguggcccacgaug

SEQ ID NO: 3933497 - RNA, 12 nt, Human adenovirus E
cuaaagauggaa

SEQ ID NO: 3933498 - RNA, 14 nt, Human adenovirus E
cuaacucuuauacc

SEQ ID NO: 3933499 - RNA, 20 nt, Human adenovirus E
cuacaagaccccguacgugc

SEQ ID NO: 3933500 - RNA, 17 nt, Human adenovirus E
cuacaaugcucagucuc

SEQ ID NO: 3933501 - RNA, 19 nt, Human adenovirus E
cuacacgggcgaguacgac

SEQ ID NO: 3933502 - RNA, 23 nt, Human adenovirus E
cuacacugacguaaaggccaaag

SEQ ID NO: 3933503 - RNA, 15 nt, Human adenovirus E
cuacagaaagcacag

SEQ ID NO: 3933504 - RNA, 16 nt, Human adenovirus E
cuacagaaagcacaga

SEQ ID NO: 3933505 - RNA, 15 nt, Human adenovirus E
cuacagccuaggcca

SEQ ID NO: 3933506 - RNA, 19 nt, Human adenovirus E
cuaccgaggucaggggcga

SEQ ID NO: 3933507 - RNA, 13 nt, Human adenovirus E
cuaccgucaccuc

SEQ ID NO: 3933508 - RNA, 13 nt, Human adenovirus E
cuaccuccagugc

SEQ ID NO: 3933509 - RNA, 20 nt, Human adenovirus E
cuaccucuaccucugccaca

SEQ ID NO: 3933510 - RNA, 15 nt, Human adenovirus E
cuaccucugccacac

SEQ ID NO: 3933511 - RNA, 23 nt, Human adenovirus E
cuacgcgcugcauccuuccauca

SEQ ID NO: 3933512 - RNA, 16 nt, Human adenovirus E
cuacugaacucugugg

SEQ ID NO: 3933513 - RNA, 16 nt, Human adenovirus E
cuacuggucgcugccc

SEQ ID NO: 3933514 - RNA, 18 nt, Human adenovirus E
cuacuuccaagaagaggc

SEQ ID NO: 3933515 - RNA, 18 nt, Human adenovirus E
cuacuugcaucgggcggc

SEQ ID NO: 3933516 - RNA, 22 nt, Human adenovirus E
cuaucucuuccucuucuugguc

SEQ ID NO: 3933517 - RNA, 22 nt, Human adenovirus E
cuauucuuaucugccuccucca

SEQ ID NO: 3933518 - RNA, 17 nt, Human adenovirus E
cucaacccaccccaccc

SEQ ID NO: 3933519 - RNA, 22 nt, Human adenovirus E
cucacagaucacgggacccugc

SEQ ID NO: 3933520 - RNA, 18 nt, Human adenovirus E
cucacagcucaacagcug

SEQ ID NO: 3933521 - RNA, 13 nt, Human adenovirus E
cucaccaaggcca

SEQ ID NO: 3933522 - RNA, 15 nt, Human adenovirus E
cucaccgccacgccc

SEQ ID NO: 3933523 - RNA, 16 nt, Human adenovirus E
cucacuaccaauaaca

SEQ ID NO: 3933524 - RNA, 19 nt, Human adenovirus E
cucagcaucagucgucugg

SEQ ID NO: 3933525 - RNA, 17 nt, Human adenovirus E
cucaggcagaggaggac

SEQ ID NO: 3933526 - RNA, 14 nt, Human adenovirus E
cucgcuguccuggc

SEQ ID NO: 3933527 - RNA, 14 nt, Human adenovirus E
cucgggacccugcc

SEQ ID NO: 3933528 - RNA, 15 nt, Human adenovirus E
cucggucuccucaca

SEQ ID NO: 3933529 - RNA, 16 nt, Human adenovirus E
cucggugauccgcacc

SEQ ID NO: 3933530 - RNA, 18 nt, Human adenovirus E
cucguacccguggaucau

SEQ ID NO: 3933531 - RNA, 13 nt, Human adenovirus E
cucuagcaccgcc

SEQ ID NO: 3933532 - RNA, 23 nt, Human adenovirus E
cucuaugccaucuuccagcagag

SEQ ID NO: 3933533 - RNA, 14 nt, Human adenovirus E
cucuauguuuaauu

SEQ ID NO: 3933534 - RNA, 18 nt, Human adenovirus E
cucucaucaaguuucaau

SEQ ID NO: 3933535 - RNA, 21 nt, Human adenovirus E
cucuccaguucguggaggagu

SEQ ID NO: 3933536 - RNA, 13 nt, Human adenovirus E
cucugaaccugcc

SEQ ID NO: 3933537 - RNA, 13 nt, Human adenovirus E
cucugacccugcc

SEQ ID NO: 3933538 - RNA, 16 nt, Human adenovirus E
cucugacgcuccuggu

SEQ ID NO: 3933539 - RNA, 16 nt, Human adenovirus E
cucugccacaccuggc

SEQ ID NO: 3933540 - RNA, 17 nt, Human adenovirus E
cucuugcaggacagcga

SEQ ID NO: 3933541 - RNA, 13 nt, Human adenovirus E
cugaaacucaccc

SEQ ID NO: 3933542 - RNA, 16 nt, Human adenovirus E
cugaaagagcucugca

SEQ ID NO: 3933543 - RNA, 18 nt, Human adenovirus E
cugaaagagcucugcaag

SEQ ID NO: 3933544 - RNA, 20 nt, Human adenovirus E
cugaaccugacacaccacca

SEQ ID NO: 3933545 - RNA, 22 nt, Human adenovirus E
cugaagcccacggccgccagcu

SEQ ID NO: 3933546 - RNA, 15 nt, Human adenovirus E
cugacacaccaccac

SEQ ID NO: 3933547 - RNA, 16 nt, Human adenovirus E
cugaccaaccuggucu

SEQ ID NO: 3933548 - RNA, 12 nt, Human adenovirus E
cugacccacugg

SEQ ID NO: 3933549 - RNA, 14 nt, Human adenovirus E
cugacccacuggcc

SEQ ID NO: 3933550 - RNA, 22 nt, Human adenovirus E
cugaccggggccgggaccgagg

SEQ ID NO: 3933551 - RNA, 16 nt, Human adenovirus E
cugacggcgcagcugu

SEQ ID NO: 3933552 - RNA, 15 nt, Human adenovirus E
cugacgucgcccagc

SEQ ID NO: 3933553 - RNA, 22 nt, Human adenovirus E
cugagcuccucccucagcaaua

SEQ ID NO: 3933554 - RNA, 16 nt, Human adenovirus E
cugcacaccacccugc

SEQ ID NO: 3933555 - RNA, 23 nt, Human adenovirus E
cugcagagcaucguggugcagga

SEQ ID NO: 3933556 - RNA, 13 nt, Human adenovirus E
cugcagcgggccc

SEQ ID NO: 3933557 - RNA, 20 nt, Human adenovirus E
cugcagcgggcccugaccgg

SEQ ID NO: 3933558 - RNA, 22 nt, Human adenovirus E
cugcagcgggcccugaccgggg

SEQ ID NO: 3933559 - RNA, 22 nt, Human adenovirus E
cugcaggaagcggcccaucaug

SEQ ID NO: 3933560 - RNA, 19 nt, Human adenovirus E
cugcaggaccacaugcuug

SEQ ID NO: 3933561 - RNA, 23 nt, Human adenovirus E
cugcaggccccggcgggcugcaa

SEQ ID NO: 3933562 - RNA, 19 nt, Human adenovirus E
cugcccccgccccagcagc

SEQ ID NO: 3933563 - RNA, 22 nt, Human adenovirus E
cugcccgacaugaugcaagacc

SEQ ID NO: 3933564 - RNA, 23 nt, Human adenovirus E
cugcccgacuuuaugagccaaag

SEQ ID NO: 3933565 - RNA, 21 nt, Human adenovirus E
cugcccguucucgcucgccac

SEQ ID NO: 3933566 - RNA, 15 nt, Human adenovirus E
cugccgcccuggugc

SEQ ID NO: 3933567 - RNA, 16 nt, Human adenovirus E
cugccguagucuggag

SEQ ID NO: 3933568 - RNA, 21 nt, Human adenovirus E
cugccguagucuggagaagaa

SEQ ID NO: 3933569 - RNA, 18 nt, Human adenovirus E
cugccuuggcaguacagu

SEQ ID NO: 3933570 - RNA, 15 nt, Human adenovirus E
cugcgagcccaaccc

SEQ ID NO: 3933571 - RNA, 20 nt, Human adenovirus E
cugcgccaccacccccagua

SEQ ID NO: 3933572 - RNA, 21 nt, Human adenovirus E
cugcgcccccguaucgggcgc

SEQ ID NO: 3933573 - RNA, 23 nt, Human adenovirus E
cugcuaccugcugcgccuggcca

SEQ ID NO: 3933574 - RNA, 17 nt, Human adenovirus E
cugcucccagagcugga

SEQ ID NO: 3933575 - RNA, 17 nt, Human adenovirus E
cugcucgaucuccuccu

SEQ ID NO: 3933576 - RNA, 21 nt, Human adenovirus E
cugcugaauaucaccgagccc

SEQ ID NO: 3933577 - RNA, 16 nt, Human adenovirus E
cugcugcgccuggcca

SEQ ID NO: 3933578 - RNA, 21 nt, Human adenovirus E
cugcugggccuuggcucccuc

SEQ ID NO: 3933579 - RNA, 15 nt, Human adenovirus E
cugcuucgcucggga

SEQ ID NO: 3933580 - RNA, 14 nt, Human adenovirus E
cuggagaugaugcu

SEQ ID NO: 3933581 - RNA, 16 nt, Human adenovirus E
cuggagcgcguggccc

SEQ ID NO: 3933582 - RNA, 23 nt, Human adenovirus E
cuggaggccaucgugcagaaccc

SEQ ID NO: 3933583 - RNA, 14 nt, Human adenovirus E
cuggaucuccugcc

SEQ ID NO: 3933584 - RNA, 18 nt, Human adenovirus E
cuggaugccaucggcucc

SEQ ID NO: 3933585 - RNA, 21 nt, Human adenovirus E
cuggcagcccagccgccgggc

SEQ ID NO: 3933586 - RNA, 19 nt, Human adenovirus E
cuggcccaauugcaagcca

SEQ ID NO: 3933587 - RNA, 15 nt, Human adenovirus E
cuggccuaccacucg

SEQ ID NO: 3933588 - RNA, 15 nt, Human adenovirus E
cuggcgccuacggag
